United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 41

SEQ ID NO: 1715717 - DNA, 23 bp, Homo sapiens
cttgtttgagagagaatgaggaa

SEQ ID NO: 1715718 - DNA, 16 bp, Homo sapiens
cttgtttgatttcaac

SEQ ID NO: 1715719 - DNA, 20 bp, Homo sapiens
cttgtttgattttagctgca

SEQ ID NO: 1715720 - DNA, 23 bp, Homo sapiens
cttgtttgattttagctgcagaa

SEQ ID NO: 1715721 - DNA, 13 bp, Homo sapiens
cttgtttgcactg

SEQ ID NO: 1715722 - DNA, 20 bp, Homo sapiens
gctacagttttgtgaatctt

SEQ ID NO: 1715723 - DNA, 14 bp, Homo sapiens
gctacatcagactc

SEQ ID NO: 1715724 - DNA, 15 bp, Homo sapiens
gctacatcagactct

SEQ ID NO: 1715725 - DNA, 17 bp, Homo sapiens
gctacatcagccttcaa

SEQ ID NO: 1715726 - DNA, 20 bp, Homo sapiens
gctacattataatgtacaga

SEQ ID NO: 1715727 - DNA, 13 bp, Homo sapiens
gctacattcctca

SEQ ID NO: 1715728 - DNA, 17 bp, Homo sapiens
gctacattcctcagctg

SEQ ID NO: 1715729 - DNA, 18 bp, Homo sapiens
gctacattcctcagctgc

SEQ ID NO: 1715730 - DNA, 15 bp, Homo sapiens
gctaccagtatttag

SEQ ID NO: 1715731 - DNA, 19 bp, Homo sapiens
gctaccagtatttagaagc

SEQ ID NO: 1715732 - DNA, 15 bp, Homo sapiens
gctaccatctgcatg

SEQ ID NO: 1715733 - DNA, 17 bp, Homo sapiens
gctacccacttctaaat

SEQ ID NO: 1715734 - DNA, 19 bp, Homo sapiens
gctaccccattctctagac

SEQ ID NO: 1715735 - DNA, 14 bp, Homo sapiens
gctaccctcagcct

SEQ ID NO: 1715736 - DNA, 21 bp, Homo sapiens
gctaccctcagcctccaatgc

SEQ ID NO: 1715737 - DNA, 18 bp, Homo sapiens
gctaccctttttctccag

SEQ ID NO: 1715738 - DNA, 13 bp, Homo sapiens
gctacctccctcc

SEQ ID NO: 1715739 - DNA, 15 bp, Homo sapiens
gctacctctgagaag

SEQ ID NO: 1715740 - DNA, 16 bp, Homo sapiens
gctacctttcaaagct

SEQ ID NO: 1715741 - DNA, 17 bp, Homo sapiens
gctacctttcaaagctt

SEQ ID NO: 1715742 - DNA, 21 bp, Homo sapiens
gctacgattccactgaaactc

SEQ ID NO: 1715743 - DNA, 20 bp, Homo sapiens
gctacgttttggttctatgc

SEQ ID NO: 1715744 - DNA, 16 bp, Homo sapiens
gctactcaagaggctg

SEQ ID NO: 1715745 - DNA, 17 bp, Homo sapiens
gctactcagaagcctga

SEQ ID NO: 1715746 - DNA, 11 bp, Homo sapiens
gctactcagca

SEQ ID NO: 1715747 - DNA, 12 bp, Homo sapiens
gctactcagcag

SEQ ID NO: 1715748 - DNA, 17 bp, Homo sapiens
gctactcagcagccctc

SEQ ID NO: 1715749 - DNA, 21 bp, Homo sapiens
attgctgccactttttaacta

SEQ ID NO: 1715750 - DNA, 17 bp, Homo sapiens
attgctggatgcatttt

SEQ ID NO: 1715751 - DNA, 13 bp, Homo sapiens
attgctggctgcc

SEQ ID NO: 1715752 - DNA, 14 bp, Homo sapiens
attgctggctgccc

SEQ ID NO: 1715753 - DNA, 21 bp, Homo sapiens
attgctggtagagacccccag

SEQ ID NO: 1715754 - DNA, 22 bp, Homo sapiens
attgctggtagagacccccagg

SEQ ID NO: 1715755 - DNA, 14 bp, Homo sapiens
attgctgtgtctcc

SEQ ID NO: 1715756 - DNA, 23 bp, Homo sapiens
attgctgtgtcttcattttcatt

SEQ ID NO: 1715757 - DNA, 12 bp, Homo sapiens
attgctgtgtga

SEQ ID NO: 1715758 - DNA, 20 bp, Homo sapiens
attgctgtttggtttgttta

SEQ ID NO: 1715759 - DNA, 23 bp, Homo sapiens
attgctgtttggtttgtttataa

SEQ ID NO: 1715760 - DNA, 14 bp, Homo sapiens
attgcttacatttt

SEQ ID NO: 1715761 - DNA, 20 bp, Homo sapiens
attgcttacatttttacaat

SEQ ID NO: 1715762 - DNA, 16 bp, Homo sapiens
attgcttattttatta

SEQ ID NO: 1715763 - DNA, 19 bp, Homo sapiens
attgcttattttattatga

SEQ ID NO: 1715764 - DNA, 15 bp, Homo sapiens
attgcttctgtagta

SEQ ID NO: 1715765 - DNA, 22 bp, Homo sapiens
attgcttctgtagtactcctta

SEQ ID NO: 1715766 - DNA, 17 bp, Homo sapiens
attgcttgagcccagga

SEQ ID NO: 1715767 - DNA, 16 bp, Homo sapiens
attgcttgagctcagg

SEQ ID NO: 1715768 - DNA, 16 bp, Homo sapiens
attgcttgagcttggg

SEQ ID NO: 1715769 - DNA, 14 bp, Homo sapiens
attgctttaaatct

SEQ ID NO: 1715770 - DNA, 13 bp, Homo sapiens
attgctttctgaa

SEQ ID NO: 1715771 - DNA, 15 bp, Homo sapiens
attgctttctgaaat

SEQ ID NO: 1715772 - DNA, 17 bp, Homo sapiens
attgctttctgaaatta

SEQ ID NO: 1715773 - DNA, 12 bp, Homo sapiens
attgctttgcca

SEQ ID NO: 1715774 - DNA, 19 bp, Homo sapiens
attgcttttgttgtgactt

SEQ ID NO: 1715775 - DNA, 21 bp, Homo sapiens
attggaagtgttcaagaaata

SEQ ID NO: 1715776 - DNA, 14 bp, Homo sapiens
attggactccaggc

SEQ ID NO: 1715777 - DNA, 15 bp, Homo sapiens
attggactccaggcc

SEQ ID NO: 1715778 - DNA, 18 bp, Homo sapiens
attggagagtaaaaactg

SEQ ID NO: 1715779 - DNA, 12 bp, Homo sapiens
attggagctgac

SEQ ID NO: 1715780 - DNA, 17 bp, Homo sapiens
attggagctgactgttc

SEQ ID NO: 1715781 - DNA, 22 bp, Homo sapiens
attggagggtgggagagcccag

SEQ ID NO: 1715782 - DNA, 15 bp, Homo sapiens
attggagtcctggtt

SEQ ID NO: 1715783 - DNA, 16 bp, Homo sapiens
attggcaagtcacgtt

SEQ ID NO: 1715784 - DNA, 22 bp, Homo sapiens
attggcagctcaaagacttcca

SEQ ID NO: 1715785 - DNA, 12 bp, Homo sapiens
attggcctctgt

SEQ ID NO: 1715786 - DNA, 13 bp, Homo sapiens
attggcctggcct

SEQ ID NO: 1715787 - DNA, 17 bp, Homo sapiens
attggcctggcctccag

SEQ ID NO: 1715788 - DNA, 18 bp, Homo sapiens
attggcctggcctccagc

SEQ ID NO: 1715789 - DNA, 20 bp, Homo sapiens
attggcctggcctccagctc

SEQ ID NO: 1715790 - DNA, 20 bp, Homo sapiens
attggcctgtagagttgctg

SEQ ID NO: 1715791 - DNA, 15 bp, Homo sapiens
attggctcacactga

SEQ ID NO: 1715792 - DNA, 16 bp, Homo sapiens
attggctcacactgag

SEQ ID NO: 1715793 - DNA, 21 bp, Homo sapiens
attggctcacactgagaatgt

SEQ ID NO: 1715794 - DNA, 20 bp, Homo sapiens
attggctccatatcatttga

SEQ ID NO: 1715795 - DNA, 23 bp, Homo sapiens
attggctgatctatgcctttcaa

SEQ ID NO: 1715796 - DNA, 15 bp, Homo sapiens
attggctgcaggaag

SEQ ID NO: 1715797 - DNA, 22 bp, Homo sapiens
attggctgcaggaagaaacttt

SEQ ID NO: 1715798 - DNA, 15 bp, Homo sapiens
attggcttaaaggga

SEQ ID NO: 1715799 - DNA, 23 bp, Homo sapiens
attgggtgaatatggtggaaaat

SEQ ID NO: 1715800 - DNA, 18 bp, Homo sapiens
attgggtgggtaaattca

SEQ ID NO: 1715801 - DNA, 22 bp, Homo sapiens
attggtaaaaacagcagctcat

SEQ ID NO: 1715802 - DNA, 17 bp, Homo sapiens
attggtagtgtgggaat

SEQ ID NO: 1715803 - DNA, 14 bp, Homo sapiens
attggtccagcttg

SEQ ID NO: 1715804 - DNA, 12 bp, Homo sapiens
attggtgaataa

SEQ ID NO: 1715805 - DNA, 22 bp, Homo sapiens
attggtgttcgtttccatcatg

SEQ ID NO: 1715806 - DNA, 23 bp, Homo sapiens
attggtgttcgtttccatcatgt

SEQ ID NO: 1715807 - DNA, 14 bp, Homo sapiens
attggttcacctgt

SEQ ID NO: 1715808 - DNA, 13 bp, Homo sapiens
attggttcttccc

SEQ ID NO: 1715809 - DNA, 14 bp, Homo sapiens
attggttcttcccc

SEQ ID NO: 1715810 - DNA, 21 bp, Homo sapiens
attggttcttcccctcatagt

SEQ ID NO: 1715811 - DNA, 19 bp, Homo sapiens
attggttgtgccttccctt

SEQ ID NO: 1715812 - DNA, 17 bp, Homo sapiens
attggttgttgtattga

SEQ ID NO: 1715813 - DNA, 18 bp, Homo sapiens
attggtttaaagaaagtg

SEQ ID NO: 1715814 - DNA, 15 bp, Homo sapiens
attgtaaaataaagt

SEQ ID NO: 1715815 - DNA, 20 bp, Homo sapiens
attgtaaaattatttcatga

SEQ ID NO: 1715816 - DNA, 19 bp, Homo sapiens
attgtaaatactggactca

SEQ ID NO: 1715817 - DNA, 13 bp, Homo sapiens
attgtaaatcact

SEQ ID NO: 1715818 - DNA, 18 bp, Homo sapiens
attgtaaatcacttgttt

SEQ ID NO: 1715819 - DNA, 17 bp, Homo sapiens
attgtaaatgtgctttt

SEQ ID NO: 1715820 - DNA, 15 bp, Homo sapiens
attgtaatcgtgtgc

SEQ ID NO: 1715821 - DNA, 14 bp, Homo sapiens
attgtaatgttgtg

SEQ ID NO: 1715822 - DNA, 13 bp, Homo sapiens
attgtacaaatgt

SEQ ID NO: 1715823 - DNA, 14 bp, Homo sapiens
attgtacaaatgta

SEQ ID NO: 1715824 - DNA, 14 bp, Homo sapiens
attgtacagactgt

SEQ ID NO: 1715825 - DNA, 17 bp, Homo sapiens
attgtacagactgtttt

SEQ ID NO: 1715826 - DNA, 18 bp, Homo sapiens
attgtacctctcttatag

SEQ ID NO: 1715827 - DNA, 19 bp, Homo sapiens
attgtacctctcttataga

SEQ ID NO: 1715828 - DNA, 14 bp, Homo sapiens
attgtactcaatgg

SEQ ID NO: 1715829 - DNA, 18 bp, Homo sapiens
attgtactcaatggattt

SEQ ID NO: 1715830 - DNA, 22 bp, Homo sapiens
attgtactcaatggatttgatg

SEQ ID NO: 1715831 - DNA, 14 bp, Homo sapiens
attgtactccagcc

SEQ ID NO: 1715832 - DNA, 16 bp, Homo sapiens
attgtactccagcctg

SEQ ID NO: 1715833 - DNA, 17 bp, Homo sapiens
attgtactctgctttat

SEQ ID NO: 1715834 - DNA, 21 bp, Homo sapiens
attgtactgttgctttaatat

SEQ ID NO: 1715835 - DNA, 22 bp, Homo sapiens
attgtacttagccagttcaaag

SEQ ID NO: 1715836 - DNA, 15 bp, Homo sapiens
attgtagaattgtat

SEQ ID NO: 1715837 - DNA, 22 bp, Homo sapiens
atttactgctctttattgcaga

SEQ ID NO: 1715838 - DNA, 18 bp, Homo sapiens
atttactgttagaattct

SEQ ID NO: 1715839 - DNA, 20 bp, Homo sapiens
atttacttcttatacatttg

SEQ ID NO: 1715840 - DNA, 12 bp, Homo sapiens
atttacttgttt

SEQ ID NO: 1715841 - DNA, 23 bp, Homo sapiens
atttacttgttttggatggcttg

SEQ ID NO: 1715842 - DNA, 14 bp, Homo sapiens
atttactttcttca

SEQ ID NO: 1715843 - DNA, 18 bp, Homo sapiens
atttagaaaaaagtttac

SEQ ID NO: 1715844 - DNA, 15 bp, Homo sapiens
atttagaactttaag

SEQ ID NO: 1715845 - DNA, 15 bp, Homo sapiens
atttagaagaaagat

SEQ ID NO: 1715846 - DNA, 15 bp, Homo sapiens
atttagaatctagaa

SEQ ID NO: 1715847 - DNA, 16 bp, Homo sapiens
atttagaatctagaaa

SEQ ID NO: 1715848 - DNA, 11 bp, Homo sapiens
atttagaatgg

SEQ ID NO: 1715849 - DNA, 14 bp, Homo sapiens
atttagacaagaga

SEQ ID NO: 1715850 - DNA, 19 bp, Homo sapiens
atttagaccccatacaagt

SEQ ID NO: 1715851 - DNA, 20 bp, Homo sapiens
atttagagaactgtggccgt

SEQ ID NO: 1715852 - DNA, 22 bp, Homo sapiens
atttagagatgctgtaacttaa

SEQ ID NO: 1715853 - DNA, 13 bp, Homo sapiens
atttagatatgca

SEQ ID NO: 1715854 - DNA, 18 bp, Homo sapiens
atttagattgttaaaata

SEQ ID NO: 1715855 - DNA, 16 bp, Homo sapiens
atttagccgggcgcgg

SEQ ID NO: 1715856 - DNA, 18 bp, Homo sapiens
atttagcgtagctaagtg

SEQ ID NO: 1715857 - DNA, 21 bp, Homo sapiens
atttagctacagcttgtttaa

SEQ ID NO: 1715858 - DNA, 13 bp, Homo sapiens
atttagctattta

SEQ ID NO: 1715859 - DNA, 15 bp, Homo sapiens
atttaggaaattcaa

SEQ ID NO: 1715860 - DNA, 20 bp, Homo sapiens
atttaggaaattcaaagcat

SEQ ID NO: 1715861 - DNA, 16 bp, Homo sapiens
atttagggaactgctt

SEQ ID NO: 1715862 - DNA, 18 bp, Homo sapiens
atttagggaactgcttga

SEQ ID NO: 1715863 - DNA, 18 bp, Homo sapiens
atttagggccttttctgt

SEQ ID NO: 1715864 - DNA, 14 bp, Homo sapiens
atttagtaagaata

SEQ ID NO: 1715865 - DNA, 15 bp, Homo sapiens
atttagtaagtatgt

SEQ ID NO: 1715866 - DNA, 20 bp, Homo sapiens
atttagtgaaagctagagat

SEQ ID NO: 1715867 - DNA, 17 bp, Homo sapiens
atttagttctttgttat

SEQ ID NO: 1715868 - DNA, 17 bp, Homo sapiens
atttataaacagacaat

SEQ ID NO: 1715869 - DNA, 23 bp, Homo sapiens
atttataactcatcataaaataa

SEQ ID NO: 1715870 - DNA, 16 bp, Homo sapiens
atttataaggttttaa

SEQ ID NO: 1715871 - DNA, 22 bp, Homo sapiens
atttataagtgactttaaactt

SEQ ID NO: 1715872 - DNA, 16 bp, Homo sapiens
atttataatgttagta

SEQ ID NO: 1715873 - DNA, 14 bp, Homo sapiens
atttataatgtttg

SEQ ID NO: 1715874 - DNA, 14 bp, Homo sapiens
atttatactattta

SEQ ID NO: 1715875 - DNA, 10 bp, Homo sapiens
atttatactc

SEQ ID NO: 1715876 - DNA, 13 bp, Homo sapiens
atttatactttgc

SEQ ID NO: 1715877 - DNA, 15 bp, Homo sapiens
atttatatagattat

SEQ ID NO: 1715878 - DNA, 12 bp, Homo sapiens
atttatatatat

SEQ ID NO: 1715879 - DNA, 15 bp, Homo sapiens
atttatatatatatg

SEQ ID NO: 1715880 - DNA, 16 bp, Homo sapiens
atttatatatatatgt

SEQ ID NO: 1715881 - DNA, 19 bp, Homo sapiens
atttatatatatatgtata

SEQ ID NO: 1715882 - DNA, 16 bp, Homo sapiens
atttatatatatgtgt

SEQ ID NO: 1715883 - DNA, 17 bp, Homo sapiens
atttatatatttataac

SEQ ID NO: 1715884 - DNA, 21 bp, Homo sapiens
atttatatcacacaatatagt

SEQ ID NO: 1715885 - DNA, 14 bp, Homo sapiens
atttatatctgctt

SEQ ID NO: 1715886 - DNA, 13 bp, Homo sapiens
atttatatgtact

SEQ ID NO: 1715887 - DNA, 21 bp, Homo sapiens
atttatattccatttacataa

SEQ ID NO: 1715888 - DNA, 12 bp, Homo sapiens
atttatattccg

SEQ ID NO: 1715889 - DNA, 23 bp, Homo sapiens
atttatattccgtatttaaagtt

SEQ ID NO: 1715890 - DNA, 14 bp, Homo sapiens
atttatatttggaa

SEQ ID NO: 1715891 - DNA, 15 bp, Homo sapiens
atttatatttggaaa

SEQ ID NO: 1715892 - DNA, 19 bp, Homo sapiens
atttatatttttaaaatat

SEQ ID NO: 1715893 - DNA, 21 bp, Homo sapiens
atttatcaaaccctagccttg

SEQ ID NO: 1715894 - DNA, 19 bp, Homo sapiens
atttatcaatttttcccag

SEQ ID NO: 1715895 - DNA, 21 bp, Homo sapiens
atttatccaattttgatcttt

SEQ ID NO: 1715896 - DNA, 19 bp, Homo sapiens
atttatcctgaaatttcag

SEQ ID NO: 1715897 - DNA, 20 bp, Homo sapiens
atttatcctgaaatttcaga

SEQ ID NO: 1715898 - DNA, 20 bp, Homo sapiens
atttatctgtgtttttgaaa

SEQ ID NO: 1715899 - DNA, 14 bp, Homo sapiens
atttatcttatcta

SEQ ID NO: 1715900 - DNA, 16 bp, Homo sapiens
atttatcttgaaggaa

SEQ ID NO: 1715901 - DNA, 12 bp, Homo sapiens
atttatctttac

SEQ ID NO: 1715902 - DNA, 16 bp, Homo sapiens
atttatctttcaaaga

SEQ ID NO: 1715903 - DNA, 13 bp, Homo sapiens
atttatctttgat

SEQ ID NO: 1715904 - DNA, 16 bp, Homo sapiens
atttatctttgataac

SEQ ID NO: 1715905 - DNA, 23 bp, Homo sapiens
atttatgaattgaattatcttgg

SEQ ID NO: 1715906 - DNA, 19 bp, Homo sapiens
atttatgagtttttgatag

SEQ ID NO: 1715907 - DNA, 17 bp, Homo sapiens
atttatgcaagttaggg

SEQ ID NO: 1715908 - DNA, 13 bp, Homo sapiens
atttatgcacatt

SEQ ID NO: 1715909 - DNA, 17 bp, Homo sapiens
atttatgcacattcacg

SEQ ID NO: 1715910 - DNA, 14 bp, Homo sapiens
atttatgcactgtg

SEQ ID NO: 1715911 - DNA, 23 bp, Homo sapiens
atttatgcatttcattcaaatca

SEQ ID NO: 1715912 - DNA, 18 bp, Homo sapiens
atttatgggcccctggca

SEQ ID NO: 1715913 - DNA, 15 bp, Homo sapiens
atttatggttgttaa

SEQ ID NO: 1715914 - DNA, 23 bp, Homo sapiens
atttatggttgttaaaaatgtca

SEQ ID NO: 1715915 - DNA, 18 bp, Homo sapiens
atttatgtagatgtgcat

SEQ ID NO: 1715916 - DNA, 21 bp, Homo sapiens
atttatgtagatgtgcatttt

SEQ ID NO: 1715917 - DNA, 22 bp, Homo sapiens
atttatgtgaggtaattattgc

SEQ ID NO: 1715918 - DNA, 15 bp, Homo sapiens
atttatgtgtagaat

SEQ ID NO: 1715919 - DNA, 15 bp, Homo sapiens
atttatgtgtatatg

SEQ ID NO: 1715920 - DNA, 22 bp, Homo sapiens
atttatgtgtgaggagctgctg

SEQ ID NO: 1715921 - DNA, 15 bp, Homo sapiens
atttatgttgggtca

SEQ ID NO: 1715922 - DNA, 22 bp, Homo sapiens
atttatgtttgcacttgtgatt

SEQ ID NO: 1715923 - DNA, 17 bp, Homo sapiens
atttattaaaaacatga

SEQ ID NO: 1715924 - DNA, 21 bp, Homo sapiens
atttattaaaaacatgaccac

SEQ ID NO: 1715925 - DNA, 22 bp, Homo sapiens
atttattaaacagatttttaca

SEQ ID NO: 1715926 - DNA, 13 bp, Homo sapiens
atttattacaaat

SEQ ID NO: 1715927 - DNA, 14 bp, Homo sapiens
atttattattttca

SEQ ID NO: 1715928 - DNA, 21 bp, Homo sapiens
atttattattttcacctgttt

SEQ ID NO: 1715929 - DNA, 21 bp, Homo sapiens
atttattcacatatatcaaag

SEQ ID NO: 1715930 - DNA, 18 bp, Homo sapiens
atttattcactgtaagtt

SEQ ID NO: 1715931 - DNA, 20 bp, Homo sapiens
atttattcactgtaagttta

SEQ ID NO: 1715932 - DNA, 13 bp, Homo sapiens
atttattcagcaa

SEQ ID NO: 1715933 - DNA, 20 bp, Homo sapiens
atttattcataatgaattat

SEQ ID NO: 1715934 - DNA, 11 bp, Homo sapiens
atttattcttt

SEQ ID NO: 1715935 - DNA, 20 bp, Homo sapiens
atttattgaaatttttctct

SEQ ID NO: 1715936 - DNA, 17 bp, Homo sapiens
atttattgactttgaca

SEQ ID NO: 1715937 - DNA, 19 bp, Homo sapiens
atttattgattaaaaatgt

SEQ ID NO: 1715938 - DNA, 22 bp, Homo sapiens
atttattgcagaggatgttcat

SEQ ID NO: 1715939 - DNA, 12 bp, Homo sapiens
atttattgccat

SEQ ID NO: 1715940 - DNA, 16 bp, Homo sapiens
atttattgtttatgta

SEQ ID NO: 1715941 - DNA, 21 bp, Homo sapiens
atttattgtttatttatcagt

SEQ ID NO: 1715942 - DNA, 20 bp, Homo sapiens
atttatttaaaagattcatt

SEQ ID NO: 1715943 - DNA, 21 bp, Homo sapiens
atttatttaaaatttcgttgt

SEQ ID NO: 1715944 - DNA, 12 bp, Homo sapiens
atttatttaata

SEQ ID NO: 1715945 - DNA, 15 bp, Homo sapiens
atttatttatccaga

SEQ ID NO: 1715946 - DNA, 14 bp, Homo sapiens
atttatttattacc

SEQ ID NO: 1715947 - DNA, 14 bp, Homo sapiens
atttatttattatt

SEQ ID NO: 1715948 - DNA, 18 bp, Homo sapiens
atttcagaggctgcagga

SEQ ID NO: 1715949 - DNA, 22 bp, Homo sapiens
atttcaggaaaatgtattgatt

SEQ ID NO: 1715950 - DNA, 18 bp, Homo sapiens
atttcaggaatttaaaat

SEQ ID NO: 1715951 - DNA, 19 bp, Homo sapiens
atttcaggatactctgtca

SEQ ID NO: 1715952 - DNA, 16 bp, Homo sapiens
atttcaggcattttgt

SEQ ID NO: 1715953 - DNA, 21 bp, Homo sapiens
atttcaggttttgtaaagatg

SEQ ID NO: 1715954 - DNA, 14 bp, Homo sapiens
atttcagtaagtct

SEQ ID NO: 1715955 - DNA, 20 bp, Homo sapiens
atttcagtcttggtggttct

SEQ ID NO: 1715956 - DNA, 23 bp, Homo sapiens
atttcagtggaatagatgtctca

SEQ ID NO: 1715957 - DNA, 17 bp, Homo sapiens
atttcagtttttcattt

SEQ ID NO: 1715958 - DNA, 20 bp, Homo sapiens
atttcagtttttcatttgtt

SEQ ID NO: 1715959 - DNA, 21 bp, Homo sapiens
atttcagtttttcatttgttt

SEQ ID NO: 1715960 - DNA, 12 bp, Homo sapiens
atttcataaaga

SEQ ID NO: 1715961 - DNA, 23 bp, Homo sapiens
atttcatactgtaacattcagga

SEQ ID NO: 1715962 - DNA, 15 bp, Homo sapiens
atttcatattgagat

SEQ ID NO: 1715963 - DNA, 14 bp, Homo sapiens
atttcatcattgtt

SEQ ID NO: 1715964 - DNA, 16 bp, Homo sapiens
atttcatctatttctg

SEQ ID NO: 1715965 - DNA, 18 bp, Homo sapiens
atttcatctatttctgag

SEQ ID NO: 1715966 - DNA, 14 bp, Homo sapiens
atttcatctatttt

SEQ ID NO: 1715967 - DNA, 16 bp, Homo sapiens
atttcatctgctctcc

SEQ ID NO: 1715968 - DNA, 20 bp, Homo sapiens
atttcatctgctctccttcc

SEQ ID NO: 1715969 - DNA, 21 bp, Homo sapiens
atttcatctgctctccttcct

SEQ ID NO: 1715970 - DNA, 17 bp, Homo sapiens
atttcatcttctggaat

SEQ ID NO: 1715971 - DNA, 16 bp, Homo sapiens
atttcatgaaaaagct

SEQ ID NO: 1715972 - DNA, 18 bp, Homo sapiens
atttcatgaaaaagctgc

SEQ ID NO: 1715973 - DNA, 23 bp, Homo sapiens
atttcatggggtttggttgtgct

SEQ ID NO: 1715974 - DNA, 22 bp, Homo sapiens
atttcatgtgtcaacttcaaca

SEQ ID NO: 1715975 - DNA, 18 bp, Homo sapiens
atttcattcaaatcagtg

SEQ ID NO: 1715976 - DNA, 13 bp, Homo sapiens
atttcatttaaat

SEQ ID NO: 1715977 - DNA, 16 bp, Homo sapiens
atttcatttaaatatc

SEQ ID NO: 1715978 - DNA, 18 bp, Homo sapiens
atttcatttcaactgttt

SEQ ID NO: 1715979 - DNA, 14 bp, Homo sapiens
atttcatttccagc

SEQ ID NO: 1715980 - DNA, 17 bp, Homo sapiens
atttcatttgtaacttt

SEQ ID NO: 1715981 - DNA, 23 bp, Homo sapiens
atttcattttgtaacaaatgaac

SEQ ID NO: 1715982 - DNA, 23 bp, Homo sapiens
atttcatttttcaatagcacata

SEQ ID NO: 1715983 - DNA, 17 bp, Homo sapiens
atttccaaattcacaag

SEQ ID NO: 1715984 - DNA, 19 bp, Homo sapiens
atttccaacaccacagaca

SEQ ID NO: 1715985 - DNA, 16 bp, Homo sapiens
atttccaactcaggtt

SEQ ID NO: 1715986 - DNA, 15 bp, Homo sapiens
atttccaagaggctg

SEQ ID NO: 1715987 - DNA, 23 bp, Homo sapiens
atttccacatggaatcaatcttt

SEQ ID NO: 1715988 - DNA, 15 bp, Homo sapiens
atttccaccaagggt

SEQ ID NO: 1715989 - DNA, 22 bp, Homo sapiens
atttccagaaccacacttgaaa

SEQ ID NO: 1715990 - DNA, 11 bp, Homo sapiens
atttccagacc

SEQ ID NO: 1715991 - DNA, 18 bp, Homo sapiens
atttccaggaaaaaataa

SEQ ID NO: 1715992 - DNA, 11 bp, Homo sapiens
atttccaggcc

SEQ ID NO: 1715993 - DNA, 14 bp, Homo sapiens
atttccaggcccct

SEQ ID NO: 1715994 - DNA, 18 bp, Homo sapiens
atttccaggcccctgagg

SEQ ID NO: 1715995 - DNA, 19 bp, Homo sapiens
atttccagggcagcagccg

SEQ ID NO: 1715996 - DNA, 17 bp, Homo sapiens
atttccagtacctttgt

SEQ ID NO: 1715997 - DNA, 11 bp, Homo sapiens
atttccagtgg

SEQ ID NO: 1715998 - DNA, 20 bp, Homo sapiens
atttccagtggtcatgctca

SEQ ID NO: 1715999 - DNA, 20 bp, Homo sapiens
atttccatcttaatgttact

SEQ ID NO: 1716000 - DNA, 16 bp, Homo sapiens
atttccatttcttcct

SEQ ID NO: 1716001 - DNA, 18 bp, Homo sapiens
atttccatttcttcctca

SEQ ID NO: 1716002 - DNA, 23 bp, Homo sapiens
atttcccactgcactccagcctg

SEQ ID NO: 1716003 - DNA, 21 bp, Homo sapiens
atttcccagttaaagattatt

SEQ ID NO: 1716004 - DNA, 14 bp, Homo sapiens
atttcccatctgca

SEQ ID NO: 1716005 - DNA, 15 bp, Homo sapiens
atttcccatctgcac

SEQ ID NO: 1716006 - DNA, 21 bp, Homo sapiens
atttcccatttgtgccagagg

SEQ ID NO: 1716007 - DNA, 22 bp, Homo sapiens
atttcccatttgtgccagagga

SEQ ID NO: 1716008 - DNA, 17 bp, Homo sapiens
atttccccaccccagct

SEQ ID NO: 1716009 - DNA, 14 bp, Homo sapiens
atttccccagccac

SEQ ID NO: 1716010 - DNA, 16 bp, Homo sapiens
atttccccagccacag

SEQ ID NO: 1716011 - DNA, 13 bp, Homo sapiens
ctttatttgtttt

SEQ ID NO: 1716012 - DNA, 16 bp, Homo sapiens
ctttatttgttttttt

SEQ ID NO: 1716013 - DNA, 14 bp, Homo sapiens
gccgggagaggatg

SEQ ID NO: 1716014 - DNA, 15 bp, Homo sapiens
gccgggcatgatggt

SEQ ID NO: 1716015 - DNA, 14 bp, Homo sapiens
gccgggcccctggg

SEQ ID NO: 1716016 - DNA, 19 bp, Homo sapiens
gccgggccgaatcccctcc

SEQ ID NO: 1716017 - DNA, 15 bp, Homo sapiens
gccgggccgcagact

SEQ ID NO: 1716018 - DNA, 14 bp, Homo sapiens
gccgggcctgggcc

SEQ ID NO: 1716019 - DNA, 22 bp, Homo sapiens
gccgggcctgggcctcctggga

SEQ ID NO: 1716020 - DNA, 13 bp, Homo sapiens
gccgggcgcagtg

SEQ ID NO: 1716021 - DNA, 14 bp, Homo sapiens
gccgggcgcggtgg

SEQ ID NO: 1716022 - DNA, 22 bp, Homo sapiens
gccgggcgcggtggctcacgcc

SEQ ID NO: 1716023 - DNA, 13 bp, Homo sapiens
gccgggctgaggg

SEQ ID NO: 1716024 - DNA, 17 bp, Homo sapiens
gccgggctgctgctgat

SEQ ID NO: 1716025 - DNA, 19 bp, Homo sapiens
gccgggcttgggccctgca

SEQ ID NO: 1716026 - DNA, 22 bp, Homo sapiens
gccgggcttgggccctgcacag

SEQ ID NO: 1716027 - DNA, 22 bp, Homo sapiens
gccggggtggagcatgggcctg

SEQ ID NO: 1716028 - DNA, 19 bp, Homo sapiens
gccggtcgggcagccagca

SEQ ID NO: 1716029 - DNA, 20 bp, Homo sapiens
gccggtgcacaggcctctgc

SEQ ID NO: 1716030 - DNA, 23 bp, Homo sapiens
gccggtgcacaggcctctgcctg

SEQ ID NO: 1716031 - DNA, 21 bp, Homo sapiens
gccggtgctgggttcccactc

SEQ ID NO: 1716032 - DNA, 16 bp, Homo sapiens
gccggtgggaccctgt

SEQ ID NO: 1716033 - DNA, 20 bp, Homo sapiens
gccggtgggaccctgtccgg

SEQ ID NO: 1716034 - DNA, 15 bp, Homo sapiens
gccgtaattctttct

SEQ ID NO: 1716035 - DNA, 18 bp, Homo sapiens
gccgtaattctttctgtc

SEQ ID NO: 1716036 - DNA, 14 bp, Homo sapiens
gccgtaatttaact

SEQ ID NO: 1716037 - DNA, 15 bp, Homo sapiens
gccgtaccccaccct

SEQ ID NO: 1716038 - DNA, 16 bp, Homo sapiens
gccgtaccccaccctc

SEQ ID NO: 1716039 - DNA, 18 bp, Homo sapiens
gccgtaccccaccctcag

SEQ ID NO: 1716040 - DNA, 19 bp, Homo sapiens
gccgtagggagtacctgct

SEQ ID NO: 1716041 - DNA, 17 bp, Homo sapiens
gccgtaggggctcctga

SEQ ID NO: 1716042 - DNA, 23 bp, Homo sapiens
gccgtattttacatgaagctgta

SEQ ID NO: 1716043 - DNA, 13 bp, Homo sapiens
gccgtcacacgta

SEQ ID NO: 1716044 - DNA, 16 bp, Homo sapiens
gccgtcacccctgcct

SEQ ID NO: 1716045 - DNA, 16 bp, Homo sapiens
gccgtccatggcacca

SEQ ID NO: 1716046 - DNA, 18 bp, Homo sapiens
gccgtccatggcaccagc

SEQ ID NO: 1716047 - DNA, 21 bp, Homo sapiens
gccgtccatggcaccagcccc

SEQ ID NO: 1716048 - DNA, 23 bp, Homo sapiens
gccgtcctaacctcgggcctgct

SEQ ID NO: 1716049 - DNA, 21 bp, Homo sapiens
gccgtcctcccgggccctccc

SEQ ID NO: 1716050 - DNA, 14 bp, Homo sapiens
gccgtctccagggg

SEQ ID NO: 1716051 - DNA, 16 bp, Homo sapiens
gccgtctccaggggct

SEQ ID NO: 1716052 - DNA, 21 bp, Homo sapiens
gccgtctccaggggctgcttc

SEQ ID NO: 1716053 - DNA, 17 bp, Homo sapiens
gccgtctcctccctcag

SEQ ID NO: 1716054 - DNA, 14 bp, Homo sapiens
gccgtctgactcca

SEQ ID NO: 1716055 - DNA, 19 bp, Homo sapiens
gccgtctgactccagagtc

SEQ ID NO: 1716056 - DNA, 15 bp, Homo sapiens
gccgtcttctgccct

SEQ ID NO: 1716057 - DNA, 21 bp, Homo sapiens
gccgtgacctattcaccctcc

SEQ ID NO: 1716058 - DNA, 12 bp, Homo sapiens
gccgtgagcagg

SEQ ID NO: 1716059 - DNA, 23 bp, Homo sapiens
gccgtgaggacacgtggcctgca

SEQ ID NO: 1716060 - DNA, 15 bp, Homo sapiens
gccgtgatgcctccc

SEQ ID NO: 1716061 - DNA, 21 bp, Homo sapiens
gccgtgcatggctcctgtctg

SEQ ID NO: 1716062 - DNA, 19 bp, Homo sapiens
gccgtgccttcagctctac

SEQ ID NO: 1716063 - DNA, 13 bp, Homo sapiens
gccgtggatggcc

SEQ ID NO: 1716064 - DNA, 22 bp, Homo sapiens
gccgtggattgcacgtggcctc

SEQ ID NO: 1716065 - DNA, 22 bp, Homo sapiens
gccgtggctatacctggggact

SEQ ID NO: 1716066 - DNA, 13 bp, Homo sapiens
gccgtggcttccc

SEQ ID NO: 1716067 - DNA, 19 bp, Homo sapiens
gccgtggcttcccgctcag

SEQ ID NO: 1716068 - DNA, 23 bp, Homo sapiens
gccgtgggcctgtcgtgccagtc

SEQ ID NO: 1716069 - DNA, 23 bp, Homo sapiens
gccgtggggccgccgcctctttc

SEQ ID NO: 1716070 - DNA, 18 bp, Homo sapiens
gccgtgggggttgaggca

SEQ ID NO: 1716071 - DNA, 23 bp, Homo sapiens
gccgtggtccaaccaggagctga

SEQ ID NO: 1716072 - DNA, 15 bp, Homo sapiens
gccgtggtccagctc

SEQ ID NO: 1716073 - DNA, 16 bp, Homo sapiens
gccgtggtccagctct

SEQ ID NO: 1716074 - DNA, 21 bp, Homo sapiens
gccgtgtcccgcggtgctgac

SEQ ID NO: 1716075 - DNA, 15 bp, Homo sapiens
gccgtgtctcagcct

SEQ ID NO: 1716076 - DNA, 21 bp, Homo sapiens
gccgtgtgtctgtcagcccaa

SEQ ID NO: 1716077 - DNA, 18 bp, Homo sapiens
gccgtgtgttgcatgcag

SEQ ID NO: 1716078 - DNA, 21 bp, Homo sapiens
gccgtgttactgttgcactga

SEQ ID NO: 1716079 - DNA, 13 bp, Homo sapiens
gccgttcagcctg

SEQ ID NO: 1716080 - DNA, 15 bp, Homo sapiens
gccgttccccttggc

SEQ ID NO: 1716081 - DNA, 12 bp, Homo sapiens
gccgttctgttc

SEQ ID NO: 1716082 - DNA, 14 bp, Homo sapiens
gccgttctgttcca

SEQ ID NO: 1716083 - DNA, 18 bp, Homo sapiens
gccgttctgttccaacct

SEQ ID NO: 1716084 - DNA, 23 bp, Homo sapiens
gccgtttgagaagaaaacatcta

SEQ ID NO: 1716085 - DNA, 16 bp, Homo sapiens
gcctaaaagtaaacat

SEQ ID NO: 1716086 - DNA, 18 bp, Homo sapiens
gcctaaaattgtatgaaa

SEQ ID NO: 1716087 - DNA, 16 bp, Homo sapiens
gcctaaagggcagggc

SEQ ID NO: 1716088 - DNA, 16 bp, Homo sapiens
gcctaaatccaaagaa

SEQ ID NO: 1716089 - DNA, 19 bp, Homo sapiens
gcctaaatcccaagaaatg

SEQ ID NO: 1716090 - DNA, 20 bp, Homo sapiens
gcctaaatttaatgctgcct

SEQ ID NO: 1716091 - DNA, 15 bp, Homo sapiens
gcctaaatttgtgct

SEQ ID NO: 1716092 - DNA, 18 bp, Homo sapiens
gcctaactaactggcagg

SEQ ID NO: 1716093 - DNA, 14 bp, Homo sapiens
gcctaagaagctct

SEQ ID NO: 1716094 - DNA, 21 bp, Homo sapiens
gcctaagatatacttgttttt

SEQ ID NO: 1716095 - DNA, 23 bp, Homo sapiens
gcctaagggatcctgcctgcccc

SEQ ID NO: 1716096 - DNA, 17 bp, Homo sapiens
gcctaagtggctgctga

SEQ ID NO: 1716097 - DNA, 14 bp, Homo sapiens
gcctaatccctggg

SEQ ID NO: 1716098 - DNA, 16 bp, Homo sapiens
gcctaatccctgggca

SEQ ID NO: 1716099 - DNA, 22 bp, Homo sapiens
gcctaatccctgggcattgctt

SEQ ID NO: 1716100 - DNA, 15 bp, Homo sapiens
gcctaatggagaaga

SEQ ID NO: 1716101 - DNA, 14 bp, Homo sapiens
gcctacaagctggc

SEQ ID NO: 1716102 - DNA, 22 bp, Homo sapiens
gcctacaagctggcacttgcta

SEQ ID NO: 1716103 - DNA, 21 bp, Homo sapiens
attaccctaagaatgctttgc

SEQ ID NO: 1716104 - DNA, 23 bp, Homo sapiens
attaccctaagaatgctttgcca

SEQ ID NO: 1716105 - DNA, 16 bp, Homo sapiens
attaccgtcacactct

SEQ ID NO: 1716106 - DNA, 20 bp, Homo sapiens
attacctccatccatccttc

SEQ ID NO: 1716107 - DNA, 18 bp, Homo sapiens
attacctgccaattgcta

SEQ ID NO: 1716108 - DNA, 15 bp, Homo sapiens
attacctgtggatat

SEQ ID NO: 1716109 - DNA, 21 bp, Homo sapiens
attacgtgggtgccctctcca

SEQ ID NO: 1716110 - DNA, 11 bp, Homo sapiens
attactaattt

SEQ ID NO: 1716111 - DNA, 12 bp, Homo sapiens
attactaatttc

SEQ ID NO: 1716112 - DNA, 15 bp, Homo sapiens
attactaattttaca

SEQ ID NO: 1716113 - DNA, 13 bp, Homo sapiens
attactcaggttt

SEQ ID NO: 1716114 - DNA, 17 bp, Homo sapiens
attactctcattctttg

SEQ ID NO: 1716115 - DNA, 14 bp, Homo sapiens
attactctttttca

SEQ ID NO: 1716116 - DNA, 21 bp, Homo sapiens
attactgaataatatcaaata

SEQ ID NO: 1716117 - DNA, 17 bp, Homo sapiens
attactgatgtgatatt

SEQ ID NO: 1716118 - DNA, 17 bp, Homo sapiens
attactgctaagtattt

SEQ ID NO: 1716119 - DNA, 19 bp, Homo sapiens
attactgctaagtatttcc

SEQ ID NO: 1716120 - DNA, 23 bp, Homo sapiens
attactgctaagtatttcccagc

SEQ ID NO: 1716121 - DNA, 20 bp, Homo sapiens
attactgctttaatcagaaa

SEQ ID NO: 1716122 - DNA, 17 bp, Homo sapiens
attactggcctttttca

SEQ ID NO: 1716123 - DNA, 18 bp, Homo sapiens
attactgtacacattaag

SEQ ID NO: 1716124 - DNA, 20 bp, Homo sapiens
attactgtatataaactcct

SEQ ID NO: 1716125 - DNA, 13 bp, Homo sapiens
attactgtcaata

SEQ ID NO: 1716126 - DNA, 14 bp, Homo sapiens
attactgtcccctt

SEQ ID NO: 1716127 - DNA, 13 bp, Homo sapiens
attactgtcttta

SEQ ID NO: 1716128 - DNA, 19 bp, Homo sapiens
attactgtctttattctta

SEQ ID NO: 1716129 - DNA, 14 bp, Homo sapiens
attactgtgatttc

SEQ ID NO: 1716130 - DNA, 15 bp, Homo sapiens
attactgtgatttct

SEQ ID NO: 1716131 - DNA, 19 bp, Homo sapiens
attactgttgcatttactt

SEQ ID NO: 1716132 - DNA, 21 bp, Homo sapiens
attactgttgcatttactttt

SEQ ID NO: 1716133 - DNA, 13 bp, Homo sapiens
attactgtttgga

SEQ ID NO: 1716134 - DNA, 16 bp, Homo sapiens
attactgttttgggcc

SEQ ID NO: 1716135 - DNA, 13 bp, Homo sapiens
attacttagagga

SEQ ID NO: 1716136 - DNA, 22 bp, Homo sapiens
attacttaggttattttgcttt

SEQ ID NO: 1716137 - DNA, 15 bp, Homo sapiens
attacttatcatcca

SEQ ID NO: 1716138 - DNA, 15 bp, Homo sapiens
attacttatttttga

SEQ ID NO: 1716139 - DNA, 18 bp, Homo sapiens
attacttatttttgacag

SEQ ID NO: 1716140 - DNA, 16 bp, Homo sapiens
attacttgtgttactt

SEQ ID NO: 1716141 - DNA, 21 bp, Homo sapiens
attactttaaaataaaaaagt

SEQ ID NO: 1716142 - DNA, 13 bp, Homo sapiens
attactttcagaa

SEQ ID NO: 1716143 - DNA, 21 bp, Homo sapiens
attactttggggctaatttaa

SEQ ID NO: 1716144 - DNA, 20 bp, Homo sapiens
attactttgtcttttcaatc

SEQ ID NO: 1716145 - DNA, 14 bp, Homo sapiens
attacttttaaata

SEQ ID NO: 1716146 - DNA, 16 bp, Homo sapiens
attagaaaattttgta

SEQ ID NO: 1716147 - DNA, 22 bp, Homo sapiens
attagaaaattttgtaaaacaa

SEQ ID NO: 1716148 - DNA, 19 bp, Homo sapiens
attagaaaggacaacagtt

SEQ ID NO: 1716149 - DNA, 22 bp, Homo sapiens
attagaaatagacagtatattt

SEQ ID NO: 1716150 - DNA, 17 bp, Homo sapiens
attagaaatattttaaa

SEQ ID NO: 1716151 - DNA, 21 bp, Homo sapiens
attagaaatattttaaaatca

SEQ ID NO: 1716152 - DNA, 24 bp, Homo sapiens
attagaaatattttaaaatcagct

SEQ ID NO: 1716153 - DNA, 20 bp, Homo sapiens
attagaaattagctgtgtga

SEQ ID NO: 1716154 - DNA, 15 bp, Homo sapiens
attagaagacaacag

SEQ ID NO: 1716155 - DNA, 13 bp, Homo sapiens
attagaattattt

SEQ ID NO: 1716156 - DNA, 18 bp, Homo sapiens
attagacactttggaaga

SEQ ID NO: 1716157 - DNA, 13 bp, Homo sapiens
attagacagaaca

SEQ ID NO: 1716158 - DNA, 13 bp, Homo sapiens
attagagaagctg

SEQ ID NO: 1716159 - DNA, 14 bp, Homo sapiens
attagagcattgaa

SEQ ID NO: 1716160 - DNA, 16 bp, Homo sapiens
attagagcctgtaaac

SEQ ID NO: 1716161 - DNA, 17 bp, Homo sapiens
attagagctgcataatg

SEQ ID NO: 1716162 - DNA, 17 bp, Homo sapiens
attagagtatttccctt

SEQ ID NO: 1716163 - DNA, 19 bp, Homo sapiens
attagagtatttcccttcc

SEQ ID NO: 1716164 - DNA, 23 bp, Homo sapiens
attagagtcaactacacaaagca

SEQ ID NO: 1716165 - DNA, 19 bp, Homo sapiens
attagagtgcaaaagtgag

SEQ ID NO: 1716166 - DNA, 17 bp, Homo sapiens
attagataaacacaggc

SEQ ID NO: 1716167 - DNA, 17 bp, Homo sapiens
attagataaagatttct

SEQ ID NO: 1716168 - DNA, 14 bp, Homo sapiens
attagataaattac

SEQ ID NO: 1716169 - DNA, 15 bp, Homo sapiens
attagataatatttt

SEQ ID NO: 1716170 - DNA, 16 bp, Homo sapiens
attagatcaaatagtt

SEQ ID NO: 1716171 - DNA, 21 bp, Homo sapiens
attagatcaaatagttgcata

SEQ ID NO: 1716172 - DNA, 23 bp, Homo sapiens
attagatcacatcttaaattcat

SEQ ID NO: 1716173 - DNA, 18 bp, Homo sapiens
attagatcttcaaacaga

SEQ ID NO: 1716174 - DNA, 22 bp, Homo sapiens
attagatgttacaagtttatat

SEQ ID NO: 1716175 - DNA, 22 bp, Homo sapiens
attagattttattttactattg

SEQ ID NO: 1716176 - DNA, 19 bp, Homo sapiens
attagcaggtgcaccttct

SEQ ID NO: 1716177 - DNA, 16 bp, Homo sapiens
attagcagttgctcac

SEQ ID NO: 1716178 - DNA, 20 bp, Homo sapiens
attagcagttgctcacatgt

SEQ ID NO: 1716179 - DNA, 20 bp, Homo sapiens
attagcatttgttttagcat

SEQ ID NO: 1716180 - DNA, 22 bp, Homo sapiens
attagccaactgtttccctgct

SEQ ID NO: 1716181 - DNA, 15 bp, Homo sapiens
attagccaggtaatg

SEQ ID NO: 1716182 - DNA, 21 bp, Homo sapiens
attagccgggcatgatggtgc

SEQ ID NO: 1716183 - DNA, 19 bp, Homo sapiens
attagccgggcatggtggc

SEQ ID NO: 1716184 - DNA, 18 bp, Homo sapiens
attagctcactgaatctt

SEQ ID NO: 1716185 - DNA, 14 bp, Homo sapiens
attaggaaaataaa

SEQ ID NO: 1716186 - DNA, 19 bp, Homo sapiens
attaggaaccttgcaacgg

SEQ ID NO: 1716187 - DNA, 22 bp, Homo sapiens
attaggaagtgtaacagctgag

SEQ ID NO: 1716188 - DNA, 22 bp, Homo sapiens
attaggacaatcagtcccctcc

SEQ ID NO: 1716189 - DNA, 21 bp, Homo sapiens
attaggatctgcaaacaatga

SEQ ID NO: 1716190 - DNA, 20 bp, Homo sapiens
attaggcaaggctatgtgat

SEQ ID NO: 1716191 - DNA, 14 bp, Homo sapiens
attaggcacacaga

SEQ ID NO: 1716192 - DNA, 15 bp, Homo sapiens
attaggcacacagat

SEQ ID NO: 1716193 - DNA, 21 bp, Homo sapiens
attaggctgtaactactttat

SEQ ID NO: 1716194 - DNA, 14 bp, Homo sapiens
attaggtagacttt

SEQ ID NO: 1716195 - DNA, 15 bp, Homo sapiens
attaggtagcacagc

SEQ ID NO: 1716196 - DNA, 16 bp, Homo sapiens
attaggtagcacagca

SEQ ID NO: 1716197 - DNA, 21 bp, Homo sapiens
attaggttatgctatttggac

SEQ ID NO: 1716198 - DNA, 19 bp, Homo sapiens
attagtatggttcaagatt

SEQ ID NO: 1716199 - DNA, 19 bp, Homo sapiens
attagtatgtctgtttttg

SEQ ID NO: 1716200 - DNA, 21 bp, Homo sapiens
attagtcgttatatttgactt

SEQ ID NO: 1716201 - DNA, 13 bp, Homo sapiens
attagtctgaaac

SEQ ID NO: 1716202 - DNA, 16 bp, Homo sapiens
attagtgattctgatt

SEQ ID NO: 1716203 - DNA, 22 bp, Homo sapiens
attagtgattctgatttcagtt

SEQ ID NO: 1716204 - DNA, 18 bp, Homo sapiens
attagtgccagaatttta

SEQ ID NO: 1716205 - DNA, 22 bp, Homo sapiens
attagtgccagaattttaggaa

SEQ ID NO: 1716206 - DNA, 20 bp, Homo sapiens
attagttccagtttctcctt

SEQ ID NO: 1716207 - DNA, 21 bp, Homo sapiens
attagttccagtttctccttg

SEQ ID NO: 1716208 - DNA, 17 bp, Homo sapiens
attagttctttttgcca

SEQ ID NO: 1716209 - DNA, 22 bp, Homo sapiens
attagttgaaaggcctcaagaa

SEQ ID NO: 1716210 - DNA, 13 bp, Homo sapiens
attagttgcacta

SEQ ID NO: 1716211 - DNA, 15 bp, Homo sapiens
attagtttaaaatgc

SEQ ID NO: 1716212 - DNA, 20 bp, Homo sapiens
attataaaaaatgtaacatc

SEQ ID NO: 1716213 - DNA, 22 bp, Homo sapiens
attataaacaagaatgaaggtt

SEQ ID NO: 1716214 - DNA, 19 bp, Homo sapiens
attataaactataaactta

SEQ ID NO: 1716215 - DNA, 15 bp, Homo sapiens
attataaatgacaac

SEQ ID NO: 1716216 - DNA, 16 bp, Homo sapiens
attataacaactattt

SEQ ID NO: 1716217 - DNA, 15 bp, Homo sapiens
attataacttaaaat

SEQ ID NO: 1716218 - DNA, 23 bp, Homo sapiens
attataagggagagctgagccag

SEQ ID NO: 1716219 - DNA, 13 bp, Homo sapiens
gcctacaataaaa

SEQ ID NO: 1716220 - DNA, 16 bp, Homo sapiens
gcctacaataaaaaga

SEQ ID NO: 1716221 - DNA, 22 bp, Homo sapiens
gcctacagctttgatccctgac

SEQ ID NO: 1716222 - DNA, 23 bp, Homo sapiens
gcctacagctttgatccctgaca

SEQ ID NO: 1716223 - DNA, 14 bp, Homo sapiens
gcctaccccgcaga

SEQ ID NO: 1716224 - DNA, 12 bp, Homo sapiens
gcctactcacga

SEQ ID NO: 1716225 - DNA, 14 bp, Homo sapiens
gcctactgtccctc

SEQ ID NO: 1716226 - DNA, 18 bp, Homo sapiens
gcctagaaatatctttct

SEQ ID NO: 1716227 - DNA, 15 bp, Homo sapiens
gcctagactgttact

SEQ ID NO: 1716228 - DNA, 17 bp, Homo sapiens
gcctagatccacacaca

SEQ ID NO: 1716229 - DNA, 15 bp, Homo sapiens
gcctagccacctccc

SEQ ID NO: 1716230 - DNA, 18 bp, Homo sapiens
gcctagccacctcccacc

SEQ ID NO: 1716231 - DNA, 21 bp, Homo sapiens
gcctagccacctcccacccca

SEQ ID NO: 1716232 - DNA, 20 bp, Homo sapiens
gcctagccgacctcagcctt

SEQ ID NO: 1716233 - DNA, 17 bp, Homo sapiens
gcctagcggagcccagc

SEQ ID NO: 1716234 - DNA, 15 bp, Homo sapiens
gcctagctcctgcca

SEQ ID NO: 1716235 - DNA, 20 bp, Homo sapiens
gcctagctcctgccacatgg

SEQ ID NO: 1716236 - DNA, 20 bp, Homo sapiens
gcctaggagatatctgaggg

SEQ ID NO: 1716237 - DNA, 16 bp, Homo sapiens
gcctaggagctggctg

SEQ ID NO: 1716238 - DNA, 18 bp, Homo sapiens
gcctaggagctggctggc

SEQ ID NO: 1716239 - DNA, 20 bp, Homo sapiens
gcctaggagctggctggcag

SEQ ID NO: 1716240 - DNA, 22 bp, Homo sapiens
gcctaggagctggctggcaggt

SEQ ID NO: 1716241 - DNA, 14 bp, Homo sapiens
gcctaggattctaa

SEQ ID NO: 1716242 - DNA, 17 bp, Homo sapiens
gcctagggcagacaata

SEQ ID NO: 1716243 - DNA, 16 bp, Homo sapiens
gcctaggggccagggc

SEQ ID NO: 1716244 - DNA, 19 bp, Homo sapiens
gcctagtggggtctccctc

SEQ ID NO: 1716245 - DNA, 17 bp, Homo sapiens
gcctagttcatccaatc

SEQ ID NO: 1716246 - DNA, 19 bp, Homo sapiens
gcctataatcccagctact

SEQ ID NO: 1716247 - DNA, 13 bp, Homo sapiens
gcctatagtccca

SEQ ID NO: 1716248 - DNA, 15 bp, Homo sapiens
gcctatattttcctg

SEQ ID NO: 1716249 - DNA, 13 bp, Homo sapiens
gcctatccgctgc

SEQ ID NO: 1716250 - DNA, 18 bp, Homo sapiens
gcctatccgctgccagcc

SEQ ID NO: 1716251 - DNA, 20 bp, Homo sapiens
gcctattatattaaaatatg

SEQ ID NO: 1716252 - DNA, 22 bp, Homo sapiens
gcctattccaggaattcctctt

SEQ ID NO: 1716253 - DNA, 21 bp, Homo sapiens
gcctcaaaacgggtcagtatt

SEQ ID NO: 1716254 - DNA, 13 bp, Homo sapiens
gcctcaactccag

SEQ ID NO: 1716255 - DNA, 22 bp, Homo sapiens
gcctcaaggatacagggagccg

SEQ ID NO: 1716256 - DNA, 21 bp, Homo sapiens
gcctcaaggttttaggttcta

SEQ ID NO: 1716257 - DNA, 21 bp, Homo sapiens
gcctcaatgtgaatcagaccc

SEQ ID NO: 1716258 - DNA, 16 bp, Homo sapiens
gcctcacagaagaata

SEQ ID NO: 1716259 - DNA, 20 bp, Homo sapiens
gcctcacccacccctgcaca

SEQ ID NO: 1716260 - DNA, 20 bp, Homo sapiens
gcctcactactcgagcccac

SEQ ID NO: 1716261 - DNA, 20 bp, Homo sapiens
gcctcactatgttgcctagg

SEQ ID NO: 1716262 - DNA, 15 bp, Homo sapiens
gcctcactggctggg

SEQ ID NO: 1716263 - DNA, 16 bp, Homo sapiens
gcctcactggctgggg

SEQ ID NO: 1716264 - DNA, 20 bp, Homo sapiens
gcctcacttgaatgtgtcac

SEQ ID NO: 1716265 - DNA, 20 bp, Homo sapiens
gcctcagaaggccccagaga

SEQ ID NO: 1716266 - DNA, 15 bp, Homo sapiens
gcctcagactccgcc

SEQ ID NO: 1716267 - DNA, 18 bp, Homo sapiens
gcctcagactccgccctc

SEQ ID NO: 1716268 - DNA, 12 bp, Homo sapiens
gcctcagagacc

SEQ ID NO: 1716269 - DNA, 17 bp, Homo sapiens
gcctcagagaccagggc

SEQ ID NO: 1716270 - DNA, 13 bp, Homo sapiens
gcctcagatccag

SEQ ID NO: 1716271 - DNA, 22 bp, Homo sapiens
gcctcagatccaggcaggagca

SEQ ID NO: 1716272 - DNA, 19 bp, Homo sapiens
gcctcagccagtggcacag

SEQ ID NO: 1716273 - DNA, 15 bp, Homo sapiens
gcctcagcctcctga

SEQ ID NO: 1716274 - DNA, 15 bp, Homo sapiens
gcctcagcgtcctgg

SEQ ID NO: 1716275 - DNA, 15 bp, Homo sapiens
gcctcagctgcctca

SEQ ID NO: 1716276 - DNA, 18 bp, Homo sapiens
gcctcaggccagggctca

SEQ ID NO: 1716277 - DNA, 21 bp, Homo sapiens
gcctcaggcgtttctgaagtg

SEQ ID NO: 1716278 - DNA, 12 bp, Homo sapiens
gcctcaggctct

SEQ ID NO: 1716279 - DNA, 13 bp, Homo sapiens
gcctcaggctctg

SEQ ID NO: 1716280 - DNA, 15 bp, Homo sapiens
gcctcaggctctgca

SEQ ID NO: 1716281 - DNA, 16 bp, Homo sapiens
gcctcaggctctgcac

SEQ ID NO: 1716282 - DNA, 16 bp, Homo sapiens
gcctcagtgccacttg

SEQ ID NO: 1716283 - DNA, 20 bp, Homo sapiens
gcctcagtggctctgggtac

SEQ ID NO: 1716284 - DNA, 19 bp, Homo sapiens
gcctcagttcccagctccc

SEQ ID NO: 1716285 - DNA, 20 bp, Homo sapiens
gcctcagttcccagctcccc

SEQ ID NO: 1716286 - DNA, 23 bp, Homo sapiens
gcctcagttcccagctccccccg

SEQ ID NO: 1716287 - DNA, 20 bp, Homo sapiens
gcctcagtttctccatcagc

SEQ ID NO: 1716288 - DNA, 15 bp, Homo sapiens
gcctcagttttcctt

SEQ ID NO: 1716289 - DNA, 17 bp, Homo sapiens
gcctcagttttccttct

SEQ ID NO: 1716290 - DNA, 24 bp, Homo sapiens
gcctcatccctcggaagccgtctg

SEQ ID NO: 1716291 - DNA, 15 bp, Homo sapiens
gcctcatgtggctgg

SEQ ID NO: 1716292 - DNA, 18 bp, Homo sapiens
gcctcatgtggctggaag

SEQ ID NO: 1716293 - DNA, 14 bp, Homo sapiens
gcctcatgttctgt

SEQ ID NO: 1716294 - DNA, 22 bp, Homo sapiens
gcctccaaagtggagctgggag

SEQ ID NO: 1716295 - DNA, 17 bp, Homo sapiens
gcctccaacgcccctgt

SEQ ID NO: 1716296 - DNA, 23 bp, Homo sapiens
gcctccaacgcccctgtggccaa

SEQ ID NO: 1716297 - DNA, 22 bp, Homo sapiens
gcctccaaggaggggctgtaaa

SEQ ID NO: 1716298 - DNA, 20 bp, Homo sapiens
gcctccaatgcattggcctc

SEQ ID NO: 1716299 - DNA, 23 bp, Homo sapiens
gcctccaatgcattggcctctgt

SEQ ID NO: 1716300 - DNA, 12 bp, Homo sapiens
gcctccacactg

SEQ ID NO: 1716301 - DNA, 21 bp, Homo sapiens
gcctccacactgaccaagtgc

SEQ ID NO: 1716302 - DNA, 22 bp, Homo sapiens
gcctccacagcgagggcagctg

SEQ ID NO: 1716303 - DNA, 14 bp, Homo sapiens
gcctccaccaccac

SEQ ID NO: 1716304 - DNA, 15 bp, Homo sapiens
gcctccaccaccact

SEQ ID NO: 1716305 - DNA, 21 bp, Homo sapiens
gcctccaccaccactggccac

SEQ ID NO: 1716306 - DNA, 12 bp, Homo sapiens
gcctccaccagc

SEQ ID NO: 1716307 - DNA, 18 bp, Homo sapiens
gcctccaccgctgcctaa

SEQ ID NO: 1716308 - DNA, 19 bp, Homo sapiens
gcctccactctagttctag

SEQ ID NO: 1716309 - DNA, 15 bp, Homo sapiens
gcctccacttccctc

SEQ ID NO: 1716310 - DNA, 21 bp, Homo sapiens
gcctccagaagctgctccttt

SEQ ID NO: 1716311 - DNA, 11 bp, Homo sapiens
gcctccagagg

SEQ ID NO: 1716312 - DNA, 22 bp, Homo sapiens
gcctccagaggggctcaggtca

SEQ ID NO: 1716313 - DNA, 16 bp, Homo sapiens
gcctccagaggtcctc

SEQ ID NO: 1716314 - DNA, 18 bp, Homo sapiens
gcctccagcctctcccgg

SEQ ID NO: 1716315 - DNA, 19 bp, Homo sapiens
gcctccagcctctcccggc

SEQ ID NO: 1716316 - DNA, 11 bp, Homo sapiens
gcctccagggc

SEQ ID NO: 1716317 - DNA, 23 bp, Homo sapiens
gcctccagggcattgctcagccc

SEQ ID NO: 1716318 - DNA, 13 bp, Homo sapiens
gcctccagggctg

SEQ ID NO: 1716319 - DNA, 18 bp, Homo sapiens
gcctccagggctggactg

SEQ ID NO: 1716320 - DNA, 20 bp, Homo sapiens
gcctccagggctggactgag

SEQ ID NO: 1716321 - DNA, 18 bp, Homo sapiens
gcctccaggtgcagaggt

SEQ ID NO: 1716322 - DNA, 21 bp, Homo sapiens
gcctccatgccccagctctgg

SEQ ID NO: 1716323 - DNA, 22 bp, Homo sapiens
gcctccatgccccagctctgga

SEQ ID NO: 1716324 - DNA, 18 bp, Homo sapiens
gcctccatggcagcagcc

SEQ ID NO: 1716325 - DNA, 17 bp, Homo sapiens
gcctccattcctggagc

SEQ ID NO: 1716326 - DNA, 21 bp, Homo sapiens
gcctccattcctggagcccga

SEQ ID NO: 1716327 - DNA, 17 bp, Homo sapiens
gcctccattctgaccat

SEQ ID NO: 1716328 - DNA, 17 bp, Homo sapiens
gcctcccaaagtgctgg

SEQ ID NO: 1716329 - DNA, 17 bp, Homo sapiens
gcctcccaaccccaggg

SEQ ID NO: 1716330 - DNA, 19 bp, Homo sapiens
gcctcccaaggtcctctca

SEQ ID NO: 1716331 - DNA, 20 bp, Homo sapiens
gcctcccaccagagccggga

SEQ ID NO: 1716332 - DNA, 17 bp, Homo sapiens
gcctcccacccccatct

SEQ ID NO: 1716333 - DNA, 20 bp, Homo sapiens
gcctcccacccgatgctgct

SEQ ID NO: 1716334 - DNA, 21 bp, Homo sapiens
gcctcccacccgatgctgctt

SEQ ID NO: 1716335 - DNA, 14 bp, Homo sapiens
attataagttctat

SEQ ID NO: 1716336 - DNA, 17 bp, Homo sapiens
attataagttctatttt

SEQ ID NO: 1716337 - DNA, 20 bp, Homo sapiens
attataagttctattttact

SEQ ID NO: 1716338 - DNA, 22 bp, Homo sapiens
attataagttctattttactgt

SEQ ID NO: 1716339 - DNA, 17 bp, Homo sapiens
attataatatgtgcctt

SEQ ID NO: 1716340 - DNA, 15 bp, Homo sapiens
attataatctcaaag

SEQ ID NO: 1716341 - DNA, 13 bp, Homo sapiens
attataattgttg

SEQ ID NO: 1716342 - DNA, 17 bp, Homo sapiens
attataatttaatgcat

SEQ ID NO: 1716343 - DNA, 23 bp, Homo sapiens
attataatttttttcaatattta

SEQ ID NO: 1716344 - DNA, 16 bp, Homo sapiens
attatacttgagattt

SEQ ID NO: 1716345 - DNA, 23 bp, Homo sapiens
attatacttgagattttcctcca

SEQ ID NO: 1716346 - DNA, 21 bp, Homo sapiens
attatagaaaattatttgtat

SEQ ID NO: 1716347 - DNA, 14 bp, Homo sapiens
attatagagcagaa

SEQ ID NO: 1716348 - DNA, 17 bp, Homo sapiens
attatagagcagaaatt

SEQ ID NO: 1716349 - DNA, 13 bp, Homo sapiens
attatagattcta

SEQ ID NO: 1716350 - DNA, 15 bp, Homo sapiens
attatagcaacttta

SEQ ID NO: 1716351 - DNA, 17 bp, Homo sapiens
attataggagccttaat

SEQ ID NO: 1716352 - DNA, 17 bp, Homo sapiens
attataggatcatttgt

SEQ ID NO: 1716353 - DNA, 18 bp, Homo sapiens
attatataaaatacataa

SEQ ID NO: 1716354 - DNA, 19 bp, Homo sapiens
attatataactgtatttga

SEQ ID NO: 1716355 - DNA, 17 bp, Homo sapiens
attatataagtattcta

SEQ ID NO: 1716356 - DNA, 20 bp, Homo sapiens
attatataggatattgctaa

SEQ ID NO: 1716357 - DNA, 14 bp, Homo sapiens
attatatattttgt

SEQ ID NO: 1716358 - DNA, 17 bp, Homo sapiens
attatatgcctgattca

SEQ ID NO: 1716359 - DNA, 13 bp, Homo sapiens
attatattaaaat

SEQ ID NO: 1716360 - DNA, 14 bp, Homo sapiens
attatattcacaga

SEQ ID NO: 1716361 - DNA, 21 bp, Homo sapiens
attatattttgttgctttctt

SEQ ID NO: 1716362 - DNA, 17 bp, Homo sapiens
attatcaatatctaata

SEQ ID NO: 1716363 - DNA, 20 bp, Homo sapiens
attatcacattaatctcaaa

SEQ ID NO: 1716364 - DNA, 13 bp, Homo sapiens
attatcagcaaag

SEQ ID NO: 1716365 - DNA, 12 bp, Homo sapiens
attatcattgct

SEQ ID NO: 1716366 - DNA, 16 bp, Homo sapiens
attatcggaagcagtg

SEQ ID NO: 1716367 - DNA, 20 bp, Homo sapiens
attatcgggaacagtgtttc

SEQ ID NO: 1716368 - DNA, 22 bp, Homo sapiens
attatcgggaacagtgtttccc

SEQ ID NO: 1716369 - DNA, 19 bp, Homo sapiens
attatcgggagcagtgtct

SEQ ID NO: 1716370 - DNA, 19 bp, Homo sapiens
attatctaaaatctgctag

SEQ ID NO: 1716371 - DNA, 12 bp, Homo sapiens
attatctctttg

SEQ ID NO: 1716372 - DNA, 20 bp, Homo sapiens
attatcttcaccctcatcct

SEQ ID NO: 1716373 - DNA, 21 bp, Homo sapiens
attatcttcaccctcatcctt

SEQ ID NO: 1716374 - DNA, 18 bp, Homo sapiens
attatcttggaaagaaac

SEQ ID NO: 1716375 - DNA, 14 bp, Homo sapiens
attatgacagttat

SEQ ID NO: 1716376 - DNA, 16 bp, Homo sapiens
attatgacagttatac

SEQ ID NO: 1716377 - DNA, 11 bp, Homo sapiens
attatgagcca

SEQ ID NO: 1716378 - DNA, 12 bp, Homo sapiens
attatgatattt

SEQ ID NO: 1716379 - DNA, 18 bp, Homo sapiens
attatgatctaataaact

SEQ ID NO: 1716380 - DNA, 18 bp, Homo sapiens
attatgatgcatacagtt

SEQ ID NO: 1716381 - DNA, 14 bp, Homo sapiens
attatgcaaaagca

SEQ ID NO: 1716382 - DNA, 15 bp, Homo sapiens
attatgcaaaagcag

SEQ ID NO: 1716383 - DNA, 17 bp, Homo sapiens
attatgcaaaagcagct

SEQ ID NO: 1716384 - DNA, 14 bp, Homo sapiens
attatgccactgct

SEQ ID NO: 1716385 - DNA, 21 bp, Homo sapiens
attatgcctgagttataaata

SEQ ID NO: 1716386 - DNA, 17 bp, Homo sapiens
attatggaagattttaa

SEQ ID NO: 1716387 - DNA, 15 bp, Homo sapiens
attatggcatttcta

SEQ ID NO: 1716388 - DNA, 17 bp, Homo sapiens
attatggcatttctatt

SEQ ID NO: 1716389 - DNA, 16 bp, Homo sapiens
attatgggtcacagga

SEQ ID NO: 1716390 - DNA, 19 bp, Homo sapiens
attatggtagaatcatttt

SEQ ID NO: 1716391 - DNA, 18 bp, Homo sapiens
attatgtaatatattgta

SEQ ID NO: 1716392 - DNA, 19 bp, Homo sapiens
attatgtaatatattgtac

SEQ ID NO: 1716393 - DNA, 18 bp, Homo sapiens
attatgtaccatgaatat

SEQ ID NO: 1716394 - DNA, 14 bp, Homo sapiens
attatgtatggata

SEQ ID NO: 1716395 - DNA, 21 bp, Homo sapiens
attatgtatggatatatttga

SEQ ID NO: 1716396 - DNA, 15 bp, Homo sapiens
attatgtcaaccagg

SEQ ID NO: 1716397 - DNA, 19 bp, Homo sapiens
attatgtccactgtgtata

SEQ ID NO: 1716398 - DNA, 12 bp, Homo sapiens
attatgtcttct

SEQ ID NO: 1716399 - DNA, 16 bp, Homo sapiens
attatgtggttttaga

SEQ ID NO: 1716400 - DNA, 17 bp, Homo sapiens
attatgtggttttagat

SEQ ID NO: 1716401 - DNA, 18 bp, Homo sapiens
attatgtttattacaatt

SEQ ID NO: 1716402 - DNA, 22 bp, Homo sapiens
attatgtttccgaggcactgtt

SEQ ID NO: 1716403 - DNA, 23 bp, Homo sapiens
attattaaattgtaaaactccaa

SEQ ID NO: 1716404 - DNA, 14 bp, Homo sapiens
attattagagattt

SEQ ID NO: 1716405 - DNA, 23 bp, Homo sapiens
attattagcatttgttttagcat

SEQ ID NO: 1716406 - DNA, 15 bp, Homo sapiens
attattagtactgct

SEQ ID NO: 1716407 - DNA, 15 bp, Homo sapiens
attattatgttctta

SEQ ID NO: 1716408 - DNA, 15 bp, Homo sapiens
attattatgtttatt

SEQ ID NO: 1716409 - DNA, 15 bp, Homo sapiens
attattattcttcat

SEQ ID NO: 1716410 - DNA, 14 bp, Homo sapiens
attattatttctgt

SEQ ID NO: 1716411 - DNA, 15 bp, Homo sapiens
attattatttctgtt

SEQ ID NO: 1716412 - DNA, 20 bp, Homo sapiens
attattattttaaaatatat

SEQ ID NO: 1716413 - DNA, 13 bp, Homo sapiens
attattcaacaca

SEQ ID NO: 1716414 - DNA, 21 bp, Homo sapiens
attattcaagaatgaaaaata

SEQ ID NO: 1716415 - DNA, 13 bp, Homo sapiens
attattcatttaa

SEQ ID NO: 1716416 - DNA, 22 bp, Homo sapiens
attattctagtcaactgctgtt

SEQ ID NO: 1716417 - DNA, 13 bp, Homo sapiens
attattctgcagc

SEQ ID NO: 1716418 - DNA, 15 bp, Homo sapiens
attattctgttttgc

SEQ ID NO: 1716419 - DNA, 12 bp, Homo sapiens
attattcttgta

SEQ ID NO: 1716420 - DNA, 13 bp, Homo sapiens
attattcttgtag

SEQ ID NO: 1716421 - DNA, 13 bp, Homo sapiens
attattctttctc

SEQ ID NO: 1716422 - DNA, 13 bp, Homo sapiens
attattgaatgtt

SEQ ID NO: 1716423 - DNA, 20 bp, Homo sapiens
attattgaatgttatatcat

SEQ ID NO: 1716424 - DNA, 12 bp, Homo sapiens
attattgcatta

SEQ ID NO: 1716425 - DNA, 13 bp, Homo sapiens
attattgctgttg

SEQ ID NO: 1716426 - DNA, 17 bp, Homo sapiens
attattgtgacttcact

SEQ ID NO: 1716427 - DNA, 19 bp, Homo sapiens
attattgtgacttcactgt

SEQ ID NO: 1716428 - DNA, 21 bp, Homo sapiens
attattgtgacttcactgtat

SEQ ID NO: 1716429 - DNA, 22 bp, Homo sapiens
attattgttcccctaagtggat

SEQ ID NO: 1716430 - DNA, 21 bp, Homo sapiens
attatttattgtattaggaaa

SEQ ID NO: 1716431 - DNA, 16 bp, Homo sapiens
attatttcaccagcag

SEQ ID NO: 1716432 - DNA, 17 bp, Homo sapiens
attatttcaccagcagc

SEQ ID NO: 1716433 - DNA, 18 bp, Homo sapiens
attatttcactttagatg

SEQ ID NO: 1716434 - DNA, 19 bp, Homo sapiens
attatttctaatccttttc

SEQ ID NO: 1716435 - DNA, 21 bp, Homo sapiens
attatttctgttcttacaaat

SEQ ID NO: 1716436 - DNA, 15 bp, Homo sapiens
attatttcttctctt

SEQ ID NO: 1716437 - DNA, 14 bp, Homo sapiens
attatttgcttttc

SEQ ID NO: 1716438 - DNA, 20 bp, Homo sapiens
attatttgcttttcatgtag

SEQ ID NO: 1716439 - DNA, 23 bp, Homo sapiens
attatttggagcctgccaagagg

SEQ ID NO: 1716440 - DNA, 12 bp, Homo sapiens
attatttgtgtt

SEQ ID NO: 1716441 - DNA, 15 bp, Homo sapiens
attatttgtgtttta

SEQ ID NO: 1716442 - DNA, 18 bp, Homo sapiens
attattttaatattttgt

SEQ ID NO: 1716443 - DNA, 15 bp, Homo sapiens
attattttactgctt

SEQ ID NO: 1716444 - DNA, 10 bp, Homo sapiens
attattttct

SEQ ID NO: 1716445 - DNA, 16 bp, Homo sapiens
attattttgaatgtca

SEQ ID NO: 1716446 - DNA, 20 bp, Homo sapiens
attattttggtacttttatg

SEQ ID NO: 1716447 - DNA, 15 bp, Homo sapiens
attattttgttcata

SEQ ID NO: 1716448 - DNA, 19 bp, Homo sapiens
attatttttataattgtac

SEQ ID NO: 1716449 - DNA, 14 bp, Homo sapiens
attatttttgtaga

SEQ ID NO: 1716450 - DNA, 18 bp, Homo sapiens
attatttttgtgtttcta

SEQ ID NO: 1716451 - DNA, 20 bp, Homo sapiens
attatttttgttagcaaaga

SEQ ID NO: 1716452 - DNA, 17 bp, Homo sapiens
attatttttttaaaatt

SEQ ID NO: 1716453 - DNA, 23 bp, Homo sapiens
gcctcccacccgatgctgctttc

SEQ ID NO: 1716454 - DNA, 15 bp, Homo sapiens
gcctcccaggcaagc

SEQ ID NO: 1716455 - DNA, 20 bp, Homo sapiens
gcctcccaggcaagcagctg

SEQ ID NO: 1716456 - DNA, 13 bp, Homo sapiens
gcctccccatttc

SEQ ID NO: 1716457 - DNA, 21 bp, Homo sapiens
gcctccccatttcccatctgc

SEQ ID NO: 1716458 - DNA, 22 bp, Homo sapiens
gcctccccatttcccatctgca

SEQ ID NO: 1716459 - DNA, 13 bp, Homo sapiens
gcctcccccaaag

SEQ ID NO: 1716460 - DNA, 14 bp, Homo sapiens
gcctcccccaaagc

SEQ ID NO: 1716461 - DNA, 16 bp, Homo sapiens
gcctcccccagccagg

SEQ ID NO: 1716462 - DNA, 17 bp, Homo sapiens
gcctcccccgccagccc

SEQ ID NO: 1716463 - DNA, 22 bp, Homo sapiens
gcctccccctcccccattccct

SEQ ID NO: 1716464 - DNA, 15 bp, Homo sapiens
gcctcccctgccacc

SEQ ID NO: 1716465 - DNA, 16 bp, Homo sapiens
gcctcccctgccacca

SEQ ID NO: 1716466 - DNA, 19 bp, Homo sapiens
gcctcccctgccaccaggc

SEQ ID NO: 1716467 - DNA, 23 bp, Homo sapiens
gcctcccctgggttaacaaatga

SEQ ID NO: 1716468 - DNA, 16 bp, Homo sapiens
gcctccctagccagca

SEQ ID NO: 1716469 - DNA, 20 bp, Homo sapiens
gcctccctagttagcatcca

SEQ ID NO: 1716470 - DNA, 16 bp, Homo sapiens
attcaaactgctccaa

SEQ ID NO: 1716471 - DNA, 17 bp, Homo sapiens
attcaaactggggcctc

SEQ ID NO: 1716472 - DNA, 22 bp, Homo sapiens
attcaaactggggcctccagaa

SEQ ID NO: 1716473 - DNA, 17 bp, Homo sapiens
attcaaagctctattaa

SEQ ID NO: 1716474 - DNA, 14 bp, Homo sapiens
attcaaaggttcta

SEQ ID NO: 1716475 - DNA, 16 bp, Homo sapiens
attcaaaggttctagg

SEQ ID NO: 1716476 - DNA, 18 bp, Homo sapiens
attcaaaggttctaggtt

SEQ ID NO: 1716477 - DNA, 22 bp, Homo sapiens
attcaaagtgttgtgttcctgg

SEQ ID NO: 1716478 - DNA, 14 bp, Homo sapiens
attcaaatcagtga

SEQ ID NO: 1716479 - DNA, 16 bp, Homo sapiens
attcaaattgctgctt

SEQ ID NO: 1716480 - DNA, 15 bp, Homo sapiens
attcaaatttgtaca

SEQ ID NO: 1716481 - DNA, 16 bp, Homo sapiens
attcaacaatttcaat

SEQ ID NO: 1716482 - DNA, 17 bp, Homo sapiens
attcaacaatttcaata

SEQ ID NO: 1716483 - DNA, 14 bp, Homo sapiens
attcaactttgtaa

SEQ ID NO: 1716484 - DNA, 19 bp, Homo sapiens
attcaacttttctaagaaa

SEQ ID NO: 1716485 - DNA, 22 bp, Homo sapiens
attcaagaaaacaacttcaata

SEQ ID NO: 1716486 - DNA, 15 bp, Homo sapiens
attcaagaaaataaa

SEQ ID NO: 1716487 - DNA, 16 bp, Homo sapiens
attcaagaatgaaaaa

SEQ ID NO: 1716488 - DNA, 22 bp, Homo sapiens
attcaagcctgtgaataaaaac

SEQ ID NO: 1716489 - DNA, 15 bp, Homo sapiens
attcaagctatttaa

SEQ ID NO: 1716490 - DNA, 18 bp, Homo sapiens
attcaaggctcagaagga

SEQ ID NO: 1716491 - DNA, 21 bp, Homo sapiens
attcaagtgacacattaatga

SEQ ID NO: 1716492 - DNA, 21 bp, Homo sapiens
attcaataaaaaaaagaaatg

SEQ ID NO: 1716493 - DNA, 22 bp, Homo sapiens
attcaataaaatactattcttt

SEQ ID NO: 1716494 - DNA, 21 bp, Homo sapiens
attcaatattgacatttgtag

SEQ ID NO: 1716495 - DNA, 16 bp, Homo sapiens
attcaatctgtaaact

SEQ ID NO: 1716496 - DNA, 17 bp, Homo sapiens
attcaatctgtaaactg

SEQ ID NO: 1716497 - DNA, 22 bp, Homo sapiens
attcaatctgtaaactgtgtat

SEQ ID NO: 1716498 - DNA, 22 bp, Homo sapiens
attcaatgaacttccatttgta

SEQ ID NO: 1716499 - DNA, 13 bp, Homo sapiens
attcaatgtattg

SEQ ID NO: 1716500 - DNA, 22 bp, Homo sapiens
attcaatgtttatgcaaggaag

SEQ ID NO: 1716501 - DNA, 24 bp, Homo sapiens
attcaattagtggtcataaaatag

SEQ ID NO: 1716502 - DNA, 14 bp, Homo sapiens
attcaattcctctg

SEQ ID NO: 1716503 - DNA, 12 bp, Homo sapiens
attcacacaccc

SEQ ID NO: 1716504 - DNA, 22 bp, Homo sapiens
attcacacacccctcaaaaaaa

SEQ ID NO: 1716505 - DNA, 14 bp, Homo sapiens
attcacagactgat

SEQ ID NO: 1716506 - DNA, 22 bp, Homo sapiens
attcacagtggtcccatttata

SEQ ID NO: 1716507 - DNA, 23 bp, Homo sapiens
attcacagttctttgggccagac

SEQ ID NO: 1716508 - DNA, 18 bp, Homo sapiens
attcacatttgatgtaca

SEQ ID NO: 1716509 - DNA, 21 bp, Homo sapiens
attcacatttgatgtacatgt

SEQ ID NO: 1716510 - DNA, 14 bp, Homo sapiens
attcacccctgccc

SEQ ID NO: 1716511 - DNA, 15 bp, Homo sapiens
attcaccctccactt

SEQ ID NO: 1716512 - DNA, 17 bp, Homo sapiens
attcaccctccacttcc

SEQ ID NO: 1716513 - DNA, 19 bp, Homo sapiens
attcaccctccacttcccg

SEQ ID NO: 1716514 - DNA, 20 bp, Homo sapiens
attcaccctccacttcccgt

SEQ ID NO: 1716515 - DNA, 16 bp, Homo sapiens
attcacctcttcctct

SEQ ID NO: 1716516 - DNA, 18 bp, Homo sapiens
attcacctttttaataaa

SEQ ID NO: 1716517 - DNA, 22 bp, Homo sapiens
attcacctttttaataaaaata

SEQ ID NO: 1716518 - DNA, 16 bp, Homo sapiens
attcacgccgtaattc

SEQ ID NO: 1716519 - DNA, 23 bp, Homo sapiens
attcacgccgtaattctttctgt

SEQ ID NO: 1716520 - DNA, 14 bp, Homo sapiens
attcacgcttttgt

SEQ ID NO: 1716521 - DNA, 19 bp, Homo sapiens
attcacgtgctttgtgttc

SEQ ID NO: 1716522 - DNA, 20 bp, Homo sapiens
attcacgtgctttgtgttca

SEQ ID NO: 1716523 - DNA, 14 bp, Homo sapiens
attcactccagtca

SEQ ID NO: 1716524 - DNA, 16 bp, Homo sapiens
attcactccagtcaac

SEQ ID NO: 1716525 - DNA, 23 bp, Homo sapiens
attcactccagtcaacagattca

SEQ ID NO: 1716526 - DNA, 12 bp, Homo sapiens
attcactcccac

SEQ ID NO: 1716527 - DNA, 21 bp, Homo sapiens
attcactcccacacccaagaa

SEQ ID NO: 1716528 - DNA, 13 bp, Homo sapiens
attcactggcccc

SEQ ID NO: 1716529 - DNA, 15 bp, Homo sapiens
attcactgtaagttt

SEQ ID NO: 1716530 - DNA, 13 bp, Homo sapiens
attcagaaattgg

SEQ ID NO: 1716531 - DNA, 14 bp, Homo sapiens
attcagaaattgga

SEQ ID NO: 1716532 - DNA, 18 bp, Homo sapiens
attcagaaggatcttcat

SEQ ID NO: 1716533 - DNA, 24 bp, Homo sapiens
attcagaaggatcttcatctgact

SEQ ID NO: 1716534 - DNA, 16 bp, Homo sapiens
attcagaatgagaatg

SEQ ID NO: 1716535 - DNA, 15 bp, Homo sapiens
attcagacaacatta

SEQ ID NO: 1716536 - DNA, 18 bp, Homo sapiens
attcagacaacattatga

SEQ ID NO: 1716537 - DNA, 13 bp, Homo sapiens
attcagacaagca

SEQ ID NO: 1716538 - DNA, 20 bp, Homo sapiens
attcagactaaaaatacacc

SEQ ID NO: 1716539 - DNA, 13 bp, Homo sapiens
attcagaggcagt

SEQ ID NO: 1716540 - DNA, 20 bp, Homo sapiens
attcagaggcagtgatgact

SEQ ID NO: 1716541 - DNA, 19 bp, Homo sapiens
attcagagtatgtttttaa

SEQ ID NO: 1716542 - DNA, 16 bp, Homo sapiens
attcagatcactgaat

SEQ ID NO: 1716543 - DNA, 17 bp, Homo sapiens
attcagattgttatcta

SEQ ID NO: 1716544 - DNA, 15 bp, Homo sapiens
attcagcaaaccatt

SEQ ID NO: 1716545 - DNA, 12 bp, Homo sapiens
attcagcacaca

SEQ ID NO: 1716546 - DNA, 20 bp, Homo sapiens
attcagcactgatttcacaa

SEQ ID NO: 1716547 - DNA, 20 bp, Homo sapiens
attcagcagcaaattttcag

SEQ ID NO: 1716548 - DNA, 14 bp, Homo sapiens
attcagcagtgcct

SEQ ID NO: 1716549 - DNA, 23 bp, Homo sapiens
attcagcatctactctaaagaaa

SEQ ID NO: 1716550 - DNA, 19 bp, Homo sapiens
attcagcatgtccaacatg

SEQ ID NO: 1716551 - DNA, 15 bp, Homo sapiens
attcagccagcttaa

SEQ ID NO: 1716552 - DNA, 17 bp, Homo sapiens
attcagccagcttaaac

SEQ ID NO: 1716553 - DNA, 20 bp, Homo sapiens
attcagccctcagaagaaaa

SEQ ID NO: 1716554 - DNA, 22 bp, Homo sapiens
attcaggaaaactgacagagga

SEQ ID NO: 1716555 - DNA, 18 bp, Homo sapiens
attcaggacttgaaagaa

SEQ ID NO: 1716556 - DNA, 22 bp, Homo sapiens
attcaggagagtagaacagata

SEQ ID NO: 1716557 - DNA, 14 bp, Homo sapiens
attcaggccagccc

SEQ ID NO: 1716558 - DNA, 14 bp, Homo sapiens
attcaggtaacact

SEQ ID NO: 1716559 - DNA, 23 bp, Homo sapiens
attcaggtatgttgcctttatgg

SEQ ID NO: 1716560 - DNA, 12 bp, Homo sapiens
attcaggttttt

SEQ ID NO: 1716561 - DNA, 15 bp, Homo sapiens
attcaggtttttcct

SEQ ID NO: 1716562 - DNA, 19 bp, Homo sapiens
attcagtaataactctacc

SEQ ID NO: 1716563 - DNA, 23 bp, Homo sapiens
attcagtccgcctggccggctcc

SEQ ID NO: 1716564 - DNA, 18 bp, Homo sapiens
attcagtcctaagaaaga

SEQ ID NO: 1716565 - DNA, 22 bp, Homo sapiens
attcagtctcagctgctgaaat

SEQ ID NO: 1716566 - DNA, 14 bp, Homo sapiens
attcagtcttctgg

SEQ ID NO: 1716567 - DNA, 15 bp, Homo sapiens
attcagtgagggtct

SEQ ID NO: 1716568 - DNA, 17 bp, Homo sapiens
attcagtgctgtggcct

SEQ ID NO: 1716569 - DNA, 22 bp, Homo sapiens
attcagtgctgtggcctgggca

SEQ ID NO: 1716570 - DNA, 15 bp, Homo sapiens
gcctctgggcagtgt

SEQ ID NO: 1716571 - DNA, 19 bp, Homo sapiens
gcctctgggcagtgtggcc

SEQ ID NO: 1716572 - DNA, 20 bp, Homo sapiens
gcctctgtaccgcccggcag

SEQ ID NO: 1716573 - DNA, 21 bp, Homo sapiens
gcctctgtaccgcccggcagc

SEQ ID NO: 1716574 - DNA, 22 bp, Homo sapiens
gcctctgtaccgcccggcagcc

SEQ ID NO: 1716575 - DNA, 18 bp, Homo sapiens
gcctctgtcaggccttca

SEQ ID NO: 1716576 - DNA, 18 bp, Homo sapiens
gcctctgtccccttctct

SEQ ID NO: 1716577 - DNA, 19 bp, Homo sapiens
gcctctgtccccttctctc

SEQ ID NO: 1716578 - DNA, 20 bp, Homo sapiens
gcctctgtccccttctctca

SEQ ID NO: 1716579 - DNA, 13 bp, Homo sapiens
gcctctgtgcaca

SEQ ID NO: 1716580 - DNA, 20 bp, Homo sapiens
gcctctgtgcacagtggctt

SEQ ID NO: 1716581 - DNA, 21 bp, Homo sapiens
gcctctgtgcacagtggcttc

SEQ ID NO: 1716582 - DNA, 14 bp, Homo sapiens
gcctctgtgctgtg

SEQ ID NO: 1716583 - DNA, 21 bp, Homo sapiens
gcctctgtggagccccagcat

SEQ ID NO: 1716584 - DNA, 16 bp, Homo sapiens
attcatgaggagggtg

SEQ ID NO: 1716585 - DNA, 21 bp, Homo sapiens
attcatgcaagagtttcttgt

SEQ ID NO: 1716586 - DNA, 22 bp, Homo sapiens
attcatgcaagagtttcttgta

SEQ ID NO: 1716587 - DNA, 15 bp, Homo sapiens
attcatgtattttgt

SEQ ID NO: 1716588 - DNA, 18 bp, Homo sapiens
attcatgttcatgtgatt

SEQ ID NO: 1716589 - DNA, 19 bp, Homo sapiens
attcatgttcatgtgatta

SEQ ID NO: 1716590 - DNA, 12 bp, Homo sapiens
attcatgtttct

SEQ ID NO: 1716591 - DNA, 23 bp, Homo sapiens
attcattcagtgagttaaacacg

SEQ ID NO: 1716592 - DNA, 23 bp, Homo sapiens
attcattgttttgcaaaagtgta

SEQ ID NO: 1716593 - DNA, 14 bp, Homo sapiens
attcatttaaaatg

SEQ ID NO: 1716594 - DNA, 14 bp, Homo sapiens
attcatttcatggt

SEQ ID NO: 1716595 - DNA, 15 bp, Homo sapiens
attcatttcctgccc

SEQ ID NO: 1716596 - DNA, 13 bp, Homo sapiens
attcatttggtga

SEQ ID NO: 1716597 - DNA, 12 bp, Homo sapiens
attcattttcct

SEQ ID NO: 1716598 - DNA, 24 bp, Homo sapiens
attcattttcctgttcagtgagat

SEQ ID NO: 1716599 - DNA, 13 bp, Homo sapiens
attccaaaaacat

SEQ ID NO: 1716600 - DNA, 15 bp, Homo sapiens
attccaaaccaggac

SEQ ID NO: 1716601 - DNA, 16 bp, Homo sapiens
attccaaaccaggaca

SEQ ID NO: 1716602 - DNA, 18 bp, Homo sapiens
attccaaagtctctaatt

SEQ ID NO: 1716603 - DNA, 22 bp, Homo sapiens
attccaactgggcatttcaatc

SEQ ID NO: 1716604 - DNA, 23 bp, Homo sapiens
attccaactgggcatttcaatcc

SEQ ID NO: 1716605 - DNA, 22 bp, Homo sapiens
attccaagtgcatttttcttat

SEQ ID NO: 1716606 - DNA, 13 bp, Homo sapiens
attccaatctaca

SEQ ID NO: 1716607 - DNA, 15 bp, Homo sapiens
attccaattctaaat

SEQ ID NO: 1716608 - DNA, 20 bp, Homo sapiens
attccacagggaccagggcc

SEQ ID NO: 1716609 - DNA, 20 bp, Homo sapiens
attccaccaggattaatctc

SEQ ID NO: 1716610 - DNA, 18 bp, Homo sapiens
attccaccattcacattt

SEQ ID NO: 1716611 - DNA, 16 bp, Homo sapiens
attccagaaaggatat

SEQ ID NO: 1716612 - DNA, 22 bp, Homo sapiens
attccagaagaagagaagctgc

SEQ ID NO: 1716613 - DNA, 23 bp, Homo sapiens
attccagaagaagagaagctgct

SEQ ID NO: 1716614 - DNA, 19 bp, Homo sapiens
attccagatctttcagaaa

SEQ ID NO: 1716615 - DNA, 22 bp, Homo sapiens
attccagatgagtcagtctctt

SEQ ID NO: 1716616 - DNA, 20 bp, Homo sapiens
attccagcaagtacagagat

SEQ ID NO: 1716617 - DNA, 17 bp, Homo sapiens
attccagcagtgaatgc

SEQ ID NO: 1716618 - DNA, 18 bp, Homo sapiens
attccagcagttgttcca

SEQ ID NO: 1716619 - DNA, 14 bp, Homo sapiens
attccagcccctct

SEQ ID NO: 1716620 - DNA, 17 bp, Homo sapiens
attccagctctgccccc

SEQ ID NO: 1716621 - DNA, 22 bp, Homo sapiens
attccagctgtcactctgtgcc

SEQ ID NO: 1716622 - DNA, 16 bp, Homo sapiens
attccaggctgagcca

SEQ ID NO: 1716623 - DNA, 17 bp, Homo sapiens
attccaggctgagccat

SEQ ID NO: 1716624 - DNA, 21 bp, Homo sapiens
attccaggctgagccatgagg

SEQ ID NO: 1716625 - DNA, 17 bp, Homo sapiens
attccagtaactttttt

SEQ ID NO: 1716626 - DNA, 19 bp, Homo sapiens
attccagtaacttttttgt

SEQ ID NO: 1716627 - DNA, 23 bp, Homo sapiens
attccagtacagtattcttttaa

SEQ ID NO: 1716628 - DNA, 13 bp, Homo sapiens
attccataaatct

SEQ ID NO: 1716629 - DNA, 13 bp, Homo sapiens
attccatatttat

SEQ ID NO: 1716630 - DNA, 13 bp, Homo sapiens
attccatgaatgt

SEQ ID NO: 1716631 - DNA, 18 bp, Homo sapiens
attccatgaatgtatcag

SEQ ID NO: 1716632 - DNA, 16 bp, Homo sapiens
attccattggtccaag

SEQ ID NO: 1716633 - DNA, 21 bp, Homo sapiens
attcccaacgtgcaaagccaa

SEQ ID NO: 1716634 - DNA, 17 bp, Homo sapiens
attcccaagtatgcctt

SEQ ID NO: 1716635 - DNA, 15 bp, Homo sapiens
attcccagagtcaga

SEQ ID NO: 1716636 - DNA, 15 bp, Homo sapiens
attcccattttgcaa

SEQ ID NO: 1716637 - DNA, 21 bp, Homo sapiens
attcccctatctctagaattt

SEQ ID NO: 1716638 - DNA, 20 bp, Homo sapiens
attcccctttgcactgtaat

SEQ ID NO: 1716639 - DNA, 21 bp, Homo sapiens
attcccctttgcactgtaatg

SEQ ID NO: 1716640 - DNA, 16 bp, Homo sapiens
attcccgttttgtcac

SEQ ID NO: 1716641 - DNA, 13 bp, Homo sapiens
attccctccccct

SEQ ID NO: 1716642 - DNA, 16 bp, Homo sapiens
attccctccccctcct

SEQ ID NO: 1716643 - DNA, 18 bp, Homo sapiens
attcccttgaattgtgta

SEQ ID NO: 1716644 - DNA, 12 bp, Homo sapiens
attcccttgtat

SEQ ID NO: 1716645 - DNA, 13 bp, Homo sapiens
attcccttttaat

SEQ ID NO: 1716646 - DNA, 22 bp, Homo sapiens
attccgaagagggaatggatgg

SEQ ID NO: 1716647 - DNA, 15 bp, Homo sapiens
attccggactggcag

SEQ ID NO: 1716648 - DNA, 13 bp, Homo sapiens
attccggatccta

SEQ ID NO: 1716649 - DNA, 19 bp, Homo sapiens
attccggatcctaagcatc

SEQ ID NO: 1716650 - DNA, 21 bp, Homo sapiens
attccgtattggttgggggct

SEQ ID NO: 1716651 - DNA, 15 bp, Homo sapiens
attccgtatttaaag

SEQ ID NO: 1716652 - DNA, 15 bp, Homo sapiens
attcctaacctgtca

SEQ ID NO: 1716653 - DNA, 18 bp, Homo sapiens
attcctaacctgtcagaa

SEQ ID NO: 1716654 - DNA, 24 bp, Homo sapiens
attcctaacctgtcagaataataa

SEQ ID NO: 1716655 - DNA, 14 bp, Homo sapiens
attcctaactagaa

SEQ ID NO: 1716656 - DNA, 21 bp, Homo sapiens
attcctaagagtggaggagga

SEQ ID NO: 1716657 - DNA, 19 bp, Homo sapiens
attcctaaggtaatcctat

SEQ ID NO: 1716658 - DNA, 17 bp, Homo sapiens
attcctacctccctgca

SEQ ID NO: 1716659 - DNA, 15 bp, Homo sapiens
attcctagataaaaa

SEQ ID NO: 1716660 - DNA, 19 bp, Homo sapiens
attcctatatcctgtgact

SEQ ID NO: 1716661 - DNA, 20 bp, Homo sapiens
attcctatatcctgtgactg

SEQ ID NO: 1716662 - DNA, 17 bp, Homo sapiens
attcctcagctgccaag

SEQ ID NO: 1716663 - DNA, 18 bp, Homo sapiens
attcctcatgaatgtaaa

SEQ ID NO: 1716664 - DNA, 23 bp, Homo sapiens
attcctcatgaatgtaaatttgt

SEQ ID NO: 1716665 - DNA, 13 bp, Homo sapiens
attcctcccagga

SEQ ID NO: 1716666 - DNA, 14 bp, Homo sapiens
attcctcccaggag

SEQ ID NO: 1716667 - DNA, 21 bp, Homo sapiens
attcctcccaggaggtgcttg

SEQ ID NO: 1716668 - DNA, 20 bp, Homo sapiens
attcctcctgctcatattgt

SEQ ID NO: 1716669 - DNA, 12 bp, Homo sapiens
attcctctggga

SEQ ID NO: 1716670 - DNA, 15 bp, Homo sapiens
attcctcttcattgt

SEQ ID NO: 1716671 - DNA, 12 bp, Homo sapiens
attcctctttaa

SEQ ID NO: 1716672 - DNA, 13 bp, Homo sapiens
attcctctttaac

SEQ ID NO: 1716673 - DNA, 13 bp, Homo sapiens
attcctcttttta

SEQ ID NO: 1716674 - DNA, 13 bp, Homo sapiens
attcctgaaagaa

SEQ ID NO: 1716675 - DNA, 15 bp, Homo sapiens
attcctgaagaacca

SEQ ID NO: 1716676 - DNA, 19 bp, Homo sapiens
attcctgaagaaccagtcc

SEQ ID NO: 1716677 - DNA, 16 bp, Homo sapiens
attcctgaagggaact

SEQ ID NO: 1716678 - DNA, 14 bp, Homo sapiens
attcctgacccagg

SEQ ID NO: 1716679 - DNA, 15 bp, Homo sapiens
attcctgacccaggc

SEQ ID NO: 1716680 - DNA, 22 bp, Homo sapiens
attcctgacccaggccgcagct

SEQ ID NO: 1716681 - DNA, 18 bp, Homo sapiens
attcctgacctccgccat

SEQ ID NO: 1716682 - DNA, 19 bp, Homo sapiens
attcctgatatgatttaaa

SEQ ID NO: 1716683 - DNA, 18 bp, Homo sapiens
attcctgccctgctgttt

SEQ ID NO: 1716684 - DNA, 17 bp, Homo sapiens
attcctggccccgggct

SEQ ID NO: 1716685 - DNA, 16 bp, Homo sapiens
attcctggctctaccc

SEQ ID NO: 1716686 - DNA, 10 bp, Homo sapiens
attcctgggc

SEQ ID NO: 1716687 - DNA, 15 bp, Homo sapiens
attcctgggcctgtc

SEQ ID NO: 1716688 - DNA, 15 bp, Homo sapiens
attcctggtacccag

SEQ ID NO: 1716689 - DNA, 23 bp, Homo sapiens
gcctgcctcccctccgcagcagg

SEQ ID NO: 1716690 - DNA, 17 bp, Homo sapiens
gcctgcctcctggctca

SEQ ID NO: 1716691 - DNA, 18 bp, Homo sapiens
gcctgcctcctggctcag

SEQ ID NO: 1716692 - DNA, 23 bp, Homo sapiens
gcctgcctcctggctcaggccca

SEQ ID NO: 1716693 - DNA, 14 bp, Homo sapiens
gcctgcctctgcct

SEQ ID NO: 1716694 - DNA, 20 bp, Homo sapiens
gcctgcctgatccctgaacc

SEQ ID NO: 1716695 - DNA, 22 bp, Homo sapiens
gcctgcctgtctgtctctccat

SEQ ID NO: 1716696 - DNA, 15 bp, Homo sapiens
gcctgcgaccctggg

SEQ ID NO: 1716697 - DNA, 23 bp, Homo sapiens
gcctgcgaccctgggggcacagg

SEQ ID NO: 1716698 - DNA, 17 bp, Homo sapiens
gcctgctaaggctcctc

SEQ ID NO: 1716699 - DNA, 24 bp, Homo sapiens
attccttagcttagacctcagcct

SEQ ID NO: 1716700 - DNA, 17 bp, Homo sapiens
attccttcactcatcca

SEQ ID NO: 1716701 - DNA, 20 bp, Homo sapiens
attccttcgaaaggccttca

SEQ ID NO: 1716702 - DNA, 20 bp, Homo sapiens
attccttggcatgccttcca

SEQ ID NO: 1716703 - DNA, 12 bp, Homo sapiens
attccttgtgaa

SEQ ID NO: 1716704 - DNA, 14 bp, Homo sapiens
attccttttctgta

SEQ ID NO: 1716705 - DNA, 17 bp, Homo sapiens
attccttttgatgggga

SEQ ID NO: 1716706 - DNA, 19 bp, Homo sapiens
attccttttgatggggaga

SEQ ID NO: 1716707 - DNA, 20 bp, Homo sapiens
attccttttgatggggagaa

SEQ ID NO: 1716708 - DNA, 21 bp, Homo sapiens
attccttttgatggggagaaa

SEQ ID NO: 1716709 - DNA, 15 bp, Homo sapiens
attcgaaccaggaaa

SEQ ID NO: 1716710 - DNA, 16 bp, Homo sapiens
attcgacctataagaa

SEQ ID NO: 1716711 - DNA, 22 bp, Homo sapiens
attcgcctttgtcttgtacttc

SEQ ID NO: 1716712 - DNA, 22 bp, Homo sapiens
attcgctgtaccctttaagata

SEQ ID NO: 1716713 - DNA, 13 bp, Homo sapiens
attcgctttctaa

SEQ ID NO: 1716714 - DNA, 17 bp, Homo sapiens
attcggtgtgctgccaa

SEQ ID NO: 1716715 - DNA, 22 bp, Homo sapiens
attcggtgtgctgccaacttga

SEQ ID NO: 1716716 - DNA, 23 bp, Homo sapiens
attcgtatgatcagtactgactt

SEQ ID NO: 1716717 - DNA, 20 bp, Homo sapiens
attcgtgcatttttggatca

SEQ ID NO: 1716718 - DNA, 19 bp, Homo sapiens
attcgttgtgttttttaag

SEQ ID NO: 1716719 - DNA, 19 bp, Homo sapiens
attctaaaacattctttaa

SEQ ID NO: 1716720 - DNA, 18 bp, Homo sapiens
attctaaagattctatag

SEQ ID NO: 1716721 - DNA, 20 bp, Homo sapiens
attctaaagattctatagtt

SEQ ID NO: 1716722 - DNA, 14 bp, Homo sapiens
attctaaatacatg

SEQ ID NO: 1716723 - DNA, 18 bp, Homo sapiens
attctaacggtctgttct

SEQ ID NO: 1716724 - DNA, 12 bp, Homo sapiens
attctaagactt

SEQ ID NO: 1716725 - DNA, 19 bp, Homo sapiens
attctaagttatttacttt

SEQ ID NO: 1716726 - DNA, 20 bp, Homo sapiens
attctaataaatatactatg

SEQ ID NO: 1716727 - DNA, 16 bp, Homo sapiens
attctaccaaattttt

SEQ ID NO: 1716728 - DNA, 16 bp, Homo sapiens
attctactggcctgta

SEQ ID NO: 1716729 - DNA, 17 bp, Homo sapiens
attctacttctctgttg

SEQ ID NO: 1716730 - DNA, 13 bp, Homo sapiens
attctactttgag

SEQ ID NO: 1716731 - DNA, 21 bp, Homo sapiens
attctagatcctgcaccccag

SEQ ID NO: 1716732 - DNA, 18 bp, Homo sapiens
attctagctgtatgattt

SEQ ID NO: 1716733 - DNA, 22 bp, Homo sapiens
attctagctgtatgatttgttt

SEQ ID NO: 1716734 - DNA, 23 bp, Homo sapiens
attctaggaaatcagaagtagtt

SEQ ID NO: 1716735 - DNA, 16 bp, Homo sapiens
attctaggatgtggag

SEQ ID NO: 1716736 - DNA, 13 bp, Homo sapiens
attctaggcatcc

SEQ ID NO: 1716737 - DNA, 14 bp, Homo sapiens
attctagtatttta

SEQ ID NO: 1716738 - DNA, 21 bp, Homo sapiens
attctagtcaactgctgtttt

SEQ ID NO: 1716739 - DNA, 12 bp, Homo sapiens
attctagtgctg

SEQ ID NO: 1716740 - DNA, 24 bp, Homo sapiens
attctataaaactctgcatgtaga

SEQ ID NO: 1716741 - DNA, 14 bp, Homo sapiens
attctataaattca

SEQ ID NO: 1716742 - DNA, 14 bp, Homo sapiens
attctatagttcta

SEQ ID NO: 1716743 - DNA, 15 bp, Homo sapiens
attctatagttctag

SEQ ID NO: 1716744 - DNA, 14 bp, Homo sapiens
attctatatgaatt

SEQ ID NO: 1716745 - DNA, 15 bp, Homo sapiens
attctatatgaattt

SEQ ID NO: 1716746 - DNA, 15 bp, Homo sapiens
attctatatttcata

SEQ ID NO: 1716747 - DNA, 17 bp, Homo sapiens
attctatgcctgtattt

SEQ ID NO: 1716748 - DNA, 20 bp, Homo sapiens
attctatgcctgtatttcca

SEQ ID NO: 1716749 - DNA, 16 bp, Homo sapiens
attctatgtatgttaa

SEQ ID NO: 1716750 - DNA, 14 bp, Homo sapiens
attctcaaagcagg

SEQ ID NO: 1716751 - DNA, 18 bp, Homo sapiens
attctcaagacctgagta

SEQ ID NO: 1716752 - DNA, 15 bp, Homo sapiens
attctcaagccctgc

SEQ ID NO: 1716753 - DNA, 16 bp, Homo sapiens
attctcactccaccac

SEQ ID NO: 1716754 - DNA, 16 bp, Homo sapiens
attctcataggagact

SEQ ID NO: 1716755 - DNA, 14 bp, Homo sapiens
attctcatgcctca

SEQ ID NO: 1716756 - DNA, 19 bp, Homo sapiens
attctcattaaaagaatat

SEQ ID NO: 1716757 - DNA, 18 bp, Homo sapiens
attctcattatgttgata

SEQ ID NO: 1716758 - DNA, 15 bp, Homo sapiens
attctccagttgatt

SEQ ID NO: 1716759 - DNA, 12 bp, Homo sapiens
attctcccagcg

SEQ ID NO: 1716760 - DNA, 20 bp, Homo sapiens
attctcccaggtaccagctg

SEQ ID NO: 1716761 - DNA, 22 bp, Homo sapiens
attctcccgcctcagcctcctg

SEQ ID NO: 1716762 - DNA, 21 bp, Homo sapiens
attctcccgcttcctggcctc

SEQ ID NO: 1716763 - DNA, 22 bp, Homo sapiens
attctcccgcttcctggcctcc

SEQ ID NO: 1716764 - DNA, 14 bp, Homo sapiens
attctccctgggcc

SEQ ID NO: 1716765 - DNA, 20 bp, Homo sapiens
attctcctgcctcagcctcc

SEQ ID NO: 1716766 - DNA, 16 bp, Homo sapiens
attctccttcagccct

SEQ ID NO: 1716767 - DNA, 18 bp, Homo sapiens
attctctaaactggcatc

SEQ ID NO: 1716768 - DNA, 15 bp, Homo sapiens
attctctccaaaaat

SEQ ID NO: 1716769 - DNA, 16 bp, Homo sapiens
attctctctcctgtcc

SEQ ID NO: 1716770 - DNA, 19 bp, Homo sapiens
attctctggctgtaaggct

SEQ ID NO: 1716771 - DNA, 21 bp, Homo sapiens
attctctggctgtaaggctct

SEQ ID NO: 1716772 - DNA, 22 bp, Homo sapiens
attctctggctgtaaggctcta

SEQ ID NO: 1716773 - DNA, 20 bp, Homo sapiens
attctctgtaagtgtagctc

SEQ ID NO: 1716774 - DNA, 22 bp, Homo sapiens
attctctgtaagtgtagctcaa

SEQ ID NO: 1716775 - DNA, 21 bp, Homo sapiens
attctctgtggttttttttga

SEQ ID NO: 1716776 - DNA, 17 bp, Homo sapiens
attctctgtgtctaaga

SEQ ID NO: 1716777 - DNA, 12 bp, Homo sapiens
attctcttatcc

SEQ ID NO: 1716778 - DNA, 15 bp, Homo sapiens
attctcttatccaac

SEQ ID NO: 1716779 - DNA, 12 bp, Homo sapiens
attctcttcgct

SEQ ID NO: 1716780 - DNA, 15 bp, Homo sapiens
attctcttcgctgtg

SEQ ID NO: 1716781 - DNA, 18 bp, Homo sapiens
attctcttcgctgtgatg

SEQ ID NO: 1716782 - DNA, 19 bp, Homo sapiens
attctcttcgctgtgatgc

SEQ ID NO: 1716783 - DNA, 14 bp, Homo sapiens
attctcttgaataa

SEQ ID NO: 1716784 - DNA, 14 bp, Homo sapiens
attctcttgcattg

SEQ ID NO: 1716785 - DNA, 16 bp, Homo sapiens
attctcttgcattgtg

SEQ ID NO: 1716786 - DNA, 20 bp, Homo sapiens
attctcttgtataagatcct

SEQ ID NO: 1716787 - DNA, 20 bp, Homo sapiens
attctctttaaaaaagactg

SEQ ID NO: 1716788 - DNA, 16 bp, Homo sapiens
attctctttgataaca

SEQ ID NO: 1716789 - DNA, 12 bp, Homo sapiens
attctcttttca

SEQ ID NO: 1716790 - DNA, 23 bp, Homo sapiens
attctgaattaattaatttggag

SEQ ID NO: 1716791 - DNA, 16 bp, Homo sapiens
attctgacatgtaaga

SEQ ID NO: 1716792 - DNA, 18 bp, Homo sapiens
attctgactcggtttctc

SEQ ID NO: 1716793 - DNA, 16 bp, Homo sapiens
attctgacttatgaat

SEQ ID NO: 1716794 - DNA, 14 bp, Homo sapiens
attctgagaaaaca

SEQ ID NO: 1716795 - DNA, 14 bp, Homo sapiens
attctgagaccaaa

SEQ ID NO: 1716796 - DNA, 17 bp, Homo sapiens
attctgaggccctgccc

SEQ ID NO: 1716797 - DNA, 16 bp, Homo sapiens
attctgataatgctca

SEQ ID NO: 1716798 - DNA, 13 bp, Homo sapiens
attctgatgtttc

SEQ ID NO: 1716799 - DNA, 16 bp, Homo sapiens
attctgatgtttctgt

SEQ ID NO: 1716800 - DNA, 19 bp, Homo sapiens
attctgatgtttctgtgaa

SEQ ID NO: 1716801 - DNA, 13 bp, Homo sapiens
attctgattccac

SEQ ID NO: 1716802 - DNA, 21 bp, Homo sapiens
attctgattctggctttaagc

SEQ ID NO: 1716803 - DNA, 22 bp, Homo sapiens
attctgattctggctttaagcc

SEQ ID NO: 1716804 - DNA, 13 bp, Homo sapiens
attctgattcttt

SEQ ID NO: 1716805 - DNA, 12 bp, Homo sapiens
attctgatttca

SEQ ID NO: 1716806 - DNA, 22 bp, Homo sapiens
attctgatttcagtttttcatt

SEQ ID NO: 1716807 - DNA, 15 bp, Homo sapiens
gccattgcactccag

SEQ ID NO: 1716808 - DNA, 17 bp, Homo sapiens
gccattgtactccagcc

SEQ ID NO: 1716809 - DNA, 20 bp, Homo sapiens
gccattgtactccagcctgg

SEQ ID NO: 1716810 - DNA, 22 bp, Homo sapiens
gccattgtactccagcctgggc

SEQ ID NO: 1716811 - DNA, 11 bp, Homo sapiens
gccatttaaaa

SEQ ID NO: 1716812 - DNA, 22 bp, Homo sapiens
gccatttaaagcttattaaaac

SEQ ID NO: 1716813 - DNA, 18 bp, Homo sapiens
gccatttcagtggcttcc

SEQ ID NO: 1716814 - DNA, 13 bp, Homo sapiens
gccatttccccct

SEQ ID NO: 1716815 - DNA, 20 bp, Homo sapiens
gccatttcctcacgtgcagg

SEQ ID NO: 1716816 - DNA, 16 bp, Homo sapiens
gccatttctgaactgt

SEQ ID NO: 1716817 - DNA, 20 bp, Homo sapiens
gccatttctgaactgttaca

SEQ ID NO: 1716818 - DNA, 22 bp, Homo sapiens
gccatttgctagttctgctgcc

SEQ ID NO: 1716819 - DNA, 15 bp, Homo sapiens
gccatttgctttttc

SEQ ID NO: 1716820 - DNA, 14 bp, Homo sapiens
gccatttttaatga

SEQ ID NO: 1716821 - DNA, 13 bp, Homo sapiens
gccatttttctgg

SEQ ID NO: 1716822 - DNA, 14 bp, Homo sapiens
gcccaaagtgggga

SEQ ID NO: 1716823 - DNA, 10 bp, Homo sapiens
gcccaaatga

SEQ ID NO: 1716824 - DNA, 14 bp, Homo sapiens
gcccaaatgatgga

SEQ ID NO: 1716825 - DNA, 14 bp, Homo sapiens
gcccaacagcactt

SEQ ID NO: 1716826 - DNA, 16 bp, Homo sapiens
gcccaacccttccctc

SEQ ID NO: 1716827 - DNA, 21 bp, Homo sapiens
gcccaagaatagatgctgact

SEQ ID NO: 1716828 - DNA, 22 bp, Homo sapiens
gcccaagaatagatgctgactg

SEQ ID NO: 1716829 - DNA, 18 bp, Homo sapiens
gcccaagagccctgtggc

SEQ ID NO: 1716830 - DNA, 14 bp, Homo sapiens
gcccaagaggtctg

SEQ ID NO: 1716831 - DNA, 17 bp, Homo sapiens
gcccaagaggtctgagc

SEQ ID NO: 1716832 - DNA, 18 bp, Homo sapiens
gcccaagaggtctgagcc

SEQ ID NO: 1716833 - DNA, 16 bp, Homo sapiens
gcccaagccagaggct

SEQ ID NO: 1716834 - DNA, 18 bp, Homo sapiens
gcccaagccagaggctgg

SEQ ID NO: 1716835 - DNA, 21 bp, Homo sapiens
gcccaagccagaggctgggtt

SEQ ID NO: 1716836 - DNA, 16 bp, Homo sapiens
gcccaagccccatctc

SEQ ID NO: 1716837 - DNA, 20 bp, Homo sapiens
gcccaagcccgacttgctgt

SEQ ID NO: 1716838 - DNA, 15 bp, Homo sapiens
gcccaagcttccctc

SEQ ID NO: 1716839 - DNA, 19 bp, Homo sapiens
gcccaagttcatgcagctg

SEQ ID NO: 1716840 - DNA, 12 bp, Homo sapiens
gcccaatattat

SEQ ID NO: 1716841 - DNA, 21 bp, Homo sapiens
gcccaatgctttgggaggcca

SEQ ID NO: 1716842 - DNA, 16 bp, Homo sapiens
gcccacacactttcca

SEQ ID NO: 1716843 - DNA, 23 bp, Homo sapiens
gcccacacccagctactttaaca

SEQ ID NO: 1716844 - DNA, 13 bp, Homo sapiens
gcccacacctggt

SEQ ID NO: 1716845 - DNA, 16 bp, Homo sapiens
gcccacacctggtgga

SEQ ID NO: 1716846 - DNA, 16 bp, Homo sapiens
gcccacagctcccacc

SEQ ID NO: 1716847 - DNA, 20 bp, Homo sapiens
gcccacaggaagctcagcct

SEQ ID NO: 1716848 - DNA, 16 bp, Homo sapiens
gcccacatattctatt

SEQ ID NO: 1716849 - DNA, 15 bp, Homo sapiens
gcccacatcccaggc

SEQ ID NO: 1716850 - DNA, 17 bp, Homo sapiens
gcccacatggccgggcc

SEQ ID NO: 1716851 - DNA, 23 bp, Homo sapiens
gcccacatgtgtccatcccagcg

SEQ ID NO: 1716852 - DNA, 16 bp, Homo sapiens
gcccacattggaccca

SEQ ID NO: 1716853 - DNA, 18 bp, Homo sapiens
gcccacatttgggctcag

SEQ ID NO: 1716854 - DNA, 12 bp, Homo sapiens
gcccacccacat

SEQ ID NO: 1716855 - DNA, 16 bp, Homo sapiens
gcccacccacatgact

SEQ ID NO: 1716856 - DNA, 13 bp, Homo sapiens
gcccacccaggtc

SEQ ID NO: 1716857 - DNA, 14 bp, Homo sapiens
gcccacccagtcca

SEQ ID NO: 1716858 - DNA, 19 bp, Homo sapiens
gcccacccagtccatgctc

SEQ ID NO: 1716859 - DNA, 23 bp, Homo sapiens
gcccacccccctccccaactccc

SEQ ID NO: 1716860 - DNA, 15 bp, Homo sapiens
gcccaccccctcaag

SEQ ID NO: 1716861 - DNA, 22 bp, Homo sapiens
gcccaccccctcaagccaatcc

SEQ ID NO: 1716862 - DNA, 18 bp, Homo sapiens
gcccaccccctgccctgc

SEQ ID NO: 1716863 - DNA, 12 bp, Homo sapiens
gcccacccctca

SEQ ID NO: 1716864 - DNA, 18 bp, Homo sapiens
atgggcttggacttcctg

SEQ ID NO: 1716865 - DNA, 19 bp, Homo sapiens
atgggcttggacttcctgg

SEQ ID NO: 1716866 - DNA, 22 bp, Homo sapiens
atgggcttggacttcctggggc

SEQ ID NO: 1716867 - DNA, 22 bp, Homo sapiens
atgggcttttggggagccagaa

SEQ ID NO: 1716868 - DNA, 19 bp, Homo sapiens
atggggaatccgtgtgtgt

SEQ ID NO: 1716869 - DNA, 22 bp, Homo sapiens
atggggagacagttgagagcgg

SEQ ID NO: 1716870 - DNA, 14 bp, Homo sapiens
atggggaggcagca

SEQ ID NO: 1716871 - DNA, 16 bp, Homo sapiens
atggggagggagggag

SEQ ID NO: 1716872 - DNA, 12 bp, Homo sapiens
atggggagtgag

SEQ ID NO: 1716873 - DNA, 14 bp, Homo sapiens
atggggccagatcc

SEQ ID NO: 1716874 - DNA, 22 bp, Homo sapiens
atggggccagatccagcctggg

SEQ ID NO: 1716875 - DNA, 12 bp, Homo sapiens
atgggggagagg

SEQ ID NO: 1716876 - DNA, 13 bp, Homo sapiens
atgggggagaggg

SEQ ID NO: 1716877 - DNA, 15 bp, Homo sapiens
atgggggatttcaaa

SEQ ID NO: 1716878 - DNA, 22 bp, Homo sapiens
atgggggatttcaaacttaaac

SEQ ID NO: 1716879 - DNA, 14 bp, Homo sapiens
atgggggcagggct

SEQ ID NO: 1716880 - DNA, 14 bp, Homo sapiens
atggggggagaagt

SEQ ID NO: 1716881 - DNA, 20 bp, Homo sapiens
atggggggcgggccagggtg

SEQ ID NO: 1716882 - DNA, 16 bp, Homo sapiens
atgggggtagcagctg

SEQ ID NO: 1716883 - DNA, 19 bp, Homo sapiens
atgggggtagcagctggac

SEQ ID NO: 1716884 - DNA, 16 bp, Homo sapiens
atggggtctgtgactg

SEQ ID NO: 1716885 - DNA, 16 bp, Homo sapiens
atggggttctggaaat

SEQ ID NO: 1716886 - DNA, 12 bp, Homo sapiens
atgggtagggta

SEQ ID NO: 1716887 - DNA, 14 bp, Homo sapiens
atgggtattaaact

SEQ ID NO: 1716888 - DNA, 15 bp, Homo sapiens
atgggtattaaactt

SEQ ID NO: 1716889 - DNA, 14 bp, Homo sapiens
atgggtcagagcta

SEQ ID NO: 1716890 - DNA, 12 bp, Homo sapiens
atgggtccaggg

SEQ ID NO: 1716891 - DNA, 14 bp, Homo sapiens
atgggtccagggcc

SEQ ID NO: 1716892 - DNA, 17 bp, Homo sapiens
atgggtcccttgaagga

SEQ ID NO: 1716893 - DNA, 21 bp, Homo sapiens
atgggtcccttgaaggaagag

SEQ ID NO: 1716894 - DNA, 16 bp, Homo sapiens
atgggtggacacggat

SEQ ID NO: 1716895 - DNA, 23 bp, Homo sapiens
atgggtggcaccaaccttgctgg

SEQ ID NO: 1716896 - DNA, 13 bp, Homo sapiens
atgggtgtgccct

SEQ ID NO: 1716897 - DNA, 20 bp, Homo sapiens
atgggtgtgcccttggggta

SEQ ID NO: 1716898 - DNA, 22 bp, Homo sapiens
atgggtttttccctgtacagta

SEQ ID NO: 1716899 - DNA, 23 bp, Homo sapiens
atggtaaaagttacttattctag

SEQ ID NO: 1716900 - DNA, 13 bp, Homo sapiens
atggtaacacttt

SEQ ID NO: 1716901 - DNA, 22 bp, Homo sapiens
atggtaaccagccacagtacat

SEQ ID NO: 1716902 - DNA, 20 bp, Homo sapiens
atggtaatagaatagcacag

SEQ ID NO: 1716903 - DNA, 18 bp, Homo sapiens
atggtacagcttctggag

SEQ ID NO: 1716904 - DNA, 21 bp, Homo sapiens
atggtagattcgctgtcccct

SEQ ID NO: 1716905 - DNA, 19 bp, Homo sapiens
atggtagggagagacacaa

SEQ ID NO: 1716906 - DNA, 16 bp, Homo sapiens
atggtaggggagggca

SEQ ID NO: 1716907 - DNA, 11 bp, Homo sapiens
atggtataaaa

SEQ ID NO: 1716908 - DNA, 19 bp, Homo sapiens
atggtatagcaaatgtttt

SEQ ID NO: 1716909 - DNA, 12 bp, Homo sapiens
atggtatatata

SEQ ID NO: 1716910 - DNA, 14 bp, Homo sapiens
atggtatatataca

SEQ ID NO: 1716911 - DNA, 16 bp, Homo sapiens
atggtatatatacata

SEQ ID NO: 1716912 - DNA, 16 bp, Homo sapiens
atggtatcattacaat

SEQ ID NO: 1716913 - DNA, 19 bp, Homo sapiens
atggtatgcacaattccat

SEQ ID NO: 1716914 - DNA, 17 bp, Homo sapiens
atggtcaagttcccaac

SEQ ID NO: 1716915 - DNA, 20 bp, Homo sapiens
atggtcagtgtggagagggg

SEQ ID NO: 1716916 - DNA, 19 bp, Homo sapiens
atggtcatatacatattgt

SEQ ID NO: 1716917 - DNA, 13 bp, Homo sapiens
atggtcccatcca

SEQ ID NO: 1716918 - DNA, 17 bp, Homo sapiens
atggtcctttctggaag

SEQ ID NO: 1716919 - DNA, 14 bp, Homo sapiens
atggtcgcccagga

SEQ ID NO: 1716920 - DNA, 20 bp, Homo sapiens
atggtcggatctcacaggct

SEQ ID NO: 1716921 - DNA, 22 bp, Homo sapiens
atggtcggatctcacaggctga

SEQ ID NO: 1716922 - DNA, 18 bp, Homo sapiens
gcccagatgaactgactg

SEQ ID NO: 1716923 - DNA, 20 bp, Homo sapiens
gcccagattcccctgtgtca

SEQ ID NO: 1716924 - DNA, 21 bp, Homo sapiens
gcccagcacatggccatagag

SEQ ID NO: 1716925 - DNA, 16 bp, Homo sapiens
gcccagcacctgctcc

SEQ ID NO: 1716926 - DNA, 17 bp, Homo sapiens
gcccagcacctgctccc

SEQ ID NO: 1716927 - DNA, 14 bp, Homo sapiens
gcccagcagctcaa

SEQ ID NO: 1716928 - DNA, 12 bp, Homo sapiens
gcccagcaggcc

SEQ ID NO: 1716929 - DNA, 19 bp, Homo sapiens
gcccagcaggcccagcatg

SEQ ID NO: 1716930 - DNA, 21 bp, Homo sapiens
gcccagcaggggccctcactc

SEQ ID NO: 1716931 - DNA, 13 bp, Homo sapiens
gcccagcatgcag

SEQ ID NO: 1716932 - DNA, 16 bp, Homo sapiens
gcccagcattgctggt

SEQ ID NO: 1716933 - DNA, 20 bp, Homo sapiens
gcccagccaaaccctgtctg

SEQ ID NO: 1716934 - DNA, 13 bp, Homo sapiens
gcccagccactcc

SEQ ID NO: 1716935 - DNA, 15 bp, Homo sapiens
gcccagccaggagca

SEQ ID NO: 1716936 - DNA, 22 bp, Homo sapiens
gcccagccattaccatggagac

SEQ ID NO: 1716937 - DNA, 14 bp, Homo sapiens
gcccagcccagctg

SEQ ID NO: 1716938 - DNA, 19 bp, Homo sapiens
gcccagcccctactgctgt

SEQ ID NO: 1716939 - DNA, 20 bp, Homo sapiens
gcccagcccctactgctgtg

SEQ ID NO: 1716940 - DNA, 13 bp, Homo sapiens
gcccagccggcct

SEQ ID NO: 1716941 - DNA, 19 bp, Homo sapiens
gcccagccggcctctctgg

SEQ ID NO: 1716942 - DNA, 19 bp, Homo sapiens
gcccagccgggcacagtgg

SEQ ID NO: 1716943 - DNA, 20 bp, Homo sapiens
gcccagcctgggagcccaga

SEQ ID NO: 1716944 - DNA, 21 bp, Homo sapiens
gcccagcctgggagcccagag

SEQ ID NO: 1716945 - DNA, 22 bp, Homo sapiens
gcccagcctgggagcccagagg

SEQ ID NO: 1716946 - DNA, 14 bp, Homo sapiens
gcccagcgccaagt

SEQ ID NO: 1716947 - DNA, 19 bp, Homo sapiens
gcccagcgctctcctggac

SEQ ID NO: 1716948 - DNA, 16 bp, Homo sapiens
gcccagcggcccctcc

SEQ ID NO: 1716949 - DNA, 17 bp, Homo sapiens
gcccagcggcccctccc

SEQ ID NO: 1716950 - DNA, 13 bp, Homo sapiens
gcccagcgggcag

SEQ ID NO: 1716951 - DNA, 14 bp, Homo sapiens
gcccagcgggcaga

SEQ ID NO: 1716952 - DNA, 17 bp, Homo sapiens
gcccagctaatttttgt

SEQ ID NO: 1716953 - DNA, 15 bp, Homo sapiens
gcccagctccaaggg

SEQ ID NO: 1716954 - DNA, 14 bp, Homo sapiens
gcccagctccaggg

SEQ ID NO: 1716955 - DNA, 18 bp, Homo sapiens
gcccagctccagggccag

SEQ ID NO: 1716956 - DNA, 14 bp, Homo sapiens
gcccagctctctga

SEQ ID NO: 1716957 - DNA, 17 bp, Homo sapiens
gcccagctctctgacgc

SEQ ID NO: 1716958 - DNA, 15 bp, Homo sapiens
gcccagctcttgctc

SEQ ID NO: 1716959 - DNA, 17 bp, Homo sapiens
gcccagctcttgctctc

SEQ ID NO: 1716960 - DNA, 18 bp, Homo sapiens
gcccagctcttgctctct

SEQ ID NO: 1716961 - DNA, 13 bp, Homo sapiens
gcccagctgggct

SEQ ID NO: 1716962 - DNA, 18 bp, Homo sapiens
gcccagctgggctctgcc

SEQ ID NO: 1716963 - DNA, 19 bp, Homo sapiens
gcccagctgggctctgcca

SEQ ID NO: 1716964 - DNA, 21 bp, Homo sapiens
gcccagctgggctctgccacc

SEQ ID NO: 1716965 - DNA, 20 bp, Homo sapiens
gcccagctgtagccatggct

SEQ ID NO: 1716966 - DNA, 23 bp, Homo sapiens
gcccagctgtagccatggctcag

SEQ ID NO: 1716967 - DNA, 18 bp, Homo sapiens
gcccagcttgggcccagc

SEQ ID NO: 1716968 - DNA, 19 bp, Homo sapiens
gcccagcttgggcccagct

SEQ ID NO: 1716969 - DNA, 21 bp, Homo sapiens
gcccagcttgggcccagctgg

SEQ ID NO: 1716970 - DNA, 19 bp, Homo sapiens
gcccaggaattagagaagc

SEQ ID NO: 1716971 - DNA, 15 bp, Homo sapiens
gcccaggacagctgg

SEQ ID NO: 1716972 - DNA, 13 bp, Homo sapiens
gcccaggaccagc

SEQ ID NO: 1716973 - DNA, 15 bp, Homo sapiens
gcccaggaccagctg

SEQ ID NO: 1716974 - DNA, 16 bp, Homo sapiens
gcccaggaccagctgg

SEQ ID NO: 1716975 - DNA, 18 bp, Homo sapiens
gcccaggaccagctgggg

SEQ ID NO: 1716976 - DNA, 19 bp, Homo sapiens
gcccaggaccagctggggc

SEQ ID NO: 1716977 - DNA, 18 bp, Homo sapiens
gcccaggagacagaccac

SEQ ID NO: 1716978 - DNA, 15 bp, Homo sapiens
gcccaggagagccag

SEQ ID NO: 1716979 - DNA, 15 bp, Homo sapiens
gcccaggagcagctt

SEQ ID NO: 1716980 - DNA, 15 bp, Homo sapiens
gcccaggagctctgc

SEQ ID NO: 1716981 - DNA, 18 bp, Homo sapiens
gcccaggagctctgcgcc

SEQ ID NO: 1716982 - DNA, 20 bp, Homo sapiens
gcccaggagctctgcgccag

SEQ ID NO: 1716983 - DNA, 22 bp, Homo sapiens
gcccaggagctctgcgccaggc

SEQ ID NO: 1716984 - DNA, 14 bp, Homo sapiens
atgtaacatcataa

SEQ ID NO: 1716985 - DNA, 20 bp, Homo sapiens
atgtaacatcataattacat

SEQ ID NO: 1716986 - DNA, 12 bp, Homo sapiens
atgtaacattgg

SEQ ID NO: 1716987 - DNA, 20 bp, Homo sapiens
atgtaactccagatagagaa

SEQ ID NO: 1716988 - DNA, 20 bp, Homo sapiens
atgtaactgcattgagaact

SEQ ID NO: 1716989 - DNA, 14 bp, Homo sapiens
atgtaacttattcc

SEQ ID NO: 1716990 - DNA, 14 bp, Homo sapiens
atgtaacttttgta

SEQ ID NO: 1716991 - DNA, 18 bp, Homo sapiens
atgtaacttttgtaagac

SEQ ID NO: 1716992 - DNA, 17 bp, Homo sapiens
atgtaagaaaatgttac

SEQ ID NO: 1716993 - DNA, 16 bp, Homo sapiens
atgtaagcatactttg

SEQ ID NO: 1716994 - DNA, 14 bp, Homo sapiens
atgtaaggcactgt

SEQ ID NO: 1716995 - DNA, 15 bp, Homo sapiens
atgtaaggcactgtc

SEQ ID NO: 1716996 - DNA, 20 bp, Homo sapiens
atgtaagggaaactgccagc

SEQ ID NO: 1716997 - DNA, 21 bp, Homo sapiens
atgtaagggaaactgccagca

SEQ ID NO: 1716998 - DNA, 22 bp, Homo sapiens
atgtaagggaaactgccagcaa

SEQ ID NO: 1716999 - DNA, 21 bp, Homo sapiens
atgtaagggtctttggtgttt

SEQ ID NO: 1717000 - DNA, 15 bp, Homo sapiens
atgtaagtgggccca

SEQ ID NO: 1717001 - DNA, 19 bp, Homo sapiens
atgtaataaaaagcctctt

SEQ ID NO: 1717002 - DNA, 15 bp, Homo sapiens
atgtaataaacttta

SEQ ID NO: 1717003 - DNA, 20 bp, Homo sapiens
atgtaatataaatttaagca

SEQ ID NO: 1717004 - DNA, 23 bp, Homo sapiens
atgtaatatattgtacaaatgta

SEQ ID NO: 1717005 - DNA, 16 bp, Homo sapiens
atgtaatcaatgtttc

SEQ ID NO: 1717006 - DNA, 16 bp, Homo sapiens
atgtaatcatttatct

SEQ ID NO: 1717007 - DNA, 13 bp, Homo sapiens
atgtaattggaat

SEQ ID NO: 1717008 - DNA, 15 bp, Homo sapiens
atgtaatttaaatga

SEQ ID NO: 1717009 - DNA, 17 bp, Homo sapiens
atgtaatttaaatgaaa

SEQ ID NO: 1717010 - DNA, 21 bp, Homo sapiens
atgtaatttcaaaatacattt

SEQ ID NO: 1717011 - DNA, 20 bp, Homo sapiens
atgtaattttattttaaaat

SEQ ID NO: 1717012 - DNA, 20 bp, Homo sapiens
atgtacaagttttgtataaa

SEQ ID NO: 1717013 - DNA, 17 bp, Homo sapiens
atgtacaatacaatgta

SEQ ID NO: 1717014 - DNA, 18 bp, Homo sapiens
atgtacaattatgtctct

SEQ ID NO: 1717015 - DNA, 20 bp, Homo sapiens
atgtacaattatgtctcttg

SEQ ID NO: 1717016 - DNA, 14 bp, Homo sapiens
atgtacagattctt

SEQ ID NO: 1717017 - DNA, 22 bp, Homo sapiens
atgtacagattttatttgtaat

SEQ ID NO: 1717018 - DNA, 13 bp, Homo sapiens
atgtacataactc

SEQ ID NO: 1717019 - DNA, 22 bp, Homo sapiens
atgtacatgtgtagggaaagtt

SEQ ID NO: 1717020 - DNA, 14 bp, Homo sapiens
atgtacattaatta

SEQ ID NO: 1717021 - DNA, 15 bp, Homo sapiens
atgtaccttgaccat

SEQ ID NO: 1717022 - DNA, 21 bp, Homo sapiens
atgtacgctgctgcaggacat

SEQ ID NO: 1717023 - DNA, 14 bp, Homo sapiens
atgtacgtttgtat

SEQ ID NO: 1717024 - DNA, 15 bp, Homo sapiens
atgtactacagctat

SEQ ID NO: 1717025 - DNA, 18 bp, Homo sapiens
atgtactagtgttctgtt

SEQ ID NO: 1717026 - DNA, 20 bp, Homo sapiens
atgtactagtgttctgtttg

SEQ ID NO: 1717027 - DNA, 22 bp, Homo sapiens
atgtactagtgttctgtttgtt

SEQ ID NO: 1717028 - DNA, 21 bp, Homo sapiens
atgtactagttttagttttct

SEQ ID NO: 1717029 - DNA, 22 bp, Homo sapiens
atgtactcacatataacatgca

SEQ ID NO: 1717030 - DNA, 20 bp, Homo sapiens
atgtactcttccgatgtttg

SEQ ID NO: 1717031 - DNA, 18 bp, Homo sapiens
atgtactgagccttgtaa

SEQ ID NO: 1717032 - DNA, 17 bp, Homo sapiens
atgtactgatttcagta

SEQ ID NO: 1717033 - DNA, 14 bp, Homo sapiens
atgtactgtttgct

SEQ ID NO: 1717034 - DNA, 20 bp, Homo sapiens
atgtacttagctgtactata

SEQ ID NO: 1717035 - DNA, 15 bp, Homo sapiens
atgtactttttagta

SEQ ID NO: 1717036 - DNA, 13 bp, Homo sapiens
atgtagaaactta

SEQ ID NO: 1717037 - DNA, 13 bp, Homo sapiens
gcccattcccacc

SEQ ID NO: 1717038 - DNA, 14 bp, Homo sapiens
gcccattcccacca

SEQ ID NO: 1717039 - DNA, 22 bp, Homo sapiens
gcccattcgtctgtcccagagc

SEQ ID NO: 1717040 - DNA, 15 bp, Homo sapiens
gcccattctctctcc

SEQ ID NO: 1717041 - DNA, 12 bp, Homo sapiens
gcccattgctgc

SEQ ID NO: 1717042 - DNA, 14 bp, Homo sapiens
gcccattgctgcca

SEQ ID NO: 1717043 - DNA, 17 bp, Homo sapiens
gcccattgctgccaagg

SEQ ID NO: 1717044 - DNA, 13 bp, Homo sapiens
gcccattgtcctc

SEQ ID NO: 1717045 - DNA, 19 bp, Homo sapiens
gccccaaacaaatatgcaa

SEQ ID NO: 1717046 - DNA, 13 bp, Homo sapiens
gccccaacctgct

SEQ ID NO: 1717047 - DNA, 14 bp, Homo sapiens
gccccaactcctgg

SEQ ID NO: 1717048 - DNA, 18 bp, Homo sapiens
gccccaactcctggaagc

SEQ ID NO: 1717049 - DNA, 23 bp, Homo sapiens
gccccaagcagccagccagtctt

SEQ ID NO: 1717050 - DNA, 22 bp, Homo sapiens
gccccaagggcccagaccctgg

SEQ ID NO: 1717051 - DNA, 21 bp, Homo sapiens
gccccaatgtatgtgtggctg

SEQ ID NO: 1717052 - DNA, 22 bp, Homo sapiens
gccccacagcccctcaaagact

SEQ ID NO: 1717053 - DNA, 16 bp, Homo sapiens
gccccacagggcaagg

SEQ ID NO: 1717054 - DNA, 21 bp, Homo sapiens
gccccacatgtggccatggcc

SEQ ID NO: 1717055 - DNA, 11 bp, Homo sapiens
gccccaccacc

SEQ ID NO: 1717056 - DNA, 13 bp, Homo sapiens
gccccaccaccta

SEQ ID NO: 1717057 - DNA, 15 bp, Homo sapiens
gccccaccacctagg

SEQ ID NO: 1717058 - DNA, 21 bp, Homo sapiens
gccccaccccacctcacagct

SEQ ID NO: 1717059 - DNA, 21 bp, Homo sapiens
gccccaccccatccagccaga

SEQ ID NO: 1717060 - DNA, 19 bp, Homo sapiens
gccccacccctaagtgccc

SEQ ID NO: 1717061 - DNA, 22 bp, Homo sapiens
gccccacccctaagtgcccaaa

SEQ ID NO: 1717062 - DNA, 12 bp, Homo sapiens
gccccaccctgg

SEQ ID NO: 1717063 - DNA, 14 bp, Homo sapiens
gccccaccctgggc

SEQ ID NO: 1717064 - DNA, 23 bp, Homo sapiens
gccccaccctgggccctgggctg

SEQ ID NO: 1717065 - DNA, 20 bp, Homo sapiens
gccccacctacttgtgactg

SEQ ID NO: 1717066 - DNA, 13 bp, Homo sapiens
gccccacctgcct

SEQ ID NO: 1717067 - DNA, 14 bp, Homo sapiens
gccccacctgtgtc

SEQ ID NO: 1717068 - DNA, 15 bp, Homo sapiens
gccccacctttatta

SEQ ID NO: 1717069 - DNA, 21 bp, Homo sapiens
gccccacctttattaaaatct

SEQ ID NO: 1717070 - DNA, 16 bp, Homo sapiens
gccccacgtggagctc

SEQ ID NO: 1717071 - DNA, 17 bp, Homo sapiens
gccccactccagcctgg

SEQ ID NO: 1717072 - DNA, 17 bp, Homo sapiens
gccccactctgcctgcc

SEQ ID NO: 1717073 - DNA, 14 bp, Homo sapiens
gccccactgacacc

SEQ ID NO: 1717074 - DNA, 22 bp, Homo sapiens
gccccactgacacccagtgtcc

SEQ ID NO: 1717075 - DNA, 17 bp, Homo sapiens
gccccagaaaatgaaat

SEQ ID NO: 1717076 - DNA, 15 bp, Homo sapiens
gccccagaaggcagg

SEQ ID NO: 1717077 - DNA, 18 bp, Homo sapiens
gccccagaaggcagggaa

SEQ ID NO: 1717078 - DNA, 17 bp, Homo sapiens
gccccagactgagctct

SEQ ID NO: 1717079 - DNA, 18 bp, Homo sapiens
gccccagactgagctctc

SEQ ID NO: 1717080 - DNA, 20 bp, Homo sapiens
gccccagactgagctctcca

SEQ ID NO: 1717081 - DNA, 12 bp, Homo sapiens
gccccagagctg

SEQ ID NO: 1717082 - DNA, 13 bp, Homo sapiens
gccccagagctgt

SEQ ID NO: 1717083 - DNA, 12 bp, Homo sapiens
gccccagaggcc

SEQ ID NO: 1717084 - DNA, 15 bp, Homo sapiens
gccccagaggccctg

SEQ ID NO: 1717085 - DNA, 18 bp, Homo sapiens
gccccagaggccctggag

SEQ ID NO: 1717086 - DNA, 21 bp, Homo sapiens
gccccagaggtcgcagctacc

SEQ ID NO: 1717087 - DNA, 22 bp, Homo sapiens
gccccagatctgcctgggcctg

SEQ ID NO: 1717088 - DNA, 21 bp, Homo sapiens
gccccagcaagagcacaagag

SEQ ID NO: 1717089 - DNA, 21 bp, Homo sapiens
gccccagcacctcagcctgca

SEQ ID NO: 1717090 - DNA, 19 bp, Homo sapiens
gccccagcactaacgtaaa

SEQ ID NO: 1717091 - DNA, 20 bp, Homo sapiens
gccccagccagagttcctgc

SEQ ID NO: 1717092 - DNA, 13 bp, Homo sapiens
gccccagcccaga

SEQ ID NO: 1717093 - DNA, 15 bp, Homo sapiens
gccccagccctgctg

SEQ ID NO: 1717094 - DNA, 18 bp, Homo sapiens
gccccagccctgctgggg

SEQ ID NO: 1717095 - DNA, 21 bp, Homo sapiens
gccccagcctccctgaagcct

SEQ ID NO: 1717096 - DNA, 14 bp, Homo sapiens
gccccagctctggc

SEQ ID NO: 1717097 - DNA, 19 bp, Homo sapiens
gccccagctgactgtggcc

SEQ ID NO: 1717098 - DNA, 15 bp, Homo sapiens
gccccaggaaaggcc

SEQ ID NO: 1717099 - DNA, 22 bp, Homo sapiens
gccccaggaaaggcccagccac

SEQ ID NO: 1717100 - DNA, 11 bp, Homo sapiens
gccccaggacc

SEQ ID NO: 1717101 - DNA, 14 bp, Homo sapiens
gccccaggaccagc

SEQ ID NO: 1717102 - DNA, 17 bp, Homo sapiens
gccccaggaccagctca

SEQ ID NO: 1717103 - DNA, 14 bp, Homo sapiens
atgtattattctgc

SEQ ID NO: 1717104 - DNA, 17 bp, Homo sapiens
atgtattatttaaatgt

SEQ ID NO: 1717105 - DNA, 16 bp, Homo sapiens
atgtattatttataat

SEQ ID NO: 1717106 - DNA, 22 bp, Homo sapiens
atgtattatttcattatgtaaa

SEQ ID NO: 1717107 - DNA, 17 bp, Homo sapiens
atgtattcccttgtatt

SEQ ID NO: 1717108 - DNA, 18 bp, Homo sapiens
atgtattcccttgtattt

SEQ ID NO: 1717109 - DNA, 14 bp, Homo sapiens
atgtattgattcaa

SEQ ID NO: 1717110 - DNA, 19 bp, Homo sapiens
atgtatttaaagttgtatc

SEQ ID NO: 1717111 - DNA, 21 bp, Homo sapiens
atgtatttatttaaaagattc

SEQ ID NO: 1717112 - DNA, 12 bp, Homo sapiens
atgtatttgatt

SEQ ID NO: 1717113 - DNA, 14 bp, Homo sapiens
atgtatttgttata

SEQ ID NO: 1717114 - DNA, 19 bp, Homo sapiens
atgtatttgttatatataa

SEQ ID NO: 1717115 - DNA, 16 bp, Homo sapiens
atgtattttaaaataa

SEQ ID NO: 1717116 - DNA, 13 bp, Homo sapiens
atgtattttccta

SEQ ID NO: 1717117 - DNA, 19 bp, Homo sapiens
atgtcaaagatatgttaag

SEQ ID NO: 1717118 - DNA, 15 bp, Homo sapiens
atgtcaagaaaagga

SEQ ID NO: 1717119 - DNA, 16 bp, Homo sapiens
atgtcaagtaccaaaa

SEQ ID NO: 1717120 - DNA, 16 bp, Homo sapiens
atgtcaatttctgtgt

SEQ ID NO: 1717121 - DNA, 19 bp, Homo sapiens
atgtcaatttctgtgttgc

SEQ ID NO: 1717122 - DNA, 14 bp, Homo sapiens
atgtcaatttgtat

SEQ ID NO: 1717123 - DNA, 17 bp, Homo sapiens
atgtcacctcagctgat

SEQ ID NO: 1717124 - DNA, 16 bp, Homo sapiens
atgtcagactggctgg

SEQ ID NO: 1717125 - DNA, 16 bp, Homo sapiens
atgtcagatacaatgt

SEQ ID NO: 1717126 - DNA, 18 bp, Homo sapiens
atgtcagatacaatgtat

SEQ ID NO: 1717127 - DNA, 19 bp, Homo sapiens
atgtcaggaacagaaggat

SEQ ID NO: 1717128 - DNA, 24 bp, Homo sapiens
atgtcagtgctataaatgccagag

SEQ ID NO: 1717129 - DNA, 21 bp, Homo sapiens
atgtcatactctgtgtaatct

SEQ ID NO: 1717130 - DNA, 19 bp, Homo sapiens
atgtcatagccaaagccag

SEQ ID NO: 1717131 - DNA, 22 bp, Homo sapiens
atgtcatatactgccatgtact

SEQ ID NO: 1717132 - DNA, 13 bp, Homo sapiens
atgtcatcttgag

SEQ ID NO: 1717133 - DNA, 15 bp, Homo sapiens
atgtcatcttgagct

SEQ ID NO: 1717134 - DNA, 17 bp, Homo sapiens
atgtcatgtacttcctg

SEQ ID NO: 1717135 - DNA, 16 bp, Homo sapiens
atgtcattaaacatga

SEQ ID NO: 1717136 - DNA, 15 bp, Homo sapiens
atgtcattgctaaaa

SEQ ID NO: 1717137 - DNA, 19 bp, Homo sapiens
atgtcattgctaaaaaata

SEQ ID NO: 1717138 - DNA, 21 bp, Homo sapiens
atgtcattgctaaaaaataaa

SEQ ID NO: 1717139 - DNA, 13 bp, Homo sapiens
atgtcattgtcta

SEQ ID NO: 1717140 - DNA, 18 bp, Homo sapiens
atgtccaacagagtggac

SEQ ID NO: 1717141 - DNA, 16 bp, Homo sapiens
atgtccacagatgcct

SEQ ID NO: 1717142 - DNA, 20 bp, Homo sapiens
atgtccacagatgcctccac

SEQ ID NO: 1717143 - DNA, 22 bp, Homo sapiens
atgtccagcaccttgtgcctgg

SEQ ID NO: 1717144 - DNA, 21 bp, Homo sapiens
atgtccatacactttgttgca

SEQ ID NO: 1717145 - DNA, 19 bp, Homo sapiens
atgtccatttatatcattt

SEQ ID NO: 1717146 - DNA, 12 bp, Homo sapiens
atgtcccaccca

SEQ ID NO: 1717147 - DNA, 14 bp, Homo sapiens
atgtcccagaaatg

SEQ ID NO: 1717148 - DNA, 18 bp, Homo sapiens
atgtccccataagacaaa

SEQ ID NO: 1717149 - DNA, 16 bp, Homo sapiens
atgtccccattctata

SEQ ID NO: 1717150 - DNA, 13 bp, Homo sapiens
atgtcccctgcgg

SEQ ID NO: 1717151 - DNA, 21 bp, Homo sapiens
atgtcccctgtcccaccaact

SEQ ID NO: 1717152 - DNA, 15 bp, Homo sapiens
gcccccagggcctcc

SEQ ID NO: 1717153 - DNA, 20 bp, Homo sapiens
gcccccagggcctccagggc

SEQ ID NO: 1717154 - DNA, 21 bp, Homo sapiens
gcccccagggcctccagggcc

SEQ ID NO: 1717155 - DNA, 22 bp, Homo sapiens
gcccccagggcctccagggccc

SEQ ID NO: 1717156 - DNA, 13 bp, Homo sapiens
gcccccaggggca

SEQ ID NO: 1717157 - DNA, 22 bp, Homo sapiens
gcccccagtatctcttcagtct

SEQ ID NO: 1717158 - DNA, 21 bp, Homo sapiens
gcccccagtccccacccctgc

SEQ ID NO: 1717159 - DNA, 14 bp, Homo sapiens
gcccccatccctcg

SEQ ID NO: 1717160 - DNA, 21 bp, Homo sapiens
gccccccacccctggaagagc

SEQ ID NO: 1717161 - DNA, 13 bp, Homo sapiens
gccccccctaaga

SEQ ID NO: 1717162 - DNA, 19 bp, Homo sapiens
gccccccgcacagccaccc

SEQ ID NO: 1717163 - DNA, 15 bp, Homo sapiens
gccccccgcagcacc

SEQ ID NO: 1717164 - DNA, 14 bp, Homo sapiens
gcccccctcaaacc

SEQ ID NO: 1717165 - DNA, 16 bp, Homo sapiens
gcccccctcccaacag

SEQ ID NO: 1717166 - DNA, 15 bp, Homo sapiens
gcccccctcctccag

SEQ ID NO: 1717167 - DNA, 16 bp, Homo sapiens
gcccccgacggctgtg

SEQ ID NO: 1717168 - DNA, 16 bp, Homo sapiens
gcccccgcccccggcg

SEQ ID NO: 1717169 - DNA, 15 bp, Homo sapiens
gcccccgcctgccac

SEQ ID NO: 1717170 - DNA, 13 bp, Homo sapiens
gcccccgcctggg

SEQ ID NO: 1717171 - DNA, 19 bp, Homo sapiens
gcccccgcgggttctagac

SEQ ID NO: 1717172 - DNA, 13 bp, Homo sapiens
gccccctccccca

SEQ ID NO: 1717173 - DNA, 16 bp, Homo sapiens
gccccctcccccatgg

SEQ ID NO: 1717174 - DNA, 19 bp, Homo sapiens
gccccctccccccagactc

SEQ ID NO: 1717175 - DNA, 20 bp, Homo sapiens
gccccctccccccagactct

SEQ ID NO: 1717176 - DNA, 16 bp, Homo sapiens
gccccctccgccctgc

SEQ ID NO: 1717177 - DNA, 21 bp, Homo sapiens
gccccctccgtgatccatcca

SEQ ID NO: 1717178 - DNA, 21 bp, Homo sapiens
gccccctcctctagctgtggg

SEQ ID NO: 1717179 - DNA, 16 bp, Homo sapiens
gccccctcctctccca

SEQ ID NO: 1717180 - DNA, 19 bp, Homo sapiens
gccccctcctctcccatcc

SEQ ID NO: 1717181 - DNA, 20 bp, Homo sapiens
gccccctcgggggcctgtgg

SEQ ID NO: 1717182 - DNA, 20 bp, Homo sapiens
gccccctctcggccaggcat

SEQ ID NO: 1717183 - DNA, 13 bp, Homo sapiens
gccccctgcaccc

SEQ ID NO: 1717184 - DNA, 18 bp, Homo sapiens
gccccctgcacccacccc

SEQ ID NO: 1717185 - DNA, 14 bp, Homo sapiens
gccccctgcctgcc

SEQ ID NO: 1717186 - DNA, 13 bp, Homo sapiens
gccccctggatgg

SEQ ID NO: 1717187 - DNA, 13 bp, Homo sapiens
gccccctggcctc

SEQ ID NO: 1717188 - DNA, 21 bp, Homo sapiens
gccccctggtggacagtcctg

SEQ ID NO: 1717189 - DNA, 19 bp, Homo sapiens
gcccccttcggttacagga

SEQ ID NO: 1717190 - DNA, 13 bp, Homo sapiens
gcccccttgccct

SEQ ID NO: 1717191 - DNA, 17 bp, Homo sapiens
gcccccttgccctccgc

SEQ ID NO: 1717192 - DNA, 18 bp, Homo sapiens
gccccgagacaccatcct

SEQ ID NO: 1717193 - DNA, 15 bp, Homo sapiens
gccccgatggactcc

SEQ ID NO: 1717194 - DNA, 19 bp, Homo sapiens
gccccgatggactcctgac

SEQ ID NO: 1717195 - DNA, 17 bp, Homo sapiens
gccccgccagggctggg

SEQ ID NO: 1717196 - DNA, 20 bp, Homo sapiens
gccccgccagggctggggac

SEQ ID NO: 1717197 - DNA, 13 bp, Homo sapiens
gccccgcccccac

SEQ ID NO: 1717198 - DNA, 21 bp, Homo sapiens
gccccgcccccacccctacag

SEQ ID NO: 1717199 - DNA, 12 bp, Homo sapiens
gccccgcccctc

SEQ ID NO: 1717200 - DNA, 18 bp, Homo sapiens
gccccgcccctcccacgc

SEQ ID NO: 1717201 - DNA, 14 bp, Homo sapiens
gccccgcctccccg

SEQ ID NO: 1717202 - DNA, 22 bp, Homo sapiens
gccccgcctgagtcagtgctct

SEQ ID NO: 1717203 - DNA, 12 bp, Homo sapiens
gccccgctagcg

SEQ ID NO: 1717204 - DNA, 16 bp, Homo sapiens
gccccggccccagcca

SEQ ID NO: 1717205 - DNA, 17 bp, Homo sapiens
gccccgggctctggcca

SEQ ID NO: 1717206 - DNA, 18 bp, Homo sapiens
gccccgggctctggccac

SEQ ID NO: 1717207 - DNA, 21 bp, Homo sapiens
gccccgggctctggccaccct

SEQ ID NO: 1717208 - DNA, 13 bp, Homo sapiens
gccccggggctgg

SEQ ID NO: 1717209 - DNA, 14 bp, Homo sapiens
gccccggggctggc

SEQ ID NO: 1717210 - DNA, 16 bp, Homo sapiens
gccccgggtccaggag

SEQ ID NO: 1717211 - DNA, 15 bp, Homo sapiens
gccccgggtccccag

SEQ ID NO: 1717212 - DNA, 18 bp, Homo sapiens
gccccgggtccccagctc

SEQ ID NO: 1717213 - DNA, 20 bp, Homo sapiens
gccccgggtccccagctccc

SEQ ID NO: 1717214 - DNA, 13 bp, Homo sapiens
gccccgtgtctgg

SEQ ID NO: 1717215 - DNA, 16 bp, Homo sapiens
gccccgttccctgtca

SEQ ID NO: 1717216 - DNA, 17 bp, Homo sapiens
gccccgttccctgtcag

SEQ ID NO: 1717217 - DNA, 21 bp, Homo sapiens
gccccgttccctgtcagaggc

SEQ ID NO: 1717218 - DNA, 19 bp, Homo sapiens
gccccgttgcttcccgctg

SEQ ID NO: 1717219 - DNA, 17 bp, Homo sapiens
gcccctaatctctgtag

SEQ ID NO: 1717220 - DNA, 19 bp, Homo sapiens
gcccctaatctctgtagga

SEQ ID NO: 1717221 - DNA, 21 bp, Homo sapiens
gcccctacgggcgctgcagcc

SEQ ID NO: 1717222 - DNA, 20 bp, Homo sapiens
atgtgacaattttgtacaaa

SEQ ID NO: 1717223 - DNA, 11 bp, Homo sapiens
atgtgacacat

SEQ ID NO: 1717224 - DNA, 22 bp, Homo sapiens
atgtgacatgcccaaggccacg

SEQ ID NO: 1717225 - DNA, 17 bp, Homo sapiens
atgtgactgcatcatat

SEQ ID NO: 1717226 - DNA, 14 bp, Homo sapiens
atgtgactgtataa

SEQ ID NO: 1717227 - DNA, 18 bp, Homo sapiens
atgtgacttcatgctata

SEQ ID NO: 1717228 - DNA, 14 bp, Homo sapiens
atgtgacttctccc

SEQ ID NO: 1717229 - DNA, 15 bp, Homo sapiens
atgtgagaagccagc

SEQ ID NO: 1717230 - DNA, 19 bp, Homo sapiens
atgtgagccaccgctgcca

SEQ ID NO: 1717231 - DNA, 22 bp, Homo sapiens
atgtgaggaactcacatactga

SEQ ID NO: 1717232 - DNA, 19 bp, Homo sapiens
atgtgaggtaattattgct

SEQ ID NO: 1717233 - DNA, 15 bp, Homo sapiens
atgtgagtccctgtg

SEQ ID NO: 1717234 - DNA, 19 bp, Homo sapiens
atgtgagtccctgtgatgg

SEQ ID NO: 1717235 - DNA, 20 bp, Homo sapiens
atgtgagtgacgatgatgta

SEQ ID NO: 1717236 - DNA, 20 bp, Homo sapiens
atgtgataaggatcagaaca

SEQ ID NO: 1717237 - DNA, 21 bp, Homo sapiens
atgtgataagttcttatgcca

SEQ ID NO: 1717238 - DNA, 15 bp, Homo sapiens
atgtgatattctaag

SEQ ID NO: 1717239 - DNA, 16 bp, Homo sapiens
atgtgatattctaaga

SEQ ID NO: 1717240 - DNA, 18 bp, Homo sapiens
atgtgatattctaagact

SEQ ID NO: 1717241 - DNA, 13 bp, Homo sapiens
atgtgatattctg

SEQ ID NO: 1717242 - DNA, 16 bp, Homo sapiens
atgtgatcactgagac

SEQ ID NO: 1717243 - DNA, 14 bp, Homo sapiens
atgtgatggttggt

SEQ ID NO: 1717244 - DNA, 16 bp, Homo sapiens
atgtgatgttctaagg

SEQ ID NO: 1717245 - DNA, 19 bp, Homo sapiens
atgtgatgttctaaggctc

SEQ ID NO: 1717246 - DNA, 20 bp, Homo sapiens
atgtgatgttctaaggctct

SEQ ID NO: 1717247 - DNA, 15 bp, Homo sapiens
atgtgatttttctga

SEQ ID NO: 1717248 - DNA, 23 bp, Homo sapiens
atgtgcaaaatctgttatagctt

SEQ ID NO: 1717249 - DNA, 17 bp, Homo sapiens
atgtgcaatacattttt

SEQ ID NO: 1717250 - DNA, 18 bp, Homo sapiens
atgtgcaatagaaggtga

SEQ ID NO: 1717251 - DNA, 20 bp, Homo sapiens
atgtgcagaaaatatttaat

SEQ ID NO: 1717252 - DNA, 13 bp, Homo sapiens
atgtgcagcaaaa

SEQ ID NO: 1717253 - DNA, 16 bp, Homo sapiens
atgtgcatctggtgta

SEQ ID NO: 1717254 - DNA, 21 bp, Homo sapiens
atgtgcatttcacctgtgaca

SEQ ID NO: 1717255 - DNA, 22 bp, Homo sapiens
atgtgcatttcacctgtgacaa

SEQ ID NO: 1717256 - DNA, 20 bp, Homo sapiens
atgtgcatttttgtgaaatg

SEQ ID NO: 1717257 - DNA, 22 bp, Homo sapiens
atgtgccaccaacataaaacaa

SEQ ID NO: 1717258 - DNA, 23 bp, Homo sapiens
atgtgccaccaacataaaacaaa

SEQ ID NO: 1717259 - DNA, 15 bp, Homo sapiens
atgtgccagttcctg

SEQ ID NO: 1717260 - DNA, 14 bp, Homo sapiens
atgtgccatctgta

SEQ ID NO: 1717261 - DNA, 15 bp, Homo sapiens
atgtgcctaattttc

SEQ ID NO: 1717262 - DNA, 16 bp, Homo sapiens
atgtgcctaattttct

SEQ ID NO: 1717263 - DNA, 20 bp, Homo sapiens
atgtgcctgtcacgctctgg

SEQ ID NO: 1717264 - DNA, 18 bp, Homo sapiens
atgtgcctttctttgcct

SEQ ID NO: 1717265 - DNA, 20 bp, Homo sapiens
atgtgcgtctctctttctcc

SEQ ID NO: 1717266 - DNA, 20 bp, Homo sapiens
atgtgctactgattgtttca

SEQ ID NO: 1717267 - DNA, 18 bp, Homo sapiens
gcccctgaggactggaga

SEQ ID NO: 1717268 - DNA, 14 bp, Homo sapiens
gcccctgaggagct

SEQ ID NO: 1717269 - DNA, 17 bp, Homo sapiens
gcccctgatgcagcctg

SEQ ID NO: 1717270 - DNA, 18 bp, Homo sapiens
gcccctgatgcagcctgt

SEQ ID NO: 1717271 - DNA, 15 bp, Homo sapiens
gcccctgcaatgtgg

SEQ ID NO: 1717272 - DNA, 13 bp, Homo sapiens
gcccctgcagttg

SEQ ID NO: 1717273 - DNA, 14 bp, Homo sapiens
gcccctgcagttgg

SEQ ID NO: 1717274 - DNA, 17 bp, Homo sapiens
gcccctgcagttggcag

SEQ ID NO: 1717275 - DNA, 17 bp, Homo sapiens
gcccctgctgtctctct

SEQ ID NO: 1717276 - DNA, 19 bp, Homo sapiens
gcccctgctgtctctctgg

SEQ ID NO: 1717277 - DNA, 14 bp, Homo sapiens
gcccctggagccag

SEQ ID NO: 1717278 - DNA, 15 bp, Homo sapiens
gcccctggagccaga

SEQ ID NO: 1717279 - DNA, 12 bp, Homo sapiens
gcccctggcact

SEQ ID NO: 1717280 - DNA, 19 bp, Homo sapiens
gcccctggccccgcctgcc

SEQ ID NO: 1717281 - DNA, 17 bp, Homo sapiens
gcccctggctttgcctc

SEQ ID NO: 1717282 - DNA, 13 bp, Homo sapiens
gcccctgggctac

SEQ ID NO: 1717283 - DNA, 16 bp, Homo sapiens
gcccctgggctaccat

SEQ ID NO: 1717284 - DNA, 14 bp, Homo sapiens
gcccctgggctctc

SEQ ID NO: 1717285 - DNA, 16 bp, Homo sapiens
gcccctgggctctcac

SEQ ID NO: 1717286 - DNA, 21 bp, Homo sapiens
gcccctgggctctcacccagt

SEQ ID NO: 1717287 - DNA, 20 bp, Homo sapiens
gcccctgggcttggcctgct

SEQ ID NO: 1717288 - DNA, 19 bp, Homo sapiens
gcccctggggaaatagcct

SEQ ID NO: 1717289 - DNA, 15 bp, Homo sapiens
gcccctggggtggcc

SEQ ID NO: 1717290 - DNA, 22 bp, Homo sapiens
gcccctgggtgggtggtgggga

SEQ ID NO: 1717291 - DNA, 15 bp, Homo sapiens
gcccctgtcccaccc

SEQ ID NO: 1717292 - DNA, 13 bp, Homo sapiens
gcccctgtggcca

SEQ ID NO: 1717293 - DNA, 14 bp, Homo sapiens
gcccctgtggccct

SEQ ID NO: 1717294 - DNA, 18 bp, Homo sapiens
gcccctgtggccctggcc

SEQ ID NO: 1717295 - DNA, 21 bp, Homo sapiens
gcccctgtgtattcaccacca

SEQ ID NO: 1717296 - DNA, 16 bp, Homo sapiens
gccccttaagggttga

SEQ ID NO: 1717297 - DNA, 20 bp, Homo sapiens
gccccttaagggttgaaggc

SEQ ID NO: 1717298 - DNA, 12 bp, Homo sapiens
gccccttccccc

SEQ ID NO: 1717299 - DNA, 11 bp, Homo sapiens
gccccttccct

SEQ ID NO: 1717300 - DNA, 14 bp, Homo sapiens
gccccttcctttaa

SEQ ID NO: 1717301 - DNA, 13 bp, Homo sapiens
gccccttgccatc

SEQ ID NO: 1717302 - DNA, 13 bp, Homo sapiens
gccccttggagag

SEQ ID NO: 1717303 - DNA, 21 bp, Homo sapiens
gccccttggagagagaggctg

SEQ ID NO: 1717304 - DNA, 18 bp, Homo sapiens
gccccttggattcctgca

SEQ ID NO: 1717305 - DNA, 19 bp, Homo sapiens
gccccttttacttttttat

SEQ ID NO: 1717306 - DNA, 15 bp, Homo sapiens
gcccgaacagggact

SEQ ID NO: 1717307 - DNA, 17 bp, Homo sapiens
gcccgaacagggacttg

SEQ ID NO: 1717308 - DNA, 14 bp, Homo sapiens
gcccgacagtgcca

SEQ ID NO: 1717309 - DNA, 15 bp, Homo sapiens
gcccgacagtgccat

SEQ ID NO: 1717310 - DNA, 16 bp, Homo sapiens
gcccgacagtgccatc

SEQ ID NO: 1717311 - DNA, 22 bp, Homo sapiens
gcccgacatggctccggcctct

SEQ ID NO: 1717312 - DNA, 13 bp, Homo sapiens
gcccgacttgctg

SEQ ID NO: 1717313 - DNA, 22 bp, Homo sapiens
gcccgagagagctctggccccg

SEQ ID NO: 1717314 - DNA, 13 bp, Homo sapiens
gcccgcacacctg

SEQ ID NO: 1717315 - DNA, 17 bp, Homo sapiens
gcccgcacccctccctg

SEQ ID NO: 1717316 - DNA, 16 bp, Homo sapiens
gcccgcaccctggcct

SEQ ID NO: 1717317 - DNA, 18 bp, Homo sapiens
gcccgcaccctggcctgg

SEQ ID NO: 1717318 - DNA, 20 bp, Homo sapiens
gcccgcaggaactgggctgg

SEQ ID NO: 1717319 - DNA, 23 bp, Homo sapiens
gcccgcaggaactgggctgggcc

SEQ ID NO: 1717320 - DNA, 22 bp, Homo sapiens
gcccgcagggccatgcagacct

SEQ ID NO: 1717321 - DNA, 15 bp, Homo sapiens
gcccgcagtgctggg

SEQ ID NO: 1717322 - DNA, 20 bp, Homo sapiens
gcccgcagtgctgggaccag

SEQ ID NO: 1717323 - DNA, 23 bp, Homo sapiens
gcccgcagtgctgggaccagagc

SEQ ID NO: 1717324 - DNA, 13 bp, Homo sapiens
gcccgccagcctc

SEQ ID NO: 1717325 - DNA, 15 bp, Homo sapiens
gcccgcccactgtcc

SEQ ID NO: 1717326 - DNA, 20 bp, Homo sapiens
gcccgcccactgtcctgggc

SEQ ID NO: 1717327 - DNA, 19 bp, Homo sapiens
gcccgcctgccgtgcatgg

SEQ ID NO: 1717328 - DNA, 20 bp, Homo sapiens
gcccgcctgccgtgcatggc

SEQ ID NO: 1717329 - DNA, 15 bp, Homo sapiens
gcccgcgtgctggag

SEQ ID NO: 1717330 - DNA, 21 bp, Homo sapiens
gcccgctcccttcctgccact

SEQ ID NO: 1717331 - DNA, 22 bp, Homo sapiens
gcccgctcccttcctgccactg

SEQ ID NO: 1717332 - DNA, 15 bp, Homo sapiens
gcccgctctgcagac

SEQ ID NO: 1717333 - DNA, 14 bp, Homo sapiens
gcccgctgggctga

SEQ ID NO: 1717334 - DNA, 16 bp, Homo sapiens
gcccgctgggctgagc

SEQ ID NO: 1717335 - DNA, 18 bp, Homo sapiens
gcccgctgggctgagccc

SEQ ID NO: 1717336 - DNA, 23 bp, Homo sapiens
gcccgcttttgttcttccccaca

SEQ ID NO: 1717337 - DNA, 17 bp, Homo sapiens
gcccggactcaccaact

SEQ ID NO: 1717338 - DNA, 15 bp, Homo sapiens
gcccggagaaacctg

SEQ ID NO: 1717339 - DNA, 17 bp, Homo sapiens
gcccggagaaacctgat

SEQ ID NO: 1717340 - DNA, 23 bp, Homo sapiens
gcccggagtaatcaggcagcctt

SEQ ID NO: 1717341 - DNA, 12 bp, Homo sapiens
atgttaaagcat

SEQ ID NO: 1717342 - DNA, 18 bp, Homo sapiens
atgttaacctcagtgtca

SEQ ID NO: 1717343 - DNA, 21 bp, Homo sapiens
atgttaacctcagtgtcattt

SEQ ID NO: 1717344 - DNA, 18 bp, Homo sapiens
atgttaagataacttact

SEQ ID NO: 1717345 - DNA, 22 bp, Homo sapiens
atgttaagataacttactgtat

SEQ ID NO: 1717346 - DNA, 12 bp, Homo sapiens
atgttaagcaga

SEQ ID NO: 1717347 - DNA, 15 bp, Homo sapiens
atgttaagcatttat

SEQ ID NO: 1717348 - DNA, 16 bp, Homo sapiens
atgttaagcatttatt

SEQ ID NO: 1717349 - DNA, 13 bp, Homo sapiens
atgttaagctctt

SEQ ID NO: 1717350 - DNA, 15 bp, Homo sapiens
atgttaagctcttta

SEQ ID NO: 1717351 - DNA, 17 bp, Homo sapiens
atgttaatcagcccctc

SEQ ID NO: 1717352 - DNA, 23 bp, Homo sapiens
atgttaattcagcactgatttca

SEQ ID NO: 1717353 - DNA, 20 bp, Homo sapiens
atgttaatttgtgtgttttt

SEQ ID NO: 1717354 - DNA, 13 bp, Homo sapiens
atgttacacatta

SEQ ID NO: 1717355 - DNA, 19 bp, Homo sapiens
atgttacataagataaatg

SEQ ID NO: 1717356 - DNA, 20 bp, Homo sapiens
atgttacataagataaatgt

SEQ ID NO: 1717357 - DNA, 14 bp, Homo sapiens
atgttacattgttt

SEQ ID NO: 1717358 - DNA, 14 bp, Homo sapiens
atgttacccattca

SEQ ID NO: 1717359 - DNA, 21 bp, Homo sapiens
atgttacctcctataaactta

SEQ ID NO: 1717360 - DNA, 14 bp, Homo sapiens
atgttacctctgaa

SEQ ID NO: 1717361 - DNA, 19 bp, Homo sapiens
atgttacggcatcacactt

SEQ ID NO: 1717362 - DNA, 14 bp, Homo sapiens
atgttactattttc

SEQ ID NO: 1717363 - DNA, 23 bp, Homo sapiens
atgttactattttctacaattaa

SEQ ID NO: 1717364 - DNA, 13 bp, Homo sapiens
atgttactgacca

SEQ ID NO: 1717365 - DNA, 14 bp, Homo sapiens
atgttactgaccag

SEQ ID NO: 1717366 - DNA, 21 bp, Homo sapiens
atgttacttattttaaaataa

SEQ ID NO: 1717367 - DNA, 15 bp, Homo sapiens
atgttagtcattgtt

SEQ ID NO: 1717368 - DNA, 20 bp, Homo sapiens
atgttagttaccttatagtt

SEQ ID NO: 1717369 - DNA, 22 bp, Homo sapiens
atgttatcggattactgaattg

SEQ ID NO: 1717370 - DNA, 15 bp, Homo sapiens
atgttatcttctcaa

SEQ ID NO: 1717371 - DNA, 13 bp, Homo sapiens
atgttatgaacag

SEQ ID NO: 1717372 - DNA, 20 bp, Homo sapiens
atgttatgaacagctgtgtc

SEQ ID NO: 1717373 - DNA, 22 bp, Homo sapiens
atgttatgaacagctgtgtctg

SEQ ID NO: 1717374 - DNA, 18 bp, Homo sapiens
atgttatgcataaagtca

SEQ ID NO: 1717375 - DNA, 23 bp, Homo sapiens
atgttatgggatgtaaacaatgt

SEQ ID NO: 1717376 - DNA, 13 bp, Homo sapiens
atgttatgtatat

SEQ ID NO: 1717377 - DNA, 13 bp, Homo sapiens
atgttattactgt

SEQ ID NO: 1717378 - DNA, 15 bp, Homo sapiens
atgttattactgttt

SEQ ID NO: 1717379 - DNA, 17 bp, Homo sapiens
atgttattactgttttg

SEQ ID NO: 1717380 - DNA, 22 bp, Homo sapiens
atgttattactgttttgggcct

SEQ ID NO: 1717381 - DNA, 13 bp, Homo sapiens
atgttattatctg

SEQ ID NO: 1717382 - DNA, 15 bp, Homo sapiens
gccctcacctctgag

SEQ ID NO: 1717383 - DNA, 16 bp, Homo sapiens
gccctcacctctgagg

SEQ ID NO: 1717384 - DNA, 18 bp, Homo sapiens
gccctcacctctgaggac

SEQ ID NO: 1717385 - DNA, 23 bp, Homo sapiens
gccctcacctctgaggacagagg

SEQ ID NO: 1717386 - DNA, 17 bp, Homo sapiens
gccctcactccctctgc

SEQ ID NO: 1717387 - DNA, 21 bp, Homo sapiens
gccctcactcttgaagtccag

SEQ ID NO: 1717388 - DNA, 19 bp, Homo sapiens
gccctcagtagtccctgca

SEQ ID NO: 1717389 - DNA, 18 bp, Homo sapiens
gccctcatggcccctctg

SEQ ID NO: 1717390 - DNA, 12 bp, Homo sapiens
gccctccaaaga

SEQ ID NO: 1717391 - DNA, 15 bp, Homo sapiens
gccctccactccagc

SEQ ID NO: 1717392 - DNA, 19 bp, Homo sapiens
gccctccacttctggtata

SEQ ID NO: 1717393 - DNA, 13 bp, Homo sapiens
gccctccaggcct

SEQ ID NO: 1717394 - DNA, 16 bp, Homo sapiens
gccctccaggcctgca

SEQ ID NO: 1717395 - DNA, 14 bp, Homo sapiens
gccctcccctgctc

SEQ ID NO: 1717396 - DNA, 21 bp, Homo sapiens
gccctccctctcccaggcccg

SEQ ID NO: 1717397 - DNA, 21 bp, Homo sapiens
gccctccctgcccctcccttc

SEQ ID NO: 1717398 - DNA, 14 bp, Homo sapiens
gccctccctgtcct

SEQ ID NO: 1717399 - DNA, 21 bp, Homo sapiens
gccctccctgtcctcctcgga

SEQ ID NO: 1717400 - DNA, 21 bp, Homo sapiens
gccctcccttggaaacctgcc

SEQ ID NO: 1717401 - DNA, 15 bp, Homo sapiens
gccctccctttctct

SEQ ID NO: 1717402 - DNA, 21 bp, Homo sapiens
gccctccctttctctctccac

SEQ ID NO: 1717403 - DNA, 23 bp, Homo sapiens
gccctccctttctctctccaccc

SEQ ID NO: 1717404 - DNA, 12 bp, Homo sapiens
gccctccgcctg

SEQ ID NO: 1717405 - DNA, 15 bp, Homo sapiens
gccctccgcctggga

SEQ ID NO: 1717406 - DNA, 16 bp, Homo sapiens
gccctccgcctgggat

SEQ ID NO: 1717407 - DNA, 21 bp, Homo sapiens
gccctcctcaccccgtctggg

SEQ ID NO: 1717408 - DNA, 22 bp, Homo sapiens
gccctcctcagcgagaggcagc

SEQ ID NO: 1717409 - DNA, 22 bp, Homo sapiens
gccctcctcgggccgaggccca

SEQ ID NO: 1717410 - DNA, 12 bp, Homo sapiens
gccctcctggac

SEQ ID NO: 1717411 - DNA, 14 bp, Homo sapiens
gccctcctttccct

SEQ ID NO: 1717412 - DNA, 16 bp, Homo sapiens
gccctcgaaccaaggc

SEQ ID NO: 1717413 - DNA, 19 bp, Homo sapiens
gccctcggaggtccagctg

SEQ ID NO: 1717414 - DNA, 24 bp, Homo sapiens
gccctcggaggtccagctgggcct

SEQ ID NO: 1717415 - DNA, 14 bp, Homo sapiens
gccctcgtggccag

SEQ ID NO: 1717416 - DNA, 22 bp, Homo sapiens
gccctctatttattagccaact

SEQ ID NO: 1717417 - DNA, 17 bp, Homo sapiens
gccctctctctgcggca

SEQ ID NO: 1717418 - DNA, 13 bp, Homo sapiens
gccctctctctgg

SEQ ID NO: 1717419 - DNA, 14 bp, Homo sapiens
gccctctctctggg

SEQ ID NO: 1717420 - DNA, 21 bp, Homo sapiens
gccctctctgctccttcactg

SEQ ID NO: 1717421 - DNA, 15 bp, Homo sapiens
gccctctgccccatc

SEQ ID NO: 1717422 - DNA, 12 bp, Homo sapiens
gccctctgcctg

SEQ ID NO: 1717423 - DNA, 12 bp, Homo sapiens
gccctctgtagc

SEQ ID NO: 1717424 - DNA, 19 bp, Homo sapiens
gccctctgtagctccctcc

SEQ ID NO: 1717425 - DNA, 12 bp, Homo sapiens
gccctcttctcg

SEQ ID NO: 1717426 - DNA, 18 bp, Homo sapiens
gccctcttgcgggcctgg

SEQ ID NO: 1717427 - DNA, 21 bp, Homo sapiens
gccctcttgcgggcctggaca

SEQ ID NO: 1717428 - DNA, 14 bp, Homo sapiens
gccctctttccctg

SEQ ID NO: 1717429 - DNA, 16 bp, Homo sapiens
gccctctttccctgcg

SEQ ID NO: 1717430 - DNA, 19 bp, Homo sapiens
gccctctttccctgcgaga

SEQ ID NO: 1717431 - DNA, 16 bp, Homo sapiens
gccctgaaagggccct

SEQ ID NO: 1717432 - DNA, 16 bp, Homo sapiens
gccctgacttctggag

SEQ ID NO: 1717433 - DNA, 22 bp, Homo sapiens
gccctgagagagaatagagctg

SEQ ID NO: 1717434 - DNA, 18 bp, Homo sapiens
gccctgaggacctctcag

SEQ ID NO: 1717435 - DNA, 20 bp, Homo sapiens
gccctgaggacctctcagca

SEQ ID NO: 1717436 - DNA, 21 bp, Homo sapiens
gccctgaggtgaaagggagct

SEQ ID NO: 1717437 - DNA, 23 bp, Homo sapiens
gccctgagtcctggtttcctggc

SEQ ID NO: 1717438 - DNA, 17 bp, Homo sapiens
gccctgagtctgggcag

SEQ ID NO: 1717439 - DNA, 13 bp, Homo sapiens
gccctgagtgtcc

SEQ ID NO: 1717440 - DNA, 14 bp, Homo sapiens
gccctgagtgtccc

SEQ ID NO: 1717441 - DNA, 22 bp, Homo sapiens
gccctgatgtgtcctcagggag

SEQ ID NO: 1717442 - DNA, 20 bp, Homo sapiens
gccctgcacagatatttcca

SEQ ID NO: 1717443 - DNA, 17 bp, Homo sapiens
gccctgcaccatgctgc

SEQ ID NO: 1717444 - DNA, 16 bp, Homo sapiens
gccctgcacctgtgca

SEQ ID NO: 1717445 - DNA, 21 bp, Homo sapiens
gccctgcagaggggaaaccag

SEQ ID NO: 1717446 - DNA, 15 bp, Homo sapiens
gccctgcagccagct

SEQ ID NO: 1717447 - DNA, 18 bp, Homo sapiens
gccctgcattggcctggc

SEQ ID NO: 1717448 - DNA, 19 bp, Homo sapiens
gccctgcattggcctggcc

SEQ ID NO: 1717449 - DNA, 22 bp, Homo sapiens
gccctgcattggcctggcctcc

SEQ ID NO: 1717450 - DNA, 23 bp, Homo sapiens
gccctgcattggcctggcctcca

SEQ ID NO: 1717451 - DNA, 13 bp, Homo sapiens
gccctgccactca

SEQ ID NO: 1717452 - DNA, 20 bp, Homo sapiens
gccctgccactcactaggcc

SEQ ID NO: 1717453 - DNA, 15 bp, Homo sapiens
gccctgccccacccc

SEQ ID NO: 1717454 - DNA, 16 bp, Homo sapiens
gccctgccccacccca

SEQ ID NO: 1717455 - DNA, 23 bp, Homo sapiens
gccctgcccccatctccccaggc

SEQ ID NO: 1717456 - DNA, 11 bp, Homo sapiens
gccctgcccct

SEQ ID NO: 1717457 - DNA, 12 bp, Homo sapiens
gccctgccccta

SEQ ID NO: 1717458 - DNA, 22 bp, Homo sapiens
gccctgcccctaggatgctgca

SEQ ID NO: 1717459 - DNA, 22 bp, Homo sapiens
atgtttatgcaaggaaggaaag

SEQ ID NO: 1717460 - DNA, 21 bp, Homo sapiens
atgtttatgtaaacaaatctt

SEQ ID NO: 1717461 - DNA, 13 bp, Homo sapiens
atgtttattaaat

SEQ ID NO: 1717462 - DNA, 19 bp, Homo sapiens
atgtttattaaatgcttca

SEQ ID NO: 1717463 - DNA, 14 bp, Homo sapiens
atgtttattcctga

SEQ ID NO: 1717464 - DNA, 21 bp, Homo sapiens
atgtttattggtatattttct

SEQ ID NO: 1717465 - DNA, 12 bp, Homo sapiens
atgtttcaaact

SEQ ID NO: 1717466 - DNA, 13 bp, Homo sapiens
atgtttcaaactt

SEQ ID NO: 1717467 - DNA, 16 bp, Homo sapiens
atgtttcaactgtgct

SEQ ID NO: 1717468 - DNA, 15 bp, Homo sapiens
atgtttccagacttc

SEQ ID NO: 1717469 - DNA, 13 bp, Homo sapiens
atgtttccagctg

SEQ ID NO: 1717470 - DNA, 14 bp, Homo sapiens
atgtttcctctagt

SEQ ID NO: 1717471 - DNA, 20 bp, Homo sapiens
atgtttcctctagttctttg

SEQ ID NO: 1717472 - DNA, 17 bp, Homo sapiens
atgtttccttaaacatg

SEQ ID NO: 1717473 - DNA, 22 bp, Homo sapiens
atgtttctggacattctctttg

SEQ ID NO: 1717474 - DNA, 12 bp, Homo sapiens
atgtttctggat

SEQ ID NO: 1717475 - DNA, 15 bp, Homo sapiens
atgtttctgtgaaat

SEQ ID NO: 1717476 - DNA, 13 bp, Homo sapiens
atgtttcttcatt

SEQ ID NO: 1717477 - DNA, 19 bp, Homo sapiens
atgtttcttcatttctctg

SEQ ID NO: 1717478 - DNA, 22 bp, Homo sapiens
atgtttcttctaggttctaaaa

SEQ ID NO: 1717479 - DNA, 13 bp, Homo sapiens
atgtttctttgat

SEQ ID NO: 1717480 - DNA, 16 bp, Homo sapiens
atgtttcttttaaaga

SEQ ID NO: 1717481 - DNA, 17 bp, Homo sapiens
atgtttgaaaacaaaaa

SEQ ID NO: 1717482 - DNA, 18 bp, Homo sapiens
atgtttgaaaacaaaaaa

SEQ ID NO: 1717483 - DNA, 18 bp, Homo sapiens
atgtttgaatttttctct

SEQ ID NO: 1717484 - DNA, 20 bp, Homo sapiens
atgtttgaatttttctcttc

SEQ ID NO: 1717485 - DNA, 16 bp, Homo sapiens
atgtttgcctcataat

SEQ ID NO: 1717486 - DNA, 12 bp, Homo sapiens
atgtttgctgat

SEQ ID NO: 1717487 - DNA, 18 bp, Homo sapiens
atgtttgcttcataaatg

SEQ ID NO: 1717488 - DNA, 21 bp, Homo sapiens
atgtttggaaaaaactctgaa

SEQ ID NO: 1717489 - DNA, 17 bp, Homo sapiens
atgtttggattctctta

SEQ ID NO: 1717490 - DNA, 15 bp, Homo sapiens
atgtttggctctgct

SEQ ID NO: 1717491 - DNA, 20 bp, Homo sapiens
atgtttgggatattaaaaca

SEQ ID NO: 1717492 - DNA, 20 bp, Homo sapiens
atgtttggttgtaaatgctc

SEQ ID NO: 1717493 - DNA, 19 bp, Homo sapiens
atgtttgtaaattaatact

SEQ ID NO: 1717494 - DNA, 19 bp, Homo sapiens
atgtttgtgatattaaatt

SEQ ID NO: 1717495 - DNA, 22 bp, Homo sapiens
atgtttgtgatattaaatttca

SEQ ID NO: 1717496 - DNA, 17 bp, Homo sapiens
atgtttgtgcagtaact

SEQ ID NO: 1717497 - DNA, 15 bp, Homo sapiens
gccctggccctgccc

SEQ ID NO: 1717498 - DNA, 17 bp, Homo sapiens
gccctggccctgcccag

SEQ ID NO: 1717499 - DNA, 16 bp, Homo sapiens
gccctggcctcccctg

SEQ ID NO: 1717500 - DNA, 17 bp, Homo sapiens
gccctggcctcccctgc

SEQ ID NO: 1717501 - DNA, 21 bp, Homo sapiens
gccctggcctcccctgccacc

SEQ ID NO: 1717502 - DNA, 24 bp, Homo sapiens
gccctggcctcccctgccaccagg

SEQ ID NO: 1717503 - DNA, 16 bp, Homo sapiens
gccctggcctgctggg

SEQ ID NO: 1717504 - DNA, 17 bp, Homo sapiens
gccctggcctgctgggc

SEQ ID NO: 1717505 - DNA, 19 bp, Homo sapiens
gccctggctcccacaggcc

SEQ ID NO: 1717506 - DNA, 14 bp, Homo sapiens
gccctggctgctgc

SEQ ID NO: 1717507 - DNA, 15 bp, Homo sapiens
gccctggctgctgcc

SEQ ID NO: 1717508 - DNA, 19 bp, Homo sapiens
gccctggctgctgccccca

SEQ ID NO: 1717509 - DNA, 19 bp, Homo sapiens
gccctggctgtgatgagtg

SEQ ID NO: 1717510 - DNA, 17 bp, Homo sapiens
gccctggcttggaggct

SEQ ID NO: 1717511 - DNA, 22 bp, Homo sapiens
gccctgggaaccactcccacca

SEQ ID NO: 1717512 - DNA, 15 bp, Homo sapiens
gccctgggccccacc

SEQ ID NO: 1717513 - DNA, 11 bp, Homo sapiens
gccctgggctg

SEQ ID NO: 1717514 - DNA, 15 bp, Homo sapiens
gccctgggctgatgg

SEQ ID NO: 1717515 - DNA, 13 bp, Homo sapiens
gccctgggctgga

SEQ ID NO: 1717516 - DNA, 22 bp, Homo sapiens
gccctggggagcttttgcccac

SEQ ID NO: 1717517 - DNA, 15 bp, Homo sapiens
gccctggggctgatc

SEQ ID NO: 1717518 - DNA, 19 bp, Homo sapiens
gccctggggctgatctcag

SEQ ID NO: 1717519 - DNA, 20 bp, Homo sapiens
gccctggggctgatctcagg

SEQ ID NO: 1717520 - DNA, 21 bp, Homo sapiens
gccctggggctgatctcaggg

SEQ ID NO: 1717521 - DNA, 24 bp, Homo sapiens
gccctggggtggcgtctgcctagg

SEQ ID NO: 1717522 - DNA, 14 bp, Homo sapiens
gccctgggtcttgc

SEQ ID NO: 1717523 - DNA, 18 bp, Homo sapiens
gccctggtccagggaagc

SEQ ID NO: 1717524 - DNA, 18 bp, Homo sapiens
gccctggtccttccaggc

SEQ ID NO: 1717525 - DNA, 15 bp, Homo sapiens
gccctggtgctgcca

SEQ ID NO: 1717526 - DNA, 14 bp, Homo sapiens
gccctggtggagaa

SEQ ID NO: 1717527 - DNA, 24 bp, Homo sapiens
gccctggttagctgacagtcagct

SEQ ID NO: 1717528 - DNA, 12 bp, Homo sapiens
gccctggttcct

SEQ ID NO: 1717529 - DNA, 15 bp, Homo sapiens
gccctggttcctgct

SEQ ID NO: 1717530 - DNA, 16 bp, Homo sapiens
gccctggttcctgctg

SEQ ID NO: 1717531 - DNA, 22 bp, Homo sapiens
gccctggttcctgctgtcctgg

SEQ ID NO: 1717532 - DNA, 18 bp, Homo sapiens
gccctgtcagagccgcca

SEQ ID NO: 1717533 - DNA, 14 bp, Homo sapiens
gccctgtcccctga

SEQ ID NO: 1717534 - DNA, 21 bp, Homo sapiens
gccctgtcgagacacttgcct

SEQ ID NO: 1717535 - DNA, 15 bp, Homo sapiens
gccctgtgagggcga

SEQ ID NO: 1717536 - DNA, 14 bp, Homo sapiens
gccctgtgcctggg

SEQ ID NO: 1717537 - DNA, 16 bp, Homo sapiens
gccctgtgcctgggcc

SEQ ID NO: 1717538 - DNA, 24 bp, Homo sapiens
gccctgtggacaggatgaggacag

SEQ ID NO: 1717539 - DNA, 16 bp, Homo sapiens
gccctgtggagtccag

SEQ ID NO: 1717540 - DNA, 19 bp, Homo sapiens
gccctgtggccgccacctg

SEQ ID NO: 1717541 - DNA, 17 bp, Homo sapiens
gccctgttctcctgtcc

SEQ ID NO: 1717542 - DNA, 22 bp, Homo sapiens
gccctgttctcctgtccctcca

SEQ ID NO: 1717543 - DNA, 13 bp, Homo sapiens
gcccttaagggaa

SEQ ID NO: 1717544 - DNA, 13 bp, Homo sapiens
gcccttaccttcc

SEQ ID NO: 1717545 - DNA, 20 bp, Homo sapiens
gcccttattttcaagaaact

SEQ ID NO: 1717546 - DNA, 16 bp, Homo sapiens
gcccttcacagtgttt

SEQ ID NO: 1717547 - DNA, 15 bp, Homo sapiens
gcccttcactgccat

SEQ ID NO: 1717548 - DNA, 16 bp, Homo sapiens
gcccttcagtctgctc

SEQ ID NO: 1717549 - DNA, 19 bp, Homo sapiens
gcccttcagtctgctccac

SEQ ID NO: 1717550 - DNA, 24 bp, Homo sapiens
gcccttcccctcccccactcctct

SEQ ID NO: 1717551 - DNA, 18 bp, Homo sapiens
gcccttccctgtccctct

SEQ ID NO: 1717552 - DNA, 22 bp, Homo sapiens
gcccttcctcctgatggagtgt

SEQ ID NO: 1717553 - DNA, 12 bp, Homo sapiens
gcccttcctctc

SEQ ID NO: 1717554 - DNA, 16 bp, Homo sapiens
gcccttcctctccact

SEQ ID NO: 1717555 - DNA, 21 bp, Homo sapiens
gcccttcctctccactgcctt

SEQ ID NO: 1717556 - DNA, 15 bp, Homo sapiens
gcccttcctctttgg

SEQ ID NO: 1717557 - DNA, 15 bp, Homo sapiens
gcccttccttcccga

SEQ ID NO: 1717558 - DNA, 20 bp, Homo sapiens
gcccttctatacccacccag

SEQ ID NO: 1717559 - DNA, 22 bp, Homo sapiens
gcccttctatacccacccagaa

SEQ ID NO: 1717560 - DNA, 17 bp, Homo sapiens
gcccttctgactgttta

SEQ ID NO: 1717561 - DNA, 20 bp, Homo sapiens
gcccttctgactgtttattt

SEQ ID NO: 1717562 - DNA, 22 bp, Homo sapiens
gcccttctgactgtttatttaa

SEQ ID NO: 1717563 - DNA, 16 bp, Homo sapiens
gcccttgaaccccctc

SEQ ID NO: 1717564 - DNA, 22 bp, Homo sapiens
gcccttgcagttcagcaccacc

SEQ ID NO: 1717565 - DNA, 22 bp, Homo sapiens
gcccttgctttcggagctcctg

SEQ ID NO: 1717566 - DNA, 20 bp, Homo sapiens
gcccttggaacaccctggat

SEQ ID NO: 1717567 - DNA, 22 bp, Homo sapiens
gcccttggaacaccctggatgc

SEQ ID NO: 1717568 - DNA, 12 bp, Homo sapiens
gcccttgggcca

SEQ ID NO: 1717569 - DNA, 14 bp, Homo sapiens
gcccttgggccacc

SEQ ID NO: 1717570 - DNA, 17 bp, Homo sapiens
gcccttgggccacgctc

SEQ ID NO: 1717571 - DNA, 18 bp, Homo sapiens
gcccttgggccacgctct

SEQ ID NO: 1717572 - DNA, 13 bp, Homo sapiens
gcccttggggcct

SEQ ID NO: 1717573 - DNA, 16 bp, Homo sapiens
gcccttggggcctggc

SEQ ID NO: 1717574 - DNA, 19 bp, Homo sapiens
gcccttggggcctggcttg

SEQ ID NO: 1717575 - DNA, 21 bp, Homo sapiens
gcccttggggtaagccagagc

SEQ ID NO: 1717576 - DNA, 19 bp, Homo sapiens
gcccttggtagcagcctgg

SEQ ID NO: 1717577 - DNA, 16 bp, Homo sapiens
attaaattagctattt

SEQ ID NO: 1717578 - DNA, 11 bp, Homo sapiens
attaaattatg

SEQ ID NO: 1717579 - DNA, 23 bp, Homo sapiens
attaaattgggcttcaatcactg

SEQ ID NO: 1717580 - DNA, 19 bp, Homo sapiens
attaaatttaatatactgc

SEQ ID NO: 1717581 - DNA, 18 bp, Homo sapiens
attaacaaatttctttgt

SEQ ID NO: 1717582 - DNA, 18 bp, Homo sapiens
attaacaacaataacact

SEQ ID NO: 1717583 - DNA, 18 bp, Homo sapiens
attaacaatgtattttaa

SEQ ID NO: 1717584 - DNA, 15 bp, Homo sapiens
attaacacaaaggaa

SEQ ID NO: 1717585 - DNA, 15 bp, Homo sapiens
attaaccatagatgt

SEQ ID NO: 1717586 - DNA, 15 bp, Homo sapiens
attaacgatgtccaa

SEQ ID NO: 1717587 - DNA, 17 bp, Homo sapiens
attaactactgaataat

SEQ ID NO: 1717588 - DNA, 19 bp, Homo sapiens
attaactataacaatcact

SEQ ID NO: 1717589 - DNA, 17 bp, Homo sapiens
attaactccctccacca

SEQ ID NO: 1717590 - DNA, 19 bp, Homo sapiens
attaactccctccaccagc

SEQ ID NO: 1717591 - DNA, 18 bp, Homo sapiens
attaacttatttagagat

SEQ ID NO: 1717592 - DNA, 13 bp, Homo sapiens
attaactttaatg

SEQ ID NO: 1717593 - DNA, 17 bp, Homo sapiens
attaacttttaaatgtt

SEQ ID NO: 1717594 - DNA, 11 bp, Homo sapiens
attaagaaacc

SEQ ID NO: 1717595 - DNA, 12 bp, Homo sapiens
attaagaaacct

SEQ ID NO: 1717596 - DNA, 21 bp, Homo sapiens
attaagaaaccttgctctcct

SEQ ID NO: 1717597 - DNA, 14 bp, Homo sapiens
attaagacagtgta

SEQ ID NO: 1717598 - DNA, 23 bp, Homo sapiens
attaagacagtgtacaaaactgt

SEQ ID NO: 1717599 - DNA, 17 bp, Homo sapiens
attaagattataattgt

SEQ ID NO: 1717600 - DNA, 20 bp, Homo sapiens
attaagattctctgcccagc

SEQ ID NO: 1717601 - DNA, 17 bp, Homo sapiens
attaagcacacacatct

SEQ ID NO: 1717602 - DNA, 24 bp, Homo sapiens
attaagcacacacatctggccctg

SEQ ID NO: 1717603 - DNA, 21 bp, Homo sapiens
attaagcactttaagctcctt

SEQ ID NO: 1717604 - DNA, 19 bp, Homo sapiens
attaagcagtaaaaactgt

SEQ ID NO: 1717605 - DNA, 22 bp, Homo sapiens
attaagctgttcctgttcagta

SEQ ID NO: 1717606 - DNA, 14 bp, Homo sapiens
attaagtaaatgct

SEQ ID NO: 1717607 - DNA, 14 bp, Homo sapiens
attaagtactatgt

SEQ ID NO: 1717608 - DNA, 21 bp, Homo sapiens
attaagtctgggatgtagaac

SEQ ID NO: 1717609 - DNA, 13 bp, Homo sapiens
attaagttatctt

SEQ ID NO: 1717610 - DNA, 13 bp, Homo sapiens
attaagttgaaaa

SEQ ID NO: 1717611 - DNA, 16 bp, Homo sapiens
gccgaccaggctggac

SEQ ID NO: 1717612 - DNA, 14 bp, Homo sapiens
gccgacctcagcct

SEQ ID NO: 1717613 - DNA, 19 bp, Homo sapiens
gccgacctcgtcctccccc

SEQ ID NO: 1717614 - DNA, 13 bp, Homo sapiens
gccgaccttccct

SEQ ID NO: 1717615 - DNA, 18 bp, Homo sapiens
gccgacgcttgcacgacc

SEQ ID NO: 1717616 - DNA, 12 bp, Homo sapiens
gccgactctggc

SEQ ID NO: 1717617 - DNA, 16 bp, Homo sapiens
gccgactctggccctg

SEQ ID NO: 1717618 - DNA, 23 bp, Homo sapiens
gccgagaccccatcttccagcca

SEQ ID NO: 1717619 - DNA, 21 bp, Homo sapiens
gccgagactcgactctgtgcc

SEQ ID NO: 1717620 - DNA, 19 bp, Homo sapiens
gccgagagcctgctccccc

SEQ ID NO: 1717621 - DNA, 22 bp, Homo sapiens
gccgagatcacaccactgtact

SEQ ID NO: 1717622 - DNA, 20 bp, Homo sapiens
gccgagatcacgccactgca

SEQ ID NO: 1717623 - DNA, 16 bp, Homo sapiens
gccgagccgggcctgg

SEQ ID NO: 1717624 - DNA, 17 bp, Homo sapiens
gccgagccgggcctggg

SEQ ID NO: 1717625 - DNA, 13 bp, Homo sapiens
gccgagcctaatg

SEQ ID NO: 1717626 - DNA, 15 bp, Homo sapiens
gccgaggactttgat

SEQ ID NO: 1717627 - DNA, 12 bp, Homo sapiens
gccgaggcccag

SEQ ID NO: 1717628 - DNA, 14 bp, Homo sapiens
gccgaggcctggcc

SEQ ID NO: 1717629 - DNA, 14 bp, Homo sapiens
gccgagggcgtcag

SEQ ID NO: 1717630 - DNA, 20 bp, Homo sapiens
gccgaggggagagagggact

SEQ ID NO: 1717631 - DNA, 14 bp, Homo sapiens
gccgatagagggac

SEQ ID NO: 1717632 - DNA, 15 bp, Homo sapiens
gccgatgccaccggc

SEQ ID NO: 1717633 - DNA, 16 bp, Homo sapiens
gccgcaagctctcagc

SEQ ID NO: 1717634 - DNA, 13 bp, Homo sapiens
gccgcaccccaga

SEQ ID NO: 1717635 - DNA, 23 bp, Homo sapiens
gccgcaccccagagtgtgggaag

SEQ ID NO: 1717636 - DNA, 14 bp, Homo sapiens
gccgcaccctgcac

SEQ ID NO: 1717637 - DNA, 18 bp, Homo sapiens
gccgcaccctgcacctgc

SEQ ID NO: 1717638 - DNA, 20 bp, Homo sapiens
gccgcaccctgcacctgctg

SEQ ID NO: 1717639 - DNA, 19 bp, Homo sapiens
gccgcacgcctctccctgc

SEQ ID NO: 1717640 - DNA, 18 bp, Homo sapiens
gccgcagacgggcacaga

SEQ ID NO: 1717641 - DNA, 20 bp, Homo sapiens
gccgcagacgggcacagaca

SEQ ID NO: 1717642 - DNA, 17 bp, Homo sapiens
gccgcagcctccctctg

SEQ ID NO: 1717643 - DNA, 14 bp, Homo sapiens
gccgcagctcttgc

SEQ ID NO: 1717644 - DNA, 20 bp, Homo sapiens
gccgcatcttctccatctgg

SEQ ID NO: 1717645 - DNA, 14 bp, Homo sapiens
gccgcattccctga

SEQ ID NO: 1717646 - DNA, 16 bp, Homo sapiens
gccgcattccctgagt

SEQ ID NO: 1717647 - DNA, 18 bp, Homo sapiens
gccgcattccctgagtca

SEQ ID NO: 1717648 - DNA, 16 bp, Homo sapiens
gccgccaccctcccct

SEQ ID NO: 1717649 - DNA, 20 bp, Homo sapiens
gccgccaccctcccctatgc

SEQ ID NO: 1717650 - DNA, 15 bp, Homo sapiens
gccgccacctgaggt

SEQ ID NO: 1717651 - DNA, 22 bp, Homo sapiens
gccgccacctgaggtgggctgg

SEQ ID NO: 1717652 - DNA, 16 bp, Homo sapiens
gccgccacggcctggc

SEQ ID NO: 1717653 - DNA, 17 bp, Homo sapiens
gccgccacggcctggct

SEQ ID NO: 1717654 - DNA, 20 bp, Homo sapiens
gccgccactaggtgtcccca

SEQ ID NO: 1717655 - DNA, 17 bp, Homo sapiens
gccgccagcgtgtggag

SEQ ID NO: 1717656 - DNA, 20 bp, Homo sapiens
gccgccagcgtgtggagcag

SEQ ID NO: 1717657 - DNA, 16 bp, Homo sapiens
gccgccagctgccgca

SEQ ID NO: 1717658 - DNA, 16 bp, Homo sapiens
gccgccattgccacca

SEQ ID NO: 1717659 - DNA, 14 bp, Homo sapiens
gccgcccccgcctg

SEQ ID NO: 1717660 - DNA, 18 bp, Homo sapiens
gccgcccccgcctgggca

SEQ ID NO: 1717661 - DNA, 21 bp, Homo sapiens
gccgcccccgcctgggcaccg

SEQ ID NO: 1717662 - DNA, 11 bp, Homo sapiens
gccgccctgta

SEQ ID NO: 1717663 - DNA, 17 bp, Homo sapiens
gccgccgacctgtgact

SEQ ID NO: 1717664 - DNA, 13 bp, Homo sapiens
gccgccgcgcgcc

SEQ ID NO: 1717665 - DNA, 15 bp, Homo sapiens
gccgccgcgcgcccc

SEQ ID NO: 1717666 - DNA, 14 bp, Homo sapiens
gccgccgctgaccc

SEQ ID NO: 1717667 - DNA, 21 bp, Homo sapiens
gccgccgctgaccctgggcct

SEQ ID NO: 1717668 - DNA, 14 bp, Homo sapiens
gccgccgtgaccta

SEQ ID NO: 1717669 - DNA, 23 bp, Homo sapiens
gccgcctactggacgctgccctg

SEQ ID NO: 1717670 - DNA, 22 bp, Homo sapiens
gccgcctccaggagcctacccc

SEQ ID NO: 1717671 - DNA, 13 bp, Homo sapiens
gccgcctgcactc

SEQ ID NO: 1717672 - DNA, 15 bp, Homo sapiens
gccgcctgctccctg

SEQ ID NO: 1717673 - DNA, 17 bp, Homo sapiens
gccgcctgctccctgca

SEQ ID NO: 1717674 - DNA, 13 bp, Homo sapiens
gccgcctgctcct

SEQ ID NO: 1717675 - DNA, 16 bp, Homo sapiens
gccgcctgctcctcac

SEQ ID NO: 1717676 - DNA, 18 bp, Homo sapiens
gccgcctgctcctcactg

SEQ ID NO: 1717677 - DNA, 23 bp, Homo sapiens
gccgcgaactgggttctttggaa

SEQ ID NO: 1717678 - DNA, 17 bp, Homo sapiens
gccgcggccgcccgcac

SEQ ID NO: 1717679 - DNA, 19 bp, Homo sapiens
gccgcgggcgctcgctcag

SEQ ID NO: 1717680 - DNA, 19 bp, Homo sapiens
gccgcgggcggccaggcaa

SEQ ID NO: 1717681 - DNA, 15 bp, Homo sapiens
gccgcgtccctgccc

SEQ ID NO: 1717682 - DNA, 21 bp, Homo sapiens
gccgcgtggtgccatccccag

SEQ ID NO: 1717683 - DNA, 18 bp, Homo sapiens
gccgctagaggcctgagg

SEQ ID NO: 1717684 - DNA, 19 bp, Homo sapiens
gccgctagaggcctgagga

SEQ ID NO: 1717685 - DNA, 18 bp, Homo sapiens
gccgctaggagagactga

SEQ ID NO: 1717686 - DNA, 15 bp, Homo sapiens
gccgctcctgtctgc

SEQ ID NO: 1717687 - DNA, 20 bp, Homo sapiens
gccgctcctgtctgccagcc

SEQ ID NO: 1717688 - DNA, 21 bp, Homo sapiens
gccgctcctgtctgccagcca

SEQ ID NO: 1717689 - DNA, 23 bp, Homo sapiens
gccgctctctctgagggggtggg

SEQ ID NO: 1717690 - DNA, 16 bp, Homo sapiens
gccgctgaccctgggc

SEQ ID NO: 1717691 - DNA, 12 bp, Homo sapiens
gccgctgcaggg

SEQ ID NO: 1717692 - DNA, 16 bp, Homo sapiens
gccgctgcagggctcc

SEQ ID NO: 1717693 - DNA, 18 bp, Homo sapiens
gccgctgcagggctccca

SEQ ID NO: 1717694 - DNA, 16 bp, Homo sapiens
gccgctgccccagccc

SEQ ID NO: 1717695 - DNA, 12 bp, Homo sapiens
gccgctggcaac

SEQ ID NO: 1717696 - DNA, 16 bp, Homo sapiens
gaccttttcccttgct

SEQ ID NO: 1717697 - DNA, 19 bp, Homo sapiens
gacgaactggctacagtac

SEQ ID NO: 1717698 - DNA, 21 bp, Homo sapiens
gacgacaagtgctgaacagtg

SEQ ID NO: 1717699 - DNA, 21 bp, Homo sapiens
gacgagacccccatccagcct

SEQ ID NO: 1717700 - DNA, 23 bp, Homo sapiens
gacgagacccccatccagcctcc

SEQ ID NO: 1717701 - DNA, 12 bp, Homo sapiens
gacgagagggct

SEQ ID NO: 1717702 - DNA, 21 bp, Homo sapiens
gacgaggggcagggaaggaca

SEQ ID NO: 1717703 - DNA, 13 bp, Homo sapiens
gacgatcgcccag

SEQ ID NO: 1717704 - DNA, 18 bp, Homo sapiens
gacgatcgcccaggctgg

SEQ ID NO: 1717705 - DNA, 14 bp, Homo sapiens
gacgcagacagagg

SEQ ID NO: 1717706 - DNA, 22 bp, Homo sapiens
gacgcagcagctgggacccctc

SEQ ID NO: 1717707 - DNA, 22 bp, Homo sapiens
gacgcatgccctcaatcccagc

SEQ ID NO: 1717708 - DNA, 23 bp, Homo sapiens
gacgccacagcccagccacggac

SEQ ID NO: 1717709 - DNA, 11 bp, Homo sapiens
gacgcccagct

SEQ ID NO: 1717710 - DNA, 23 bp, Homo sapiens
gacgccctatttctatgtcattt

SEQ ID NO: 1717711 - DNA, 19 bp, Homo sapiens
gacgccttccaggtcagga

SEQ ID NO: 1717712 - DNA, 16 bp, Homo sapiens
gacgcgaggggaaagg

SEQ ID NO: 1717713 - DNA, 22 bp, Homo sapiens
gacgcgaggggaaaggcctgtg

SEQ ID NO: 1717714 - DNA, 14 bp, Homo sapiens
gcacggttcaatgg

SEQ ID NO: 1717715 - DNA, 13 bp, Homo sapiens
gcacgtcatggga

SEQ ID NO: 1717716 - DNA, 18 bp, Homo sapiens
gcacgtggcatgtggcct

SEQ ID NO: 1717717 - DNA, 19 bp, Homo sapiens
gcacgtggcctcttgagca

SEQ ID NO: 1717718 - DNA, 19 bp, Homo sapiens
gcactaacgttgagcccct

SEQ ID NO: 1717719 - DNA, 14 bp, Homo sapiens
gcactacaatcatg

SEQ ID NO: 1717720 - DNA, 21 bp, Homo sapiens
gcactactccctcaaagcaca

SEQ ID NO: 1717721 - DNA, 16 bp, Homo sapiens
gcactactcctctgca

SEQ ID NO: 1717722 - DNA, 22 bp, Homo sapiens
gcactagtttgattattatgtt

SEQ ID NO: 1717723 - DNA, 14 bp, Homo sapiens
gcactataatgtaa

SEQ ID NO: 1717724 - DNA, 15 bp, Homo sapiens
gcactataatgtaag

SEQ ID NO: 1717725 - DNA, 21 bp, Homo sapiens
gcactcaaatcttaagaaata

SEQ ID NO: 1717726 - DNA, 16 bp, Homo sapiens
gcactcacagacctgg

SEQ ID NO: 1717727 - DNA, 21 bp, Homo sapiens
gcactcacccctagccctggt

SEQ ID NO: 1717728 - DNA, 11 bp, Homo sapiens
gcactcagatt

SEQ ID NO: 1717729 - DNA, 13 bp, Homo sapiens
gcactcagcctca

SEQ ID NO: 1717730 - DNA, 15 bp, Homo sapiens
gcactccacacatct

SEQ ID NO: 1717731 - DNA, 15 bp, Homo sapiens
gcactccagcctgag

SEQ ID NO: 1717732 - DNA, 17 bp, Homo sapiens
gcactccagcctggggg

SEQ ID NO: 1717733 - DNA, 19 bp, Homo sapiens
gcactccagcctgggggac

SEQ ID NO: 1717734 - DNA, 14 bp, Homo sapiens
gcactccatggcca

SEQ ID NO: 1717735 - DNA, 17 bp, Homo sapiens
gcactccatggccaccc

SEQ ID NO: 1717736 - DNA, 13 bp, Homo sapiens
gcactcccaaccc

SEQ ID NO: 1717737 - DNA, 15 bp, Homo sapiens
gcactccctcctgga

SEQ ID NO: 1717738 - DNA, 18 bp, Homo sapiens
gcactccgcgccgatgcc

SEQ ID NO: 1717739 - DNA, 21 bp, Homo sapiens
gcactccgcgccgatgccacc

SEQ ID NO: 1717740 - DNA, 14 bp, Homo sapiens
gcactccggaggta

SEQ ID NO: 1717741 - DNA, 21 bp, Homo sapiens
gcactccggtcccaaatgtag

SEQ ID NO: 1717742 - DNA, 19 bp, Homo sapiens
gcactcctcggtactccca

SEQ ID NO: 1717743 - DNA, 18 bp, Homo sapiens
gcactcgctgttatcaaa

SEQ ID NO: 1717744 - DNA, 11 bp, Homo sapiens
gcactctagat

SEQ ID NO: 1717745 - DNA, 12 bp, Homo sapiens
gcactctagatt

SEQ ID NO: 1717746 - DNA, 13 bp, Homo sapiens
gcactctagattc

SEQ ID NO: 1717747 - DNA, 15 bp, Homo sapiens
gcactctagcctggc

SEQ ID NO: 1717748 - DNA, 24 bp, Homo sapiens
gcactctccccgctcaggggcctg

SEQ ID NO: 1717749 - DNA, 23 bp, Homo sapiens
gcactctgagtttaccatttgta

SEQ ID NO: 1717750 - DNA, 18 bp, Homo sapiens
gcactcttgttcccacac

SEQ ID NO: 1717751 - DNA, 23 bp, Homo sapiens
gcactcttgtttgctttgaaaat

SEQ ID NO: 1717752 - DNA, 20 bp, Homo sapiens
gcactgaaaacttagccaga

SEQ ID NO: 1717753 - DNA, 20 bp, Homo sapiens
gcactgaaaataccatcagg

SEQ ID NO: 1717754 - DNA, 15 bp, Homo sapiens
gcactgaacagaatt

SEQ ID NO: 1717755 - DNA, 18 bp, Homo sapiens
gcactgaagccggacagc

SEQ ID NO: 1717756 - DNA, 19 bp, Homo sapiens
gcactgaagccggacagct

SEQ ID NO: 1717757 - DNA, 16 bp, Homo sapiens
gcactgacaccctggt

SEQ ID NO: 1717758 - DNA, 17 bp, Homo sapiens
gcactgacagatttcca

SEQ ID NO: 1717759 - DNA, 18 bp, Homo sapiens
gcactgacttctaagtaa

SEQ ID NO: 1717760 - DNA, 15 bp, Homo sapiens
gcactgagatattta

SEQ ID NO: 1717761 - DNA, 12 bp, Homo sapiens
gcactgagcccc

SEQ ID NO: 1717762 - DNA, 11 bp, Homo sapiens
gcactgaggaa

SEQ ID NO: 1717763 - DNA, 11 bp, Homo sapiens
gcactgagggc

SEQ ID NO: 1717764 - DNA, 12 bp, Homo sapiens
gcactgagggcc

SEQ ID NO: 1717765 - DNA, 16 bp, Homo sapiens
gcactgagggccacac

SEQ ID NO: 1717766 - DNA, 19 bp, Homo sapiens
gcactgatgctgcccctca

SEQ ID NO: 1717767 - DNA, 18 bp, Homo sapiens
gcactgcattcctgtgcc

SEQ ID NO: 1717768 - DNA, 14 bp, Homo sapiens
gcactgccactggg

SEQ ID NO: 1717769 - DNA, 21 bp, Homo sapiens
gcactgccattagactgaatt

SEQ ID NO: 1717770 - DNA, 20 bp, Homo sapiens
gcactgcctgcatgagctgg

SEQ ID NO: 1717771 - DNA, 18 bp, Homo sapiens
gcactgctcacgtctctg

SEQ ID NO: 1717772 - DNA, 20 bp, Homo sapiens
gcactgctcacgtctctgcc

SEQ ID NO: 1717773 - DNA, 18 bp, Homo sapiens
gcactggaaccacctgga

SEQ ID NO: 1717774 - DNA, 19 bp, Homo sapiens
gcactggaaccacctggac

SEQ ID NO: 1717775 - DNA, 21 bp, Homo sapiens
gcactggaggggcccacccac

SEQ ID NO: 1717776 - DNA, 18 bp, Homo sapiens
gcactggagtccagtctc

SEQ ID NO: 1717777 - DNA, 14 bp, Homo sapiens
gcactggagtgcag

SEQ ID NO: 1717778 - DNA, 15 bp, Homo sapiens
gcactggagtgcagg

SEQ ID NO: 1717779 - DNA, 16 bp, Homo sapiens
gcactggagtgcaggg

SEQ ID NO: 1717780 - DNA, 15 bp, Homo sapiens
gcactggccagagag

SEQ ID NO: 1717781 - DNA, 16 bp, Homo sapiens
gcactggccagagagg

SEQ ID NO: 1717782 - DNA, 21 bp, Homo sapiens
gcactgggagggggtggggga

SEQ ID NO: 1717783 - DNA, 13 bp, Homo sapiens
gcactgggccacg

SEQ ID NO: 1717784 - DNA, 17 bp, Homo sapiens
gcactgggccacggagg

SEQ ID NO: 1717785 - DNA, 19 bp, Homo sapiens
gcactggggagcccgtctc

SEQ ID NO: 1717786 - DNA, 23 bp, Homo sapiens
gcactggggagcccgtctcagtg

SEQ ID NO: 1717787 - DNA, 18 bp, Homo sapiens
gcactgggttgactttca

SEQ ID NO: 1717788 - DNA, 23 bp, Homo sapiens
gcactggtaggttgggacaccag

SEQ ID NO: 1717789 - DNA, 23 bp, Homo sapiens
gcactgtcccttgcctcaatgcc

SEQ ID NO: 1717790 - DNA, 19 bp, Homo sapiens
gcactgtctcagtttcact

SEQ ID NO: 1717791 - DNA, 11 bp, Homo sapiens
gcactgtgaag

SEQ ID NO: 1717792 - DNA, 19 bp, Homo sapiens
gcactgtgaagacccagca

SEQ ID NO: 1717793 - DNA, 17 bp, Homo sapiens
gcactgtgaaggaccct

SEQ ID NO: 1717794 - DNA, 19 bp, Homo sapiens
gcactgtgaatcctggcaa

SEQ ID NO: 1717795 - DNA, 18 bp, Homo sapiens
gcactgtggattatttca

SEQ ID NO: 1717796 - DNA, 16 bp, Homo sapiens
gcactgtgtgctgact

SEQ ID NO: 1717797 - DNA, 14 bp, Homo sapiens
gcactgttcacatc

SEQ ID NO: 1717798 - DNA, 16 bp, Homo sapiens
gcactgttcacatcat

SEQ ID NO: 1717799 - DNA, 14 bp, Homo sapiens
gcactgttgagaag

SEQ ID NO: 1717800 - DNA, 20 bp, Homo sapiens
gcactgttttatctctgtga

SEQ ID NO: 1717801 - DNA, 18 bp, Homo sapiens
gcacttaaacagaagcag

SEQ ID NO: 1717802 - DNA, 21 bp, Homo sapiens
gcacttaaacagaagcagagg

SEQ ID NO: 1717803 - DNA, 23 bp, Homo sapiens
gcacttaaacagaagcagaggct

SEQ ID NO: 1717804 - DNA, 22 bp, Homo sapiens
gcacttaagcacaagcagagtg

SEQ ID NO: 1717805 - DNA, 19 bp, Homo sapiens
gcacttaagtgcacttttt

SEQ ID NO: 1717806 - DNA, 14 bp, Homo sapiens
gcacttaatggctg

SEQ ID NO: 1717807 - DNA, 22 bp, Homo sapiens
gcacttacacttataaaataac

SEQ ID NO: 1717808 - DNA, 23 bp, Homo sapiens
gcacttattatgaggctattaaa

SEQ ID NO: 1717809 - DNA, 23 bp, Homo sapiens
gcacttattgaccattttttaat

SEQ ID NO: 1717810 - DNA, 14 bp, Homo sapiens
gcacttcccaggat

SEQ ID NO: 1717811 - DNA, 15 bp, Homo sapiens
gcacttgcctgggtc

SEQ ID NO: 1717812 - DNA, 18 bp, Homo sapiens
gcacttgcctgggtcaca

SEQ ID NO: 1717813 - DNA, 23 bp, Homo sapiens
gcacttgcctgttggctgctgcg

SEQ ID NO: 1717814 - DNA, 16 bp, Homo sapiens
gcacttgcgtcctgca

SEQ ID NO: 1717815 - DNA, 12 bp, Homo sapiens
gcacttgtatat

SEQ ID NO: 1717816 - DNA, 17 bp, Homo sapiens
gcacttgtgatcctaaa

SEQ ID NO: 1717817 - DNA, 17 bp, Homo sapiens
gcacttgtgattattta

SEQ ID NO: 1717818 - DNA, 20 bp, Homo sapiens
gcacttgtgattatttatta

SEQ ID NO: 1717819 - DNA, 23 bp, Homo sapiens
gcacttgtgattatttattattt

SEQ ID NO: 1717820 - DNA, 17 bp, Homo sapiens
gcactttctaatgtttc

SEQ ID NO: 1717821 - DNA, 21 bp, Homo sapiens
gcactttgagaggctgaggtg

SEQ ID NO: 1717822 - DNA, 16 bp, Homo sapiens
gcactttgggaggctg

SEQ ID NO: 1717823 - DNA, 20 bp, Homo sapiens
atctgagctcccacctccct

SEQ ID NO: 1717824 - DNA, 21 bp, Homo sapiens
atctgagctcccacctccctt

SEQ ID NO: 1717825 - DNA, 20 bp, Homo sapiens
atctgaggttggatttgctc

SEQ ID NO: 1717826 - DNA, 16 bp, Homo sapiens
atctgatctgtaccat

SEQ ID NO: 1717827 - DNA, 22 bp, Homo sapiens
atctgatggccttaatttcctt

SEQ ID NO: 1717828 - DNA, 20 bp, Homo sapiens
gcacttttttaaatataaaa

SEQ ID NO: 1717829 - DNA, 22 bp, Homo sapiens
gcagaaaacccttgggccagaa

SEQ ID NO: 1717830 - DNA, 15 bp, Homo sapiens
gcagaaaagaggaga

SEQ ID NO: 1717831 - DNA, 21 bp, Homo sapiens
gcagaaaagaggagaccctgg

SEQ ID NO: 1717832 - DNA, 22 bp, Homo sapiens
gcagaaaagaggagaccctgga

SEQ ID NO: 1717833 - DNA, 14 bp, Homo sapiens
gcagaaaatattta

SEQ ID NO: 1717834 - DNA, 23 bp, Homo sapiens
gcagaaacgaagccatctttctt

SEQ ID NO: 1717835 - DNA, 12 bp, Homo sapiens
gcagaacaaatg

SEQ ID NO: 1717836 - DNA, 18 bp, Homo sapiens
gcagaacaaatgtgtttt

SEQ ID NO: 1717837 - DNA, 22 bp, Homo sapiens
gcagaacaaatgtgtttttcta

SEQ ID NO: 1717838 - DNA, 18 bp, Homo sapiens
gcagaacagccgctcctg

SEQ ID NO: 1717839 - DNA, 21 bp, Homo sapiens
gcagaacagccgctcctgtct

SEQ ID NO: 1717840 - DNA, 23 bp, Homo sapiens
gcagaacaggtagtattacacca

SEQ ID NO: 1717841 - DNA, 17 bp, Homo sapiens
gcagaacccccaggtgg

SEQ ID NO: 1717842 - DNA, 20 bp, Homo sapiens
gcagaacccccaggtggcct

SEQ ID NO: 1717843 - DNA, 15 bp, Homo sapiens
gcagaacctgcacac

SEQ ID NO: 1717844 - DNA, 15 bp, Homo sapiens
gcagaacggaggagg

SEQ ID NO: 1717845 - DNA, 23 bp, Homo sapiens
gcagaactttccagggatccagg

SEQ ID NO: 1717846 - DNA, 17 bp, Homo sapiens
gcagaagaaagggtgga

SEQ ID NO: 1717847 - DNA, 23 bp, Homo sapiens
gcagaagagagtggggcctgccc

SEQ ID NO: 1717848 - DNA, 12 bp, Homo sapiens
gcagaagagggt

SEQ ID NO: 1717849 - DNA, 20 bp, Homo sapiens
gcagaagcatattttgctgg

SEQ ID NO: 1717850 - DNA, 19 bp, Homo sapiens
gcagaagcattgcctggac

SEQ ID NO: 1717851 - DNA, 20 bp, Homo sapiens
gcagaagcattgcctggact

SEQ ID NO: 1717852 - DNA, 15 bp, Homo sapiens
gcagaagccctgatg

SEQ ID NO: 1717853 - DNA, 15 bp, Homo sapiens
gcagaaggaaagaag

SEQ ID NO: 1717854 - DNA, 22 bp, Homo sapiens
gcagaagggggtggtgtctcca

SEQ ID NO: 1717855 - DNA, 23 bp, Homo sapiens
gcagaagtctggctttgctctat

SEQ ID NO: 1717856 - DNA, 22 bp, Homo sapiens
gcagaagtgctctttgtggcag

SEQ ID NO: 1717857 - DNA, 19 bp, Homo sapiens
gcagaatactggtctcagg

SEQ ID NO: 1717858 - DNA, 23 bp, Homo sapiens
gcagaatcctaggctccacccca

SEQ ID NO: 1717859 - DNA, 16 bp, Homo sapiens
gcagaatggaggcagg

SEQ ID NO: 1717860 - DNA, 22 bp, Homo sapiens
gcagaatgtaagtgggcccacc

SEQ ID NO: 1717861 - DNA, 23 bp, Homo sapiens
gcagaattgtttagattttgtgt

SEQ ID NO: 1717862 - DNA, 11 bp, Homo sapiens
gcagaatttta

SEQ ID NO: 1717863 - DNA, 12 bp, Homo sapiens
gcagaattttaa

SEQ ID NO: 1717864 - DNA, 13 bp, Homo sapiens
gcagaattttaat

SEQ ID NO: 1717865 - DNA, 19 bp, Homo sapiens
gcagaattttaatgtgaag

SEQ ID NO: 1717866 - DNA, 16 bp, Homo sapiens
gcagacaaagccctgt

SEQ ID NO: 1717867 - DNA, 13 bp, Homo sapiens
gcagacaagagct

SEQ ID NO: 1717868 - DNA, 15 bp, Homo sapiens
gcagacaagagctgc

SEQ ID NO: 1717869 - DNA, 10 bp, Homo sapiens
gcagacacac

SEQ ID NO: 1717870 - DNA, 19 bp, Homo sapiens
gcagacacaccgcggccag

SEQ ID NO: 1717871 - DNA, 18 bp, Homo sapiens
gcagacagagccaggaga

SEQ ID NO: 1717872 - DNA, 14 bp, Homo sapiens
gcagacagcagctc

SEQ ID NO: 1717873 - DNA, 20 bp, Homo sapiens
gcagacagcagctcaggcac

SEQ ID NO: 1717874 - DNA, 19 bp, Homo sapiens
gcagacaggcggggcccag

SEQ ID NO: 1717875 - DNA, 20 bp, Homo sapiens
gcagacatagaagagccaag

SEQ ID NO: 1717876 - DNA, 21 bp, Homo sapiens
gcagaccaccccgcctgccct

SEQ ID NO: 1717877 - DNA, 23 bp, Homo sapiens
gcagaccacgcccgtcctgcctg

SEQ ID NO: 1717878 - DNA, 16 bp, Homo sapiens
gcagacctaagccctg

SEQ ID NO: 1717879 - DNA, 13 bp, Homo sapiens
gcagacctcatgc

SEQ ID NO: 1717880 - DNA, 21 bp, Homo sapiens
gcagacctcatgcccagctct

SEQ ID NO: 1717881 - DNA, 19 bp, Homo sapiens
gcagacctcttagagtcct

SEQ ID NO: 1717882 - DNA, 21 bp, Homo sapiens
gcagacctgtcaccctgcagg

SEQ ID NO: 1717883 - DNA, 14 bp, Homo sapiens
gcagacgggcacag

SEQ ID NO: 1717884 - DNA, 19 bp, Homo sapiens
gcagacgggcacagacacg

SEQ ID NO: 1717885 - DNA, 16 bp, Homo sapiens
gcagacgtctgccttg

SEQ ID NO: 1717886 - DNA, 22 bp, Homo sapiens
gcagacgtctgccttggcatcc

SEQ ID NO: 1717887 - DNA, 21 bp, Homo sapiens
gcagactagaattctagtgct

SEQ ID NO: 1717888 - DNA, 17 bp, Homo sapiens
gcagactcagtttgtca

SEQ ID NO: 1717889 - DNA, 18 bp, Homo sapiens
gcagactcagtttgtcag

SEQ ID NO: 1717890 - DNA, 16 bp, Homo sapiens
gcagactcctcagatc

SEQ ID NO: 1717891 - DNA, 21 bp, Homo sapiens
gcagactcctcagatctgaac

SEQ ID NO: 1717892 - DNA, 22 bp, Homo sapiens
gcagactcctcagatctgaaca

SEQ ID NO: 1717893 - DNA, 21 bp, Homo sapiens
gcagagaaacttaagcaaagg

SEQ ID NO: 1717894 - DNA, 21 bp, Homo sapiens
gcagagaattctcttatccaa

SEQ ID NO: 1717895 - DNA, 22 bp, Homo sapiens
gcagagagagaggacagagggg

SEQ ID NO: 1717896 - DNA, 16 bp, Homo sapiens
gcagagatttctcatt

SEQ ID NO: 1717897 - DNA, 16 bp, Homo sapiens
gcagagcaattccagg

SEQ ID NO: 1717898 - DNA, 17 bp, Homo sapiens
gcagagcaattccaggc

SEQ ID NO: 1717899 - DNA, 14 bp, Homo sapiens
gcagagcacacagg

SEQ ID NO: 1717900 - DNA, 20 bp, Homo sapiens
gcagagcaggggcagggtga

SEQ ID NO: 1717901 - DNA, 12 bp, Homo sapiens
gcagagccaggc

SEQ ID NO: 1717902 - DNA, 19 bp, Homo sapiens
gcagagccaggctgttgga

SEQ ID NO: 1717903 - DNA, 17 bp, Homo sapiens
gcagagccatgggcctg

SEQ ID NO: 1717904 - DNA, 19 bp, Homo sapiens
gcagagccatgggcctggg

SEQ ID NO: 1717905 - DNA, 22 bp, Homo sapiens
gcagagccctccaggcctgcag

SEQ ID NO: 1717906 - DNA, 23 bp, Homo sapiens
gcagagccctccaggcctgcagg

SEQ ID NO: 1717907 - DNA, 23 bp, Homo sapiens
gcagagctctcccctcctgctgg

SEQ ID NO: 1717908 - DNA, 17 bp, Homo sapiens
gcagagctgagggccct

SEQ ID NO: 1717909 - DNA, 23 bp, Homo sapiens
gcagagctggctctgagcgcctc

SEQ ID NO: 1717910 - DNA, 13 bp, Homo sapiens
gcagaggaccaca

SEQ ID NO: 1717911 - DNA, 12 bp, Homo sapiens
gcagaggcagcg

SEQ ID NO: 1717912 - DNA, 12 bp, Homo sapiens
gcagaggccaga

SEQ ID NO: 1717913 - DNA, 17 bp, Homo sapiens
gcagaggcctgggctgg

SEQ ID NO: 1717914 - DNA, 22 bp, Homo sapiens
gcagaggcctgggctgggaaaa

SEQ ID NO: 1717915 - DNA, 22 bp, Homo sapiens
gcagaggctggaggcagggcct

SEQ ID NO: 1717916 - DNA, 19 bp, Homo sapiens
gcagagggcagaggctgga

SEQ ID NO: 1717917 - DNA, 12 bp, Homo sapiens
gcagagggctgg

SEQ ID NO: 1717918 - DNA, 13 bp, Homo sapiens
gcagagggctgga

SEQ ID NO: 1717919 - DNA, 16 bp, Homo sapiens
gcagagggctggaggc

SEQ ID NO: 1717920 - DNA, 19 bp, Homo sapiens
gcagagggctggaggccca

SEQ ID NO: 1717921 - DNA, 13 bp, Homo sapiens
gcagaggggcagc

SEQ ID NO: 1717922 - DNA, 22 bp, Homo sapiens
gcagaggggcagccgctaggag

SEQ ID NO: 1717923 - DNA, 12 bp, Homo sapiens
gcagaggggctt

SEQ ID NO: 1717924 - DNA, 18 bp, Homo sapiens
gcagagggggagtagcca

SEQ ID NO: 1717925 - DNA, 23 bp, Homo sapiens
gcagagggggagtagccaagctg

SEQ ID NO: 1717926 - DNA, 15 bp, Homo sapiens
gcagaggtaccctgg

SEQ ID NO: 1717927 - DNA, 22 bp, Homo sapiens
gcagagtgagcaagggggccca

SEQ ID NO: 1717928 - DNA, 12 bp, Homo sapiens
gcagagtgagga

SEQ ID NO: 1717929 - DNA, 16 bp, Homo sapiens
gcagagtgcacagctg

SEQ ID NO: 1717930 - DNA, 20 bp, Homo sapiens
gcagagtggaaactcagccg

SEQ ID NO: 1717931 - DNA, 21 bp, Homo sapiens
gcagagttaaatctcaaatag

SEQ ID NO: 1717932 - DNA, 18 bp, Homo sapiens
gcagagttacagttctgt

SEQ ID NO: 1717933 - DNA, 13 bp, Homo sapiens
gcagagttacttg

SEQ ID NO: 1717934 - DNA, 14 bp, Homo sapiens
gcagagttttcatt

SEQ ID NO: 1717935 - DNA, 12 bp, Homo sapiens
gcagatcccagc

SEQ ID NO: 1717936 - DNA, 14 bp, Homo sapiens
gcagatcccagctc

SEQ ID NO: 1717937 - DNA, 22 bp, Homo sapiens
gcagatctgtgccccatgcctg

SEQ ID NO: 1717938 - DNA, 23 bp, Homo sapiens
gcagatggtctgagttcttgtgt

SEQ ID NO: 1717939 - DNA, 16 bp, Homo sapiens
gcagatgttcaaatat

SEQ ID NO: 1717940 - DNA, 19 bp, Homo sapiens
atcttaagcaggtttgttt

SEQ ID NO: 1717941 - DNA, 18 bp, Homo sapiens
atcttaatactgttattc

SEQ ID NO: 1717942 - DNA, 16 bp, Homo sapiens
gcagattcctgggcct

SEQ ID NO: 1717943 - DNA, 22 bp, Homo sapiens
gcagattcctgggcctgtcccc

SEQ ID NO: 1717944 - DNA, 13 bp, Homo sapiens
gcagattgaatat

SEQ ID NO: 1717945 - DNA, 23 bp, Homo sapiens
gcagatttagtgaaagctagaga

SEQ ID NO: 1717946 - DNA, 16 bp, Homo sapiens
gcagattttacaaaag

SEQ ID NO: 1717947 - DNA, 20 bp, Homo sapiens
gcagattttacaaaagatgt

SEQ ID NO: 1717948 - DNA, 14 bp, Homo sapiens
gcagcaagggacct

SEQ ID NO: 1717949 - DNA, 15 bp, Homo sapiens
gcagcacacctcagc

SEQ ID NO: 1717950 - DNA, 16 bp, Homo sapiens
gcagcacacctcagcc

SEQ ID NO: 1717951 - DNA, 14 bp, Homo sapiens
gcagcaccaaccac

SEQ ID NO: 1717952 - DNA, 21 bp, Homo sapiens
gcagcaccaaccacagcatcg

SEQ ID NO: 1717953 - DNA, 13 bp, Homo sapiens
gcagcaccacact

SEQ ID NO: 1717954 - DNA, 15 bp, Homo sapiens
gcagcaccacactgg

SEQ ID NO: 1717955 - DNA, 17 bp, Homo sapiens
gcagcaccctgcagagc

SEQ ID NO: 1717956 - DNA, 22 bp, Homo sapiens
gcagcactccccagagctgtgc

SEQ ID NO: 1717957 - DNA, 22 bp, Homo sapiens
gcagcactggaaccacctggac

SEQ ID NO: 1717958 - DNA, 15 bp, Homo sapiens
gcagcagcaggtgat

SEQ ID NO: 1717959 - DNA, 21 bp, Homo sapiens
gcagcagccactgcacaggag

SEQ ID NO: 1717960 - DNA, 12 bp, Homo sapiens
gcagcagccagc

SEQ ID NO: 1717961 - DNA, 13 bp, Homo sapiens
gcagcagccagca

SEQ ID NO: 1717962 - DNA, 14 bp, Homo sapiens
gcagcagccagcac

SEQ ID NO: 1717963 - DNA, 22 bp, Homo sapiens
gcagcagccagggacccccaga

SEQ ID NO: 1717964 - DNA, 14 bp, Homo sapiens
gcagcagccatcat

SEQ ID NO: 1717965 - DNA, 13 bp, Homo sapiens
gcagcagcccagc

SEQ ID NO: 1717966 - DNA, 15 bp, Homo sapiens
gcagcagcccagctt

SEQ ID NO: 1717967 - DNA, 20 bp, Homo sapiens
gcagcagctaggactgagga

SEQ ID NO: 1717968 - DNA, 23 bp, Homo sapiens
gcagcagctaggactgaggagtg

SEQ ID NO: 1717969 - DNA, 23 bp, Homo sapiens
gcagcagcttttaatacagggta

SEQ ID NO: 1717970 - DNA, 15 bp, Homo sapiens
gcagcaggaggagtg

SEQ ID NO: 1717971 - DNA, 18 bp, Homo sapiens
gcagcaggctcaggcaca

SEQ ID NO: 1717972 - DNA, 15 bp, Homo sapiens
gcagcaggtgtggcc

SEQ ID NO: 1717973 - DNA, 17 bp, Homo sapiens
gcagcagtgagtctctt

SEQ ID NO: 1717974 - DNA, 21 bp, Homo sapiens
gcagcagtgagtctcttcaga

SEQ ID NO: 1717975 - DNA, 14 bp, Homo sapiens
gcagcagtgtctgt

SEQ ID NO: 1717976 - DNA, 15 bp, Homo sapiens
gcagcagtgtctgta

SEQ ID NO: 1717977 - DNA, 15 bp, Homo sapiens
gcagcatctgctaat

SEQ ID NO: 1717978 - DNA, 12 bp, Homo sapiens
gcagcatcttct

SEQ ID NO: 1717979 - DNA, 17 bp, Homo sapiens
gcagcatgacctgtgac

SEQ ID NO: 1717980 - DNA, 15 bp, Homo sapiens
gcagcatgagacttt

SEQ ID NO: 1717981 - DNA, 14 bp, Homo sapiens
gcagcatgcttggg

SEQ ID NO: 1717982 - DNA, 20 bp, Homo sapiens
gcagcatgcttgggctgacc

SEQ ID NO: 1717983 - DNA, 23 bp, Homo sapiens
gcagcatgcttgggctgacccag

SEQ ID NO: 1717984 - DNA, 12 bp, Homo sapiens
gcagcatggaaa

SEQ ID NO: 1717985 - DNA, 14 bp, Homo sapiens
gcagcatggaaaaa

SEQ ID NO: 1717986 - DNA, 17 bp, Homo sapiens
gcagcatggaaaaatgg

SEQ ID NO: 1717987 - DNA, 23 bp, Homo sapiens
gcagcatggaaaaatggttgatg

SEQ ID NO: 1717988 - DNA, 14 bp, Homo sapiens
gcagcatggcatag

SEQ ID NO: 1717989 - DNA, 23 bp, Homo sapiens
gcagcattctggaggggagagct

SEQ ID NO: 1717990 - DNA, 21 bp, Homo sapiens
gcagccaaacccatgaggcaa

SEQ ID NO: 1717991 - DNA, 21 bp, Homo sapiens
gcagccaaggccgaagctctg

SEQ ID NO: 1717992 - DNA, 22 bp, Homo sapiens
gcagccaaggccgaagctctgg

SEQ ID NO: 1717993 - DNA, 23 bp, Homo sapiens
gcagccaaggccgaagctctggc

SEQ ID NO: 1717994 - DNA, 15 bp, Homo sapiens
gcagccaaggccgcc

SEQ ID NO: 1717995 - DNA, 15 bp, Homo sapiens
gcagccacaccactg

SEQ ID NO: 1717996 - DNA, 13 bp, Homo sapiens
gcagccagagctg

SEQ ID NO: 1717997 - DNA, 23 bp, Homo sapiens
gcagccagcaccacctacacagg

SEQ ID NO: 1717998 - DNA, 17 bp, Homo sapiens
gcagccagcccagccca

SEQ ID NO: 1717999 - DNA, 21 bp, Homo sapiens
gcagccagcccagcccagctg

SEQ ID NO: 1718000 - DNA, 22 bp, Homo sapiens
gcagccagccgtgagtgcagac

SEQ ID NO: 1718001 - DNA, 17 bp, Homo sapiens
gcagccagctctcagcc

SEQ ID NO: 1718002 - DNA, 17 bp, Homo sapiens
gcagccaggctgccaag

SEQ ID NO: 1718003 - DNA, 14 bp, Homo sapiens
gcagccagggaccc

SEQ ID NO: 1718004 - DNA, 18 bp, Homo sapiens
gcagccagggacccccag

SEQ ID NO: 1718005 - DNA, 21 bp, Homo sapiens
gcagccagggacccccagaac

SEQ ID NO: 1718006 - DNA, 17 bp, Homo sapiens
gcagccagtctcagaga

SEQ ID NO: 1718007 - DNA, 18 bp, Homo sapiens
gcagccagtctcagagac

SEQ ID NO: 1718008 - DNA, 19 bp, Homo sapiens
gcagccagtctcagagacc

SEQ ID NO: 1718009 - DNA, 23 bp, Homo sapiens
gcagccagtctcagagaccagca

SEQ ID NO: 1718010 - DNA, 13 bp, Homo sapiens
gcagccatgcctc

SEQ ID NO: 1718011 - DNA, 18 bp, Homo sapiens
gcagccatgcctcatgcc

SEQ ID NO: 1718012 - DNA, 20 bp, Homo sapiens
gcagccatgcctcatgccac

SEQ ID NO: 1718013 - DNA, 17 bp, Homo sapiens
gcagcccaagcttccct

SEQ ID NO: 1718014 - DNA, 21 bp, Homo sapiens
gcagcccaagcttccctccat

SEQ ID NO: 1718015 - DNA, 17 bp, Homo sapiens
gcagcccaccctgctgc

SEQ ID NO: 1718016 - DNA, 20 bp, Homo sapiens
gcagcccaccctgctgctgg

SEQ ID NO: 1718017 - DNA, 13 bp, Homo sapiens
gcagcccagagac

SEQ ID NO: 1718018 - DNA, 14 bp, Homo sapiens
gcagcccagctcct

SEQ ID NO: 1718019 - DNA, 15 bp, Homo sapiens
gcagcccatgcccac

SEQ ID NO: 1718020 - DNA, 19 bp, Homo sapiens
gcagccccacttcaccccc

SEQ ID NO: 1718021 - DNA, 22 bp, Homo sapiens
gcagccccacttcacccccaac

SEQ ID NO: 1718022 - DNA, 14 bp, Homo sapiens
gcagccccccttgc

SEQ ID NO: 1718023 - DNA, 14 bp, Homo sapiens
gcagccccttctgg

SEQ ID NO: 1718024 - DNA, 15 bp, Homo sapiens
gcagcccggggagga

SEQ ID NO: 1718025 - DNA, 20 bp, Homo sapiens
gcagcccgtgaagcagtgcc

SEQ ID NO: 1718026 - DNA, 22 bp, Homo sapiens
gcagcccgtgaagcagtgcctc

SEQ ID NO: 1718027 - DNA, 22 bp, Homo sapiens
gcagccctaaggatctctcagg

SEQ ID NO: 1718028 - DNA, 16 bp, Homo sapiens
gcagccctcacctctg

SEQ ID NO: 1718029 - DNA, 13 bp, Homo sapiens
gcagccctgccag

SEQ ID NO: 1718030 - DNA, 14 bp, Homo sapiens
gcagccctgctttg

SEQ ID NO: 1718031 - DNA, 24 bp, Homo sapiens
gcagccctgctttgggctgccctg

SEQ ID NO: 1718032 - DNA, 14 bp, Homo sapiens
gcagcccttccaaa

SEQ ID NO: 1718033 - DNA, 16 bp, Homo sapiens
gcagccgaggcctggc

SEQ ID NO: 1718034 - DNA, 15 bp, Homo sapiens
gcagccgccagctgg

SEQ ID NO: 1718035 - DNA, 19 bp, Homo sapiens
gcagccgctaggagagact

SEQ ID NO: 1718036 - DNA, 21 bp, Homo sapiens
gcagccgctaggagagactga

SEQ ID NO: 1718037 - DNA, 21 bp, Homo sapiens
gcagccggagggaggcactag

SEQ ID NO: 1718038 - DNA, 18 bp, Homo sapiens
gcagccgtcccaggccac

SEQ ID NO: 1718039 - DNA, 22 bp, Homo sapiens
gcagccgtcccaggccaccccc

SEQ ID NO: 1718040 - DNA, 18 bp, Homo sapiens
gcagccgtttgagaagaa

SEQ ID NO: 1718041 - DNA, 22 bp, Homo sapiens
gcagccgtttgagaagaaaaca

SEQ ID NO: 1718042 - DNA, 12 bp, Homo sapiens
gcagcctccact

SEQ ID NO: 1718043 - DNA, 13 bp, Homo sapiens
gcagcctccactg

SEQ ID NO: 1718044 - DNA, 20 bp, Homo sapiens
gcagcctccagagccagcct

SEQ ID NO: 1718045 - DNA, 22 bp, Homo sapiens
gcagcctccctctgacctgcag

SEQ ID NO: 1718046 - DNA, 23 bp, Homo sapiens
gcagcctccctgtcactcagctg

SEQ ID NO: 1718047 - DNA, 13 bp, Homo sapiens
gcagcctcccttc

SEQ ID NO: 1718048 - DNA, 17 bp, Homo sapiens
gcagcctcctttgtgtg

SEQ ID NO: 1718049 - DNA, 17 bp, Homo sapiens
gcagcctcgcacaggcc

SEQ ID NO: 1718050 - DNA, 19 bp, Homo sapiens
gcagcctcgcacaggccct

SEQ ID NO: 1718051 - DNA, 22 bp, Homo sapiens
gcagcctcgcacaggccctagc

SEQ ID NO: 1718052 - DNA, 20 bp, Homo sapiens
gcagcctctccccaggtcca

SEQ ID NO: 1718053 - DNA, 17 bp, Homo sapiens
gcagcctgaagcctgga

SEQ ID NO: 1718054 - DNA, 23 bp, Homo sapiens
gcagcctgatggccaagggggtg

SEQ ID NO: 1718055 - DNA, 15 bp, Homo sapiens
gcagcctgctctgga

SEQ ID NO: 1718056 - DNA, 22 bp, Homo sapiens
gcaggagtgccaggaccagcct

SEQ ID NO: 1718057 - DNA, 15 bp, Homo sapiens
gcaggagtgtcctgc

SEQ ID NO: 1718058 - DNA, 21 bp, Homo sapiens
gcaggagtgtcctgcccatgc

SEQ ID NO: 1718059 - DNA, 22 bp, Homo sapiens
gcaggagtgtcctgcccatgcc

SEQ ID NO: 1718060 - DNA, 23 bp, Homo sapiens
gcaggatcagatgactctctcca

SEQ ID NO: 1718061 - DNA, 15 bp, Homo sapiens
gcaggatccctcctg

SEQ ID NO: 1718062 - DNA, 16 bp, Homo sapiens
gcaggatccctcctga

SEQ ID NO: 1718063 - DNA, 18 bp, Homo sapiens
gcaggatccctcctgagc

SEQ ID NO: 1718064 - DNA, 23 bp, Homo sapiens
atcttttttagcataaaattttc

SEQ ID NO: 1718065 - DNA, 21 bp, Homo sapiens
atcttttttggaactaaagca

SEQ ID NO: 1718066 - DNA, 21 bp, Homo sapiens
atcttttttgttaactgattt

SEQ ID NO: 1718067 - DNA, 17 bp, Homo sapiens
atgaaaaagctgcttct

SEQ ID NO: 1718068 - DNA, 14 bp, Homo sapiens
atgaaaaatacttt

SEQ ID NO: 1718069 - DNA, 18 bp, Homo sapiens
atgaaaaattggggagga

SEQ ID NO: 1718070 - DNA, 18 bp, Homo sapiens
atgaaaacatgtactaca

SEQ ID NO: 1718071 - DNA, 19 bp, Homo sapiens
atgaaaacatgtactacag

SEQ ID NO: 1718072 - DNA, 21 bp, Homo sapiens
atgaaaaggttgcctgaaaaa

SEQ ID NO: 1718073 - DNA, 14 bp, Homo sapiens
atgaaaataaaaca

SEQ ID NO: 1718074 - DNA, 20 bp, Homo sapiens
atgaaaataaaacacacctc

SEQ ID NO: 1718075 - DNA, 15 bp, Homo sapiens
atgaaaataattttc

SEQ ID NO: 1718076 - DNA, 12 bp, Homo sapiens
atgaaaatcctt

SEQ ID NO: 1718077 - DNA, 18 bp, Homo sapiens
atgaaaatccttttaacc

SEQ ID NO: 1718078 - DNA, 16 bp, Homo sapiens
atgaaaatgagcatca

SEQ ID NO: 1718079 - DNA, 12 bp, Homo sapiens
atgaaaatgtca

SEQ ID NO: 1718080 - DNA, 15 bp, Homo sapiens
atgaaaatgtcagaa

SEQ ID NO: 1718081 - DNA, 19 bp, Homo sapiens
atgaaaatgtcagaaacca

SEQ ID NO: 1718082 - DNA, 12 bp, Homo sapiens
atgaaacaagca

SEQ ID NO: 1718083 - DNA, 20 bp, Homo sapiens
atgaaacactcagttgttca

SEQ ID NO: 1718084 - DNA, 15 bp, Homo sapiens
atgaaacacttctca

SEQ ID NO: 1718085 - DNA, 13 bp, Homo sapiens
atgaaacagaaac

SEQ ID NO: 1718086 - DNA, 18 bp, Homo sapiens
atgaaacagaaacaaaaa

SEQ ID NO: 1718087 - DNA, 19 bp, Homo sapiens
atgaaacttgtttcactga

SEQ ID NO: 1718088 - DNA, 23 bp, Homo sapiens
atgaaagctgattactgtcaata

SEQ ID NO: 1718089 - DNA, 17 bp, Homo sapiens
atgaaagggaaactggg

SEQ ID NO: 1718090 - DNA, 22 bp, Homo sapiens
atgaaagggtttgtaatacttt

SEQ ID NO: 1718091 - DNA, 14 bp, Homo sapiens
atgaaataaaatta

SEQ ID NO: 1718092 - DNA, 15 bp, Homo sapiens
atgaaatatgcatct

SEQ ID NO: 1718093 - DNA, 15 bp, Homo sapiens
atgaaatcaaatgta

SEQ ID NO: 1718094 - DNA, 21 bp, Homo sapiens
atgaaatcaaatgtatgtatc

SEQ ID NO: 1718095 - DNA, 21 bp, Homo sapiens
atgaaatccgtgaagtcacat

SEQ ID NO: 1718096 - DNA, 23 bp, Homo sapiens
atgaaatgtgaatttttattgtt

SEQ ID NO: 1718097 - DNA, 23 bp, Homo sapiens
atgaaattacttatcatccacat

SEQ ID NO: 1718098 - DNA, 21 bp, Homo sapiens
atgaaattatataagtattct

SEQ ID NO: 1718099 - DNA, 22 bp, Homo sapiens
atgaaattgtctagcagagcag

SEQ ID NO: 1718100 - DNA, 14 bp, Homo sapiens
atgaacaaattctt

SEQ ID NO: 1718101 - DNA, 23 bp, Homo sapiens
atgaacactatgcactgctgtaa

SEQ ID NO: 1718102 - DNA, 14 bp, Homo sapiens
atgaacactcccca

SEQ ID NO: 1718103 - DNA, 13 bp, Homo sapiens
atgaacacttata

SEQ ID NO: 1718104 - DNA, 16 bp, Homo sapiens
atgaacagaaatattg

SEQ ID NO: 1718105 - DNA, 13 bp, Homo sapiens
atgaacagctcct

SEQ ID NO: 1718106 - DNA, 17 bp, Homo sapiens
atgaacagctgtgtctg

SEQ ID NO: 1718107 - DNA, 21 bp, Homo sapiens
atgaacagctgtgtctgccaa

SEQ ID NO: 1718108 - DNA, 20 bp, Homo sapiens
atgaacagtttggggactca

SEQ ID NO: 1718109 - DNA, 21 bp, Homo sapiens
atgaacatattgttgaaaggt

SEQ ID NO: 1718110 - DNA, 15 bp, Homo sapiens
atgaacatgttcctg

SEQ ID NO: 1718111 - DNA, 15 bp, Homo sapiens
atgaacattgtactg

SEQ ID NO: 1718112 - DNA, 14 bp, Homo sapiens
atgaacctattttc

SEQ ID NO: 1718113 - DNA, 14 bp, Homo sapiens
atgaactcaacttt

SEQ ID NO: 1718114 - DNA, 22 bp, Homo sapiens
atgaactcagctattaagaaaa

SEQ ID NO: 1718115 - DNA, 23 bp, Homo sapiens
atgaactgcttttcctcaagcaa

SEQ ID NO: 1718116 - DNA, 17 bp, Homo sapiens
atgaactggcttgtaca

SEQ ID NO: 1718117 - DNA, 19 bp, Homo sapiens
atgaactggcttgtacatt

SEQ ID NO: 1718118 - DNA, 13 bp, Homo sapiens
atgaactgtacta

SEQ ID NO: 1718119 - DNA, 20 bp, Homo sapiens
atgaactgtccgtgaatggt

SEQ ID NO: 1718120 - DNA, 22 bp, Homo sapiens
atgaacttccatttgtattcaa

SEQ ID NO: 1718121 - DNA, 19 bp, Homo sapiens
atgaagaaaatcacttagg

SEQ ID NO: 1718122 - DNA, 21 bp, Homo sapiens
atgaagaaagtcaaaaaatta

SEQ ID NO: 1718123 - DNA, 19 bp, Homo sapiens
atgaagaagacaaagtcta

SEQ ID NO: 1718124 - DNA, 17 bp, Homo sapiens
atgaagaagggggtggg

SEQ ID NO: 1718125 - DNA, 17 bp, Homo sapiens
atgaagaattatgtaat

SEQ ID NO: 1718126 - DNA, 14 bp, Homo sapiens
atgaagacttaaaa

SEQ ID NO: 1718127 - DNA, 16 bp, Homo sapiens
atgaagacttaaaaga

SEQ ID NO: 1718128 - DNA, 12 bp, Homo sapiens
atgaagagaaaa

SEQ ID NO: 1718129 - DNA, 18 bp, Homo sapiens
atgaagagtgagagggca

SEQ ID NO: 1718130 - DNA, 16 bp, Homo sapiens
atgaagatgaagagct

SEQ ID NO: 1718131 - DNA, 22 bp, Homo sapiens
atgaagatgtttcaaaaaatct

SEQ ID NO: 1718132 - DNA, 13 bp, Homo sapiens
atgaagcagtatt

SEQ ID NO: 1718133 - DNA, 12 bp, Homo sapiens
atgaagcccaag

SEQ ID NO: 1718134 - DNA, 20 bp, Homo sapiens
atgaagcctccttagaaaaa

SEQ ID NO: 1718135 - DNA, 16 bp, Homo sapiens
atgaagccttagccag

SEQ ID NO: 1718136 - DNA, 16 bp, Homo sapiens
atgaaggcaaaaaaat

SEQ ID NO: 1718137 - DNA, 17 bp, Homo sapiens
atgaagggaaaggatat

SEQ ID NO: 1718138 - DNA, 17 bp, Homo sapiens
atgaaggtaaataaaaa

SEQ ID NO: 1718139 - DNA, 21 bp, Homo sapiens
atgaaggttaggatttaacag

SEQ ID NO: 1718140 - DNA, 17 bp, Homo sapiens
atgaaggtttttgtaaa

SEQ ID NO: 1718141 - DNA, 12 bp, Homo sapiens
atgaagtaaatt

SEQ ID NO: 1718142 - DNA, 17 bp, Homo sapiens
atgaagtatataatggt

SEQ ID NO: 1718143 - DNA, 19 bp, Homo sapiens
atgaagtgcacaggagcca

SEQ ID NO: 1718144 - DNA, 19 bp, Homo sapiens
atgaagttgctgtttattt

SEQ ID NO: 1718145 - DNA, 13 bp, Homo sapiens
atgaataaaacaa

SEQ ID NO: 1718146 - DNA, 20 bp, Homo sapiens
atgaataaaacaataaatga

SEQ ID NO: 1718147 - DNA, 16 bp, Homo sapiens
atgaataaaacactca

SEQ ID NO: 1718148 - DNA, 17 bp, Homo sapiens
atgaataaaacactcat

SEQ ID NO: 1718149 - DNA, 17 bp, Homo sapiens
atgaataaagcctttgt

SEQ ID NO: 1718150 - DNA, 20 bp, Homo sapiens
atgaataatggaaaatgcca

SEQ ID NO: 1718151 - DNA, 20 bp, Homo sapiens
atgaatacaaacaatggaaa

SEQ ID NO: 1718152 - DNA, 14 bp, Homo sapiens
atgaatacatttcc

SEQ ID NO: 1718153 - DNA, 12 bp, Homo sapiens
atgaatatcagg

SEQ ID NO: 1718154 - DNA, 21 bp, Homo sapiens
atgaatatctattaatatatg

SEQ ID NO: 1718155 - DNA, 22 bp, Homo sapiens
atgaatatctattaatatatgt

SEQ ID NO: 1718156 - DNA, 23 bp, Homo sapiens
atgaatctattatactgtattaa

SEQ ID NO: 1718157 - DNA, 13 bp, Homo sapiens
atgaatgaataac

SEQ ID NO: 1718158 - DNA, 15 bp, Homo sapiens
atgaatgagtctgtt

SEQ ID NO: 1718159 - DNA, 15 bp, Homo sapiens
atgaatgcacactag

SEQ ID NO: 1718160 - DNA, 21 bp, Homo sapiens
atgaatgggctgagctgcctg

SEQ ID NO: 1718161 - DNA, 12 bp, Homo sapiens
atgaatgtaaat

SEQ ID NO: 1718162 - DNA, 21 bp, Homo sapiens
atgaatgtaaatttgtactat

SEQ ID NO: 1718163 - DNA, 13 bp, Homo sapiens
atgaatgtatcag

SEQ ID NO: 1718164 - DNA, 15 bp, Homo sapiens
atgaatgtatcagga

SEQ ID NO: 1718165 - DNA, 16 bp, Homo sapiens
atgaatgtatcaggaa

SEQ ID NO: 1718166 - DNA, 21 bp, Homo sapiens
atgaatgtgctggtgaacact

SEQ ID NO: 1718167 - DNA, 14 bp, Homo sapiens
atgaattaaagtgg

SEQ ID NO: 1718168 - DNA, 16 bp, Homo sapiens
atgaattaaataaacc

SEQ ID NO: 1718169 - DNA, 16 bp, Homo sapiens
atgaattataacagtt

SEQ ID NO: 1718170 - DNA, 16 bp, Homo sapiens
atgagcatcagagagt

SEQ ID NO: 1718171 - DNA, 16 bp, Homo sapiens
atgagccatcactaga

SEQ ID NO: 1718172 - DNA, 18 bp, Homo sapiens
atgagccatcactagaag

SEQ ID NO: 1718173 - DNA, 20 bp, Homo sapiens
atgagcctgctggaagccca

SEQ ID NO: 1718174 - DNA, 22 bp, Homo sapiens
atgagccttgcagatatctgca

SEQ ID NO: 1718175 - DNA, 11 bp, Homo sapiens
atgagctcctg

SEQ ID NO: 1718176 - DNA, 21 bp, Homo sapiens
atgagctggaaggagtgagag

SEQ ID NO: 1718177 - DNA, 13 bp, Homo sapiens
atgagctgggtac

SEQ ID NO: 1718178 - DNA, 16 bp, Homo sapiens
atgagctgggtactga

SEQ ID NO: 1718179 - DNA, 14 bp, Homo sapiens
atgaggaaaaaatg

SEQ ID NO: 1718180 - DNA, 21 bp, Homo sapiens
atgaggaactgtagatgatgt

SEQ ID NO: 1718181 - DNA, 22 bp, Homo sapiens
atgaggaactgtagatgatgta

SEQ ID NO: 1718182 - DNA, 15 bp, Homo sapiens
atgaggaagcaaaga

SEQ ID NO: 1718183 - DNA, 12 bp, Homo sapiens
atgaggacagaa

SEQ ID NO: 1718184 - DNA, 15 bp, Homo sapiens
atgaggactcatata

SEQ ID NO: 1718185 - DNA, 18 bp, Homo sapiens
gcagtaagtcttttttga

SEQ ID NO: 1718186 - DNA, 13 bp, Homo sapiens
gcagtacatggga

SEQ ID NO: 1718187 - DNA, 15 bp, Homo sapiens
gcagtactaaaatta

SEQ ID NO: 1718188 - DNA, 21 bp, Homo sapiens
gcagtagaaataatatgcatt

SEQ ID NO: 1718189 - DNA, 20 bp, Homo sapiens
gcagtatgatggcaggagaa

SEQ ID NO: 1718190 - DNA, 13 bp, Homo sapiens
gcagtattgagtt

SEQ ID NO: 1718191 - DNA, 23 bp, Homo sapiens
gcagtcactggaggttgaagcca

SEQ ID NO: 1718192 - DNA, 20 bp, Homo sapiens
gcagtcaggggtcaggtgtc

SEQ ID NO: 1718193 - DNA, 14 bp, Homo sapiens
gcagtcatctactt

SEQ ID NO: 1718194 - DNA, 17 bp, Homo sapiens
gcagtcatctacttttt

SEQ ID NO: 1718195 - DNA, 13 bp, Homo sapiens
gcagtccagccag

SEQ ID NO: 1718196 - DNA, 15 bp, Homo sapiens
gcagtccagccagct

SEQ ID NO: 1718197 - DNA, 18 bp, Homo sapiens
gcagtccagccagctcct

SEQ ID NO: 1718198 - DNA, 22 bp, Homo sapiens
gcagtccccagcccttctgcct

SEQ ID NO: 1718199 - DNA, 12 bp, Homo sapiens
gcagtccgcagt

SEQ ID NO: 1718200 - DNA, 14 bp, Homo sapiens
gcagtcctgaggag

SEQ ID NO: 1718201 - DNA, 17 bp, Homo sapiens
gcagtcctgcctcagcc

SEQ ID NO: 1718202 - DNA, 12 bp, Homo sapiens
gcagtcctggag

SEQ ID NO: 1718203 - DNA, 15 bp, Homo sapiens
gcagtcctggaggca

SEQ ID NO: 1718204 - DNA, 22 bp, Homo sapiens
gcagtcctggtggggctgagcc

SEQ ID NO: 1718205 - DNA, 22 bp, Homo sapiens
gcagtcctttgtaaacagtgtt

SEQ ID NO: 1718206 - DNA, 21 bp, Homo sapiens
gcagtcgggggctggcctagg

SEQ ID NO: 1718207 - DNA, 23 bp, Homo sapiens
gcagtcgggggctggcctaggag

SEQ ID NO: 1718208 - DNA, 16 bp, Homo sapiens
gcagtcgtgcctgtgt

SEQ ID NO: 1718209 - DNA, 14 bp, Homo sapiens
gcagtctctatatt

SEQ ID NO: 1718210 - DNA, 20 bp, Homo sapiens
gcagtctctatattatgtct

SEQ ID NO: 1718211 - DNA, 22 bp, Homo sapiens
gcagtctctatattatgtcttc

SEQ ID NO: 1718212 - DNA, 18 bp, Homo sapiens
gcagtctgaacccttgtg

SEQ ID NO: 1718213 - DNA, 19 bp, Homo sapiens
gcagtcttctctctggctc

SEQ ID NO: 1718214 - DNA, 21 bp, Homo sapiens
gcagtcttctctctggctcag

SEQ ID NO: 1718215 - DNA, 16 bp, Homo sapiens
gcagtgaaaaatatgt

SEQ ID NO: 1718216 - DNA, 21 bp, Homo sapiens
gcagtgaattgtgaccaagtt

SEQ ID NO: 1718217 - DNA, 19 bp, Homo sapiens
gcagtgacacaatctcggc

SEQ ID NO: 1718218 - DNA, 21 bp, Homo sapiens
gcagtgagcagggttcctgtg

SEQ ID NO: 1718219 - DNA, 20 bp, Homo sapiens
gcagtgagccaagattgcgc

SEQ ID NO: 1718220 - DNA, 14 bp, Homo sapiens
gcagtgagctgaga

SEQ ID NO: 1718221 - DNA, 18 bp, Homo sapiens
gcagtgagtctcttcaga

SEQ ID NO: 1718222 - DNA, 14 bp, Homo sapiens
gcagtgatctcagg

SEQ ID NO: 1718223 - DNA, 18 bp, Homo sapiens
gcagtgatctcagggcag

SEQ ID NO: 1718224 - DNA, 13 bp, Homo sapiens
gcagtgcccggct

SEQ ID NO: 1718225 - DNA, 19 bp, Homo sapiens
gcagtgctgggaccagagc

SEQ ID NO: 1718226 - DNA, 20 bp, Homo sapiens
gcagtgctgggaccagagcc

SEQ ID NO: 1718227 - DNA, 23 bp, Homo sapiens
gcagtgctgggaccagagccaga

SEQ ID NO: 1718228 - DNA, 15 bp, Homo sapiens
gcagtggacaccagg

SEQ ID NO: 1718229 - DNA, 16 bp, Homo sapiens
gcagtggaggctgctg

SEQ ID NO: 1718230 - DNA, 12 bp, Homo sapiens
gcagtggccagg

SEQ ID NO: 1718231 - DNA, 15 bp, Homo sapiens
gcagtggcctggccg

SEQ ID NO: 1718232 - DNA, 22 bp, Homo sapiens
gcagtggcgcgatctcagctca

SEQ ID NO: 1718233 - DNA, 14 bp, Homo sapiens
gcagtggctggtcc

SEQ ID NO: 1718234 - DNA, 20 bp, Homo sapiens
gcagtggctggtccagggct

SEQ ID NO: 1718235 - DNA, 15 bp, Homo sapiens
gcagtggcttttcat

SEQ ID NO: 1718236 - DNA, 15 bp, Homo sapiens
gcagtgggcaggtgg

SEQ ID NO: 1718237 - DNA, 24 bp, Homo sapiens
gcagtggttttggcaaacgctaaa

SEQ ID NO: 1718238 - DNA, 16 bp, Homo sapiens
gcagtgtcccctgccc

SEQ ID NO: 1718239 - DNA, 18 bp, Homo sapiens
gcagtgtcccctgcccca

SEQ ID NO: 1718240 - DNA, 20 bp, Homo sapiens
gcagtgtcccctgccccaga

SEQ ID NO: 1718241 - DNA, 23 bp, Homo sapiens
gcagtgtcccctgccccagaggt

SEQ ID NO: 1718242 - DNA, 18 bp, Homo sapiens
gcagtgtctgtgttttga

SEQ ID NO: 1718243 - DNA, 20 bp, Homo sapiens
gcagtgtgaggacctccctg

SEQ ID NO: 1718244 - DNA, 16 bp, Homo sapiens
gcagtgtgatccagtt

SEQ ID NO: 1718245 - DNA, 12 bp, Homo sapiens
gcagtgtggagt

SEQ ID NO: 1718246 - DNA, 21 bp, Homo sapiens
gcagtgtggagttcaccttgg

SEQ ID NO: 1718247 - DNA, 14 bp, Homo sapiens
gcagtgtggcctct

SEQ ID NO: 1718248 - DNA, 22 bp, Homo sapiens
gcagtgtttcccgccttgggct

SEQ ID NO: 1718249 - DNA, 19 bp, Homo sapiens
gcagttacagctctgtagt

SEQ ID NO: 1718250 - DNA, 22 bp, Homo sapiens
gcagttaccttaaagctgaatt

SEQ ID NO: 1718251 - DNA, 14 bp, Homo sapiens
gcagttatagaaaa

SEQ ID NO: 1718252 - DNA, 18 bp, Homo sapiens
gcagttcaaatcctcacc

SEQ ID NO: 1718253 - DNA, 22 bp, Homo sapiens
gcagttcagaatggcagtcctg

SEQ ID NO: 1718254 - DNA, 23 bp, Homo sapiens
gcagttcagaatggcagtcctgg

SEQ ID NO: 1718255 - DNA, 17 bp, Homo sapiens
gcagttcagcaccaccc

SEQ ID NO: 1718256 - DNA, 12 bp, Homo sapiens
gcagttctagaa

SEQ ID NO: 1718257 - DNA, 21 bp, Homo sapiens
gcagttctagtttgcattcct

SEQ ID NO: 1718258 - DNA, 15 bp, Homo sapiens
gcagttgataagagg

SEQ ID NO: 1718259 - DNA, 18 bp, Homo sapiens
gcagttgataagaggaat

SEQ ID NO: 1718260 - DNA, 17 bp, Homo sapiens
gcagttggactctcagg

SEQ ID NO: 1718261 - DNA, 19 bp, Homo sapiens
gcagttggccaagcagaaa

SEQ ID NO: 1718262 - DNA, 13 bp, Homo sapiens
gcagtttcctgga

SEQ ID NO: 1718263 - DNA, 14 bp, Homo sapiens
gcagtttcctggaa

SEQ ID NO: 1718264 - DNA, 16 bp, Homo sapiens
gcagtttgcaaaaaat

SEQ ID NO: 1718265 - DNA, 14 bp, Homo sapiens
gcagtttggccctg

SEQ ID NO: 1718266 - DNA, 20 bp, Homo sapiens
gcagtttggccctggagcca

SEQ ID NO: 1718267 - DNA, 16 bp, Homo sapiens
gcagttttgtaaatgt

SEQ ID NO: 1718268 - DNA, 17 bp, Homo sapiens
gcagttttgtaaatgta

SEQ ID NO: 1718269 - DNA, 12 bp, Homo sapiens
gcagtttttcag

SEQ ID NO: 1718270 - DNA, 12 bp, Homo sapiens
gcagttttttga

SEQ ID NO: 1718271 - DNA, 14 bp, Homo sapiens
gcataacctgtctc

SEQ ID NO: 1718272 - DNA, 19 bp, Homo sapiens
gcataacctgtctcacctg

SEQ ID NO: 1718273 - DNA, 16 bp, Homo sapiens
gcataactaaaattaa

SEQ ID NO: 1718274 - DNA, 16 bp, Homo sapiens
gcataatagtcaattt

SEQ ID NO: 1718275 - DNA, 22 bp, Homo sapiens
gcataatgctcccatctcctga

SEQ ID NO: 1718276 - DNA, 16 bp, Homo sapiens
gcatacaacagagggg

SEQ ID NO: 1718277 - DNA, 20 bp, Homo sapiens
gcatacaagtttcattctcc

SEQ ID NO: 1718278 - DNA, 22 bp, Homo sapiens
gcatacacacatgccctcctgg

SEQ ID NO: 1718279 - DNA, 16 bp, Homo sapiens
gcatacactgtagttt

SEQ ID NO: 1718280 - DNA, 17 bp, Homo sapiens
gcatacatttataatgt

SEQ ID NO: 1718281 - DNA, 23 bp, Homo sapiens
gcataccggacttgtcacacgga

SEQ ID NO: 1718282 - DNA, 20 bp, Homo sapiens
gcatacgagagcagaggtct

SEQ ID NO: 1718283 - DNA, 16 bp, Homo sapiens
gcatactttctctcta

SEQ ID NO: 1718284 - DNA, 17 bp, Homo sapiens
gcatctgcccctccccc

SEQ ID NO: 1718285 - DNA, 23 bp, Homo sapiens
gcatctgctctagattcataaat

SEQ ID NO: 1718286 - DNA, 18 bp, Homo sapiens
gcatctggctgtctagaa

SEQ ID NO: 1718287 - DNA, 20 bp, Homo sapiens
gcatctggctgtctagaatg

SEQ ID NO: 1718288 - DNA, 19 bp, Homo sapiens
gcatctggtgtaggaagtt

SEQ ID NO: 1718289 - DNA, 13 bp, Homo sapiens
gcatctttgcctt

SEQ ID NO: 1718290 - DNA, 18 bp, Homo sapiens
gcatctttgccttgggct

SEQ ID NO: 1718291 - DNA, 23 bp, Homo sapiens
gcatctttgccttgggctgctcc

SEQ ID NO: 1718292 - DNA, 21 bp, Homo sapiens
gcatcttttctagagacacat

SEQ ID NO: 1718293 - DNA, 23 bp, Homo sapiens
gcatcttttctagagacacattg

SEQ ID NO: 1718294 - DNA, 16 bp, Homo sapiens
gcatcttttgtattaa

SEQ ID NO: 1718295 - DNA, 20 bp, Homo sapiens
gcatgaaatgaatgtctgag

SEQ ID NO: 1718296 - DNA, 16 bp, Homo sapiens
gcatgaaattgtatct

SEQ ID NO: 1718297 - DNA, 20 bp, Homo sapiens
gcatgaaattgtatctcagt

SEQ ID NO: 1718298 - DNA, 14 bp, Homo sapiens
gcatgaataaaaca

SEQ ID NO: 1718299 - DNA, 15 bp, Homo sapiens
gcatgaataaaacac

SEQ ID NO: 1718300 - DNA, 20 bp, Homo sapiens
gcatgaatcactgtgctcag

SEQ ID NO: 1718301 - DNA, 22 bp, Homo sapiens
gcatgaatcactgtgctcagcc

SEQ ID NO: 1718302 - DNA, 21 bp, Homo sapiens
gcatgaattactgtatataaa

SEQ ID NO: 1718303 - DNA, 18 bp, Homo sapiens
gcatgacagaaaatatgt

SEQ ID NO: 1718304 - DNA, 21 bp, Homo sapiens
atgcaaaatagacatctttaa

SEQ ID NO: 1718305 - DNA, 12 bp, Homo sapiens
atgcaaaattgt

SEQ ID NO: 1718306 - DNA, 18 bp, Homo sapiens
atgcaaaatttttttaat

SEQ ID NO: 1718307 - DNA, 17 bp, Homo sapiens
atgcaaacattggaaga

SEQ ID NO: 1718308 - DNA, 12 bp, Homo sapiens
atgcaaagcact

SEQ ID NO: 1718309 - DNA, 11 bp, Homo sapiens
atgcaaataca

SEQ ID NO: 1718310 - DNA, 17 bp, Homo sapiens
atgcaaccaagtcacac

SEQ ID NO: 1718311 - DNA, 16 bp, Homo sapiens
atgcaaggaaggaaag

SEQ ID NO: 1718312 - DNA, 18 bp, Homo sapiens
atgcaaggaaggaaagaa

SEQ ID NO: 1718313 - DNA, 22 bp, Homo sapiens
atgcaaggaccaggactccctc

SEQ ID NO: 1718314 - DNA, 18 bp, Homo sapiens
atgcaataaaatttaaaa

SEQ ID NO: 1718315 - DNA, 23 bp, Homo sapiens
atgcaataaaatttaaaaaataa

SEQ ID NO: 1718316 - DNA, 13 bp, Homo sapiens
atgcaataactct

SEQ ID NO: 1718317 - DNA, 22 bp, Homo sapiens
atgcaatactggtcaacttaag

SEQ ID NO: 1718318 - DNA, 15 bp, Homo sapiens
atgcaatataagcat

SEQ ID NO: 1718319 - DNA, 18 bp, Homo sapiens
atgcaatgtatagtgtct

SEQ ID NO: 1718320 - DNA, 14 bp, Homo sapiens
atgcaatttgaagt

SEQ ID NO: 1718321 - DNA, 17 bp, Homo sapiens
atgcaatttgattgact

SEQ ID NO: 1718322 - DNA, 15 bp, Homo sapiens
atgcacacagataca

SEQ ID NO: 1718323 - DNA, 21 bp, Homo sapiens
atgcacacagtgctttccgtg

SEQ ID NO: 1718324 - DNA, 19 bp, Homo sapiens
atgcacacatatataggca

SEQ ID NO: 1718325 - DNA, 13 bp, Homo sapiens
atgcacagctgct

SEQ ID NO: 1718326 - DNA, 17 bp, Homo sapiens
atgcacagctgcttgtc

SEQ ID NO: 1718327 - DNA, 12 bp, Homo sapiens
atgcacagctgt

SEQ ID NO: 1718328 - DNA, 12 bp, Homo sapiens
atgcacagtaca

SEQ ID NO: 1718329 - DNA, 15 bp, Homo sapiens
atgcacagtacaata

SEQ ID NO: 1718330 - DNA, 14 bp, Homo sapiens
atgcacagtatttg

SEQ ID NO: 1718331 - DNA, 19 bp, Homo sapiens
atgcacatgctgtctggcc

SEQ ID NO: 1718332 - DNA, 21 bp, Homo sapiens
atgcacatgctgtctggccct

SEQ ID NO: 1718333 - DNA, 14 bp, Homo sapiens
atgcacatttatat

SEQ ID NO: 1718334 - DNA, 17 bp, Homo sapiens
atgcacatttatatata

SEQ ID NO: 1718335 - DNA, 22 bp, Homo sapiens
atgcacatttatatatatatgt

SEQ ID NO: 1718336 - DNA, 16 bp, Homo sapiens
atgcacatttctggat

SEQ ID NO: 1718337 - DNA, 21 bp, Homo sapiens
atgcacatttgtcactgaata

SEQ ID NO: 1718338 - DNA, 13 bp, Homo sapiens
atgcacattttgt

SEQ ID NO: 1718339 - DNA, 21 bp, Homo sapiens
atgcaccaccaagccaaggga

SEQ ID NO: 1718340 - DNA, 16 bp, Homo sapiens
atgcaccatggagacg

SEQ ID NO: 1718341 - DNA, 19 bp, Homo sapiens
atgcacctcccttccctcc

SEQ ID NO: 1718342 - DNA, 18 bp, Homo sapiens
atgcaccttgtgtctgta

SEQ ID NO: 1718343 - DNA, 19 bp, Homo sapiens
atgcacgtggggcccactg

SEQ ID NO: 1718344 - DNA, 18 bp, Homo sapiens
atgcactcacccctagcc

SEQ ID NO: 1718345 - DNA, 22 bp, Homo sapiens
atgcactcacccctagccctgg

SEQ ID NO: 1718346 - DNA, 17 bp, Homo sapiens
atgcactgacccttcca

SEQ ID NO: 1718347 - DNA, 22 bp, Homo sapiens
atgcactgacccttccagacat

SEQ ID NO: 1718348 - DNA, 18 bp, Homo sapiens
atgcactgtgaaggaccc

SEQ ID NO: 1718349 - DNA, 19 bp, Homo sapiens
atgcactgtgaaggaccct

SEQ ID NO: 1718350 - DNA, 14 bp, Homo sapiens
atgcactgtggttt

SEQ ID NO: 1718351 - DNA, 15 bp, Homo sapiens
atgcactgtggtttc

SEQ ID NO: 1718352 - DNA, 18 bp, Homo sapiens
atgcactgtggtttcaga

SEQ ID NO: 1718353 - DNA, 21 bp, Homo sapiens
atgcactgtggtttcagatgt

SEQ ID NO: 1718354 - DNA, 23 bp, Homo sapiens
atgcactgtggtttcagatgtgc

SEQ ID NO: 1718355 - DNA, 16 bp, Homo sapiens
atgcacttttagaaat

SEQ ID NO: 1718356 - DNA, 21 bp, Homo sapiens
atgcacttttagaaatgcata

SEQ ID NO: 1718357 - DNA, 19 bp, Homo sapiens
atgcagaaaacagggtctg

SEQ ID NO: 1718358 - DNA, 11 bp, Homo sapiens
atgcagaaata

SEQ ID NO: 1718359 - DNA, 18 bp, Homo sapiens
atgcagaagcatattttg

SEQ ID NO: 1718360 - DNA, 18 bp, Homo sapiens
atgcagacaaagccctgt

SEQ ID NO: 1718361 - DNA, 19 bp, Homo sapiens
atgcagacaaagccctgtc

SEQ ID NO: 1718362 - DNA, 21 bp, Homo sapiens
atgcagacagtctgttatgca

SEQ ID NO: 1718363 - DNA, 23 bp, Homo sapiens
atgcagacagtctgttatgcact

SEQ ID NO: 1718364 - DNA, 19 bp, Homo sapiens
atgcagacctcatgcccag

SEQ ID NO: 1718365 - DNA, 21 bp, Homo sapiens
atgcagacctcatgcccagct

SEQ ID NO: 1718366 - DNA, 18 bp, Homo sapiens
atgcagactcctcagatc

SEQ ID NO: 1718367 - DNA, 15 bp, Homo sapiens
atgcagaggcctggg

SEQ ID NO: 1718368 - DNA, 17 bp, Homo sapiens
atgcagaggtctccaaa

SEQ ID NO: 1718369 - DNA, 17 bp, Homo sapiens
atgcagagtaagtatta

SEQ ID NO: 1718370 - DNA, 16 bp, Homo sapiens
atgcagagttgacatg

SEQ ID NO: 1718371 - DNA, 17 bp, Homo sapiens
atgcagcaaatatatga

SEQ ID NO: 1718372 - DNA, 16 bp, Homo sapiens
atgcagccatatatgg

SEQ ID NO: 1718373 - DNA, 15 bp, Homo sapiens
atgcagcccatgccc

SEQ ID NO: 1718374 - DNA, 21 bp, Homo sapiens
atgcagccgtgatcaagggaa

SEQ ID NO: 1718375 - DNA, 15 bp, Homo sapiens
atgcagctactggaa

SEQ ID NO: 1718376 - DNA, 15 bp, Homo sapiens
atgcaggaagaggcc

SEQ ID NO: 1718377 - DNA, 16 bp, Homo sapiens
atgcaggaagaggccc

SEQ ID NO: 1718378 - DNA, 17 bp, Homo sapiens
atgcaggacaggaggcg

SEQ ID NO: 1718379 - DNA, 16 bp, Homo sapiens
atgcaggggtcagtgc

SEQ ID NO: 1718380 - DNA, 14 bp, Homo sapiens
atgcagtactaaaa

SEQ ID NO: 1718381 - DNA, 16 bp, Homo sapiens
atgcagtgaattgtga

SEQ ID NO: 1718382 - DNA, 18 bp, Homo sapiens
atgcagtgtgatccagtt

SEQ ID NO: 1718383 - DNA, 20 bp, Homo sapiens
atgcagttacaaattataat

SEQ ID NO: 1718384 - DNA, 19 bp, Homo sapiens
atgcagttagctgaagaat

SEQ ID NO: 1718385 - DNA, 14 bp, Homo sapiens
atgcagttcctggc

SEQ ID NO: 1718386 - DNA, 15 bp, Homo sapiens
atgcagttcctggcc

SEQ ID NO: 1718387 - DNA, 15 bp, Homo sapiens
atgcagttctgagca

SEQ ID NO: 1718388 - DNA, 17 bp, Homo sapiens
atgcagtttttcagagt

SEQ ID NO: 1718389 - DNA, 22 bp, Homo sapiens
atgcagtttttcagagtggaat

SEQ ID NO: 1718390 - DNA, 14 bp, Homo sapiens
atgcataaatgcat

SEQ ID NO: 1718391 - DNA, 14 bp, Homo sapiens
atgcataatttatg

SEQ ID NO: 1718392 - DNA, 14 bp, Homo sapiens
atgcatacaagttt

SEQ ID NO: 1718393 - DNA, 17 bp, Homo sapiens
atgcatacagttttcta

SEQ ID NO: 1718394 - DNA, 18 bp, Homo sapiens
atgcatacagttttctag

SEQ ID NO: 1718395 - DNA, 21 bp, Homo sapiens
atgcataggtttagcagtata

SEQ ID NO: 1718396 - DNA, 15 bp, Homo sapiens
atgcatatatatatg

SEQ ID NO: 1718397 - DNA, 16 bp, Homo sapiens
atgcatatatatatgt

SEQ ID NO: 1718398 - DNA, 12 bp, Homo sapiens
atgcctgtattt

SEQ ID NO: 1718399 - DNA, 15 bp, Homo sapiens
atgcctgtatttcca

SEQ ID NO: 1718400 - DNA, 16 bp, Homo sapiens
atgcctgtctctagct

SEQ ID NO: 1718401 - DNA, 23 bp, Homo sapiens
atgcctgtctctgttcagatgtg

SEQ ID NO: 1718402 - DNA, 13 bp, Homo sapiens
atgcctgtgaagc

SEQ ID NO: 1718403 - DNA, 16 bp, Homo sapiens
atgcctgtgaagcagt

SEQ ID NO: 1718404 - DNA, 13 bp, Homo sapiens
atgcctgtgccaa

SEQ ID NO: 1718405 - DNA, 17 bp, Homo sapiens
atgccttaagcagaaca

SEQ ID NO: 1718406 - DNA, 20 bp, Homo sapiens
atgccttaagcagaacaaat

SEQ ID NO: 1718407 - DNA, 21 bp, Homo sapiens
atgccttaagcagaacaaatg

SEQ ID NO: 1718408 - DNA, 17 bp, Homo sapiens
atgccttctagattcac

SEQ ID NO: 1718409 - DNA, 15 bp, Homo sapiens
atgccttctatacat

SEQ ID NO: 1718410 - DNA, 18 bp, Homo sapiens
atgccttctatacattag

SEQ ID NO: 1718411 - DNA, 14 bp, Homo sapiens
atgccttcttattg

SEQ ID NO: 1718412 - DNA, 20 bp, Homo sapiens
atgccttcttattgctttta

SEQ ID NO: 1718413 - DNA, 22 bp, Homo sapiens
atgccttgcaatggatcagcca

SEQ ID NO: 1718414 - DNA, 12 bp, Homo sapiens
atgccttgtata

SEQ ID NO: 1718415 - DNA, 14 bp, Homo sapiens
atgccttgtataaa

SEQ ID NO: 1718416 - DNA, 21 bp, Homo sapiens
atgccttgtataatattgaaa

SEQ ID NO: 1718417 - DNA, 21 bp, Homo sapiens
atgcctttctagtcctattct

SEQ ID NO: 1718418 - DNA, 13 bp, Homo sapiens
atgcctttgtaag

SEQ ID NO: 1718419 - DNA, 15 bp, Homo sapiens
atgcctttgtaagtt

SEQ ID NO: 1718420 - DNA, 14 bp, Homo sapiens
atgcgaggctcgga

SEQ ID NO: 1718421 - DNA, 19 bp, Homo sapiens
atgcgaggctcggagcacc

SEQ ID NO: 1718422 - DNA, 21 bp, Homo sapiens
atgcgaggctcggagcaccct

SEQ ID NO: 1718423 - DNA, 15 bp, Homo sapiens
atgcgcagaggccag

SEQ ID NO: 1718424 - DNA, 13 bp, Homo sapiens
atgcgccccctcc

SEQ ID NO: 1718425 - DNA, 19 bp, Homo sapiens
gcattccagagttaaaatg

SEQ ID NO: 1718426 - DNA, 18 bp, Homo sapiens
gcattccagctctgcccc

SEQ ID NO: 1718427 - DNA, 22 bp, Homo sapiens
gcattccagtaacttttttgtg

SEQ ID NO: 1718428 - DNA, 16 bp, Homo sapiens
gcattcctacaaagat

SEQ ID NO: 1718429 - DNA, 22 bp, Homo sapiens
gcattcctgatatgatttaaaa

SEQ ID NO: 1718430 - DNA, 16 bp, Homo sapiens
gcattcctttgtcttc

SEQ ID NO: 1718431 - DNA, 22 bp, Homo sapiens
gcattcgttgtgttttttaaga

SEQ ID NO: 1718432 - DNA, 17 bp, Homo sapiens
gcattctctcccatcct

SEQ ID NO: 1718433 - DNA, 21 bp, Homo sapiens
gcattctctcccatcctgggg

SEQ ID NO: 1718434 - DNA, 22 bp, Homo sapiens
gcattcttgtcacaataaatgt

SEQ ID NO: 1718435 - DNA, 16 bp, Homo sapiens
gcattgagaaactgaa

SEQ ID NO: 1718436 - DNA, 21 bp, Homo sapiens
gcattgagaactgcatatgtt

SEQ ID NO: 1718437 - DNA, 22 bp, Homo sapiens
gcattgagaactgcatatgttt

SEQ ID NO: 1718438 - DNA, 15 bp, Homo sapiens
gcattgagtattgtt

SEQ ID NO: 1718439 - DNA, 17 bp, Homo sapiens
gcattgcctggactgac

SEQ ID NO: 1718440 - DNA, 14 bp, Homo sapiens
gcattgctagataa

SEQ ID NO: 1718441 - DNA, 16 bp, Homo sapiens
gcattgctagataaaa

SEQ ID NO: 1718442 - DNA, 17 bp, Homo sapiens
gcattgctagataaaag

SEQ ID NO: 1718443 - DNA, 15 bp, Homo sapiens
gcattgctcagcccg

SEQ ID NO: 1718444 - DNA, 13 bp, Homo sapiens
gcattgctgtgtg

SEQ ID NO: 1718445 - DNA, 12 bp, Homo sapiens
gcattgctttct

SEQ ID NO: 1718446 - DNA, 13 bp, Homo sapiens
gcattggaattct

SEQ ID NO: 1718447 - DNA, 20 bp, Homo sapiens
gcattggccagaccacagca

SEQ ID NO: 1718448 - DNA, 15 bp, Homo sapiens
gcattggcctctgta

SEQ ID NO: 1718449 - DNA, 16 bp, Homo sapiens
gcattggcctctgtgt

SEQ ID NO: 1718450 - DNA, 14 bp, Homo sapiens
gcattggcctggcc

SEQ ID NO: 1718451 - DNA, 16 bp, Homo sapiens
gcattgggctgacacc

SEQ ID NO: 1718452 - DNA, 17 bp, Homo sapiens
gcattgtctttgctgta

SEQ ID NO: 1718453 - DNA, 17 bp, Homo sapiens
gcattgtgattggcctg

SEQ ID NO: 1718454 - DNA, 18 bp, Homo sapiens
gcatttaaaacagacact

SEQ ID NO: 1718455 - DNA, 12 bp, Homo sapiens
gcatttaaaata

SEQ ID NO: 1718456 - DNA, 19 bp, Homo sapiens
gcatttaataaagatgagt

SEQ ID NO: 1718457 - DNA, 18 bp, Homo sapiens
gcatttaatggcagctag

SEQ ID NO: 1718458 - DNA, 21 bp, Homo sapiens
gcatttagtgaagttgtgcaa

SEQ ID NO: 1718459 - DNA, 16 bp, Homo sapiens
gcatttcaaagccctg

SEQ ID NO: 1718460 - DNA, 16 bp, Homo sapiens
gcatttcaaggaacag

SEQ ID NO: 1718461 - DNA, 17 bp, Homo sapiens
gcatttcaattcctggc

SEQ ID NO: 1718462 - DNA, 19 bp, Homo sapiens
gcatttcacatgccttgca

SEQ ID NO: 1718463 - DNA, 22 bp, Homo sapiens
gcatttcatgaaaaagctgctt

SEQ ID NO: 1718464 - DNA, 14 bp, Homo sapiens
gcatttcattcaaa

SEQ ID NO: 1718465 - DNA, 13 bp, Homo sapiens
gcatttccaaaca

SEQ ID NO: 1718466 - DNA, 22 bp, Homo sapiens
gcatttccaacaccacagacac

SEQ ID NO: 1718467 - DNA, 23 bp, Homo sapiens
gcatttccaacaccacagacaca

SEQ ID NO: 1718468 - DNA, 13 bp, Homo sapiens
gcatttcctgctg

SEQ ID NO: 1718469 - DNA, 14 bp, Homo sapiens
gcatttcctgctga

SEQ ID NO: 1718470 - DNA, 18 bp, Homo sapiens
gcatttcctgctggtcaa

SEQ ID NO: 1718471 - DNA, 21 bp, Homo sapiens
gcatttcgggaagggcatgca

SEQ ID NO: 1718472 - DNA, 14 bp, Homo sapiens
gcatttctctttaa

SEQ ID NO: 1718473 - DNA, 16 bp, Homo sapiens
gcatttctctttaaac

SEQ ID NO: 1718474 - DNA, 16 bp, Homo sapiens
gcatttgagaaatgca

SEQ ID NO: 1718475 - DNA, 13 bp, Homo sapiens
gcatttgattttt

SEQ ID NO: 1718476 - DNA, 16 bp, Homo sapiens
gcatttggctgctgta

SEQ ID NO: 1718477 - DNA, 19 bp, Homo sapiens
gcatttggtctcaggcagc

SEQ ID NO: 1718478 - DNA, 21 bp, Homo sapiens
gcatttggtgagagtcaaagc

SEQ ID NO: 1718479 - DNA, 18 bp, Homo sapiens
gcatttgttttagcatta

SEQ ID NO: 1718480 - DNA, 14 bp, Homo sapiens
gcattttcccagat

SEQ ID NO: 1718481 - DNA, 13 bp, Homo sapiens
gcattttgaaaca

SEQ ID NO: 1718482 - DNA, 18 bp, Homo sapiens
gcattttgtttctgtata

SEQ ID NO: 1718483 - DNA, 19 bp, Homo sapiens
gcattttgtttctgtatat

SEQ ID NO: 1718484 - DNA, 14 bp, Homo sapiens
gcatttttaaactt

SEQ ID NO: 1718485 - DNA, 18 bp, Homo sapiens
gcatttttaaacttgaaa

SEQ ID NO: 1718486 - DNA, 21 bp, Homo sapiens
gcatttttcaatatattgaac

SEQ ID NO: 1718487 - DNA, 18 bp, Homo sapiens
gcatttttgtgaaatgaa

SEQ ID NO: 1718488 - DNA, 21 bp, Homo sapiens
gccaaaaactaaaattcaaca

SEQ ID NO: 1718489 - DNA, 13 bp, Homo sapiens
gccaaaaaggacc

SEQ ID NO: 1718490 - DNA, 23 bp, Homo sapiens
gccaaaatggtacagcttctgga

SEQ ID NO: 1718491 - DNA, 15 bp, Homo sapiens
gccaaacagccacac

SEQ ID NO: 1718492 - DNA, 19 bp, Homo sapiens
gccaaacccttgctttcct

SEQ ID NO: 1718493 - DNA, 15 bp, Homo sapiens
gccaaactcaggccc

SEQ ID NO: 1718494 - DNA, 16 bp, Homo sapiens
gccaaactcaggccca

SEQ ID NO: 1718495 - DNA, 17 bp, Homo sapiens
gccaaactctgccagcc

SEQ ID NO: 1718496 - DNA, 18 bp, Homo sapiens
gccaaactctgccagcca

SEQ ID NO: 1718497 - DNA, 19 bp, Homo sapiens
gccaaagagcctcccacca

SEQ ID NO: 1718498 - DNA, 22 bp, Homo sapiens
gccaaagagcctttccaaagag

SEQ ID NO: 1718499 - DNA, 14 bp, Homo sapiens
gccaaagcacagct

SEQ ID NO: 1718500 - DNA, 18 bp, Homo sapiens
gccaaagcacagctgggc

SEQ ID NO: 1718501 - DNA, 16 bp, Homo sapiens
gccaaagctagggtgg

SEQ ID NO: 1718502 - DNA, 18 bp, Homo sapiens
gccaaaggtcaaacaggc

SEQ ID NO: 1718503 - DNA, 15 bp, Homo sapiens
gccaaagtacagaat

SEQ ID NO: 1718504 - DNA, 18 bp, Homo sapiens
gccaaagttttcaaactg

SEQ ID NO: 1718505 - DNA, 15 bp, Homo sapiens
gccaaatagcaaaga

SEQ ID NO: 1718506 - DNA, 21 bp, Homo sapiens
gccaaatagccccagactggg

SEQ ID NO: 1718507 - DNA, 22 bp, Homo sapiens
gccaaatgaccgagccctggag

SEQ ID NO: 1718508 - DNA, 14 bp, Homo sapiens
gccaaatgcacaag

SEQ ID NO: 1718509 - DNA, 16 bp, Homo sapiens
gccaaatgtaattgaa

SEQ ID NO: 1718510 - DNA, 18 bp, Homo sapiens
gccaaatgttcatcctca

SEQ ID NO: 1718511 - DNA, 22 bp, Homo sapiens
gccaacaaaccctctgtagcta

SEQ ID NO: 1718512 - DNA, 16 bp, Homo sapiens
gccaacaactctgcct

SEQ ID NO: 1718513 - DNA, 17 bp, Homo sapiens
gccaccacgtctgccag

SEQ ID NO: 1718514 - DNA, 12 bp, Homo sapiens
gccaccaggcca

SEQ ID NO: 1718515 - DNA, 18 bp, Homo sapiens
gccaccaggccacctccc

SEQ ID NO: 1718516 - DNA, 16 bp, Homo sapiens
gccaccatccccaccc

SEQ ID NO: 1718517 - DNA, 12 bp, Homo sapiens
gccaccatcctg

SEQ ID NO: 1718518 - DNA, 17 bp, Homo sapiens
gccaccatcctgcagcc

SEQ ID NO: 1718519 - DNA, 22 bp, Homo sapiens
gccaccatgcctcactaatttt

SEQ ID NO: 1718520 - DNA, 16 bp, Homo sapiens
gccacccaagcctgct

SEQ ID NO: 1718521 - DNA, 19 bp, Homo sapiens
gccacccatcgtccacccc

SEQ ID NO: 1718522 - DNA, 17 bp, Homo sapiens
gccacccccagttccta

SEQ ID NO: 1718523 - DNA, 14 bp, Homo sapiens
gccacccccttccc

SEQ ID NO: 1718524 - DNA, 18 bp, Homo sapiens
gccaccccgggctctctg

SEQ ID NO: 1718525 - DNA, 15 bp, Homo sapiens
gccaccccgtgccac

SEQ ID NO: 1718526 - DNA, 13 bp, Homo sapiens
gccaccccttcct

SEQ ID NO: 1718527 - DNA, 21 bp, Homo sapiens
gccacccgtaggcagcctctc

SEQ ID NO: 1718528 - DNA, 22 bp, Homo sapiens
gccacccgtaggcagcctctct

SEQ ID NO: 1718529 - DNA, 18 bp, Homo sapiens
gccacccgttctgctggc

SEQ ID NO: 1718530 - DNA, 22 bp, Homo sapiens
gccacccgttctgctggcctgg

SEQ ID NO: 1718531 - DNA, 18 bp, Homo sapiens
gccaccctccttcccgcc

SEQ ID NO: 1718532 - DNA, 14 bp, Homo sapiens
gccaccctgcccct

SEQ ID NO: 1718533 - DNA, 23 bp, Homo sapiens
gccaccctggcccgcccctcgct

SEQ ID NO: 1718534 - DNA, 21 bp, Homo sapiens
gccaccgcaggggactgtctc

SEQ ID NO: 1718535 - DNA, 17 bp, Homo sapiens
gccaccgcgcccagcct

SEQ ID NO: 1718536 - DNA, 15 bp, Homo sapiens
gccaccgctgccagc

SEQ ID NO: 1718537 - DNA, 21 bp, Homo sapiens
gccaccggcctgtgggtctct

SEQ ID NO: 1718538 - DNA, 17 bp, Homo sapiens
gccaccgggacagacct

SEQ ID NO: 1718539 - DNA, 19 bp, Homo sapiens
gccaccgggacagacctgg

SEQ ID NO: 1718540 - DNA, 22 bp, Homo sapiens
gccaccgggacagacctggaca

SEQ ID NO: 1718541 - DNA, 23 bp, Homo sapiens
gccaccgggacagacctggacac

SEQ ID NO: 1718542 - DNA, 19 bp, Homo sapiens
gccacctagaagtctccct

SEQ ID NO: 1718543 - DNA, 13 bp, Homo sapiens
gccacctcagggc

SEQ ID NO: 1718544 - DNA, 14 bp, Homo sapiens
gccacctcagggca

SEQ ID NO: 1718545 - DNA, 15 bp, Homo sapiens
gccacctcagggcac

SEQ ID NO: 1718546 - DNA, 15 bp, Homo sapiens
gccacctcccacccc

SEQ ID NO: 1718547 - DNA, 23 bp, Homo sapiens
gccacctcccaccccactccagc

SEQ ID NO: 1718548 - DNA, 22 bp, Homo sapiens
atgcgccccctccgccctgcca

SEQ ID NO: 1718549 - DNA, 17 bp, Homo sapiens
atgcggaggaaagcaag

SEQ ID NO: 1718550 - DNA, 23 bp, Homo sapiens
atgcggcccactttcctgagctg

SEQ ID NO: 1718551 - DNA, 19 bp, Homo sapiens
atgcggttaattttgaagt

SEQ ID NO: 1718552 - DNA, 13 bp, Homo sapiens
atgcgtatatgtg

SEQ ID NO: 1718553 - DNA, 22 bp, Homo sapiens
atgcgtgagatgggtgtacaaa

SEQ ID NO: 1718554 - DNA, 18 bp, Homo sapiens
atgcgtgccgcctgctcc

SEQ ID NO: 1718555 - DNA, 14 bp, Homo sapiens
atgctaaaccttag

SEQ ID NO: 1718556 - DNA, 13 bp, Homo sapiens
atgctaagaaatg

SEQ ID NO: 1718557 - DNA, 16 bp, Homo sapiens
atgctaattcaatgcc

SEQ ID NO: 1718558 - DNA, 16 bp, Homo sapiens
atgctacattaatgtt

SEQ ID NO: 1718559 - DNA, 22 bp, Homo sapiens
atgctatgagaccattcagaat

SEQ ID NO: 1718560 - DNA, 16 bp, Homo sapiens
atgctatgagttttct

SEQ ID NO: 1718561 - DNA, 22 bp, Homo sapiens
atgctatggaacataaagttgt

SEQ ID NO: 1718562 - DNA, 14 bp, Homo sapiens
atgctatttatgca

SEQ ID NO: 1718563 - DNA, 16 bp, Homo sapiens
atgctcaaccactgtg

SEQ ID NO: 1718564 - DNA, 15 bp, Homo sapiens
atgctcagccttgct

SEQ ID NO: 1718565 - DNA, 18 bp, Homo sapiens
atgctcagggtcactgaa

SEQ ID NO: 1718566 - DNA, 13 bp, Homo sapiens
atgctcatctgct

SEQ ID NO: 1718567 - DNA, 14 bp, Homo sapiens
atgctcatctgctg

SEQ ID NO: 1718568 - DNA, 15 bp, Homo sapiens
atgctccaagattct

SEQ ID NO: 1718569 - DNA, 19 bp, Homo sapiens
atgctccaagattctagat

SEQ ID NO: 1718570 - DNA, 20 bp, Homo sapiens
atgctccaagattctagatg

SEQ ID NO: 1718571 - DNA, 21 bp, Homo sapiens
atgctccagcaacacagcctg

SEQ ID NO: 1718572 - DNA, 14 bp, Homo sapiens
atgctccaggatct

SEQ ID NO: 1718573 - DNA, 11 bp, Homo sapiens
atgctccaggg

SEQ ID NO: 1718574 - DNA, 18 bp, Homo sapiens
atgctccagggcagcctc

SEQ ID NO: 1718575 - DNA, 17 bp, Homo sapiens
atgctcccatctcctga

SEQ ID NO: 1718576 - DNA, 22 bp, Homo sapiens
atgctccccacagcgtccctgg

SEQ ID NO: 1718577 - DNA, 18 bp, Homo sapiens
atgctccctcccctgccc

SEQ ID NO: 1718578 - DNA, 21 bp, Homo sapiens
atgctccctcctctcctaccc

SEQ ID NO: 1718579 - DNA, 19 bp, Homo sapiens
atgctccgacagcgtctcc

SEQ ID NO: 1718580 - DNA, 13 bp, Homo sapiens
atgctcctcacct

SEQ ID NO: 1718581 - DNA, 14 bp, Homo sapiens
atgctcctctcttt

SEQ ID NO: 1718582 - DNA, 18 bp, Homo sapiens
atgctccttgagaggaga

SEQ ID NO: 1718583 - DNA, 13 bp, Homo sapiens
atgctcggctttt

SEQ ID NO: 1718584 - DNA, 23 bp, Homo sapiens
atgctctctgcagccagcccagc

SEQ ID NO: 1718585 - DNA, 18 bp, Homo sapiens
atgctctgcatgttacat

SEQ ID NO: 1718586 - DNA, 19 bp, Homo sapiens
atgctctgcatgttacata

SEQ ID NO: 1718587 - DNA, 21 bp, Homo sapiens
atgctctgccccaagccccca

SEQ ID NO: 1718588 - DNA, 13 bp, Homo sapiens
atgctcttctgtg

SEQ ID NO: 1718589 - DNA, 16 bp, Homo sapiens
atgctctttacttcat

SEQ ID NO: 1718590 - DNA, 13 bp, Homo sapiens
atgctctttccca

SEQ ID NO: 1718591 - DNA, 12 bp, Homo sapiens
atgctgaaacaa

SEQ ID NO: 1718592 - DNA, 14 bp, Homo sapiens
atgctgaacgcaga

SEQ ID NO: 1718593 - DNA, 23 bp, Homo sapiens
atgctgaatatacagcaggtgct

SEQ ID NO: 1718594 - DNA, 19 bp, Homo sapiens
atgctgacctcacctggtc

SEQ ID NO: 1718595 - DNA, 22 bp, Homo sapiens
atgctgacctcacctggtcctc

SEQ ID NO: 1718596 - DNA, 19 bp, Homo sapiens
atgctgaggccacccactg

SEQ ID NO: 1718597 - DNA, 13 bp, Homo sapiens
atgctgagggtgt

SEQ ID NO: 1718598 - DNA, 22 bp, Homo sapiens
atgctgagtatgttaagctctt

SEQ ID NO: 1718599 - DNA, 17 bp, Homo sapiens
atgctgatcttttaaaa

SEQ ID NO: 1718600 - DNA, 22 bp, Homo sapiens
atgctgatgatcaaaacctgtg

SEQ ID NO: 1718601 - DNA, 17 bp, Homo sapiens
atgctgcaaaggagaag

SEQ ID NO: 1718602 - DNA, 23 bp, Homo sapiens
atgctgcattttaattttaacca

SEQ ID NO: 1718603 - DNA, 12 bp, Homo sapiens
atgctgccagtg

SEQ ID NO: 1718604 - DNA, 13 bp, Homo sapiens
atgctgccagtgt

SEQ ID NO: 1718605 - DNA, 17 bp, Homo sapiens
atgctgcctgcctgtct

SEQ ID NO: 1718606 - DNA, 19 bp, Homo sapiens
atgctgctaattcaaagct

SEQ ID NO: 1718607 - DNA, 22 bp, Homo sapiens
atgctgctctcagcctcccaca

SEQ ID NO: 1718608 - DNA, 13 bp, Homo sapiens
atgctgctggcca

SEQ ID NO: 1718609 - DNA, 16 bp, Homo sapiens
atgctgctggggaaga

SEQ ID NO: 1718610 - DNA, 18 bp, Homo sapiens
atgctgctggggaagaca

SEQ ID NO: 1718611 - DNA, 21 bp, Homo sapiens
atgctgctggggaagacagtg

SEQ ID NO: 1718612 - DNA, 12 bp, Homo sapiens
atgctgcttcca

SEQ ID NO: 1718613 - DNA, 21 bp, Homo sapiens
atgctggaaataaaacagctg

SEQ ID NO: 1718614 - DNA, 22 bp, Homo sapiens
atgctggacggcattcctgctt

SEQ ID NO: 1718615 - DNA, 16 bp, Homo sapiens
atgctggactggaggc

SEQ ID NO: 1718616 - DNA, 16 bp, Homo sapiens
atgctggaggccctcg

SEQ ID NO: 1718617 - DNA, 15 bp, Homo sapiens
atgctggagggaggc

SEQ ID NO: 1718618 - DNA, 11 bp, Homo sapiens
atgctgggttg

SEQ ID NO: 1718619 - DNA, 21 bp, Homo sapiens
atgctggtagatgctgaggcc

SEQ ID NO: 1718620 - DNA, 21 bp, Homo sapiens
atgctggttttcctaaatgca

SEQ ID NO: 1718621 - DNA, 12 bp, Homo sapiens
atgctgtaaata

SEQ ID NO: 1718622 - DNA, 18 bp, Homo sapiens
atgctgtattttaacact

SEQ ID NO: 1718623 - DNA, 20 bp, Homo sapiens
atgctgtcaactatgatatg

SEQ ID NO: 1718624 - DNA, 22 bp, Homo sapiens
atgctgtcaactatgatatggt

SEQ ID NO: 1718625 - DNA, 16 bp, Homo sapiens
atgctgtctggccctg

SEQ ID NO: 1718626 - DNA, 23 bp, Homo sapiens
atgctgtgacacatggcccctcc

SEQ ID NO: 1718627 - DNA, 21 bp, Homo sapiens
atgctgtgagtctttggttct

SEQ ID NO: 1718628 - DNA, 18 bp, Homo sapiens
atgctgtgcgcccagggc

SEQ ID NO: 1718629 - DNA, 18 bp, Homo sapiens
atgctgtgctatgaattt

SEQ ID NO: 1718630 - DNA, 18 bp, Homo sapiens
atgctgtgctctttgaag

SEQ ID NO: 1718631 - DNA, 21 bp, Homo sapiens
atgctgtggcatgggtgaaga

SEQ ID NO: 1718632 - DNA, 15 bp, Homo sapiens
atgctgttgcctcat

SEQ ID NO: 1718633 - DNA, 14 bp, Homo sapiens
atgctgtttctaag

SEQ ID NO: 1718634 - DNA, 15 bp, Homo sapiens
atgctgtttctaaga

SEQ ID NO: 1718635 - DNA, 20 bp, Homo sapiens
atgctgtttctaagaaaatg

SEQ ID NO: 1718636 - DNA, 22 bp, Homo sapiens
atgctgtttctaagaaaatgta

SEQ ID NO: 1718637 - DNA, 13 bp, Homo sapiens
atgcttaaatttt

SEQ ID NO: 1718638 - DNA, 14 bp, Homo sapiens
atgcttaaatttta

SEQ ID NO: 1718639 - DNA, 23 bp, Homo sapiens
atgcttacgtgatcctctcacct

SEQ ID NO: 1718640 - DNA, 15 bp, Homo sapiens
atgcttactcttgct

SEQ ID NO: 1718641 - DNA, 13 bp, Homo sapiens
atgcttactgata

SEQ ID NO: 1718642 - DNA, 22 bp, Homo sapiens
atgcttactgatatattttaca

SEQ ID NO: 1718643 - DNA, 23 bp, Homo sapiens
atgcttactgatatattttacaa

SEQ ID NO: 1718644 - DNA, 19 bp, Homo sapiens
atgcttcaagtgttgctct

SEQ ID NO: 1718645 - DNA, 19 bp, Homo sapiens
atgcttcatcattccctct

SEQ ID NO: 1718646 - DNA, 13 bp, Homo sapiens
atgcttcattatt

SEQ ID NO: 1718647 - DNA, 14 bp, Homo sapiens
atgcttcattgaaa

SEQ ID NO: 1718648 - DNA, 16 bp, Homo sapiens
atgcttcatttgtatg

SEQ ID NO: 1718649 - DNA, 17 bp, Homo sapiens
atgcttcctagaagtta

SEQ ID NO: 1718650 - DNA, 21 bp, Homo sapiens
atgcttcctagaagttactga

SEQ ID NO: 1718651 - DNA, 16 bp, Homo sapiens
atgcttcctgacaatc

SEQ ID NO: 1718652 - DNA, 17 bp, Homo sapiens
atgcttcctttctctcc

SEQ ID NO: 1718653 - DNA, 22 bp, Homo sapiens
atgcttcctttctctcctggct

SEQ ID NO: 1718654 - DNA, 16 bp, Homo sapiens
atgcttctagagtttt

SEQ ID NO: 1718655 - DNA, 20 bp, Homo sapiens
atgcttctataattttgcct

SEQ ID NO: 1718656 - DNA, 18 bp, Homo sapiens
atgcttgcataagagctt

SEQ ID NO: 1718657 - DNA, 18 bp, Homo sapiens
atgcttgcggcaaaagga

SEQ ID NO: 1718658 - DNA, 23 bp, Homo sapiens
atgcttgcggcaaaaggaaagct

SEQ ID NO: 1718659 - DNA, 18 bp, Homo sapiens
atgcttgggccctgcatt

SEQ ID NO: 1718660 - DNA, 18 bp, Homo sapiens
atgcttgtaacaagaaaa

SEQ ID NO: 1718661 - DNA, 22 bp, Homo sapiens
atgcttgtaatttaaacatttg

SEQ ID NO: 1718662 - DNA, 12 bp, Homo sapiens
atgcttgtttat

SEQ ID NO: 1718663 - DNA, 17 bp, Homo sapiens
atgcttgtttatgatat

SEQ ID NO: 1718664 - DNA, 17 bp, Homo sapiens
gccacctcccactcctg

SEQ ID NO: 1718665 - DNA, 20 bp, Homo sapiens
gccacctcccctatccaccc

SEQ ID NO: 1718666 - DNA, 14 bp, Homo sapiens
gccacctcctcccc

SEQ ID NO: 1718667 - DNA, 15 bp, Homo sapiens
gccacctcctccccc

SEQ ID NO: 1718668 - DNA, 12 bp, Homo sapiens
gccacctctcca

SEQ ID NO: 1718669 - DNA, 23 bp, Homo sapiens
gccacctgaggtgggcccaggac

SEQ ID NO: 1718670 - DNA, 10 bp, Homo sapiens
gccacctgca

SEQ ID NO: 1718671 - DNA, 11 bp, Homo sapiens
gccacctgcaa

SEQ ID NO: 1718672 - DNA, 12 bp, Homo sapiens
gccacctgcaag

SEQ ID NO: 1718673 - DNA, 14 bp, Homo sapiens
gccaccttcccacc

SEQ ID NO: 1718674 - DNA, 20 bp, Homo sapiens
gccaccttcccaccccttca

SEQ ID NO: 1718675 - DNA, 16 bp, Homo sapiens
gccacctttcaccctc

SEQ ID NO: 1718676 - DNA, 23 bp, Homo sapiens
gccacctttcaccctcatgaaaa

SEQ ID NO: 1718677 - DNA, 15 bp, Homo sapiens
gccacgcactgggcc

SEQ ID NO: 1718678 - DNA, 16 bp, Homo sapiens
gccacgcactgggcca

SEQ ID NO: 1718679 - DNA, 17 bp, Homo sapiens
gccacgcactgggccac

SEQ ID NO: 1718680 - DNA, 15 bp, Homo sapiens
gccacgcagccagga

SEQ ID NO: 1718681 - DNA, 18 bp, Homo sapiens
gccacgcagccaggacac

SEQ ID NO: 1718682 - DNA, 13 bp, Homo sapiens
gccacgcagggcc

SEQ ID NO: 1718683 - DNA, 23 bp, Homo sapiens
gccacgcagggccatccactgtg

SEQ ID NO: 1718684 - DNA, 13 bp, Homo sapiens
gccacgctccagc

SEQ ID NO: 1718685 - DNA, 16 bp, Homo sapiens
gccacggacgctggct

SEQ ID NO: 1718686 - DNA, 18 bp, Homo sapiens
gccacggacgctggctcc

SEQ ID NO: 1718687 - DNA, 22 bp, Homo sapiens
gccacggaggagggatgctgct

SEQ ID NO: 1718688 - DNA, 15 bp, Homo sapiens
gccacggccaccctc

SEQ ID NO: 1718689 - DNA, 13 bp, Homo sapiens
gccacggcctggc

SEQ ID NO: 1718690 - DNA, 14 bp, Homo sapiens
gccacggcctggct

SEQ ID NO: 1718691 - DNA, 15 bp, Homo sapiens
gccacggcctggctg

SEQ ID NO: 1718692 - DNA, 21 bp, Homo sapiens
gccacgttccttactgcagaa

SEQ ID NO: 1718693 - DNA, 17 bp, Homo sapiens
gccactaaagcttcaga

SEQ ID NO: 1718694 - DNA, 18 bp, Homo sapiens
gccactaaagcttcagac

SEQ ID NO: 1718695 - DNA, 23 bp, Homo sapiens
gccactacactccagcctgagca

SEQ ID NO: 1718696 - DNA, 17 bp, Homo sapiens
gccactaggtgtcccca

SEQ ID NO: 1718697 - DNA, 18 bp, Homo sapiens
gccactcactaggccccc

SEQ ID NO: 1718698 - DNA, 20 bp, Homo sapiens
gccactccagacccctggct

SEQ ID NO: 1718699 - DNA, 22 bp, Homo sapiens
gccactcccggcactccatgct

SEQ ID NO: 1718700 - DNA, 14 bp, Homo sapiens
gccactccctgagc

SEQ ID NO: 1718701 - DNA, 20 bp, Homo sapiens
gccactccctgagctttggg

SEQ ID NO: 1718702 - DNA, 12 bp, Homo sapiens
gccactcctccc

SEQ ID NO: 1718703 - DNA, 13 bp, Homo sapiens
gccactcctgtcc

SEQ ID NO: 1718704 - DNA, 18 bp, Homo sapiens
gccactcgcagtcgcagg

SEQ ID NO: 1718705 - DNA, 21 bp, Homo sapiens
gccactctatgagttggactt

SEQ ID NO: 1718706 - DNA, 19 bp, Homo sapiens
gccactctgcctctgcctg

SEQ ID NO: 1718707 - DNA, 15 bp, Homo sapiens
gccactgaagctggg

SEQ ID NO: 1718708 - DNA, 18 bp, Homo sapiens
gccactgacttgctgtgt

SEQ ID NO: 1718709 - DNA, 14 bp, Homo sapiens
gccactgagcctgg

SEQ ID NO: 1718710 - DNA, 16 bp, Homo sapiens
gccactgagcctggcc

SEQ ID NO: 1718711 - DNA, 16 bp, Homo sapiens
gccactgaggagacag

SEQ ID NO: 1718712 - DNA, 17 bp, Homo sapiens
gccactgaggagacaga

SEQ ID NO: 1718713 - DNA, 18 bp, Homo sapiens
gccactgcactccagcct

SEQ ID NO: 1718714 - DNA, 14 bp, Homo sapiens
gccactgccaggca

SEQ ID NO: 1718715 - DNA, 15 bp, Homo sapiens
gccactgccaggcac

SEQ ID NO: 1718716 - DNA, 17 bp, Homo sapiens
gccactgccaggcacct

SEQ ID NO: 1718717 - DNA, 20 bp, Homo sapiens
gccactgccaggcacctggc

SEQ ID NO: 1718718 - DNA, 23 bp, Homo sapiens
gccactgccaggcacctggcctg

SEQ ID NO: 1718719 - DNA, 24 bp, Homo sapiens
gccactgccaggcacctggcctgc

SEQ ID NO: 1718720 - DNA, 22 bp, Homo sapiens
gccactgccttcgcttcttgcc

SEQ ID NO: 1718721 - DNA, 12 bp, Homo sapiens
gccactggaagg

SEQ ID NO: 1718722 - DNA, 17 bp, Homo sapiens
gccactgggacagctgg

SEQ ID NO: 1718723 - DNA, 22 bp, Homo sapiens
gccactgggcacctgcgcacag

SEQ ID NO: 1718724 - DNA, 18 bp, Homo sapiens
gccactggggactttatt

SEQ ID NO: 1718725 - DNA, 23 bp, Homo sapiens
gccactggggactttatttattt

SEQ ID NO: 1718726 - DNA, 18 bp, Homo sapiens
gccactgggtctcactcc

SEQ ID NO: 1718727 - DNA, 12 bp, Homo sapiens
gccactgtggcc

SEQ ID NO: 1718728 - DNA, 13 bp, Homo sapiens
gccactgtggcca

SEQ ID NO: 1718729 - DNA, 16 bp, Homo sapiens
gccactgtggccagag

SEQ ID NO: 1718730 - DNA, 16 bp, Homo sapiens
gccactgtggtggcag

SEQ ID NO: 1718731 - DNA, 21 bp, Homo sapiens
gccactgttttgaatctcata

SEQ ID NO: 1718732 - DNA, 19 bp, Homo sapiens
gccacttcaacccccagct

SEQ ID NO: 1718733 - DNA, 13 bp, Homo sapiens
gccacttctaaga

SEQ ID NO: 1718734 - DNA, 18 bp, Homo sapiens
gccacttctcactcacca

SEQ ID NO: 1718735 - DNA, 15 bp, Homo sapiens
gccacttctggcttc

SEQ ID NO: 1718736 - DNA, 19 bp, Homo sapiens
gccacttcttaaaggcctg

SEQ ID NO: 1718737 - DNA, 21 bp, Homo sapiens
gccacttcttaaaggcctgga

SEQ ID NO: 1718738 - DNA, 16 bp, Homo sapiens
gccacttgacattcct

SEQ ID NO: 1718739 - DNA, 16 bp, Homo sapiens
gccacttggtttttgg

SEQ ID NO: 1718740 - DNA, 18 bp, Homo sapiens
gccactttacccacctag

SEQ ID NO: 1718741 - DNA, 22 bp, Homo sapiens
gccactttacccacctagaaca

SEQ ID NO: 1718742 - DNA, 14 bp, Homo sapiens
gctctccctctggc

SEQ ID NO: 1718743 - DNA, 21 bp, Homo sapiens
gctctccctctggccctgcct

SEQ ID NO: 1718744 - DNA, 12 bp, Homo sapiens
gctctccctgtc

SEQ ID NO: 1718745 - DNA, 14 bp, Homo sapiens
gctctccctgtcac

SEQ ID NO: 1718746 - DNA, 17 bp, Homo sapiens
gctctcctccacctcaa

SEQ ID NO: 1718747 - DNA, 20 bp, Homo sapiens
gctctcctcccgccccgccc

SEQ ID NO: 1718748 - DNA, 12 bp, Homo sapiens
gctctccttcct

SEQ ID NO: 1718749 - DNA, 22 bp, Homo sapiens
gctctccttcctggagcccaga

SEQ ID NO: 1718750 - DNA, 16 bp, Homo sapiens
gctctcgctctctctc

SEQ ID NO: 1718751 - DNA, 18 bp, Homo sapiens
gctctctaggcctctcca

SEQ ID NO: 1718752 - DNA, 19 bp, Homo sapiens
gctctctaggcctctccag

SEQ ID NO: 1718753 - DNA, 18 bp, Homo sapiens
gctctctgcagccagccc

SEQ ID NO: 1718754 - DNA, 14 bp, Homo sapiens
gctctctgccctgt

SEQ ID NO: 1718755 - DNA, 18 bp, Homo sapiens
gctctctgccctgtgtac

SEQ ID NO: 1718756 - DNA, 11 bp, Homo sapiens
gctctctgctg

SEQ ID NO: 1718757 - DNA, 13 bp, Homo sapiens
gctctctgctgta

SEQ ID NO: 1718758 - DNA, 13 bp, Homo sapiens
gctctctgggcct

SEQ ID NO: 1718759 - DNA, 15 bp, Homo sapiens
gctctctgtgaccct

SEQ ID NO: 1718760 - DNA, 16 bp, Homo sapiens
gctctcttcaggaggc

SEQ ID NO: 1718761 - DNA, 13 bp, Homo sapiens
gctctcttcctgt

SEQ ID NO: 1718762 - DNA, 23 bp, Homo sapiens
gctctcttgtgacgtgcactgtg

SEQ ID NO: 1718763 - DNA, 15 bp, Homo sapiens
gctctctttctgtct

SEQ ID NO: 1718764 - DNA, 17 bp, Homo sapiens
gctctgaaatctccttt

SEQ ID NO: 1718765 - DNA, 19 bp, Homo sapiens
gctctgaatgggagccaga

SEQ ID NO: 1718766 - DNA, 16 bp, Homo sapiens
gctctgacaagatggt

SEQ ID NO: 1718767 - DNA, 18 bp, Homo sapiens
gctctgacatcccttcct

SEQ ID NO: 1718768 - DNA, 19 bp, Homo sapiens
gctctgacccaagtggggc

SEQ ID NO: 1718769 - DNA, 23 bp, Homo sapiens
gctctgacccaagtggggcctcc

SEQ ID NO: 1718770 - DNA, 16 bp, Homo sapiens
gctctgacgtagaaag

SEQ ID NO: 1718771 - DNA, 22 bp, Homo sapiens
gctctgacgtagaaagatcctt

SEQ ID NO: 1718772 - DNA, 9 bp, Homo sapiens
gctctgaga

SEQ ID NO: 1718773 - DNA, 23 bp, Homo sapiens
gctctgagacccttttctcagga

SEQ ID NO: 1718774 - DNA, 18 bp, Homo sapiens
gctctgagagtctagatt

SEQ ID NO: 1718775 - DNA, 14 bp, Homo sapiens
gctctgagcgcctc

SEQ ID NO: 1718776 - DNA, 15 bp, Homo sapiens
gctctgaggcctcac

SEQ ID NO: 1718777 - DNA, 22 bp, Homo sapiens
gctctgaggggaggcacctcca

SEQ ID NO: 1718778 - DNA, 21 bp, Homo sapiens
gctctgatattccatgaatgt

SEQ ID NO: 1718779 - DNA, 21 bp, Homo sapiens
gctctgatctaacaaaataag

SEQ ID NO: 1718780 - DNA, 17 bp, Homo sapiens
gctctgcaattcccctc

SEQ ID NO: 1718781 - DNA, 18 bp, Homo sapiens
gctctgcaattcccctct

SEQ ID NO: 1718782 - DNA, 23 bp, Homo sapiens
gctctgcaattcccctctgctgc

SEQ ID NO: 1718783 - DNA, 12 bp, Homo sapiens
gctctgcacaga

SEQ ID NO: 1718784 - DNA, 13 bp, Homo sapiens
gctctgcacagac

SEQ ID NO: 1718785 - DNA, 15 bp, Homo sapiens
gctctgccccaagcc

SEQ ID NO: 1718786 - DNA, 16 bp, Homo sapiens
gctctgccccaggccc

SEQ ID NO: 1718787 - DNA, 22 bp, Homo sapiens
gctctgccccaggccctactac

SEQ ID NO: 1718788 - DNA, 14 bp, Homo sapiens
gctctgccccttgg

SEQ ID NO: 1718789 - DNA, 13 bp, Homo sapiens
gctctgccctgcc

SEQ ID NO: 1718790 - DNA, 15 bp, Homo sapiens
gctctgccctgccct

SEQ ID NO: 1718791 - DNA, 23 bp, Homo sapiens
gctctgcctccctctccatatct

SEQ ID NO: 1718792 - DNA, 11 bp, Homo sapiens
gctctgcctgg

SEQ ID NO: 1718793 - DNA, 14 bp, Homo sapiens
gctctgccttctca

SEQ ID NO: 1718794 - DNA, 16 bp, Homo sapiens
gctctgcctttgctct

SEQ ID NO: 1718795 - DNA, 12 bp, Homo sapiens
gctctgcgccag

SEQ ID NO: 1718796 - DNA, 13 bp, Homo sapiens
gctctgcgccagg

SEQ ID NO: 1718797 - DNA, 16 bp, Homo sapiens
gctctgcgccaggcag

SEQ ID NO: 1718798 - DNA, 14 bp, Homo sapiens
gctctgcttgacaa

SEQ ID NO: 1718799 - DNA, 20 bp, Homo sapiens
gctctggaataaagttgcag

SEQ ID NO: 1718800 - DNA, 22 bp, Homo sapiens
gctctggaataaagttgcagat

SEQ ID NO: 1718801 - DNA, 14 bp, Homo sapiens
gctctggacgtgaa

SEQ ID NO: 1718802 - DNA, 13 bp, Homo sapiens
gctctggagaaca

SEQ ID NO: 1718803 - DNA, 15 bp, Homo sapiens
gctctggagaacagt

SEQ ID NO: 1718804 - DNA, 12 bp, Homo sapiens
gctctggagcag

SEQ ID NO: 1718805 - DNA, 16 bp, Homo sapiens
gctctggagcagccaa

SEQ ID NO: 1718806 - DNA, 17 bp, Homo sapiens
gctctggaggaagttct

SEQ ID NO: 1718807 - DNA, 22 bp, Homo sapiens
gctctggaggaagttctccagc

SEQ ID NO: 1718808 - DNA, 13 bp, Homo sapiens
gctctggagggga

SEQ ID NO: 1718809 - DNA, 19 bp, Homo sapiens
gctctggcagtaggtgtcc

SEQ ID NO: 1718810 - DNA, 14 bp, Homo sapiens
gctctggccccgct

SEQ ID NO: 1718811 - DNA, 15 bp, Homo sapiens
gctctggccccgcta

SEQ ID NO: 1718812 - DNA, 21 bp, Homo sapiens
gctctggcggcttcctgtcca

SEQ ID NO: 1718813 - DNA, 19 bp, Homo sapiens
gctctggctgaaccctgtg

SEQ ID NO: 1718814 - DNA, 22 bp, Homo sapiens
gctctggctgaaccctgtgctg

SEQ ID NO: 1718815 - DNA, 15 bp, Homo sapiens
gctctgggcctgagg

SEQ ID NO: 1718816 - DNA, 20 bp, Homo sapiens
gctctgggcctgagggtcca

SEQ ID NO: 1718817 - DNA, 11 bp, Homo sapiens
gctctgggctc

SEQ ID NO: 1718818 - DNA, 17 bp, Homo sapiens
gctctgggctcagggct

SEQ ID NO: 1718819 - DNA, 20 bp, Homo sapiens
gctctgggctcagggctgga

SEQ ID NO: 1718820 - DNA, 17 bp, Homo sapiens
gctctggggacagcttc

SEQ ID NO: 1718821 - DNA, 20 bp, Homo sapiens
gctctgggtacctgcaagca

SEQ ID NO: 1718822 - DNA, 20 bp, Homo sapiens
gctctgtagtttatgatgca

SEQ ID NO: 1718823 - DNA, 23 bp, Homo sapiens
gctctgtagtttatgatgcaaat

SEQ ID NO: 1718824 - DNA, 22 bp, Homo sapiens
gctctgtgagggtgctgactgg

SEQ ID NO: 1718825 - DNA, 14 bp, Homo sapiens
gctctgtgcagtca

SEQ ID NO: 1718826 - DNA, 14 bp, Homo sapiens
gctctgtgccttgg

SEQ ID NO: 1718827 - DNA, 11 bp, Homo sapiens
gctctgtggcc

SEQ ID NO: 1718828 - DNA, 13 bp, Homo sapiens
gctctgtggcctg

SEQ ID NO: 1718829 - DNA, 15 bp, Homo sapiens
gctctgtggcctgtg

SEQ ID NO: 1718830 - DNA, 16 bp, Homo sapiens
gctctgtggcctgtgt

SEQ ID NO: 1718831 - DNA, 19 bp, Homo sapiens
gctctgtggcctgtgtcca

SEQ ID NO: 1718832 - DNA, 21 bp, Homo sapiens
gctctgttgcccaggctggag

SEQ ID NO: 1718833 - DNA, 17 bp, Homo sapiens
gctctgtttgtgggact

SEQ ID NO: 1718834 - DNA, 18 bp, Homo sapiens
gctcttaagcagcatgga

SEQ ID NO: 1718835 - DNA, 19 bp, Homo sapiens
gctcttatgtgtgcctttg

SEQ ID NO: 1718836 - DNA, 16 bp, Homo sapiens
gctcttcaagctgtcc

SEQ ID NO: 1718837 - DNA, 19 bp, Homo sapiens
gctcttcaatgctaccggg

SEQ ID NO: 1718838 - DNA, 15 bp, Homo sapiens
gctcttcagatgcca

SEQ ID NO: 1718839 - DNA, 14 bp, Homo sapiens
gctcttcattccat

SEQ ID NO: 1718840 - DNA, 21 bp, Homo sapiens
gctcttcccccatgtgcctgt

SEQ ID NO: 1718841 - DNA, 22 bp, Homo sapiens
gctcttcccccatgtgcctgtc

SEQ ID NO: 1718842 - DNA, 13 bp, Homo sapiens
gctcttcctggac

SEQ ID NO: 1718843 - DNA, 16 bp, Homo sapiens
gctcttcctggacctg

SEQ ID NO: 1718844 - DNA, 20 bp, Homo sapiens
gctcttccttgaatcttctc

SEQ ID NO: 1718845 - DNA, 22 bp, Homo sapiens
gctcttgaaatattcagaaatt

SEQ ID NO: 1718846 - DNA, 23 bp, Homo sapiens
gctcttgatacccccctctgtct

SEQ ID NO: 1718847 - DNA, 17 bp, Homo sapiens
gctcttgcatctgggcc

SEQ ID NO: 1718848 - DNA, 12 bp, Homo sapiens
gctcttgccctt

SEQ ID NO: 1718849 - DNA, 22 bp, Homo sapiens
gctcttgcccttccctgtccct

SEQ ID NO: 1718850 - DNA, 13 bp, Homo sapiens
gctcttggctgac

SEQ ID NO: 1718851 - DNA, 16 bp, Homo sapiens
gctcttggctgacccc

SEQ ID NO: 1718852 - DNA, 17 bp, Homo sapiens
gctcttggctgacccct

SEQ ID NO: 1718853 - DNA, 18 bp, Homo sapiens
gctcttggctgacccctc

SEQ ID NO: 1718854 - DNA, 14 bp, Homo sapiens
gctcttggtccctg

SEQ ID NO: 1718855 - DNA, 16 bp, Homo sapiens
gctcttggtccctggt

SEQ ID NO: 1718856 - DNA, 18 bp, Homo sapiens
gctcttgtcggggtgggg

SEQ ID NO: 1718857 - DNA, 22 bp, Homo sapiens
gctcttgtttttattaatttat

SEQ ID NO: 1718858 - DNA, 14 bp, Homo sapiens
gctctttagccagt

SEQ ID NO: 1718859 - DNA, 16 bp, Homo sapiens
gctgccataattctaa

SEQ ID NO: 1718860 - DNA, 20 bp, Homo sapiens
gctgccatccttgctgcagc

SEQ ID NO: 1718861 - DNA, 17 bp, Homo sapiens
gctgccatgccactgcc

SEQ ID NO: 1718862 - DNA, 22 bp, Homo sapiens
gctgccatggcgtgtccctctc

SEQ ID NO: 1718863 - DNA, 18 bp, Homo sapiens
gctgccatttgatttttc

SEQ ID NO: 1718864 - DNA, 22 bp, Homo sapiens
gctgcccactgtttctcttgag

SEQ ID NO: 1718865 - DNA, 19 bp, Homo sapiens
gctgcccagccactccagg

SEQ ID NO: 1718866 - DNA, 16 bp, Homo sapiens
gctgcccaggagacag

SEQ ID NO: 1718867 - DNA, 19 bp, Homo sapiens
gctgcccatcatgtggccc

SEQ ID NO: 1718868 - DNA, 14 bp, Homo sapiens
gctgcccatcccag

SEQ ID NO: 1718869 - DNA, 16 bp, Homo sapiens
gctgcccatcccagtc

SEQ ID NO: 1718870 - DNA, 18 bp, Homo sapiens
gctgcccatcccagtccc

SEQ ID NO: 1718871 - DNA, 19 bp, Homo sapiens
gctgcccatcccagtccct

SEQ ID NO: 1718872 - DNA, 21 bp, Homo sapiens
gctgcccatcccagtccctcg

SEQ ID NO: 1718873 - DNA, 14 bp, Homo sapiens
gctgcccatgagca

SEQ ID NO: 1718874 - DNA, 17 bp, Homo sapiens
gctgccccaacctgctg

SEQ ID NO: 1718875 - DNA, 14 bp, Homo sapiens
gctgccccagcccc

SEQ ID NO: 1718876 - DNA, 22 bp, Homo sapiens
gctgccccagctgactgtggcc

SEQ ID NO: 1718877 - DNA, 19 bp, Homo sapiens
gctgccccaggccggagcc

SEQ ID NO: 1718878 - DNA, 23 bp, Homo sapiens
gctgccccaggccggagcccaga

SEQ ID NO: 1718879 - DNA, 15 bp, Homo sapiens
gctgcccccaccccg

SEQ ID NO: 1718880 - DNA, 20 bp, Homo sapiens
gctgccccgcttccccacag

SEQ ID NO: 1718881 - DNA, 15 bp, Homo sapiens
gctgccccggcccct

SEQ ID NO: 1718882 - DNA, 23 bp, Homo sapiens
gctgccccggcccctccccctga

SEQ ID NO: 1718883 - DNA, 17 bp, Homo sapiens
gctgccccggcctcctc

SEQ ID NO: 1718884 - DNA, 21 bp, Homo sapiens
gctgccccgggtccccagctc

SEQ ID NO: 1718885 - DNA, 19 bp, Homo sapiens
gctgccccgttccctgtca

SEQ ID NO: 1718886 - DNA, 20 bp, Homo sapiens
gctgccccgttccctgtcag

SEQ ID NO: 1718887 - DNA, 14 bp, Homo sapiens
gctgcccctctcac

SEQ ID NO: 1718888 - DNA, 18 bp, Homo sapiens
gctgcccctctcaccaaa

SEQ ID NO: 1718889 - DNA, 13 bp, Homo sapiens
gctgcccctggca

SEQ ID NO: 1718890 - DNA, 14 bp, Homo sapiens
gctgcccctggcac

SEQ ID NO: 1718891 - DNA, 15 bp, Homo sapiens
gctgcccctggcacc

SEQ ID NO: 1718892 - DNA, 15 bp, Homo sapiens
gctgcccggggtggg

SEQ ID NO: 1718893 - DNA, 20 bp, Homo sapiens
gctgcccgtcttcagcctag

SEQ ID NO: 1718894 - DNA, 13 bp, Homo sapiens
gctgccctagctg

SEQ ID NO: 1718895 - DNA, 18 bp, Homo sapiens
gctgccctagctgacccc

SEQ ID NO: 1718896 - DNA, 16 bp, Homo sapiens
gctgccctatgggcct

SEQ ID NO: 1718897 - DNA, 14 bp, Homo sapiens
gctgccctcccaca

SEQ ID NO: 1718898 - DNA, 20 bp, Homo sapiens
gctgccctcccacagcctcc

SEQ ID NO: 1718899 - DNA, 21 bp, Homo sapiens
gctgccctcccacagcctcct

SEQ ID NO: 1718900 - DNA, 15 bp, Homo sapiens
gctgccctggccctg

SEQ ID NO: 1718901 - DNA, 17 bp, Homo sapiens
gctgccctggccctgag

SEQ ID NO: 1718902 - DNA, 13 bp, Homo sapiens
gctgccctggctg

SEQ ID NO: 1718903 - DNA, 15 bp, Homo sapiens
gctgccctggtgctg

SEQ ID NO: 1718904 - DNA, 20 bp, Homo sapiens
gctgccctggtgctgccaca

SEQ ID NO: 1718905 - DNA, 15 bp, Homo sapiens
gctgcccttgttgcc

SEQ ID NO: 1718906 - DNA, 19 bp, Homo sapiens
gctgcccttgttgcctgca

SEQ ID NO: 1718907 - DNA, 16 bp, Homo sapiens
gctgccgaccagagcc

SEQ ID NO: 1718908 - DNA, 17 bp, Homo sapiens
gctgccgaccagagccc

SEQ ID NO: 1718909 - DNA, 18 bp, Homo sapiens
gctgccgacttggagact

SEQ ID NO: 1718910 - DNA, 22 bp, Homo sapiens
gctgccgagacagaccctctgc

SEQ ID NO: 1718911 - DNA, 12 bp, Homo sapiens
gctgccggagga

SEQ ID NO: 1718912 - DNA, 15 bp, Homo sapiens
gctgccggatctggg

SEQ ID NO: 1718913 - DNA, 19 bp, Homo sapiens
gctgccggctctgggcctg

SEQ ID NO: 1718914 - DNA, 22 bp, Homo sapiens
gctgccgtgccgcctgcactcc

SEQ ID NO: 1718915 - DNA, 22 bp, Homo sapiens
gctgccgtggggccgccgcctc

SEQ ID NO: 1718916 - DNA, 12 bp, Homo sapiens
gctgcctcagcc

SEQ ID NO: 1718917 - DNA, 14 bp, Homo sapiens
gctgcctcatttag

SEQ ID NO: 1718918 - DNA, 15 bp, Homo sapiens
gctgcctccatggca

SEQ ID NO: 1718919 - DNA, 17 bp, Homo sapiens
gctgcctccatggcagc

SEQ ID NO: 1718920 - DNA, 21 bp, Homo sapiens
gctgcctccatggcagcagcc

SEQ ID NO: 1718921 - DNA, 15 bp, Homo sapiens
gctgcctcctgccct

SEQ ID NO: 1718922 - DNA, 18 bp, Homo sapiens
gctgcctcggactccatg

SEQ ID NO: 1718923 - DNA, 17 bp, Homo sapiens
gctgcctctgaaaatat

SEQ ID NO: 1718924 - DNA, 19 bp, Homo sapiens
gctgcctctgaaaatattt

SEQ ID NO: 1718925 - DNA, 11 bp, Homo sapiens
gctgcctctgc

SEQ ID NO: 1718926 - DNA, 12 bp, Homo sapiens
gctgcctctgct

SEQ ID NO: 1718927 - DNA, 15 bp, Homo sapiens
gctgcctctgctccc

SEQ ID NO: 1718928 - DNA, 13 bp, Homo sapiens
gctgcctctgggc

SEQ ID NO: 1718929 - DNA, 15 bp, Homo sapiens
gctgcctctgggcca

SEQ ID NO: 1718930 - DNA, 22 bp, Homo sapiens
gctgcctgagcacctcccagcc

SEQ ID NO: 1718931 - DNA, 23 bp, Homo sapiens
gctgcctgagcacctcccagccc

SEQ ID NO: 1718932 - DNA, 15 bp, Homo sapiens
gctgcctgccgccca

SEQ ID NO: 1718933 - DNA, 11 bp, Homo sapiens
gctgcctgcct

SEQ ID NO: 1718934 - DNA, 13 bp, Homo sapiens
gctgcctgcctgt

SEQ ID NO: 1718935 - DNA, 16 bp, Homo sapiens
gctgcctgcctgtctg

SEQ ID NO: 1718936 - DNA, 16 bp, Homo sapiens
gctgcctggatgagaa

SEQ ID NO: 1718937 - DNA, 16 bp, Homo sapiens
gctgcctggccaggcc

SEQ ID NO: 1718938 - DNA, 17 bp, Homo sapiens
gctgcctggccaggccc

SEQ ID NO: 1718939 - DNA, 12 bp, Homo sapiens
gctgcctgggct

SEQ ID NO: 1718940 - DNA, 22 bp, Homo sapiens
gctgcctgggctgttggcactc

SEQ ID NO: 1718941 - DNA, 23 bp, Homo sapiens
gctgcctgggctgttggcactca

SEQ ID NO: 1718942 - DNA, 12 bp, Homo sapiens
gctgcctggtct

SEQ ID NO: 1718943 - DNA, 19 bp, Homo sapiens
gctgcctgtatttgagaga

SEQ ID NO: 1718944 - DNA, 22 bp, Homo sapiens
gctgcctgtatttgagagactg

SEQ ID NO: 1718945 - DNA, 16 bp, Homo sapiens
gctgccttccctagct

SEQ ID NO: 1718946 - DNA, 17 bp, Homo sapiens
gctgccttggctcagac

SEQ ID NO: 1718947 - DNA, 19 bp, Homo sapiens
gctgccttggctcagacat

SEQ ID NO: 1718948 - DNA, 17 bp, Homo sapiens
gctgccttttctggagt

SEQ ID NO: 1718949 - DNA, 21 bp, Homo sapiens
gctgccttttgtttctagaat

SEQ ID NO: 1718950 - DNA, 14 bp, Homo sapiens
gctgcggctgtggg

SEQ ID NO: 1718951 - DNA, 18 bp, Homo sapiens
gctgcgggcccagctgag

SEQ ID NO: 1718952 - DNA, 16 bp, Homo sapiens
gctgggtgccctctca

SEQ ID NO: 1718953 - DNA, 22 bp, Homo sapiens
gctgggtggtagatttcctcct

SEQ ID NO: 1718954 - DNA, 16 bp, Homo sapiens
gctgggttggtgcaca

SEQ ID NO: 1718955 - DNA, 22 bp, Homo sapiens
gctggtaacagttcatgtttgc

SEQ ID NO: 1718956 - DNA, 19 bp, Homo sapiens
gctggtagagacccccagg

SEQ ID NO: 1718957 - DNA, 20 bp, Homo sapiens
gctggtagatgctgaggccc

SEQ ID NO: 1718958 - DNA, 20 bp, Homo sapiens
gctggtagcagcaggctcag

SEQ ID NO: 1718959 - DNA, 18 bp, Homo sapiens
gctggtatctcagaaagt

SEQ ID NO: 1718960 - DNA, 23 bp, Homo sapiens
gctggtcactctgccctctgctg

SEQ ID NO: 1718961 - DNA, 20 bp, Homo sapiens
gctggtcagagagacctcat

SEQ ID NO: 1718962 - DNA, 23 bp, Homo sapiens
gctggtcagtctttgctcagtgt

SEQ ID NO: 1718963 - DNA, 14 bp, Homo sapiens
gctggtccagggct

SEQ ID NO: 1718964 - DNA, 21 bp, Homo sapiens
gctggtccctgccctcccctg

SEQ ID NO: 1718965 - DNA, 18 bp, Homo sapiens
gctggtctagtcacgcat

SEQ ID NO: 1718966 - DNA, 20 bp, Homo sapiens
gctggtctattttgattttg

SEQ ID NO: 1718967 - DNA, 12 bp, Homo sapiens
gctggtgcacag

SEQ ID NO: 1718968 - DNA, 20 bp, Homo sapiens
gctggtgcacagccactccc

SEQ ID NO: 1718969 - DNA, 19 bp, Homo sapiens
gctggtgccaaatagcccc

SEQ ID NO: 1718970 - DNA, 23 bp, Homo sapiens
gctggtgccagccttcctctgca

SEQ ID NO: 1718971 - DNA, 20 bp, Homo sapiens
gctggtgccccacctgcctg

SEQ ID NO: 1718972 - DNA, 14 bp, Homo sapiens
gctggtgcccggag

SEQ ID NO: 1718973 - DNA, 19 bp, Homo sapiens
gctggtggaccacaggcat

SEQ ID NO: 1718974 - DNA, 19 bp, Homo sapiens
gctggtggccctgtgcctg

SEQ ID NO: 1718975 - DNA, 13 bp, Homo sapiens
gctggtgggaagg

SEQ ID NO: 1718976 - DNA, 17 bp, Homo sapiens
gctggtgtagtcttttt

SEQ ID NO: 1718977 - DNA, 17 bp, Homo sapiens
gctggtgtcctgaccac

SEQ ID NO: 1718978 - DNA, 15 bp, Homo sapiens
gctggtgtcctgccc

SEQ ID NO: 1718979 - DNA, 15 bp, Homo sapiens
gctggttgttgccag

SEQ ID NO: 1718980 - DNA, 22 bp, Homo sapiens
gctggtttgaaagattatgatg

SEQ ID NO: 1718981 - DNA, 19 bp, Homo sapiens
gctggttttgatggctggg

SEQ ID NO: 1718982 - DNA, 18 bp, Homo sapiens
gcggccttgaagacagag

SEQ ID NO: 1718983 - DNA, 20 bp, Homo sapiens
gcggccttgaagacagagca

SEQ ID NO: 1718984 - DNA, 20 bp, Homo sapiens
gcggcctttgttgctcagca

SEQ ID NO: 1718985 - DNA, 20 bp, Homo sapiens
gcggctactcagcagccctc

SEQ ID NO: 1718986 - DNA, 22 bp, Homo sapiens
gcggctcaaaaggaaaccaagt

SEQ ID NO: 1718987 - DNA, 23 bp, Homo sapiens
gcggctgagagccccagctgaca

SEQ ID NO: 1718988 - DNA, 23 bp, Homo sapiens
gcggctgagtcatgatctccctg

SEQ ID NO: 1718989 - DNA, 15 bp, Homo sapiens
gcggctggtgcaggg

SEQ ID NO: 1718990 - DNA, 20 bp, Homo sapiens
gcggcttcctgtccactctc

SEQ ID NO: 1718991 - DNA, 20 bp, Homo sapiens
gcgggaccggtacagaaagg

SEQ ID NO: 1718992 - DNA, 16 bp, Homo sapiens
gcgggagacctgtgct

SEQ ID NO: 1718993 - DNA, 15 bp, Homo sapiens
gcgggagctctgtat

SEQ ID NO: 1718994 - DNA, 13 bp, Homo sapiens
gcgggaggcacca

SEQ ID NO: 1718995 - DNA, 15 bp, Homo sapiens
gcgggaggcaccagc

SEQ ID NO: 1718996 - DNA, 19 bp, Homo sapiens
gcgggatcctccacagaga

SEQ ID NO: 1718997 - DNA, 15 bp, Homo sapiens
gcgggatggtcctgg

SEQ ID NO: 1718998 - DNA, 20 bp, Homo sapiens
gcgggcacagggcaccagag

SEQ ID NO: 1718999 - DNA, 21 bp, Homo sapiens
gcgggcacagggcaccagagg

SEQ ID NO: 1719000 - DNA, 15 bp, Homo sapiens
gcgggcagagggctg

SEQ ID NO: 1719001 - DNA, 17 bp, Homo sapiens
gcgggcagagggctgga

SEQ ID NO: 1719002 - DNA, 18 bp, Homo sapiens
gcgggcagcgggccaggc

SEQ ID NO: 1719003 - DNA, 13 bp, Homo sapiens
gcgggccaggccc

SEQ ID NO: 1719004 - DNA, 14 bp, Homo sapiens
gcgggccaggcccg

SEQ ID NO: 1719005 - DNA, 23 bp, Homo sapiens
gcgggccaggcccgcaccccggc

SEQ ID NO: 1719006 - DNA, 11 bp, Homo sapiens
gcgggccaggg

SEQ ID NO: 1719007 - DNA, 20 bp, Homo sapiens
gcgggccgtctcccttggcc

SEQ ID NO: 1719008 - DNA, 15 bp, Homo sapiens
gcgggcgcgtgagtg

SEQ ID NO: 1719009 - DNA, 15 bp, Homo sapiens
gcgggcggccaggca

SEQ ID NO: 1719010 - DNA, 14 bp, Homo sapiens
gcgggctcaaggaa

SEQ ID NO: 1719011 - DNA, 23 bp, Homo sapiens
gcggggatcagagcgcacaggga

SEQ ID NO: 1719012 - DNA, 13 bp, Homo sapiens
gcggggcagcagg

SEQ ID NO: 1719013 - DNA, 22 bp, Homo sapiens
gcggggcccagcgctctcctgg

SEQ ID NO: 1719014 - DNA, 14 bp, Homo sapiens
gcgggggctgctca

SEQ ID NO: 1719015 - DNA, 16 bp, Homo sapiens
gcggggtggcggtgga

SEQ ID NO: 1719016 - DNA, 15 bp, Homo sapiens
gcgggtctcctccca

SEQ ID NO: 1719017 - DNA, 16 bp, Homo sapiens
gcgggtctcctcccag

SEQ ID NO: 1719018 - DNA, 22 bp, Homo sapiens
gcgggtgacagctccgggatca

SEQ ID NO: 1719019 - DNA, 14 bp, Homo sapiens
gcggtcacagcatg

SEQ ID NO: 1719020 - DNA, 17 bp, Homo sapiens
gcggtcatgtgtgcatg

SEQ ID NO: 1719021 - DNA, 18 bp, Homo sapiens
gcggtccaacgccgcctt

SEQ ID NO: 1719022 - DNA, 15 bp, Homo sapiens
gcggtgccatgtctg

SEQ ID NO: 1719023 - DNA, 21 bp, Homo sapiens
gcggtgccatgtctgcagtgt

SEQ ID NO: 1719024 - DNA, 15 bp, Homo sapiens
gcggtggctcacgcc

SEQ ID NO: 1719025 - DNA, 16 bp, Homo sapiens
gcggtggctgccccgg

SEQ ID NO: 1719026 - DNA, 22 bp, Homo sapiens
gcggttataaaaaatggttcag

SEQ ID NO: 1719027 - DNA, 14 bp, Homo sapiens
gcgtaatgggcctg

SEQ ID NO: 1719028 - DNA, 15 bp, Homo sapiens
gcgtaatgggcctgc

SEQ ID NO: 1719029 - DNA, 13 bp, Homo sapiens
gcgtacacagaga

SEQ ID NO: 1719030 - DNA, 16 bp, Homo sapiens
gcgtactacccagctc

SEQ ID NO: 1719031 - DNA, 20 bp, Homo sapiens
gcgtatatgtgcgtctctct

SEQ ID NO: 1719032 - DNA, 14 bp, Homo sapiens
gcgtcaagacattt

SEQ ID NO: 1719033 - DNA, 14 bp, Homo sapiens
gcgtcactccagtg

SEQ ID NO: 1719034 - DNA, 15 bp, Homo sapiens
gcgtcactccagtgc

SEQ ID NO: 1719035 - DNA, 22 bp, Homo sapiens
gcgtcagctgctccctggcatt

SEQ ID NO: 1719036 - DNA, 17 bp, Homo sapiens
gcgtcccaagatgttga

SEQ ID NO: 1719037 - DNA, 14 bp, Homo sapiens
gcgtcccagctgaa

SEQ ID NO: 1719038 - DNA, 23 bp, Homo sapiens
gcgtcccagctgaaggcagtggc

SEQ ID NO: 1719039 - DNA, 14 bp, Homo sapiens
gcgtcccccgccgc

SEQ ID NO: 1719040 - DNA, 18 bp, Homo sapiens
gcgtcccttggtgagaaa

SEQ ID NO: 1719041 - DNA, 19 bp, Homo sapiens
gcgtccgcgcgccagcaca

SEQ ID NO: 1719042 - DNA, 13 bp, Homo sapiens
gcgtcctcatttc

SEQ ID NO: 1719043 - DNA, 22 bp, Homo sapiens
gcgtcctcatttcccctcccaa

SEQ ID NO: 1719044 - DNA, 20 bp, Homo sapiens
gcgtcctcctcacctcatgc

SEQ ID NO: 1719045 - DNA, 17 bp, Homo sapiens
gcgtcctgacgccctgc

SEQ ID NO: 1719046 - DNA, 19 bp, Homo sapiens
gcgtcctgcagaggaccac

SEQ ID NO: 1719047 - DNA, 12 bp, Homo sapiens
gcgtcctgccct

SEQ ID NO: 1719048 - DNA, 17 bp, Homo sapiens
gcgtctctaatgtctgc

SEQ ID NO: 1719049 - DNA, 21 bp, Homo sapiens
gcgtctctctttctccctcac

SEQ ID NO: 1719050 - DNA, 23 bp, Homo sapiens
gcgtctctctttctccctcaccc

SEQ ID NO: 1719051 - DNA, 15 bp, Homo sapiens
gcgtctgagctgggg

SEQ ID NO: 1719052 - DNA, 13 bp, Homo sapiens
gcgtctgtgtgcg

SEQ ID NO: 1719053 - DNA, 14 bp, Homo sapiens
gcgtcttcctgagt

SEQ ID NO: 1719054 - DNA, 16 bp, Homo sapiens
gcgtcttgcccagcag

SEQ ID NO: 1719055 - DNA, 12 bp, Homo sapiens
gcgtgaatctgt

SEQ ID NO: 1719056 - DNA, 13 bp, Homo sapiens
gcgtgactcaccc

SEQ ID NO: 1719057 - DNA, 14 bp, Homo sapiens
gcgtgactcaccca

SEQ ID NO: 1719058 - DNA, 16 bp, Homo sapiens
gcgtgactcacccaag

SEQ ID NO: 1719059 - DNA, 15 bp, Homo sapiens
gcgtgatctcagctc

SEQ ID NO: 1719060 - DNA, 17 bp, Homo sapiens
gcgtgcccccctcctcc

SEQ ID NO: 1719061 - DNA, 18 bp, Homo sapiens
gcgtgccgcctgctcctc

SEQ ID NO: 1719062 - DNA, 23 bp, Homo sapiens
gcgtgcgagcacacacacacata

SEQ ID NO: 1719063 - DNA, 14 bp, Homo sapiens
gcgtggagggaggc

SEQ ID NO: 1719064 - DNA, 16 bp, Homo sapiens
gcgtggagggaggccc

SEQ ID NO: 1719065 - DNA, 21 bp, Homo sapiens
gcgtggagggaggccccaggg

SEQ ID NO: 1719066 - DNA, 19 bp, Homo sapiens
gctagagccgaggggagag

SEQ ID NO: 1719067 - DNA, 20 bp, Homo sapiens
gctagagccgaggggagaga

SEQ ID NO: 1719068 - DNA, 18 bp, Homo sapiens
gctagaggccagccccac

SEQ ID NO: 1719069 - DNA, 20 bp, Homo sapiens
gctagaggccagccccaccc

SEQ ID NO: 1719070 - DNA, 20 bp, Homo sapiens
gctagagtcctcactcccag

SEQ ID NO: 1719071 - DNA, 19 bp, Homo sapiens
gctagcaaatggcagaacc

SEQ ID NO: 1719072 - DNA, 15 bp, Homo sapiens
gctagcgctgccgca

SEQ ID NO: 1719073 - DNA, 23 bp, Homo sapiens
gctagcgctgccgcaccccagag

SEQ ID NO: 1719074 - DNA, 11 bp, Homo sapiens
gctagctgcca

SEQ ID NO: 1719075 - DNA, 14 bp, Homo sapiens
gctagctgccactt

SEQ ID NO: 1719076 - DNA, 17 bp, Homo sapiens
gctagcttctgcttttc

SEQ ID NO: 1719077 - DNA, 12 bp, Homo sapiens
gctaggaatgaa

SEQ ID NO: 1719078 - DNA, 16 bp, Homo sapiens
gctaggagccccagct

SEQ ID NO: 1719079 - DNA, 22 bp, Homo sapiens
gctaggagccccagcttcctgt

SEQ ID NO: 1719080 - DNA, 14 bp, Homo sapiens
gctaggatggttct

SEQ ID NO: 1719081 - DNA, 22 bp, Homo sapiens
gctaggccccagaggccctgga

SEQ ID NO: 1719082 - DNA, 18 bp, Homo sapiens
gctaggcgctggggagac

SEQ ID NO: 1719083 - DNA, 18 bp, Homo sapiens
gctagggaaacttcccgt

SEQ ID NO: 1719084 - DNA, 14 bp, Homo sapiens
gctagggtggccct

SEQ ID NO: 1719085 - DNA, 18 bp, Homo sapiens
gctaggttaaatggttgg

SEQ ID NO: 1719086 - DNA, 21 bp, Homo sapiens
gctagtaccctatagagaggg

SEQ ID NO: 1719087 - DNA, 17 bp, Homo sapiens
gctagtagcaatgtgcc

SEQ ID NO: 1719088 - DNA, 15 bp, Homo sapiens
gctagtcactggcag

SEQ ID NO: 1719089 - DNA, 18 bp, Homo sapiens
gctagtgaaatggctggg

SEQ ID NO: 1719090 - DNA, 19 bp, Homo sapiens
gctagtgctgtaatattgt

SEQ ID NO: 1719091 - DNA, 17 bp, Homo sapiens
gctagtgtacctcctct

SEQ ID NO: 1719092 - DNA, 16 bp, Homo sapiens
gctagtgtgagtggca

SEQ ID NO: 1719093 - DNA, 23 bp, Homo sapiens
gctagtgtgagtggcagccatgc

SEQ ID NO: 1719094 - DNA, 16 bp, Homo sapiens
gctagttctgctgccc

SEQ ID NO: 1719095 - DNA, 19 bp, Homo sapiens
gctagttggggagctaagg

SEQ ID NO: 1719096 - DNA, 22 bp, Homo sapiens
gctagttttacagattgcctcc

SEQ ID NO: 1719097 - DNA, 14 bp, Homo sapiens
gctataaatgccag

SEQ ID NO: 1719098 - DNA, 18 bp, Homo sapiens
gctataaatgccagagcc

SEQ ID NO: 1719099 - DNA, 12 bp, Homo sapiens
gctataagtgct

SEQ ID NO: 1719100 - DNA, 23 bp, Homo sapiens
gctataatcattagttttagagg

SEQ ID NO: 1719101 - DNA, 16 bp, Homo sapiens
gctatagctacaggaa

SEQ ID NO: 1719102 - DNA, 18 bp, Homo sapiens
gctatagctacaggaagc

SEQ ID NO: 1719103 - DNA, 14 bp, Homo sapiens
gctatatataaaga

SEQ ID NO: 1719104 - DNA, 20 bp, Homo sapiens
gctatatataaagacaacaa

SEQ ID NO: 1719105 - DNA, 23 bp, Homo sapiens
gctatatatttaggaaattcaaa

SEQ ID NO: 1719106 - DNA, 14 bp, Homo sapiens
gctatattagctga

SEQ ID NO: 1719107 - DNA, 19 bp, Homo sapiens
gctatatttgattatgtat

SEQ ID NO: 1719108 - DNA, 16 bp, Homo sapiens
gctatccagttgcagg

SEQ ID NO: 1719109 - DNA, 21 bp, Homo sapiens
gctatccccatctccctgcct

SEQ ID NO: 1719110 - DNA, 23 bp, Homo sapiens
gctatccccatctccctgcctgg

SEQ ID NO: 1719111 - DNA, 23 bp, Homo sapiens
gctatccttggctttcagagcca

SEQ ID NO: 1719112 - DNA, 13 bp, Homo sapiens
gctatctctgtgt

SEQ ID NO: 1719113 - DNA, 20 bp, Homo sapiens
gctatctctgtgtgcacaaa

SEQ ID NO: 1719114 - DNA, 21 bp, Homo sapiens
gctatctggaggccttccagc

SEQ ID NO: 1719115 - DNA, 15 bp, Homo sapiens
gctatcttttctgga

SEQ ID NO: 1719116 - DNA, 17 bp, Homo sapiens
gctatgagctggggatg

SEQ ID NO: 1719117 - DNA, 14 bp, Homo sapiens
gctatgagttttct

SEQ ID NO: 1719118 - DNA, 20 bp, Homo sapiens
gctatgatttttttttccaa

SEQ ID NO: 1719119 - DNA, 17 bp, Homo sapiens
gctatgggagccccagg

SEQ ID NO: 1719120 - DNA, 21 bp, Homo sapiens
gctatgggagccccagggtct

SEQ ID NO: 1719121 - DNA, 23 bp, Homo sapiens
gctatgtaaacaaaccacagcag

SEQ ID NO: 1719122 - DNA, 16 bp, Homo sapiens
gctatgtataaaatac

SEQ ID NO: 1719123 - DNA, 15 bp, Homo sapiens
gctatgtcagtacta

SEQ ID NO: 1719124 - DNA, 14 bp, Homo sapiens
gctatgtgaaacta

SEQ ID NO: 1719125 - DNA, 18 bp, Homo sapiens
gctatgttctgtcttccc

SEQ ID NO: 1719126 - DNA, 15 bp, Homo sapiens
gctattaaaaaagtc

SEQ ID NO: 1719127 - DNA, 18 bp, Homo sapiens
gctattaaaagaatccaa

SEQ ID NO: 1719128 - DNA, 17 bp, Homo sapiens
gctattattttcactgt

SEQ ID NO: 1719129 - DNA, 18 bp, Homo sapiens
gctattattttcactgta

SEQ ID NO: 1719130 - DNA, 22 bp, Homo sapiens
gctattcacctcagtagaaaag

SEQ ID NO: 1719131 - DNA, 19 bp, Homo sapiens
gctattcagtaataactct

SEQ ID NO: 1719132 - DNA, 20 bp, Homo sapiens
gctattcagtaataactcta

SEQ ID NO: 1719133 - DNA, 18 bp, Homo sapiens
gctattctcatgcctcag

SEQ ID NO: 1719134 - DNA, 12 bp, Homo sapiens
gctattctgtgt

SEQ ID NO: 1719135 - DNA, 15 bp, Homo sapiens
gctattctgtgttga

SEQ ID NO: 1719136 - DNA, 19 bp, Homo sapiens
gctattgaagatgctgcct

SEQ ID NO: 1719137 - DNA, 21 bp, Homo sapiens
gctattgaccatgtggttcac

SEQ ID NO: 1719138 - DNA, 16 bp, Homo sapiens
gctattgcactccagt

SEQ ID NO: 1719139 - DNA, 18 bp, Homo sapiens
gctattgcactccagtct

SEQ ID NO: 1719140 - DNA, 16 bp, Homo sapiens
gctattgttgtgggct

SEQ ID NO: 1719141 - DNA, 22 bp, Homo sapiens
gctattgtttctttaagaaagt

SEQ ID NO: 1719142 - DNA, 16 bp, Homo sapiens
gctatttacactatta

SEQ ID NO: 1719143 - DNA, 13 bp, Homo sapiens
gcctcactggctg

SEQ ID NO: 1719144 - DNA, 22 bp, Homo sapiens
gcctcactggctggggcagagg

SEQ ID NO: 1719145 - DNA, 16 bp, Homo sapiens
gcctcagaaagggatt

SEQ ID NO: 1719146 - DNA, 22 bp, Homo sapiens
gcctcagaagaaaacaaagttc

SEQ ID NO: 1719147 - DNA, 17 bp, Homo sapiens
gcctcagactccgccct

SEQ ID NO: 1719148 - DNA, 15 bp, Homo sapiens
gcctcagagaccagg

SEQ ID NO: 1719149 - DNA, 18 bp, Homo sapiens
gcctcagagaccagggct

SEQ ID NO: 1719150 - DNA, 23 bp, Homo sapiens
gcctcagatccaggcaggagcac

SEQ ID NO: 1719151 - DNA, 16 bp, Homo sapiens
gcctcagccagtggca

SEQ ID NO: 1719152 - DNA, 15 bp, Homo sapiens
gcctcagcctactcc

SEQ ID NO: 1719153 - DNA, 17 bp, Homo sapiens
gcctcagcctcctgagt

SEQ ID NO: 1719154 - DNA, 17 bp, Homo sapiens
gcctcagcctctcaagt

SEQ ID NO: 1719155 - DNA, 20 bp, Homo sapiens
gcctcagctgcctcacttcc

SEQ ID NO: 1719156 - DNA, 14 bp, Homo sapiens
gcctcaggctctgc

SEQ ID NO: 1719157 - DNA, 13 bp, Homo sapiens
gcctcagggcgct

SEQ ID NO: 1719158 - DNA, 19 bp, Homo sapiens
gcctcagggcgctcagacg

SEQ ID NO: 1719159 - DNA, 15 bp, Homo sapiens
gcctcagtgccactt

SEQ ID NO: 1719160 - DNA, 24 bp, Homo sapiens
gcctcagtgccacttgacattcct

SEQ ID NO: 1719161 - DNA, 19 bp, Homo sapiens
gcctcagtggctctgggta

SEQ ID NO: 1719162 - DNA, 16 bp, Homo sapiens
gcctcagtgtgcccat

SEQ ID NO: 1719163 - DNA, 13 bp, Homo sapiens
gcctcagttccca

SEQ ID NO: 1719164 - DNA, 17 bp, Homo sapiens
gcctcagttcccagctc

SEQ ID NO: 1719165 - DNA, 22 bp, Homo sapiens
gcctcagttcccagctcccccc

SEQ ID NO: 1719166 - DNA, 19 bp, Homo sapiens
gcctcagttttccttctgt

SEQ ID NO: 1719167 - DNA, 13 bp, Homo sapiens
gcctcatccctcg

SEQ ID NO: 1719168 - DNA, 14 bp, Homo sapiens
gcctcatccctcgg

SEQ ID NO: 1719169 - DNA, 17 bp, Homo sapiens
gcctcatccctcggaag

SEQ ID NO: 1719170 - DNA, 17 bp, Homo sapiens
gcctcatccgaggcagg

SEQ ID NO: 1719171 - DNA, 18 bp, Homo sapiens
gcctcatccgaggcaggg

SEQ ID NO: 1719172 - DNA, 12 bp, Homo sapiens
gcctcatctcct

SEQ ID NO: 1719173 - DNA, 13 bp, Homo sapiens
gcctcatgccaca

SEQ ID NO: 1719174 - DNA, 17 bp, Homo sapiens
gcctcatgccacacctt

SEQ ID NO: 1719175 - DNA, 16 bp, Homo sapiens
gcctcatgtggctgga

SEQ ID NO: 1719176 - DNA, 17 bp, Homo sapiens
gcctcatgtggctggaa

SEQ ID NO: 1719177 - DNA, 19 bp, Homo sapiens
gcctcatgtggctggaaga

SEQ ID NO: 1719178 - DNA, 15 bp, Homo sapiens
gcctcatgttctgtg

SEQ ID NO: 1719179 - DNA, 21 bp, Homo sapiens
gcctcattcagcatgggtcct

SEQ ID NO: 1719180 - DNA, 22 bp, Homo sapiens
gcctcattcagcatgggtcctt

SEQ ID NO: 1719181 - DNA, 13 bp, Homo sapiens
gcctcatttccct

SEQ ID NO: 1719182 - DNA, 23 bp, Homo sapiens
gcctccaaagtggagctgggagg

SEQ ID NO: 1719183 - DNA, 22 bp, Homo sapiens
gcctccaaatgccaacttgtcc

SEQ ID NO: 1719184 - DNA, 21 bp, Homo sapiens
gcctccaacgcccctgtggcc

SEQ ID NO: 1719185 - DNA, 22 bp, Homo sapiens
gcctccaacgcccctgtggcca

SEQ ID NO: 1719186 - DNA, 13 bp, Homo sapiens
gcctccaagcctg

SEQ ID NO: 1719187 - DNA, 17 bp, Homo sapiens
gcctccaagcctgcctc

SEQ ID NO: 1719188 - DNA, 23 bp, Homo sapiens
gcctccaaggaggggctgtaaaa

SEQ ID NO: 1719189 - DNA, 19 bp, Homo sapiens
gcctccaagggtttcgact

SEQ ID NO: 1719190 - DNA, 19 bp, Homo sapiens
gcctccaatgcattggcct

SEQ ID NO: 1719191 - DNA, 22 bp, Homo sapiens
gcctccaatgcattggcctctg

SEQ ID NO: 1719192 - DNA, 20 bp, Homo sapiens
gcctccacagcgagggcagc

SEQ ID NO: 1719193 - DNA, 13 bp, Homo sapiens
gcctccaccagca

SEQ ID NO: 1719194 - DNA, 15 bp, Homo sapiens
gcctccaccagcaag

SEQ ID NO: 1719195 - DNA, 18 bp, Homo sapiens
gcctccaccgagccagct

SEQ ID NO: 1719196 - DNA, 12 bp, Homo sapiens
gcctccaccgct

SEQ ID NO: 1719197 - DNA, 15 bp, Homo sapiens
gcctccactccccca

SEQ ID NO: 1719198 - DNA, 19 bp, Homo sapiens
gcctccactcccccacctg

SEQ ID NO: 1719199 - DNA, 21 bp, Homo sapiens
gcctccactcccccacctgac

SEQ ID NO: 1719200 - DNA, 22 bp, Homo sapiens
gcctccactcccccacctgaca

SEQ ID NO: 1719201 - DNA, 15 bp, Homo sapiens
gcctccactctagtt

SEQ ID NO: 1719202 - DNA, 20 bp, Homo sapiens
gcctccactctagttctaga

SEQ ID NO: 1719203 - DNA, 22 bp, Homo sapiens
gcctccactctagttctagatg

SEQ ID NO: 1719204 - DNA, 12 bp, Homo sapiens
gcctccagaact

SEQ ID NO: 1719205 - DNA, 17 bp, Homo sapiens
gcctccagaactcactg

SEQ ID NO: 1719206 - DNA, 17 bp, Homo sapiens
gcctccagaagctgctc

SEQ ID NO: 1719207 - DNA, 20 bp, Homo sapiens
gcctccagaagctgctcctt

SEQ ID NO: 1719208 - DNA, 12 bp, Homo sapiens
gcctccagagcc

SEQ ID NO: 1719209 - DNA, 16 bp, Homo sapiens
gcctccagagccagcc

SEQ ID NO: 1719210 - DNA, 17 bp, Homo sapiens
gcctccagagccagcct

SEQ ID NO: 1719211 - DNA, 20 bp, Homo sapiens
gcctccagagccagcctggg

SEQ ID NO: 1719212 - DNA, 24 bp, Homo sapiens
gcctccagagccagcctgggactc

SEQ ID NO: 1719213 - DNA, 19 bp, Homo sapiens
gcctccagaggtcctccgt

SEQ ID NO: 1719214 - DNA, 12 bp, Homo sapiens
gcctccagcctc

SEQ ID NO: 1719215 - DNA, 13 bp, Homo sapiens
gcctccagcctct

SEQ ID NO: 1719216 - DNA, 14 bp, Homo sapiens
gcctccagcctctc

SEQ ID NO: 1719217 - DNA, 16 bp, Homo sapiens
gcctccagcctctccc

SEQ ID NO: 1719218 - DNA, 22 bp, Homo sapiens
gcctccagcctctcccggctgc

SEQ ID NO: 1719219 - DNA, 16 bp, Homo sapiens
gcctccagctcccact

SEQ ID NO: 1719220 - DNA, 13 bp, Homo sapiens
gcctccaggagcc

SEQ ID NO: 1719221 - DNA, 18 bp, Homo sapiens
gcctccaggagcctaccc

SEQ ID NO: 1719222 - DNA, 19 bp, Homo sapiens
gcctccagggcattgctca

SEQ ID NO: 1719223 - DNA, 22 bp, Homo sapiens
gcctccagggcattgctcagcc

SEQ ID NO: 1719224 - DNA, 18 bp, Homo sapiens
gcctccagggcccaggtt

SEQ ID NO: 1719225 - DNA, 12 bp, Homo sapiens
gcctccagggct

SEQ ID NO: 1719226 - DNA, 14 bp, Homo sapiens
gcctccagggctgg

SEQ ID NO: 1719227 - DNA, 19 bp, Homo sapiens
gcctccagggctggactga

SEQ ID NO: 1719228 - DNA, 21 bp, Homo sapiens
gcctccagggctggactgagg

SEQ ID NO: 1719229 - DNA, 23 bp, Homo sapiens
gcctccagggctggactgaggcc

SEQ ID NO: 1719230 - DNA, 17 bp, Homo sapiens
gcctccaggtgcagagg

SEQ ID NO: 1719231 - DNA, 13 bp, Homo sapiens
gcctccaggtgtg

SEQ ID NO: 1719232 - DNA, 15 bp, Homo sapiens
gcctccatgccccag

SEQ ID NO: 1719233 - DNA, 23 bp, Homo sapiens
gcctccatgccccagctctggat

SEQ ID NO: 1719234 - DNA, 18 bp, Homo sapiens
gcctccattcctggagcc

SEQ ID NO: 1719235 - DNA, 16 bp, Homo sapiens
gcctccattctgacca

SEQ ID NO: 1719236 - DNA, 13 bp, Homo sapiens
gcctcccaaagtg

SEQ ID NO: 1719237 - DNA, 15 bp, Homo sapiens
gcctcccacagtgct

SEQ ID NO: 1719238 - DNA, 17 bp, Homo sapiens
gcctcccacagtgctgg

SEQ ID NO: 1719239 - DNA, 13 bp, Homo sapiens
gcctcccaccaga

SEQ ID NO: 1719240 - DNA, 16 bp, Homo sapiens
gcctcccaccagagcc

SEQ ID NO: 1719241 - DNA, 17 bp, Homo sapiens
gcctcccaccagagccg

SEQ ID NO: 1719242 - DNA, 12 bp, Homo sapiens
gcctcccacccg

SEQ ID NO: 1719243 - DNA, 18 bp, Homo sapiens
gcctcccacccgatgctg

SEQ ID NO: 1719244 - DNA, 19 bp, Homo sapiens
gcctcccacccgatgctgc

SEQ ID NO: 1719245 - DNA, 13 bp, Homo sapiens
gcctcccaccgca

SEQ ID NO: 1719246 - DNA, 17 bp, Homo sapiens
gcctcccactcctgttc

SEQ ID NO: 1719247 - DNA, 19 bp, Homo sapiens
gcctcccaggcaagcagct

SEQ ID NO: 1719248 - DNA, 12 bp, Homo sapiens
gcctcccaggtt

SEQ ID NO: 1719249 - DNA, 14 bp, Homo sapiens
gcctcccatgttca

SEQ ID NO: 1719250 - DNA, 17 bp, Homo sapiens
gcctccccacctccagg

SEQ ID NO: 1719251 - DNA, 18 bp, Homo sapiens
gcctccccacctccaggc

SEQ ID NO: 1719252 - DNA, 16 bp, Homo sapiens
gcctccccatttccca

SEQ ID NO: 1719253 - DNA, 20 bp, Homo sapiens
gcctccccatttcccatctg

SEQ ID NO: 1719254 - DNA, 17 bp, Homo sapiens
gcctcccccagccagga

SEQ ID NO: 1719255 - DNA, 13 bp, Homo sapiens
gcctccccccaga

SEQ ID NO: 1719256 - DNA, 16 bp, Homo sapiens
gcctcccccgccagcc

SEQ ID NO: 1719257 - DNA, 21 bp, Homo sapiens
gcctccccctcccccattccc

SEQ ID NO: 1719258 - DNA, 18 bp, Homo sapiens
gcctcccctctccttcct

SEQ ID NO: 1719259 - DNA, 19 bp, Homo sapiens
gcctcccctctccttcctg

SEQ ID NO: 1719260 - DNA, 20 bp, Homo sapiens
gcctgctcccagcagcccta

SEQ ID NO: 1719261 - DNA, 11 bp, Homo sapiens
gcctgctcccc

SEQ ID NO: 1719262 - DNA, 15 bp, Homo sapiens
gcctgctcccccacc

SEQ ID NO: 1719263 - DNA, 19 bp, Homo sapiens
gcctgctcccccaccccct

SEQ ID NO: 1719264 - DNA, 13 bp, Homo sapiens
gcctgctccctgt

SEQ ID NO: 1719265 - DNA, 16 bp, Homo sapiens
gcctgctccctgtctg

SEQ ID NO: 1719266 - DNA, 16 bp, Homo sapiens
gcctgctgccagtgca

SEQ ID NO: 1719267 - DNA, 18 bp, Homo sapiens
gcctgctgccagtgcagc

SEQ ID NO: 1719268 - DNA, 10 bp, Homo sapiens
gcctgctggc

SEQ ID NO: 1719269 - DNA, 19 bp, Homo sapiens
gcctgctggcacccaccgt

SEQ ID NO: 1719270 - DNA, 22 bp, Homo sapiens
gcctgctgggaaccccgcagcc

SEQ ID NO: 1719271 - DNA, 16 bp, Homo sapiens
gcctgctgggctctcc

SEQ ID NO: 1719272 - DNA, 18 bp, Homo sapiens
gcctgctgggctctccac

SEQ ID NO: 1719273 - DNA, 24 bp, Homo sapiens
gcctgctgggctctccacctcagc

SEQ ID NO: 1719274 - DNA, 15 bp, Homo sapiens
gcctgctggggatta

SEQ ID NO: 1719275 - DNA, 20 bp, Homo sapiens
gcctgctgttggtcctctct

SEQ ID NO: 1719276 - DNA, 19 bp, Homo sapiens
gcctgcttttccaggatcc

SEQ ID NO: 1719277 - DNA, 18 bp, Homo sapiens
gcctggaacaccagcagc

SEQ ID NO: 1719278 - DNA, 12 bp, Homo sapiens
gcctggaaccag

SEQ ID NO: 1719279 - DNA, 20 bp, Homo sapiens
gcctggaaccagggaggaga

SEQ ID NO: 1719280 - DNA, 15 bp, Homo sapiens
gcctggaccaaaggg

SEQ ID NO: 1719281 - DNA, 15 bp, Homo sapiens
gcctggacctgcctc

SEQ ID NO: 1719282 - DNA, 23 bp, Homo sapiens
gcctggacctgcctcctgcctgc

SEQ ID NO: 1719283 - DNA, 15 bp, Homo sapiens
gcctggactctaagc

SEQ ID NO: 1719284 - DNA, 13 bp, Homo sapiens
gcctggactgcta

SEQ ID NO: 1719285 - DNA, 19 bp, Homo sapiens
gcctggagatcctcctgca

SEQ ID NO: 1719286 - DNA, 22 bp, Homo sapiens
gcctggagatcctcctgcagac

SEQ ID NO: 1719287 - DNA, 20 bp, Homo sapiens
gcctggagcatggacagtgt

SEQ ID NO: 1719288 - DNA, 12 bp, Homo sapiens
gcctggagcccc

SEQ ID NO: 1719289 - DNA, 18 bp, Homo sapiens
gcctggagccctgggcgg

SEQ ID NO: 1719290 - DNA, 17 bp, Homo sapiens
gcctggaggtctggctg

SEQ ID NO: 1719291 - DNA, 15 bp, Homo sapiens
gcctggagtgtcgga

SEQ ID NO: 1719292 - DNA, 21 bp, Homo sapiens
gcctggatgggggtgcaggca

SEQ ID NO: 1719293 - DNA, 14 bp, Homo sapiens
gcctggattcattt

SEQ ID NO: 1719294 - DNA, 21 bp, Homo sapiens
gcctggattcatttcctgccc

SEQ ID NO: 1719295 - DNA, 13 bp, Homo sapiens
gcctggcacagga

SEQ ID NO: 1719296 - DNA, 17 bp, Homo sapiens
gcctggcacaggactga

SEQ ID NO: 1719297 - DNA, 14 bp, Homo sapiens
gcctggcacagggc

SEQ ID NO: 1719298 - DNA, 20 bp, Homo sapiens
gcctggcagtccgtgggacg

SEQ ID NO: 1719299 - DNA, 17 bp, Homo sapiens
gcctggcatcttctgga

SEQ ID NO: 1719300 - DNA, 17 bp, Homo sapiens
gcctggcatggcacctg

SEQ ID NO: 1719301 - DNA, 17 bp, Homo sapiens
gcctggccaatgcggcc

SEQ ID NO: 1719302 - DNA, 17 bp, Homo sapiens
gcctggccacctctctc

SEQ ID NO: 1719303 - DNA, 18 bp, Homo sapiens
gcctggccacctctctcc

SEQ ID NO: 1719304 - DNA, 19 bp, Homo sapiens
gcctggccacctctctcct

SEQ ID NO: 1719305 - DNA, 20 bp, Homo sapiens
gcctggccacgcagccagga

SEQ ID NO: 1719306 - DNA, 22 bp, Homo sapiens
gcctggccacgcagccaggaca

SEQ ID NO: 1719307 - DNA, 23 bp, Homo sapiens
gcctggccacgcagccaggacac

SEQ ID NO: 1719308 - DNA, 20 bp, Homo sapiens
gcctggccagacacaggccc

SEQ ID NO: 1719309 - DNA, 15 bp, Homo sapiens
gcctggccaggagca

SEQ ID NO: 1719310 - DNA, 12 bp, Homo sapiens
gcctggccaggc

SEQ ID NO: 1719311 - DNA, 15 bp, Homo sapiens
gcctggccaggcaga

SEQ ID NO: 1719312 - DNA, 13 bp, Homo sapiens
gcctggccaggcc

SEQ ID NO: 1719313 - DNA, 23 bp, Homo sapiens
gcctggccaggccctgggtcttg

SEQ ID NO: 1719314 - DNA, 13 bp, Homo sapiens
gcctggccagtcc

SEQ ID NO: 1719315 - DNA, 13 bp, Homo sapiens
gcctggcccccaa

SEQ ID NO: 1719316 - DNA, 20 bp, Homo sapiens
gcctggcccccaacctcagg

SEQ ID NO: 1719317 - DNA, 18 bp, Homo sapiens
gcctggccgttcagcctg

SEQ ID NO: 1719318 - DNA, 14 bp, Homo sapiens
gcctggcctccagc

SEQ ID NO: 1719319 - DNA, 17 bp, Homo sapiens
gcctggcctccagctcc

SEQ ID NO: 1719320 - DNA, 19 bp, Homo sapiens
gcctggcctccagctccca

SEQ ID NO: 1719321 - DNA, 13 bp, Homo sapiens
gcctggcctctgg

SEQ ID NO: 1719322 - DNA, 15 bp, Homo sapiens
gcctggcctctgggc

SEQ ID NO: 1719323 - DNA, 21 bp, Homo sapiens
gcctggcctctgggcagtgtg

SEQ ID NO: 1719324 - DNA, 11 bp, Homo sapiens
gcctggcctga

SEQ ID NO: 1719325 - DNA, 15 bp, Homo sapiens
gcctggcctgagctg

SEQ ID NO: 1719326 - DNA, 18 bp, Homo sapiens
gcctggcctgagctgggg

SEQ ID NO: 1719327 - DNA, 20 bp, Homo sapiens
gcctggcctgagctggggcc

SEQ ID NO: 1719328 - DNA, 12 bp, Homo sapiens
gcctggcctgat

SEQ ID NO: 1719329 - DNA, 13 bp, Homo sapiens
gcctggcctggct

SEQ ID NO: 1719330 - DNA, 21 bp, Homo sapiens
gcctggcgaaaccccatctct

SEQ ID NO: 1719331 - DNA, 22 bp, Homo sapiens
gcctggctccccacgagtcacc

SEQ ID NO: 1719332 - DNA, 23 bp, Homo sapiens
gcctggctccccacgagtcacct

SEQ ID NO: 1719333 - DNA, 16 bp, Homo sapiens
gcctggctctgccccc

SEQ ID NO: 1719334 - DNA, 23 bp, Homo sapiens
gcctggctctgccccctccccca

SEQ ID NO: 1719335 - DNA, 13 bp, Homo sapiens
gcctggctgtgga

SEQ ID NO: 1719336 - DNA, 20 bp, Homo sapiens
gcctggctgtggaggcctga

SEQ ID NO: 1719337 - DNA, 13 bp, Homo sapiens
gcctggcttctgg

SEQ ID NO: 1719338 - DNA, 16 bp, Homo sapiens
gcctggcttctggagc

SEQ ID NO: 1719339 - DNA, 15 bp, Homo sapiens
gcctggcttgctcca

SEQ ID NO: 1719340 - DNA, 23 bp, Homo sapiens
gcctgggaatgtattattctgca

SEQ ID NO: 1719341 - DNA, 16 bp, Homo sapiens
gcctgggacccagcta

SEQ ID NO: 1719342 - DNA, 14 bp, Homo sapiens
gcctgggagcccag

SEQ ID NO: 1719343 - DNA, 20 bp, Homo sapiens
gcctgggcaacacagcgaga

SEQ ID NO: 1719344 - DNA, 20 bp, Homo sapiens
gcctgggcaacagagcaaga

SEQ ID NO: 1719345 - DNA, 19 bp, Homo sapiens
gcctgggcagcatagcaag

SEQ ID NO: 1719346 - DNA, 20 bp, Homo sapiens
gcctgggcagccaggctgcc

SEQ ID NO: 1719347 - DNA, 23 bp, Homo sapiens
gcctgggcagccaggctgccaag

SEQ ID NO: 1719348 - DNA, 20 bp, Homo sapiens
gcctgggccccagctcgcgg

SEQ ID NO: 1719349 - DNA, 20 bp, Homo sapiens
gcctgggcccggaagggctt

SEQ ID NO: 1719350 - DNA, 17 bp, Homo sapiens
gcctgggccgctgccac

SEQ ID NO: 1719351 - DNA, 14 bp, Homo sapiens
gcctgggcctcatg

SEQ ID NO: 1719352 - DNA, 17 bp, Homo sapiens
gcctgggcctgcttttc

SEQ ID NO: 1719353 - DNA, 17 bp, Homo sapiens
gcctgggcctgtgcagc

SEQ ID NO: 1719354 - DNA, 20 bp, Homo sapiens
gcctgggcgacagagcgaga

SEQ ID NO: 1719355 - DNA, 15 bp, Homo sapiens
gcctgggctcactgt

SEQ ID NO: 1719356 - DNA, 22 bp, Homo sapiens
gcctgggctcactgtgctgggg

SEQ ID NO: 1719357 - DNA, 13 bp, Homo sapiens
gcctggggacccc

SEQ ID NO: 1719358 - DNA, 21 bp, Homo sapiens
gcctggggatgtaaccaagct

SEQ ID NO: 1719359 - DNA, 18 bp, Homo sapiens
gcctggggctccctctct

SEQ ID NO: 1719360 - DNA, 19 bp, Homo sapiens
gccttcagcagcagctcac

SEQ ID NO: 1719361 - DNA, 12 bp, Homo sapiens
gccttcagccct

SEQ ID NO: 1719362 - DNA, 16 bp, Homo sapiens
gccttcagctctacag

SEQ ID NO: 1719363 - DNA, 19 bp, Homo sapiens
gccttcatcctcctcccca

SEQ ID NO: 1719364 - DNA, 16 bp, Homo sapiens
gccttcattctgcaag

SEQ ID NO: 1719365 - DNA, 19 bp, Homo sapiens
gccttccacgtcttcctcc

SEQ ID NO: 1719366 - DNA, 21 bp, Homo sapiens
gccttccagaaagcaggagca

SEQ ID NO: 1719367 - DNA, 19 bp, Homo sapiens
gccttccaggtggcgtgag

SEQ ID NO: 1719368 - DNA, 14 bp, Homo sapiens
gccttccataatta

SEQ ID NO: 1719369 - DNA, 19 bp, Homo sapiens
gccttcccaagttgtgctt

SEQ ID NO: 1719370 - DNA, 20 bp, Homo sapiens
gccttcccaagttgtgcttg

SEQ ID NO: 1719371 - DNA, 18 bp, Homo sapiens
gccttcccctcagccaca

SEQ ID NO: 1719372 - DNA, 18 bp, Homo sapiens
gccttccccttgcccagg

SEQ ID NO: 1719373 - DNA, 24 bp, Homo sapiens
gccttccccttttgcctggctgtg

SEQ ID NO: 1719374 - DNA, 20 bp, Homo sapiens
gccttcccttctctggtctc

SEQ ID NO: 1719375 - DNA, 23 bp, Homo sapiens
gccttccgggtctcgcagcctga

SEQ ID NO: 1719376 - DNA, 16 bp, Homo sapiens
gccttcctcatcccct

SEQ ID NO: 1719377 - DNA, 17 bp, Homo sapiens
gccttcctccacatcct

SEQ ID NO: 1719378 - DNA, 17 bp, Homo sapiens
gccttcctcctccacag

SEQ ID NO: 1719379 - DNA, 17 bp, Homo sapiens
gccttcctctctccaga

SEQ ID NO: 1719380 - DNA, 13 bp, Homo sapiens
gccttcctctgca

SEQ ID NO: 1719381 - DNA, 22 bp, Homo sapiens
gcctccctagttagcatccagg

SEQ ID NO: 1719382 - DNA, 19 bp, Homo sapiens
gcctccctccccagtgcaa

SEQ ID NO: 1719383 - DNA, 22 bp, Homo sapiens
gcctccctctcagaggcctgct

SEQ ID NO: 1719384 - DNA, 23 bp, Homo sapiens
gcctccctctcagaggcctgctg

SEQ ID NO: 1719385 - DNA, 24 bp, Homo sapiens
gcctccctctcagaggcctgctgc

SEQ ID NO: 1719386 - DNA, 13 bp, Homo sapiens
gcctccctctcca

SEQ ID NO: 1719387 - DNA, 14 bp, Homo sapiens
gcctccctctgacc

SEQ ID NO: 1719388 - DNA, 20 bp, Homo sapiens
gcctccctctgacctgcagg

SEQ ID NO: 1719389 - DNA, 21 bp, Homo sapiens
gcctccctctgacctgcaggc

SEQ ID NO: 1719390 - DNA, 13 bp, Homo sapiens
gcctccctgaagc

SEQ ID NO: 1719391 - DNA, 12 bp, Homo sapiens
gcctccctgcag

SEQ ID NO: 1719392 - DNA, 19 bp, Homo sapiens
gcctccctgtcactcagct

SEQ ID NO: 1719393 - DNA, 21 bp, Homo sapiens
gcctccctgtcactcagctga

SEQ ID NO: 1719394 - DNA, 22 bp, Homo sapiens
gcctccctgtcactcagctgag

SEQ ID NO: 1719395 - DNA, 15 bp, Homo sapiens
gcctccctgtctcca

SEQ ID NO: 1719396 - DNA, 20 bp, Homo sapiens
gcctccctgtctccagctgc

SEQ ID NO: 1719397 - DNA, 23 bp, Homo sapiens
gcctccctgtctccagctgcctg

SEQ ID NO: 1719398 - DNA, 19 bp, Homo sapiens
gcctcccttccatgcccca

SEQ ID NO: 1719399 - DNA, 20 bp, Homo sapiens
gcctcccttccatgccccag

SEQ ID NO: 1719400 - DNA, 22 bp, Homo sapiens
gcctcccttccatgccccagga

SEQ ID NO: 1719401 - DNA, 23 bp, Homo sapiens
gcctcccttccatgccccaggat

SEQ ID NO: 1719402 - DNA, 14 bp, Homo sapiens
gcctccgaggctcc

SEQ ID NO: 1719403 - DNA, 19 bp, Homo sapiens
gcctccgaggctccccgcc

SEQ ID NO: 1719404 - DNA, 23 bp, Homo sapiens
gcctccggcgtcttgcccagcag

SEQ ID NO: 1719405 - DNA, 18 bp, Homo sapiens
gcctccgtttatgggcct

SEQ ID NO: 1719406 - DNA, 21 bp, Homo sapiens
gcctccgtttatgggccttgc

SEQ ID NO: 1719407 - DNA, 23 bp, Homo sapiens
gcctccgtttatgggccttgctt

SEQ ID NO: 1719408 - DNA, 16 bp, Homo sapiens
gcctcctcacccccag

SEQ ID NO: 1719409 - DNA, 19 bp, Homo sapiens
gcctcctcacccccagctt

SEQ ID NO: 1719410 - DNA, 19 bp, Homo sapiens
gcctcctcagtgaaggtgg

SEQ ID NO: 1719411 - DNA, 17 bp, Homo sapiens
gcctcctcatcccgtgt

SEQ ID NO: 1719412 - DNA, 22 bp, Homo sapiens
gcctcctcatcccgtgttctcc

SEQ ID NO: 1719413 - DNA, 13 bp, Homo sapiens
gcctcctcctgac

SEQ ID NO: 1719414 - DNA, 23 bp, Homo sapiens
gcctcctctctcagtttttatat

SEQ ID NO: 1719415 - DNA, 16 bp, Homo sapiens
gcctcctctgtccagg

SEQ ID NO: 1719416 - DNA, 23 bp, Homo sapiens
gcctcctgagtagatgggactac

SEQ ID NO: 1719417 - DNA, 19 bp, Homo sapiens
gcctcctgagtagctggga

SEQ ID NO: 1719418 - DNA, 23 bp, Homo sapiens
gcctcctgcctgcccctctcccg

SEQ ID NO: 1719419 - DNA, 17 bp, Homo sapiens
gcctcctgtttgcaggc

SEQ ID NO: 1719420 - DNA, 15 bp, Homo sapiens
gcctccttcccatgc

SEQ ID NO: 1719421 - DNA, 18 bp, Homo sapiens
gcctccttcccatgcctg

SEQ ID NO: 1719422 - DNA, 14 bp, Homo sapiens
gcctccttctgttt

SEQ ID NO: 1719423 - DNA, 15 bp, Homo sapiens
gcctccttcttccac

SEQ ID NO: 1719424 - DNA, 20 bp, Homo sapiens
gcctccttgatatttgtatt

SEQ ID NO: 1719425 - DNA, 14 bp, Homo sapiens
gcctccttgtgcaa

SEQ ID NO: 1719426 - DNA, 12 bp, Homo sapiens
gcctcctttttt

SEQ ID NO: 1719427 - DNA, 14 bp, Homo sapiens
gcctcgcacaggcc

SEQ ID NO: 1719428 - DNA, 13 bp, Homo sapiens
gcctcggactcca

SEQ ID NO: 1719429 - DNA, 17 bp, Homo sapiens
gcctcggactccatggc

SEQ ID NO: 1719430 - DNA, 13 bp, Homo sapiens
gcctcggcccctc

SEQ ID NO: 1719431 - DNA, 18 bp, Homo sapiens
gcctcggcccctcccaca

SEQ ID NO: 1719432 - DNA, 16 bp, Homo sapiens
gcctcggcctcccaaa

SEQ ID NO: 1719433 - DNA, 23 bp, Homo sapiens
gcctcggcctcccaaagtgctgg

SEQ ID NO: 1719434 - DNA, 22 bp, Homo sapiens
gcctcggctaggggtcctcggg

SEQ ID NO: 1719435 - DNA, 15 bp, Homo sapiens
gcctcggtatctggc

SEQ ID NO: 1719436 - DNA, 19 bp, Homo sapiens
gcctcggtatctggcttcc

SEQ ID NO: 1719437 - DNA, 14 bp, Homo sapiens
gcctcgtgaggggc

SEQ ID NO: 1719438 - DNA, 16 bp, Homo sapiens
gcctcgtgaggggcaa

SEQ ID NO: 1719439 - DNA, 12 bp, Homo sapiens
gcctcgtgccag

SEQ ID NO: 1719440 - DNA, 15 bp, Homo sapiens
gcctcgtgccagcag

SEQ ID NO: 1719441 - DNA, 16 bp, Homo sapiens
gcctctaagagtgccc

SEQ ID NO: 1719442 - DNA, 20 bp, Homo sapiens
gcctctagtccccaaggcct

SEQ ID NO: 1719443 - DNA, 13 bp, Homo sapiens
gcctctcaagtag

SEQ ID NO: 1719444 - DNA, 15 bp, Homo sapiens
gcctctcacacacat

SEQ ID NO: 1719445 - DNA, 19 bp, Homo sapiens
gcctctcatcaactgaatg

SEQ ID NO: 1719446 - DNA, 17 bp, Homo sapiens
gcctctccaaccactgt

SEQ ID NO: 1719447 - DNA, 16 bp, Homo sapiens
gcctctccatttgctc

SEQ ID NO: 1719448 - DNA, 20 bp, Homo sapiens
gcctctcccgcaccaggccg

SEQ ID NO: 1719449 - DNA, 13 bp, Homo sapiens
gcctctcccggct

SEQ ID NO: 1719450 - DNA, 18 bp, Homo sapiens
gcctctcccggctgcctg

SEQ ID NO: 1719451 - DNA, 18 bp, Homo sapiens
gcctctcctccacagccc

SEQ ID NO: 1719452 - DNA, 14 bp, Homo sapiens
gcctctcctgccct

SEQ ID NO: 1719453 - DNA, 18 bp, Homo sapiens
gcctctcctgccctctgc

SEQ ID NO: 1719454 - DNA, 13 bp, Homo sapiens
gcctctctagcac

SEQ ID NO: 1719455 - DNA, 20 bp, Homo sapiens
gcctctctatcctctcttcc

SEQ ID NO: 1719456 - DNA, 23 bp, Homo sapiens
gcctctctatcctctcttcctct

SEQ ID NO: 1719457 - DNA, 14 bp, Homo sapiens
gcctctctccttgg

SEQ ID NO: 1719458 - DNA, 21 bp, Homo sapiens
gcctctctccttggccacaga

SEQ ID NO: 1719459 - DNA, 22 bp, Homo sapiens
gcctctctccttggccacagac

SEQ ID NO: 1719460 - DNA, 23 bp, Homo sapiens
gcctctctccttggccacagact

SEQ ID NO: 1719461 - DNA, 16 bp, Homo sapiens
gcctctctctgcctga

SEQ ID NO: 1719462 - DNA, 12 bp, Homo sapiens
gcctctctggcc

SEQ ID NO: 1719463 - DNA, 13 bp, Homo sapiens
gcctctctggcct

SEQ ID NO: 1719464 - DNA, 14 bp, Homo sapiens
gcctctctggcctc

SEQ ID NO: 1719465 - DNA, 18 bp, Homo sapiens
gcctctctggcctcccac

SEQ ID NO: 1719466 - DNA, 19 bp, Homo sapiens
gcctctcttggtttccttc

SEQ ID NO: 1719467 - DNA, 22 bp, Homo sapiens
gcctctgacagtccacaggggc

SEQ ID NO: 1719468 - DNA, 15 bp, Homo sapiens
gcctctgagatttgg

SEQ ID NO: 1719469 - DNA, 18 bp, Homo sapiens
gcctctgatatgggactg

SEQ ID NO: 1719470 - DNA, 23 bp, Homo sapiens
gcctctgatatgggactgagcct

SEQ ID NO: 1719471 - DNA, 20 bp, Homo sapiens
gcctctgcaactgctcagct

SEQ ID NO: 1719472 - DNA, 16 bp, Homo sapiens
gcctctgccaggcctg

SEQ ID NO: 1719473 - DNA, 11 bp, Homo sapiens
gcctctgcctg

SEQ ID NO: 1719474 - DNA, 12 bp, Homo sapiens
gcctctgcctgc

SEQ ID NO: 1719475 - DNA, 14 bp, Homo sapiens
gcctctgcctggga

SEQ ID NO: 1719476 - DNA, 17 bp, Homo sapiens
gcctctggactggcctg

SEQ ID NO: 1719477 - DNA, 13 bp, Homo sapiens
gcctctggatcta

SEQ ID NO: 1719478 - DNA, 12 bp, Homo sapiens
gcctctggccag

SEQ ID NO: 1719479 - DNA, 15 bp, Homo sapiens
gcctctggccaggca

SEQ ID NO: 1719480 - DNA, 16 bp, Homo sapiens
gcctctggccgccacc

SEQ ID NO: 1719481 - DNA, 12 bp, Homo sapiens
gcctctgggact

SEQ ID NO: 1719482 - DNA, 13 bp, Homo sapiens
gcctctgggccat

SEQ ID NO: 1719483 - DNA, 15 bp, Homo sapiens
gcctctgtccccttc

SEQ ID NO: 1719484 - DNA, 21 bp, Homo sapiens
gcctctgtccccttctctcat

SEQ ID NO: 1719485 - DNA, 22 bp, Homo sapiens
gcctctgtccccttctctcatc

SEQ ID NO: 1719486 - DNA, 11 bp, Homo sapiens
gcctctgtgct

SEQ ID NO: 1719487 - DNA, 17 bp, Homo sapiens
gcctctgtgctgtgtgt

SEQ ID NO: 1719488 - DNA, 18 bp, Homo sapiens
gcctctgtgctgtgtgtg

SEQ ID NO: 1719489 - DNA, 20 bp, Homo sapiens
gcctcttagtgattgtgtct

SEQ ID NO: 1719490 - DNA, 16 bp, Homo sapiens
gcgatctctcctggcc

SEQ ID NO: 1719491 - DNA, 14 bp, Homo sapiens
gcgatgtgcaggaa

SEQ ID NO: 1719492 - DNA, 19 bp, Homo sapiens
gcgatgtgcaggaagaaaa

SEQ ID NO: 1719493 - DNA, 21 bp, Homo sapiens
gcgattctcccgcctcagcct

SEQ ID NO: 1719494 - DNA, 23 bp, Homo sapiens
gcgattctcctgcctcagcctcc

SEQ ID NO: 1719495 - DNA, 23 bp, Homo sapiens
gcgcaagcctgtaatcccagcta

SEQ ID NO: 1719496 - DNA, 13 bp, Homo sapiens
gcgcaaggcactt

SEQ ID NO: 1719497 - DNA, 17 bp, Homo sapiens
gcgcacaaggctgacca

SEQ ID NO: 1719498 - DNA, 17 bp, Homo sapiens
gcgcacctgccccctgg

SEQ ID NO: 1719499 - DNA, 18 bp, Homo sapiens
gcgcacctgccccctggt

SEQ ID NO: 1719500 - DNA, 19 bp, Homo sapiens
gcgcacctgccccctggtg

SEQ ID NO: 1719501 - DNA, 22 bp, Homo sapiens
gcgcagagccctccaggcctgc

SEQ ID NO: 1719502 - DNA, 18 bp, Homo sapiens
gcgcaggtctcttctggg

SEQ ID NO: 1719503 - DNA, 21 bp, Homo sapiens
gcgcaggtgccatgcctgctc

SEQ ID NO: 1719504 - DNA, 18 bp, Homo sapiens
gcgcagtgcttctctaca

SEQ ID NO: 1719505 - DNA, 19 bp, Homo sapiens
gcgcatgtaatcccagcta

SEQ ID NO: 1719506 - DNA, 22 bp, Homo sapiens
gcgccactacactccagcctga

SEQ ID NO: 1719507 - DNA, 17 bp, Homo sapiens
gcgccagcacagaaaca

SEQ ID NO: 1719508 - DNA, 13 bp, Homo sapiens
gcgccagctcctt

SEQ ID NO: 1719509 - DNA, 17 bp, Homo sapiens
gcgccaggcagagctga

SEQ ID NO: 1719510 - DNA, 13 bp, Homo sapiens
gcgccagtcctgc

SEQ ID NO: 1719511 - DNA, 16 bp, Homo sapiens
gcgccattgcactcca

SEQ ID NO: 1719512 - DNA, 20 bp, Homo sapiens
gcgccattgcactccagcct

SEQ ID NO: 1719513 - DNA, 17 bp, Homo sapiens
gcgcccacccaggtccc

SEQ ID NO: 1719514 - DNA, 19 bp, Homo sapiens
gcgcccattcgtctgtccc

SEQ ID NO: 1719515 - DNA, 13 bp, Homo sapiens
gcgcccccagtgt

SEQ ID NO: 1719516 - DNA, 22 bp, Homo sapiens
gcgccccctccgccctgccact

SEQ ID NO: 1719517 - DNA, 14 bp, Homo sapiens
gcgccccgccccca

SEQ ID NO: 1719518 - DNA, 17 bp, Homo sapiens
gcgccccgcccccaccc

SEQ ID NO: 1719519 - DNA, 13 bp, Homo sapiens
gcgccccttcccc

SEQ ID NO: 1719520 - DNA, 13 bp, Homo sapiens
gcgcccgctgggc

SEQ ID NO: 1719521 - DNA, 14 bp, Homo sapiens
gcgcccgctgggct

SEQ ID NO: 1719522 - DNA, 16 bp, Homo sapiens
gcgcccgctgggctga

SEQ ID NO: 1719523 - DNA, 14 bp, Homo sapiens
gcgccctctctgct

SEQ ID NO: 1719524 - DNA, 13 bp, Homo sapiens
gcgccctggaagc

SEQ ID NO: 1719525 - DNA, 16 bp, Homo sapiens
gcgcccttggcttctg

SEQ ID NO: 1719526 - DNA, 20 bp, Homo sapiens
gcgcccttgtgccctgcctc

SEQ ID NO: 1719527 - DNA, 17 bp, Homo sapiens
gcgccgatgccaccggc

SEQ ID NO: 1719528 - DNA, 22 bp, Homo sapiens
gcgccgccgccgcgcgcccctg

SEQ ID NO: 1719529 - DNA, 13 bp, Homo sapiens
gcgccgtctccag

SEQ ID NO: 1719530 - DNA, 15 bp, Homo sapiens
gcgccgtctccaggg

SEQ ID NO: 1719531 - DNA, 21 bp, Homo sapiens
gcgcctagtggggtctccctc

SEQ ID NO: 1719532 - DNA, 19 bp, Homo sapiens
gcgcctccatccaaggcca

SEQ ID NO: 1719533 - DNA, 22 bp, Homo sapiens
gcgcctccttccttgctgtcct

SEQ ID NO: 1719534 - DNA, 18 bp, Homo sapiens
gcgcctcgttctctgggt

SEQ ID NO: 1719535 - DNA, 23 bp, Homo sapiens
gcgccttctcggagctggcccag

SEQ ID NO: 1719536 - DNA, 23 bp, Homo sapiens
gcgcgcatgtaatcccagctact

SEQ ID NO: 1719537 - DNA, 11 bp, Homo sapiens
gcgcgctgtgg

SEQ ID NO: 1719538 - DNA, 16 bp, Homo sapiens
gcgcgggaggcaccag

SEQ ID NO: 1719539 - DNA, 16 bp, Homo sapiens
gcgcgggcagccaccc

SEQ ID NO: 1719540 - DNA, 15 bp, Homo sapiens
gcgcgtatcaccata

SEQ ID NO: 1719541 - DNA, 13 bp, Homo sapiens
gcgctacccactt

SEQ ID NO: 1719542 - DNA, 20 bp, Homo sapiens
gcgctattgcactccagtct

SEQ ID NO: 1719543 - DNA, 23 bp, Homo sapiens
gcgctcacctgcagcccctcctc

SEQ ID NO: 1719544 - DNA, 14 bp, Homo sapiens
gcgctcagacggcg

SEQ ID NO: 1719545 - DNA, 14 bp, Homo sapiens
gcgctcaggaccca

SEQ ID NO: 1719546 - DNA, 16 bp, Homo sapiens
gcgctcaggacccagg

SEQ ID NO: 1719547 - DNA, 12 bp, Homo sapiens
gcgctctcaaga

SEQ ID NO: 1719548 - DNA, 17 bp, Homo sapiens
gcgctctcaagaccaga

SEQ ID NO: 1719549 - DNA, 20 bp, Homo sapiens
gcgctctcaagaccagagac

SEQ ID NO: 1719550 - DNA, 12 bp, Homo sapiens
gcgctctcccta

SEQ ID NO: 1719551 - DNA, 16 bp, Homo sapiens
gcgctctccctacctt

SEQ ID NO: 1719552 - DNA, 20 bp, Homo sapiens
gcgctctccctaccttgcct

SEQ ID NO: 1719553 - DNA, 17 bp, Homo sapiens
gcgctcttggtccctgg

SEQ ID NO: 1719554 - DNA, 18 bp, Homo sapiens
gcgctcttggtccctggt

SEQ ID NO: 1719555 - DNA, 11 bp, Homo sapiens
gcgctgcaaat

SEQ ID NO: 1719556 - DNA, 13 bp, Homo sapiens
gcgctgcagcctc

SEQ ID NO: 1719557 - DNA, 16 bp, Homo sapiens
gcgctgccgcacccca

SEQ ID NO: 1719558 - DNA, 11 bp, Homo sapiens
gcgctgcctgg

SEQ ID NO: 1719559 - DNA, 14 bp, Homo sapiens
gcgctgcctggcca

SEQ ID NO: 1719560 - DNA, 15 bp, Homo sapiens
gcgctgcctggccag

SEQ ID NO: 1719561 - DNA, 10 bp, Homo sapiens
gcgctgctaa

SEQ ID NO: 1719562 - DNA, 14 bp, Homo sapiens
gcgctggcccagcc

SEQ ID NO: 1719563 - DNA, 14 bp, Homo sapiens
gcgctggctccctg

SEQ ID NO: 1719564 - DNA, 19 bp, Homo sapiens
gcgctggctccctgggcag

SEQ ID NO: 1719565 - DNA, 13 bp, Homo sapiens
gcgctggtggacc

SEQ ID NO: 1719566 - DNA, 17 bp, Homo sapiens
gcgctggtggaccacag

SEQ ID NO: 1719567 - DNA, 14 bp, Homo sapiens
gcgcttcccagcac

SEQ ID NO: 1719568 - DNA, 12 bp, Homo sapiens
gcgcttccctgg

SEQ ID NO: 1719569 - DNA, 20 bp, Homo sapiens
gcggaagccaaaggcagcta

SEQ ID NO: 1719570 - DNA, 16 bp, Homo sapiens
gcggagagagccaaga

SEQ ID NO: 1719571 - DNA, 13 bp, Homo sapiens
gcggagcccagcc

SEQ ID NO: 1719572 - DNA, 18 bp, Homo sapiens
gcggagccggcacctaca

SEQ ID NO: 1719573 - DNA, 19 bp, Homo sapiens
gcggaggaaagcaagtgtt

SEQ ID NO: 1719574 - DNA, 22 bp, Homo sapiens
gcggaggagaccagctcagagg

SEQ ID NO: 1719575 - DNA, 23 bp, Homo sapiens
gcggaggcgctcctccctgcctc

SEQ ID NO: 1719576 - DNA, 18 bp, Homo sapiens
gcggaggggatccagcca

SEQ ID NO: 1719577 - DNA, 21 bp, Homo sapiens
gcggaggggatccagccactt

SEQ ID NO: 1719578 - DNA, 20 bp, Homo sapiens
gcggaggtctctgggagccc

SEQ ID NO: 1719579 - DNA, 24 bp, Homo sapiens
gccggggtgtaacttcctgctgca

SEQ ID NO: 1719580 - DNA, 18 bp, Homo sapiens
gccgggttctagtctcct

SEQ ID NO: 1719581 - DNA, 17 bp, Homo sapiens
gccggtaactgtcctgt

SEQ ID NO: 1719582 - DNA, 12 bp, Homo sapiens
gccggtcatttt

SEQ ID NO: 1719583 - DNA, 18 bp, Homo sapiens
gccggtcgggcagccagc

SEQ ID NO: 1719584 - DNA, 18 bp, Homo sapiens
gccggtgcacaggcctct

SEQ ID NO: 1719585 - DNA, 19 bp, Homo sapiens
gccggtgcacaggcctctg

SEQ ID NO: 1719586 - DNA, 15 bp, Homo sapiens
gccggtgctgggttc

SEQ ID NO: 1719587 - DNA, 13 bp, Homo sapiens
gccgtaatttaac

SEQ ID NO: 1719588 - DNA, 22 bp, Homo sapiens
gccatctgactgccaagccaga

SEQ ID NO: 1719589 - DNA, 12 bp, Homo sapiens
gccatctgccca

SEQ ID NO: 1719590 - DNA, 12 bp, Homo sapiens
gccatctgtgtg

SEQ ID NO: 1719591 - DNA, 19 bp, Homo sapiens
gccatgaggagcgtggact

SEQ ID NO: 1719592 - DNA, 20 bp, Homo sapiens
gccatgaggagttgctgttt

SEQ ID NO: 1719593 - DNA, 15 bp, Homo sapiens
gccatgatggcctta

SEQ ID NO: 1719594 - DNA, 21 bp, Homo sapiens
gccatgcaggaagaggcccac

SEQ ID NO: 1719595 - DNA, 14 bp, Homo sapiens
gccatgccaccctg

SEQ ID NO: 1719596 - DNA, 13 bp, Homo sapiens
gccatgccactgc

SEQ ID NO: 1719597 - DNA, 23 bp, Homo sapiens
gccatgccactgccaggcacctg

SEQ ID NO: 1719598 - DNA, 18 bp, Homo sapiens
gccatgccaggaacctgt

SEQ ID NO: 1719599 - DNA, 13 bp, Homo sapiens
gccatgcctgctc

SEQ ID NO: 1719600 - DNA, 16 bp, Homo sapiens
gccatgcctgctccct

SEQ ID NO: 1719601 - DNA, 20 bp, Homo sapiens
gccatgcctgctccctgtct

SEQ ID NO: 1719602 - DNA, 21 bp, Homo sapiens
gccatgcctgctccctgtctg

SEQ ID NO: 1719603 - DNA, 22 bp, Homo sapiens
gccatgcctgctccctgtctgt

SEQ ID NO: 1719604 - DNA, 23 bp, Homo sapiens
gccatgcctgctccctgtctgtg

SEQ ID NO: 1719605 - DNA, 21 bp, Homo sapiens
gccatgctgaggcctgggccg

SEQ ID NO: 1719606 - DNA, 13 bp, Homo sapiens
gccatgctgggcc

SEQ ID NO: 1719607 - DNA, 19 bp, Homo sapiens
gccatggatttccactgct

SEQ ID NO: 1719608 - DNA, 12 bp, Homo sapiens
gccatggcctct

SEQ ID NO: 1719609 - DNA, 21 bp, Homo sapiens
gccatggcctgtgctgggcca

SEQ ID NO: 1719610 - DNA, 22 bp, Homo sapiens
gccatggcgtgtccctctcgga

SEQ ID NO: 1719611 - DNA, 12 bp, Homo sapiens
gccatgggcctg

SEQ ID NO: 1719612 - DNA, 14 bp, Homo sapiens
gccatgggcctggg

SEQ ID NO: 1719613 - DNA, 16 bp, Homo sapiens
gccatgggcctgggcc

SEQ ID NO: 1719614 - DNA, 17 bp, Homo sapiens
gccatgggcctgggcct

SEQ ID NO: 1719615 - DNA, 18 bp, Homo sapiens
gccatgggcctgggcctg

SEQ ID NO: 1719616 - DNA, 20 bp, Homo sapiens
gccatgggcctgggcctgct

SEQ ID NO: 1719617 - DNA, 16 bp, Homo sapiens
gccatgggtggaaagt

SEQ ID NO: 1719618 - DNA, 22 bp, Homo sapiens
gccatgtaaatccccactggga

SEQ ID NO: 1719619 - DNA, 14 bp, Homo sapiens
gccatgtaaggttg

SEQ ID NO: 1719620 - DNA, 15 bp, Homo sapiens
gccatgtactagttt

SEQ ID NO: 1719621 - DNA, 17 bp, Homo sapiens
gccatgtactagtttta

SEQ ID NO: 1719622 - DNA, 19 bp, Homo sapiens
gccatgtactcaagtacca

SEQ ID NO: 1719623 - DNA, 15 bp, Homo sapiens
gccatgtccaaagag

SEQ ID NO: 1719624 - DNA, 18 bp, Homo sapiens
gccatgtccaaagaggct

SEQ ID NO: 1719625 - DNA, 19 bp, Homo sapiens
gccatgtccaaagaggctg

SEQ ID NO: 1719626 - DNA, 23 bp, Homo sapiens
gccatgtctgcagtgtgcccccc

SEQ ID NO: 1719627 - DNA, 18 bp, Homo sapiens
gccatgtgagccaccgct

SEQ ID NO: 1719628 - DNA, 23 bp, Homo sapiens
gccatgtggaaggcaagccaggc

SEQ ID NO: 1719629 - DNA, 23 bp, Homo sapiens
gccatgtttagtgaatgactttt

SEQ ID NO: 1719630 - DNA, 20 bp, Homo sapiens
gccatgtttggttgtaaatg

SEQ ID NO: 1719631 - DNA, 13 bp, Homo sapiens
gccattaccatgg

SEQ ID NO: 1719632 - DNA, 22 bp, Homo sapiens
gccattagactgaatttaacta

SEQ ID NO: 1719633 - DNA, 16 bp, Homo sapiens
gccattctcttgcatt

SEQ ID NO: 1719634 - DNA, 18 bp, Homo sapiens
gccattctcttgcattgt

SEQ ID NO: 1719635 - DNA, 23 bp, Homo sapiens
gccattctgcctcagcctcctga

SEQ ID NO: 1719636 - DNA, 20 bp, Homo sapiens
gccattcttctggtgctact

SEQ ID NO: 1719637 - DNA, 18 bp, Homo sapiens
gccattgcactccagcct

SEQ ID NO: 1719638 - DNA, 21 bp, Homo sapiens
gccattgcactccagcctggg

SEQ ID NO: 1719639 - DNA, 15 bp, Homo sapiens
gccattgcttacctt

SEQ ID NO: 1719640 - DNA, 16 bp, Homo sapiens
gccattgggaccctcc

SEQ ID NO: 1719641 - DNA, 19 bp, Homo sapiens
gccattgtactccagcctg

SEQ ID NO: 1719642 - DNA, 22 bp, Homo sapiens
gccatttaagtatcttgtgctt

SEQ ID NO: 1719643 - DNA, 21 bp, Homo sapiens
gccatttagaatctagaaatg

SEQ ID NO: 1719644 - DNA, 22 bp, Homo sapiens
gccatttagaatctagaaatgt

SEQ ID NO: 1719645 - DNA, 16 bp, Homo sapiens
gccatttatttattga

SEQ ID NO: 1719646 - DNA, 14 bp, Homo sapiens
gccatttccccctc

SEQ ID NO: 1719647 - DNA, 22 bp, Homo sapiens
gccatttcctcacgtgcaggac

SEQ ID NO: 1719648 - DNA, 12 bp, Homo sapiens
gccatttctctg

SEQ ID NO: 1719649 - DNA, 13 bp, Homo sapiens
gccatttctctgc

SEQ ID NO: 1719650 - DNA, 11 bp, Homo sapiens
gccatttgaga

SEQ ID NO: 1719651 - DNA, 14 bp, Homo sapiens
gccatttggtagat

SEQ ID NO: 1719652 - DNA, 18 bp, Homo sapiens
gccatttttctataaatc

SEQ ID NO: 1719653 - DNA, 17 bp, Homo sapiens
gcccaaaacccagggca

SEQ ID NO: 1719654 - DNA, 18 bp, Homo sapiens
gcccaaaacccagggcaa

SEQ ID NO: 1719655 - DNA, 14 bp, Homo sapiens
gcccaaaatttgat

SEQ ID NO: 1719656 - DNA, 19 bp, Homo sapiens
gcccaaccatcggtccaca

SEQ ID NO: 1719657 - DNA, 20 bp, Homo sapiens
gcccaagacagatgccccag

SEQ ID NO: 1719658 - DNA, 23 bp, Homo sapiens
gcccaagacagatgccccagagc

SEQ ID NO: 1719659 - DNA, 20 bp, Homo sapiens
gcccaagaggactgagactg

SEQ ID NO: 1719660 - DNA, 19 bp, Homo sapiens
gcccaagaggtctgagccc

SEQ ID NO: 1719661 - DNA, 17 bp, Homo sapiens
gcccaagccagaggctg

SEQ ID NO: 1719662 - DNA, 23 bp, Homo sapiens
gcccaagccagaggctgggttca

SEQ ID NO: 1719663 - DNA, 17 bp, Homo sapiens
gcccgtggggtctgcgc

SEQ ID NO: 1719664 - DNA, 23 bp, Homo sapiens
gcccgtggtggcggtggctgccc

SEQ ID NO: 1719665 - DNA, 23 bp, Homo sapiens
gcccgtgtagtccccaaccgtgt

SEQ ID NO: 1719666 - DNA, 13 bp, Homo sapiens
gcccgtgtgtgtg

SEQ ID NO: 1719667 - DNA, 18 bp, Homo sapiens
gccctaaatagcagaaag

SEQ ID NO: 1719668 - DNA, 16 bp, Homo sapiens
gccctaacctgacaga

SEQ ID NO: 1719669 - DNA, 14 bp, Homo sapiens
gccctaagccccca

SEQ ID NO: 1719670 - DNA, 16 bp, Homo sapiens
gccctaagcccccagg

SEQ ID NO: 1719671 - DNA, 20 bp, Homo sapiens
gccctaagcccccagggcct

SEQ ID NO: 1719672 - DNA, 14 bp, Homo sapiens
gccctaagggactt

SEQ ID NO: 1719673 - DNA, 13 bp, Homo sapiens
gccctaccagcgc

SEQ ID NO: 1719674 - DNA, 23 bp, Homo sapiens
gccctaccagcgcccgctgggct

SEQ ID NO: 1719675 - DNA, 13 bp, Homo sapiens
gccctactccact

SEQ ID NO: 1719676 - DNA, 14 bp, Homo sapiens
gccctactccactg

SEQ ID NO: 1719677 - DNA, 22 bp, Homo sapiens
gccctactccactgccctggca

SEQ ID NO: 1719678 - DNA, 17 bp, Homo sapiens
gccctactccctgcaga

SEQ ID NO: 1719679 - DNA, 20 bp, Homo sapiens
gccctactccctgcagatgc

SEQ ID NO: 1719680 - DNA, 17 bp, Homo sapiens
gccctagagcacactgt

SEQ ID NO: 1719681 - DNA, 19 bp, Homo sapiens
gccctagagcacactgtag

SEQ ID NO: 1719682 - DNA, 21 bp, Homo sapiens
gccctagagcacactgtagca

SEQ ID NO: 1719683 - DNA, 15 bp, Homo sapiens
gccctagaggcgagc

SEQ ID NO: 1719684 - DNA, 15 bp, Homo sapiens
gccctagctgacccc

SEQ ID NO: 1719685 - DNA, 15 bp, Homo sapiens
gccctagctgtccca

SEQ ID NO: 1719686 - DNA, 14 bp, Homo sapiens
gccctaggcctggc

SEQ ID NO: 1719687 - DNA, 14 bp, Homo sapiens
gccctatttctatg

SEQ ID NO: 1719688 - DNA, 19 bp, Homo sapiens
gccctcaaacttgactcta

SEQ ID NO: 1719689 - DNA, 15 bp, Homo sapiens
gccctcacatcttcc

SEQ ID NO: 1719690 - DNA, 19 bp, Homo sapiens
gccctcaccaccacactac

SEQ ID NO: 1719691 - DNA, 16 bp, Homo sapiens
gccctggagccagggc

SEQ ID NO: 1719692 - DNA, 20 bp, Homo sapiens
gccctggaggtctccagggg

SEQ ID NO: 1719693 - DNA, 10 bp, Homo sapiens
gccctggcaa

SEQ ID NO: 1719694 - DNA, 20 bp, Homo sapiens
gccctggcacccccacaagc

SEQ ID NO: 1719695 - DNA, 13 bp, Homo sapiens
gccctggccagga

SEQ ID NO: 1719696 - DNA, 13 bp, Homo sapiens
gccctggccctga

SEQ ID NO: 1719697 - DNA, 18 bp, Homo sapiens
gccctggccctgaggtgt

SEQ ID NO: 1719698 - DNA, 18 bp, Homo sapiens
gccctggccctgcccagc

SEQ ID NO: 1719699 - DNA, 20 bp, Homo sapiens
gccctggctcccacaggccc

SEQ ID NO: 1719700 - DNA, 17 bp, Homo sapiens
gccctggctgctgcccc

SEQ ID NO: 1719701 - DNA, 22 bp, Homo sapiens
gccctggctgctgcccccaccc

SEQ ID NO: 1719702 - DNA, 23 bp, Homo sapiens
gccctggctgttctgtggttcct

SEQ ID NO: 1719703 - DNA, 19 bp, Homo sapiens
gccctgggcacccacctcc

SEQ ID NO: 1719704 - DNA, 18 bp, Homo sapiens
gccctgggccccaccacc

SEQ ID NO: 1719705 - DNA, 20 bp, Homo sapiens
gccctgggccccaccaccta

SEQ ID NO: 1719706 - DNA, 22 bp, Homo sapiens
gccctgggccccaccacctagg

SEQ ID NO: 1719707 - DNA, 18 bp, Homo sapiens
gccctgggcgagcccctc

SEQ ID NO: 1719708 - DNA, 20 bp, Homo sapiens
gccctggggatcttcccaca

SEQ ID NO: 1719709 - DNA, 21 bp, Homo sapiens
gccctggggatcttcccacag

SEQ ID NO: 1719710 - DNA, 22 bp, Homo sapiens
gccctggggatcttcccacagg

SEQ ID NO: 1719711 - DNA, 18 bp, Homo sapiens
gccctggggtggcgtctg

SEQ ID NO: 1719712 - DNA, 17 bp, Homo sapiens
gccctggtccagggaag

SEQ ID NO: 1719713 - DNA, 16 bp, Homo sapiens
gccctggtcctggcct

SEQ ID NO: 1719714 - DNA, 13 bp, Homo sapiens
gccctggtggaga

SEQ ID NO: 1719715 - DNA, 18 bp, Homo sapiens
gccctggtggagaaagca

SEQ ID NO: 1719716 - DNA, 17 bp, Homo sapiens
gccctggttagctgaca

SEQ ID NO: 1719717 - DNA, 18 bp, Homo sapiens
gccctggttagctgacag

SEQ ID NO: 1719718 - DNA, 14 bp, Homo sapiens
gccctggttcctgc

SEQ ID NO: 1719719 - DNA, 20 bp, Homo sapiens
gccctggttcctgctgtcct

SEQ ID NO: 1719720 - DNA, 20 bp, Homo sapiens
gccctgtgcctgggccctgg

SEQ ID NO: 1719721 - DNA, 21 bp, Homo sapiens
gccctgtggagtccagctcta

SEQ ID NO: 1719722 - DNA, 23 bp, Homo sapiens
gccctgtggagtccagctctact

SEQ ID NO: 1719723 - DNA, 13 bp, Homo sapiens
gccctgtggccgc

SEQ ID NO: 1719724 - DNA, 13 bp, Homo sapiens
gccctgtgtgcag

SEQ ID NO: 1719725 - DNA, 15 bp, Homo sapiens
gccctgttccctgga

SEQ ID NO: 1719726 - DNA, 16 bp, Homo sapiens
gccctgttccctggag

SEQ ID NO: 1719727 - DNA, 14 bp, Homo sapiens
gcccttaccttccc

SEQ ID NO: 1719728 - DNA, 20 bp, Homo sapiens
gcccttacctttcctgatgc

SEQ ID NO: 1719729 - DNA, 19 bp, Homo sapiens
gcccttatgcccggcgccg

SEQ ID NO: 1719730 - DNA, 17 bp, Homo sapiens
gcccttattttcaagaa

SEQ ID NO: 1719731 - DNA, 18 bp, Homo sapiens
gcccttattttcaagaaa

SEQ ID NO: 1719732 - DNA, 14 bp, Homo sapiens
gcccttcactgcca

SEQ ID NO: 1719733 - DNA, 17 bp, Homo sapiens
gcccttcactgccatga

SEQ ID NO: 1719734 - DNA, 16 bp, Homo sapiens
gcccttcagcccacca

SEQ ID NO: 1719735 - DNA, 20 bp, Homo sapiens
gcccttcagcccaccaccct

SEQ ID NO: 1719736 - DNA, 21 bp, Homo sapiens
gcccttcagcccaccaccctg

SEQ ID NO: 1719737 - DNA, 15 bp, Homo sapiens
gcccttccaaactct

SEQ ID NO: 1719738 - DNA, 20 bp, Homo sapiens
gcccttccatgtgcctttct

SEQ ID NO: 1719739 - DNA, 18 bp, Homo sapiens
gcccttcccctcccccac

SEQ ID NO: 1719740 - DNA, 12 bp, Homo sapiens
gcccttccctgt

SEQ ID NO: 1719741 - DNA, 13 bp, Homo sapiens
gcccttccctgtc

SEQ ID NO: 1719742 - DNA, 21 bp, Homo sapiens
gcccttcctcctgatggagtg

SEQ ID NO: 1719743 - DNA, 15 bp, Homo sapiens
gcccttcctctccac

SEQ ID NO: 1719744 - DNA, 17 bp, Homo sapiens
gcccttcctctccactg

SEQ ID NO: 1719745 - DNA, 19 bp, Homo sapiens
gcccttcctctccactgcc

SEQ ID NO: 1719746 - DNA, 18 bp, Homo sapiens
gcccttctgactgtttat

SEQ ID NO: 1719747 - DNA, 21 bp, Homo sapiens
gcccttctgactgtttattta

SEQ ID NO: 1719748 - DNA, 22 bp, Homo sapiens
gcccttctttgtcccctgggtc

SEQ ID NO: 1719749 - DNA, 19 bp, Homo sapiens
gcccttgcagttcagcacc

SEQ ID NO: 1719750 - DNA, 13 bp, Homo sapiens
gcccttgcctccc

SEQ ID NO: 1719751 - DNA, 16 bp, Homo sapiens
gcccttgcctccccat

SEQ ID NO: 1719752 - DNA, 18 bp, Homo sapiens
gcccttgcttacctctca

SEQ ID NO: 1719753 - DNA, 17 bp, Homo sapiens
gcccttggaacaccctg

SEQ ID NO: 1719754 - DNA, 19 bp, Homo sapiens
gcccttggaacaccctgga

SEQ ID NO: 1719755 - DNA, 21 bp, Homo sapiens
gcccttggaacaccctggatg

SEQ ID NO: 1719756 - DNA, 14 bp, Homo sapiens
gcccttggctgcag

SEQ ID NO: 1719757 - DNA, 17 bp, Homo sapiens
gcccttggctgcaggca

SEQ ID NO: 1719758 - DNA, 15 bp, Homo sapiens
gcccttggggcctgg

SEQ ID NO: 1719759 - DNA, 17 bp, Homo sapiens
gcccttggggcctggct

SEQ ID NO: 1719760 - DNA, 13 bp, Homo sapiens
gcccttgtcctgc

SEQ ID NO: 1719761 - DNA, 14 bp, Homo sapiens
gcccttgtcctgcc

SEQ ID NO: 1719762 - DNA, 16 bp, Homo sapiens
gcccttgtcctgccag

SEQ ID NO: 1719763 - DNA, 19 bp, Homo sapiens
gcccttgtcctgccagctg

SEQ ID NO: 1719764 - DNA, 20 bp, Homo sapiens
gcccttgtcctgccagctgc

SEQ ID NO: 1719765 - DNA, 18 bp, Homo sapiens
gcccttgtcgtgggatgg

SEQ ID NO: 1719766 - DNA, 13 bp, Homo sapiens
gccctttccttgc

SEQ ID NO: 1719767 - DNA, 13 bp, Homo sapiens
gccctttggagaa

SEQ ID NO: 1719768 - DNA, 21 bp, Homo sapiens
gccctttgggaggctgaggcg

SEQ ID NO: 1719769 - DNA, 21 bp, Homo sapiens
gccctttttcccttccctcct

SEQ ID NO: 1719770 - DNA, 15 bp, Homo sapiens
gccgaaccaaaagaa

SEQ ID NO: 1719771 - DNA, 22 bp, Homo sapiens
gccgaagccccttggagagaga

SEQ ID NO: 1719772 - DNA, 17 bp, Homo sapiens
gccgaagctctggctga

SEQ ID NO: 1719773 - DNA, 21 bp, Homo sapiens
gccgaaggtgcctcagactcc

SEQ ID NO: 1719774 - DNA, 15 bp, Homo sapiens
gccgacatccctccc

SEQ ID NO: 1719775 - DNA, 17 bp, Homo sapiens
gccgacatccctccccc

SEQ ID NO: 1719776 - DNA, 19 bp, Homo sapiens
gccgacatccctcccccag

SEQ ID NO: 1719777 - DNA, 17 bp, Homo sapiens
gccgaccaggctggaca

SEQ ID NO: 1719778 - DNA, 17 bp, Homo sapiens
gccgacctcagccttcc

SEQ ID NO: 1719779 - DNA, 22 bp, Homo sapiens
gccgaccttccctccgccttct

SEQ ID NO: 1719780 - DNA, 18 bp, Homo sapiens
gccgacttggagactcct

SEQ ID NO: 1719781 - DNA, 22 bp, Homo sapiens
gccgagagcctgctcccccacc

SEQ ID NO: 1719782 - DNA, 22 bp, Homo sapiens
gccgagatcacgccactgcact

SEQ ID NO: 1719783 - DNA, 20 bp, Homo sapiens
gccgagccgggcctggggct

SEQ ID NO: 1719784 - DNA, 13 bp, Homo sapiens
gccagtgacagac

SEQ ID NO: 1719785 - DNA, 14 bp, Homo sapiens
gccagtgacagaca

SEQ ID NO: 1719786 - DNA, 13 bp, Homo sapiens
gccagtgcagcca

SEQ ID NO: 1719787 - DNA, 14 bp, Homo sapiens
gccagtgcagccac

SEQ ID NO: 1719788 - DNA, 16 bp, Homo sapiens
gccagtgcagccactg

SEQ ID NO: 1719789 - DNA, 20 bp, Homo sapiens
gccagtgccttacctcctgc

SEQ ID NO: 1719790 - DNA, 22 bp, Homo sapiens
gccagtgccttacctcctgccc

SEQ ID NO: 1719791 - DNA, 15 bp, Homo sapiens
gccagtgcggctgcc

SEQ ID NO: 1719792 - DNA, 14 bp, Homo sapiens
gccagtgctcaagg

SEQ ID NO: 1719793 - DNA, 20 bp, Homo sapiens
gccagttctctgtggaagca

SEQ ID NO: 1719794 - DNA, 21 bp, Homo sapiens
gccagttctttccataataaa

SEQ ID NO: 1719795 - DNA, 18 bp, Homo sapiens
gccagttttaccagcgca

SEQ ID NO: 1719796 - DNA, 15 bp, Homo sapiens
gccagttttccctgg

SEQ ID NO: 1719797 - DNA, 22 bp, Homo sapiens
gccatacataatatatgacttc

SEQ ID NO: 1719798 - DNA, 13 bp, Homo sapiens
gccatactgcgcc

SEQ ID NO: 1719799 - DNA, 16 bp, Homo sapiens
gccatagacctacaga

SEQ ID NO: 1719800 - DNA, 21 bp, Homo sapiens
gccatagacctacagacctgg

SEQ ID NO: 1719801 - DNA, 17 bp, Homo sapiens
gccatagaggcccaggc

SEQ ID NO: 1719802 - DNA, 22 bp, Homo sapiens
gccatataagtttgaaggaaac

SEQ ID NO: 1719803 - DNA, 14 bp, Homo sapiens
gccatattgtgtaa

SEQ ID NO: 1719804 - DNA, 14 bp, Homo sapiens
gccatcaagcactt

SEQ ID NO: 1719805 - DNA, 18 bp, Homo sapiens
gccatcactagaagaaaa

SEQ ID NO: 1719806 - DNA, 16 bp, Homo sapiens
gccatcacttctcccc

SEQ ID NO: 1719807 - DNA, 20 bp, Homo sapiens
gccatcagaagttactttta

SEQ ID NO: 1719808 - DNA, 19 bp, Homo sapiens
gccatcataggaagggacc

SEQ ID NO: 1719809 - DNA, 17 bp, Homo sapiens
gccatcatgtttacaga

SEQ ID NO: 1719810 - DNA, 21 bp, Homo sapiens
gccatcatgtttacagaggac

SEQ ID NO: 1719811 - DNA, 15 bp, Homo sapiens
gccatccactgtgac

SEQ ID NO: 1719812 - DNA, 21 bp, Homo sapiens
gccatcccttcggagccaaca

SEQ ID NO: 1719813 - DNA, 23 bp, Homo sapiens
gccatccctttttttacatttca

SEQ ID NO: 1719814 - DNA, 12 bp, Homo sapiens
gccatccttcac

SEQ ID NO: 1719815 - DNA, 23 bp, Homo sapiens
gccatctagccagcccctcttcc

SEQ ID NO: 1719816 - DNA, 18 bp, Homo sapiens
gccagagtggcctggcca

SEQ ID NO: 1719817 - DNA, 24 bp, Homo sapiens
gccagagttcctgcggagtgaaga

SEQ ID NO: 1719818 - DNA, 11 bp, Homo sapiens
gccagatccag

SEQ ID NO: 1719819 - DNA, 14 bp, Homo sapiens
gccagatccagcct

SEQ ID NO: 1719820 - DNA, 16 bp, Homo sapiens
gccagatccagcctgg

SEQ ID NO: 1719821 - DNA, 16 bp, Homo sapiens
gccagatgcaggacag

SEQ ID NO: 1719822 - DNA, 17 bp, Homo sapiens
gccagatgcctccccaa

SEQ ID NO: 1719823 - DNA, 18 bp, Homo sapiens
gccagatgcctccccaag

SEQ ID NO: 1719824 - DNA, 13 bp, Homo sapiens
gccagattctctt

SEQ ID NO: 1719825 - DNA, 16 bp, Homo sapiens
gccagatttgtctttt

SEQ ID NO: 1719826 - DNA, 15 bp, Homo sapiens
gccagcaacattggc

SEQ ID NO: 1719827 - DNA, 13 bp, Homo sapiens
gccagcaacgctt

SEQ ID NO: 1719828 - DNA, 14 bp, Homo sapiens
gccagcaacgcttg

SEQ ID NO: 1719829 - DNA, 20 bp, Homo sapiens
gccagcacaccaagtggctg

SEQ ID NO: 1719830 - DNA, 22 bp, Homo sapiens
gccagcacagaaacagaggaga

SEQ ID NO: 1719831 - DNA, 24 bp, Homo sapiens
gccagcacaggggccccagatctg

SEQ ID NO: 1719832 - DNA, 18 bp, Homo sapiens
gccagcacagtaggtccc

SEQ ID NO: 1719833 - DNA, 20 bp, Homo sapiens
gccagcaccacctacacagg

SEQ ID NO: 1719834 - DNA, 21 bp, Homo sapiens
gccagcaccacctacacagga

SEQ ID NO: 1719835 - DNA, 15 bp, Homo sapiens
gccagcacgcctggc

SEQ ID NO: 1719836 - DNA, 20 bp, Homo sapiens
gccagcactagtaaaggagg

SEQ ID NO: 1719837 - DNA, 14 bp, Homo sapiens
gccagcactggagg

SEQ ID NO: 1719838 - DNA, 15 bp, Homo sapiens
gccagcacttgtata

SEQ ID NO: 1719839 - DNA, 16 bp, Homo sapiens
gccagcacttgtatat

SEQ ID NO: 1719840 - DNA, 18 bp, Homo sapiens
gccagcagaggtcagagg

SEQ ID NO: 1719841 - DNA, 16 bp, Homo sapiens
gccagcagccagctct

SEQ ID NO: 1719842 - DNA, 18 bp, Homo sapiens
gccagcagccagctctca

SEQ ID NO: 1719843 - DNA, 19 bp, Homo sapiens
gccagcagccagctctcag

SEQ ID NO: 1719844 - DNA, 21 bp, Homo sapiens
gccagcagccagctctcagcc

SEQ ID NO: 1719845 - DNA, 23 bp, Homo sapiens
gccagcagccagctctcagccaa

SEQ ID NO: 1719846 - DNA, 12 bp, Homo sapiens
gccagcagcctc

SEQ ID NO: 1719847 - DNA, 19 bp, Homo sapiens
gccagcagcgcgcaggcct

SEQ ID NO: 1719848 - DNA, 17 bp, Homo sapiens
gccagcagggctgtgat

SEQ ID NO: 1719849 - DNA, 17 bp, Homo sapiens
gccagcattcagcacac

SEQ ID NO: 1719850 - DNA, 18 bp, Homo sapiens
gccagcattcagcacaca

SEQ ID NO: 1719851 - DNA, 22 bp, Homo sapiens
gccagccaagctttaaattatg

SEQ ID NO: 1719852 - DNA, 10 bp, Homo sapiens
gccagccaca

SEQ ID NO: 1719853 - DNA, 12 bp, Homo sapiens
gccagccagcag

SEQ ID NO: 1719854 - DNA, 16 bp, Homo sapiens
gccagccaggccctgc

SEQ ID NO: 1719855 - DNA, 18 bp, Homo sapiens
gccagccaggcgggctca

SEQ ID NO: 1719856 - DNA, 21 bp, Homo sapiens
gccagccaggcgggctcaagg

SEQ ID NO: 1719857 - DNA, 22 bp, Homo sapiens
gccagccagtcttgcctaggcc

SEQ ID NO: 1719858 - DNA, 13 bp, Homo sapiens
gccagcccagcca

SEQ ID NO: 1719859 - DNA, 14 bp, Homo sapiens
gccagcccagccag

SEQ ID NO: 1719860 - DNA, 18 bp, Homo sapiens
gccagcccatggccccca

SEQ ID NO: 1719861 - DNA, 19 bp, Homo sapiens
gccagcccatggcccccaa

SEQ ID NO: 1719862 - DNA, 20 bp, Homo sapiens
gccagcccatggcccccaat

SEQ ID NO: 1719863 - DNA, 21 bp, Homo sapiens
gccagcccatggcccccaata

SEQ ID NO: 1719864 - DNA, 15 bp, Homo sapiens
gccagccccacccag

SEQ ID NO: 1719865 - DNA, 14 bp, Homo sapiens
gccagccccctcca

SEQ ID NO: 1719866 - DNA, 17 bp, Homo sapiens
gccagccccctccagct

SEQ ID NO: 1719867 - DNA, 22 bp, Homo sapiens
gccagccccctccagctcatga

SEQ ID NO: 1719868 - DNA, 17 bp, Homo sapiens
gccagccccgctcccac

SEQ ID NO: 1719869 - DNA, 20 bp, Homo sapiens
gccagccccgctcccaccta

SEQ ID NO: 1719870 - DNA, 15 bp, Homo sapiens
gccagccctccctgg

SEQ ID NO: 1719871 - DNA, 17 bp, Homo sapiens
gccagccctccctggct

SEQ ID NO: 1719872 - DNA, 21 bp, Homo sapiens
gccagccctccctggctgtga

SEQ ID NO: 1719873 - DNA, 17 bp, Homo sapiens
gccagccctccctgtcc

SEQ ID NO: 1719874 - DNA, 22 bp, Homo sapiens
gccagccctccctgtcctcctc

SEQ ID NO: 1719875 - DNA, 19 bp, Homo sapiens
gccagcccttcatatctgt

SEQ ID NO: 1719876 - DNA, 17 bp, Homo sapiens
gccagccggtgcctggc

SEQ ID NO: 1719877 - DNA, 18 bp, Homo sapiens
gccagccgtgatgctcag

SEQ ID NO: 1719878 - DNA, 20 bp, Homo sapiens
gccagccgtgatgctcaggc

SEQ ID NO: 1719879 - DNA, 16 bp, Homo sapiens
gccagcctcagaaggc

SEQ ID NO: 1719880 - DNA, 20 bp, Homo sapiens
gccagcctcagaaggcccca

SEQ ID NO: 1719881 - DNA, 13 bp, Homo sapiens
gccagcctcagtg

SEQ ID NO: 1719882 - DNA, 16 bp, Homo sapiens
gccagcctcagtgcca

SEQ ID NO: 1719883 - DNA, 20 bp, Homo sapiens
gccagcctccgagagggaga

SEQ ID NO: 1719884 - DNA, 21 bp, Homo sapiens
gccagcctccgagagggagag

SEQ ID NO: 1719885 - DNA, 11 bp, Homo sapiens
gccagcctggc

SEQ ID NO: 1719886 - DNA, 18 bp, Homo sapiens
gccagcctggctctgccc

SEQ ID NO: 1719887 - DNA, 16 bp, Homo sapiens
gccagcctggcttctg

SEQ ID NO: 1719888 - DNA, 19 bp, Homo sapiens
gccagcctggcttctggag

SEQ ID NO: 1719889 - DNA, 21 bp, Homo sapiens
gccagcctggcttctggagcc

SEQ ID NO: 1719890 - DNA, 22 bp, Homo sapiens
gccagcctggcttctggagccc

SEQ ID NO: 1719891 - DNA, 12 bp, Homo sapiens
gccagcctggga

SEQ ID NO: 1719892 - DNA, 13 bp, Homo sapiens
gccagcctgggac

SEQ ID NO: 1719893 - DNA, 20 bp, Homo sapiens
gccagcctgggactcccagt

SEQ ID NO: 1719894 - DNA, 16 bp, Homo sapiens
gccagccttcctctgc

SEQ ID NO: 1719895 - DNA, 19 bp, Homo sapiens
gccagccttcctctgcagc

SEQ ID NO: 1719896 - DNA, 22 bp, Homo sapiens
gccagccttcctctgcagctga

SEQ ID NO: 1719897 - DNA, 17 bp, Homo sapiens
gccagccttgagccctg

SEQ ID NO: 1719898 - DNA, 13 bp, Homo sapiens
gccagcgcatgtg

SEQ ID NO: 1719899 - DNA, 15 bp, Homo sapiens
gccagcgcatgtgtc

SEQ ID NO: 1719900 - DNA, 14 bp, Homo sapiens
gccagcgggcacag

SEQ ID NO: 1719901 - DNA, 18 bp, Homo sapiens
gccagcgggcacagggca

SEQ ID NO: 1719902 - DNA, 19 bp, Homo sapiens
gccagcgggcacagggcac

SEQ ID NO: 1719903 - DNA, 23 bp, Homo sapiens
gccagcgggcacagggcaccaga

SEQ ID NO: 1719904 - DNA, 13 bp, Homo sapiens
gccagcgtcccag

SEQ ID NO: 1719905 - DNA, 14 bp, Homo sapiens
gccagcgtcccagg

SEQ ID NO: 1719906 - DNA, 16 bp, Homo sapiens
gccagcgtcccagggt

SEQ ID NO: 1719907 - DNA, 19 bp, Homo sapiens
gccagcgtcccagggtacc

SEQ ID NO: 1719908 - DNA, 16 bp, Homo sapiens
gccagcgtcccttggt

SEQ ID NO: 1719909 - DNA, 15 bp, Homo sapiens
gccagcgtctgttgt

SEQ ID NO: 1719910 - DNA, 17 bp, Homo sapiens
gcatgcatggaggactc

SEQ ID NO: 1719911 - DNA, 18 bp, Homo sapiens
gcatgcatggaggactct

SEQ ID NO: 1719912 - DNA, 19 bp, Homo sapiens
gcatgccacgccccgtgtc

SEQ ID NO: 1719913 - DNA, 13 bp, Homo sapiens
gcatgccaggacc

SEQ ID NO: 1719914 - DNA, 23 bp, Homo sapiens
gcatgccgggcccctccatccac

SEQ ID NO: 1719915 - DNA, 18 bp, Homo sapiens
gcatgcctgtaatcccag

SEQ ID NO: 1719916 - DNA, 19 bp, Homo sapiens
gcatgcctgtagtctcagc

SEQ ID NO: 1719917 - DNA, 13 bp, Homo sapiens
gcattgctttcgt

SEQ ID NO: 1719918 - DNA, 20 bp, Homo sapiens
gcattgctttctgaaattag

SEQ ID NO: 1719919 - DNA, 21 bp, Homo sapiens
gcattggaaaccctatttccc

SEQ ID NO: 1719920 - DNA, 22 bp, Homo sapiens
gcattggaattctactggaaaa

SEQ ID NO: 1719921 - DNA, 22 bp, Homo sapiens
gcattggcccctgagcccagag

SEQ ID NO: 1719922 - DNA, 16 bp, Homo sapiens
gcattggcctctgtac

SEQ ID NO: 1719923 - DNA, 13 bp, Homo sapiens
gcattggcctggc

SEQ ID NO: 1719924 - DNA, 16 bp, Homo sapiens
gcattggcctggcctc

SEQ ID NO: 1719925 - DNA, 17 bp, Homo sapiens
gcattggcctggcctcc

SEQ ID NO: 1719926 - DNA, 13 bp, Homo sapiens
gcattgtctttgc

SEQ ID NO: 1719927 - DNA, 15 bp, Homo sapiens
gcattgtctttgctg

SEQ ID NO: 1719928 - DNA, 22 bp, Homo sapiens
gcattgtgattggcctgtagag

SEQ ID NO: 1719929 - DNA, 15 bp, Homo sapiens
gcattgttagtttag

SEQ ID NO: 1719930 - DNA, 21 bp, Homo sapiens
gcattgttagtttagtgtgtg

SEQ ID NO: 1719931 - DNA, 23 bp, Homo sapiens
gcatttaaaataccactgtaatt

SEQ ID NO: 1719932 - DNA, 14 bp, Homo sapiens
gcatttaataaaga

SEQ ID NO: 1719933 - DNA, 23 bp, Homo sapiens
gcatttaatggcagctagtgcct

SEQ ID NO: 1719934 - DNA, 16 bp, Homo sapiens
gcatttagctggccac

SEQ ID NO: 1719935 - DNA, 13 bp, Homo sapiens
gcatttaggagaa

SEQ ID NO: 1719936 - DNA, 22 bp, Homo sapiens
gcatttaggagaatagcagaga

SEQ ID NO: 1719937 - DNA, 17 bp, Homo sapiens
gcatttcaaagccctgc

SEQ ID NO: 1719938 - DNA, 21 bp, Homo sapiens
gcatttcaaagccctgcctct

SEQ ID NO: 1719939 - DNA, 22 bp, Homo sapiens
gcatttcaaagccctgcctctg

SEQ ID NO: 1719940 - DNA, 18 bp, Homo sapiens
gcatttcacatgccttgc

SEQ ID NO: 1719941 - DNA, 21 bp, Homo sapiens
gcatttcagaaagcctttcat

SEQ ID NO: 1719942 - DNA, 23 bp, Homo sapiens
gcatttcatagcttcacaatgtt

SEQ ID NO: 1719943 - DNA, 10 bp, Homo sapiens
gcatttccta

SEQ ID NO: 1719944 - DNA, 12 bp, Homo sapiens
gcatttctattg

SEQ ID NO: 1719945 - DNA, 15 bp, Homo sapiens
gcatttgagaaatgc

SEQ ID NO: 1719946 - DNA, 12 bp, Homo sapiens
gcatttggtctc

SEQ ID NO: 1719947 - DNA, 16 bp, Homo sapiens
gcatttggtctcaggc

SEQ ID NO: 1719948 - DNA, 13 bp, Homo sapiens
gcatttggtgcct

SEQ ID NO: 1719949 - DNA, 15 bp, Homo sapiens
gcatttgtataaaga

SEQ ID NO: 1719950 - DNA, 13 bp, Homo sapiens
gcatttgtcaatg

SEQ ID NO: 1719951 - DNA, 12 bp, Homo sapiens
gcatttgttcac

SEQ ID NO: 1719952 - DNA, 21 bp, Homo sapiens
gcattttcactgcaatgtcaa

SEQ ID NO: 1719953 - DNA, 20 bp, Homo sapiens
gcattttcctcttgtcctgg

SEQ ID NO: 1719954 - DNA, 20 bp, Homo sapiens
gcattttctaagtgggacat

SEQ ID NO: 1719955 - DNA, 19 bp, Homo sapiens
gcatttttattaaagcatt

SEQ ID NO: 1719956 - DNA, 19 bp, Homo sapiens
gccaaaacaagccaaagag

SEQ ID NO: 1719957 - DNA, 15 bp, Homo sapiens
gccaaaatcaagagt

SEQ ID NO: 1719958 - DNA, 20 bp, Homo sapiens
gccaaacatcagacctgtct

SEQ ID NO: 1719959 - DNA, 21 bp, Homo sapiens
gccaaacattcttattttaga

SEQ ID NO: 1719960 - DNA, 18 bp, Homo sapiens
gccaaaccaggaccctgt

SEQ ID NO: 1719961 - DNA, 17 bp, Homo sapiens
gccaaacccttgctttc

SEQ ID NO: 1719962 - DNA, 23 bp, Homo sapiens
gccaaacccttgctttcctgggc

SEQ ID NO: 1719963 - DNA, 17 bp, Homo sapiens
gccaaactcaggcccag

SEQ ID NO: 1719964 - DNA, 21 bp, Homo sapiens
gccaaagaaacaagctgtgca

SEQ ID NO: 1719965 - DNA, 19 bp, Homo sapiens
gccaaagagcctttccaaa

SEQ ID NO: 1719966 - DNA, 17 bp, Homo sapiens
gccaaagcacagctggg

SEQ ID NO: 1719967 - DNA, 16 bp, Homo sapiens
gccaaagccaggcctg

SEQ ID NO: 1719968 - DNA, 19 bp, Homo sapiens
gccaaagttttcaaactgc

SEQ ID NO: 1719969 - DNA, 14 bp, Homo sapiens
gccaaatagcaaag

SEQ ID NO: 1719970 - DNA, 18 bp, Homo sapiens
gccaaatagccccagact

SEQ ID NO: 1719971 - DNA, 15 bp, Homo sapiens
gccaaataggaggga

SEQ ID NO: 1719972 - DNA, 17 bp, Homo sapiens
gccaaatgaccgagccc

SEQ ID NO: 1719973 - DNA, 20 bp, Homo sapiens
gccaaatgaccgagccctgg

SEQ ID NO: 1719974 - DNA, 23 bp, Homo sapiens
gccaaatgaccgagccctggaga

SEQ ID NO: 1719975 - DNA, 21 bp, Homo sapiens
gccaaatgcagggaggggagg

SEQ ID NO: 1719976 - DNA, 18 bp, Homo sapiens
gccaaatgtaattgaata

SEQ ID NO: 1719977 - DNA, 13 bp, Homo sapiens
gccaaatgttcat

SEQ ID NO: 1719978 - DNA, 14 bp, Homo sapiens
gccaaatgttcatc

SEQ ID NO: 1719979 - DNA, 15 bp, Homo sapiens
gccaaattgctgcat

SEQ ID NO: 1719980 - DNA, 18 bp, Homo sapiens
gccaaattgctgcatatt

SEQ ID NO: 1719981 - DNA, 19 bp, Homo sapiens
gccaaatttcctgtttgaa

SEQ ID NO: 1719982 - DNA, 14 bp, Homo sapiens
gccaaattttggcc

SEQ ID NO: 1719983 - DNA, 21 bp, Homo sapiens
gccaacaactctgcctttatg

SEQ ID NO: 1719984 - DNA, 21 bp, Homo sapiens
gccaacaagaccgccccaggg

SEQ ID NO: 1719985 - DNA, 19 bp, Homo sapiens
gccaacagaagcttccatt

SEQ ID NO: 1719986 - DNA, 15 bp, Homo sapiens
gccaacagcacctcc

SEQ ID NO: 1719987 - DNA, 20 bp, Homo sapiens
gccaacagtcaaaacagaga

SEQ ID NO: 1719988 - DNA, 15 bp, Homo sapiens
gccaacatgaggaca

SEQ ID NO: 1719989 - DNA, 16 bp, Homo sapiens
gccaacatgaggacag

SEQ ID NO: 1719990 - DNA, 19 bp, Homo sapiens
gccaacatgaggacagaag

SEQ ID NO: 1719991 - DNA, 20 bp, Homo sapiens
gccaacatgaggacagaagg

SEQ ID NO: 1719992 - DNA, 20 bp, Homo sapiens
gccaacatggtgaaaccctg

SEQ ID NO: 1719993 - DNA, 13 bp, Homo sapiens
gccaaccagcccg

SEQ ID NO: 1719994 - DNA, 14 bp, Homo sapiens
gccaaccctgggct

SEQ ID NO: 1719995 - DNA, 13 bp, Homo sapiens
gccaacctggact

SEQ ID NO: 1719996 - DNA, 14 bp, Homo sapiens
gccaacctggactt

SEQ ID NO: 1719997 - DNA, 15 bp, Homo sapiens
gccaacctggacttc

SEQ ID NO: 1719998 - DNA, 20 bp, Homo sapiens
gccaacctggacttcctgtc

SEQ ID NO: 1719999 - DNA, 22 bp, Homo sapiens
gccaacctgttcttagagtgta

SEQ ID NO: 1720000 - DNA, 15 bp, Homo sapiens
gccaacgagacacat

SEQ ID NO: 1720001 - DNA, 17 bp, Homo sapiens
gccaacgagacacattg

SEQ ID NO: 1720002 - DNA, 18 bp, Homo sapiens
gccaacggcaacagcatg

SEQ ID NO: 1720003 - DNA, 15 bp, Homo sapiens
gccaactaagccctc

SEQ ID NO: 1720004 - DNA, 16 bp, Homo sapiens
gccaactagcccctgg

SEQ ID NO: 1720005 - DNA, 17 bp, Homo sapiens
gccaactagcccctggg

SEQ ID NO: 1720006 - DNA, 22 bp, Homo sapiens
gccaactgcaaaaaaagcctcc

SEQ ID NO: 1720007 - DNA, 22 bp, Homo sapiens
gccaactgccaggctgcctcct

SEQ ID NO: 1720008 - DNA, 18 bp, Homo sapiens
gccaactgtttccctgct

SEQ ID NO: 1720009 - DNA, 13 bp, Homo sapiens
gccaacttgtaaa

SEQ ID NO: 1720010 - DNA, 17 bp, Homo sapiens
gccaacttgtaaataca

SEQ ID NO: 1720011 - DNA, 18 bp, Homo sapiens
gccaacttgtaaatacac

SEQ ID NO: 1720012 - DNA, 15 bp, Homo sapiens
gccaagacggaggag

SEQ ID NO: 1720013 - DNA, 18 bp, Homo sapiens
gccaagagatctgtgtgg

SEQ ID NO: 1720014 - DNA, 22 bp, Homo sapiens
gccaagagatctgtgtggctcc

SEQ ID NO: 1720015 - DNA, 16 bp, Homo sapiens
gccaagagcagaggca

SEQ ID NO: 1720016 - DNA, 20 bp, Homo sapiens
gccaagagcatcgtgaccct

SEQ ID NO: 1720017 - DNA, 17 bp, Homo sapiens
gccaagagccgccgtgg

SEQ ID NO: 1720018 - DNA, 20 bp, Homo sapiens
gccaagatcgcaccactgca

SEQ ID NO: 1720019 - DNA, 17 bp, Homo sapiens
gccaagatggctgctgc

SEQ ID NO: 1720020 - DNA, 20 bp, Homo sapiens
gccaagatggctgctgcctg

SEQ ID NO: 1720021 - DNA, 18 bp, Homo sapiens
gccaagatgtacttctct

SEQ ID NO: 1720022 - DNA, 20 bp, Homo sapiens
gccaagcacagtgcctgcat

SEQ ID NO: 1720023 - DNA, 15 bp, Homo sapiens
gccaagcactgctca

SEQ ID NO: 1720024 - DNA, 12 bp, Homo sapiens
gccaagccagat

SEQ ID NO: 1720025 - DNA, 22 bp, Homo sapiens
gccaagccagattctcttgaat

SEQ ID NO: 1720026 - DNA, 20 bp, Homo sapiens
gccaaggacagggctggctc

SEQ ID NO: 1720027 - DNA, 23 bp, Homo sapiens
gccaaggagggtggatcacctga

SEQ ID NO: 1720028 - DNA, 14 bp, Homo sapiens
gccaaggcagaggc

SEQ ID NO: 1720029 - DNA, 12 bp, Homo sapiens
gccaaggcagcg

SEQ ID NO: 1720030 - DNA, 20 bp, Homo sapiens
gccacggcctggctggtggg

SEQ ID NO: 1720031 - DNA, 23 bp, Homo sapiens
gccacggcctggctggtgggaag

SEQ ID NO: 1720032 - DNA, 21 bp, Homo sapiens
gccacgtcccagcatccctgg

SEQ ID NO: 1720033 - DNA, 22 bp, Homo sapiens
gccacgtcccagcatccctgga

SEQ ID NO: 1720034 - DNA, 23 bp, Homo sapiens
gccacgtcccagcatccctggag

SEQ ID NO: 1720035 - DNA, 14 bp, Homo sapiens
gccacgtgaatggc

SEQ ID NO: 1720036 - DNA, 14 bp, Homo sapiens
gccacgtgccaggc

SEQ ID NO: 1720037 - DNA, 22 bp, Homo sapiens
gccacgttccttactgcagaat

SEQ ID NO: 1720038 - DNA, 20 bp, Homo sapiens
gccactaaagcttcagactc

SEQ ID NO: 1720039 - DNA, 23 bp, Homo sapiens
gccactaaagcttcagactcaag

SEQ ID NO: 1720040 - DNA, 23 bp, Homo sapiens
gccactaattttagtattcattc

SEQ ID NO: 1720041 - DNA, 17 bp, Homo sapiens
gccactacactccagcc

SEQ ID NO: 1720042 - DNA, 18 bp, Homo sapiens
gccactacactccagcct

SEQ ID NO: 1720043 - DNA, 22 bp, Homo sapiens
gccactacactccagcctgagc

SEQ ID NO: 1720044 - DNA, 16 bp, Homo sapiens
gccactaggtgtcccc

SEQ ID NO: 1720045 - DNA, 18 bp, Homo sapiens
gccactaggtgtccccaa

SEQ ID NO: 1720046 - DNA, 19 bp, Homo sapiens
gccactaggtgtccccaac

SEQ ID NO: 1720047 - DNA, 16 bp, Homo sapiens
gccactcaccgaagcc

SEQ ID NO: 1720048 - DNA, 23 bp, Homo sapiens
gccactcactaggcccccacttg

SEQ ID NO: 1720049 - DNA, 18 bp, Homo sapiens
gccactcagccatttccc

SEQ ID NO: 1720050 - DNA, 22 bp, Homo sapiens
gccactcagccatttccccctc

SEQ ID NO: 1720051 - DNA, 21 bp, Homo sapiens
gccactcaggaggctgaggca

SEQ ID NO: 1720052 - DNA, 17 bp, Homo sapiens
gccactcctgtcccgcc

SEQ ID NO: 1720053 - DNA, 18 bp, Homo sapiens
gccactcctgtcccgcct

SEQ ID NO: 1720054 - DNA, 12 bp, Homo sapiens
gccactccttgt

SEQ ID NO: 1720055 - DNA, 22 bp, Homo sapiens
gccactcgcagtcgcaggatcc

SEQ ID NO: 1720056 - DNA, 15 bp, Homo sapiens
gccactctatgagtt

SEQ ID NO: 1720057 - DNA, 15 bp, Homo sapiens
gccactctctgggac

SEQ ID NO: 1720058 - DNA, 22 bp, Homo sapiens
gccactctctgggactctcctc

SEQ ID NO: 1720059 - DNA, 15 bp, Homo sapiens
gccactctgcctctg

SEQ ID NO: 1720060 - DNA, 21 bp, Homo sapiens
gccactctgcctctgcctgca

SEQ ID NO: 1720061 - DNA, 22 bp, Homo sapiens
gccactctgcctctgcctgcat

SEQ ID NO: 1720062 - DNA, 20 bp, Homo sapiens
gccactgacttgctgtgtga

SEQ ID NO: 1720063 - DNA, 15 bp, Homo sapiens
gccactgagcctggc

SEQ ID NO: 1720064 - DNA, 17 bp, Homo sapiens
gccactgagcctggccc

SEQ ID NO: 1720065 - DNA, 12 bp, Homo sapiens
gccactgaggag

SEQ ID NO: 1720066 - DNA, 19 bp, Homo sapiens
gccactgaggagacagaaa

SEQ ID NO: 1720067 - DNA, 21 bp, Homo sapiens
gccactgaggagacagaaagc

SEQ ID NO: 1720068 - DNA, 22 bp, Homo sapiens
gccactgaggagacagaaagcc

SEQ ID NO: 1720069 - DNA, 22 bp, Homo sapiens
gccactgcactccagcctgggc

SEQ ID NO: 1720070 - DNA, 13 bp, Homo sapiens
gccactgccaggc

SEQ ID NO: 1720071 - DNA, 18 bp, Homo sapiens
gccactgccaggcacctg

SEQ ID NO: 1720072 - DNA, 19 bp, Homo sapiens
gccactgccaggcacctgg

SEQ ID NO: 1720073 - DNA, 21 bp, Homo sapiens
gccactgccaggcacctggcc

SEQ ID NO: 1720074 - DNA, 13 bp, Homo sapiens
gccactgcccccc

SEQ ID NO: 1720075 - DNA, 15 bp, Homo sapiens
gccactgccccccga

SEQ ID NO: 1720076 - DNA, 18 bp, Homo sapiens
gccactgccccccgaggc

SEQ ID NO: 1720077 - DNA, 23 bp, Homo sapiens
gccactgccccccgaggctgcta

SEQ ID NO: 1720078 - DNA, 14 bp, Homo sapiens
gccactgccgccta

SEQ ID NO: 1720079 - DNA, 18 bp, Homo sapiens
gccactgctttccagcct

SEQ ID NO: 1720080 - DNA, 23 bp, Homo sapiens
gccactgcttttccctttgtgag

SEQ ID NO: 1720081 - DNA, 14 bp, Homo sapiens
gccactggaaggag

SEQ ID NO: 1720082 - DNA, 15 bp, Homo sapiens
gccactgggacagct

SEQ ID NO: 1720083 - DNA, 19 bp, Homo sapiens
gccactgggacagctggct

SEQ ID NO: 1720084 - DNA, 21 bp, Homo sapiens
gccactgggacagctggctgg

SEQ ID NO: 1720085 - DNA, 12 bp, Homo sapiens
gccactgggcac

SEQ ID NO: 1720086 - DNA, 19 bp, Homo sapiens
gccactgggtctcactcct

SEQ ID NO: 1720087 - DNA, 20 bp, Homo sapiens
gccactgggtctcactcctg

SEQ ID NO: 1720088 - DNA, 16 bp, Homo sapiens
gccactggtttctcag

SEQ ID NO: 1720089 - DNA, 17 bp, Homo sapiens
gccactggtttctcaga

SEQ ID NO: 1720090 - DNA, 20 bp, Homo sapiens
gccactggtttctcagaatc

SEQ ID NO: 1720091 - DNA, 20 bp, Homo sapiens
gccactgtggccagagctgg

SEQ ID NO: 1720092 - DNA, 16 bp, Homo sapiens
gccactgttgttttgg

SEQ ID NO: 1720093 - DNA, 13 bp, Homo sapiens
gccacttaatgta

SEQ ID NO: 1720094 - DNA, 13 bp, Homo sapiens
gccacttcaaccc

SEQ ID NO: 1720095 - DNA, 24 bp, Homo sapiens
gccacttctcactcaccactacca

SEQ ID NO: 1720096 - DNA, 13 bp, Homo sapiens
gccacttctcccc

SEQ ID NO: 1720097 - DNA, 20 bp, Homo sapiens
gccacttctgggtggggcag

SEQ ID NO: 1720098 - DNA, 20 bp, Homo sapiens
gccacttcttaaaggcctgg

SEQ ID NO: 1720099 - DNA, 23 bp, Homo sapiens
gccacttgacattccttgtcacc

SEQ ID NO: 1720100 - DNA, 19 bp, Homo sapiens
gccactttacccacctaga

SEQ ID NO: 1720101 - DNA, 20 bp, Homo sapiens
gccactttacccacctagaa

SEQ ID NO: 1720102 - DNA, 21 bp, Homo sapiens
gccactttcacgtggcctccg

SEQ ID NO: 1720103 - DNA, 19 bp, Homo sapiens
gccactttcagagccccca

SEQ ID NO: 1720104 - DNA, 23 bp, Homo sapiens
gccactttggtacatggccagtg

SEQ ID NO: 1720105 - DNA, 22 bp, Homo sapiens
gccagaagagcttgtcagcaag

SEQ ID NO: 1720106 - DNA, 23 bp, Homo sapiens
gccagaagcctctgcctccctag

SEQ ID NO: 1720107 - DNA, 18 bp, Homo sapiens
gccagaaggagggcagag

SEQ ID NO: 1720108 - DNA, 21 bp, Homo sapiens
gccagaaggagggcagagcca

SEQ ID NO: 1720109 - DNA, 21 bp, Homo sapiens
gccagaagtaccagactagat

SEQ ID NO: 1720110 - DNA, 17 bp, Homo sapiens
gccagacaaaatttgag

SEQ ID NO: 1720111 - DNA, 18 bp, Homo sapiens
gccagacaaaatttgaga

SEQ ID NO: 1720112 - DNA, 21 bp, Homo sapiens
gccagacaaaatttgagaata

SEQ ID NO: 1720113 - DNA, 13 bp, Homo sapiens
gccagacactctg

SEQ ID NO: 1720114 - DNA, 14 bp, Homo sapiens
gccagaccacagca

SEQ ID NO: 1720115 - DNA, 16 bp, Homo sapiens
gccagaccagcaggct

SEQ ID NO: 1720116 - DNA, 19 bp, Homo sapiens
gccagacttgcttcctgca

SEQ ID NO: 1720117 - DNA, 19 bp, Homo sapiens
gccagagaggagcacctga

SEQ ID NO: 1720118 - DNA, 19 bp, Homo sapiens
gccagagagggcccagctg

SEQ ID NO: 1720119 - DNA, 20 bp, Homo sapiens
gccagagagggcccagctgt

SEQ ID NO: 1720120 - DNA, 13 bp, Homo sapiens
gccagagatccaa

SEQ ID NO: 1720121 - DNA, 22 bp, Homo sapiens
gccagagatccaaaagaagccc

SEQ ID NO: 1720122 - DNA, 19 bp, Homo sapiens
gccagagcaggagcccctg

SEQ ID NO: 1720123 - DNA, 11 bp, Homo sapiens
gccagagccaa

SEQ ID NO: 1720124 - DNA, 13 bp, Homo sapiens
gccagagccaacc

SEQ ID NO: 1720125 - DNA, 16 bp, Homo sapiens
gccagagccaacctgg

SEQ ID NO: 1720126 - DNA, 20 bp, Homo sapiens
gccagagccaacctggactt

SEQ ID NO: 1720127 - DNA, 14 bp, Homo sapiens
gccagagccgggca

SEQ ID NO: 1720128 - DNA, 13 bp, Homo sapiens
gccagagcctggg

SEQ ID NO: 1720129 - DNA, 16 bp, Homo sapiens
gccagagcctggggtg

SEQ ID NO: 1720130 - DNA, 17 bp, Homo sapiens
gccagagctggaaggca

SEQ ID NO: 1720131 - DNA, 22 bp, Homo sapiens
gccagagctggaaggcagggca

SEQ ID NO: 1720132 - DNA, 14 bp, Homo sapiens
gccagagctgtgcc

SEQ ID NO: 1720133 - DNA, 17 bp, Homo sapiens
gccagaggaatcctggc

SEQ ID NO: 1720134 - DNA, 19 bp, Homo sapiens
gccagaggaatcctggcag

SEQ ID NO: 1720135 - DNA, 21 bp, Homo sapiens
gccagaggaatcctggcagcc

SEQ ID NO: 1720136 - DNA, 24 bp, Homo sapiens
gccagaggaatcctggcagcccag

SEQ ID NO: 1720137 - DNA, 20 bp, Homo sapiens
gccagaggatgctctttccc

SEQ ID NO: 1720138 - DNA, 12 bp, Homo sapiens
gccagaggctgg

SEQ ID NO: 1720139 - DNA, 14 bp, Homo sapiens
gccagagggccagc

SEQ ID NO: 1720140 - DNA, 16 bp, Homo sapiens
gccagagggccagcag

SEQ ID NO: 1720141 - DNA, 22 bp, Homo sapiens
gccagagggccagcaggctcct

SEQ ID NO: 1720142 - DNA, 13 bp, Homo sapiens
gccagaggtgctt

SEQ ID NO: 1720143 - DNA, 16 bp, Homo sapiens
gccagaggtgcttcac

SEQ ID NO: 1720144 - DNA, 15 bp, Homo sapiens
gccagaggtgggcag

SEQ ID NO: 1720145 - DNA, 23 bp, Homo sapiens
gcaggacacatcccggcctcttc

SEQ ID NO: 1720146 - DNA, 13 bp, Homo sapiens
gcaggacattaat

SEQ ID NO: 1720147 - DNA, 23 bp, Homo sapiens
gcaggaccagtttgattgaggag

SEQ ID NO: 1720148 - DNA, 13 bp, Homo sapiens
gcaggaccttggg

SEQ ID NO: 1720149 - DNA, 13 bp, Homo sapiens
gcaggactccagg

SEQ ID NO: 1720150 - DNA, 14 bp, Homo sapiens
gcaggagaatcact

SEQ ID NO: 1720151 - DNA, 14 bp, Homo sapiens
gcaggagcagctgt

SEQ ID NO: 1720152 - DNA, 22 bp, Homo sapiens
gcaggagctagttctcagcttg

SEQ ID NO: 1720153 - DNA, 15 bp, Homo sapiens
gcaggagctcctgga

SEQ ID NO: 1720154 - DNA, 14 bp, Homo sapiens
gcaggaggagtgga

SEQ ID NO: 1720155 - DNA, 14 bp, Homo sapiens
gcaggaggattgct

SEQ ID NO: 1720156 - DNA, 14 bp, Homo sapiens
gcaggaggccccag

SEQ ID NO: 1720157 - DNA, 17 bp, Homo sapiens
gcaggaggctcaggtga

SEQ ID NO: 1720158 - DNA, 18 bp, Homo sapiens
gcaggagggccctacctg

SEQ ID NO: 1720159 - DNA, 22 bp, Homo sapiens
gcaggaggttctgggcctctga

SEQ ID NO: 1720160 - DNA, 15 bp, Homo sapiens
gcaggagtgccagga

SEQ ID NO: 1720161 - DNA, 16 bp, Homo sapiens
gcaggagtgccaggac

SEQ ID NO: 1720162 - DNA, 19 bp, Homo sapiens
gcaggagtgccaggaccag

SEQ ID NO: 1720163 - DNA, 20 bp, Homo sapiens
gcaggagtgccaggaccagc

SEQ ID NO: 1720164 - DNA, 17 bp, Homo sapiens
gcaggagtgtcctgccc

SEQ ID NO: 1720165 - DNA, 17 bp, Homo sapiens
gcaggatccctcctgag

SEQ ID NO: 1720166 - DNA, 19 bp, Homo sapiens
gcaggatccctcctgagct

SEQ ID NO: 1720167 - DNA, 19 bp, Homo sapiens
gcaggatccgctgccacca

SEQ ID NO: 1720168 - DNA, 19 bp, Homo sapiens
gcagggtggtgctgggact

SEQ ID NO: 1720169 - DNA, 19 bp, Homo sapiens
gcaggtactgtctgcttct

SEQ ID NO: 1720170 - DNA, 22 bp, Homo sapiens
gcaggtagatcgcttgagccca

SEQ ID NO: 1720171 - DNA, 18 bp, Homo sapiens
gcaggtcactgtcactgc

SEQ ID NO: 1720172 - DNA, 19 bp, Homo sapiens
gcaggtcctggtgggtcag

SEQ ID NO: 1720173 - DNA, 15 bp, Homo sapiens
gcaggtctcttctgg

SEQ ID NO: 1720174 - DNA, 16 bp, Homo sapiens
gcaggtgagaacccag

SEQ ID NO: 1720175 - DNA, 18 bp, Homo sapiens
gcaggtgcagatgggctg

SEQ ID NO: 1720176 - DNA, 18 bp, Homo sapiens
gcaggtgccatgcctgct

SEQ ID NO: 1720177 - DNA, 13 bp, Homo sapiens
gcaggtgcctcca

SEQ ID NO: 1720178 - DNA, 15 bp, Homo sapiens
gcaggtgcctccagg

SEQ ID NO: 1720179 - DNA, 21 bp, Homo sapiens
gcaggtgcctgttgaatctga

SEQ ID NO: 1720180 - DNA, 13 bp, Homo sapiens
gcaggtgctgcct

SEQ ID NO: 1720181 - DNA, 22 bp, Homo sapiens
gcaggtgctgcggcgcgggccc

SEQ ID NO: 1720182 - DNA, 23 bp, Homo sapiens
gcaggtgctgtgcgccttgtaga

SEQ ID NO: 1720183 - DNA, 18 bp, Homo sapiens
gcaggtggactgactgtg

SEQ ID NO: 1720184 - DNA, 14 bp, Homo sapiens
gcaacccacagctc

SEQ ID NO: 1720185 - DNA, 22 bp, Homo sapiens
gcaacccagtcacactgtggcc

SEQ ID NO: 1720186 - DNA, 13 bp, Homo sapiens
gcaaccccccagc

SEQ ID NO: 1720187 - DNA, 13 bp, Homo sapiens
gcaacccctgtac

SEQ ID NO: 1720188 - DNA, 14 bp, Homo sapiens
gcaacctacccagc

SEQ ID NO: 1720189 - DNA, 13 bp, Homo sapiens
gcaacctccacct

SEQ ID NO: 1720190 - DNA, 12 bp, Homo sapiens
gcaacctcccat

SEQ ID NO: 1720191 - DNA, 19 bp, Homo sapiens
gcaacgcccctccaaacct

SEQ ID NO: 1720192 - DNA, 15 bp, Homo sapiens
gcaacggccagggtt

SEQ ID NO: 1720193 - DNA, 17 bp, Homo sapiens
gcaacgtagcctgggct

SEQ ID NO: 1720194 - DNA, 20 bp, Homo sapiens
gcaactaatgtttgaacaaa

SEQ ID NO: 1720195 - DNA, 17 bp, Homo sapiens
gcaactctggctccagg

SEQ ID NO: 1720196 - DNA, 13 bp, Homo sapiens
gcaactgaggcag

SEQ ID NO: 1720197 - DNA, 21 bp, Homo sapiens
gatgatacaagattagaagct

SEQ ID NO: 1720198 - DNA, 13 bp, Homo sapiens
gatgatcaattat

SEQ ID NO: 1720199 - DNA, 20 bp, Homo sapiens
gatgatcagctgtttgtcat

SEQ ID NO: 1720200 - DNA, 23 bp, Homo sapiens
gatgatgacgacgacaacgatga

SEQ ID NO: 1720201 - DNA, 19 bp, Homo sapiens
gatgatgccaacctctgga

SEQ ID NO: 1720202 - DNA, 17 bp, Homo sapiens
gatgatggcagagccag

SEQ ID NO: 1720203 - DNA, 14 bp, Homo sapiens
gatgatgtctcttg

SEQ ID NO: 1720204 - DNA, 19 bp, Homo sapiens
gatgattgcgcagggaggg

SEQ ID NO: 1720205 - DNA, 19 bp, Homo sapiens
gatgattgcttgagctcag

SEQ ID NO: 1720206 - DNA, 12 bp, Homo sapiens
gatgatttaagt

SEQ ID NO: 1720207 - DNA, 14 bp, Homo sapiens
gatgatttaagtgt

SEQ ID NO: 1720208 - DNA, 18 bp, Homo sapiens
gatgatttggtcagattg

SEQ ID NO: 1720209 - DNA, 14 bp, Homo sapiens
gatgatttttgtca

SEQ ID NO: 1720210 - DNA, 21 bp, Homo sapiens
gatgattttttaaggagctgg

SEQ ID NO: 1720211 - DNA, 22 bp, Homo sapiens
gatgattttttaaggagctggg

SEQ ID NO: 1720212 - DNA, 17 bp, Homo sapiens
gatgcaaggaccaggac

SEQ ID NO: 1720213 - DNA, 15 bp, Homo sapiens
gatgcacagatgcca

SEQ ID NO: 1720214 - DNA, 13 bp, Homo sapiens
gatgcacatttct

SEQ ID NO: 1720215 - DNA, 21 bp, Homo sapiens
gatgcacgtggggcccactgc

SEQ ID NO: 1720216 - DNA, 14 bp, Homo sapiens
gatgcagacacaga

SEQ ID NO: 1720217 - DNA, 21 bp, Homo sapiens
gatgcagcctgtggcttggag

SEQ ID NO: 1720218 - DNA, 15 bp, Homo sapiens
gatgcagctactgga

SEQ ID NO: 1720219 - DNA, 14 bp, Homo sapiens
gatgcaggacagga

SEQ ID NO: 1720220 - DNA, 23 bp, Homo sapiens
gatgcaggacaggaggcggcccg

SEQ ID NO: 1720221 - DNA, 16 bp, Homo sapiens
gatgcagtcctcagga

SEQ ID NO: 1720222 - DNA, 17 bp, Homo sapiens
gatgcatgagctccctc

SEQ ID NO: 1720223 - DNA, 14 bp, Homo sapiens
gatgcatttaataa

SEQ ID NO: 1720224 - DNA, 17 bp, Homo sapiens
gatgcatttaataaaga

SEQ ID NO: 1720225 - DNA, 22 bp, Homo sapiens
gatgcatttaataaagatgagt

SEQ ID NO: 1720226 - DNA, 18 bp, Homo sapiens
gatgcattttgagtgttt

SEQ ID NO: 1720227 - DNA, 19 bp, Homo sapiens
gatgccaaaccacaagact

SEQ ID NO: 1720228 - DNA, 13 bp, Homo sapiens
gatgccaccggcc

SEQ ID NO: 1720229 - DNA, 17 bp, Homo sapiens
gatgccacgcctggaag

SEQ ID NO: 1720230 - DNA, 17 bp, Homo sapiens
gatgccactcctccctc

SEQ ID NO: 1720231 - DNA, 24 bp, Homo sapiens
gatgccacttcccagaggcagagc

SEQ ID NO: 1720232 - DNA, 11 bp, Homo sapiens
gatgccagagg

SEQ ID NO: 1720233 - DNA, 12 bp, Homo sapiens
gatgccagaggg

SEQ ID NO: 1720234 - DNA, 15 bp, Homo sapiens
gatgccagagggcca

SEQ ID NO: 1720235 - DNA, 18 bp, Homo sapiens
gatgccagagggccagca

SEQ ID NO: 1720236 - DNA, 21 bp, Homo sapiens
gatgccagcttctctctccag

SEQ ID NO: 1720237 - DNA, 23 bp, Homo sapiens
gatgccagcttctctctccaggg

SEQ ID NO: 1720238 - DNA, 20 bp, Homo sapiens
gatgccataatcagaacaca

SEQ ID NO: 1720239 - DNA, 12 bp, Homo sapiens
gatgccccagag

SEQ ID NO: 1720240 - DNA, 19 bp, Homo sapiens
gatgccccctccaggagag

SEQ ID NO: 1720241 - DNA, 13 bp, Homo sapiens
gatgcccctgaca

SEQ ID NO: 1720242 - DNA, 21 bp, Homo sapiens
gatgcccctgcagtttggccc

SEQ ID NO: 1720243 - DNA, 16 bp, Homo sapiens
gatgcctccaccgctg

SEQ ID NO: 1720244 - DNA, 17 bp, Homo sapiens
gatgcctccaccgctgc

SEQ ID NO: 1720245 - DNA, 15 bp, Homo sapiens
gatgcctccttggcc

SEQ ID NO: 1720246 - DNA, 20 bp, Homo sapiens
gatgcctccttggccaccag

SEQ ID NO: 1720247 - DNA, 14 bp, Homo sapiens
gatgcgcagtgcct

SEQ ID NO: 1720248 - DNA, 16 bp, Homo sapiens
gatgcggatcctgctg

SEQ ID NO: 1720249 - DNA, 18 bp, Homo sapiens
gatgcggatcctgctggg

SEQ ID NO: 1720250 - DNA, 20 bp, Homo sapiens
gatgcgttgttacaggaagt

SEQ ID NO: 1720251 - DNA, 16 bp, Homo sapiens
gatgctaaagatgatg

SEQ ID NO: 1720252 - DNA, 16 bp, Homo sapiens
gatgctaggctgtctg

SEQ ID NO: 1720253 - DNA, 14 bp, Homo sapiens
gatgctcaggcttg

SEQ ID NO: 1720254 - DNA, 19 bp, Homo sapiens
gatgctccaagattctaga

SEQ ID NO: 1720255 - DNA, 19 bp, Homo sapiens
gatgctccagggcagcctc

SEQ ID NO: 1720256 - DNA, 23 bp, Homo sapiens
gatgctccctcccctgccctggt

SEQ ID NO: 1720257 - DNA, 19 bp, Homo sapiens
gatgctctttcccaggacg

SEQ ID NO: 1720258 - DNA, 18 bp, Homo sapiens
gatgctgaggccacccac

SEQ ID NO: 1720259 - DNA, 19 bp, Homo sapiens
gatgctgccccgttccctg

SEQ ID NO: 1720260 - DNA, 11 bp, Homo sapiens
gatgctgcttt

SEQ ID NO: 1720261 - DNA, 17 bp, Homo sapiens
gatgctggatgtctgcc

SEQ ID NO: 1720262 - DNA, 23 bp, Homo sapiens
gatgctggcccagggcccagagc

SEQ ID NO: 1720263 - DNA, 19 bp, Homo sapiens
gatgctgggagttctaaca

SEQ ID NO: 1720264 - DNA, 19 bp, Homo sapiens
gatgctgggcaatgaggca

SEQ ID NO: 1720265 - DNA, 21 bp, Homo sapiens
gatgctgggcacttcatctga

SEQ ID NO: 1720266 - DNA, 23 bp, Homo sapiens
gatgctgggcacttcatctgatc

SEQ ID NO: 1720267 - DNA, 12 bp, Homo sapiens
gatgctgggctg

SEQ ID NO: 1720268 - DNA, 20 bp, Homo sapiens
gatgctgggttggtgcacag

SEQ ID NO: 1720269 - DNA, 18 bp, Homo sapiens
gatgctgtcggcaccatg

SEQ ID NO: 1720270 - DNA, 17 bp, Homo sapiens
gatgctgttgagggcca

SEQ ID NO: 1720271 - DNA, 13 bp, Homo sapiens
gatgctgtttgac

SEQ ID NO: 1720272 - DNA, 14 bp, Homo sapiens
gatgctgtttgaca

SEQ ID NO: 1720273 - DNA, 20 bp, Homo sapiens
gatgcttgcggcaaaaggaa

SEQ ID NO: 1720274 - DNA, 19 bp, Homo sapiens
gatgcttggagcaatcaga

SEQ ID NO: 1720275 - DNA, 18 bp, Homo sapiens
gatgcttgtaacaagaaa

SEQ ID NO: 1720276 - DNA, 21 bp, Homo sapiens
gatgcttgtaacaagaaaaca

SEQ ID NO: 1720277 - DNA, 18 bp, Homo sapiens
gatggaaaataaacatca

SEQ ID NO: 1720278 - DNA, 14 bp, Homo sapiens
gatggaaatacagt

SEQ ID NO: 1720279 - DNA, 21 bp, Homo sapiens
gatggaacaggctcagatctc

SEQ ID NO: 1720280 - DNA, 15 bp, Homo sapiens
gatggaagatggtcc

SEQ ID NO: 1720281 - DNA, 15 bp, Homo sapiens
gatggacacgagcca

SEQ ID NO: 1720282 - DNA, 19 bp, Homo sapiens
gatggacacgagccacaag

SEQ ID NO: 1720283 - DNA, 15 bp, Homo sapiens
gatggaccgggtggg

SEQ ID NO: 1720284 - DNA, 20 bp, Homo sapiens
gatggaccgggtgggcctgg

SEQ ID NO: 1720285 - DNA, 23 bp, Homo sapiens
gatggaccgggtgggcctggcct

SEQ ID NO: 1720286 - DNA, 13 bp, Homo sapiens
gatggactcctga

SEQ ID NO: 1720287 - DNA, 18 bp, Homo sapiens
gatggagaaagaagtgga

SEQ ID NO: 1720288 - DNA, 22 bp, Homo sapiens
gatggagacaccctctgggggt

SEQ ID NO: 1720289 - DNA, 13 bp, Homo sapiens
gatggagagaata

SEQ ID NO: 1720290 - DNA, 14 bp, Homo sapiens
gatggagagagggg

SEQ ID NO: 1720291 - DNA, 14 bp, Homo sapiens
gatggagccccacc

SEQ ID NO: 1720292 - DNA, 23 bp, Homo sapiens
gatggagccccaccttgtctgct

SEQ ID NO: 1720293 - DNA, 22 bp, Homo sapiens
gatggagcgcacctgccccctg

SEQ ID NO: 1720294 - DNA, 22 bp, Homo sapiens
gatggaggggtggtcctgactc

SEQ ID NO: 1720295 - DNA, 17 bp, Homo sapiens
gatggagggtggaaata

SEQ ID NO: 1720296 - DNA, 19 bp, Homo sapiens
gatggagtgtgcagacagc

SEQ ID NO: 1720297 - DNA, 18 bp, Homo sapiens
gatggagttcttgtgcca

SEQ ID NO: 1720298 - DNA, 16 bp, Homo sapiens
gatggatcaccattat

SEQ ID NO: 1720299 - DNA, 12 bp, Homo sapiens
gatggatggcac

SEQ ID NO: 1720300 - DNA, 15 bp, Homo sapiens
gatggatggcaccct

SEQ ID NO: 1720301 - DNA, 19 bp, Homo sapiens
gatggatttgcctgtgcca

SEQ ID NO: 1720302 - DNA, 20 bp, Homo sapiens
gatggcaaagaaggagagca

SEQ ID NO: 1720303 - DNA, 22 bp, Homo sapiens
gatggcaacagatctggaacct

SEQ ID NO: 1720304 - DNA, 14 bp, Homo sapiens
gatggcaccctgga

SEQ ID NO: 1720305 - DNA, 15 bp, Homo sapiens
gatggcaccctggaa

SEQ ID NO: 1720306 - DNA, 16 bp, Homo sapiens
gatggcaccctggaac

SEQ ID NO: 1720307 - DNA, 18 bp, Homo sapiens
gatggcaccctggaaccg

SEQ ID NO: 1720308 - DNA, 13 bp, Homo sapiens
gatggcagagcca

SEQ ID NO: 1720309 - DNA, 24 bp, Homo sapiens
gatggcatttggtctcaggcagca

SEQ ID NO: 1720310 - DNA, 14 bp, Homo sapiens
gatggccaagagca

SEQ ID NO: 1720311 - DNA, 18 bp, Homo sapiens
gatggccccatctggatg

SEQ ID NO: 1720312 - DNA, 17 bp, Homo sapiens
gatggcccccagctggt

SEQ ID NO: 1720313 - DNA, 22 bp, Homo sapiens
gagtgggccccgggctggagaa

SEQ ID NO: 1720314 - DNA, 17 bp, Homo sapiens
gagtgggcgcagtggct

SEQ ID NO: 1720315 - DNA, 16 bp, Homo sapiens
gagtggggcctgccct

SEQ ID NO: 1720316 - DNA, 18 bp, Homo sapiens
gagtgggtgcgtggtata

SEQ ID NO: 1720317 - DNA, 21 bp, Homo sapiens
gagtgggtgcgtggtatacat

SEQ ID NO: 1720318 - DNA, 15 bp, Homo sapiens
gagtgggtggaggca

SEQ ID NO: 1720319 - DNA, 15 bp, Homo sapiens
gagtggttgttgcca

SEQ ID NO: 1720320 - DNA, 21 bp, Homo sapiens
gagtggtttaggctatttgta

SEQ ID NO: 1720321 - DNA, 17 bp, Homo sapiens
gagtgtagactgtggct

SEQ ID NO: 1720322 - DNA, 23 bp, Homo sapiens
gagtgtagcctaaagggcagggc

SEQ ID NO: 1720323 - DNA, 20 bp, Homo sapiens
gagtgtagctgtaagggcag

SEQ ID NO: 1720324 - DNA, 23 bp, Homo sapiens
gagtgtagctgtaagggcagtgc

SEQ ID NO: 1720325 - DNA, 14 bp, Homo sapiens
gagtgtcccaagcc

SEQ ID NO: 1720326 - DNA, 23 bp, Homo sapiens
gagtgtccttgcaggggccggag

SEQ ID NO: 1720327 - DNA, 13 bp, Homo sapiens
gagtgtgtaattt

SEQ ID NO: 1720328 - DNA, 16 bp, Homo sapiens
gagtgtgtgggcaggg

SEQ ID NO: 1720329 - DNA, 22 bp, Homo sapiens
gagtgttcattttagtgactgt

SEQ ID NO: 1720330 - DNA, 21 bp, Homo sapiens
gatacgtccgtgtgtcccaga

SEQ ID NO: 1720331 - DNA, 15 bp, Homo sapiens
gatactctcagattt

SEQ ID NO: 1720332 - DNA, 17 bp, Homo sapiens
gatactgcgactttctg

SEQ ID NO: 1720333 - DNA, 23 bp, Homo sapiens
gatactgcgactttctgcctgga

SEQ ID NO: 1720334 - DNA, 20 bp, Homo sapiens
gatactggaagttttgcatt

SEQ ID NO: 1720335 - DNA, 19 bp, Homo sapiens
gatacttagtggtatgtct

SEQ ID NO: 1720336 - DNA, 22 bp, Homo sapiens
gatacttagtggtatgtctctt

SEQ ID NO: 1720337 - DNA, 20 bp, Homo sapiens
gatacttcaggtgcttttga

SEQ ID NO: 1720338 - DNA, 19 bp, Homo sapiens
gatagaaaatccttcagct

SEQ ID NO: 1720339 - DNA, 11 bp, Homo sapiens
gatagaaagct

SEQ ID NO: 1720340 - DNA, 14 bp, Homo sapiens
gatagaaagctgga

SEQ ID NO: 1720341 - DNA, 18 bp, Homo sapiens
gatagaaagctggactga

SEQ ID NO: 1720342 - DNA, 21 bp, Homo sapiens
gatagaacacaaaacttgaaa

SEQ ID NO: 1720343 - DNA, 14 bp, Homo sapiens
gatagaactgtact

SEQ ID NO: 1720344 - DNA, 22 bp, Homo sapiens
gatagaactgtactgttttctg

SEQ ID NO: 1720345 - DNA, 13 bp, Homo sapiens
gatagacttggga

SEQ ID NO: 1720346 - DNA, 21 bp, Homo sapiens
gatagacttgggatggggagg

SEQ ID NO: 1720347 - DNA, 11 bp, Homo sapiens
gatagagaaat

SEQ ID NO: 1720348 - DNA, 22 bp, Homo sapiens
gatagcatggggcccctggccc

SEQ ID NO: 1720349 - DNA, 14 bp, Homo sapiens
gatagctggggctt

SEQ ID NO: 1720350 - DNA, 16 bp, Homo sapiens
gatagctggggcttca

SEQ ID NO: 1720351 - DNA, 18 bp, Homo sapiens
gatagcttacactgagga

SEQ ID NO: 1720352 - DNA, 20 bp, Homo sapiens
gatagctttattttttaagt

SEQ ID NO: 1720353 - DNA, 15 bp, Homo sapiens
gataggaaactgaag

SEQ ID NO: 1720354 - DNA, 20 bp, Homo sapiens
gataggctctgcacagatgg

SEQ ID NO: 1720355 - DNA, 17 bp, Homo sapiens
gatagtactaagcattt

SEQ ID NO: 1720356 - DNA, 14 bp, Homo sapiens
gatagtcacctgct

SEQ ID NO: 1720357 - DNA, 22 bp, Homo sapiens
gatagtctttcagttaaggaga

SEQ ID NO: 1720358 - DNA, 23 bp, Homo sapiens
gatagtcttttgcttttggcaaa

SEQ ID NO: 1720359 - DNA, 23 bp, Homo sapiens
gatagtgggcaccccactgcaat

SEQ ID NO: 1720360 - DNA, 22 bp, Homo sapiens
gatagtgttctgctcctgcttt

SEQ ID NO: 1720361 - DNA, 14 bp, Homo sapiens
gatataaaatgaaa

SEQ ID NO: 1720362 - DNA, 14 bp, Homo sapiens
gatataaaatgtgc

SEQ ID NO: 1720363 - DNA, 15 bp, Homo sapiens
gatataaaatgtgca

SEQ ID NO: 1720364 - DNA, 21 bp, Homo sapiens
gatataaatgcaatattaatg

SEQ ID NO: 1720365 - DNA, 18 bp, Homo sapiens
gatataaatttttaagag

SEQ ID NO: 1720366 - DNA, 21 bp, Homo sapiens
gatataaatttttaagagaaa

SEQ ID NO: 1720367 - DNA, 15 bp, Homo sapiens
gatataactgtcttg

SEQ ID NO: 1720368 - DNA, 16 bp, Homo sapiens
gatataactgtcttgt

SEQ ID NO: 1720369 - DNA, 20 bp, Homo sapiens
gatataactgtcttgtttca

SEQ ID NO: 1720370 - DNA, 16 bp, Homo sapiens
gatataagagaagtct

SEQ ID NO: 1720371 - DNA, 19 bp, Homo sapiens
gatataagagaagtctcat

SEQ ID NO: 1720372 - DNA, 22 bp, Homo sapiens
gatataagagaagtctcattcg

SEQ ID NO: 1720373 - DNA, 21 bp, Homo sapiens
gatatactatgggatgtatat

SEQ ID NO: 1720374 - DNA, 22 bp, Homo sapiens
gatatacttgtttttgtaaaga

SEQ ID NO: 1720375 - DNA, 20 bp, Homo sapiens
gatatagacagtccttaaaa

SEQ ID NO: 1720376 - DNA, 14 bp, Homo sapiens
gatatagagtcatt

SEQ ID NO: 1720377 - DNA, 20 bp, Homo sapiens
gatatagtagttacttgtga

SEQ ID NO: 1720378 - DNA, 13 bp, Homo sapiens
gatatataaataa

SEQ ID NO: 1720379 - DNA, 20 bp, Homo sapiens
gatatataatggtaatagaa

SEQ ID NO: 1720380 - DNA, 23 bp, Homo sapiens
gatatatgctctgcatgttacat

SEQ ID NO: 1720381 - DNA, 18 bp, Homo sapiens
gatatatggaggattctt

SEQ ID NO: 1720382 - DNA, 16 bp, Homo sapiens
gatatatggataatgc

SEQ ID NO: 1720383 - DNA, 23 bp, Homo sapiens
gatatattttacaattttttatc

SEQ ID NO: 1720384 - DNA, 16 bp, Homo sapiens
gatatatttttaagat

SEQ ID NO: 1720385 - DNA, 12 bp, Homo sapiens
gatatcaaaatt

SEQ ID NO: 1720386 - DNA, 23 bp, Homo sapiens
gatatctataaaatagatataaa

SEQ ID NO: 1720387 - DNA, 21 bp, Homo sapiens
gatatctgagggaggaggcca

SEQ ID NO: 1720388 - DNA, 16 bp, Homo sapiens
gatatgaccaaaattt

SEQ ID NO: 1720389 - DNA, 18 bp, Homo sapiens
gatatgcagttttcctta

SEQ ID NO: 1720390 - DNA, 17 bp, Homo sapiens
gatatgcatatttgttt

SEQ ID NO: 1720391 - DNA, 22 bp, Homo sapiens
gatatgtctgctgagttggcct

SEQ ID NO: 1720392 - DNA, 15 bp, Homo sapiens
gatatgtgtgtgttt

SEQ ID NO: 1720393 - DNA, 14 bp, Homo sapiens
gatattaaatttca

SEQ ID NO: 1720394 - DNA, 12 bp, Homo sapiens
gatattaatcaa

SEQ ID NO: 1720395 - DNA, 18 bp, Homo sapiens
gatattataagggagagc

SEQ ID NO: 1720396 - DNA, 15 bp, Homo sapiens
gatattatagaaaat

SEQ ID NO: 1720397 - DNA, 16 bp, Homo sapiens
gatattatattaaaca

SEQ ID NO: 1720398 - DNA, 23 bp, Homo sapiens
gatattattagaaattagaaaaa

SEQ ID NO: 1720399 - DNA, 15 bp, Homo sapiens
gatattattcttgta

SEQ ID NO: 1720400 - DNA, 15 bp, Homo sapiens
gatattatttcttct

SEQ ID NO: 1720401 - DNA, 16 bp, Homo sapiens
gatattccatgaatgt

SEQ ID NO: 1720402 - DNA, 20 bp, Homo sapiens
gatattccccccacttaaga

SEQ ID NO: 1720403 - DNA, 18 bp, Homo sapiens
gatattctccctgacctt

SEQ ID NO: 1720404 - DNA, 16 bp, Homo sapiens
gatattgaatgttaaa

SEQ ID NO: 1720405 - DNA, 11 bp, Homo sapiens
gatattgcctt

SEQ ID NO: 1720406 - DNA, 14 bp, Homo sapiens
gatattgtacataa

SEQ ID NO: 1720407 - DNA, 16 bp, Homo sapiens
gatattgtgaagtaca

SEQ ID NO: 1720408 - DNA, 21 bp, Homo sapiens
gatattgttttctgtaaataa

SEQ ID NO: 1720409 - DNA, 23 bp, Homo sapiens
gatatttaagaaaatacaataaa

SEQ ID NO: 1720410 - DNA, 17 bp, Homo sapiens
gatatttcagaaataca

SEQ ID NO: 1720411 - DNA, 20 bp, Homo sapiens
gatatttccatttcttcctc

SEQ ID NO: 1720412 - DNA, 13 bp, Homo sapiens
gatatttcttgct

SEQ ID NO: 1720413 - DNA, 14 bp, Homo sapiens
gatatttcttgctt

SEQ ID NO: 1720414 - DNA, 16 bp, Homo sapiens
gatatttcttgctttc

SEQ ID NO: 1720415 - DNA, 20 bp, Homo sapiens
gatatttgtatttattcttt

SEQ ID NO: 1720416 - DNA, 21 bp, Homo sapiens
gatatttgtatttatttccag

SEQ ID NO: 1720417 - DNA, 19 bp, Homo sapiens
gatattttcaacgcagccc

SEQ ID NO: 1720418 - DNA, 21 bp, Homo sapiens
gatattttcaacgcagccctg

SEQ ID NO: 1720419 - DNA, 22 bp, Homo sapiens
gatattttcaacgcagccctgc

SEQ ID NO: 1720420 - DNA, 15 bp, Homo sapiens
gatattttctgtgcc

SEQ ID NO: 1720421 - DNA, 20 bp, Homo sapiens
gatattttcttccaagcaaa

SEQ ID NO: 1720422 - DNA, 22 bp, Homo sapiens
gatatttttcataaacaagttc

SEQ ID NO: 1720423 - DNA, 20 bp, Homo sapiens
gatcaaaaagaaactttgtt

SEQ ID NO: 1720424 - DNA, 15 bp, Homo sapiens
gatcaaaaataaact

SEQ ID NO: 1720425 - DNA, 16 bp, Homo sapiens
gatcaaaaccttcctt

SEQ ID NO: 1720426 - DNA, 21 bp, Homo sapiens
gatcaaaaccttccttccctg

SEQ ID NO: 1720427 - DNA, 20 bp, Homo sapiens
gatcaaaaggttaataaagt

SEQ ID NO: 1720428 - DNA, 23 bp, Homo sapiens
gatcaaaaggttaataaagtaat

SEQ ID NO: 1720429 - DNA, 17 bp, Homo sapiens
gatcaaaataaaaagtg

SEQ ID NO: 1720430 - DNA, 16 bp, Homo sapiens
gatcaaatagttgcat

SEQ ID NO: 1720431 - DNA, 16 bp, Homo sapiens
gatcaaattctacaac

SEQ ID NO: 1720432 - DNA, 20 bp, Homo sapiens
gcaccaggcacgaacccacc

SEQ ID NO: 1720433 - DNA, 19 bp, Homo sapiens
gcaccaggggtttctcgca

SEQ ID NO: 1720434 - DNA, 23 bp, Homo sapiens
gcaccatacattatttcttccca

SEQ ID NO: 1720435 - DNA, 15 bp, Homo sapiens
gcaccatcagcctgt

SEQ ID NO: 1720436 - DNA, 13 bp, Homo sapiens
gcaccatcatgtt

SEQ ID NO: 1720437 - DNA, 14 bp, Homo sapiens
gcaccatctgcttg

SEQ ID NO: 1720438 - DNA, 20 bp, Homo sapiens
gcaccatgctgctggggaag

SEQ ID NO: 1720439 - DNA, 19 bp, Homo sapiens
gcaccatgtgggcacggag

SEQ ID NO: 1720440 - DNA, 15 bp, Homo sapiens
gcaccattctcctgc

SEQ ID NO: 1720441 - DNA, 15 bp, Homo sapiens
gcaccattctgactc

SEQ ID NO: 1720442 - DNA, 12 bp, Homo sapiens
gcacccacccct

SEQ ID NO: 1720443 - DNA, 19 bp, Homo sapiens
gcacccaccgtggaggagg

SEQ ID NO: 1720444 - DNA, 22 bp, Homo sapiens
gcacccacctgttttctgaaac

SEQ ID NO: 1720445 - DNA, 12 bp, Homo sapiens
gcacccagaaca

SEQ ID NO: 1720446 - DNA, 12 bp, Homo sapiens
gcacccagagca

SEQ ID NO: 1720447 - DNA, 17 bp, Homo sapiens
gcacccagagcaccccc

SEQ ID NO: 1720448 - DNA, 22 bp, Homo sapiens
gcacccagagcaccccctgctc

SEQ ID NO: 1720449 - DNA, 15 bp, Homo sapiens
gcacccgccctttcc

SEQ ID NO: 1720450 - DNA, 13 bp, Homo sapiens
gcacccgcctctc

SEQ ID NO: 1720451 - DNA, 17 bp, Homo sapiens
gcaccctaggcagcctg

SEQ ID NO: 1720452 - DNA, 16 bp, Homo sapiens
gcaccctccaccctgt

SEQ ID NO: 1720453 - DNA, 17 bp, Homo sapiens
gcaccctccaccctgtc

SEQ ID NO: 1720454 - DNA, 18 bp, Homo sapiens
gcaccctccaccctgtcc

SEQ ID NO: 1720455 - DNA, 22 bp, Homo sapiens
gcaccctccaccctgtccccca

SEQ ID NO: 1720456 - DNA, 15 bp, Homo sapiens
gcaccctctatccca

SEQ ID NO: 1720457 - DNA, 16 bp, Homo sapiens
gcaccctgcgcctcca

SEQ ID NO: 1720458 - DNA, 20 bp, Homo sapiens
gcaccctgcgcctccagagg

SEQ ID NO: 1720459 - DNA, 22 bp, Homo sapiens
gcaccctggaaaggggagttga

SEQ ID NO: 1720460 - DNA, 16 bp, Homo sapiens
gcaccctggcctggtc

SEQ ID NO: 1720461 - DNA, 17 bp, Homo sapiens
gcaccctggcctggtcc

SEQ ID NO: 1720462 - DNA, 12 bp, Homo sapiens
gcaccctgggtg

SEQ ID NO: 1720463 - DNA, 13 bp, Homo sapiens
gcaccctgggtgc

SEQ ID NO: 1720464 - DNA, 15 bp, Homo sapiens
gcaccctgggtgcca

SEQ ID NO: 1720465 - DNA, 22 bp, Homo sapiens
gcacccttccctcttccctctc

SEQ ID NO: 1720466 - DNA, 23 bp, Homo sapiens
gcacccttccctcttccctctcc

SEQ ID NO: 1720467 - DNA, 12 bp, Homo sapiens
gcaccgccacgt

SEQ ID NO: 1720468 - DNA, 20 bp, Homo sapiens
gcaccgccacgtcccagcat

SEQ ID NO: 1720469 - DNA, 13 bp, Homo sapiens
gcaccgcctgccc

SEQ ID NO: 1720470 - DNA, 22 bp, Homo sapiens
gcaccgcggcgcttcccagcac

SEQ ID NO: 1720471 - DNA, 21 bp, Homo sapiens
gcaccgtcatggcttaatgtt

SEQ ID NO: 1720472 - DNA, 15 bp, Homo sapiens
gcacctaatccaggc

SEQ ID NO: 1720473 - DNA, 19 bp, Homo sapiens
gcacctacatccccaggtc

SEQ ID NO: 1720474 - DNA, 20 bp, Homo sapiens
gcacctaccccttggaaatg

SEQ ID NO: 1720475 - DNA, 13 bp, Homo sapiens
gcacctcagcctg

SEQ ID NO: 1720476 - DNA, 15 bp, Homo sapiens
gcacctccaggcctg

SEQ ID NO: 1720477 - DNA, 18 bp, Homo sapiens
gcacctccccccactgca

SEQ ID NO: 1720478 - DNA, 19 bp, Homo sapiens
gcacctccccccactgcag

SEQ ID NO: 1720479 - DNA, 18 bp, Homo sapiens
gcacctccccgctctccc

SEQ ID NO: 1720480 - DNA, 16 bp, Homo sapiens
gcacctccccgctggg

SEQ ID NO: 1720481 - DNA, 15 bp, Homo sapiens
gcacctcccttccct

SEQ ID NO: 1720482 - DNA, 16 bp, Homo sapiens
gcacctcctgagaagg

SEQ ID NO: 1720483 - DNA, 21 bp, Homo sapiens
gcacctcggggacaccagagc

SEQ ID NO: 1720484 - DNA, 23 bp, Homo sapiens
gcacctcggggacaccagagctg

SEQ ID NO: 1720485 - DNA, 19 bp, Homo sapiens
gcacctctggctagagccg

SEQ ID NO: 1720486 - DNA, 14 bp, Homo sapiens
gcacctcttccttg

SEQ ID NO: 1720487 - DNA, 16 bp, Homo sapiens
gcacctgaaccccatg

SEQ ID NO: 1720488 - DNA, 18 bp, Homo sapiens
gcacctgaaccccatggg

SEQ ID NO: 1720489 - DNA, 12 bp, Homo sapiens
gcacctgagacc

SEQ ID NO: 1720490 - DNA, 13 bp, Homo sapiens
gcacctgagaccc

SEQ ID NO: 1720491 - DNA, 18 bp, Homo sapiens
gcacctgattagttgaaa

SEQ ID NO: 1720492 - DNA, 15 bp, Homo sapiens
gcacctgccagcctg

SEQ ID NO: 1720493 - DNA, 16 bp, Homo sapiens
gcacctgccagcctgg

SEQ ID NO: 1720494 - DNA, 22 bp, Homo sapiens
gcacctgccagcctggcttctg

SEQ ID NO: 1720495 - DNA, 16 bp, Homo sapiens
gcacctgccccctggt

SEQ ID NO: 1720496 - DNA, 18 bp, Homo sapiens
gcacctgccccctggtgg

SEQ ID NO: 1720497 - DNA, 21 bp, Homo sapiens
gcacctgccgacctcgtcctc

SEQ ID NO: 1720498 - DNA, 16 bp, Homo sapiens
gcacctgcctccacca

SEQ ID NO: 1720499 - DNA, 18 bp, Homo sapiens
gcacctgcctccaccagc

SEQ ID NO: 1720500 - DNA, 16 bp, Homo sapiens
gcacctgctgcgtccc

SEQ ID NO: 1720501 - DNA, 21 bp, Homo sapiens
gcacctgctgcgtccccactc

SEQ ID NO: 1720502 - DNA, 23 bp, Homo sapiens
gcacctgctgcgtccccactccc

SEQ ID NO: 1720503 - DNA, 17 bp, Homo sapiens
gcacctggcctgctggg

SEQ ID NO: 1720504 - DNA, 18 bp, Homo sapiens
gcacctggcctgctggga

SEQ ID NO: 1720505 - DNA, 17 bp, Homo sapiens
gcacctggcctgggcca

SEQ ID NO: 1720506 - DNA, 20 bp, Homo sapiens
gcacctggctgagcctggct

SEQ ID NO: 1720507 - DNA, 21 bp, Homo sapiens
gcacctggctgagcctggctg

SEQ ID NO: 1720508 - DNA, 17 bp, Homo sapiens
gcacctggtgggtggtg

SEQ ID NO: 1720509 - DNA, 18 bp, Homo sapiens
gcacctgtagtcccagct

SEQ ID NO: 1720510 - DNA, 22 bp, Homo sapiens
gcacctgtctggattgttttta

SEQ ID NO: 1720511 - DNA, 14 bp, Homo sapiens
gcaccttcctcctc

SEQ ID NO: 1720512 - DNA, 15 bp, Homo sapiens
gcaccttggcccagg

SEQ ID NO: 1720513 - DNA, 20 bp, Homo sapiens
gcaccttgtgtctgtacacg

SEQ ID NO: 1720514 - DNA, 11 bp, Homo sapiens
gcaccttttca

SEQ ID NO: 1720515 - DNA, 17 bp, Homo sapiens
gcacgaacccacctgct

SEQ ID NO: 1720516 - DNA, 17 bp, Homo sapiens
gcacgacgtcagcctct

SEQ ID NO: 1720517 - DNA, 23 bp, Homo sapiens
gcacgagctggaacccacgagga

SEQ ID NO: 1720518 - DNA, 12 bp, Homo sapiens
gcacgcaccact

SEQ ID NO: 1720519 - DNA, 16 bp, Homo sapiens
gcacgcacttgcctgt

SEQ ID NO: 1720520 - DNA, 16 bp, Homo sapiens
gcacgcatctgtagtt

SEQ ID NO: 1720521 - DNA, 14 bp, Homo sapiens
gcacgccctactcc

SEQ ID NO: 1720522 - DNA, 13 bp, Homo sapiens
gcacgcctgccat

SEQ ID NO: 1720523 - DNA, 23 bp, Homo sapiens
gcacgcggattaatttgcatctg

SEQ ID NO: 1720524 - DNA, 14 bp, Homo sapiens
gcacggagagaagg

SEQ ID NO: 1720525 - DNA, 15 bp, Homo sapiens
gcacgggcatgcaca

SEQ ID NO: 1720526 - DNA, 18 bp, Homo sapiens
gcacggtacaaacccaaa

SEQ ID NO: 1720527 - DNA, 20 bp, Homo sapiens
gcacggtggacccagacaca

SEQ ID NO: 1720528 - DNA, 18 bp, Homo sapiens
gcacggttcaatggtaga

SEQ ID NO: 1720529 - DNA, 18 bp, Homo sapiens
gcacgtggagagctggtg

SEQ ID NO: 1720530 - DNA, 20 bp, Homo sapiens
gcacgtggagagctggtgcc

SEQ ID NO: 1720531 - DNA, 14 bp, Homo sapiens
gcacgtggcctctt

SEQ ID NO: 1720532 - DNA, 15 bp, Homo sapiens
gcacgtggcctcttg

SEQ ID NO: 1720533 - DNA, 17 bp, Homo sapiens
gcactaaatcagagaca

SEQ ID NO: 1720534 - DNA, 20 bp, Homo sapiens
gcactaaccaatgccttttt

SEQ ID NO: 1720535 - DNA, 13 bp, Homo sapiens
gcactacaatcat

SEQ ID NO: 1720536 - DNA, 13 bp, Homo sapiens
gcactactcctct

SEQ ID NO: 1720537 - DNA, 15 bp, Homo sapiens
gcactactctgtgcc

SEQ ID NO: 1720538 - DNA, 18 bp, Homo sapiens
gcactagaaattgggcag

SEQ ID NO: 1720539 - DNA, 14 bp, Homo sapiens
gcactagcctgtga

SEQ ID NO: 1720540 - DNA, 18 bp, Homo sapiens
gcactagtcaccgacagc

SEQ ID NO: 1720541 - DNA, 21 bp, Homo sapiens
gcactagtcaccgacagcggc

SEQ ID NO: 1720542 - DNA, 13 bp, Homo sapiens
gcactattttata

SEQ ID NO: 1720543 - DNA, 17 bp, Homo sapiens
gcactattttatattta

SEQ ID NO: 1720544 - DNA, 18 bp, Homo sapiens
gcactcaaatcttaagaa

SEQ ID NO: 1720545 - DNA, 20 bp, Homo sapiens
gcactcaaatcttaagaaat

SEQ ID NO: 1720546 - DNA, 19 bp, Homo sapiens
gcactcaaccttaagacct

SEQ ID NO: 1720547 - DNA, 14 bp, Homo sapiens
gcagcaggctcagg

SEQ ID NO: 1720548 - DNA, 14 bp, Homo sapiens
gcagcagggaagct

SEQ ID NO: 1720549 - DNA, 23 bp, Homo sapiens
gcagcatcggacaagacccccag

SEQ ID NO: 1720550 - DNA, 15 bp, Homo sapiens
gcagcatcttcaaac

SEQ ID NO: 1720551 - DNA, 18 bp, Homo sapiens
gcagcatgcttgggctga

SEQ ID NO: 1720552 - DNA, 15 bp, Homo sapiens
gcagcatggaaaaat

SEQ ID NO: 1720553 - DNA, 19 bp, Homo sapiens
gcagcatttactatgcaca

SEQ ID NO: 1720554 - DNA, 20 bp, Homo sapiens
gcagcatttactatgcacaa

SEQ ID NO: 1720555 - DNA, 14 bp, Homo sapiens
gcagccaacctaag

SEQ ID NO: 1720556 - DNA, 22 bp, Homo sapiens
gcagccaaggccgccagcgtgt

SEQ ID NO: 1720557 - DNA, 19 bp, Homo sapiens
gcagccacccaagcctgct

SEQ ID NO: 1720558 - DNA, 22 bp, Homo sapiens
gcagccacggccccgggtccag

SEQ ID NO: 1720559 - DNA, 22 bp, Homo sapiens
gcagccactgcacaggaggagg

SEQ ID NO: 1720560 - DNA, 18 bp, Homo sapiens
gcagccacttaggacaaa

SEQ ID NO: 1720561 - DNA, 19 bp, Homo sapiens
gcagccagaccagcaggct

SEQ ID NO: 1720562 - DNA, 11 bp, Homo sapiens
gcagccagagc

SEQ ID NO: 1720563 - DNA, 12 bp, Homo sapiens
gcagccagagct

SEQ ID NO: 1720564 - DNA, 13 bp, Homo sapiens
gcagccagcacca

SEQ ID NO: 1720565 - DNA, 12 bp, Homo sapiens
gcagccagcaga

SEQ ID NO: 1720566 - DNA, 15 bp, Homo sapiens
gcagccagccagtct

SEQ ID NO: 1720567 - DNA, 20 bp, Homo sapiens
gcagccagccagtcttgcct

SEQ ID NO: 1720568 - DNA, 23 bp, Homo sapiens
gcagccagccagtcttgcctagg

SEQ ID NO: 1720569 - DNA, 16 bp, Homo sapiens
gcagccagcccagccc

SEQ ID NO: 1720570 - DNA, 23 bp, Homo sapiens
gcagccagcccagcccagctggt

SEQ ID NO: 1720571 - DNA, 18 bp, Homo sapiens
gcagccagccggtgcctg

SEQ ID NO: 1720572 - DNA, 19 bp, Homo sapiens
gcagccagccggtgcctgg

SEQ ID NO: 1720573 - DNA, 13 bp, Homo sapiens
gcagccagccgtg

SEQ ID NO: 1720574 - DNA, 23 bp, Homo sapiens
gcagccagccgtgagtgcagacc

SEQ ID NO: 1720575 - DNA, 18 bp, Homo sapiens
gcagccagctctcagcca

SEQ ID NO: 1720576 - DNA, 13 bp, Homo sapiens
gcagccaggacac

SEQ ID NO: 1720577 - DNA, 19 bp, Homo sapiens
gcagccaggacaccgggca

SEQ ID NO: 1720578 - DNA, 14 bp, Homo sapiens
gcagccaggctgcc

SEQ ID NO: 1720579 - DNA, 19 bp, Homo sapiens
gcagccagggacccccaga

SEQ ID NO: 1720580 - DNA, 20 bp, Homo sapiens
gcagccagtctcagagacca

SEQ ID NO: 1720581 - DNA, 13 bp, Homo sapiens
gcagccagttcaa

SEQ ID NO: 1720582 - DNA, 23 bp, Homo sapiens
gcagccatgcctcatgccacacc

SEQ ID NO: 1720583 - DNA, 18 bp, Homo sapiens
gcagcccaacagcacttt

SEQ ID NO: 1720584 - DNA, 20 bp, Homo sapiens
gcagcccagctcctgaataa

SEQ ID NO: 1720585 - DNA, 18 bp, Homo sapiens
gcagcccatgcccacctg

SEQ ID NO: 1720586 - DNA, 20 bp, Homo sapiens
gcagcccatgcccacctgcc

SEQ ID NO: 1720587 - DNA, 13 bp, Homo sapiens
gcagccccacttc

SEQ ID NO: 1720588 - DNA, 14 bp, Homo sapiens
gcagccccctgtgg

SEQ ID NO: 1720589 - DNA, 18 bp, Homo sapiens
gcagccccctgtggcggc

SEQ ID NO: 1720590 - DNA, 21 bp, Homo sapiens
gcagccccggcaactctggct

SEQ ID NO: 1720591 - DNA, 19 bp, Homo sapiens
gcagccccttctggccggt

SEQ ID NO: 1720592 - DNA, 22 bp, Homo sapiens
gcagccccttctggccggtgct

SEQ ID NO: 1720593 - DNA, 23 bp, Homo sapiens
gcagcccgcctgccgtgcatggc

SEQ ID NO: 1720594 - DNA, 23 bp, Homo sapiens
gcagccctaaggatctctcagga

SEQ ID NO: 1720595 - DNA, 23 bp, Homo sapiens
gcagccctcacctctgaggacag

SEQ ID NO: 1720596 - DNA, 18 bp, Homo sapiens
gcagccctccacttctgg

SEQ ID NO: 1720597 - DNA, 15 bp, Homo sapiens
gcagccctcctcacc

SEQ ID NO: 1720598 - DNA, 18 bp, Homo sapiens
gcagccctcctcaccccg

SEQ ID NO: 1720599 - DNA, 21 bp, Homo sapiens
gcagcccttgctttcggagct

SEQ ID NO: 1720600 - DNA, 17 bp, Homo sapiens
gcagccgaggcctggcc

SEQ ID NO: 1720601 - DNA, 21 bp, Homo sapiens
gcagccgaggcctggccaatg

SEQ ID NO: 1720602 - DNA, 13 bp, Homo sapiens
gcagccgccagct

SEQ ID NO: 1720603 - DNA, 17 bp, Homo sapiens
gcagccgctaggagaga

SEQ ID NO: 1720604 - DNA, 18 bp, Homo sapiens
gcagccggagggaggcac

SEQ ID NO: 1720605 - DNA, 14 bp, Homo sapiens
gcagccgtcccagg

SEQ ID NO: 1720606 - DNA, 17 bp, Homo sapiens
gcagccgtcccaggcca

SEQ ID NO: 1720607 - DNA, 15 bp, Homo sapiens
gcagccgtgccttca

SEQ ID NO: 1720608 - DNA, 21 bp, Homo sapiens
gcagcctcaaaacgggtcagt

SEQ ID NO: 1720609 - DNA, 21 bp, Homo sapiens
gcagcctccaccttgctcttc

SEQ ID NO: 1720610 - DNA, 17 bp, Homo sapiens
gcagcctccactgtgtc

SEQ ID NO: 1720611 - DNA, 16 bp, Homo sapiens
gcagcctccacttccc

SEQ ID NO: 1720612 - DNA, 15 bp, Homo sapiens
gcagcctccagagcc

SEQ ID NO: 1720613 - DNA, 19 bp, Homo sapiens
gcagcctccagagccagcc

SEQ ID NO: 1720614 - DNA, 21 bp, Homo sapiens
gcagcctccagagccagcctg

SEQ ID NO: 1720615 - DNA, 22 bp, Homo sapiens
gcagcctccagagccagcctgg

SEQ ID NO: 1720616 - DNA, 14 bp, Homo sapiens
gcagcctcctcctg

SEQ ID NO: 1720617 - DNA, 15 bp, Homo sapiens
gcagcctcctcctga

SEQ ID NO: 1720618 - DNA, 14 bp, Homo sapiens
gcagcctcctttgt

SEQ ID NO: 1720619 - DNA, 15 bp, Homo sapiens
gcagcctcgcacagg

SEQ ID NO: 1720620 - DNA, 16 bp, Homo sapiens
gcagcctcgcacaggc

SEQ ID NO: 1720621 - DNA, 18 bp, Homo sapiens
gcagcctcgcacaggccc

SEQ ID NO: 1720622 - DNA, 23 bp, Homo sapiens
gcagcctcgcacaggccctagct

SEQ ID NO: 1720623 - DNA, 12 bp, Homo sapiens
gcagcctctccc

SEQ ID NO: 1720624 - DNA, 20 bp, Homo sapiens
gcagcctctccgactctgca

SEQ ID NO: 1720625 - DNA, 14 bp, Homo sapiens
gcagcctctgccag

SEQ ID NO: 1720626 - DNA, 17 bp, Homo sapiens
gcagcctctgccaggcc

SEQ ID NO: 1720627 - DNA, 19 bp, Homo sapiens
gcagcctctgtcaggcctt

SEQ ID NO: 1720628 - DNA, 20 bp, Homo sapiens
gcagcctgaagcctggattc

SEQ ID NO: 1720629 - DNA, 12 bp, Homo sapiens
gcagcctgatgg

SEQ ID NO: 1720630 - DNA, 14 bp, Homo sapiens
gcagcctgatggcc

SEQ ID NO: 1720631 - DNA, 15 bp, Homo sapiens
gcagcctgatggcca

SEQ ID NO: 1720632 - DNA, 19 bp, Homo sapiens
gcagcctgatggccaaggg

SEQ ID NO: 1720633 - DNA, 21 bp, Homo sapiens
gcagcctgctctagtgggaca

SEQ ID NO: 1720634 - DNA, 19 bp, Homo sapiens
gcagcctggctcccaggac

SEQ ID NO: 1720635 - DNA, 22 bp, Homo sapiens
gcagcctgtatgtggtgtgggg

SEQ ID NO: 1720636 - DNA, 15 bp, Homo sapiens
gcagcctgtgcctgc

SEQ ID NO: 1720637 - DNA, 12 bp, Homo sapiens
gcagcctgtggc

SEQ ID NO: 1720638 - DNA, 14 bp, Homo sapiens
gcagcctgtggcat

SEQ ID NO: 1720639 - DNA, 16 bp, Homo sapiens
gcagcctgtggcatct

SEQ ID NO: 1720640 - DNA, 19 bp, Homo sapiens
gcagccttgaccacggctg

SEQ ID NO: 1720641 - DNA, 18 bp, Homo sapiens
gcagcgaccgccccctcc

SEQ ID NO: 1720642 - DNA, 22 bp, Homo sapiens
gcagcgaccgccccctcctcta

SEQ ID NO: 1720643 - DNA, 14 bp, Homo sapiens
gcagcgagggcgga

SEQ ID NO: 1720644 - DNA, 21 bp, Homo sapiens
gcagcgagggcggagccggcc

SEQ ID NO: 1720645 - DNA, 16 bp, Homo sapiens
gcagcgcccggtgctc

SEQ ID NO: 1720646 - DNA, 16 bp, Homo sapiens
gcagcgcgcaggcctg

SEQ ID NO: 1720647 - DNA, 17 bp, Homo sapiens
gcagcggattgctctgg

SEQ ID NO: 1720648 - DNA, 14 bp, Homo sapiens
gcagcggcagagca

SEQ ID NO: 1720649 - DNA, 16 bp, Homo sapiens
gcagcggcagagcaat

SEQ ID NO: 1720650 - DNA, 15 bp, Homo sapiens
gcagcgggccaggcc

SEQ ID NO: 1720651 - DNA, 18 bp, Homo sapiens
gcagcgggccaggcccgc

SEQ ID NO: 1720652 - DNA, 19 bp, Homo sapiens
gcagcgggccaggcccgca

SEQ ID NO: 1720653 - DNA, 13 bp, Homo sapiens
gcagcgggcggag

SEQ ID NO: 1720654 - DNA, 12 bp, Homo sapiens
gcagcgtccccc

SEQ ID NO: 1720655 - DNA, 16 bp, Homo sapiens
gcagcgtgtgggtccc

SEQ ID NO: 1720656 - DNA, 18 bp, Homo sapiens
gcagcgtgtgggtcccgc

SEQ ID NO: 1720657 - DNA, 20 bp, Homo sapiens
gcagcgtgtgggtcccgcac

SEQ ID NO: 1720658 - DNA, 16 bp, Homo sapiens
gatcgcttgagcccag

SEQ ID NO: 1720659 - DNA, 20 bp, Homo sapiens
gatcgcttgagcccaggagt

SEQ ID NO: 1720660 - DNA, 13 bp, Homo sapiens
gatcgggaagcag

SEQ ID NO: 1720661 - DNA, 15 bp, Homo sapiens
gatcgtgctaaattt

SEQ ID NO: 1720662 - DNA, 18 bp, Homo sapiens
gatcgtggccaacgtgga

SEQ ID NO: 1720663 - DNA, 15 bp, Homo sapiens
gatctaaaatttgta

SEQ ID NO: 1720664 - DNA, 14 bp, Homo sapiens
gatctaaacttttg

SEQ ID NO: 1720665 - DNA, 18 bp, Homo sapiens
gatctaagaagggctgag

SEQ ID NO: 1720666 - DNA, 15 bp, Homo sapiens
gatctagtccttgtc

SEQ ID NO: 1720667 - DNA, 16 bp, Homo sapiens
gatctataggcagctt

SEQ ID NO: 1720668 - DNA, 19 bp, Homo sapiens
gatctatcacctgtcatca

SEQ ID NO: 1720669 - DNA, 13 bp, Homo sapiens
gatctatttcatg

SEQ ID NO: 1720670 - DNA, 14 bp, Homo sapiens
gatctatttcatgt

SEQ ID NO: 1720671 - DNA, 11 bp, Homo sapiens
gatctcagcca

SEQ ID NO: 1720672 - DNA, 13 bp, Homo sapiens
gatctcagctcac

SEQ ID NO: 1720673 - DNA, 22 bp, Homo sapiens
gatctcagctttgagaagcctt

SEQ ID NO: 1720674 - DNA, 13 bp, Homo sapiens
gatctcaggagcc

SEQ ID NO: 1720675 - DNA, 13 bp, Homo sapiens
gatctcagggcag

SEQ ID NO: 1720676 - DNA, 19 bp, Homo sapiens
gatctcaggggctgtttga

SEQ ID NO: 1720677 - DNA, 21 bp, Homo sapiens
gatctcaggggtcttaccttg

SEQ ID NO: 1720678 - DNA, 21 bp, Homo sapiens
gatctcatggaaactggccag

SEQ ID NO: 1720679 - DNA, 17 bp, Homo sapiens
gatctcattcagtatta

SEQ ID NO: 1720680 - DNA, 12 bp, Homo sapiens
gatctcccctca

SEQ ID NO: 1720681 - DNA, 12 bp, Homo sapiens
gatctccctgcc

SEQ ID NO: 1720682 - DNA, 13 bp, Homo sapiens
gatctccctgccg

SEQ ID NO: 1720683 - DNA, 22 bp, Homo sapiens
gatctcccttggtcttccatgg

SEQ ID NO: 1720684 - DNA, 13 bp, Homo sapiens
gatctcctgacct

SEQ ID NO: 1720685 - DNA, 16 bp, Homo sapiens
gatctcctgctgcctt

SEQ ID NO: 1720686 - DNA, 21 bp, Homo sapiens
gatctctactaccacaaggaa

SEQ ID NO: 1720687 - DNA, 16 bp, Homo sapiens
gatctctcaggagcac

SEQ ID NO: 1720688 - DNA, 19 bp, Homo sapiens
gatctctcaggagcacagg

SEQ ID NO: 1720689 - DNA, 21 bp, Homo sapiens
gatctctcaggagcacaggca

SEQ ID NO: 1720690 - DNA, 14 bp, Homo sapiens
gatctctcctggcc

SEQ ID NO: 1720691 - DNA, 18 bp, Homo sapiens
gatctctcttgtcctctt

SEQ ID NO: 1720692 - DNA, 20 bp, Homo sapiens
gatctctcttgtcctcttct

SEQ ID NO: 1720693 - DNA, 14 bp, Homo sapiens
gatctgactgccaa

SEQ ID NO: 1720694 - DNA, 22 bp, Homo sapiens
gatctgagaacacgttgccagg

SEQ ID NO: 1720695 - DNA, 22 bp, Homo sapiens
gatctgaggttggatttgctca

SEQ ID NO: 1720696 - DNA, 19 bp, Homo sapiens
gatctgatccccaagacat

SEQ ID NO: 1720697 - DNA, 17 bp, Homo sapiens
gatctgatctgtaccat

SEQ ID NO: 1720698 - DNA, 15 bp, Homo sapiens
gatctgatggtgagc

SEQ ID NO: 1720699 - DNA, 20 bp, Homo sapiens
gatctgatggtgagctggga

SEQ ID NO: 1720700 - DNA, 22 bp, Homo sapiens
gatctgcaagaacactggacct

SEQ ID NO: 1720701 - DNA, 20 bp, Homo sapiens
gatctgcacagtcagaagga

SEQ ID NO: 1720702 - DNA, 14 bp, Homo sapiens
gatctgcaggctgc

SEQ ID NO: 1720703 - DNA, 20 bp, Homo sapiens
gatctgcagggggtgtgtct

SEQ ID NO: 1720704 - DNA, 17 bp, Homo sapiens
gatctgccattgggacc

SEQ ID NO: 1720705 - DNA, 22 bp, Homo sapiens
gatctgcccacctcggcctccc

SEQ ID NO: 1720706 - DNA, 23 bp, Homo sapiens
gatctgcctgggcctgtgcagca

SEQ ID NO: 1720707 - DNA, 18 bp, Homo sapiens
gatctgcggatctcagct

SEQ ID NO: 1720708 - DNA, 21 bp, Homo sapiens
gatctgcggatctcagctttg

SEQ ID NO: 1720709 - DNA, 17 bp, Homo sapiens
gatctgctgaggcccag

SEQ ID NO: 1720710 - DNA, 14 bp, Homo sapiens
gatctggaacccag

SEQ ID NO: 1720711 - DNA, 16 bp, Homo sapiens
gatctggaacccagac

SEQ ID NO: 1720712 - DNA, 17 bp, Homo sapiens
gatctggaacccagact

SEQ ID NO: 1720713 - DNA, 17 bp, Homo sapiens
gatctggaacctcagcc

SEQ ID NO: 1720714 - DNA, 18 bp, Homo sapiens
gatctggaacctcagcct

SEQ ID NO: 1720715 - DNA, 17 bp, Homo sapiens
gatctggcacactccct

SEQ ID NO: 1720716 - DNA, 22 bp, Homo sapiens
gatctgggaccctttccttcct

SEQ ID NO: 1720717 - DNA, 14 bp, Homo sapiens
gatctgtcctcagc

SEQ ID NO: 1720718 - DNA, 18 bp, Homo sapiens
gatctgtcctcagccttg

SEQ ID NO: 1720719 - DNA, 13 bp, Homo sapiens
gatctgtgattgg

SEQ ID NO: 1720720 - DNA, 11 bp, Homo sapiens
gatctgtgtgg

SEQ ID NO: 1720721 - DNA, 16 bp, Homo sapiens
gatctgtgtggctcct

SEQ ID NO: 1720722 - DNA, 18 bp, Homo sapiens
gatctgtgtggctcctgg

SEQ ID NO: 1720723 - DNA, 18 bp, Homo sapiens
gatctgttttctggaagt

SEQ ID NO: 1720724 - DNA, 16 bp, Homo sapiens
gatcttcatctgacta

SEQ ID NO: 1720725 - DNA, 15 bp, Homo sapiens
gatcttcccacagga

SEQ ID NO: 1720726 - DNA, 22 bp, Homo sapiens
gatcttcccacctcacagtgat

SEQ ID NO: 1720727 - DNA, 17 bp, Homo sapiens
gatcttccgtggtcaga

SEQ ID NO: 1720728 - DNA, 13 bp, Homo sapiens
gatcttgtgctca

SEQ ID NO: 1720729 - DNA, 13 bp, Homo sapiens
gatctttaaaata

SEQ ID NO: 1720730 - DNA, 13 bp, Homo sapiens
gatctttctcttc

SEQ ID NO: 1720731 - DNA, 14 bp, Homo sapiens
gatctttctcttcc

SEQ ID NO: 1720732 - DNA, 17 bp, Homo sapiens
gatctttctcttccctg

SEQ ID NO: 1720733 - DNA, 17 bp, Homo sapiens
gatcttttaaagtgtta

SEQ ID NO: 1720734 - DNA, 18 bp, Homo sapiens
gatcttttagaagtgaga

SEQ ID NO: 1720735 - DNA, 18 bp, Homo sapiens
gatgaaatctgctagaaa

SEQ ID NO: 1720736 - DNA, 15 bp, Homo sapiens
gatgaacatattcat

SEQ ID NO: 1720737 - DNA, 17 bp, Homo sapiens
gatgaacatattcatga

SEQ ID NO: 1720738 - DNA, 16 bp, Homo sapiens
gatgaactgactgaag

SEQ ID NO: 1720739 - DNA, 18 bp, Homo sapiens
gatgaactgactgaagga

SEQ ID NO: 1720740 - DNA, 20 bp, Homo sapiens
gatgaagaacacagcatgtg

SEQ ID NO: 1720741 - DNA, 22 bp, Homo sapiens
gatgaagaacacagcatgtgcc

SEQ ID NO: 1720742 - DNA, 22 bp, Homo sapiens
gatgaagagctatttaatgaca

SEQ ID NO: 1720743 - DNA, 21 bp, Homo sapiens
gatgaagagtgagagggcatg

SEQ ID NO: 1720744 - DNA, 16 bp, Homo sapiens
gatgaatctacatttg

SEQ ID NO: 1720745 - DNA, 16 bp, Homo sapiens
gatgaatgccgtggat

SEQ ID NO: 1720746 - DNA, 18 bp, Homo sapiens
gatgaattttctgcagct

SEQ ID NO: 1720747 - DNA, 15 bp, Homo sapiens
gatgacacataaatc

SEQ ID NO: 1720748 - DNA, 15 bp, Homo sapiens
gatgacaccctggcc

SEQ ID NO: 1720749 - DNA, 12 bp, Homo sapiens
gatgacagctct

SEQ ID NO: 1720750 - DNA, 13 bp, Homo sapiens
gatgacagctctt

SEQ ID NO: 1720751 - DNA, 21 bp, Homo sapiens
gatgacagctcttctaaggaa

SEQ ID NO: 1720752 - DNA, 14 bp, Homo sapiens
gatgacagggcaga

SEQ ID NO: 1720753 - DNA, 22 bp, Homo sapiens
gatgacagtgctctaggctgcc

SEQ ID NO: 1720754 - DNA, 15 bp, Homo sapiens
gatgaccaatgggat

SEQ ID NO: 1720755 - DNA, 16 bp, Homo sapiens
gatgacccactaaaga

SEQ ID NO: 1720756 - DNA, 18 bp, Homo sapiens
gatgacccactaaagagt

SEQ ID NO: 1720757 - DNA, 12 bp, Homo sapiens
gatgactaaaat

SEQ ID NO: 1720758 - DNA, 15 bp, Homo sapiens
gatgactagaggcag

SEQ ID NO: 1720759 - DNA, 22 bp, Homo sapiens
gatgactatgcagaggcctggg

SEQ ID NO: 1720760 - DNA, 22 bp, Homo sapiens
gatgactcaagattttttctgg

SEQ ID NO: 1720761 - DNA, 12 bp, Homo sapiens
gatgactgagtc

SEQ ID NO: 1720762 - DNA, 13 bp, Homo sapiens
gatgagaaaaaac

SEQ ID NO: 1720763 - DNA, 19 bp, Homo sapiens
gatgagaaacagctcagcc

SEQ ID NO: 1720764 - DNA, 20 bp, Homo sapiens
gatgagattggcatggcttt

SEQ ID NO: 1720765 - DNA, 16 bp, Homo sapiens
gatgagatttgccagc

SEQ ID NO: 1720766 - DNA, 16 bp, Homo sapiens
gatgagccccacgtgg

SEQ ID NO: 1720767 - DNA, 22 bp, Homo sapiens
gatgagccttcgtgccccccct

SEQ ID NO: 1720768 - DNA, 16 bp, Homo sapiens
gatgagcgccacctct

SEQ ID NO: 1720769 - DNA, 21 bp, Homo sapiens
gatgaggccgctagaggcctg

SEQ ID NO: 1720770 - DNA, 23 bp, Homo sapiens
gatgaggggcttcctgggtcctg

SEQ ID NO: 1720771 - DNA, 19 bp, Homo sapiens
gatgaggtcagttgtgttt

SEQ ID NO: 1720772 - DNA, 20 bp, Homo sapiens
gatgagtcccctgtgagatt

SEQ ID NO: 1720773 - DNA, 21 bp, Homo sapiens
gatgagtgggaggcgtgcccc

SEQ ID NO: 1720774 - DNA, 14 bp, Homo sapiens
gatgataaagtccc

SEQ ID NO: 1720775 - DNA, 21 bp, Homo sapiens
gaggcccaaggagcttaccca

SEQ ID NO: 1720776 - DNA, 18 bp, Homo sapiens
gaggcccactagagggcc

SEQ ID NO: 1720777 - DNA, 19 bp, Homo sapiens
gaggcccactagagggccc

SEQ ID NO: 1720778 - DNA, 16 bp, Homo sapiens
gaggcccagcgggcag

SEQ ID NO: 1720779 - DNA, 18 bp, Homo sapiens
gaggcccagcgggcagat

SEQ ID NO: 1720780 - DNA, 12 bp, Homo sapiens
gaggcccaggca

SEQ ID NO: 1720781 - DNA, 17 bp, Homo sapiens
gaggcccaggcaccacc

SEQ ID NO: 1720782 - DNA, 18 bp, Homo sapiens
gaggcccaggcaccacca

SEQ ID NO: 1720783 - DNA, 19 bp, Homo sapiens
gaggcccaggcaccaccag

SEQ ID NO: 1720784 - DNA, 24 bp, Homo sapiens
gaggcccaggcaccaccaggagca

SEQ ID NO: 1720785 - DNA, 16 bp, Homo sapiens
gaggcccaggctggga

SEQ ID NO: 1720786 - DNA, 18 bp, Homo sapiens
gaggcccagttcaccctg

SEQ ID NO: 1720787 - DNA, 13 bp, Homo sapiens
gaggcccatgccc

SEQ ID NO: 1720788 - DNA, 15 bp, Homo sapiens
gaggccccaaccctg

SEQ ID NO: 1720789 - DNA, 13 bp, Homo sapiens
gaggccccagcct

SEQ ID NO: 1720790 - DNA, 12 bp, Homo sapiens
gaggccccaggg

SEQ ID NO: 1720791 - DNA, 20 bp, Homo sapiens
gaggcccccagcccagggct

SEQ ID NO: 1720792 - DNA, 20 bp, Homo sapiens
gaggccccgatggactcctg

SEQ ID NO: 1720793 - DNA, 18 bp, Homo sapiens
gaggcccctggagccaga

SEQ ID NO: 1720794 - DNA, 20 bp, Homo sapiens
gaggcccctgggtccttcta

SEQ ID NO: 1720795 - DNA, 16 bp, Homo sapiens
gaggccctggtgtcag

SEQ ID NO: 1720796 - DNA, 12 bp, Homo sapiens
gaggcccttgtc

SEQ ID NO: 1720797 - DNA, 15 bp, Homo sapiens
gaggccgaaggtgcc

SEQ ID NO: 1720798 - DNA, 18 bp, Homo sapiens
gaggccgaggtgggcaga

SEQ ID NO: 1720799 - DNA, 20 bp, Homo sapiens
gaggccgctagaggcctgag

SEQ ID NO: 1720800 - DNA, 18 bp, Homo sapiens
gaggcctaccccgcagac

SEQ ID NO: 1720801 - DNA, 15 bp, Homo sapiens
gaggcctagactctg

SEQ ID NO: 1720802 - DNA, 23 bp, Homo sapiens
gaggcctcactactcgagcccac

SEQ ID NO: 1720803 - DNA, 12 bp, Homo sapiens
gaggcctcaggt

SEQ ID NO: 1720804 - DNA, 22 bp, Homo sapiens
gaggcctcaggtgctgtccatg

SEQ ID NO: 1720805 - DNA, 19 bp, Homo sapiens
gaggcctcagtttctccat

SEQ ID NO: 1720806 - DNA, 23 bp, Homo sapiens
gaggcctcagtttctccatcagc

SEQ ID NO: 1720807 - DNA, 15 bp, Homo sapiens
gaggcctcatccctc

SEQ ID NO: 1720808 - DNA, 22 bp, Homo sapiens
gaggcctgaagccagctgccct

SEQ ID NO: 1720809 - DNA, 23 bp, Homo sapiens
gaggcctgaagccagctgcccta

SEQ ID NO: 1720810 - DNA, 20 bp, Homo sapiens
gaggcctgagcgctcctgcc

SEQ ID NO: 1720811 - DNA, 13 bp, Homo sapiens
gaggcctgatgct

SEQ ID NO: 1720812 - DNA, 15 bp, Homo sapiens
gaggcctgatgctgc

SEQ ID NO: 1720813 - DNA, 20 bp, Homo sapiens
ctgtaactgctgagccactc

SEQ ID NO: 1720814 - DNA, 22 bp, Homo sapiens
ctgtaactggtagtgttcagta

SEQ ID NO: 1720815 - DNA, 17 bp, Homo sapiens
ctgtaagagcttgctcc

SEQ ID NO: 1720816 - DNA, 21 bp, Homo sapiens
ctgtaaggatccggaaagaag

SEQ ID NO: 1720817 - DNA, 18 bp, Homo sapiens
ctgtaagggcagtgccca

SEQ ID NO: 1720818 - DNA, 16 bp, Homo sapiens
ctgtaagtttattttt

SEQ ID NO: 1720819 - DNA, 21 bp, Homo sapiens
ctgtaagtttattttttctac

SEQ ID NO: 1720820 - DNA, 22 bp, Homo sapiens
ctgtaagtttattttttctaca

SEQ ID NO: 1720821 - DNA, 20 bp, Homo sapiens
ctgtaatacgtagctctctt

SEQ ID NO: 1720822 - DNA, 23 bp, Homo sapiens
ctgtaatagttcagtagaattac

SEQ ID NO: 1720823 - DNA, 16 bp, Homo sapiens
ctgtaatattgtaaat

SEQ ID NO: 1720824 - DNA, 21 bp, Homo sapiens
ctgtaatattgtaaatactgg

SEQ ID NO: 1720825 - DNA, 19 bp, Homo sapiens
ctgtaatcagttatgccgt

SEQ ID NO: 1720826 - DNA, 13 bp, Homo sapiens
ctgtaatcccagc

SEQ ID NO: 1720827 - DNA, 14 bp, Homo sapiens
ctgtaatcccagca

SEQ ID NO: 1720828 - DNA, 15 bp, Homo sapiens
ctgtaatcccagcac

SEQ ID NO: 1720829 - DNA, 17 bp, Homo sapiens
ctgtaatcccagcactt

SEQ ID NO: 1720830 - DNA, 18 bp, Homo sapiens
ctgtaatcccagcacttt

SEQ ID NO: 1720831 - DNA, 14 bp, Homo sapiens
ctgtaatcccagct

SEQ ID NO: 1720832 - DNA, 17 bp, Homo sapiens
ctgtaatctaccagtgg

SEQ ID NO: 1720833 - DNA, 20 bp, Homo sapiens
ctgtaatcttttatttaagt

SEQ ID NO: 1720834 - DNA, 17 bp, Homo sapiens
ctgtaatgacaaaagat

SEQ ID NO: 1720835 - DNA, 16 bp, Homo sapiens
ctgtaatgaggaaaaa

SEQ ID NO: 1720836 - DNA, 22 bp, Homo sapiens
ctgtaatggaactgaccccctc

SEQ ID NO: 1720837 - DNA, 15 bp, Homo sapiens
ctgtaattatttgaa

SEQ ID NO: 1720838 - DNA, 24 bp, Homo sapiens
ctgtaattcattgagcagttagct

SEQ ID NO: 1720839 - DNA, 16 bp, Homo sapiens
ctgtaattcctacctc

SEQ ID NO: 1720840 - DNA, 16 bp, Homo sapiens
ctgtaattgataatag

SEQ ID NO: 1720841 - DNA, 20 bp, Homo sapiens
ctgtaatttcgccttaaact

SEQ ID NO: 1720842 - DNA, 21 bp, Homo sapiens
ctgtacacattcctgcattca

SEQ ID NO: 1720843 - DNA, 16 bp, Homo sapiens
ctgtacacgtgtcctg

SEQ ID NO: 1720844 - DNA, 17 bp, Homo sapiens
ctgtacacgtgtcctgt

SEQ ID NO: 1720845 - DNA, 23 bp, Homo sapiens
ctgtacagtaccttgttgcagat

SEQ ID NO: 1720846 - DNA, 15 bp, Homo sapiens
ctgtacatactgttt

SEQ ID NO: 1720847 - DNA, 19 bp, Homo sapiens
ctgtacatattactgttgc

SEQ ID NO: 1720848 - DNA, 14 bp, Homo sapiens
ctgtacattgtgag

SEQ ID NO: 1720849 - DNA, 17 bp, Homo sapiens
ctgtacattgtgagctc

SEQ ID NO: 1720850 - DNA, 19 bp, Homo sapiens
ctgtacatttaaaattgct

SEQ ID NO: 1720851 - DNA, 13 bp, Homo sapiens
ctgtaccacatct

SEQ ID NO: 1720852 - DNA, 15 bp, Homo sapiens
ctgtaccacatctgc

SEQ ID NO: 1720853 - DNA, 17 bp, Homo sapiens
gagggaaggttcttcat

SEQ ID NO: 1720854 - DNA, 14 bp, Homo sapiens
gagggaatgtgaaa

SEQ ID NO: 1720855 - DNA, 19 bp, Homo sapiens
gagggaatgttccctgcac

SEQ ID NO: 1720856 - DNA, 15 bp, Homo sapiens
gagggacaagggatt

SEQ ID NO: 1720857 - DNA, 16 bp, Homo sapiens
gagggacaggctgaag

SEQ ID NO: 1720858 - DNA, 17 bp, Homo sapiens
gagggaccaactgggcc

SEQ ID NO: 1720859 - DNA, 16 bp, Homo sapiens
gagggaccagccaaga

SEQ ID NO: 1720860 - DNA, 13 bp, Homo sapiens
gagggaccttgga

SEQ ID NO: 1720861 - DNA, 18 bp, Homo sapiens
gagggaccttggagagct

SEQ ID NO: 1720862 - DNA, 20 bp, Homo sapiens
gagggaccttggagagctca

SEQ ID NO: 1720863 - DNA, 20 bp, Homo sapiens
gagggacggccaagaatgta

SEQ ID NO: 1720864 - DNA, 14 bp, Homo sapiens
gagggagaagcatg

SEQ ID NO: 1720865 - DNA, 13 bp, Homo sapiens
gagggaggaggcc

SEQ ID NO: 1720866 - DNA, 17 bp, Homo sapiens
gagggaggaggccacct

SEQ ID NO: 1720867 - DNA, 17 bp, Homo sapiens
gagggaggccccagggg

SEQ ID NO: 1720868 - DNA, 12 bp, Homo sapiens
gagggaggggaa

SEQ ID NO: 1720869 - DNA, 13 bp, Homo sapiens
gagggagggggct

SEQ ID NO: 1720870 - DNA, 18 bp, Homo sapiens
gagggatggagaaagaag

SEQ ID NO: 1720871 - DNA, 13 bp, Homo sapiens
gagggcacagccc

SEQ ID NO: 1720872 - DNA, 16 bp, Homo sapiens
gagggcacagccctcc

SEQ ID NO: 1720873 - DNA, 16 bp, Homo sapiens
gagggcacatgaacag

SEQ ID NO: 1720874 - DNA, 22 bp, Homo sapiens
gagggcacattaactccctcca

SEQ ID NO: 1720875 - DNA, 16 bp, Homo sapiens
gagggcactggtggcc

SEQ ID NO: 1720876 - DNA, 17 bp, Homo sapiens
gagggcagactggggca

SEQ ID NO: 1720877 - DNA, 22 bp, Homo sapiens
gagggcagagccatgggcctgg

SEQ ID NO: 1720878 - DNA, 13 bp, Homo sapiens
gagggcagctgct

SEQ ID NO: 1720879 - DNA, 13 bp, Homo sapiens
gagggcaggcttg

SEQ ID NO: 1720880 - DNA, 19 bp, Homo sapiens
gagggcaggcttggggaaa

SEQ ID NO: 1720881 - DNA, 20 bp, Homo sapiens
gagggcaggcttggggaaaa

SEQ ID NO: 1720882 - DNA, 15 bp, Homo sapiens
gagggcagtacctgg

SEQ ID NO: 1720883 - DNA, 16 bp, Homo sapiens
gagggcagtacctggg

SEQ ID NO: 1720884 - DNA, 17 bp, Homo sapiens
gagggccaagagatctg

SEQ ID NO: 1720885 - DNA, 14 bp, Homo sapiens
gagggccagcaggc

SEQ ID NO: 1720886 - DNA, 21 bp, Homo sapiens
gagggccagcaggctcctggc

SEQ ID NO: 1720887 - DNA, 14 bp, Homo sapiens
gagggccagggacc

SEQ ID NO: 1720888 - DNA, 13 bp, Homo sapiens
gaggtctaatcta

SEQ ID NO: 1720889 - DNA, 12 bp, Homo sapiens
gaggtctatttt

SEQ ID NO: 1720890 - DNA, 18 bp, Homo sapiens
gaggtctctgggagccca

SEQ ID NO: 1720891 - DNA, 17 bp, Homo sapiens
gaggtctcttgagggag

SEQ ID NO: 1720892 - DNA, 14 bp, Homo sapiens
gaggtctgagccct

SEQ ID NO: 1720893 - DNA, 16 bp, Homo sapiens
gaggtctgagccctgg

SEQ ID NO: 1720894 - DNA, 12 bp, Homo sapiens
gaggtctggcca

SEQ ID NO: 1720895 - DNA, 17 bp, Homo sapiens
gaggtctggctgagccc

SEQ ID NO: 1720896 - DNA, 21 bp, Homo sapiens
gaggtctggctgagcccctgg

SEQ ID NO: 1720897 - DNA, 13 bp, Homo sapiens
gaggtctgtgctg

SEQ ID NO: 1720898 - DNA, 16 bp, Homo sapiens
gaggtctgtgctgagg

SEQ ID NO: 1720899 - DNA, 15 bp, Homo sapiens
gaggtgaaagggagc

SEQ ID NO: 1720900 - DNA, 16 bp, Homo sapiens
gaggtgaaagggagct

SEQ ID NO: 1720901 - DNA, 17 bp, Homo sapiens
gaggtgaggattccaaa

SEQ ID NO: 1720902 - DNA, 14 bp, Homo sapiens
gaggtgatagcatt

SEQ ID NO: 1720903 - DNA, 18 bp, Homo sapiens
gaggtgatgggtgcagga

SEQ ID NO: 1720904 - DNA, 19 bp, Homo sapiens
gaggtgcaggggaagacca

SEQ ID NO: 1720905 - DNA, 23 bp, Homo sapiens
gaggtgcgctcacctcagagcag

SEQ ID NO: 1720906 - DNA, 20 bp, Homo sapiens
gaggtgcgtgttcagcagaa

SEQ ID NO: 1720907 - DNA, 24 bp, Homo sapiens
gaggtgcgtgttcagcagaacctg

SEQ ID NO: 1720908 - DNA, 11 bp, Homo sapiens
gaggtgctgat

SEQ ID NO: 1720909 - DNA, 18 bp, Homo sapiens
gaggtgcttgaggccccg

SEQ ID NO: 1720910 - DNA, 16 bp, Homo sapiens
gaggtggaagaaggga

SEQ ID NO: 1720911 - DNA, 17 bp, Homo sapiens
gaggtggaagaagggag

SEQ ID NO: 1720912 - DNA, 20 bp, Homo sapiens
gaggtggaagccctccttcc

SEQ ID NO: 1720913 - DNA, 13 bp, Homo sapiens
gaggtggagaact

SEQ ID NO: 1720914 - DNA, 19 bp, Homo sapiens
gaggtggagattgcagtga

SEQ ID NO: 1720915 - DNA, 14 bp, Homo sapiens
gaggtggagccaag

SEQ ID NO: 1720916 - DNA, 14 bp, Homo sapiens
gaggtgggagggcc

SEQ ID NO: 1720917 - DNA, 15 bp, Homo sapiens
gaggtgggaggtgga

SEQ ID NO: 1720918 - DNA, 17 bp, Homo sapiens
gaggtgggatcctccct

SEQ ID NO: 1720919 - DNA, 15 bp, Homo sapiens
gaggtgggcagctgg

SEQ ID NO: 1720920 - DNA, 12 bp, Homo sapiens
gaggtgggccca

SEQ ID NO: 1720921 - DNA, 15 bp, Homo sapiens
gaggtgggcccagga

SEQ ID NO: 1720922 - DNA, 23 bp, Homo sapiens
gaggtgggcccaggaccagctgg

SEQ ID NO: 1720923 - DNA, 21 bp, Homo sapiens
gaggtgggctggggctgctcc

SEQ ID NO: 1720924 - DNA, 17 bp, Homo sapiens
gaggtgtctggggtgag

SEQ ID NO: 1720925 - DNA, 17 bp, Homo sapiens
gaggtgtgggccgatct

SEQ ID NO: 1720926 - DNA, 16 bp, Homo sapiens
gaggtgtgggggctgc

SEQ ID NO: 1720927 - DNA, 19 bp, Homo sapiens
gaggttataggtcactcct

SEQ ID NO: 1720928 - DNA, 15 bp, Homo sapiens
gaggttatctgcctg

SEQ ID NO: 1720929 - DNA, 19 bp, Homo sapiens
gaggttatctgcctggcct

SEQ ID NO: 1720930 - DNA, 21 bp, Homo sapiens
gaggttatctgcctggcctgg

SEQ ID NO: 1720931 - DNA, 23 bp, Homo sapiens
gaggttatctgcctggcctggct

SEQ ID NO: 1720932 - DNA, 19 bp, Homo sapiens
gaggttgcagggagccgag

SEQ ID NO: 1720933 - DNA, 13 bp, Homo sapiens
gaggttgcagtgt

SEQ ID NO: 1720934 - DNA, 14 bp, Homo sapiens
gaggttgggtgggc

SEQ ID NO: 1720935 - DNA, 14 bp, Homo sapiens
gaggttggtgactg

SEQ ID NO: 1720936 - DNA, 14 bp, Homo sapiens
gaggttgtggatgc

SEQ ID NO: 1720937 - DNA, 21 bp, Homo sapiens
gaggttgtggatgctccaggg

SEQ ID NO: 1720938 - DNA, 15 bp, Homo sapiens
gaggtttggaagagt

SEQ ID NO: 1720939 - DNA, 16 bp, Homo sapiens
gaggtttggaagagtg

SEQ ID NO: 1720940 - DNA, 19 bp, Homo sapiens
gaggtttggaagagtgaag

SEQ ID NO: 1720941 - DNA, 23 bp, Homo sapiens
gaggtttgtcgggcaccagccag

SEQ ID NO: 1720942 - DNA, 22 bp, Homo sapiens
gaggtttgtttagaagaagtgt

SEQ ID NO: 1720943 - DNA, 23 bp, Homo sapiens
gaggttttattctgacttcctct

SEQ ID NO: 1720944 - DNA, 13 bp, Homo sapiens
gagtaaaaactag

SEQ ID NO: 1720945 - DNA, 17 bp, Homo sapiens
gagtaaaacattttatt

SEQ ID NO: 1720946 - DNA, 13 bp, Homo sapiens
gagtaacatttgc

SEQ ID NO: 1720947 - DNA, 16 bp, Homo sapiens
gagtaacatttgctgt

SEQ ID NO: 1720948 - DNA, 12 bp, Homo sapiens
gagtaagtatta

SEQ ID NO: 1720949 - DNA, 23 bp, Homo sapiens
gagtaatcaatacagacaaggtt

SEQ ID NO: 1720950 - DNA, 14 bp, Homo sapiens
gagtaatggtgtag

SEQ ID NO: 1720951 - DNA, 19 bp, Homo sapiens
gagtaatggtgtagaacac

SEQ ID NO: 1720952 - DNA, 18 bp, Homo sapiens
gagtacctgcaaaaatga

SEQ ID NO: 1720953 - DNA, 18 bp, Homo sapiens
gagtacctgctgccccag

SEQ ID NO: 1720954 - DNA, 12 bp, Homo sapiens
gagtagaatgta

SEQ ID NO: 1720955 - DNA, 17 bp, Homo sapiens
gagtagaggtataattg

SEQ ID NO: 1720956 - DNA, 21 bp, Homo sapiens
gagtagccgagagcctgctcc

SEQ ID NO: 1720957 - DNA, 20 bp, Homo sapiens
gagtagttgatgttgcattt

SEQ ID NO: 1720958 - DNA, 17 bp, Homo sapiens
gagtagtttttcagcta

SEQ ID NO: 1720959 - DNA, 19 bp, Homo sapiens
gagtatacctcctatatgt

SEQ ID NO: 1720960 - DNA, 12 bp, Homo sapiens
gagtatatgcac

SEQ ID NO: 1720961 - DNA, 11 bp, Homo sapiens
gagtatatgtc

SEQ ID NO: 1720962 - DNA, 18 bp, Homo sapiens
gagtattccatgagctgc

SEQ ID NO: 1720963 - DNA, 21 bp, Homo sapiens
gagtattccatgagctgctca

SEQ ID NO: 1720964 - DNA, 22 bp, Homo sapiens
gagtattctcataggagactgc

SEQ ID NO: 1720965 - DNA, 21 bp, Homo sapiens
gagtattgtttaaaatgtaat

SEQ ID NO: 1720966 - DNA, 14 bp, Homo sapiens
gagtatttcccttc

SEQ ID NO: 1720967 - DNA, 14 bp, Homo sapiens
gagtatttttgaca

SEQ ID NO: 1720968 - DNA, 17 bp, Homo sapiens
gagtatttttgacagaa

SEQ ID NO: 1720969 - DNA, 14 bp, Homo sapiens
gagtcaaaacaaag

SEQ ID NO: 1720970 - DNA, 14 bp, Homo sapiens
gagtcaaagctgac

SEQ ID NO: 1720971 - DNA, 11 bp, Homo sapiens
gagtcaaatcc

SEQ ID NO: 1720972 - DNA, 12 bp, Homo sapiens
gagtcaaatcca

SEQ ID NO: 1720973 - DNA, 13 bp, Homo sapiens
gagtcaaatccag

SEQ ID NO: 1720974 - DNA, 15 bp, Homo sapiens
gagtcaactggagca

SEQ ID NO: 1720975 - DNA, 15 bp, Homo sapiens
gagtcaaggcctgct

SEQ ID NO: 1720976 - DNA, 21 bp, Homo sapiens
gagtcacatcagtgaggaggg

SEQ ID NO: 1720977 - DNA, 17 bp, Homo sapiens
gagtcacccagttggtg

SEQ ID NO: 1720978 - DNA, 15 bp, Homo sapiens
gagtcacctcctcca

SEQ ID NO: 1720979 - DNA, 15 bp, Homo sapiens
gagcaggactccagg

SEQ ID NO: 1720980 - DNA, 19 bp, Homo sapiens
gagcaggactctattttaa

SEQ ID NO: 1720981 - DNA, 13 bp, Homo sapiens
gagcaggagcccc

SEQ ID NO: 1720982 - DNA, 15 bp, Homo sapiens
gagcaggcacatgga

SEQ ID NO: 1720983 - DNA, 21 bp, Homo sapiens
gagcaggcacgggtggtcccc

SEQ ID NO: 1720984 - DNA, 18 bp, Homo sapiens
gagcagggaaggcctgac

SEQ ID NO: 1720985 - DNA, 19 bp, Homo sapiens
gagcagggccaaagcacag

SEQ ID NO: 1720986 - DNA, 18 bp, Homo sapiens
gagcagggtccacagctg

SEQ ID NO: 1720987 - DNA, 22 bp, Homo sapiens
gagcagggtccacagctggaaa

SEQ ID NO: 1720988 - DNA, 16 bp, Homo sapiens
gagcaggtgactgtgc

SEQ ID NO: 1720989 - DNA, 23 bp, Homo sapiens
gagcaggtgactgtgctgtgcag

SEQ ID NO: 1720990 - DNA, 20 bp, Homo sapiens
gagcaggttccccaagggcc

SEQ ID NO: 1720991 - DNA, 22 bp, Homo sapiens
gagcaggttccccaagggccct

SEQ ID NO: 1720992 - DNA, 20 bp, Homo sapiens
gagcagtcagggtgggaaga

SEQ ID NO: 1720993 - DNA, 23 bp, Homo sapiens
gagcagtggctggtccagggcta

SEQ ID NO: 1720994 - DNA, 17 bp, Homo sapiens
gagcagtgggcaggtgg

SEQ ID NO: 1720995 - DNA, 19 bp, Homo sapiens
gagcagtgtcttccataat

SEQ ID NO: 1720996 - DNA, 16 bp, Homo sapiens
gagcagttcagagtgg

SEQ ID NO: 1720997 - DNA, 21 bp, Homo sapiens
gagcagttggccaagcagaaa

SEQ ID NO: 1720998 - DNA, 18 bp, Homo sapiens
gagcagttttcccctggc

SEQ ID NO: 1720999 - DNA, 22 bp, Homo sapiens
gagcagttttcccctggcctca

SEQ ID NO: 1721000 - DNA, 22 bp, Homo sapiens
gagcatagtccaaaaagctcct

SEQ ID NO: 1721001 - DNA, 14 bp, Homo sapiens
gagcatatactggt

SEQ ID NO: 1721002 - DNA, 15 bp, Homo sapiens
gagcatcaatcttgt

SEQ ID NO: 1721003 - DNA, 21 bp, Homo sapiens
gagcatcactagtgacaagtc

SEQ ID NO: 1721004 - DNA, 22 bp, Homo sapiens
gagcatcaggctaagaccctgt

SEQ ID NO: 1721005 - DNA, 21 bp, Homo sapiens
gagcatcgtgacccttcaggg

SEQ ID NO: 1721006 - DNA, 15 bp, Homo sapiens
gagcatgcacagctg

SEQ ID NO: 1721007 - DNA, 19 bp, Homo sapiens
gagcatgcacagctgcttg

SEQ ID NO: 1721008 - DNA, 15 bp, Homo sapiens
gagcatgggcctggc

SEQ ID NO: 1721009 - DNA, 21 bp, Homo sapiens
gagcatggggataaaggagaa

SEQ ID NO: 1721010 - DNA, 22 bp, Homo sapiens
gagcatggggataaaggagaag

SEQ ID NO: 1721011 - DNA, 19 bp, Homo sapiens
gagcatgggggctgccagc

SEQ ID NO: 1721012 - DNA, 13 bp, Homo sapiens
gagcatgggtgtg

SEQ ID NO: 1721013 - DNA, 19 bp, Homo sapiens
gagcatgtaaaagcggaaa

SEQ ID NO: 1721014 - DNA, 22 bp, Homo sapiens
gagcatgtactgagccttgtaa

SEQ ID NO: 1721015 - DNA, 22 bp, Homo sapiens
gagcattgcttttgtttcttaa

SEQ ID NO: 1721016 - DNA, 23 bp, Homo sapiens
gagcattgcttttgtttcttaag

SEQ ID NO: 1721017 - DNA, 21 bp, Homo sapiens
gagccaaatgaccgagccctg

SEQ ID NO: 1721018 - DNA, 22 bp, Homo sapiens
gagccaaatgaccgagccctgg

SEQ ID NO: 1721019 - DNA, 23 bp, Homo sapiens
gagccaaatgaccgagccctgga

SEQ ID NO: 1721020 - DNA, 20 bp, Homo sapiens
gagccaacagaagcttccat

SEQ ID NO: 1721021 - DNA, 19 bp, Homo sapiens
gagccaacctggacttcct

SEQ ID NO: 1721022 - DNA, 20 bp, Homo sapiens
gagccaacctggacttcctg

SEQ ID NO: 1721023 - DNA, 21 bp, Homo sapiens
gagccaacctggacttcctgt

SEQ ID NO: 1721024 - DNA, 22 bp, Homo sapiens
gagccaacctggacttcctgtc

SEQ ID NO: 1721025 - DNA, 15 bp, Homo sapiens
gagccaagacggagg

SEQ ID NO: 1721026 - DNA, 18 bp, Homo sapiens
gagccaagcactgctcac

SEQ ID NO: 1721027 - DNA, 18 bp, Homo sapiens
gagccaagcttcaaccct

SEQ ID NO: 1721028 - DNA, 13 bp, Homo sapiens
gagccaaggacag

SEQ ID NO: 1721029 - DNA, 23 bp, Homo sapiens
gagccaaggacagggctggctcc

SEQ ID NO: 1721030 - DNA, 19 bp, Homo sapiens
gagccaagggttcagagac

SEQ ID NO: 1721031 - DNA, 17 bp, Homo sapiens
gagccaagtggtccagc

SEQ ID NO: 1721032 - DNA, 20 bp, Homo sapiens
gagccaatgaacagctcctc

SEQ ID NO: 1721033 - DNA, 15 bp, Homo sapiens
gagccacaagctgca

SEQ ID NO: 1721034 - DNA, 23 bp, Homo sapiens
gagccacagaccacctgcttctg

SEQ ID NO: 1721035 - DNA, 15 bp, Homo sapiens
gagccacagtcactg

SEQ ID NO: 1721036 - DNA, 17 bp, Homo sapiens
gagccaccaaagtcaca

SEQ ID NO: 1721037 - DNA, 15 bp, Homo sapiens
gagccaccgctgcca

SEQ ID NO: 1721038 - DNA, 11 bp, Homo sapiens
gagccacctgc

SEQ ID NO: 1721039 - DNA, 12 bp, Homo sapiens
gagccacctgca

SEQ ID NO: 1721040 - DNA, 13 bp, Homo sapiens
gagccacctgcaa

SEQ ID NO: 1721041 - DNA, 13 bp, Homo sapiens
gagccacctggat

SEQ ID NO: 1721042 - DNA, 14 bp, Homo sapiens
gagccacctggatc

SEQ ID NO: 1721043 - DNA, 15 bp, Homo sapiens
gagccactcctgtcc

SEQ ID NO: 1721044 - DNA, 21 bp, Homo sapiens
gagccactcgcagtcgcagga

SEQ ID NO: 1721045 - DNA, 19 bp, Homo sapiens
gagccactttcaagctgca

SEQ ID NO: 1721046 - DNA, 13 bp, Homo sapiens
gagccagagggag

SEQ ID NO: 1721047 - DNA, 15 bp, Homo sapiens
gagccagatgcagga

SEQ ID NO: 1721048 - DNA, 17 bp, Homo sapiens
gagccagatgcaggaca

SEQ ID NO: 1721049 - DNA, 17 bp, Homo sapiens
gagccagatgcctcccc

SEQ ID NO: 1721050 - DNA, 15 bp, Homo sapiens
gagccagatggcaag

SEQ ID NO: 1721051 - DNA, 16 bp, Homo sapiens
gagccagcctggctct

SEQ ID NO: 1721052 - DNA, 13 bp, Homo sapiens
gagccagcctggg

SEQ ID NO: 1721053 - DNA, 19 bp, Homo sapiens
gagccagcggctccaactc

SEQ ID NO: 1721054 - DNA, 20 bp, Homo sapiens
gagccagcggctccaactcc

SEQ ID NO: 1721055 - DNA, 20 bp, Homo sapiens
gagccagctgctttttgtga

SEQ ID NO: 1721056 - DNA, 20 bp, Homo sapiens
gagccagcttggggccacca

SEQ ID NO: 1721057 - DNA, 14 bp, Homo sapiens
gagccagcttggtc

SEQ ID NO: 1721058 - DNA, 13 bp, Homo sapiens
gagccaggagaag

SEQ ID NO: 1721059 - DNA, 14 bp, Homo sapiens
gagccagggaacag

SEQ ID NO: 1721060 - DNA, 15 bp, Homo sapiens
gagccagggcagagg

SEQ ID NO: 1721061 - DNA, 20 bp, Homo sapiens
gagccagggcagaggaatgt

SEQ ID NO: 1721062 - DNA, 13 bp, Homo sapiens
gagccagggcctc

SEQ ID NO: 1721063 - DNA, 13 bp, Homo sapiens
gagccagtcccag

SEQ ID NO: 1721064 - DNA, 15 bp, Homo sapiens
gagccagtcccaggg

SEQ ID NO: 1721065 - DNA, 23 bp, Homo sapiens
gagccagtcctccactcgaccca

SEQ ID NO: 1721066 - DNA, 21 bp, Homo sapiens
gagccagtgggccagccacag

SEQ ID NO: 1721067 - DNA, 18 bp, Homo sapiens
gagccagttgtcctatgg

SEQ ID NO: 1721068 - DNA, 20 bp, Homo sapiens
gagccatcactagaagaaaa

SEQ ID NO: 1721069 - DNA, 23 bp, Homo sapiens
gagccatcccttcggagccaaca

SEQ ID NO: 1721070 - DNA, 22 bp, Homo sapiens
gagccatcggtgaaactaacag

SEQ ID NO: 1721071 - DNA, 18 bp, Homo sapiens
gagccatcttggcagggt

SEQ ID NO: 1721072 - DNA, 19 bp, Homo sapiens
gagccatgatttcccactg

SEQ ID NO: 1721073 - DNA, 22 bp, Homo sapiens
gagccatggaccacgcaggaag

SEQ ID NO: 1721074 - DNA, 13 bp, Homo sapiens
gagccatgggcct

SEQ ID NO: 1721075 - DNA, 18 bp, Homo sapiens
gagccatgggcctgggcc

SEQ ID NO: 1721076 - DNA, 21 bp, Homo sapiens
gagccatgggcctgggcctgc

SEQ ID NO: 1721077 - DNA, 17 bp, Homo sapiens
gagccattcccttggaa

SEQ ID NO: 1721078 - DNA, 13 bp, Homo sapiens
gagccatttgaga

SEQ ID NO: 1721079 - DNA, 15 bp, Homo sapiens
gagccattttggtaa

SEQ ID NO: 1721080 - DNA, 20 bp, Homo sapiens
gagcccaccagggacacctc

SEQ ID NO: 1721081 - DNA, 11 bp, Homo sapiens
gagcccaccca

SEQ ID NO: 1721082 - DNA, 12 bp, Homo sapiens
gagcccacccag

SEQ ID NO: 1721083 - DNA, 24 bp, Homo sapiens
gagcccactgtcctgggcctgcag

SEQ ID NO: 1721084 - DNA, 20 bp, Homo sapiens
gagcccagccagaaagcact

SEQ ID NO: 1721085 - DNA, 16 bp, Homo sapiens
gagcccagcccaggag

SEQ ID NO: 1721086 - DNA, 18 bp, Homo sapiens
gagcccagccctccccat

SEQ ID NO: 1721087 - DNA, 13 bp, Homo sapiens
gagcccagcctgg

SEQ ID NO: 1721088 - DNA, 21 bp, Homo sapiens
gagcccagcctgggagcccag

SEQ ID NO: 1721089 - DNA, 12 bp, Homo sapiens
gagcccagctcc

SEQ ID NO: 1721090 - DNA, 12 bp, Homo sapiens
gagcccaggccg

SEQ ID NO: 1721091 - DNA, 16 bp, Homo sapiens
gagcccagtctgttga

SEQ ID NO: 1721092 - DNA, 14 bp, Homo sapiens
gagcccatgctcaa

SEQ ID NO: 1721093 - DNA, 23 bp, Homo sapiens
gagcccatgctcaaccactgtgg

SEQ ID NO: 1721094 - DNA, 15 bp, Homo sapiens
gagccccaagtcctg

SEQ ID NO: 1721095 - DNA, 11 bp, Homo sapiens
gagccccacct

SEQ ID NO: 1721096 - DNA, 16 bp, Homo sapiens
gagccccagcttcctg

SEQ ID NO: 1721097 - DNA, 14 bp, Homo sapiens
gagccccagggtct

SEQ ID NO: 1721098 - DNA, 24 bp, Homo sapiens
gagccccagggtcttccctacctc

SEQ ID NO: 1721099 - DNA, 14 bp, Homo sapiens
gagccccagtgcca

SEQ ID NO: 1721100 - DNA, 17 bp, Homo sapiens
gagccccagtgccaagc

SEQ ID NO: 1721101 - DNA, 17 bp, Homo sapiens
gagcccccagccctggg

SEQ ID NO: 1721102 - DNA, 20 bp, Homo sapiens
gagcccccagccctgggaac

SEQ ID NO: 1721103 - DNA, 19 bp, Homo sapiens
gagccccctgcacccaccc

SEQ ID NO: 1721104 - DNA, 13 bp, Homo sapiens
gagccccctggat

SEQ ID NO: 1721105 - DNA, 22 bp, Homo sapiens
gagcccctcctccagcccctgt

SEQ ID NO: 1721106 - DNA, 18 bp, Homo sapiens
gagcccctcggctctgga

SEQ ID NO: 1721107 - DNA, 19 bp, Homo sapiens
gagcccctcggctctggag

SEQ ID NO: 1721108 - DNA, 13 bp, Homo sapiens
gagcccctgggga

SEQ ID NO: 1721109 - DNA, 14 bp, Homo sapiens
gagcccctgggtgg

SEQ ID NO: 1721110 - DNA, 23 bp, Homo sapiens
gagccccttcatccgcctgtggg

SEQ ID NO: 1721111 - DNA, 14 bp, Homo sapiens
gagcccgaagctct

SEQ ID NO: 1721112 - DNA, 19 bp, Homo sapiens
gagcccgcagggccatgca

SEQ ID NO: 1721113 - DNA, 22 bp, Homo sapiens
gagcccgggctgcctgggctgt

SEQ ID NO: 1721114 - DNA, 21 bp, Homo sapiens
gagcccgtcgcgctggacagc

SEQ ID NO: 1721115 - DNA, 18 bp, Homo sapiens
gagccctaaccccttcca

SEQ ID NO: 1721116 - DNA, 21 bp, Homo sapiens
gagccctaaccccttccagat

SEQ ID NO: 1721117 - DNA, 15 bp, Homo sapiens
gagccctgctgtggg

SEQ ID NO: 1721118 - DNA, 16 bp, Homo sapiens
gagccctgctgtggga

SEQ ID NO: 1721119 - DNA, 17 bp, Homo sapiens
gagccctgctgtgggag

SEQ ID NO: 1721120 - DNA, 13 bp, Homo sapiens
gagccctggagag

SEQ ID NO: 1721121 - DNA, 13 bp, Homo sapiens
gagccctggcagg

SEQ ID NO: 1721122 - DNA, 19 bp, Homo sapiens
gagccctgtggccgccacc

SEQ ID NO: 1721123 - DNA, 21 bp, Homo sapiens
gagccctgtggccgccacctg

SEQ ID NO: 1721124 - DNA, 15 bp, Homo sapiens
gagcccttcactgcc

SEQ ID NO: 1721125 - DNA, 22 bp, Homo sapiens
gagcccttctatacccacccag

SEQ ID NO: 1721126 - DNA, 23 bp, Homo sapiens
gagcccttctatacccacccaga

SEQ ID NO: 1721127 - DNA, 17 bp, Homo sapiens
gagcccttgcctcccca

SEQ ID NO: 1721128 - DNA, 20 bp, Homo sapiens
gagccgagattgcgccactg

SEQ ID NO: 1721129 - DNA, 21 bp, Homo sapiens
gagccgagggcgtcagagaga

SEQ ID NO: 1721130 - DNA, 17 bp, Homo sapiens
gagccgaggggagagag

SEQ ID NO: 1721131 - DNA, 20 bp, Homo sapiens
gagccgaggggagagaggga

SEQ ID NO: 1721132 - DNA, 19 bp, Homo sapiens
gagccgggcctcccaccgc

SEQ ID NO: 1721133 - DNA, 14 bp, Homo sapiens
gagccgggcctggg

SEQ ID NO: 1721134 - DNA, 17 bp, Homo sapiens
gagccggtaactgtcct

SEQ ID NO: 1721135 - DNA, 18 bp, Homo sapiens
gagccggtaactgtcctg

SEQ ID NO: 1721136 - DNA, 16 bp, Homo sapiens
gagccgtggtccctga

SEQ ID NO: 1721137 - DNA, 19 bp, Homo sapiens
gagccgtggtccctgagga

SEQ ID NO: 1721138 - DNA, 19 bp, Homo sapiens
gagcctagcggagcccagc

SEQ ID NO: 1721139 - DNA, 16 bp, Homo sapiens
gagcctcaaccttctg

SEQ ID NO: 1721140 - DNA, 15 bp, Homo sapiens
gagcctcagaagaaa

SEQ ID NO: 1721141 - DNA, 17 bp, Homo sapiens
gagcctcatccgaggca

SEQ ID NO: 1721142 - DNA, 21 bp, Homo sapiens
gagcctcccaccagagccggg

SEQ ID NO: 1721143 - DNA, 21 bp, Homo sapiens
gagcctgcaaactcactgctc

SEQ ID NO: 1721144 - DNA, 16 bp, Homo sapiens
gagcctgcagggaagc

SEQ ID NO: 1721145 - DNA, 16 bp, Homo sapiens
gagcctgcagggtggt

SEQ ID NO: 1721146 - DNA, 22 bp, Homo sapiens
gagcctgcagggtggtgctggg

SEQ ID NO: 1721147 - DNA, 23 bp, Homo sapiens
gagcctgcagggtggtgctggga

SEQ ID NO: 1721148 - DNA, 18 bp, Homo sapiens
gagcctgccgcccccgcc

SEQ ID NO: 1721149 - DNA, 19 bp, Homo sapiens
gagcctgctcccccacccc

SEQ ID NO: 1721150 - DNA, 12 bp, Homo sapiens
gagcctgctgga

SEQ ID NO: 1721151 - DNA, 15 bp, Homo sapiens
gagcctgctggcacc

SEQ ID NO: 1721152 - DNA, 18 bp, Homo sapiens
gagcctggcacaggactg

SEQ ID NO: 1721153 - DNA, 17 bp, Homo sapiens
gagatccccagggcagc

SEQ ID NO: 1721154 - DNA, 12 bp, Homo sapiens
gagatcctcctg

SEQ ID NO: 1721155 - DNA, 17 bp, Homo sapiens
gagatcctcctgcagac

SEQ ID NO: 1721156 - DNA, 22 bp, Homo sapiens
gagatccttcacaggcagtgca

SEQ ID NO: 1721157 - DNA, 16 bp, Homo sapiens
gagatcgggaagcaga

SEQ ID NO: 1721158 - DNA, 15 bp, Homo sapiens
gagatctaaaaataa

SEQ ID NO: 1721159 - DNA, 16 bp, Homo sapiens
gagatctatatttttg

SEQ ID NO: 1721160 - DNA, 14 bp, Homo sapiens
gagatctggggagg

SEQ ID NO: 1721161 - DNA, 18 bp, Homo sapiens
gagatctgtgtggctcct

SEQ ID NO: 1721162 - DNA, 16 bp, Homo sapiens
gagatgaattaaattt

SEQ ID NO: 1721163 - DNA, 21 bp, Homo sapiens
gagatgaccagggatgctggg

SEQ ID NO: 1721164 - DNA, 21 bp, Homo sapiens
gagatgcaccaccaagccaag

SEQ ID NO: 1721165 - DNA, 14 bp, Homo sapiens
gagatgcctccacc

SEQ ID NO: 1721166 - DNA, 15 bp, Homo sapiens
gagatgcctccaccg

SEQ ID NO: 1721167 - DNA, 19 bp, Homo sapiens
gagatgcctccaccgctgc

SEQ ID NO: 1721168 - DNA, 17 bp, Homo sapiens
gagatgctgtaacttaa

SEQ ID NO: 1721169 - DNA, 13 bp, Homo sapiens
gagatggaagctt

SEQ ID NO: 1721170 - DNA, 17 bp, Homo sapiens
gagatggagggcttggc

SEQ ID NO: 1721171 - DNA, 20 bp, Homo sapiens
gagatggcgctattgcactc

SEQ ID NO: 1721172 - DNA, 20 bp, Homo sapiens
gagatgggaatgaggtggga

SEQ ID NO: 1721173 - DNA, 18 bp, Homo sapiens
gagatgggcttgttttct

SEQ ID NO: 1721174 - DNA, 13 bp, Homo sapiens
gagatgggtcctg

SEQ ID NO: 1721175 - DNA, 20 bp, Homo sapiens
gagatggtaatctacagctc

SEQ ID NO: 1721176 - DNA, 21 bp, Homo sapiens
gagatggtatgcacaattcca

SEQ ID NO: 1721177 - DNA, 15 bp, Homo sapiens
gagatgtcttggaac

SEQ ID NO: 1721178 - DNA, 16 bp, Homo sapiens
gagatgtcttggaaca

SEQ ID NO: 1721179 - DNA, 16 bp, Homo sapiens
gagatgtgacccacca

SEQ ID NO: 1721180 - DNA, 18 bp, Homo sapiens
gagatgtgacccaccagt

SEQ ID NO: 1721181 - DNA, 14 bp, Homo sapiens
gagatgtgctttgc

SEQ ID NO: 1721182 - DNA, 17 bp, Homo sapiens
gagatgttattactgtt

SEQ ID NO: 1721183 - DNA, 14 bp, Homo sapiens
gagatgttttagag

SEQ ID NO: 1721184 - DNA, 13 bp, Homo sapiens
gagattataataa

SEQ ID NO: 1721185 - DNA, 14 bp, Homo sapiens
gagattcagactgt

SEQ ID NO: 1721186 - DNA, 17 bp, Homo sapiens
gagattggacggcctga

SEQ ID NO: 1721187 - DNA, 13 bp, Homo sapiens
gagattggctttg

SEQ ID NO: 1721188 - DNA, 23 bp, Homo sapiens
gagatttaattaatcatgaatgt

SEQ ID NO: 1721189 - DNA, 13 bp, Homo sapiens
gagatttcatctg

SEQ ID NO: 1721190 - DNA, 17 bp, Homo sapiens
gagatttcatctgctct

SEQ ID NO: 1721191 - DNA, 23 bp, Homo sapiens
gagatttcatctgctctccttcc

SEQ ID NO: 1721192 - DNA, 18 bp, Homo sapiens
gagatttgccagcacagg

SEQ ID NO: 1721193 - DNA, 12 bp, Homo sapiens
gagattttctct

SEQ ID NO: 1721194 - DNA, 18 bp, Homo sapiens
gagcaaaaatctgagaaa

SEQ ID NO: 1721195 - DNA, 22 bp, Homo sapiens
gagcaaaagcctcagaaaggga

SEQ ID NO: 1721196 - DNA, 12 bp, Homo sapiens
gagcaaaataat

SEQ ID NO: 1721197 - DNA, 19 bp, Homo sapiens
gagcaaaatcgatgcagtg

SEQ ID NO: 1721198 - DNA, 14 bp, Homo sapiens
gagcaaacccagag

SEQ ID NO: 1721199 - DNA, 22 bp, Homo sapiens
gagcaaagatcaaaataaaaag

SEQ ID NO: 1721200 - DNA, 22 bp, Homo sapiens
gagcaaagcgcccacccaggtc

SEQ ID NO: 1721201 - DNA, 23 bp, Homo sapiens
gagcaaagcgcccacccaggtcc

SEQ ID NO: 1721202 - DNA, 18 bp, Homo sapiens
gagcaaatattaaaattg

SEQ ID NO: 1721203 - DNA, 18 bp, Homo sapiens
gagcaaatgcaaaaataa

SEQ ID NO: 1721204 - DNA, 14 bp, Homo sapiens
gagcaacctactgt

SEQ ID NO: 1721205 - DNA, 16 bp, Homo sapiens
gagcaaggaagcttca

SEQ ID NO: 1721206 - DNA, 21 bp, Homo sapiens
gagcaaggaaggtaaaaagtt

SEQ ID NO: 1721207 - DNA, 15 bp, Homo sapiens
gagcaaggcatttgg

SEQ ID NO: 1721208 - DNA, 23 bp, Homo sapiens
gagcaatcagaacttcaggtgtg

SEQ ID NO: 1721209 - DNA, 23 bp, Homo sapiens
gagagaataaattggattatttt

SEQ ID NO: 1721210 - DNA, 13 bp, Homo sapiens
gagagacaagaag

SEQ ID NO: 1721211 - DNA, 15 bp, Homo sapiens
gagagacccaaggag

SEQ ID NO: 1721212 - DNA, 19 bp, Homo sapiens
gagagacccaaggaggaaa

SEQ ID NO: 1721213 - DNA, 21 bp, Homo sapiens
gagagaccccgcacccggctc

SEQ ID NO: 1721214 - DNA, 23 bp, Homo sapiens
gagagaccctcactgctggggag

SEQ ID NO: 1721215 - DNA, 14 bp, Homo sapiens
gagagaccctgcaa

SEQ ID NO: 1721216 - DNA, 17 bp, Homo sapiens
gagagacctgtgtgaac

SEQ ID NO: 1721217 - DNA, 21 bp, Homo sapiens
gagagacgcagtccgcccagg

SEQ ID NO: 1721218 - DNA, 19 bp, Homo sapiens
gagagactgaaagcagcag

SEQ ID NO: 1721219 - DNA, 13 bp, Homo sapiens
gagagactgccat

SEQ ID NO: 1721220 - DNA, 20 bp, Homo sapiens
gagagacttgtgctcaagga

SEQ ID NO: 1721221 - DNA, 11 bp, Homo sapiens
gagagagaaag

SEQ ID NO: 1721222 - DNA, 16 bp, Homo sapiens
gagagagcaaggaagc

SEQ ID NO: 1721223 - DNA, 12 bp, Homo sapiens
gagagagccaag

SEQ ID NO: 1721224 - DNA, 13 bp, Homo sapiens
gagagagccaaga

SEQ ID NO: 1721225 - DNA, 22 bp, Homo sapiens
gagagaggaggtttgcctgtga

SEQ ID NO: 1721226 - DNA, 17 bp, Homo sapiens
gagagaggctgcctcag

SEQ ID NO: 1721227 - DNA, 19 bp, Homo sapiens
gagagaggctgcctcagcc

SEQ ID NO: 1721228 - DNA, 17 bp, Homo sapiens
gagagagggactcaagg

SEQ ID NO: 1721229 - DNA, 15 bp, Homo sapiens
gagagaggggcctgc

SEQ ID NO: 1721230 - DNA, 14 bp, Homo sapiens
gagagagttagcat

SEQ ID NO: 1721231 - DNA, 14 bp, Homo sapiens
gagagatcaaagat

SEQ ID NO: 1721232 - DNA, 15 bp, Homo sapiens
gagagatcaaagatg

SEQ ID NO: 1721233 - DNA, 19 bp, Homo sapiens
gagagatgtttggaaacca

SEQ ID NO: 1721234 - DNA, 15 bp, Homo sapiens
gagagattctgtgat

SEQ ID NO: 1721235 - DNA, 12 bp, Homo sapiens
gagagcagcagc

SEQ ID NO: 1721236 - DNA, 14 bp, Homo sapiens
gagagcagcagcac

SEQ ID NO: 1721237 - DNA, 15 bp, Homo sapiens
gagagcagtgggcag

SEQ ID NO: 1721238 - DNA, 21 bp, Homo sapiens
gagagcagtgggcaggtggcc

SEQ ID NO: 1721239 - DNA, 15 bp, Homo sapiens
gagagccaaatctga

SEQ ID NO: 1721240 - DNA, 14 bp, Homo sapiens
gagagccccagctg

SEQ ID NO: 1721241 - DNA, 14 bp, Homo sapiens
gagagccccatggt

SEQ ID NO: 1721242 - DNA, 18 bp, Homo sapiens
gagagccctagaaagctg

SEQ ID NO: 1721243 - DNA, 12 bp, Homo sapiens
gagagccctgct

SEQ ID NO: 1721244 - DNA, 16 bp, Homo sapiens
gagagccctgctgtgg

SEQ ID NO: 1721245 - DNA, 19 bp, Homo sapiens
gagagccgtggtccctgag

SEQ ID NO: 1721246 - DNA, 20 bp, Homo sapiens
gagagccgtggtccctgagg

SEQ ID NO: 1721247 - DNA, 14 bp, Homo sapiens
gagagcctgctccc

SEQ ID NO: 1721248 - DNA, 17 bp, Homo sapiens
gagagcctgctccccca

SEQ ID NO: 1721249 - DNA, 12 bp, Homo sapiens
gagagcctgctg

SEQ ID NO: 1721250 - DNA, 13 bp, Homo sapiens
gagagcctgctgg

SEQ ID NO: 1721251 - DNA, 19 bp, Homo sapiens
gagagcctgtcaccagagc

SEQ ID NO: 1721252 - DNA, 20 bp, Homo sapiens
gagagcctgtcaccagagct

SEQ ID NO: 1721253 - DNA, 21 bp, Homo sapiens
gagagcctgtcaccagagctt

SEQ ID NO: 1721254 - DNA, 13 bp, Homo sapiens
gagagcggctgga

SEQ ID NO: 1721255 - DNA, 16 bp, Homo sapiens
gagagcggctggagaa

SEQ ID NO: 1721256 - DNA, 20 bp, Homo sapiens
gagagcggctggagaaagat

SEQ ID NO: 1721257 - DNA, 17 bp, Homo sapiens
gagagctctggccccgc

SEQ ID NO: 1721258 - DNA, 12 bp, Homo sapiens
gagagctgctga

SEQ ID NO: 1721259 - DNA, 15 bp, Homo sapiens
gagagctttgtgctt

SEQ ID NO: 1721260 - DNA, 19 bp, Homo sapiens
gagaggacaatactggggt

SEQ ID NO: 1721261 - DNA, 12 bp, Homo sapiens
gactgaactcca

SEQ ID NO: 1721262 - DNA, 14 bp, Homo sapiens
gactgaagcacagc

SEQ ID NO: 1721263 - DNA, 14 bp, Homo sapiens
gactgaaggaaaag

SEQ ID NO: 1721264 - DNA, 22 bp, Homo sapiens
gactgaatgctgttaatatttc

SEQ ID NO: 1721265 - DNA, 15 bp, Homo sapiens
gactgaatgtgccta

SEQ ID NO: 1721266 - DNA, 19 bp, Homo sapiens
gactgaccaaagactgcag

SEQ ID NO: 1721267 - DNA, 20 bp, Homo sapiens
gactgaccaaagactgcaga

SEQ ID NO: 1721268 - DNA, 21 bp, Homo sapiens
gactgaccacaccaaccaggc

SEQ ID NO: 1721269 - DNA, 22 bp, Homo sapiens
gactgagactggcacttagccc

SEQ ID NO: 1721270 - DNA, 15 bp, Homo sapiens
gactgagcagccgcc

SEQ ID NO: 1721271 - DNA, 21 bp, Homo sapiens
gactgagcagccgccagctgg

SEQ ID NO: 1721272 - DNA, 12 bp, Homo sapiens
gactgagccagt

SEQ ID NO: 1721273 - DNA, 17 bp, Homo sapiens
gactgagccagtcccag

SEQ ID NO: 1721274 - DNA, 18 bp, Homo sapiens
gactgagctctccaggcc

SEQ ID NO: 1721275 - DNA, 20 bp, Homo sapiens
gactgagctctccaggccag

SEQ ID NO: 1721276 - DNA, 21 bp, Homo sapiens
gactgagctctccaggccagg

SEQ ID NO: 1721277 - DNA, 13 bp, Homo sapiens
gactgaggagtgg

SEQ ID NO: 1721278 - DNA, 12 bp, Homo sapiens
gactgaggcctg

SEQ ID NO: 1721279 - DNA, 12 bp, Homo sapiens
gactgagggcag

SEQ ID NO: 1721280 - DNA, 15 bp, Homo sapiens
gactgaggtataaag

SEQ ID NO: 1721281 - DNA, 15 bp, Homo sapiens
gactgagtcagatgg

SEQ ID NO: 1721282 - DNA, 19 bp, Homo sapiens
gactgatagcttacactga

SEQ ID NO: 1721283 - DNA, 13 bp, Homo sapiens
gactgatgtcatc

SEQ ID NO: 1721284 - DNA, 17 bp, Homo sapiens
gactgatgtcatcttga

SEQ ID NO: 1721285 - DNA, 14 bp, Homo sapiens
gactgatttcagag

SEQ ID NO: 1721286 - DNA, 19 bp, Homo sapiens
gactgatttgtggaaagga

SEQ ID NO: 1721287 - DNA, 18 bp, Homo sapiens
gactgcagaacccccagg

SEQ ID NO: 1721288 - DNA, 22 bp, Homo sapiens
gactgcagaacccccaggtggc

SEQ ID NO: 1721289 - DNA, 14 bp, Homo sapiens
gactgcagctgctg

SEQ ID NO: 1721290 - DNA, 21 bp, Homo sapiens
gactgcagggacacgggcagc

SEQ ID NO: 1721291 - DNA, 20 bp, Homo sapiens
gactgcagtcggcatgccag

SEQ ID NO: 1721292 - DNA, 21 bp, Homo sapiens
gactgcagtcggcatgccagg

SEQ ID NO: 1721293 - DNA, 16 bp, Homo sapiens
gactgcagtgtggagt

SEQ ID NO: 1721294 - DNA, 20 bp, Homo sapiens
gactgcagtgtggagttcac

SEQ ID NO: 1721295 - DNA, 21 bp, Homo sapiens
gactgcagtgtggagttcacc

SEQ ID NO: 1721296 - DNA, 21 bp, Homo sapiens
gactgcatggggaggcagcag

SEQ ID NO: 1721297 - DNA, 22 bp, Homo sapiens
gactgcatggggaggcagcaga

SEQ ID NO: 1721298 - DNA, 14 bp, Homo sapiens
gactgccaagccag

SEQ ID NO: 1721299 - DNA, 15 bp, Homo sapiens
gactgccaagccaga

SEQ ID NO: 1721300 - DNA, 18 bp, Homo sapiens
gactgccaagccagattc

SEQ ID NO: 1721301 - DNA, 20 bp, Homo sapiens
gactgccaagccagattctc

SEQ ID NO: 1721302 - DNA, 21 bp, Homo sapiens
gactgccccacggccctgtca

SEQ ID NO: 1721303 - DNA, 16 bp, Homo sapiens
gactgccccttctatg

SEQ ID NO: 1721304 - DNA, 17 bp, Homo sapiens
gactgctacctctgaga

SEQ ID NO: 1721305 - DNA, 21 bp, Homo sapiens
gactgctacctttcaaagctt

SEQ ID NO: 1721306 - DNA, 15 bp, Homo sapiens
gactgctcagaactt

SEQ ID NO: 1721307 - DNA, 16 bp, Homo sapiens
gactgcttcccatcct

SEQ ID NO: 1721308 - DNA, 20 bp, Homo sapiens
gactggagaccgcttcaccc

SEQ ID NO: 1721309 - DNA, 21 bp, Homo sapiens
gactggagaccgcttcacccc

SEQ ID NO: 1721310 - DNA, 15 bp, Homo sapiens
gactggaggcccctg

SEQ ID NO: 1721311 - DNA, 16 bp, Homo sapiens
gactggaggcccctgg

SEQ ID NO: 1721312 - DNA, 23 bp, Homo sapiens
gactggaggcccctggagccaga

SEQ ID NO: 1721313 - DNA, 17 bp, Homo sapiens
gactggaggcctcgccc

SEQ ID NO: 1721314 - DNA, 21 bp, Homo sapiens
gactggagtgaggcttccagg

SEQ ID NO: 1721315 - DNA, 23 bp, Homo sapiens
gactggagtgaggcttccaggct

SEQ ID NO: 1721316 - DNA, 16 bp, Homo sapiens
gactggcacttagccc

SEQ ID NO: 1721317 - DNA, 14 bp, Homo sapiens
gactggcaggtgca

SEQ ID NO: 1721318 - DNA, 17 bp, Homo sapiens
gactggctggctgcagt

SEQ ID NO: 1721319 - DNA, 15 bp, Homo sapiens
gactggctgtctgcc

SEQ ID NO: 1721320 - DNA, 19 bp, Homo sapiens
gactggctgtctgcctgta

SEQ ID NO: 1721321 - DNA, 21 bp, Homo sapiens
gactgggagccacttctcccc

SEQ ID NO: 1721322 - DNA, 14 bp, Homo sapiens
gactgggcccaggc

SEQ ID NO: 1721323 - DNA, 15 bp, Homo sapiens
gactgggcccaggca

SEQ ID NO: 1721324 - DNA, 17 bp, Homo sapiens
gactgggcccaggcagg

SEQ ID NO: 1721325 - DNA, 20 bp, Homo sapiens
gactgggcccaggcaggtct

SEQ ID NO: 1721326 - DNA, 15 bp, Homo sapiens
gactgggctctggct

SEQ ID NO: 1721327 - DNA, 14 bp, Homo sapiens
gactgggggccaga

SEQ ID NO: 1721328 - DNA, 16 bp, Homo sapiens
gactgggtctgacctg

SEQ ID NO: 1721329 - DNA, 18 bp, Homo sapiens
gactgggtctgacctggt

SEQ ID NO: 1721330 - DNA, 21 bp, Homo sapiens
gactgggtctgacctggtggg

SEQ ID NO: 1721331 - DNA, 18 bp, Homo sapiens
gactgggttagaggagtc

SEQ ID NO: 1721332 - DNA, 22 bp, Homo sapiens
gactgggtttggaccccagctg

SEQ ID NO: 1721333 - DNA, 12 bp, Homo sapiens
gactggtccagc

SEQ ID NO: 1721334 - DNA, 13 bp, Homo sapiens
gactggtccagct

SEQ ID NO: 1721335 - DNA, 13 bp, Homo sapiens
gactgtaaagatt

SEQ ID NO: 1721336 - DNA, 16 bp, Homo sapiens
gactgtactcctccca

SEQ ID NO: 1721337 - DNA, 20 bp, Homo sapiens
gactgtagatatgtattctt

SEQ ID NO: 1721338 - DNA, 22 bp, Homo sapiens
gactgtagattgcttctgtagt

SEQ ID NO: 1721339 - DNA, 14 bp, Homo sapiens
gacttttgctttaa

SEQ ID NO: 1721340 - DNA, 17 bp, Homo sapiens
gactttttagccagtga

SEQ ID NO: 1721341 - DNA, 19 bp, Homo sapiens
gactttttagccagtgact

SEQ ID NO: 1721342 - DNA, 16 bp, Homo sapiens
gactttttgcatttaa

SEQ ID NO: 1721343 - DNA, 17 bp, Homo sapiens
gactttttttgtatgtg

SEQ ID NO: 1721344 - DNA, 18 bp, Homo sapiens
gacttttttttttctttt

SEQ ID NO: 1721345 - DNA, 14 bp, Homo sapiens
gagaaaaaaaacct

SEQ ID NO: 1721346 - DNA, 20 bp, Homo sapiens
gagaaaaaaaaccttgtaaa

SEQ ID NO: 1721347 - DNA, 14 bp, Homo sapiens
gagaaaaaagaagt

SEQ ID NO: 1721348 - DNA, 11 bp, Homo sapiens
gagaaaaacaa

SEQ ID NO: 1721349 - DNA, 16 bp, Homo sapiens
gagaaaaagaaatgca

SEQ ID NO: 1721350 - DNA, 16 bp, Homo sapiens
gagaaaaaggtgccat

SEQ ID NO: 1721351 - DNA, 14 bp, Homo sapiens
gagaaaagagagaa

SEQ ID NO: 1721352 - DNA, 16 bp, Homo sapiens
gagaaaatcatcaaga

SEQ ID NO: 1721353 - DNA, 23 bp, Homo sapiens
gagaaaatgcctcaattcacata

SEQ ID NO: 1721354 - DNA, 18 bp, Homo sapiens
gagaaaatgtaaaggagg

SEQ ID NO: 1721355 - DNA, 19 bp, Homo sapiens
gagaaaatgtaaaggaggg

SEQ ID NO: 1721356 - DNA, 14 bp, Homo sapiens
gagaaacagctcag

SEQ ID NO: 1721357 - DNA, 19 bp, Homo sapiens
gagaaacagctcagccagt

SEQ ID NO: 1721358 - DNA, 17 bp, Homo sapiens
gagaaacagttggtaac

SEQ ID NO: 1721359 - DNA, 21 bp, Homo sapiens
gagaaacagttggtaactttt

SEQ ID NO: 1721360 - DNA, 22 bp, Homo sapiens
gagaaacagttggtaacttttg

SEQ ID NO: 1721361 - DNA, 20 bp, Homo sapiens
gagaaaccctaaaaagagaa

SEQ ID NO: 1721362 - DNA, 21 bp, Homo sapiens
gagaaaccctaaaaagagaag

SEQ ID NO: 1721363 - DNA, 23 bp, Homo sapiens
gagaaaccttattgtacctctct

SEQ ID NO: 1721364 - DNA, 17 bp, Homo sapiens
gagaaactgctgcagat

SEQ ID NO: 1721365 - DNA, 14 bp, Homo sapiens
gagaaacttcaaag

SEQ ID NO: 1721366 - DNA, 19 bp, Homo sapiens
gagaaagaggcaccaggaa

SEQ ID NO: 1721367 - DNA, 17 bp, Homo sapiens
gagaaagatgaaactga

SEQ ID NO: 1721368 - DNA, 19 bp, Homo sapiens
gagaaagatgaaactgaaa

SEQ ID NO: 1721369 - DNA, 16 bp, Homo sapiens
gagaaagatgcagtcc

SEQ ID NO: 1721370 - DNA, 21 bp, Homo sapiens
gagaaaggacagagccagcgg

SEQ ID NO: 1721371 - DNA, 21 bp, Homo sapiens
gagaaagttactgttaagggt

SEQ ID NO: 1721372 - DNA, 19 bp, Homo sapiens
gagaaatacataaaaaagt

SEQ ID NO: 1721373 - DNA, 16 bp, Homo sapiens
gagaaatcacaggggc

SEQ ID NO: 1721374 - DNA, 14 bp, Homo sapiens
gagaaatgtcataa

SEQ ID NO: 1721375 - DNA, 12 bp, Homo sapiens
gagaaattagaa

SEQ ID NO: 1721376 - DNA, 23 bp, Homo sapiens
gagaacaagtcacagctgcagct

SEQ ID NO: 1721377 - DNA, 12 bp, Homo sapiens
gagaacagtggt

SEQ ID NO: 1721378 - DNA, 17 bp, Homo sapiens
gagaacagtggttgcct

SEQ ID NO: 1721379 - DNA, 21 bp, Homo sapiens
gagaacagtggttgcctgggg

SEQ ID NO: 1721380 - DNA, 15 bp, Homo sapiens
gaattttctgcagct

SEQ ID NO: 1721381 - DNA, 17 bp, Homo sapiens
gaattttgcaatgtatt

SEQ ID NO: 1721382 - DNA, 20 bp, Homo sapiens
gaattttgttctctgggaga

SEQ ID NO: 1721383 - DNA, 23 bp, Homo sapiens
gaattttgtttttattttcaaga

SEQ ID NO: 1721384 - DNA, 12 bp, Homo sapiens
gaatttttaagc

SEQ ID NO: 1721385 - DNA, 14 bp, Homo sapiens
gaatttttttgtaa

SEQ ID NO: 1721386 - DNA, 17 bp, Homo sapiens
gaatttttttgtcttta

SEQ ID NO: 1721387 - DNA, 17 bp, Homo sapiens
gaattttttttaacatt

SEQ ID NO: 1721388 - DNA, 22 bp, Homo sapiens
gaaggcaaaaactgtactgtgt

SEQ ID NO: 1721389 - DNA, 23 bp, Homo sapiens
gaaggcaaatataagctgggaaa

SEQ ID NO: 1721390 - DNA, 23 bp, Homo sapiens
gaaggcaagagggggtggagggg

SEQ ID NO: 1721391 - DNA, 15 bp, Homo sapiens
gaaggcacccgccct

SEQ ID NO: 1721392 - DNA, 18 bp, Homo sapiens
gaaggcagagaaatctaa

SEQ ID NO: 1721393 - DNA, 13 bp, Homo sapiens
gaaggcagctgct

SEQ ID NO: 1721394 - DNA, 22 bp, Homo sapiens
gaaggcagggggaaggtggggt

SEQ ID NO: 1721395 - DNA, 17 bp, Homo sapiens
gaaggcagtctgaaccc

SEQ ID NO: 1721396 - DNA, 22 bp, Homo sapiens
gaaggcagtggcaggggagcag

SEQ ID NO: 1721397 - DNA, 17 bp, Homo sapiens
gaaggcatttgcagggt

SEQ ID NO: 1721398 - DNA, 16 bp, Homo sapiens
gaaggccccagagaga

SEQ ID NO: 1721399 - DNA, 21 bp, Homo sapiens
gaaggccccagagagaccctg

SEQ ID NO: 1721400 - DNA, 15 bp, Homo sapiens
gaaggccccttccct

SEQ ID NO: 1721401 - DNA, 16 bp, Homo sapiens
gaaggccctgctgagt

SEQ ID NO: 1721402 - DNA, 18 bp, Homo sapiens
gaaggccctgctgagtca

SEQ ID NO: 1721403 - DNA, 20 bp, Homo sapiens
gaaggccgctgccccagccc

SEQ ID NO: 1721404 - DNA, 21 bp, Homo sapiens
gaaggccgctgccccagcccc

SEQ ID NO: 1721405 - DNA, 17 bp, Homo sapiens
gaaggcctttcttctgt

SEQ ID NO: 1721406 - DNA, 20 bp, Homo sapiens
gaaggcctttcttctgtgtt

SEQ ID NO: 1721407 - DNA, 22 bp, Homo sapiens
gaaggctgaactcttcagaaca

SEQ ID NO: 1721408 - DNA, 13 bp, Homo sapiens
gaaggctggctgg

SEQ ID NO: 1721409 - DNA, 22 bp, Homo sapiens
gaaggcttctctccacagtgtt

SEQ ID NO: 1721410 - DNA, 15 bp, Homo sapiens
gaagggaagagacag

SEQ ID NO: 1721411 - DNA, 13 bp, Homo sapiens
gaagggaagtggg

SEQ ID NO: 1721412 - DNA, 19 bp, Homo sapiens
gaagggaatcctcctccag

SEQ ID NO: 1721413 - DNA, 18 bp, Homo sapiens
gaagggacagctgctggg

SEQ ID NO: 1721414 - DNA, 21 bp, Homo sapiens
gaagggaccaaggcaaggcag

SEQ ID NO: 1721415 - DNA, 13 bp, Homo sapiens
gaagggagagggc

SEQ ID NO: 1721416 - DNA, 18 bp, Homo sapiens
gaagggagggtggccagc

SEQ ID NO: 1721417 - DNA, 14 bp, Homo sapiens
gaagggcaagaaat

SEQ ID NO: 1721418 - DNA, 22 bp, Homo sapiens
gaagggcaggaaggagagcctg

SEQ ID NO: 1721419 - DNA, 16 bp, Homo sapiens
gaagggccagagccag

SEQ ID NO: 1721420 - DNA, 19 bp, Homo sapiens
gaagggccagtcctgcctg

SEQ ID NO: 1721421 - DNA, 22 bp, Homo sapiens
gaagggcctgcccagttgcact

SEQ ID NO: 1721422 - DNA, 15 bp, Homo sapiens
gaaggggaaaaatgg

SEQ ID NO: 1721423 - DNA, 14 bp, Homo sapiens
gaaggggaggcaca

SEQ ID NO: 1721424 - DNA, 15 bp, Homo sapiens
gaaggggaggcacac

SEQ ID NO: 1721425 - DNA, 16 bp, Homo sapiens
gaaggggaggcacact

SEQ ID NO: 1721426 - DNA, 14 bp, Homo sapiens
gaaggggccccggg

SEQ ID NO: 1721427 - DNA, 23 bp, Homo sapiens
gaaggggccctggtccttccagg

SEQ ID NO: 1721428 - DNA, 17 bp, Homo sapiens
gaaggggctgaggacga

SEQ ID NO: 1721429 - DNA, 15 bp, Homo sapiens
gaagggggccctgct

SEQ ID NO: 1721430 - DNA, 20 bp, Homo sapiens
gaagggggccctgctacctg

SEQ ID NO: 1721431 - DNA, 23 bp, Homo sapiens
gaaggggggttgcagtggagagg

SEQ ID NO: 1721432 - DNA, 19 bp, Homo sapiens
gaagggggtggtgtctcca

SEQ ID NO: 1721433 - DNA, 21 bp, Homo sapiens
gaagggggtgtgcgtgcgtgt

SEQ ID NO: 1721434 - DNA, 17 bp, Homo sapiens
gaaggggttggattgca

SEQ ID NO: 1721435 - DNA, 21 bp, Homo sapiens
gaagggtggcctgttccctag

SEQ ID NO: 1721436 - DNA, 18 bp, Homo sapiens
gaagggttctgccctgcc

SEQ ID NO: 1721437 - DNA, 23 bp, Homo sapiens
gaagggttctgccctgcctgagg

SEQ ID NO: 1721438 - DNA, 15 bp, Homo sapiens
gaagggttttctttt

SEQ ID NO: 1721439 - DNA, 18 bp, Homo sapiens
gaagggtttttagagaat

SEQ ID NO: 1721440 - DNA, 19 bp, Homo sapiens
gaagggtttttagagaatg

SEQ ID NO: 1721441 - DNA, 17 bp, Homo sapiens
gaaggtaaataaaaaga

SEQ ID NO: 1721442 - DNA, 13 bp, Homo sapiens
gaaggtagcccag

SEQ ID NO: 1721443 - DNA, 17 bp, Homo sapiens
gaaggtattagcaaagc

SEQ ID NO: 1721444 - DNA, 15 bp, Homo sapiens
gaaggtcgcccttgc

SEQ ID NO: 1721445 - DNA, 15 bp, Homo sapiens
gaaggtgacagcagt

SEQ ID NO: 1721446 - DNA, 17 bp, Homo sapiens
gaaggtgataagggaaa

SEQ ID NO: 1721447 - DNA, 19 bp, Homo sapiens
gaaggtgataagggaaaag

SEQ ID NO: 1721448 - DNA, 14 bp, Homo sapiens
gaaggtgatggggg

SEQ ID NO: 1721449 - DNA, 19 bp, Homo sapiens
gaaggtgatgttgccatcc

SEQ ID NO: 1721450 - DNA, 16 bp, Homo sapiens
gaaggtgcctcagact

SEQ ID NO: 1721451 - DNA, 22 bp, Homo sapiens
gaaggtgctgagcttagccttg

SEQ ID NO: 1721452 - DNA, 16 bp, Homo sapiens
gaaggtggacctggca

SEQ ID NO: 1721453 - DNA, 20 bp, Homo sapiens
gaaggtggaggttgcggtga

SEQ ID NO: 1721454 - DNA, 22 bp, Homo sapiens
gaaggtggatggccccagcaca

SEQ ID NO: 1721455 - DNA, 18 bp, Homo sapiens
gaaggtggcctctgtgga

SEQ ID NO: 1721456 - DNA, 22 bp, Homo sapiens
gaaggtggccttcctgctgtta

SEQ ID NO: 1721457 - DNA, 20 bp, Homo sapiens
gaaggtggggccctgcccct

SEQ ID NO: 1721458 - DNA, 17 bp, Homo sapiens
gaaggtggtggggctgc

SEQ ID NO: 1721459 - DNA, 14 bp, Homo sapiens
gaaggtttattgtt

SEQ ID NO: 1721460 - DNA, 23 bp, Homo sapiens
gaaggtttttaagggccggggat

SEQ ID NO: 1721461 - DNA, 16 bp, Homo sapiens
gaagtaaactttttgt

SEQ ID NO: 1721462 - DNA, 20 bp, Homo sapiens
gaagtaaactttttgttctg

SEQ ID NO: 1721463 - DNA, 20 bp, Homo sapiens
gaagtaaattaaacattttt

SEQ ID NO: 1721464 - DNA, 14 bp, Homo sapiens
gaagtaagaagagg

SEQ ID NO: 1721465 - DNA, 19 bp, Homo sapiens
gaagtaagaagaggagcct

SEQ ID NO: 1721466 - DNA, 17 bp, Homo sapiens
gaagtaagtggggttgc

SEQ ID NO: 1721467 - DNA, 14 bp, Homo sapiens
gaagtaccagacta

SEQ ID NO: 1721468 - DNA, 20 bp, Homo sapiens
gaagtcaaaatatgtaagaa

SEQ ID NO: 1721469 - DNA, 15 bp, Homo sapiens
gaagtcaaacatttc

SEQ ID NO: 1721470 - DNA, 18 bp, Homo sapiens
gaagtcactcacactggc

SEQ ID NO: 1721471 - DNA, 14 bp, Homo sapiens
gaagtcagccacac

SEQ ID NO: 1721472 - DNA, 23 bp, Homo sapiens
gaagtcagccacactgggcctgg

SEQ ID NO: 1721473 - DNA, 18 bp, Homo sapiens
gaagtcatcttgctacca

SEQ ID NO: 1721474 - DNA, 20 bp, Homo sapiens
gaagtcctccctcctgcagg

SEQ ID NO: 1721475 - DNA, 13 bp, Homo sapiens
gaagtctcagcta

SEQ ID NO: 1721476 - DNA, 21 bp, Homo sapiens
gaagtctccatgaagagcttg

SEQ ID NO: 1721477 - DNA, 12 bp, Homo sapiens
gaagtctggaaa

SEQ ID NO: 1721478 - DNA, 15 bp, Homo sapiens
gaagtctggctttgc

SEQ ID NO: 1721479 - DNA, 16 bp, Homo sapiens
gaagtctggctttgct

SEQ ID NO: 1721480 - DNA, 24 bp, Homo sapiens
gaagtctggctttgctctattaag

SEQ ID NO: 1721481 - DNA, 19 bp, Homo sapiens
gaagtcttgaagttgggtg

SEQ ID NO: 1721482 - DNA, 14 bp, Homo sapiens
gaagtgaacatttc

SEQ ID NO: 1721483 - DNA, 15 bp, Homo sapiens
gaagtgaatgctggg

SEQ ID NO: 1721484 - DNA, 16 bp, Homo sapiens
gaagtgaatgctggga

SEQ ID NO: 1721485 - DNA, 21 bp, Homo sapiens
gaagtgagagaaaaaggtcct

SEQ ID NO: 1721486 - DNA, 13 bp, Homo sapiens
gaagtgaggccca

SEQ ID NO: 1721487 - DNA, 19 bp, Homo sapiens
gaagtgaggcccaaggagc

SEQ ID NO: 1721488 - DNA, 22 bp, Homo sapiens
gaagtgagggctcactcagcca

SEQ ID NO: 1721489 - DNA, 18 bp, Homo sapiens
gaagtgagtttgtaaata

SEQ ID NO: 1721490 - DNA, 17 bp, Homo sapiens
gaagtgatatggtgaag

SEQ ID NO: 1721491 - DNA, 13 bp, Homo sapiens
gaagtgctccctg

SEQ ID NO: 1721492 - DNA, 15 bp, Homo sapiens
gaagtgctccctgga

SEQ ID NO: 1721493 - DNA, 20 bp, Homo sapiens
gaagtgctcttggctgaccc

SEQ ID NO: 1721494 - DNA, 18 bp, Homo sapiens
gaagtggaccaggacagg

SEQ ID NO: 1721495 - DNA, 16 bp, Homo sapiens
gaagtgggccaggaca

SEQ ID NO: 1721496 - DNA, 21 bp, Homo sapiens
gaagtgggccaggacaggccc

SEQ ID NO: 1721497 - DNA, 18 bp, Homo sapiens
gaagtggggtgttcttct

SEQ ID NO: 1721498 - DNA, 20 bp, Homo sapiens
gaagtggtacaatctggctc

SEQ ID NO: 1721499 - DNA, 14 bp, Homo sapiens
gaagtgtaacagct

SEQ ID NO: 1721500 - DNA, 18 bp, Homo sapiens
gaagtgtaacagctgagg

SEQ ID NO: 1721501 - DNA, 12 bp, Homo sapiens
gacccagcctga

SEQ ID NO: 1721502 - DNA, 13 bp, Homo sapiens
gacccagcctgaa

SEQ ID NO: 1721503 - DNA, 15 bp, Homo sapiens
gacccaggaaaggca

SEQ ID NO: 1721504 - DNA, 11 bp, Homo sapiens
gacccaggccc

SEQ ID NO: 1721505 - DNA, 15 bp, Homo sapiens
gacccaggccctcca

SEQ ID NO: 1721506 - DNA, 15 bp, Homo sapiens
gacccaggccgcagc

SEQ ID NO: 1721507 - DNA, 21 bp, Homo sapiens
gacccaggtggagggcacagc

SEQ ID NO: 1721508 - DNA, 19 bp, Homo sapiens
gacccaggtgtgcctgtgc

SEQ ID NO: 1721509 - DNA, 17 bp, Homo sapiens
gacccagtgcactccgg

SEQ ID NO: 1721510 - DNA, 13 bp, Homo sapiens
gacccatggtcat

SEQ ID NO: 1721511 - DNA, 20 bp, Homo sapiens
gacccatgtaatccttttgt

SEQ ID NO: 1721512 - DNA, 23 bp, Homo sapiens
gaccccaaacaccttccagctcc

SEQ ID NO: 1721513 - DNA, 21 bp, Homo sapiens
gaccccaaaggaacactgaca

SEQ ID NO: 1721514 - DNA, 19 bp, Homo sapiens
gaccccacccaagcttggc

SEQ ID NO: 1721515 - DNA, 18 bp, Homo sapiens
gaccccagcggctgagtc

SEQ ID NO: 1721516 - DNA, 13 bp, Homo sapiens
gaccccaggacct

SEQ ID NO: 1721517 - DNA, 15 bp, Homo sapiens
gaccccattcctgat

SEQ ID NO: 1721518 - DNA, 22 bp, Homo sapiens
gaccccattcctgatcccatgg

SEQ ID NO: 1721519 - DNA, 15 bp, Homo sapiens
gacccccacacctca

SEQ ID NO: 1721520 - DNA, 18 bp, Homo sapiens
gacccccactctcattcc

SEQ ID NO: 1721521 - DNA, 15 bp, Homo sapiens
gacccccatccagcc

SEQ ID NO: 1721522 - DNA, 17 bp, Homo sapiens
gacccccatccagcctc

SEQ ID NO: 1721523 - DNA, 21 bp, Homo sapiens
gacccccccccaatcggactg

SEQ ID NO: 1721524 - DNA, 18 bp, Homo sapiens
gaccccgacgccacagcc

SEQ ID NO: 1721525 - DNA, 22 bp, Homo sapiens
gaccccgacgccacagcccagc

SEQ ID NO: 1721526 - DNA, 19 bp, Homo sapiens
gaccccgagaaccctgagc

SEQ ID NO: 1721527 - DNA, 18 bp, Homo sapiens
gaccccgagaagtgctct

SEQ ID NO: 1721528 - DNA, 21 bp, Homo sapiens
gaccccgcaggatccctcctg

SEQ ID NO: 1721529 - DNA, 13 bp, Homo sapiens
gaccccgcccctg

SEQ ID NO: 1721530 - DNA, 17 bp, Homo sapiens
gaccccgcccctgggga

SEQ ID NO: 1721531 - DNA, 17 bp, Homo sapiens
gacccctaatgtcagct

SEQ ID NO: 1721532 - DNA, 20 bp, Homo sapiens
gacccctggaccaccagccc

SEQ ID NO: 1721533 - DNA, 13 bp, Homo sapiens
gacccctggcttt

SEQ ID NO: 1721534 - DNA, 15 bp, Homo sapiens
gacccctgggagctt

SEQ ID NO: 1721535 - DNA, 16 bp, Homo sapiens
gacccctgttcatgcc

SEQ ID NO: 1721536 - DNA, 13 bp, Homo sapiens
gacccgccagccc

SEQ ID NO: 1721537 - DNA, 14 bp, Homo sapiens
gacccgccagcccc

SEQ ID NO: 1721538 - DNA, 17 bp, Homo sapiens
gacccggaggggcctgg

SEQ ID NO: 1721539 - DNA, 18 bp, Homo sapiens
gacccggaggggcctggc

SEQ ID NO: 1721540 - DNA, 21 bp, Homo sapiens
gacccggccgccgccaggact

SEQ ID NO: 1721541 - DNA, 23 bp, Homo sapiens
gacccggccgccgccaggactgt

SEQ ID NO: 1721542 - DNA, 17 bp, Homo sapiens
gacccgggaccacagct

SEQ ID NO: 1721543 - DNA, 21 bp, Homo sapiens
gacccggggtctcctggacct

SEQ ID NO: 1721544 - DNA, 15 bp, Homo sapiens
gaccctacaggagag

SEQ ID NO: 1721545 - DNA, 22 bp, Homo sapiens
gaccctcatggcccccaggggc

SEQ ID NO: 1721546 - DNA, 17 bp, Homo sapiens
gaccctccccgcacccc

SEQ ID NO: 1721547 - DNA, 14 bp, Homo sapiens
gaccctcgcagacc

SEQ ID NO: 1721548 - DNA, 18 bp, Homo sapiens
gaccctcgtggccttccc

SEQ ID NO: 1721549 - DNA, 20 bp, Homo sapiens
gaccctcttgcccatcctga

SEQ ID NO: 1721550 - DNA, 22 bp, Homo sapiens
gaccctcttgcccatcctgact

SEQ ID NO: 1721551 - DNA, 21 bp, Homo sapiens
gaccctgaaaggaacactggc

SEQ ID NO: 1721552 - DNA, 17 bp, Homo sapiens
gaccctgacctccgccc

SEQ ID NO: 1721553 - DNA, 22 bp, Homo sapiens
gaccctgacctccgcccctgcc

SEQ ID NO: 1721554 - DNA, 13 bp, Homo sapiens
gaccctgccctgg

SEQ ID NO: 1721555 - DNA, 20 bp, Homo sapiens
gaccctggaattcagcaccc

SEQ ID NO: 1721556 - DNA, 21 bp, Homo sapiens
gaccctggaattcagcaccct

SEQ ID NO: 1721557 - DNA, 16 bp, Homo sapiens
gaccctggaggcccca

SEQ ID NO: 1721558 - DNA, 14 bp, Homo sapiens
gaccctgggcctgg

SEQ ID NO: 1721559 - DNA, 15 bp, Homo sapiens
gaccctgggcctgga

SEQ ID NO: 1721560 - DNA, 16 bp, Homo sapiens
gaccctgggcctggag

SEQ ID NO: 1721561 - DNA, 11 bp, Homo sapiens
gaccctggggg

SEQ ID NO: 1721562 - DNA, 17 bp, Homo sapiens
gaccctgggggcacagg

SEQ ID NO: 1721563 - DNA, 21 bp, Homo sapiens
gaccctgggggcacaggaggc

SEQ ID NO: 1721564 - DNA, 17 bp, Homo sapiens
gaccctgggtgggctct

SEQ ID NO: 1721565 - DNA, 18 bp, Homo sapiens
gaccctgggtgggctctg

SEQ ID NO: 1721566 - DNA, 19 bp, Homo sapiens
gaccctgggtgggctctgt

SEQ ID NO: 1721567 - DNA, 21 bp, Homo sapiens
gaccctgtccggcccagtgcc

SEQ ID NO: 1721568 - DNA, 15 bp, Homo sapiens
gaccctgtgcaggag

SEQ ID NO: 1721569 - DNA, 21 bp, Homo sapiens
gaccctgtgtcctccaccatg

SEQ ID NO: 1721570 - DNA, 16 bp, Homo sapiens
gacccttattgctgtc

SEQ ID NO: 1721571 - DNA, 15 bp, Homo sapiens
gacccttcagggcca

SEQ ID NO: 1721572 - DNA, 16 bp, Homo sapiens
gacccttcagggccag

SEQ ID NO: 1721573 - DNA, 21 bp, Homo sapiens
gacccttcccaatcagcactg

SEQ ID NO: 1721574 - DNA, 21 bp, Homo sapiens
gacccttggcctccatttctg

SEQ ID NO: 1721575 - DNA, 24 bp, Homo sapiens
gacccttggcctccatttctgtct

SEQ ID NO: 1721576 - DNA, 21 bp, Homo sapiens
gaccctttccttccttccctg

SEQ ID NO: 1721577 - DNA, 23 bp, Homo sapiens
gaccctttccttccttccctggc

SEQ ID NO: 1721578 - DNA, 14 bp, Homo sapiens
gacccttttctcag

SEQ ID NO: 1721579 - DNA, 14 bp, Homo sapiens
gaccgactacccca

SEQ ID NO: 1721580 - DNA, 18 bp, Homo sapiens
gaccgactaccccagtcc

SEQ ID NO: 1721581 - DNA, 13 bp, Homo sapiens
gaccgagccctgg

SEQ ID NO: 1721582 - DNA, 16 bp, Homo sapiens
gaccgccatggtgctg

SEQ ID NO: 1721583 - DNA, 13 bp, Homo sapiens
gaccgccccaggg

SEQ ID NO: 1721584 - DNA, 14 bp, Homo sapiens
gaccgccccctcct

SEQ ID NO: 1721585 - DNA, 14 bp, Homo sapiens
gaccgggtgggcct

SEQ ID NO: 1721586 - DNA, 21 bp, Homo sapiens
gaccgggtgggcctggcctga

SEQ ID NO: 1721587 - DNA, 15 bp, Homo sapiens
gaccggtgctgcagg

SEQ ID NO: 1721588 - DNA, 16 bp, Homo sapiens
gaccggtgctgcagga

SEQ ID NO: 1721589 - DNA, 17 bp, Homo sapiens
gaccggtgctgcaggag

SEQ ID NO: 1721590 - DNA, 13 bp, Homo sapiens
gaccgtggacagg

SEQ ID NO: 1721591 - DNA, 16 bp, Homo sapiens
gaccgtggacaggccc

SEQ ID NO: 1721592 - DNA, 13 bp, Homo sapiens
gaccgtggccctg

SEQ ID NO: 1721593 - DNA, 17 bp, Homo sapiens
gacctaaaaattggtgt

SEQ ID NO: 1721594 - DNA, 20 bp, Homo sapiens
gacgggagcattggcccctg

SEQ ID NO: 1721595 - DNA, 17 bp, Homo sapiens
gacggggtttcaccatg

SEQ ID NO: 1721596 - DNA, 15 bp, Homo sapiens
gacgggttgaaagac

SEQ ID NO: 1721597 - DNA, 17 bp, Homo sapiens
gacgggttgaaagacat

SEQ ID NO: 1721598 - DNA, 18 bp, Homo sapiens
gacgggttgaaagacatc

SEQ ID NO: 1721599 - DNA, 21 bp, Homo sapiens
gacggtaagtgttctcatgaa

SEQ ID NO: 1721600 - DNA, 17 bp, Homo sapiens
gacggtgctcactccca

SEQ ID NO: 1721601 - DNA, 21 bp, Homo sapiens
gacggtgggcatttgtgaggc

SEQ ID NO: 1721602 - DNA, 22 bp, Homo sapiens
gacggtgttaattttgctaact

SEQ ID NO: 1721603 - DNA, 18 bp, Homo sapiens
gacggttaacttgtatat

SEQ ID NO: 1721604 - DNA, 23 bp, Homo sapiens
gacggttaacttgtatattccac

SEQ ID NO: 1721605 - DNA, 15 bp, Homo sapiens
gacggtttccaggga

SEQ ID NO: 1721606 - DNA, 22 bp, Homo sapiens
gacggtttccagggaggggccg

SEQ ID NO: 1721607 - DNA, 16 bp, Homo sapiens
gacgtaattaaatcca

SEQ ID NO: 1721608 - DNA, 14 bp, Homo sapiens
gacgtcaagtctcc

SEQ ID NO: 1721609 - DNA, 20 bp, Homo sapiens
gacgtcagcctcttaccttc

SEQ ID NO: 1721610 - DNA, 18 bp, Homo sapiens
gacgtgcacctgtactca

SEQ ID NO: 1721611 - DNA, 14 bp, Homo sapiens
gacgtgcactgtga

SEQ ID NO: 1721612 - DNA, 22 bp, Homo sapiens
gacgtgccttttgcacccctcc

SEQ ID NO: 1721613 - DNA, 16 bp, Homo sapiens
gacgtggacatgcctc

SEQ ID NO: 1721614 - DNA, 18 bp, Homo sapiens
gacgtggacatgcctcaa

SEQ ID NO: 1721615 - DNA, 15 bp, Homo sapiens
gacgtggtgggactc

SEQ ID NO: 1721616 - DNA, 24 bp, Homo sapiens
gacgtggtgggactccagctcgtg

SEQ ID NO: 1721617 - DNA, 14 bp, Homo sapiens
gacgtgtgtgaatg

SEQ ID NO: 1721618 - DNA, 15 bp, Homo sapiens
gacgtgtgtggctgg

SEQ ID NO: 1721619 - DNA, 22 bp, Homo sapiens
gacgtgttacccactgccatgc

SEQ ID NO: 1721620 - DNA, 19 bp, Homo sapiens
gacgtttataaacagaaat

SEQ ID NO: 1721621 - DNA, 17 bp, Homo sapiens
gacgtttctgggcggcc

SEQ ID NO: 1721622 - DNA, 16 bp, Homo sapiens
gaagacattttgttac

SEQ ID NO: 1721623 - DNA, 19 bp, Homo sapiens
gaagacattttttgctata

SEQ ID NO: 1721624 - DNA, 20 bp, Homo sapiens
gaagacattttttgctataa

SEQ ID NO: 1721625 - DNA, 21 bp, Homo sapiens
gaagaccaaatgatagaactg

SEQ ID NO: 1721626 - DNA, 18 bp, Homo sapiens
gaagacccagcaggaagc

SEQ ID NO: 1721627 - DNA, 18 bp, Homo sapiens
gaagaccccgcaggatcc

SEQ ID NO: 1721628 - DNA, 18 bp, Homo sapiens
gaagacgtggactcctct

SEQ ID NO: 1721629 - DNA, 19 bp, Homo sapiens
gaagactcaggagtctgcc

SEQ ID NO: 1721630 - DNA, 13 bp, Homo sapiens
gaagactccctga

SEQ ID NO: 1721631 - DNA, 13 bp, Homo sapiens
gaagactgtggct

SEQ ID NO: 1721632 - DNA, 15 bp, Homo sapiens
gaagacttaattctg

SEQ ID NO: 1721633 - DNA, 14 bp, Homo sapiens
gaagacttcttggg

SEQ ID NO: 1721634 - DNA, 17 bp, Homo sapiens
gaagagaaaaaaaggaa

SEQ ID NO: 1721635 - DNA, 21 bp, Homo sapiens
gaagagaaaaaaaggaaaaga

SEQ ID NO: 1721636 - DNA, 23 bp, Homo sapiens
gaagagaaaaaggctgaaaagaa

SEQ ID NO: 1721637 - DNA, 12 bp, Homo sapiens
gaagagaaaatg

SEQ ID NO: 1721638 - DNA, 12 bp, Homo sapiens
gaagagaaacca

SEQ ID NO: 1721639 - DNA, 15 bp, Homo sapiens
gaagagaaaggactc

SEQ ID NO: 1721640 - DNA, 15 bp, Homo sapiens
gaagagaagctgctg

SEQ ID NO: 1721641 - DNA, 18 bp, Homo sapiens
gaagagaatgtattctgt

SEQ ID NO: 1721642 - DNA, 15 bp, Homo sapiens
gaagagacagcccag

SEQ ID NO: 1721643 - DNA, 20 bp, Homo sapiens
gaaagatggaaattctgaaa

SEQ ID NO: 1721644 - DNA, 19 bp, Homo sapiens
gaaagatggttaaacattt

SEQ ID NO: 1721645 - DNA, 23 bp, Homo sapiens
gaaagatttgtgaactggaagaa

SEQ ID NO: 1721646 - DNA, 12 bp, Homo sapiens
gaaagattttat

SEQ ID NO: 1721647 - DNA, 17 bp, Homo sapiens
gaaagattttattgtat

SEQ ID NO: 1721648 - DNA, 22 bp, Homo sapiens
gaaagcaatacgtttgtgcaga

SEQ ID NO: 1721649 - DNA, 18 bp, Homo sapiens
gaaagcactacaatcatg

SEQ ID NO: 1721650 - DNA, 12 bp, Homo sapiens
gaaagcagcagc

SEQ ID NO: 1721651 - DNA, 22 bp, Homo sapiens
gaaagcagcagctaggactgag

SEQ ID NO: 1721652 - DNA, 17 bp, Homo sapiens
gaaagcaggagcagctg

SEQ ID NO: 1721653 - DNA, 22 bp, Homo sapiens
gaaagcaggagcagctgtgctg

SEQ ID NO: 1721654 - DNA, 16 bp, Homo sapiens
gaaagcatcacctcag

SEQ ID NO: 1721655 - DNA, 18 bp, Homo sapiens
gaaagcatcacctcaggc

SEQ ID NO: 1721656 - DNA, 17 bp, Homo sapiens
gaaagcatttaggagaa

SEQ ID NO: 1721657 - DNA, 16 bp, Homo sapiens
gaaagcccgctagaag

SEQ ID NO: 1721658 - DNA, 23 bp, Homo sapiens
gaaagcctttcattttgctttaa

SEQ ID NO: 1721659 - DNA, 20 bp, Homo sapiens
gaaagcgcccctcactcctg

SEQ ID NO: 1721660 - DNA, 17 bp, Homo sapiens
gaaagcggagttcctaa

SEQ ID NO: 1721661 - DNA, 19 bp, Homo sapiens
gaaagctatataagacaag

SEQ ID NO: 1721662 - DNA, 22 bp, Homo sapiens
gaaagctccacggtgcgtggct

SEQ ID NO: 1721663 - DNA, 22 bp, Homo sapiens
gaaagctgatgatgtctcttgt

SEQ ID NO: 1721664 - DNA, 14 bp, Homo sapiens
gaaagctggactga

SEQ ID NO: 1721665 - DNA, 20 bp, Homo sapiens
gaaagctggactgaccaaag

SEQ ID NO: 1721666 - DNA, 20 bp, Homo sapiens
gaaagctgtgtttatatgga

SEQ ID NO: 1721667 - DNA, 15 bp, Homo sapiens
gaaagcttacatttt

SEQ ID NO: 1721668 - DNA, 12 bp, Homo sapiens
gaaaggaaaaga

SEQ ID NO: 1721669 - DNA, 20 bp, Homo sapiens
gaaaggaacaggcttggagg

SEQ ID NO: 1721670 - DNA, 14 bp, Homo sapiens
gaaaggaacatttt

SEQ ID NO: 1721671 - DNA, 21 bp, Homo sapiens
gaaaggaagcattgtaaaata

SEQ ID NO: 1721672 - DNA, 12 bp, Homo sapiens
gaaaggacagag

SEQ ID NO: 1721673 - DNA, 20 bp, Homo sapiens
gaaaggaccaaattgcttta

SEQ ID NO: 1721674 - DNA, 15 bp, Homo sapiens
gaaaggactcagtgt

SEQ ID NO: 1721675 - DNA, 13 bp, Homo sapiens
gaaaggagactag

SEQ ID NO: 1721676 - DNA, 17 bp, Homo sapiens
gaacatactgattggga

SEQ ID NO: 1721677 - DNA, 13 bp, Homo sapiens
gaacatacttggt

SEQ ID NO: 1721678 - DNA, 12 bp, Homo sapiens
gaacatattgtt

SEQ ID NO: 1721679 - DNA, 17 bp, Homo sapiens
gaacatcacattcctct

SEQ ID NO: 1721680 - DNA, 19 bp, Homo sapiens
gaacatccttccttcccac

SEQ ID NO: 1721681 - DNA, 14 bp, Homo sapiens
gaacatctcttgaa

SEQ ID NO: 1721682 - DNA, 19 bp, Homo sapiens
gaacatgcacatttatata

SEQ ID NO: 1721683 - DNA, 22 bp, Homo sapiens
gaacatgcttttactttattgc

SEQ ID NO: 1721684 - DNA, 17 bp, Homo sapiens
gaacatggctggcctgg

SEQ ID NO: 1721685 - DNA, 13 bp, Homo sapiens
gaacattaaaata

SEQ ID NO: 1721686 - DNA, 14 bp, Homo sapiens
gaacattcagctct

SEQ ID NO: 1721687 - DNA, 16 bp, Homo sapiens
gaacattcagctctgg

SEQ ID NO: 1721688 - DNA, 22 bp, Homo sapiens
gaacattcagctctggagaaca

SEQ ID NO: 1721689 - DNA, 18 bp, Homo sapiens
gaacattcccagcccagc

SEQ ID NO: 1721690 - DNA, 12 bp, Homo sapiens
gaacattggaat

SEQ ID NO: 1721691 - DNA, 22 bp, Homo sapiens
gaacattggaatgttctcagat

SEQ ID NO: 1721692 - DNA, 16 bp, Homo sapiens
gaacattggagctgac

SEQ ID NO: 1721693 - DNA, 10 bp, Homo sapiens
gaacatttct

SEQ ID NO: 1721694 - DNA, 13 bp, Homo sapiens
gaaccaaagctca

SEQ ID NO: 1721695 - DNA, 15 bp, Homo sapiens
gaaccaaatacctca

SEQ ID NO: 1721696 - DNA, 15 bp, Homo sapiens
gaaccaacactaaca

SEQ ID NO: 1721697 - DNA, 13 bp, Homo sapiens
gaaccaaccccca

SEQ ID NO: 1721698 - DNA, 19 bp, Homo sapiens
gaaccaacccccatctccc

SEQ ID NO: 1721699 - DNA, 13 bp, Homo sapiens
gaaccaagcttca

SEQ ID NO: 1721700 - DNA, 18 bp, Homo sapiens
gaaccaagcttcagagcc

SEQ ID NO: 1721701 - DNA, 14 bp, Homo sapiens
gaaccaaggcagcc

SEQ ID NO: 1721702 - DNA, 18 bp, Homo sapiens
gaaccaaggcagcctcca

SEQ ID NO: 1721703 - DNA, 21 bp, Homo sapiens
gaaccaaggcagcctccagag

SEQ ID NO: 1721704 - DNA, 22 bp, Homo sapiens
gaaccaaggcagcctccagagc

SEQ ID NO: 1721705 - DNA, 23 bp, Homo sapiens
gaaccaagtggaccttgagacca

SEQ ID NO: 1721706 - DNA, 21 bp, Homo sapiens
gaaccacgcgggggccttgag

SEQ ID NO: 1721707 - DNA, 15 bp, Homo sapiens
gaaccactcccacca

SEQ ID NO: 1721708 - DNA, 22 bp, Homo sapiens
gaaccactcccaccacaggcat

SEQ ID NO: 1721709 - DNA, 12 bp, Homo sapiens
gaaccactgctt

SEQ ID NO: 1721710 - DNA, 21 bp, Homo sapiens
gaaccactgcttctcttttga

SEQ ID NO: 1721711 - DNA, 16 bp, Homo sapiens
gaaccagactcttgcc

SEQ ID NO: 1721712 - DNA, 16 bp, Homo sapiens
gaaccagccgtatttt

SEQ ID NO: 1721713 - DNA, 17 bp, Homo sapiens
gaaccagggaggagagg

SEQ ID NO: 1721714 - DNA, 23 bp, Homo sapiens
gaaccagtccaggtggtgaattt

SEQ ID NO: 1721715 - DNA, 19 bp, Homo sapiens
gaaccagtccccccaccct

SEQ ID NO: 1721716 - DNA, 14 bp, Homo sapiens
gaacccaagcctca

SEQ ID NO: 1721717 - DNA, 15 bp, Homo sapiens
gaacccaagtgcctc

SEQ ID NO: 1721718 - DNA, 16 bp, Homo sapiens
gaacccaagtgcctca

SEQ ID NO: 1721719 - DNA, 23 bp, Homo sapiens
gaacccacataaaagccccagct

SEQ ID NO: 1721720 - DNA, 13 bp, Homo sapiens
gaacccagactca

SEQ ID NO: 1721721 - DNA, 14 bp, Homo sapiens
gaaccccctccctg

SEQ ID NO: 1721722 - DNA, 18 bp, Homo sapiens
gaaccccctccctgtccc

SEQ ID NO: 1721723 - DNA, 23 bp, Homo sapiens
gaaccccctccctgtcccagggc

SEQ ID NO: 1721724 - DNA, 16 bp, Homo sapiens
gaaccccgcagcccgt

SEQ ID NO: 1721725 - DNA, 13 bp, Homo sapiens
gaacccctgtgtc

SEQ ID NO: 1721726 - DNA, 17 bp, Homo sapiens
gaacccgggggacagag

SEQ ID NO: 1721727 - DNA, 17 bp, Homo sapiens
gaaccctatttaaaact

SEQ ID NO: 1721728 - DNA, 17 bp, Homo sapiens
gaaccctgtgctggtgt

SEQ ID NO: 1721729 - DNA, 21 bp, Homo sapiens
gaaccgagcaaagatcaaaat

SEQ ID NO: 1721730 - DNA, 16 bp, Homo sapiens
gaaccgggaagggtgg

SEQ ID NO: 1721731 - DNA, 17 bp, Homo sapiens
gaaccgtgtccagcaca

SEQ ID NO: 1721732 - DNA, 21 bp, Homo sapiens
gaacctacagactccatctct

SEQ ID NO: 1721733 - DNA, 18 bp, Homo sapiens
gaacctcagcctggccag

SEQ ID NO: 1721734 - DNA, 18 bp, Homo sapiens
gaacctcattgctaccac

SEQ ID NO: 1721735 - DNA, 21 bp, Homo sapiens
gaacctcattgctaccacaga

SEQ ID NO: 1721736 - DNA, 13 bp, Homo sapiens
gaacctcttcccc

SEQ ID NO: 1721737 - DNA, 14 bp, Homo sapiens
gaacctcttcccca

SEQ ID NO: 1721738 - DNA, 13 bp, Homo sapiens
gaacctgcaagcc

SEQ ID NO: 1721739 - DNA, 20 bp, Homo sapiens
gaacctgcacacaggacagc

SEQ ID NO: 1721740 - DNA, 17 bp, Homo sapiens
gaacctgctacttaaaa

SEQ ID NO: 1721741 - DNA, 16 bp, Homo sapiens
gaacctggaacttggg

SEQ ID NO: 1721742 - DNA, 17 bp, Homo sapiens
gaacctggatccagcac

SEQ ID NO: 1721743 - DNA, 13 bp, Homo sapiens
gaacctgggcact

SEQ ID NO: 1721744 - DNA, 19 bp, Homo sapiens
gaaccttccttcctgcttg

SEQ ID NO: 1721745 - DNA, 18 bp, Homo sapiens
gaaccttggaccactcct

SEQ ID NO: 1721746 - DNA, 19 bp, Homo sapiens
gaaccttgtagaggagcag

SEQ ID NO: 1721747 - DNA, 21 bp, Homo sapiens
gaacgacaatagctttaccct

SEQ ID NO: 1721748 - DNA, 13 bp, Homo sapiens
gaacgagcagccc

SEQ ID NO: 1721749 - DNA, 15 bp, Homo sapiens
gaacgagcagcccag

SEQ ID NO: 1721750 - DNA, 16 bp, Homo sapiens
gaacgagcagcccagg

SEQ ID NO: 1721751 - DNA, 17 bp, Homo sapiens
gaacgagcagcccaggg

SEQ ID NO: 1721752 - DNA, 22 bp, Homo sapiens
gaacgaggggaaagttctcaga

SEQ ID NO: 1721753 - DNA, 15 bp, Homo sapiens
gaacgcagaagaaag

SEQ ID NO: 1721754 - DNA, 22 bp, Homo sapiens
gaacgccagtctcccaggcccc

SEQ ID NO: 1721755 - DNA, 19 bp, Homo sapiens
gaacggaacgttggacttt

SEQ ID NO: 1721756 - DNA, 15 bp, Homo sapiens
gaacggtaaatttct

SEQ ID NO: 1721757 - DNA, 18 bp, Homo sapiens
gaacgtgcttctttgtaa

SEQ ID NO: 1721758 - DNA, 13 bp, Homo sapiens
gaacgtttctggc

SEQ ID NO: 1721759 - DNA, 21 bp, Homo sapiens
gaacgtttctggcctgggttt

SEQ ID NO: 1721760 - DNA, 14 bp, Homo sapiens
gaacgttttcttct

SEQ ID NO: 1721761 - DNA, 15 bp, Homo sapiens
gaacgttttcttctt

SEQ ID NO: 1721762 - DNA, 20 bp, Homo sapiens
gaacgttttcttctttccct

SEQ ID NO: 1721763 - DNA, 19 bp, Homo sapiens
gaacgttttttcctcagtg

SEQ ID NO: 1721764 - DNA, 12 bp, Homo sapiens
gaactactgtac

SEQ ID NO: 1721765 - DNA, 20 bp, Homo sapiens
ctttgtctaactcagaatta

SEQ ID NO: 1721766 - DNA, 15 bp, Homo sapiens
ctttgtcttgtactt

SEQ ID NO: 1721767 - DNA, 16 bp, Homo sapiens
ctttgtcttgtacttc

SEQ ID NO: 1721768 - DNA, 11 bp, Homo sapiens
ctttgtctttt

SEQ ID NO: 1721769 - DNA, 14 bp, Homo sapiens
ctttgtcttttcaa

SEQ ID NO: 1721770 - DNA, 22 bp, Homo sapiens
ctttgtgatgagggtgagaaaa

SEQ ID NO: 1721771 - DNA, 15 bp, Homo sapiens
ctttgtgattccatg

SEQ ID NO: 1721772 - DNA, 14 bp, Homo sapiens
ctttgtgcctttgg

SEQ ID NO: 1721773 - DNA, 18 bp, Homo sapiens
ctttgtgcctttggcctg

SEQ ID NO: 1721774 - DNA, 17 bp, Homo sapiens
ctttgtgctcataaatt

SEQ ID NO: 1721775 - DNA, 14 bp, Homo sapiens
ctttgtgcttgggg

SEQ ID NO: 1721776 - DNA, 22 bp, Homo sapiens
ctttgtgcttggggctatttgt

SEQ ID NO: 1721777 - DNA, 21 bp, Homo sapiens
ctttgtgggagggtaagacaa

SEQ ID NO: 1721778 - DNA, 17 bp, Homo sapiens
ctttgtgtagtatcttg

SEQ ID NO: 1721779 - DNA, 20 bp, Homo sapiens
ctttgtgtagtatcttgaaa

SEQ ID NO: 1721780 - DNA, 21 bp, Homo sapiens
ctttgtgtagtatcttgaaat

SEQ ID NO: 1721781 - DNA, 15 bp, Homo sapiens
ctttgtgtgtgtgtc

SEQ ID NO: 1721782 - DNA, 23 bp, Homo sapiens
ctttgtgtttctattgacttcaa

SEQ ID NO: 1721783 - DNA, 15 bp, Homo sapiens
ctttgttctgagcat

SEQ ID NO: 1721784 - DNA, 13 bp, Homo sapiens
ctttgttctgttg

SEQ ID NO: 1721785 - DNA, 18 bp, Homo sapiens
ctttgttgcaagatgtga

SEQ ID NO: 1721786 - DNA, 20 bp, Homo sapiens
ctttgttgcaagatgtgaat

SEQ ID NO: 1721787 - DNA, 16 bp, Homo sapiens
ctttgttgtctacatt

SEQ ID NO: 1721788 - DNA, 17 bp, Homo sapiens
ctttgtttcgtggggag

SEQ ID NO: 1721789 - DNA, 18 bp, Homo sapiens
ctttgtttcgtggggagg

SEQ ID NO: 1721790 - DNA, 19 bp, Homo sapiens
ctttgtttctttcttcctc

SEQ ID NO: 1721791 - DNA, 22 bp, Homo sapiens
ctttgtttgtcacaagtggtgt

SEQ ID NO: 1721792 - DNA, 14 bp, Homo sapiens
ctttgttttaataa

SEQ ID NO: 1721793 - DNA, 17 bp, Homo sapiens
ctttgttttaataaaca

SEQ ID NO: 1721794 - DNA, 24 bp, Homo sapiens
ctttgttttgatgtttgtggcctc

SEQ ID NO: 1721795 - DNA, 21 bp, Homo sapiens
cttttaaaaaatactctgcta

SEQ ID NO: 1721796 - DNA, 13 bp, Homo sapiens
cttttaaaaatgt

SEQ ID NO: 1721797 - DNA, 17 bp, Homo sapiens
cttttaaaaatgtttgg

SEQ ID NO: 1721798 - DNA, 20 bp, Homo sapiens
cttttaaacctcacctttgt

SEQ ID NO: 1721799 - DNA, 20 bp, Homo sapiens
cttttaaagaaaaatatgat

SEQ ID NO: 1721800 - DNA, 18 bp, Homo sapiens
cttttaaagactacctgg

SEQ ID NO: 1721801 - DNA, 20 bp, Homo sapiens
cttttaaagtgttacttttt

SEQ ID NO: 1721802 - DNA, 20 bp, Homo sapiens
cttttaactttataaatcca

SEQ ID NO: 1721803 - DNA, 23 bp, Homo sapiens
cttttaaggataaatcataaagt

SEQ ID NO: 1721804 - DNA, 23 bp, Homo sapiens
cttttaatgcttcattcaatatt

SEQ ID NO: 1721805 - DNA, 22 bp, Homo sapiens
cttttaattaaataaaagctgg

SEQ ID NO: 1721806 - DNA, 22 bp, Homo sapiens
cttttaattaatgaaatatctg

SEQ ID NO: 1721807 - DNA, 18 bp, Homo sapiens
cttttagttgtatctctt

SEQ ID NO: 1721808 - DNA, 19 bp, Homo sapiens
cttttagttgtatctcttt

SEQ ID NO: 1721809 - DNA, 21 bp, Homo sapiens
cttttagttgtatctcttttg

SEQ ID NO: 1721810 - DNA, 21 bp, Homo sapiens
cttttagttttagttgcagaa

SEQ ID NO: 1721811 - DNA, 15 bp, Homo sapiens
cttttagtttttccc

SEQ ID NO: 1721812 - DNA, 12 bp, Homo sapiens
cttttataattc

SEQ ID NO: 1721813 - DNA, 15 bp, Homo sapiens
cttttatactgacac

SEQ ID NO: 1721814 - DNA, 21 bp, Homo sapiens
cttttataggtgagaaaaaaa

SEQ ID NO: 1721815 - DNA, 22 bp, Homo sapiens
cttttataggtgagaaaaaaac

SEQ ID NO: 1721816 - DNA, 13 bp, Homo sapiens
cttttatatttgt

SEQ ID NO: 1721817 - DNA, 24 bp, Homo sapiens
cttttatctattctgagaaaacaa

SEQ ID NO: 1721818 - DNA, 17 bp, Homo sapiens
cttttatgcagcaaata

SEQ ID NO: 1721819 - DNA, 18 bp, Homo sapiens
cttttatggctctatctt

SEQ ID NO: 1721820 - DNA, 18 bp, Homo sapiens
cttttattaataaaacaa

SEQ ID NO: 1721821 - DNA, 13 bp, Homo sapiens
ctttcttggccag

SEQ ID NO: 1721822 - DNA, 11 bp, Homo sapiens
ctttcttggga

SEQ ID NO: 1721823 - DNA, 20 bp, Homo sapiens
ctttcttgtttgtcagcatc

SEQ ID NO: 1721824 - DNA, 15 bp, Homo sapiens
ctttctttagaattt

SEQ ID NO: 1721825 - DNA, 17 bp, Homo sapiens
ctttctttgcaccaaag

SEQ ID NO: 1721826 - DNA, 20 bp, Homo sapiens
ctttctttgcacttaaaaat

SEQ ID NO: 1721827 - DNA, 12 bp, Homo sapiens
ctttctttgcct

SEQ ID NO: 1721828 - DNA, 17 bp, Homo sapiens
ctttctttgcctctgca

SEQ ID NO: 1721829 - DNA, 18 bp, Homo sapiens
ctttctttgcctctgcag

SEQ ID NO: 1721830 - DNA, 19 bp, Homo sapiens
ctttctttgtttctttctt

SEQ ID NO: 1721831 - DNA, 14 bp, Homo sapiens
ctttcttttaatga

SEQ ID NO: 1721832 - DNA, 15 bp, Homo sapiens
ctttctttttttccc

SEQ ID NO: 1721833 - DNA, 12 bp, Homo sapiens
ctttgaaagaag

SEQ ID NO: 1721834 - DNA, 17 bp, Homo sapiens
ctttgaaagaagcaaga

SEQ ID NO: 1721835 - DNA, 15 bp, Homo sapiens
ctttgaaataaaaaa

SEQ ID NO: 1721836 - DNA, 20 bp, Homo sapiens
ctttgaacgtgcttctttgt

SEQ ID NO: 1721837 - DNA, 23 bp, Homo sapiens
ctttgaacgtgcttctttgtaat

SEQ ID NO: 1721838 - DNA, 15 bp, Homo sapiens
ctttgaagcaaatac

SEQ ID NO: 1721839 - DNA, 13 bp, Homo sapiens
ctttgaagtagct

SEQ ID NO: 1721840 - DNA, 14 bp, Homo sapiens
ctttgacaaggaaa

SEQ ID NO: 1721841 - DNA, 16 bp, Homo sapiens
ctttgacaaggaaaat

SEQ ID NO: 1721842 - DNA, 22 bp, Homo sapiens
ctttgacaaggaaaatctatat

SEQ ID NO: 1721843 - DNA, 16 bp, Homo sapiens
ctttgacacccaggct

SEQ ID NO: 1721844 - DNA, 22 bp, Homo sapiens
ctttgaccagatctttctcttc

SEQ ID NO: 1721845 - DNA, 18 bp, Homo sapiens
ctttgacgtaattaaatc

SEQ ID NO: 1721846 - DNA, 21 bp, Homo sapiens
ctttgacgtaattaaatccaa

SEQ ID NO: 1721847 - DNA, 12 bp, Homo sapiens
ctttgactgaaa

SEQ ID NO: 1721848 - DNA, 15 bp, Homo sapiens
ctttgactgtgattt

SEQ ID NO: 1721849 - DNA, 15 bp, Homo sapiens
ctttgagaagccttc

SEQ ID NO: 1721850 - DNA, 17 bp, Homo sapiens
ctttgagaagccttcag

SEQ ID NO: 1721851 - DNA, 17 bp, Homo sapiens
ctttgagaatgtgattc

SEQ ID NO: 1721852 - DNA, 20 bp, Homo sapiens
ctttgagaatgtgattcctt

SEQ ID NO: 1721853 - DNA, 15 bp, Homo sapiens
ctttgagaggctgag

SEQ ID NO: 1721854 - DNA, 19 bp, Homo sapiens
ctttgagatctaaaaataa

SEQ ID NO: 1721855 - DNA, 23 bp, Homo sapiens
ctttgagatctaaaaataactgt

SEQ ID NO: 1721856 - DNA, 17 bp, Homo sapiens
ctttgagatctggggag

SEQ ID NO: 1721857 - DNA, 21 bp, Homo sapiens
ctttgagatctggggaggcag

SEQ ID NO: 1721858 - DNA, 16 bp, Homo sapiens
ctttgagccttggccc

SEQ ID NO: 1721859 - DNA, 18 bp, Homo sapiens
ctttgagggtggaaggat

SEQ ID NO: 1721860 - DNA, 17 bp, Homo sapiens
ctttgaggttgctttgt

SEQ ID NO: 1721861 - DNA, 16 bp, Homo sapiens
ctttgagtacagatac

SEQ ID NO: 1721862 - DNA, 23 bp, Homo sapiens
ctttgagtagatccatttccatt

SEQ ID NO: 1721863 - DNA, 13 bp, Homo sapiens
ctttgagtgatcc

SEQ ID NO: 1721864 - DNA, 17 bp, Homo sapiens
ctttgataaaataaatg

SEQ ID NO: 1721865 - DNA, 15 bp, Homo sapiens
ctttgataacaaaaa

SEQ ID NO: 1721866 - DNA, 20 bp, Homo sapiens
ctttgataacaaaaaataaa

SEQ ID NO: 1721867 - DNA, 13 bp, Homo sapiens
ctttgattctcct

SEQ ID NO: 1721868 - DNA, 14 bp, Homo sapiens
ctttgattctcctt

SEQ ID NO: 1721869 - DNA, 19 bp, Homo sapiens
ctttgattctccttcagcc

SEQ ID NO: 1721870 - DNA, 13 bp, Homo sapiens
ctttgattctgat

SEQ ID NO: 1721871 - DNA, 14 bp, Homo sapiens
ctttgattgcacat

SEQ ID NO: 1721872 - DNA, 21 bp, Homo sapiens
ctttgattgcacattgttgtt

SEQ ID NO: 1721873 - DNA, 21 bp, Homo sapiens
ctttgattggttgtgccttcc

SEQ ID NO: 1721874 - DNA, 23 bp, Homo sapiens
ctttgattggttgtgccttccct

SEQ ID NO: 1721875 - DNA, 17 bp, Homo sapiens
ctttgattgtgaaacag

SEQ ID NO: 1721876 - DNA, 12 bp, Homo sapiens
ctttgcaaagac

SEQ ID NO: 1721877 - DNA, 20 bp, Homo sapiens
ctttgcaaattcaagagcct

SEQ ID NO: 1721878 - DNA, 18 bp, Homo sapiens
ctttgcaatccaaataaa

SEQ ID NO: 1721879 - DNA, 13 bp, Homo sapiens
ctttgcacatgtg

SEQ ID NO: 1721880 - DNA, 15 bp, Homo sapiens
ctttgcacatgtgac

SEQ ID NO: 1721881 - DNA, 13 bp, Homo sapiens
ctttgcaccaaag

SEQ ID NO: 1721882 - DNA, 17 bp, Homo sapiens
ctttgcaccgtggtcag

SEQ ID NO: 1721883 - DNA, 14 bp, Homo sapiens
ctttgcacctgaga

SEQ ID NO: 1721884 - DNA, 14 bp, Homo sapiens
ctttgcacgtgctg

SEQ ID NO: 1721885 - DNA, 13 bp, Homo sapiens
ctttgcactgagg

SEQ ID NO: 1721886 - DNA, 16 bp, Homo sapiens
ctttgcactgagggcc

SEQ ID NO: 1721887 - DNA, 22 bp, Homo sapiens
ctttgcactgtaatgaggaaaa

SEQ ID NO: 1721888 - DNA, 22 bp, Homo sapiens
ctttgcactttttcttaatcat

SEQ ID NO: 1721889 - DNA, 13 bp, Homo sapiens
ctttgcaggctct

SEQ ID NO: 1721890 - DNA, 15 bp, Homo sapiens
ctttgcaggctctgg

SEQ ID NO: 1721891 - DNA, 16 bp, Homo sapiens
ctttgcaggctctggg

SEQ ID NO: 1721892 - DNA, 18 bp, Homo sapiens
ctttgcaggctctgggct

SEQ ID NO: 1721893 - DNA, 19 bp, Homo sapiens
ctttgcaggctctgggctc

SEQ ID NO: 1721894 - DNA, 20 bp, Homo sapiens
ctttgcaggctctgggctca

SEQ ID NO: 1721895 - DNA, 20 bp, Homo sapiens
ctttgcagttggactctcag

SEQ ID NO: 1721896 - DNA, 15 bp, Homo sapiens
ctttgccaacatggt

SEQ ID NO: 1721897 - DNA, 19 bp, Homo sapiens
ctttgccagagcaggagcc

SEQ ID NO: 1721898 - DNA, 19 bp, Homo sapiens
ctttgccagtcattcagca

SEQ ID NO: 1721899 - DNA, 21 bp, Homo sapiens
ctttgccataaccacatttaa

SEQ ID NO: 1721900 - DNA, 14 bp, Homo sapiens
ctttgcccacccct

SEQ ID NO: 1721901 - DNA, 16 bp, Homo sapiens
ctttgcccacccctca

SEQ ID NO: 1721902 - DNA, 19 bp, Homo sapiens
ctttgcccacccctcactc

SEQ ID NO: 1721903 - DNA, 10 bp, Homo sapiens
ctttgcctca

SEQ ID NO: 1721904 - DNA, 11 bp, Homo sapiens
ctttgcctctt

SEQ ID NO: 1721905 - DNA, 15 bp, Homo sapiens
ctttgcctcttcttt

SEQ ID NO: 1721906 - DNA, 17 bp, Homo sapiens
ctttgcctcttctttgt

SEQ ID NO: 1721907 - DNA, 21 bp, Homo sapiens
ctttgcctcttctttgtgcct

SEQ ID NO: 1721908 - DNA, 16 bp, Homo sapiens
ctttgccttgggctgc

SEQ ID NO: 1721909 - DNA, 20 bp, Homo sapiens
ctttgctacaaatttatgca

SEQ ID NO: 1721910 - DNA, 19 bp, Homo sapiens
ctttgctcagtgtccagct

SEQ ID NO: 1721911 - DNA, 20 bp, Homo sapiens
ctttgctcagtgtccagctt

SEQ ID NO: 1721912 - DNA, 13 bp, Homo sapiens
ctttgctccagat

SEQ ID NO: 1721913 - DNA, 16 bp, Homo sapiens
ctttgctccgctccca

SEQ ID NO: 1721914 - DNA, 12 bp, Homo sapiens
ctttgctctggt

SEQ ID NO: 1721915 - DNA, 13 bp, Homo sapiens
ctttgctcttgcc

SEQ ID NO: 1721916 - DNA, 14 bp, Homo sapiens
ctttgctgagagct

SEQ ID NO: 1721917 - DNA, 19 bp, Homo sapiens
ctttgctgatttcccctct

SEQ ID NO: 1721918 - DNA, 12 bp, Homo sapiens
ctttgctgcaga

SEQ ID NO: 1721919 - DNA, 22 bp, Homo sapiens
ctttgctgcagagatcaagggt

SEQ ID NO: 1721920 - DNA, 23 bp, Homo sapiens
ctttgctgctatgaaaatgagca

SEQ ID NO: 1721921 - DNA, 22 bp, Homo sapiens
ctttgctgtactcttgctgatg

SEQ ID NO: 1721922 - DNA, 20 bp, Homo sapiens
ctttgcttatgaatatttat

SEQ ID NO: 1721923 - DNA, 14 bp, Homo sapiens
ctttgcttcattcc

SEQ ID NO: 1721924 - DNA, 20 bp, Homo sapiens
ctttggaaatagcatgacag

SEQ ID NO: 1721925 - DNA, 16 bp, Homo sapiens
ctttggaacaagacag

SEQ ID NO: 1721926 - DNA, 16 bp, Homo sapiens
ctttggaacaagatgg

SEQ ID NO: 1721927 - DNA, 14 bp, Homo sapiens
ctttggaaccagac

SEQ ID NO: 1721928 - DNA, 15 bp, Homo sapiens
ctttggaagaaaaaa

SEQ ID NO: 1721929 - DNA, 17 bp, Homo sapiens
ctttggaatattttatc

SEQ ID NO: 1721930 - DNA, 20 bp, Homo sapiens
ctttggaatattttatcctg

SEQ ID NO: 1721931 - DNA, 17 bp, Homo sapiens
ctttggacctaatccaa

SEQ ID NO: 1721932 - DNA, 19 bp, Homo sapiens
ctttggagaccattatcag

SEQ ID NO: 1721933 - DNA, 14 bp, Homo sapiens
ctttggattctaaa

SEQ ID NO: 1721934 - DNA, 18 bp, Homo sapiens
ctttggattctaaataca

SEQ ID NO: 1721935 - DNA, 20 bp, Homo sapiens
ctttggattctaaatacatg

SEQ ID NO: 1721936 - DNA, 17 bp, Homo sapiens
ctttggcagtgttttgg

SEQ ID NO: 1721937 - DNA, 22 bp, Homo sapiens
ctttggcattgctgcatatttg

SEQ ID NO: 1721938 - DNA, 22 bp, Homo sapiens
ctttagtacctgaaaagtaact

SEQ ID NO: 1721939 - DNA, 15 bp, Homo sapiens
ctttagtactcaatg

SEQ ID NO: 1721940 - DNA, 19 bp, Homo sapiens
ctttagtgttctgtttgaa

SEQ ID NO: 1721941 - DNA, 23 bp, Homo sapiens
ctttagtgttctgtttgaaacta

SEQ ID NO: 1721942 - DNA, 13 bp, Homo sapiens
ctttagttagcat

SEQ ID NO: 1721943 - DNA, 23 bp, Homo sapiens
ctttagttttgattttggaaaga

SEQ ID NO: 1721944 - DNA, 13 bp, Homo sapiens
ctttagtttttgg

SEQ ID NO: 1721945 - DNA, 14 bp, Homo sapiens
ctttagtttttggt

SEQ ID NO: 1721946 - DNA, 23 bp, Homo sapiens
ctttagtttttggttgggaatga

SEQ ID NO: 1721947 - DNA, 13 bp, Homo sapiens
ctttataaatcca

SEQ ID NO: 1721948 - DNA, 22 bp, Homo sapiens
ctttatagaaggaatttgtact

SEQ ID NO: 1721949 - DNA, 23 bp, Homo sapiens
ctttatagaaggaatttgtactt

SEQ ID NO: 1721950 - DNA, 22 bp, Homo sapiens
ctttatcaaagggtgaaaatta

SEQ ID NO: 1721951 - DNA, 19 bp, Homo sapiens
ctttatcacctcattctga

SEQ ID NO: 1721952 - DNA, 21 bp, Homo sapiens
ctttatctaatacctctgtgt

SEQ ID NO: 1721953 - DNA, 16 bp, Homo sapiens
ctttatctcaacggaa

SEQ ID NO: 1721954 - DNA, 13 bp, Homo sapiens
ctttatctgttct

SEQ ID NO: 1721955 - DNA, 15 bp, Homo sapiens
ctttatcttgaagtc

SEQ ID NO: 1721956 - DNA, 14 bp, Homo sapiens
ctttatcttgacat

SEQ ID NO: 1721957 - DNA, 23 bp, Homo sapiens
ctttatgactgtttttgtagtgg

SEQ ID NO: 1721958 - DNA, 20 bp, Homo sapiens
ctttatgataatagattctc

SEQ ID NO: 1721959 - DNA, 16 bp, Homo sapiens
ctttatgcaaatacaa

SEQ ID NO: 1721960 - DNA, 21 bp, Homo sapiens
ctttatgcaaatacaatcagc

SEQ ID NO: 1721961 - DNA, 19 bp, Homo sapiens
ctttatgccggatgtgctt

SEQ ID NO: 1721962 - DNA, 15 bp, Homo sapiens
ctttatgctgtattt

SEQ ID NO: 1721963 - DNA, 13 bp, Homo sapiens
ctttatggctgct

SEQ ID NO: 1721964 - DNA, 13 bp, Homo sapiens
ctttatggtttct

SEQ ID NO: 1721965 - DNA, 15 bp, Homo sapiens
ctttatgtgaatttt

SEQ ID NO: 1721966 - DNA, 20 bp, Homo sapiens
ctttatgtgatataaggatt

SEQ ID NO: 1721967 - DNA, 18 bp, Homo sapiens
ctttatgtggaaaacaga

SEQ ID NO: 1721968 - DNA, 23 bp, Homo sapiens
ctttatgtggaaaacagaacatc

SEQ ID NO: 1721969 - DNA, 12 bp, Homo sapiens
ctttatgtgtaa

SEQ ID NO: 1721970 - DNA, 14 bp, Homo sapiens
ctttatgtgtaaat

SEQ ID NO: 1721971 - DNA, 17 bp, Homo sapiens
ctttatgttgtatgatt

SEQ ID NO: 1721972 - DNA, 18 bp, Homo sapiens
ctttattaaaatcttaaa

SEQ ID NO: 1721973 - DNA, 16 bp, Homo sapiens
ctttattaagtaaaat

SEQ ID NO: 1721974 - DNA, 20 bp, Homo sapiens
ctttattaccccctccttca

SEQ ID NO: 1721975 - DNA, 16 bp, Homo sapiens
ctttattcacccctgc

SEQ ID NO: 1721976 - DNA, 15 bp, Homo sapiens
ctttattctgtgtta

SEQ ID NO: 1721977 - DNA, 14 bp, Homo sapiens
ctttattcttgctg

SEQ ID NO: 1721978 - DNA, 16 bp, Homo sapiens
ctttattcttgctggg

SEQ ID NO: 1721979 - DNA, 22 bp, Homo sapiens
ctttattgctatcgccctcctt

SEQ ID NO: 1721980 - DNA, 14 bp, Homo sapiens
ctttattgcttttt

SEQ ID NO: 1721981 - DNA, 18 bp, Homo sapiens
ctttattgcttttttgta

SEQ ID NO: 1721982 - DNA, 16 bp, Homo sapiens
ctttattggctgagat

SEQ ID NO: 1721983 - DNA, 20 bp, Homo sapiens
ctttattgtacagactgttt

SEQ ID NO: 1721984 - DNA, 18 bp, Homo sapiens
ctttatttaaaaaagaaa

SEQ ID NO: 1721985 - DNA, 15 bp, Homo sapiens
ctttatttatttcta

SEQ ID NO: 1721986 - DNA, 14 bp, Homo sapiens
ctttatttctagca

SEQ ID NO: 1721987 - DNA, 19 bp, Homo sapiens
ctttattttttaaaaatga

SEQ ID NO: 1721988 - DNA, 22 bp, Homo sapiens
ctttattttttaagtatttata

SEQ ID NO: 1721989 - DNA, 14 bp, Homo sapiens
ctttcaaaaacatg

SEQ ID NO: 1721990 - DNA, 23 bp, Homo sapiens
ctttcaaaatatattttcagtac

SEQ ID NO: 1721991 - DNA, 18 bp, Homo sapiens
ctttcaaagaaggaattc

SEQ ID NO: 1721992 - DNA, 22 bp, Homo sapiens
ctttcaagcagtcgtgcctgtg

SEQ ID NO: 1721993 - DNA, 13 bp, Homo sapiens
ctttcaagctgca

SEQ ID NO: 1721994 - DNA, 14 bp, Homo sapiens
ctttcaaggaaagt

SEQ ID NO: 1721995 - DNA, 19 bp, Homo sapiens
ctttcaattgtcacttttt

SEQ ID NO: 1721996 - DNA, 20 bp, Homo sapiens
ctttcaattgtcacttttta

SEQ ID NO: 1721997 - DNA, 15 bp, Homo sapiens
ctttcacaaaaaaga

SEQ ID NO: 1721998 - DNA, 20 bp, Homo sapiens
ctttcacaaaattttattcc

SEQ ID NO: 1721999 - DNA, 14 bp, Homo sapiens
ctttcacacatctg

SEQ ID NO: 1722000 - DNA, 23 bp, Homo sapiens
ctttcacacatctgggtgccctg

SEQ ID NO: 1722001 - DNA, 23 bp, Homo sapiens
ctttcacacttccaccagcctgc

SEQ ID NO: 1722002 - DNA, 19 bp, Homo sapiens
ctttcactacatattaaat

SEQ ID NO: 1722003 - DNA, 22 bp, Homo sapiens
ctttcactatttcctttataat

SEQ ID NO: 1722004 - DNA, 18 bp, Homo sapiens
cttgttaatgctttctga

SEQ ID NO: 1722005 - DNA, 20 bp, Homo sapiens
cttgttaatgtcattgctaa

SEQ ID NO: 1722006 - DNA, 19 bp, Homo sapiens
cttgttactgctgattctt

SEQ ID NO: 1722007 - DNA, 21 bp, Homo sapiens
cttgttactgctgattcttgt

SEQ ID NO: 1722008 - DNA, 14 bp, Homo sapiens
cttgttacttctga

SEQ ID NO: 1722009 - DNA, 16 bp, Homo sapiens
cttgttagaaaacaaa

SEQ ID NO: 1722010 - DNA, 23 bp, Homo sapiens
cttgttagaaaacaaaattttat

SEQ ID NO: 1722011 - DNA, 17 bp, Homo sapiens
cttgttagcccttcaga

SEQ ID NO: 1722012 - DNA, 13 bp, Homo sapiens
cttgttatttata

SEQ ID NO: 1722013 - DNA, 16 bp, Homo sapiens
cttgttcattttgagt

SEQ ID NO: 1722014 - DNA, 18 bp, Homo sapiens
cttgttcccgaagtaaaa

SEQ ID NO: 1722015 - DNA, 14 bp, Homo sapiens
cttgttccctctcc

SEQ ID NO: 1722016 - DNA, 14 bp, Homo sapiens
cttgttcctgctct

SEQ ID NO: 1722017 - DNA, 21 bp, Homo sapiens
cttgttgaaaacccagactgt

SEQ ID NO: 1722018 - DNA, 22 bp, Homo sapiens
cttgttgcagagatttcctcca

SEQ ID NO: 1722019 - DNA, 20 bp, Homo sapiens
cttgttgcagatgggtgata

SEQ ID NO: 1722020 - DNA, 22 bp, Homo sapiens
cttgttgctgttgatgttttgt

SEQ ID NO: 1722021 - DNA, 18 bp, Homo sapiens
cttgttgggattcctgac

SEQ ID NO: 1722022 - DNA, 21 bp, Homo sapiens
cttgttgggattcctgaccca

SEQ ID NO: 1722023 - DNA, 22 bp, Homo sapiens
cttgttgggattcctgacccag

SEQ ID NO: 1722024 - DNA, 20 bp, Homo sapiens
cttgttgttggttgtttttt

SEQ ID NO: 1722025 - DNA, 19 bp, Homo sapiens
cttgtttacagcactactc

SEQ ID NO: 1722026 - DNA, 15 bp, Homo sapiens
cttgtttacctttct

SEQ ID NO: 1722027 - DNA, 19 bp, Homo sapiens
cttgtttacgatttcacta

SEQ ID NO: 1722028 - DNA, 21 bp, Homo sapiens
cttgtttagagagcctgtcac

SEQ ID NO: 1722029 - DNA, 23 bp, Homo sapiens
cttgtttagagagcctgtcacca

SEQ ID NO: 1722030 - DNA, 12 bp, Homo sapiens
cttgtttcaatt

SEQ ID NO: 1722031 - DNA, 18 bp, Homo sapiens
cttgtttccttttgggct

SEQ ID NO: 1722032 - DNA, 14 bp, Homo sapiens
cttgtttcttttca

SEQ ID NO: 1722033 - DNA, 13 bp, Homo sapiens
cttgtttgatttc

SEQ ID NO: 1722034 - DNA, 17 bp, Homo sapiens
cttgtttgcactgtgtg

SEQ ID NO: 1722035 - DNA, 15 bp, Homo sapiens
cttgtttgtcagcat

SEQ ID NO: 1722036 - DNA, 16 bp, Homo sapiens
cttgtttgtcagcatc

SEQ ID NO: 1722037 - DNA, 19 bp, Homo sapiens
cttgtttgtcagcatctga

SEQ ID NO: 1722038 - DNA, 15 bp, Homo sapiens
cttgtttgtcttcca

SEQ ID NO: 1722039 - DNA, 22 bp, Homo sapiens
cttgttttataaaattttgctt

SEQ ID NO: 1722040 - DNA, 18 bp, Homo sapiens
cttgttttcttgccaatg

SEQ ID NO: 1722041 - DNA, 14 bp, Homo sapiens
cttgttttggatgc

SEQ ID NO: 1722042 - DNA, 14 bp, Homo sapiens
cttgtttttaagtt

SEQ ID NO: 1722043 - DNA, 12 bp, Homo sapiens
cttgtttttgca

SEQ ID NO: 1722044 - DNA, 14 bp, Homo sapiens
cttgtttttgtaaa

SEQ ID NO: 1722045 - DNA, 15 bp, Homo sapiens
cttgtttttgtaaag

SEQ ID NO: 1722046 - DNA, 16 bp, Homo sapiens
cttgtttttgtaaaga

SEQ ID NO: 1722047 - DNA, 21 bp, Homo sapiens
cttgtttttgtaaagaaaaat

SEQ ID NO: 1722048 - DNA, 22 bp, Homo sapiens
cttgtttttgtaaagaaaaata

SEQ ID NO: 1722049 - DNA, 19 bp, Homo sapiens
cttgttttttttttccact

SEQ ID NO: 1722050 - DNA, 21 bp, Homo sapiens
cttgttttttttttccactta

SEQ ID NO: 1722051 - DNA, 23 bp, Homo sapiens
ctttaaaaaagaaaagtgcatat

SEQ ID NO: 1722052 - DNA, 13 bp, Homo sapiens
ctttaaaaaggaa

SEQ ID NO: 1722053 - DNA, 20 bp, Homo sapiens
ctttaaaaaggaaatttgtt

SEQ ID NO: 1722054 - DNA, 12 bp, Homo sapiens
ctttaaaacaag

SEQ ID NO: 1722055 - DNA, 13 bp, Homo sapiens
ctttaaaagagag

SEQ ID NO: 1722056 - DNA, 21 bp, Homo sapiens
ctttaaaagagagagagagaa

SEQ ID NO: 1722057 - DNA, 22 bp, Homo sapiens
ctttaaaagagagagagagaaa

SEQ ID NO: 1722058 - DNA, 17 bp, Homo sapiens
ctttaaaaggaaagaaa

SEQ ID NO: 1722059 - DNA, 15 bp, Homo sapiens
ctttaaaataaaaaa

SEQ ID NO: 1722060 - DNA, 15 bp, Homo sapiens
ctttaaagctcagga

SEQ ID NO: 1722061 - DNA, 13 bp, Homo sapiens
ctttaaagtaaag

SEQ ID NO: 1722062 - DNA, 16 bp, Homo sapiens
ctttaaagtacctgta

SEQ ID NO: 1722063 - DNA, 23 bp, Homo sapiens
ctttaaagtacctgtagtgagaa

SEQ ID NO: 1722064 - DNA, 22 bp, Homo sapiens
ctttaaagtatgaatctatgcc

SEQ ID NO: 1722065 - DNA, 19 bp, Homo sapiens
ctttaaatagatacaaatg

SEQ ID NO: 1722066 - DNA, 21 bp, Homo sapiens
ctttaacatacaagaaaatgt

SEQ ID NO: 1722067 - DNA, 12 bp, Homo sapiens
ctttaagaaaaa

SEQ ID NO: 1722068 - DNA, 20 bp, Homo sapiens
ctttaagcaaggtgtccctg

SEQ ID NO: 1722069 - DNA, 15 bp, Homo sapiens
ctttaagccaaagaa

SEQ ID NO: 1722070 - DNA, 18 bp, Homo sapiens
ctttaagccaaagaaaca

SEQ ID NO: 1722071 - DNA, 21 bp, Homo sapiens
ctttaagccaaagaaacaagc

SEQ ID NO: 1722072 - DNA, 17 bp, Homo sapiens
cttgctttgggctttgc

SEQ ID NO: 1722073 - DNA, 20 bp, Homo sapiens
cttgctttgttttaataaac

SEQ ID NO: 1722074 - DNA, 20 bp, Homo sapiens
cttggaaaaatccagaaaga

SEQ ID NO: 1722075 - DNA, 23 bp, Homo sapiens
cttggaaaagtggcaagaccaaa

SEQ ID NO: 1722076 - DNA, 17 bp, Homo sapiens
cttggaaacctgccctg

SEQ ID NO: 1722077 - DNA, 18 bp, Homo sapiens
cttggaaacctgccctgc

SEQ ID NO: 1722078 - DNA, 17 bp, Homo sapiens
cttggaaatgtctgctg

SEQ ID NO: 1722079 - DNA, 19 bp, Homo sapiens
cttggaaattcctgtactg

SEQ ID NO: 1722080 - DNA, 20 bp, Homo sapiens
cttggaaattcctgtactgt

SEQ ID NO: 1722081 - DNA, 16 bp, Homo sapiens
cttggaacaccctgga

SEQ ID NO: 1722082 - DNA, 14 bp, Homo sapiens
cttggaagagctct

SEQ ID NO: 1722083 - DNA, 21 bp, Homo sapiens
cttggaagggcgttctaggta

SEQ ID NO: 1722084 - DNA, 18 bp, Homo sapiens
cttggaagtgtttcaaaa

SEQ ID NO: 1722085 - DNA, 14 bp, Homo sapiens
cttggacaaatcac

SEQ ID NO: 1722086 - DNA, 15 bp, Homo sapiens
cttggacatcctcct

SEQ ID NO: 1722087 - DNA, 22 bp, Homo sapiens
cttggaccactcctgtccctgt

SEQ ID NO: 1722088 - DNA, 13 bp, Homo sapiens
cttggacttcctg

SEQ ID NO: 1722089 - DNA, 17 bp, Homo sapiens
cttggacttcctggggc

SEQ ID NO: 1722090 - DNA, 19 bp, Homo sapiens
cttggacttcctggggccc

SEQ ID NO: 1722091 - DNA, 21 bp, Homo sapiens
cttggacttcctggggccccg

SEQ ID NO: 1722092 - DNA, 14 bp, Homo sapiens
cttggagaaaataa

SEQ ID NO: 1722093 - DNA, 17 bp, Homo sapiens
cttggagaagtctcagc

SEQ ID NO: 1722094 - DNA, 15 bp, Homo sapiens
cttggagagacacag

SEQ ID NO: 1722095 - DNA, 16 bp, Homo sapiens
cttggagagacacagc

SEQ ID NO: 1722096 - DNA, 14 bp, Homo sapiens
cttggagcaatcag

SEQ ID NO: 1722097 - DNA, 18 bp, Homo sapiens
cttggagcctaaagagaa

SEQ ID NO: 1722098 - DNA, 13 bp, Homo sapiens
cttggagctgtcc

SEQ ID NO: 1722099 - DNA, 18 bp, Homo sapiens
cttggagctgtcctccag

SEQ ID NO: 1722100 - DNA, 21 bp, Homo sapiens
cttggaggacctggcgtgctc

SEQ ID NO: 1722101 - DNA, 15 bp, Homo sapiens
cttggaggagagaga

SEQ ID NO: 1722102 - DNA, 14 bp, Homo sapiens
cttggaggcttggc

SEQ ID NO: 1722103 - DNA, 17 bp, Homo sapiens
cttggagggaagggaga

SEQ ID NO: 1722104 - DNA, 20 bp, Homo sapiens
cttggatccatacaaaacta

SEQ ID NO: 1722105 - DNA, 21 bp, Homo sapiens
cttggatcgctaagctggctc

SEQ ID NO: 1722106 - DNA, 18 bp, Homo sapiens
cttggatgattgcagtta

SEQ ID NO: 1722107 - DNA, 15 bp, Homo sapiens
cttggattctctaac

SEQ ID NO: 1722108 - DNA, 23 bp, Homo sapiens
cttggattggacaggagatcagc

SEQ ID NO: 1722109 - DNA, 16 bp, Homo sapiens
cttggcaaattttaaa

SEQ ID NO: 1722110 - DNA, 20 bp, Homo sapiens
cttggcaccagacacccagg

SEQ ID NO: 1722111 - DNA, 21 bp, Homo sapiens
cttggcaccagacacccagga

SEQ ID NO: 1722112 - DNA, 15 bp, Homo sapiens
cttggcagctgaact

SEQ ID NO: 1722113 - DNA, 23 bp, Homo sapiens
cttggcagcttaacattgacttc

SEQ ID NO: 1722114 - DNA, 14 bp, Homo sapiens
cttggcataagaca

SEQ ID NO: 1722115 - DNA, 18 bp, Homo sapiens
cttggcatcacagggcag

SEQ ID NO: 1722116 - DNA, 17 bp, Homo sapiens
cttggcatgccttccag

SEQ ID NO: 1722117 - DNA, 21 bp, Homo sapiens
cttggccagcaagttagagaa

SEQ ID NO: 1722118 - DNA, 18 bp, Homo sapiens
cttggccagttatccctt

SEQ ID NO: 1722119 - DNA, 18 bp, Homo sapiens
cttggcccagagacggag

SEQ ID NO: 1722120 - DNA, 22 bp, Homo sapiens
cttggcccaggagctctgcgcc

SEQ ID NO: 1722121 - DNA, 21 bp, Homo sapiens
cttggcccggccggcctggca

SEQ ID NO: 1722122 - DNA, 14 bp, Homo sapiens
cttggccctttcct

SEQ ID NO: 1722123 - DNA, 15 bp, Homo sapiens
cttggccctttcctt

SEQ ID NO: 1722124 - DNA, 18 bp, Homo sapiens
cttggcctccatttctgt

SEQ ID NO: 1722125 - DNA, 21 bp, Homo sapiens
cttggcctcccaaagtgctgg

SEQ ID NO: 1722126 - DNA, 22 bp, Homo sapiens
cttggcctcccaaagtgctggg

SEQ ID NO: 1722127 - DNA, 13 bp, Homo sapiens
cttggcctgctgt

SEQ ID NO: 1722128 - DNA, 15 bp, Homo sapiens
cttggcctgctgtga

SEQ ID NO: 1722129 - DNA, 22 bp, Homo sapiens
cttggcctgtctcatccccagg

SEQ ID NO: 1722130 - DNA, 23 bp, Homo sapiens
cttggcctgtctcatccccaggg

SEQ ID NO: 1722131 - DNA, 18 bp, Homo sapiens
cttggccttgcagctggc

SEQ ID NO: 1722132 - DNA, 21 bp, Homo sapiens
cttggccttgcagctggccca

SEQ ID NO: 1722133 - DNA, 14 bp, Homo sapiens
cttggcggcagcag

SEQ ID NO: 1722134 - DNA, 23 bp, Homo sapiens
cttggctattgaagatgctgcct

SEQ ID NO: 1722135 - DNA, 21 bp, Homo sapiens
cttggctcaatcctctaagct

SEQ ID NO: 1722136 - DNA, 12 bp, Homo sapiens
cttggctcagac

SEQ ID NO: 1722137 - DNA, 15 bp, Homo sapiens
cttggctgacccctc

SEQ ID NO: 1722138 - DNA, 19 bp, Homo sapiens
cttggctgacccctctggt

SEQ ID NO: 1722139 - DNA, 20 bp, Homo sapiens
cttggctgcaaataaggaca

SEQ ID NO: 1722140 - DNA, 22 bp, Homo sapiens
cttggctgcaaataaggacagc

SEQ ID NO: 1722141 - DNA, 21 bp, Homo sapiens
cttggctgtctgaccagagaa

SEQ ID NO: 1722142 - DNA, 22 bp, Homo sapiens
cttggctgtctgaccagagaat

SEQ ID NO: 1722143 - DNA, 19 bp, Homo sapiens
cttggcttaatcattttca

SEQ ID NO: 1722144 - DNA, 23 bp, Homo sapiens
cttggcttcctccgtccacccag

SEQ ID NO: 1722145 - DNA, 13 bp, Homo sapiens
cttggcttctgtg

SEQ ID NO: 1722146 - DNA, 17 bp, Homo sapiens
cttggcttgccattttt

SEQ ID NO: 1722147 - DNA, 21 bp, Homo sapiens
cttggctttatgcaaatacaa

SEQ ID NO: 1722148 - DNA, 18 bp, Homo sapiens
cttggctttcagagccag

SEQ ID NO: 1722149 - DNA, 10 bp, Homo sapiens
cttgggaatg

SEQ ID NO: 1722150 - DNA, 19 bp, Homo sapiens
cttgggacccccactaaga

SEQ ID NO: 1722151 - DNA, 16 bp, Homo sapiens
cttgggaggctgaggc

SEQ ID NO: 1722152 - DNA, 21 bp, Homo sapiens
cttgggatagtgttctgctcc

SEQ ID NO: 1722153 - DNA, 23 bp, Homo sapiens
cttgggatagtgttctgctcctg

SEQ ID NO: 1722154 - DNA, 20 bp, Homo sapiens
cttgggatgatgcctcatga

SEQ ID NO: 1722155 - DNA, 15 bp, Homo sapiens
cttgggcagagctgg

SEQ ID NO: 1722156 - DNA, 22 bp, Homo sapiens
cttgggcagagctggctctgag

SEQ ID NO: 1722157 - DNA, 17 bp, Homo sapiens
cttgggcatccacccag

SEQ ID NO: 1722158 - DNA, 20 bp, Homo sapiens
cttgggcatccacccagtgc

SEQ ID NO: 1722159 - DNA, 21 bp, Homo sapiens
cttgggccacgctcttgagga

SEQ ID NO: 1722160 - DNA, 23 bp, Homo sapiens
cttgggccagaagtaccagacta

SEQ ID NO: 1722161 - DNA, 15 bp, Homo sapiens
cttgggccctgcaca

SEQ ID NO: 1722162 - DNA, 14 bp, Homo sapiens
cttgggccctgcat

SEQ ID NO: 1722163 - DNA, 20 bp, Homo sapiens
cttgggccctgcattggcct

SEQ ID NO: 1722164 - DNA, 14 bp, Homo sapiens
cttgggcctggcca

SEQ ID NO: 1722165 - DNA, 16 bp, Homo sapiens
cttgggcctggccagt

SEQ ID NO: 1722166 - DNA, 17 bp, Homo sapiens
cttgggcctggccagtc

SEQ ID NO: 1722167 - DNA, 18 bp, Homo sapiens
cttgggcggctgagagcc

SEQ ID NO: 1722168 - DNA, 22 bp, Homo sapiens
cttgggcggctgagagccccag

SEQ ID NO: 1722169 - DNA, 18 bp, Homo sapiens
cttgggctactggcagct

SEQ ID NO: 1722170 - DNA, 20 bp, Homo sapiens
cttgggctactggcagctcc

SEQ ID NO: 1722171 - DNA, 12 bp, Homo sapiens
cttgggctcctg

SEQ ID NO: 1722172 - DNA, 19 bp, Homo sapiens
cttgggctcctggctgcca

SEQ ID NO: 1722173 - DNA, 20 bp, Homo sapiens
cttgggctcctggctgccag

SEQ ID NO: 1722174 - DNA, 22 bp, Homo sapiens
cttgggctgacccagcatctcc

SEQ ID NO: 1722175 - DNA, 20 bp, Homo sapiens
cttggggaaaatggccatgc

SEQ ID NO: 1722176 - DNA, 21 bp, Homo sapiens
cttggggagttaagacctggc

SEQ ID NO: 1722177 - DNA, 15 bp, Homo sapiens
cttggggcagggcct

SEQ ID NO: 1722178 - DNA, 17 bp, Homo sapiens
cttggggcagggcctgg

SEQ ID NO: 1722179 - DNA, 18 bp, Homo sapiens
cttggggcagggcctggg

SEQ ID NO: 1722180 - DNA, 23 bp, Homo sapiens
cttggggccaccaaagctgccca

SEQ ID NO: 1722181 - DNA, 12 bp, Homo sapiens
cttggggcccag

SEQ ID NO: 1722182 - DNA, 16 bp, Homo sapiens
cttggggcccagtgca

SEQ ID NO: 1722183 - DNA, 15 bp, Homo sapiens
cttggggcctggctt

SEQ ID NO: 1722184 - DNA, 23 bp, Homo sapiens
cttggggcctggcttgctccagg

SEQ ID NO: 1722185 - DNA, 23 bp, Homo sapiens
cttgaagaggggaggggcctagg

SEQ ID NO: 1722186 - DNA, 13 bp, Homo sapiens
cttgaagatcgtt

SEQ ID NO: 1722187 - DNA, 18 bp, Homo sapiens
cttgaagcacagagggct

SEQ ID NO: 1722188 - DNA, 13 bp, Homo sapiens
cttgaagccactg

SEQ ID NO: 1722189 - DNA, 11 bp, Homo sapiens
cttgaagctgt

SEQ ID NO: 1722190 - DNA, 17 bp, Homo sapiens
cttgaagggccagagcc

SEQ ID NO: 1722191 - DNA, 14 bp, Homo sapiens
cttgaaggtgctga

SEQ ID NO: 1722192 - DNA, 22 bp, Homo sapiens
cttgaaggtgctgacggccagg

SEQ ID NO: 1722193 - DNA, 15 bp, Homo sapiens
cttgaagtcagccac

SEQ ID NO: 1722194 - DNA, 20 bp, Homo sapiens
cttgaagtcagccacactgg

SEQ ID NO: 1722195 - DNA, 19 bp, Homo sapiens
cttgaagtctaaaagcaga

SEQ ID NO: 1722196 - DNA, 16 bp, Homo sapiens
cttgaagtgagaagat

SEQ ID NO: 1722197 - DNA, 23 bp, Homo sapiens
cttgaagttgggtgtttccagaa

SEQ ID NO: 1722198 - DNA, 17 bp, Homo sapiens
cttgaataagagtgatt

SEQ ID NO: 1722199 - DNA, 13 bp, Homo sapiens
cttgaatataaaa

SEQ ID NO: 1722200 - DNA, 20 bp, Homo sapiens
cttgaatataaaaaatcatg

SEQ ID NO: 1722201 - DNA, 13 bp, Homo sapiens
cttgaatgctgcc

SEQ ID NO: 1722202 - DNA, 14 bp, Homo sapiens
cttgaatgctgcca

SEQ ID NO: 1722203 - DNA, 16 bp, Homo sapiens
cttgaatgctgccagt

SEQ ID NO: 1722204 - DNA, 21 bp, Homo sapiens
cttgaatgtccccattctata

SEQ ID NO: 1722205 - DNA, 17 bp, Homo sapiens
cttgaattagtatttca

SEQ ID NO: 1722206 - DNA, 13 bp, Homo sapiens
cttgaattgtgta

SEQ ID NO: 1722207 - DNA, 13 bp, Homo sapiens
cttgaatttctga

SEQ ID NO: 1722208 - DNA, 13 bp, Homo sapiens
cttgaatttttga

SEQ ID NO: 1722209 - DNA, 24 bp, Homo sapiens
cttgacaacatcccacagtggcac

SEQ ID NO: 1722210 - DNA, 11 bp, Homo sapiens
cttgacaagct

SEQ ID NO: 1722211 - DNA, 23 bp, Homo sapiens
cttgacaagctgacttggcactt

SEQ ID NO: 1722212 - DNA, 21 bp, Homo sapiens
cttgacacaggaaatgggaaa

SEQ ID NO: 1722213 - DNA, 14 bp, Homo sapiens
cttgacatacctac

SEQ ID NO: 1722214 - DNA, 15 bp, Homo sapiens
cttgacatacctacc

SEQ ID NO: 1722215 - DNA, 22 bp, Homo sapiens
cttgacattccttgtcaccagc

SEQ ID NO: 1722216 - DNA, 16 bp, Homo sapiens
cttgaccaacagaaac

SEQ ID NO: 1722217 - DNA, 21 bp, Homo sapiens
cttgaccagcagatcccagct

SEQ ID NO: 1722218 - DNA, 22 bp, Homo sapiens
cttgaccagcagatcccagctc

SEQ ID NO: 1722219 - DNA, 21 bp, Homo sapiens
cttgaccaggctgcctccctt

SEQ ID NO: 1722220 - DNA, 12 bp, Homo sapiens
cttctgctttca

SEQ ID NO: 1722221 - DNA, 22 bp, Homo sapiens
cttctgcttttctgccctggct

SEQ ID NO: 1722222 - DNA, 14 bp, Homo sapiens
cttctggaaggctg

SEQ ID NO: 1722223 - DNA, 19 bp, Homo sapiens
cttctggaaggctggctga

SEQ ID NO: 1722224 - DNA, 14 bp, Homo sapiens
cttctggaatattg

SEQ ID NO: 1722225 - DNA, 15 bp, Homo sapiens
cttctggaatattgt

SEQ ID NO: 1722226 - DNA, 19 bp, Homo sapiens
cttctggacactgagaggg

SEQ ID NO: 1722227 - DNA, 15 bp, Homo sapiens
cttctggacaggctc

SEQ ID NO: 1722228 - DNA, 21 bp, Homo sapiens
cttctggacaggctctgcttc

SEQ ID NO: 1722229 - DNA, 11 bp, Homo sapiens
cttctggagcc

SEQ ID NO: 1722230 - DNA, 13 bp, Homo sapiens
cttctggagccct

SEQ ID NO: 1722231 - DNA, 13 bp, Homo sapiens
cttctggatccat

SEQ ID NO: 1722232 - DNA, 14 bp, Homo sapiens
cttctggatccatg

SEQ ID NO: 1722233 - DNA, 15 bp, Homo sapiens
cttctggccggtgct

SEQ ID NO: 1722234 - DNA, 18 bp, Homo sapiens
cttctggccggtgctggg

SEQ ID NO: 1722235 - DNA, 22 bp, Homo sapiens
cttctggccggtgctgggttcc

SEQ ID NO: 1722236 - DNA, 16 bp, Homo sapiens
cttctggcttcagccc

SEQ ID NO: 1722237 - DNA, 16 bp, Homo sapiens
cttctgggaaaaacaa

SEQ ID NO: 1722238 - DNA, 17 bp, Homo sapiens
cttctgggagcaggaac

SEQ ID NO: 1722239 - DNA, 16 bp, Homo sapiens
cttctgggcgtctgag

SEQ ID NO: 1722240 - DNA, 21 bp, Homo sapiens
cttctgggcttcattctggaa

SEQ ID NO: 1722241 - DNA, 23 bp, Homo sapiens
cttctgggcttcattctggaaac

SEQ ID NO: 1722242 - DNA, 16 bp, Homo sapiens
cttctggggcaggctg

SEQ ID NO: 1722243 - DNA, 19 bp, Homo sapiens
cttctggggcaggctgggc

SEQ ID NO: 1722244 - DNA, 21 bp, Homo sapiens
cttctggggcaggctgggcca

SEQ ID NO: 1722245 - DNA, 22 bp, Homo sapiens
cttctggggcaggctgggccat

SEQ ID NO: 1722246 - DNA, 15 bp, Homo sapiens
cttctgggtggggca

SEQ ID NO: 1722247 - DNA, 19 bp, Homo sapiens
cttctgggttcaagcgatt

SEQ ID NO: 1722248 - DNA, 17 bp, Homo sapiens
cttctggttgcttcaga

SEQ ID NO: 1722249 - DNA, 16 bp, Homo sapiens
cttctggttgtatttc

SEQ ID NO: 1722250 - DNA, 18 bp, Homo sapiens
cttctggttgtatttcta

SEQ ID NO: 1722251 - DNA, 19 bp, Homo sapiens
cttctggttgtatttctat

SEQ ID NO: 1722252 - DNA, 22 bp, Homo sapiens
cttaagcccagtgcactgaaag

SEQ ID NO: 1722253 - DNA, 18 bp, Homo sapiens
cttaagccctttgctctg

SEQ ID NO: 1722254 - DNA, 23 bp, Homo sapiens
cttatttgccttctactcccctt

SEQ ID NO: 1722255 - DNA, 16 bp, Homo sapiens
cttatttgtatatggt

SEQ ID NO: 1722256 - DNA, 15 bp, Homo sapiens
cttattttaaaataa

SEQ ID NO: 1722257 - DNA, 18 bp, Homo sapiens
cttattttaggaaattta

SEQ ID NO: 1722258 - DNA, 19 bp, Homo sapiens
cttcccacacctgcctgcg

SEQ ID NO: 1722259 - DNA, 14 bp, Homo sapiens
cttcccacaggagg

SEQ ID NO: 1722260 - DNA, 22 bp, Homo sapiens
cttcccacaggagggccagcgc

SEQ ID NO: 1722261 - DNA, 13 bp, Homo sapiens
cttcccaccctgc

SEQ ID NO: 1722262 - DNA, 15 bp, Homo sapiens
cttcccactggggcc

SEQ ID NO: 1722263 - DNA, 16 bp, Homo sapiens
cttcccactggggccg

SEQ ID NO: 1722264 - DNA, 19 bp, Homo sapiens
cttcccagaatctctgagc

SEQ ID NO: 1722265 - DNA, 20 bp, Homo sapiens
cttcccagaatctctgagcc

SEQ ID NO: 1722266 - DNA, 18 bp, Homo sapiens
cttcccagaccaggaaag

SEQ ID NO: 1722267 - DNA, 17 bp, Homo sapiens
cttcccagaggcagagc

SEQ ID NO: 1722268 - DNA, 19 bp, Homo sapiens
cttcccagcaacaataatg

SEQ ID NO: 1722269 - DNA, 13 bp, Homo sapiens
cttcccagctctg

SEQ ID NO: 1722270 - DNA, 15 bp, Homo sapiens
cttcccaggcccttt

SEQ ID NO: 1722271 - DNA, 23 bp, Homo sapiens
cttcccatagtggggcctgggag

SEQ ID NO: 1722272 - DNA, 17 bp, Homo sapiens
cttcccatcactggagc

SEQ ID NO: 1722273 - DNA, 16 bp, Homo sapiens
cttcccatcctaccct

SEQ ID NO: 1722274 - DNA, 23 bp, Homo sapiens
cttcccattctgccccagagtgg

SEQ ID NO: 1722275 - DNA, 18 bp, Homo sapiens
cttcccattgtggctcct

SEQ ID NO: 1722276 - DNA, 15 bp, Homo sapiens
cttcccatttcttcc

SEQ ID NO: 1722277 - DNA, 16 bp, Homo sapiens
cttcccatttcttccc

SEQ ID NO: 1722278 - DNA, 19 bp, Homo sapiens
cttcccatttcttcccact

SEQ ID NO: 1722279 - DNA, 20 bp, Homo sapiens
cttcccatttcttcccactt

SEQ ID NO: 1722280 - DNA, 14 bp, Homo sapiens
cttccccacagaac

SEQ ID NO: 1722281 - DNA, 15 bp, Homo sapiens
cttccccacagaact

SEQ ID NO: 1722282 - DNA, 16 bp, Homo sapiens
cttccccacagaactg

SEQ ID NO: 1722283 - DNA, 14 bp, Homo sapiens
cttccccagacttg

SEQ ID NO: 1722284 - DNA, 20 bp, Homo sapiens
cttccccagacttgcactgg

SEQ ID NO: 1722285 - DNA, 21 bp, Homo sapiens
cttccccagacttgcactggg

SEQ ID NO: 1722286 - DNA, 15 bp, Homo sapiens
cttccccaggcccac

SEQ ID NO: 1722287 - DNA, 19 bp, Homo sapiens
cttccccaggcccaccatc

SEQ ID NO: 1722288 - DNA, 12 bp, Homo sapiens
cttccccatccc

SEQ ID NO: 1722289 - DNA, 13 bp, Homo sapiens
cttcccccaccac

SEQ ID NO: 1722290 - DNA, 15 bp, Homo sapiens
cttcccccaccacca

SEQ ID NO: 1722291 - DNA, 23 bp, Homo sapiens
cttcccccaccggtccagctggc

SEQ ID NO: 1722292 - DNA, 14 bp, Homo sapiens
cttcccccagccca

SEQ ID NO: 1722293 - DNA, 12 bp, Homo sapiens
cttccccctcca

SEQ ID NO: 1722294 - DNA, 15 bp, Homo sapiens
cttccccctccaatc

SEQ ID NO: 1722295 - DNA, 16 bp, Homo sapiens
cttccccctcccaggg

SEQ ID NO: 1722296 - DNA, 15 bp, Homo sapiens
cttccccctccccct

SEQ ID NO: 1722297 - DNA, 18 bp, Homo sapiens
cttccccctgtagactag

SEQ ID NO: 1722298 - DNA, 12 bp, Homo sapiens
cttcccctgcac

SEQ ID NO: 1722299 - DNA, 19 bp, Homo sapiens
cttcccctgcacctggcct

SEQ ID NO: 1722300 - DNA, 13 bp, Homo sapiens
cttccccttccct

SEQ ID NO: 1722301 - DNA, 14 bp, Homo sapiens
cttccccttccctt

SEQ ID NO: 1722302 - DNA, 17 bp, Homo sapiens
cttccccttcctgtttc

SEQ ID NO: 1722303 - DNA, 18 bp, Homo sapiens
cttcccctttactcagcc

SEQ ID NO: 1722304 - DNA, 13 bp, Homo sapiens
cttcccctttccc

SEQ ID NO: 1722305 - DNA, 19 bp, Homo sapiens
cttccccttttgcctggct

SEQ ID NO: 1722306 - DNA, 15 bp, Homo sapiens
cttcccgcctcggct

SEQ ID NO: 1722307 - DNA, 14 bp, Homo sapiens
cttcccgccttcca

SEQ ID NO: 1722308 - DNA, 14 bp, Homo sapiens
cttcccgctgcaca

SEQ ID NO: 1722309 - DNA, 18 bp, Homo sapiens
cttcccgggccagggctg

SEQ ID NO: 1722310 - DNA, 18 bp, Homo sapiens
cttcccgtagctgccagt

SEQ ID NO: 1722311 - DNA, 15 bp, Homo sapiens
cttccctacctcagg

SEQ ID NO: 1722312 - DNA, 17 bp, Homo sapiens
cttccctcaccttggca

SEQ ID NO: 1722313 - DNA, 15 bp, Homo sapiens
cttccctccctgagg

SEQ ID NO: 1722314 - DNA, 16 bp, Homo sapiens
cttccctccctgaggc

SEQ ID NO: 1722315 - DNA, 17 bp, Homo sapiens
cttccctccgccttctc

SEQ ID NO: 1722316 - DNA, 15 bp, Homo sapiens
cttccctcggggagc

SEQ ID NO: 1722317 - DNA, 14 bp, Homo sapiens
cttccctctcctgc

SEQ ID NO: 1722318 - DNA, 13 bp, Homo sapiens
cttccctctcgct

SEQ ID NO: 1722319 - DNA, 13 bp, Homo sapiens
cttccctcttccc

SEQ ID NO: 1722320 - DNA, 14 bp, Homo sapiens
cttccctcttccct

SEQ ID NO: 1722321 - DNA, 19 bp, Homo sapiens
cttccctcttccctctccc

SEQ ID NO: 1722322 - DNA, 23 bp, Homo sapiens
cttccctgaacttcctgcttcct

SEQ ID NO: 1722323 - DNA, 19 bp, Homo sapiens
cttccctgccacttcaacc

SEQ ID NO: 1722324 - DNA, 13 bp, Homo sapiens
cttccctgctctt

SEQ ID NO: 1722325 - DNA, 16 bp, Homo sapiens
cttccctgctcttgca

SEQ ID NO: 1722326 - DNA, 18 bp, Homo sapiens
cttccctggctacttccc

SEQ ID NO: 1722327 - DNA, 19 bp, Homo sapiens
cttccctggctacttccct

SEQ ID NO: 1722328 - DNA, 21 bp, Homo sapiens
cttccctggctacttcccttc

SEQ ID NO: 1722329 - DNA, 19 bp, Homo sapiens
cttccctgggaaggctaag

SEQ ID NO: 1722330 - DNA, 12 bp, Homo sapiens
cttccctgggag

SEQ ID NO: 1722331 - DNA, 13 bp, Homo sapiens
cttccctgggagg

SEQ ID NO: 1722332 - DNA, 18 bp, Homo sapiens
cttccctgggagggaggt

SEQ ID NO: 1722333 - DNA, 15 bp, Homo sapiens
cttccctgtccctct

SEQ ID NO: 1722334 - DNA, 16 bp, Homo sapiens
cttccctgtccctcta

SEQ ID NO: 1722335 - DNA, 16 bp, Homo sapiens
cttcccttagcctctc

SEQ ID NO: 1722336 - DNA, 17 bp, Homo sapiens
cttcccttagcctctcc

SEQ ID NO: 1722337 - DNA, 19 bp, Homo sapiens
cttcccttagcctctccca

SEQ ID NO: 1722338 - DNA, 11 bp, Homo sapiens
cttcccttcct

SEQ ID NO: 1722339 - DNA, 12 bp, Homo sapiens
cttcccttctcc

SEQ ID NO: 1722340 - DNA, 19 bp, Homo sapiens
cttcccttctctggtctcc

SEQ ID NO: 1722341 - DNA, 21 bp, Homo sapiens
cttcccttctctggtctcctt

SEQ ID NO: 1722342 - DNA, 22 bp, Homo sapiens
cttcccttctctggtctccttg

SEQ ID NO: 1722343 - DNA, 22 bp, Homo sapiens
cttccgagatccccagggcagc

SEQ ID NO: 1722344 - DNA, 20 bp, Homo sapiens
cttccgatcaacatttatga

SEQ ID NO: 1722345 - DNA, 14 bp, Homo sapiens
cttccgcctcctgt

SEQ ID NO: 1722346 - DNA, 15 bp, Homo sapiens
cttccgcctcctgtg

SEQ ID NO: 1722347 - DNA, 13 bp, Homo sapiens
cttccgctgaggg

SEQ ID NO: 1722348 - DNA, 20 bp, Homo sapiens
cttccgggtctcgcagcctg

SEQ ID NO: 1722349 - DNA, 21 bp, Homo sapiens
cttccgggtctcgcagcctga

SEQ ID NO: 1722350 - DNA, 21 bp, Homo sapiens
cttccgtggtcagagtgccac

SEQ ID NO: 1722351 - DNA, 23 bp, Homo sapiens
cttccgtggtcagagtgccactg

SEQ ID NO: 1722352 - DNA, 22 bp, Homo sapiens
cttcctaaacccaatgacttcc

SEQ ID NO: 1722353 - DNA, 24 bp, Homo sapiens
cttcctacaagagcagcctgtggc

SEQ ID NO: 1722354 - DNA, 21 bp, Homo sapiens
cttcctagatctgcaggctgc

SEQ ID NO: 1722355 - DNA, 17 bp, Homo sapiens
cttcctagccttgcact

SEQ ID NO: 1722356 - DNA, 17 bp, Homo sapiens
cttcctagggatctgaa

SEQ ID NO: 1722357 - DNA, 19 bp, Homo sapiens
cttcctagggatctgaaat

SEQ ID NO: 1722358 - DNA, 22 bp, Homo sapiens
cttcctagttttctcctcccag

SEQ ID NO: 1722359 - DNA, 12 bp, Homo sapiens
cttcctataata

SEQ ID NO: 1722360 - DNA, 17 bp, Homo sapiens
cttcctcacacccctgt

SEQ ID NO: 1722361 - DNA, 22 bp, Homo sapiens
cttcctcacacccctgtcccac

SEQ ID NO: 1722362 - DNA, 14 bp, Homo sapiens
cttcctcagagggc

SEQ ID NO: 1722363 - DNA, 21 bp, Homo sapiens
cttcctcagtaacatttctgt

SEQ ID NO: 1722364 - DNA, 23 bp, Homo sapiens
cttcctcagtaacatttctgttc

SEQ ID NO: 1722365 - DNA, 18 bp, Homo sapiens
cttcctcagtttaatcct

SEQ ID NO: 1722366 - DNA, 21 bp, Homo sapiens
cttcctcataccacatggctt

SEQ ID NO: 1722367 - DNA, 22 bp, Homo sapiens
cttcctcatccaccccatccct

SEQ ID NO: 1722368 - DNA, 19 bp, Homo sapiens
cttcctccccacactccac

SEQ ID NO: 1722369 - DNA, 21 bp, Homo sapiens
cttcctccccacactccactc

SEQ ID NO: 1722370 - DNA, 24 bp, Homo sapiens
cttcctccgtccacccaggctgca

SEQ ID NO: 1722371 - DNA, 18 bp, Homo sapiens
cttcctcctccacagtgc

SEQ ID NO: 1722372 - DNA, 21 bp, Homo sapiens
cttcctcctccacagtgctgc

SEQ ID NO: 1722373 - DNA, 16 bp, Homo sapiens
cttcctcctccccact

SEQ ID NO: 1722374 - DNA, 19 bp, Homo sapiens
cttcctcctccccgctccg

SEQ ID NO: 1722375 - DNA, 16 bp, Homo sapiens
cttcaggctcttctcc

SEQ ID NO: 1722376 - DNA, 19 bp, Homo sapiens
cttcaggctcttctccttt

SEQ ID NO: 1722377 - DNA, 19 bp, Homo sapiens
cttcagggcagggctctga

SEQ ID NO: 1722378 - DNA, 22 bp, Homo sapiens
cttcaggggagtcccgtcagga

SEQ ID NO: 1722379 - DNA, 21 bp, Homo sapiens
cttcaggtgcttttgatgtga

SEQ ID NO: 1722380 - DNA, 12 bp, Homo sapiens
cttcaggttctc

SEQ ID NO: 1722381 - DNA, 19 bp, Homo sapiens
cttcagtaccctctcagct

SEQ ID NO: 1722382 - DNA, 19 bp, Homo sapiens
cttcagtctcacagagaag

SEQ ID NO: 1722383 - DNA, 17 bp, Homo sapiens
cttcagtctctatacca

SEQ ID NO: 1722384 - DNA, 19 bp, Homo sapiens
cttcagtgactcctgctgg

SEQ ID NO: 1722385 - DNA, 17 bp, Homo sapiens
cttcagtgtatggaaat

SEQ ID NO: 1722386 - DNA, 17 bp, Homo sapiens
cttcagttatgattttt

SEQ ID NO: 1722387 - DNA, 19 bp, Homo sapiens
cttcagtttaatgtctcct

SEQ ID NO: 1722388 - DNA, 22 bp, Homo sapiens
cttcagtttatttccactattt

SEQ ID NO: 1722389 - DNA, 15 bp, Homo sapiens
cttcagtttgtaaag

SEQ ID NO: 1722390 - DNA, 14 bp, Homo sapiens
cttcataaatgaag

SEQ ID NO: 1722391 - DNA, 17 bp, Homo sapiens
cttcataccgcctcgtg

SEQ ID NO: 1722392 - DNA, 19 bp, Homo sapiens
cttcataccgcctcgtgcc

SEQ ID NO: 1722393 - DNA, 23 bp, Homo sapiens
cttcataccgcctcgtgccagca

SEQ ID NO: 1722394 - DNA, 22 bp, Homo sapiens
cttcatagatgcaggaggctca

SEQ ID NO: 1722395 - DNA, 20 bp, Homo sapiens
cttcataggcggtcatgtgt

SEQ ID NO: 1722396 - DNA, 20 bp, Homo sapiens
cttcatattctaaaaccatt

SEQ ID NO: 1722397 - DNA, 15 bp, Homo sapiens
cttcatcaagaaata

SEQ ID NO: 1722398 - DNA, 13 bp, Homo sapiens
cttcatccctttc

SEQ ID NO: 1722399 - DNA, 14 bp, Homo sapiens
cttcatccctttcc

SEQ ID NO: 1722400 - DNA, 16 bp, Homo sapiens
cttcatccctttccag

SEQ ID NO: 1722401 - DNA, 15 bp, Homo sapiens
cttcatcctcctccc

SEQ ID NO: 1722402 - DNA, 19 bp, Homo sapiens
cttcatcctcctccccagc

SEQ ID NO: 1722403 - DNA, 14 bp, Homo sapiens
cttcatcttcctgt

SEQ ID NO: 1722404 - DNA, 16 bp, Homo sapiens
cttcatcttcctgtgt

SEQ ID NO: 1722405 - DNA, 16 bp, Homo sapiens
cttcatgaaactgtcc

SEQ ID NO: 1722406 - DNA, 20 bp, Homo sapiens
cttcatgcataggtttagca

SEQ ID NO: 1722407 - DNA, 15 bp, Homo sapiens
cttcatgccagctac

SEQ ID NO: 1722408 - DNA, 16 bp, Homo sapiens
cttcatgccagctact

SEQ ID NO: 1722409 - DNA, 18 bp, Homo sapiens
cttcatgcccttctgatt

SEQ ID NO: 1722410 - DNA, 19 bp, Homo sapiens
cttcatgcttgacatacct

SEQ ID NO: 1722411 - DNA, 20 bp, Homo sapiens
cttcatgcttttgcttgcaa

SEQ ID NO: 1722412 - DNA, 14 bp, Homo sapiens
cttcattattctct

SEQ ID NO: 1722413 - DNA, 15 bp, Homo sapiens
cttcattattctctg

SEQ ID NO: 1722414 - DNA, 20 bp, Homo sapiens
cttcattcaatattgacatt

SEQ ID NO: 1722415 - DNA, 14 bp, Homo sapiens
cttcattccggact

SEQ ID NO: 1722416 - DNA, 16 bp, Homo sapiens
cttcattccgttagga

SEQ ID NO: 1722417 - DNA, 10 bp, Homo sapiens
cttcattctt

SEQ ID NO: 1722418 - DNA, 15 bp, Homo sapiens
cttcattctttactg

SEQ ID NO: 1722419 - DNA, 17 bp, Homo sapiens
cttcattctttactgca

SEQ ID NO: 1722420 - DNA, 23 bp, Homo sapiens
cttcattgagagttttgtcttga

SEQ ID NO: 1722421 - DNA, 19 bp, Homo sapiens
cttcatttgacacaaagct

SEQ ID NO: 1722422 - DNA, 17 bp, Homo sapiens
cttcatttttctttctt

SEQ ID NO: 1722423 - DNA, 17 bp, Homo sapiens
cttccaaaacctgcttc

SEQ ID NO: 1722424 - DNA, 22 bp, Homo sapiens
cttccaaagactccctccatag

SEQ ID NO: 1722425 - DNA, 14 bp, Homo sapiens
cttccaagaaaaat

SEQ ID NO: 1722426 - DNA, 16 bp, Homo sapiens
cttccaagaaaaataa

SEQ ID NO: 1722427 - DNA, 16 bp, Homo sapiens
cttccaagcatgacaa

SEQ ID NO: 1722428 - DNA, 13 bp, Homo sapiens
cttccaaggagac

SEQ ID NO: 1722429 - DNA, 15 bp, Homo sapiens
cttccaaggagacca

SEQ ID NO: 1722430 - DNA, 12 bp, Homo sapiens
cttccaaggccc

SEQ ID NO: 1722431 - DNA, 16 bp, Homo sapiens
cttccacaaaattaga

SEQ ID NO: 1722432 - DNA, 18 bp, Homo sapiens
cttccacaagagtgaatt

SEQ ID NO: 1722433 - DNA, 17 bp, Homo sapiens
cttccacagcagcagaa

SEQ ID NO: 1722434 - DNA, 14 bp, Homo sapiens
cttccaccagcctg

SEQ ID NO: 1722435 - DNA, 17 bp, Homo sapiens
cttccaccagcctgcac

SEQ ID NO: 1722436 - DNA, 12 bp, Homo sapiens
cttccacccagt

SEQ ID NO: 1722437 - DNA, 14 bp, Homo sapiens
cttccacccagtgc

SEQ ID NO: 1722438 - DNA, 14 bp, Homo sapiens
cttccacccattcc

SEQ ID NO: 1722439 - DNA, 22 bp, Homo sapiens
cttccacccattcccccatgtg

SEQ ID NO: 1722440 - DNA, 17 bp, Homo sapiens
cttccacctcctagagg

SEQ ID NO: 1722441 - DNA, 15 bp, Homo sapiens
cttccacctgtgccc

SEQ ID NO: 1722442 - DNA, 17 bp, Homo sapiens
cttccacctgtgccctc

SEQ ID NO: 1722443 - DNA, 20 bp, Homo sapiens
cttccacctgtgccctcacc

SEQ ID NO: 1722444 - DNA, 15 bp, Homo sapiens
cttccacgtcttcct

SEQ ID NO: 1722445 - DNA, 18 bp, Homo sapiens
cttccactccttctctca

SEQ ID NO: 1722446 - DNA, 19 bp, Homo sapiens
cttccactcgatgatgctt

SEQ ID NO: 1722447 - DNA, 15 bp, Homo sapiens
cttccactctggaac

SEQ ID NO: 1722448 - DNA, 20 bp, Homo sapiens
cttccacttctccaagaatg

SEQ ID NO: 1722449 - DNA, 16 bp, Homo sapiens
cttccagaatcccaag

SEQ ID NO: 1722450 - DNA, 16 bp, Homo sapiens
cttccagaatgctgaa

SEQ ID NO: 1722451 - DNA, 23 bp, Homo sapiens
cttccagaatgctgaactccttg

SEQ ID NO: 1722452 - DNA, 15 bp, Homo sapiens
cttccagatcactgc

SEQ ID NO: 1722453 - DNA, 20 bp, Homo sapiens
cttccagatggtcatccaga

SEQ ID NO: 1722454 - DNA, 12 bp, Homo sapiens
cttccagatttt

SEQ ID NO: 1722455 - DNA, 18 bp, Homo sapiens
cttccagattttaaattt

SEQ ID NO: 1722456 - DNA, 16 bp, Homo sapiens
cttccagcaccctgca

SEQ ID NO: 1722457 - DNA, 13 bp, Homo sapiens
cttccagcattta

SEQ ID NO: 1722458 - DNA, 15 bp, Homo sapiens
cttccagctcctgta

SEQ ID NO: 1722459 - DNA, 13 bp, Homo sapiens
cttccagctgctg

SEQ ID NO: 1722460 - DNA, 14 bp, Homo sapiens
cttccagctgctgt

SEQ ID NO: 1722461 - DNA, 17 bp, Homo sapiens
cttccaggcctgaagtc

SEQ ID NO: 1722462 - DNA, 10 bp, Homo sapiens
cttccaggct

SEQ ID NO: 1722463 - DNA, 14 bp, Homo sapiens
cttccaggctcttc

SEQ ID NO: 1722464 - DNA, 15 bp, Homo sapiens
cttccaggctcttcc

SEQ ID NO: 1722465 - DNA, 23 bp, Homo sapiens
cttccaggctcttcctggacctg

SEQ ID NO: 1722466 - DNA, 15 bp, Homo sapiens
cttccaggctgggca

SEQ ID NO: 1722467 - DNA, 14 bp, Homo sapiens
cttccaggtcagga

SEQ ID NO: 1722468 - DNA, 23 bp, Homo sapiens
cttccaggttccatccaccacct

SEQ ID NO: 1722469 - DNA, 22 bp, Homo sapiens
cttccagtcttcctgacacttt

SEQ ID NO: 1722470 - DNA, 23 bp, Homo sapiens
cttccagtgttggctgtgtgaca

SEQ ID NO: 1722471 - DNA, 14 bp, Homo sapiens
cttccatagcctaa

SEQ ID NO: 1722472 - DNA, 22 bp, Homo sapiens
cttccatagcctaatccctggg

SEQ ID NO: 1722473 - DNA, 22 bp, Homo sapiens
cttccatcagcgggtctcctcc

SEQ ID NO: 1722474 - DNA, 23 bp, Homo sapiens
cttccatcagcgggtctcctccc

SEQ ID NO: 1722475 - DNA, 17 bp, Homo sapiens
cttccatcatcactgta

SEQ ID NO: 1722476 - DNA, 12 bp, Homo sapiens
cttccatcccta

SEQ ID NO: 1722477 - DNA, 17 bp, Homo sapiens
cttccatctagtcacaa

SEQ ID NO: 1722478 - DNA, 20 bp, Homo sapiens
cttccatcttgtggggccag

SEQ ID NO: 1722479 - DNA, 22 bp, Homo sapiens
cttccatcttgtggggccagga

SEQ ID NO: 1722480 - DNA, 14 bp, Homo sapiens
cttccatgatttta

SEQ ID NO: 1722481 - DNA, 22 bp, Homo sapiens
cttccatggtactgtagcaggg

SEQ ID NO: 1722482 - DNA, 19 bp, Homo sapiens
cttccatgtatcttttgaa

SEQ ID NO: 1722483 - DNA, 15 bp, Homo sapiens
cttccatgtgccttt

SEQ ID NO: 1722484 - DNA, 16 bp, Homo sapiens
cttccatgtgcctttc

SEQ ID NO: 1722485 - DNA, 23 bp, Homo sapiens
cttccattttcccccactactgc

SEQ ID NO: 1722486 - DNA, 18 bp, Homo sapiens
cttcccaaacccagtctc

SEQ ID NO: 1722487 - DNA, 21 bp, Homo sapiens
cttcccaaacccagtctcctc

SEQ ID NO: 1722488 - DNA, 17 bp, Homo sapiens
cttcccaatcagcactg

SEQ ID NO: 1722489 - DNA, 19 bp, Homo sapiens
cttcccaatcagcactgaa

SEQ ID NO: 1722490 - DNA, 20 bp, Homo sapiens
cttcccaatcagcactgaaa

SEQ ID NO: 1722491 - DNA, 17 bp, Homo sapiens
cttcccacacctgcctg

SEQ ID NO: 1722492 - DNA, 23 bp, Homo sapiens
cttattttatcttctttcctcaa

SEQ ID NO: 1722493 - DNA, 12 bp, Homo sapiens
cttattttcaag

SEQ ID NO: 1722494 - DNA, 14 bp, Homo sapiens
cttattttcaagaa

SEQ ID NO: 1722495 - DNA, 19 bp, Homo sapiens
cttattttcaagaaactga

SEQ ID NO: 1722496 - DNA, 19 bp, Homo sapiens
cttattttgcattccagaa

SEQ ID NO: 1722497 - DNA, 23 bp, Homo sapiens
cttattttgcattccagaatctt

SEQ ID NO: 1722498 - DNA, 12 bp, Homo sapiens
cttattttgctt

SEQ ID NO: 1722499 - DNA, 14 bp, Homo sapiens
cttatttttctgag

SEQ ID NO: 1722500 - DNA, 17 bp, Homo sapiens
cttcaaaatgttctatt

SEQ ID NO: 1722501 - DNA, 18 bp, Homo sapiens
cttcaaactttcactttg

SEQ ID NO: 1722502 - DNA, 15 bp, Homo sapiens
cttcaaagccttctc

SEQ ID NO: 1722503 - DNA, 16 bp, Homo sapiens
cttcaaagcttgaaga

SEQ ID NO: 1722504 - DNA, 15 bp, Homo sapiens
cttcaaagtttatat

SEQ ID NO: 1722505 - DNA, 15 bp, Homo sapiens
cttcaaatatttccc

SEQ ID NO: 1722506 - DNA, 13 bp, Homo sapiens
cttcaaatgcaaa

SEQ ID NO: 1722507 - DNA, 18 bp, Homo sapiens
cttcaagaactctgggct

SEQ ID NO: 1722508 - DNA, 17 bp, Homo sapiens
cttcaagaatcagaaga

SEQ ID NO: 1722509 - DNA, 18 bp, Homo sapiens
cttcaagacgaggggcag

SEQ ID NO: 1722510 - DNA, 15 bp, Homo sapiens
cttcaagctgtcccc

SEQ ID NO: 1722511 - DNA, 17 bp, Homo sapiens
cttcaaggactgtttca

SEQ ID NO: 1722512 - DNA, 23 bp, Homo sapiens
cttcaaggactgtttcagtgtga

SEQ ID NO: 1722513 - DNA, 16 bp, Homo sapiens
cttcaaggcttccact

SEQ ID NO: 1722514 - DNA, 17 bp, Homo sapiens
cttcaaggtggcagctg

SEQ ID NO: 1722515 - DNA, 13 bp, Homo sapiens
cttcaagtgccaa

SEQ ID NO: 1722516 - DNA, 15 bp, Homo sapiens
cttcaagtgccaaac

SEQ ID NO: 1722517 - DNA, 20 bp, Homo sapiens
cttcaagtgttgctcttgga

SEQ ID NO: 1722518 - DNA, 18 bp, Homo sapiens
cttcaagttagctcagga

SEQ ID NO: 1722519 - DNA, 15 bp, Homo sapiens
cttcaataaatcttt

SEQ ID NO: 1722520 - DNA, 21 bp, Homo sapiens
cttcaataaatggtatagcaa

SEQ ID NO: 1722521 - DNA, 17 bp, Homo sapiens
cttcaatacttaaaaat

SEQ ID NO: 1722522 - DNA, 17 bp, Homo sapiens
cttcaatataagaagca

SEQ ID NO: 1722523 - DNA, 18 bp, Homo sapiens
cttcaatatgaatctata

SEQ ID NO: 1722524 - DNA, 13 bp, Homo sapiens
cttcaatcactgt

SEQ ID NO: 1722525 - DNA, 21 bp, Homo sapiens
cttcaatcactgtaacctgat

SEQ ID NO: 1722526 - DNA, 12 bp, Homo sapiens
cttcaatctctg

SEQ ID NO: 1722527 - DNA, 13 bp, Homo sapiens
cttcaatctctgg

SEQ ID NO: 1722528 - DNA, 15 bp, Homo sapiens
cttcaattcctgggc

SEQ ID NO: 1722529 - DNA, 16 bp, Homo sapiens
cttcaattcctgggcc

SEQ ID NO: 1722530 - DNA, 16 bp, Homo sapiens
cttcaattggtggaat

SEQ ID NO: 1722531 - DNA, 22 bp, Homo sapiens
cttcacaaatgtcattgtctac

SEQ ID NO: 1722532 - DNA, 17 bp, Homo sapiens
cttcacacacaggcaac

SEQ ID NO: 1722533 - DNA, 22 bp, Homo sapiens
cttcacacacaggcaactgagg

SEQ ID NO: 1722534 - DNA, 15 bp, Homo sapiens
cttcacactgcaaga

SEQ ID NO: 1722535 - DNA, 21 bp, Homo sapiens
cttcacactgcaagagccttg

SEQ ID NO: 1722536 - DNA, 12 bp, Homo sapiens
cttcacagcgtc

SEQ ID NO: 1722537 - DNA, 15 bp, Homo sapiens
cttcacagcgtctgc

SEQ ID NO: 1722538 - DNA, 20 bp, Homo sapiens
cttcacaggcagtgcatgtg

SEQ ID NO: 1722539 - DNA, 22 bp, Homo sapiens
cttcacagtagagccagcttgg

SEQ ID NO: 1722540 - DNA, 12 bp, Homo sapiens
cttcacagtgtt

SEQ ID NO: 1722541 - DNA, 13 bp, Homo sapiens
cttcacagtgttt

SEQ ID NO: 1722542 - DNA, 22 bp, Homo sapiens
cttcacataagctcagaatcca

SEQ ID NO: 1722543 - DNA, 14 bp, Homo sapiens
cttcaccaccccct

SEQ ID NO: 1722544 - DNA, 17 bp, Homo sapiens
cttcaccaccccctgtc

SEQ ID NO: 1722545 - DNA, 19 bp, Homo sapiens
cttcaccagagcatttcca

SEQ ID NO: 1722546 - DNA, 20 bp, Homo sapiens
cttcaccagtctgtctactg

SEQ ID NO: 1722547 - DNA, 22 bp, Homo sapiens
cttcaccagtctgtctactgtg

SEQ ID NO: 1722548 - DNA, 20 bp, Homo sapiens
cttcaccatcaatcctgatt

SEQ ID NO: 1722549 - DNA, 22 bp, Homo sapiens
cttcacccagctaatctgtagg

SEQ ID NO: 1722550 - DNA, 16 bp, Homo sapiens
cttcacccctgcactt

SEQ ID NO: 1722551 - DNA, 17 bp, Homo sapiens
cttcacccgagttcctc

SEQ ID NO: 1722552 - DNA, 15 bp, Homo sapiens
cttcaccctgagttt

SEQ ID NO: 1722553 - DNA, 12 bp, Homo sapiens
cttcacctcaga

SEQ ID NO: 1722554 - DNA, 13 bp, Homo sapiens
cttcacctttgta

SEQ ID NO: 1722555 - DNA, 23 bp, Homo sapiens
cttcactccggtgtgcctgcagc

SEQ ID NO: 1722556 - DNA, 13 bp, Homo sapiens
cttcactgaccag

SEQ ID NO: 1722557 - DNA, 14 bp, Homo sapiens
cttcactgaccagc

SEQ ID NO: 1722558 - DNA, 22 bp, Homo sapiens
cttcactggcgccttctcggag

SEQ ID NO: 1722559 - DNA, 17 bp, Homo sapiens
cttcactgtcatcttca

SEQ ID NO: 1722560 - DNA, 19 bp, Homo sapiens
cttcactgtgaggggaagg

SEQ ID NO: 1722561 - DNA, 23 bp, Homo sapiens
cttcactgtgaggggaaggcctt

SEQ ID NO: 1722562 - DNA, 16 bp, Homo sapiens
cttcactgtggccaca

SEQ ID NO: 1722563 - DNA, 14 bp, Homo sapiens
cttcactgttccct

SEQ ID NO: 1722564 - DNA, 16 bp, Homo sapiens
cttcacttcaagctgt

SEQ ID NO: 1722565 - DNA, 11 bp, Homo sapiens
cttcagaaaga

SEQ ID NO: 1722566 - DNA, 12 bp, Homo sapiens
cttcagaaagac

SEQ ID NO: 1722567 - DNA, 18 bp, Homo sapiens
cttcagaacacacagact

SEQ ID NO: 1722568 - DNA, 20 bp, Homo sapiens
cttcagaacacacagacttt

SEQ ID NO: 1722569 - DNA, 20 bp, Homo sapiens
cttcagaaggggacctgttt

SEQ ID NO: 1722570 - DNA, 19 bp, Homo sapiens
cttcagacacaaaagtcca

SEQ ID NO: 1722571 - DNA, 19 bp, Homo sapiens
cttcagacagagaggactg

SEQ ID NO: 1722572 - DNA, 17 bp, Homo sapiens
cttcagacccagagaag

SEQ ID NO: 1722573 - DNA, 14 bp, Homo sapiens
cttcagactcaagt

SEQ ID NO: 1722574 - DNA, 23 bp, Homo sapiens
cttcagagcaaaagacttgagcc

SEQ ID NO: 1722575 - DNA, 12 bp, Homo sapiens
cttcagagccta

SEQ ID NO: 1722576 - DNA, 16 bp, Homo sapiens
cttcagagcctagcca

SEQ ID NO: 1722577 - DNA, 22 bp, Homo sapiens
cttcagagcctagccacctccc

SEQ ID NO: 1722578 - DNA, 23 bp, Homo sapiens
cttcagagcctagccacctccca

SEQ ID NO: 1722579 - DNA, 11 bp, Homo sapiens
cttcagagctc

SEQ ID NO: 1722580 - DNA, 13 bp, Homo sapiens
cttcagagctctt

SEQ ID NO: 1722581 - DNA, 10 bp, Homo sapiens
cttcagaggc

SEQ ID NO: 1722582 - DNA, 18 bp, Homo sapiens
cttcagaggcctggcatc

SEQ ID NO: 1722583 - DNA, 23 bp, Homo sapiens
cttcagagtcctcattataaaat

SEQ ID NO: 1722584 - DNA, 23 bp, Homo sapiens
cttcagagtttgtcatatactgc

SEQ ID NO: 1722585 - DNA, 17 bp, Homo sapiens
cttcagagtttgtgtgt

SEQ ID NO: 1722586 - DNA, 18 bp, Homo sapiens
cttcagagtttgtgtgta

SEQ ID NO: 1722587 - DNA, 21 bp, Homo sapiens
cttcagagtttgtgtgtattt

SEQ ID NO: 1722588 - DNA, 19 bp, Homo sapiens
cttcagatattattgcttt

SEQ ID NO: 1722589 - DNA, 17 bp, Homo sapiens
cttcagatcagtgcttg

SEQ ID NO: 1722590 - DNA, 20 bp, Homo sapiens
cttcagatcagtgcttgagt

SEQ ID NO: 1722591 - DNA, 17 bp, Homo sapiens
cttcagatgccacttct

SEQ ID NO: 1722592 - DNA, 20 bp, Homo sapiens
cttcagcaagttagaactag

SEQ ID NO: 1722593 - DNA, 18 bp, Homo sapiens
cttcagcatatttatagc

SEQ ID NO: 1722594 - DNA, 18 bp, Homo sapiens
cttcagcccaccaccctg

SEQ ID NO: 1722595 - DNA, 15 bp, Homo sapiens
cttcagcccaggctt

SEQ ID NO: 1722596 - DNA, 22 bp, Homo sapiens
cttcagcccaggcttttgctag

SEQ ID NO: 1722597 - DNA, 15 bp, Homo sapiens
cttcagcccccacca

SEQ ID NO: 1722598 - DNA, 16 bp, Homo sapiens
cttcagcccccaccag

SEQ ID NO: 1722599 - DNA, 17 bp, Homo sapiens
cttcagccctcacccct

SEQ ID NO: 1722600 - DNA, 14 bp, Homo sapiens
cttcagcctgaggc

SEQ ID NO: 1722601 - DNA, 16 bp, Homo sapiens
cttcagcctgaggctg

SEQ ID NO: 1722602 - DNA, 20 bp, Homo sapiens
cttcagcctgaggctgagac

SEQ ID NO: 1722603 - DNA, 20 bp, Homo sapiens
cttcagctagcttttaggaa

SEQ ID NO: 1722604 - DNA, 21 bp, Homo sapiens
cttcagctcaactcacagctt

SEQ ID NO: 1722605 - DNA, 17 bp, Homo sapiens
cttcaggaacaagtaat

SEQ ID NO: 1722606 - DNA, 23 bp, Homo sapiens
cttcaggatattggttcttcccc

SEQ ID NO: 1722607 - DNA, 12 bp, Homo sapiens
cttcaggcctcc

SEQ ID NO: 1722608 - DNA, 15 bp, Homo sapiens
cttcaggcctccctc

SEQ ID NO: 1722609 - DNA, 21 bp, Homo sapiens
ctgtatgatttaggcttctat

SEQ ID NO: 1722610 - DNA, 18 bp, Homo sapiens
ctgtatgatttgttttga

SEQ ID NO: 1722611 - DNA, 16 bp, Homo sapiens
ctgtatgctgatcatc

SEQ ID NO: 1722612 - DNA, 19 bp, Homo sapiens
ctgtatgtgctgtaattta

SEQ ID NO: 1722613 - DNA, 15 bp, Homo sapiens
ctgtatgttgtccaa

SEQ ID NO: 1722614 - DNA, 18 bp, Homo sapiens
ctgtatgttgtccaattg

SEQ ID NO: 1722615 - DNA, 20 bp, Homo sapiens
ctgtattaaatcttaaacaa

SEQ ID NO: 1722616 - DNA, 23 bp, Homo sapiens
ctgtattaatccccatcattact

SEQ ID NO: 1722617 - DNA, 16 bp, Homo sapiens
ctgtattcgtgcattt

SEQ ID NO: 1722618 - DNA, 19 bp, Homo sapiens
ctgtattcttgtttgaatt

SEQ ID NO: 1722619 - DNA, 14 bp, Homo sapiens
ctgtatttaatttt

SEQ ID NO: 1722620 - DNA, 23 bp, Homo sapiens
ctgtatttatgtgtgaggagctg

SEQ ID NO: 1722621 - DNA, 14 bp, Homo sapiens
ctgtatttcctgct

SEQ ID NO: 1722622 - DNA, 18 bp, Homo sapiens
ctgtatttcctgcttccc

SEQ ID NO: 1722623 - DNA, 12 bp, Homo sapiens
ctgtatttcctt

SEQ ID NO: 1722624 - DNA, 22 bp, Homo sapiens
ctgtatttgaaataagaattca

SEQ ID NO: 1722625 - DNA, 16 bp, Homo sapiens
ctgtatttgagagact

SEQ ID NO: 1722626 - DNA, 16 bp, Homo sapiens
ctgtatttgctgttga

SEQ ID NO: 1722627 - DNA, 19 bp, Homo sapiens
ctgtattttaacactttgt

SEQ ID NO: 1722628 - DNA, 20 bp, Homo sapiens
ctgtattttaacactttgta

SEQ ID NO: 1722629 - DNA, 23 bp, Homo sapiens
ctgtattttaacactttgtatta

SEQ ID NO: 1722630 - DNA, 14 bp, Homo sapiens
ctgtattttaatgt

SEQ ID NO: 1722631 - DNA, 15 bp, Homo sapiens
ctgtattttctttta

SEQ ID NO: 1722632 - DNA, 16 bp, Homo sapiens
ctgtattttgccagac

SEQ ID NO: 1722633 - DNA, 21 bp, Homo sapiens
ctgtatttttttttctaagag

SEQ ID NO: 1722634 - DNA, 22 bp, Homo sapiens
ctgtatttttttttctaagaga

SEQ ID NO: 1722635 - DNA, 22 bp, Homo sapiens
ctgtcaaaactactgacaggga

SEQ ID NO: 1722636 - DNA, 21 bp, Homo sapiens
ctgtcaatatcgtacctgtcc

SEQ ID NO: 1722637 - DNA, 23 bp, Homo sapiens
ctgtcaccaagctcacagttcct

SEQ ID NO: 1722638 - DNA, 16 bp, Homo sapiens
ctgtcaccaccctgct

SEQ ID NO: 1722639 - DNA, 23 bp, Homo sapiens
ctgtcaccaccctgctcatccac

SEQ ID NO: 1722640 - DNA, 13 bp, Homo sapiens
ctgtcaccagagc

SEQ ID NO: 1722641 - DNA, 19 bp, Homo sapiens
ctgtcaccagagcttctct

SEQ ID NO: 1722642 - DNA, 18 bp, Homo sapiens
ctgtcacctagaacgtgc

SEQ ID NO: 1722643 - DNA, 17 bp, Homo sapiens
ctgtcacgctcatgtcc

SEQ ID NO: 1722644 - DNA, 18 bp, Homo sapiens
ctgtcacgctctggtgca

SEQ ID NO: 1722645 - DNA, 16 bp, Homo sapiens
ctgtcacgtgaaatat

SEQ ID NO: 1722646 - DNA, 15 bp, Homo sapiens
ctgtcactcagctga

SEQ ID NO: 1722647 - DNA, 23 bp, Homo sapiens
ctgtcactcattgctgagcctct

SEQ ID NO: 1722648 - DNA, 13 bp, Homo sapiens
ctgtcactgtggg

SEQ ID NO: 1722649 - DNA, 17 bp, Homo sapiens
ctgtcacttcttcacct

SEQ ID NO: 1722650 - DNA, 23 bp, Homo sapiens
ctgtcacttcttcacctcttcca

SEQ ID NO: 1722651 - DNA, 22 bp, Homo sapiens
ctgtcactttttttctttttct

SEQ ID NO: 1722652 - DNA, 14 bp, Homo sapiens
ctgtcagagccgcc

SEQ ID NO: 1722653 - DNA, 13 bp, Homo sapiens
ctgtcagaggcta

SEQ ID NO: 1722654 - DNA, 22 bp, Homo sapiens
ctgtcagatgggaagacatgaa

SEQ ID NO: 1722655 - DNA, 14 bp, Homo sapiens
ctgtcagatgtcac

SEQ ID NO: 1722656 - DNA, 15 bp, Homo sapiens
ctgtcagatgtcaca

SEQ ID NO: 1722657 - DNA, 14 bp, Homo sapiens
ctgtcagcatctgg

SEQ ID NO: 1722658 - DNA, 17 bp, Homo sapiens
ctgtcagccgggccctg

SEQ ID NO: 1722659 - DNA, 22 bp, Homo sapiens
ctgtcagccgggccctgagtaa

SEQ ID NO: 1722660 - DNA, 16 bp, Homo sapiens
ctgtcagctgagcttg

SEQ ID NO: 1722661 - DNA, 13 bp, Homo sapiens
ctgtcaggaagaa

SEQ ID NO: 1722662 - DNA, 18 bp, Homo sapiens
ctgtcaggaagaaatcac

SEQ ID NO: 1722663 - DNA, 13 bp, Homo sapiens
ctgtcaggaatgg

SEQ ID NO: 1722664 - DNA, 16 bp, Homo sapiens
ctgtcaggccttcagg

SEQ ID NO: 1722665 - DNA, 18 bp, Homo sapiens
ctgtcagtggggcagcct

SEQ ID NO: 1722666 - DNA, 22 bp, Homo sapiens
ctgtcagtggggcagcctctcc

SEQ ID NO: 1722667 - DNA, 22 bp, Homo sapiens
ctgtcataagcattactttata

SEQ ID NO: 1722668 - DNA, 19 bp, Homo sapiens
ctgtcatcactccctggat

SEQ ID NO: 1722669 - DNA, 20 bp, Homo sapiens
ctgtcatcactccctggatg

SEQ ID NO: 1722670 - DNA, 22 bp, Homo sapiens
ctgtcatcctcaaagaaagtgt

SEQ ID NO: 1722671 - DNA, 23 bp, Homo sapiens
ctgtcatcctcaaagaaagtgta

SEQ ID NO: 1722672 - DNA, 14 bp, Homo sapiens
ctgtcatctaaagt

SEQ ID NO: 1722673 - DNA, 20 bp, Homo sapiens
ctgtcatgaaatcagcaaga

SEQ ID NO: 1722674 - DNA, 21 bp, Homo sapiens
ctgtcatgaaatcagcaagag

SEQ ID NO: 1722675 - DNA, 15 bp, Homo sapiens
ctgtcatgaacatgt

SEQ ID NO: 1722676 - DNA, 19 bp, Homo sapiens
ctgtcatgaacatgttcct

SEQ ID NO: 1722677 - DNA, 13 bp, Homo sapiens
ctgtcattagtct

SEQ ID NO: 1722678 - DNA, 15 bp, Homo sapiens
ctgtcattatttcct

SEQ ID NO: 1722679 - DNA, 23 bp, Homo sapiens
ctgtcattttcacaatcttgggg

SEQ ID NO: 1722680 - DNA, 12 bp, Homo sapiens
ctgtcattttgc

SEQ ID NO: 1722681 - DNA, 15 bp, Homo sapiens
ctgtcattttgcact

SEQ ID NO: 1722682 - DNA, 18 bp, Homo sapiens
ctgtcattttgcactgta

SEQ ID NO: 1722683 - DNA, 17 bp, Homo sapiens
ctgtccaaaggaggctg

SEQ ID NO: 1722684 - DNA, 20 bp, Homo sapiens
ctgtccaaaggaggctggca

SEQ ID NO: 1722685 - DNA, 23 bp, Homo sapiens
ctgtccacatccccagagcccag

SEQ ID NO: 1722686 - DNA, 15 bp, Homo sapiens
ctgtccacatgacct

SEQ ID NO: 1722687 - DNA, 17 bp, Homo sapiens
ctgtccacatgacctcc

SEQ ID NO: 1722688 - DNA, 18 bp, Homo sapiens
ctgtccacatgacctcca

SEQ ID NO: 1722689 - DNA, 19 bp, Homo sapiens
ctgtccacatgacctccat

SEQ ID NO: 1722690 - DNA, 20 bp, Homo sapiens
ctgtccacatgacctccatt

SEQ ID NO: 1722691 - DNA, 13 bp, Homo sapiens
ctgtccaccctgc

SEQ ID NO: 1722692 - DNA, 23 bp, Homo sapiens
ctgtccaccctgccaagactcct

SEQ ID NO: 1722693 - DNA, 14 bp, Homo sapiens
ctgtccactctcgg

SEQ ID NO: 1722694 - DNA, 17 bp, Homo sapiens
ctgtccagcctgggcag

SEQ ID NO: 1722695 - DNA, 14 bp, Homo sapiens
ctgtccagctccaa

SEQ ID NO: 1722696 - DNA, 17 bp, Homo sapiens
ctgtccagctccaacct

SEQ ID NO: 1722697 - DNA, 21 bp, Homo sapiens
ctgtccagctcccgctgtggc

SEQ ID NO: 1722698 - DNA, 22 bp, Homo sapiens
ctgtccaggcagctccctcctg

SEQ ID NO: 1722699 - DNA, 13 bp, Homo sapiens
ctgtccaggccac

SEQ ID NO: 1722700 - DNA, 22 bp, Homo sapiens
ctgtccaggccactgtggccag

SEQ ID NO: 1722701 - DNA, 19 bp, Homo sapiens
ctgtccagggccctgagct

SEQ ID NO: 1722702 - DNA, 23 bp, Homo sapiens
ctgtccagggccctgagctcggt

SEQ ID NO: 1722703 - DNA, 20 bp, Homo sapiens
ctgtccagttcctttagaaa

SEQ ID NO: 1722704 - DNA, 22 bp, Homo sapiens
ctgtccatgtattcacacaccc

SEQ ID NO: 1722705 - DNA, 21 bp, Homo sapiens
ctgtcccacaaaatatttcta

SEQ ID NO: 1722706 - DNA, 22 bp, Homo sapiens
ctgtcccacaaaatatttctaa

SEQ ID NO: 1722707 - DNA, 13 bp, Homo sapiens
ctgtcccagagct

SEQ ID NO: 1722708 - DNA, 12 bp, Homo sapiens
ctgtcccagagg

SEQ ID NO: 1722709 - DNA, 13 bp, Homo sapiens
ctgtcccagaggt

SEQ ID NO: 1722710 - DNA, 21 bp, Homo sapiens
ctgtcccagggccctcccagc

SEQ ID NO: 1722711 - DNA, 13 bp, Homo sapiens
ctgtcccagttgt

SEQ ID NO: 1722712 - DNA, 17 bp, Homo sapiens
ctgtcccagttgtggca

SEQ ID NO: 1722713 - DNA, 14 bp, Homo sapiens
ctgtcccccagctc

SEQ ID NO: 1722714 - DNA, 17 bp, Homo sapiens
ctgtcccccagctctgg

SEQ ID NO: 1722715 - DNA, 23 bp, Homo sapiens
ctgtccccgcagccctggcaggg

SEQ ID NO: 1722716 - DNA, 12 bp, Homo sapiens
ctgtcccctcag

SEQ ID NO: 1722717 - DNA, 16 bp, Homo sapiens
ctgtccccttctctca

SEQ ID NO: 1722718 - DNA, 15 bp, Homo sapiens
ctgtcccgccttcct

SEQ ID NO: 1722719 - DNA, 21 bp, Homo sapiens
ctgtcccgccttcctcctcca

SEQ ID NO: 1722720 - DNA, 12 bp, Homo sapiens
ctgtccctcact

SEQ ID NO: 1722721 - DNA, 13 bp, Homo sapiens
ctgtccctccagg

SEQ ID NO: 1722722 - DNA, 16 bp, Homo sapiens
ctgtccctctcagtgc

SEQ ID NO: 1722723 - DNA, 15 bp, Homo sapiens
ctgtccctgaaacct

SEQ ID NO: 1722724 - DNA, 19 bp, Homo sapiens
ctgtccctgaactcccaga

SEQ ID NO: 1722725 - DNA, 21 bp, Homo sapiens
ctgttatttatcaatttttcc

SEQ ID NO: 1722726 - DNA, 22 bp, Homo sapiens
ctgttatttcttccctgctttg

SEQ ID NO: 1722727 - DNA, 23 bp, Homo sapiens
ctgttatttttacagcaaaagat

SEQ ID NO: 1722728 - DNA, 17 bp, Homo sapiens
ctgttcaatgtttaatg

SEQ ID NO: 1722729 - DNA, 22 bp, Homo sapiens
ctgttcacaaactacctctgga

SEQ ID NO: 1722730 - DNA, 16 bp, Homo sapiens
ctgttcacagaaaaag

SEQ ID NO: 1722731 - DNA, 12 bp, Homo sapiens
ctgttcacccac

SEQ ID NO: 1722732 - DNA, 18 bp, Homo sapiens
ctgttcacccacagggct

SEQ ID NO: 1722733 - DNA, 11 bp, Homo sapiens
ctgtgaaatac

SEQ ID NO: 1722734 - DNA, 20 bp, Homo sapiens
ctgtgaaataccacaagcct

SEQ ID NO: 1722735 - DNA, 16 bp, Homo sapiens
ctgtgaaattctcaga

SEQ ID NO: 1722736 - DNA, 18 bp, Homo sapiens
ctgtgaacagcttgctgt

SEQ ID NO: 1722737 - DNA, 19 bp, Homo sapiens
ctgtgaaccaacccccatc

SEQ ID NO: 1722738 - DNA, 22 bp, Homo sapiens
ctgtgaaccaacccccatctcc

SEQ ID NO: 1722739 - DNA, 19 bp, Homo sapiens
ctgtgaaccctggggcctg

SEQ ID NO: 1722740 - DNA, 19 bp, Homo sapiens
ctgtgaacttgactgggtg

SEQ ID NO: 1722741 - DNA, 18 bp, Homo sapiens
ctgtgaagacccagcagg

SEQ ID NO: 1722742 - DNA, 19 bp, Homo sapiens
ctgtgaagacccagcagga

SEQ ID NO: 1722743 - DNA, 20 bp, Homo sapiens
ctgtgaagacccagcaggaa

SEQ ID NO: 1722744 - DNA, 15 bp, Homo sapiens
ctgtgaagagaatgt

SEQ ID NO: 1722745 - DNA, 21 bp, Homo sapiens
ctgtgaagagccggtggtgcc

SEQ ID NO: 1722746 - DNA, 14 bp, Homo sapiens
ctgtgaagcctctc

SEQ ID NO: 1722747 - DNA, 20 bp, Homo sapiens
ctgtgaagtaacccctcctg

SEQ ID NO: 1722748 - DNA, 18 bp, Homo sapiens
ctgtgaagtttacattgt

SEQ ID NO: 1722749 - DNA, 23 bp, Homo sapiens
ctgtgaagtttacattgtaaata

SEQ ID NO: 1722750 - DNA, 16 bp, Homo sapiens
ctgtgaatcctggcaa

SEQ ID NO: 1722751 - DNA, 18 bp, Homo sapiens
ctgtgaatcctggcaaga

SEQ ID NO: 1722752 - DNA, 21 bp, Homo sapiens
ctgtgaatcctggcaagaaag

SEQ ID NO: 1722753 - DNA, 15 bp, Homo sapiens
ctgtgcctgggccct

SEQ ID NO: 1722754 - DNA, 23 bp, Homo sapiens
ctgtgccttggtctctccttcct

SEQ ID NO: 1722755 - DNA, 20 bp, Homo sapiens
ctgtgcgccttgtagaatgc

SEQ ID NO: 1722756 - DNA, 16 bp, Homo sapiens
ctgtgcgtcccagctg

SEQ ID NO: 1722757 - DNA, 17 bp, Homo sapiens
ctgtgcgtcccagctga

SEQ ID NO: 1722758 - DNA, 21 bp, Homo sapiens
ctgtgcgtcttggtgtaattt

SEQ ID NO: 1722759 - DNA, 22 bp, Homo sapiens
ctgtgcgtcttggtgtaatttg

SEQ ID NO: 1722760 - DNA, 18 bp, Homo sapiens
ctgtgctaatcaaaactt

SEQ ID NO: 1722761 - DNA, 21 bp, Homo sapiens
ctgtgctagggaaacttcccg

SEQ ID NO: 1722762 - DNA, 15 bp, Homo sapiens
ctgtgctatgaattt

SEQ ID NO: 1722763 - DNA, 17 bp, Homo sapiens
ctgtgctatttgtacaa

SEQ ID NO: 1722764 - DNA, 18 bp, Homo sapiens
ctgtgctatttgtacaaa

SEQ ID NO: 1722765 - DNA, 20 bp, Homo sapiens
ctgtgctatttgtacaaata

SEQ ID NO: 1722766 - DNA, 18 bp, Homo sapiens
ctgtgctcatcggagact

SEQ ID NO: 1722767 - DNA, 14 bp, Homo sapiens
ctgtgctccaacct

SEQ ID NO: 1722768 - DNA, 18 bp, Homo sapiens
ctgtgctcccctgccaca

SEQ ID NO: 1722769 - DNA, 16 bp, Homo sapiens
ctgtgtacctctagaa

SEQ ID NO: 1722770 - DNA, 15 bp, Homo sapiens
ctgtgtactctttat

SEQ ID NO: 1722771 - DNA, 11 bp, Homo sapiens
ctgtgtactgt

SEQ ID NO: 1722772 - DNA, 13 bp, Homo sapiens
ctgtgtactgttc

SEQ ID NO: 1722773 - DNA, 17 bp, Homo sapiens
ctgtgtagccgccctga

SEQ ID NO: 1722774 - DNA, 21 bp, Homo sapiens
ctgtgtatatggtatatatac

SEQ ID NO: 1722775 - DNA, 13 bp, Homo sapiens
ctgtgtatgtaca

SEQ ID NO: 1722776 - DNA, 18 bp, Homo sapiens
ctgtgtatgtacatatat

SEQ ID NO: 1722777 - DNA, 14 bp, Homo sapiens
ctgtgtatttgctt

SEQ ID NO: 1722778 - DNA, 16 bp, Homo sapiens
ctgtgtatttgctttt

SEQ ID NO: 1722779 - DNA, 14 bp, Homo sapiens
ctgtgtccagagac

SEQ ID NO: 1722780 - DNA, 19 bp, Homo sapiens
ctgtgtccagagacatggg

SEQ ID NO: 1722781 - DNA, 15 bp, Homo sapiens
ctgtgtccagcagct

SEQ ID NO: 1722782 - DNA, 18 bp, Homo sapiens
ctgtgtccagcagctgcg

SEQ ID NO: 1722783 - DNA, 22 bp, Homo sapiens
ctgtgtccatgcgctcagggcc

SEQ ID NO: 1722784 - DNA, 15 bp, Homo sapiens
ctgtgtcccagccac

SEQ ID NO: 1722785 - DNA, 22 bp, Homo sapiens
ctgtgtcccagccacgcagggc

SEQ ID NO: 1722786 - DNA, 16 bp, Homo sapiens
ctgtgtcccttttgca

SEQ ID NO: 1722787 - DNA, 17 bp, Homo sapiens
ctgtgtcctccaccatg

SEQ ID NO: 1722788 - DNA, 18 bp, Homo sapiens
ctgtgtcctgatggccca

SEQ ID NO: 1722789 - DNA, 19 bp, Homo sapiens
ctgtgtcctggtgctctct

SEQ ID NO: 1722790 - DNA, 20 bp, Homo sapiens
ctgtgtcctggtgctctctg

SEQ ID NO: 1722791 - DNA, 23 bp, Homo sapiens
ctgtgtcctggtgctctctgcca

SEQ ID NO: 1722792 - DNA, 16 bp, Homo sapiens
ctgtgtccttgcacct

SEQ ID NO: 1722793 - DNA, 19 bp, Homo sapiens
ctgtgtccttgcacctgca

SEQ ID NO: 1722794 - DNA, 16 bp, Homo sapiens
ctgtgtctaagattct

SEQ ID NO: 1722795 - DNA, 17 bp, Homo sapiens
ctgtgtctaagattcta

SEQ ID NO: 1722796 - DNA, 18 bp, Homo sapiens
ctgtgtctaagattctag

SEQ ID NO: 1722797 - DNA, 20 bp, Homo sapiens
ctgtgtctggcgttctcaag

SEQ ID NO: 1722798 - DNA, 21 bp, Homo sapiens
ctgtgtctggcgttctcaaga

SEQ ID NO: 1722799 - DNA, 14 bp, Homo sapiens
ctgtgtcttcattt

SEQ ID NO: 1722800 - DNA, 19 bp, Homo sapiens
ctgtgtgaaataccagtgt

SEQ ID NO: 1722801 - DNA, 20 bp, Homo sapiens
ctgtgtgaatccaggaggca

SEQ ID NO: 1722802 - DNA, 23 bp, Homo sapiens
ctgtgtgagtgagcacacccgtg

SEQ ID NO: 1722803 - DNA, 15 bp, Homo sapiens
ctgtgtgagttgagt

SEQ ID NO: 1722804 - DNA, 13 bp, Homo sapiens
ctgtgtgccccac

SEQ ID NO: 1722805 - DNA, 14 bp, Homo sapiens
ctgtgtgccccact

SEQ ID NO: 1722806 - DNA, 18 bp, Homo sapiens
ctgtgtgccccactccag

SEQ ID NO: 1722807 - DNA, 18 bp, Homo sapiens
ctgtgtgctcctccttgg

SEQ ID NO: 1722808 - DNA, 15 bp, Homo sapiens
ctgtgtgcttggtct

SEQ ID NO: 1722809 - DNA, 20 bp, Homo sapiens
ctgtgtgctttttttgtgtg

SEQ ID NO: 1722810 - DNA, 16 bp, Homo sapiens
ctgtgtggactgtgat

SEQ ID NO: 1722811 - DNA, 18 bp, Homo sapiens
ctgtgtggactgtgatgc

SEQ ID NO: 1722812 - DNA, 16 bp, Homo sapiens
ctgtgtggagagggaa

SEQ ID NO: 1722813 - DNA, 22 bp, Homo sapiens
ctgtgtggagagggaatgtgaa

SEQ ID NO: 1722814 - DNA, 13 bp, Homo sapiens
ctgtgtggctcct

SEQ ID NO: 1722815 - DNA, 18 bp, Homo sapiens
ctgtgtggctcctgggcc

SEQ ID NO: 1722816 - DNA, 18 bp, Homo sapiens
ctgtgtggtggagccagg

SEQ ID NO: 1722817 - DNA, 14 bp, Homo sapiens
ctgtgtgtgccctg

SEQ ID NO: 1722818 - DNA, 18 bp, Homo sapiens
ctgtgtgttagttcccaa

SEQ ID NO: 1722819 - DNA, 21 bp, Homo sapiens
ctgtgtgttagttcccaacat

SEQ ID NO: 1722820 - DNA, 16 bp, Homo sapiens
ctgtgtgtttatgtgt

SEQ ID NO: 1722821 - DNA, 17 bp, Homo sapiens
ctgtgtgtttatgtgtg

SEQ ID NO: 1722822 - DNA, 18 bp, Homo sapiens
ctgtgtgtttatgtgtgt

SEQ ID NO: 1722823 - DNA, 20 bp, Homo sapiens
ctgtgtgtttatgtgtgtgt

SEQ ID NO: 1722824 - DNA, 23 bp, Homo sapiens
ctgtgttcaagcgattctcctgt

SEQ ID NO: 1722825 - DNA, 13 bp, Homo sapiens
ctgtgttcatttt

SEQ ID NO: 1722826 - DNA, 14 bp, Homo sapiens
ctgtgttgccaagc

SEQ ID NO: 1722827 - DNA, 17 bp, Homo sapiens
ctgtgttgccaagctcc

SEQ ID NO: 1722828 - DNA, 19 bp, Homo sapiens
ctgtgttgccaagctccaa

SEQ ID NO: 1722829 - DNA, 18 bp, Homo sapiens
ctgtgttgcgtgtcgtgg

SEQ ID NO: 1722830 - DNA, 17 bp, Homo sapiens
ctgtgtttataaaatat

SEQ ID NO: 1722831 - DNA, 16 bp, Homo sapiens
ctgtgtttatatggaa

SEQ ID NO: 1722832 - DNA, 21 bp, Homo sapiens
ctgtgtttcgcattaagcaca

SEQ ID NO: 1722833 - DNA, 15 bp, Homo sapiens
ctgtgtttctggagt

SEQ ID NO: 1722834 - DNA, 15 bp, Homo sapiens
ctgtgtttgcagcct

SEQ ID NO: 1722835 - DNA, 23 bp, Homo sapiens
ctgtgtttgcagcctgctctagt

SEQ ID NO: 1722836 - DNA, 23 bp, Homo sapiens
ctgtgtttgcattgtctaatgac

SEQ ID NO: 1722837 - DNA, 18 bp, Homo sapiens
ctgtgttttataaaatag

SEQ ID NO: 1722838 - DNA, 16 bp, Homo sapiens
ctgtgttttgaaagaa

SEQ ID NO: 1722839 - DNA, 22 bp, Homo sapiens
ctgtgttttgaatggtgttgta

SEQ ID NO: 1722840 - DNA, 15 bp, Homo sapiens
ctgtgtttttgaaat

SEQ ID NO: 1722841 - DNA, 13 bp, Homo sapiens
ctgttaaaacaac

SEQ ID NO: 1722842 - DNA, 23 bp, Homo sapiens
ctgttaaaagatgaaaatatttg

SEQ ID NO: 1722843 - DNA, 15 bp, Homo sapiens
ctgttaaatacagga

SEQ ID NO: 1722844 - DNA, 13 bp, Homo sapiens
ctgttaacatcta

SEQ ID NO: 1722845 - DNA, 20 bp, Homo sapiens
ctgttaacgtcatctcaggg

SEQ ID NO: 1722846 - DNA, 12 bp, Homo sapiens
ctgttacaaaag

SEQ ID NO: 1722847 - DNA, 17 bp, Homo sapiens
ctgttacaaaagaaaaa

SEQ ID NO: 1722848 - DNA, 13 bp, Homo sapiens
ctgttacactggg

SEQ ID NO: 1722849 - DNA, 15 bp, Homo sapiens
ctgttacactgggct

SEQ ID NO: 1722850 - DNA, 18 bp, Homo sapiens
ctgttacactgggctggg

SEQ ID NO: 1722851 - DNA, 19 bp, Homo sapiens
ctgttacccagggctctgc

SEQ ID NO: 1722852 - DNA, 23 bp, Homo sapiens
ctgttacccagggctctgcagca

SEQ ID NO: 1722853 - DNA, 15 bp, Homo sapiens
ctgttactccacagc

SEQ ID NO: 1722854 - DNA, 17 bp, Homo sapiens
ctgttactccacagcgg

SEQ ID NO: 1722855 - DNA, 16 bp, Homo sapiens
ctgttactgggccctg

SEQ ID NO: 1722856 - DNA, 20 bp, Homo sapiens
ctgttactgggccctgagtc

SEQ ID NO: 1722857 - DNA, 15 bp, Homo sapiens
ctgttacttacctaa

SEQ ID NO: 1722858 - DNA, 16 bp, Homo sapiens
ctgttacttgcttcag

SEQ ID NO: 1722859 - DNA, 19 bp, Homo sapiens
ctgttacttgcttcagtgg

SEQ ID NO: 1722860 - DNA, 23 bp, Homo sapiens
ctgttagctccctgtggggcagg

SEQ ID NO: 1722861 - DNA, 13 bp, Homo sapiens
ctgttagtcattt

SEQ ID NO: 1722862 - DNA, 14 bp, Homo sapiens
ctgttagtcatttg

SEQ ID NO: 1722863 - DNA, 18 bp, Homo sapiens
ctgttagtcatttgctga

SEQ ID NO: 1722864 - DNA, 13 bp, Homo sapiens
ctgttagtgacag

SEQ ID NO: 1722865 - DNA, 22 bp, Homo sapiens
ctgttagtgttaaaaatctagt

SEQ ID NO: 1722866 - DNA, 21 bp, Homo sapiens
ctgttataggtcctttagaaa

SEQ ID NO: 1722867 - DNA, 19 bp, Homo sapiens
ctgttatcaaaactttctt

SEQ ID NO: 1722868 - DNA, 20 bp, Homo sapiens
ctgttatgcactgtggtttc

SEQ ID NO: 1722869 - DNA, 19 bp, Homo sapiens
ctgttatgctgtgacacat

SEQ ID NO: 1722870 - DNA, 14 bp, Homo sapiens
ctgttattctttgc

SEQ ID NO: 1722871 - DNA, 15 bp, Homo sapiens
ctgttattctttgca

SEQ ID NO: 1722872 - DNA, 23 bp, Homo sapiens
ctgtcctgggcgccctggaagcc

SEQ ID NO: 1722873 - DNA, 12 bp, Homo sapiens
ctgtcctggtgg

SEQ ID NO: 1722874 - DNA, 21 bp, Homo sapiens
ctgtcctggtggctgggccca

SEQ ID NO: 1722875 - DNA, 23 bp, Homo sapiens
ctgtcctggtggctgggcccagc

SEQ ID NO: 1722876 - DNA, 16 bp, Homo sapiens
ctgtccttccctgcca

SEQ ID NO: 1722877 - DNA, 17 bp, Homo sapiens
ctgtccttccctgccac

SEQ ID NO: 1722878 - DNA, 18 bp, Homo sapiens
ctgtccttgaaaaacaaa

SEQ ID NO: 1722879 - DNA, 16 bp, Homo sapiens
ctgtccttgcacactc

SEQ ID NO: 1722880 - DNA, 14 bp, Homo sapiens
ctgtccttttagga

SEQ ID NO: 1722881 - DNA, 13 bp, Homo sapiens
ctgtcgagacact

SEQ ID NO: 1722882 - DNA, 13 bp, Homo sapiens
ctgtcgcccagtg

SEQ ID NO: 1722883 - DNA, 13 bp, Homo sapiens
ctgtcgctgcctc

SEQ ID NO: 1722884 - DNA, 18 bp, Homo sapiens
ctgtcgctgcctccatgg

SEQ ID NO: 1722885 - DNA, 16 bp, Homo sapiens
ctgtcgtgccagtcct

SEQ ID NO: 1722886 - DNA, 20 bp, Homo sapiens
ctgtctacatttctgcagat

SEQ ID NO: 1722887 - DNA, 14 bp, Homo sapiens
ctgtctagaatgtg

SEQ ID NO: 1722888 - DNA, 15 bp, Homo sapiens
ctgtctagaatgtgg

SEQ ID NO: 1722889 - DNA, 16 bp, Homo sapiens
ctgtctagaatgtgga

SEQ ID NO: 1722890 - DNA, 15 bp, Homo sapiens
ctgtctagactggcc

SEQ ID NO: 1722891 - DNA, 18 bp, Homo sapiens
ctgtctaggactgcagtg

SEQ ID NO: 1722892 - DNA, 17 bp, Homo sapiens
ctgtctaggtctcctca

SEQ ID NO: 1722893 - DNA, 21 bp, Homo sapiens
ctgtctaggtctcctcagggt

SEQ ID NO: 1722894 - DNA, 16 bp, Homo sapiens
ctgtctattaaaattc

SEQ ID NO: 1722895 - DNA, 13 bp, Homo sapiens
ctgtctcaaaaaa

SEQ ID NO: 1722896 - DNA, 18 bp, Homo sapiens
ctgtctcaagagggcact

SEQ ID NO: 1722897 - DNA, 21 bp, Homo sapiens
ctgtctcaagagggcactggt

SEQ ID NO: 1722898 - DNA, 14 bp, Homo sapiens
ctgtctcagcctcc

SEQ ID NO: 1722899 - DNA, 15 bp, Homo sapiens
ctgtctcagcctccc

SEQ ID NO: 1722900 - DNA, 17 bp, Homo sapiens
ctgtctcagcctcccag

SEQ ID NO: 1722901 - DNA, 16 bp, Homo sapiens
ctgtctcagcctcctg

SEQ ID NO: 1722902 - DNA, 16 bp, Homo sapiens
ctgtctcatccccagg

SEQ ID NO: 1722903 - DNA, 20 bp, Homo sapiens
ctgtctcatccccaggggtc

SEQ ID NO: 1722904 - DNA, 19 bp, Homo sapiens
ctgtctcatcttctgaaga

SEQ ID NO: 1722905 - DNA, 12 bp, Homo sapiens
ctgtctccagct

SEQ ID NO: 1722906 - DNA, 14 bp, Homo sapiens
ctgtctccagctgc

SEQ ID NO: 1722907 - DNA, 19 bp, Homo sapiens
ctgtctccagctgcctggg

SEQ ID NO: 1722908 - DNA, 19 bp, Homo sapiens
ctgtctcccggctcccctc

SEQ ID NO: 1722909 - DNA, 23 bp, Homo sapiens
ctgtctccctcccctctcagaac

SEQ ID NO: 1722910 - DNA, 14 bp, Homo sapiens
ctgtctcccttctc

SEQ ID NO: 1722911 - DNA, 13 bp, Homo sapiens
ctgtctcctgtct

SEQ ID NO: 1722912 - DNA, 16 bp, Homo sapiens
ctgtctctccatctgt

SEQ ID NO: 1722913 - DNA, 12 bp, Homo sapiens
ctgtctctctgg

SEQ ID NO: 1722914 - DNA, 14 bp, Homo sapiens
ctgtctctctgggc

SEQ ID NO: 1722915 - DNA, 12 bp, Homo sapiens
ctgtctctgcct

SEQ ID NO: 1722916 - DNA, 17 bp, Homo sapiens
ctgtctctgcctgcggc

SEQ ID NO: 1722917 - DNA, 23 bp, Homo sapiens
ctgtctctgttcagatgtgcatt

SEQ ID NO: 1722918 - DNA, 21 bp, Homo sapiens
ctgtctcttaaaaaaataaaa

SEQ ID NO: 1722919 - DNA, 20 bp, Homo sapiens
ctgtctcttcggcagggagg

SEQ ID NO: 1722920 - DNA, 15 bp, Homo sapiens
ctgtctcttttctct

SEQ ID NO: 1722921 - DNA, 19 bp, Homo sapiens
ctgtctgaatattctagaa

SEQ ID NO: 1722922 - DNA, 17 bp, Homo sapiens
ctgtctgccaacctaaa

SEQ ID NO: 1722923 - DNA, 16 bp, Homo sapiens
ctgtctgccagccagc

SEQ ID NO: 1722924 - DNA, 13 bp, Homo sapiens
ctgtctgccccag

SEQ ID NO: 1722925 - DNA, 16 bp, Homo sapiens
ctgtctgcttctctct

SEQ ID NO: 1722926 - DNA, 14 bp, Homo sapiens
ctgtctggccctgg

SEQ ID NO: 1722927 - DNA, 21 bp, Homo sapiens
ctgtctggctcggacccaccc

SEQ ID NO: 1722928 - DNA, 22 bp, Homo sapiens
ctgtctggctcggacccacccc

SEQ ID NO: 1722929 - DNA, 15 bp, Homo sapiens
ctgtctgtgtcccag

SEQ ID NO: 1722930 - DNA, 19 bp, Homo sapiens
ctgtctgtgtcccagccac

SEQ ID NO: 1722931 - DNA, 23 bp, Homo sapiens
ctgtctgtgtcccagccacgcag

SEQ ID NO: 1722932 - DNA, 21 bp, Homo sapiens
ctgtcttaaactaaatgtgca

SEQ ID NO: 1722933 - DNA, 19 bp, Homo sapiens
ctgtcttactattatagca

SEQ ID NO: 1722934 - DNA, 16 bp, Homo sapiens
ctgtcttatcctccac

SEQ ID NO: 1722935 - DNA, 18 bp, Homo sapiens
ctgtcttcacaacagatt

SEQ ID NO: 1722936 - DNA, 13 bp, Homo sapiens
ctgtcttcacatg

SEQ ID NO: 1722937 - DNA, 19 bp, Homo sapiens
ctgtcttcagtctcacaga

SEQ ID NO: 1722938 - DNA, 19 bp, Homo sapiens
ctgtcttcatagcagattt

SEQ ID NO: 1722939 - DNA, 14 bp, Homo sapiens
ctgtcttcctcaaa

SEQ ID NO: 1722940 - DNA, 18 bp, Homo sapiens
ctgtcttcctgcattcac

SEQ ID NO: 1722941 - DNA, 13 bp, Homo sapiens
ctgtcttctgggc

SEQ ID NO: 1722942 - DNA, 14 bp, Homo sapiens
ctgtcttctgggca

SEQ ID NO: 1722943 - DNA, 15 bp, Homo sapiens
ctgtcttgaataaga

SEQ ID NO: 1722944 - DNA, 21 bp, Homo sapiens
ctgtcttgaataagagtgatt

SEQ ID NO: 1722945 - DNA, 12 bp, Homo sapiens
ctgtcttgaatt

SEQ ID NO: 1722946 - DNA, 13 bp, Homo sapiens
ctgtcttgaatta

SEQ ID NO: 1722947 - DNA, 12 bp, Homo sapiens
ctgtcttggcct

SEQ ID NO: 1722948 - DNA, 15 bp, Homo sapiens
ctgtcttggcctccc

SEQ ID NO: 1722949 - DNA, 14 bp, Homo sapiens
ctgtcttggggcca

SEQ ID NO: 1722950 - DNA, 14 bp, Homo sapiens
ctgtctttattctt

SEQ ID NO: 1722951 - DNA, 22 bp, Homo sapiens
ctgtctttcagcattcagtccg

SEQ ID NO: 1722952 - DNA, 12 bp, Homo sapiens
ctgtctttccta

SEQ ID NO: 1722953 - DNA, 21 bp, Homo sapiens
ctgtctttgttgtctccctct

SEQ ID NO: 1722954 - DNA, 16 bp, Homo sapiens
ctgtgaaaatagtgta

SEQ ID NO: 1722955 - DNA, 15 bp, Homo sapiens
ctgtgaaactggcac

SEQ ID NO: 1722956 - DNA, 23 bp, Homo sapiens
tttttggcctgtttgatgtatgt

SEQ ID NO: 1722957 - DNA, 16 bp, Homo sapiens
tttttggctagagttt

SEQ ID NO: 1722958 - DNA, 12 bp, Homo sapiens
tttttggtcaaa

SEQ ID NO: 1722959 - DNA, 10 bp, Homo sapiens
tttttgtaaa

SEQ ID NO: 1722960 - DNA, 21 bp, Homo sapiens
tttttgtaaccatatgattga

SEQ ID NO: 1722961 - DNA, 12 bp, Homo sapiens
tttttgtacttt

SEQ ID NO: 1722962 - DNA, 17 bp, Homo sapiens
tttttgtagcactgaca

SEQ ID NO: 1722963 - DNA, 20 bp, Homo sapiens
tttttgtagcactgacagat

SEQ ID NO: 1722964 - DNA, 21 bp, Homo sapiens
tttttgtagcactgacagatt

SEQ ID NO: 1722965 - DNA, 12 bp, Homo sapiens
tttttgtatctt

SEQ ID NO: 1722966 - DNA, 13 bp, Homo sapiens
tttttgtgtttct

SEQ ID NO: 1722967 - DNA, 22 bp, Homo sapiens
tttttgtgttttgttctttaaa

SEQ ID NO: 1722968 - DNA, 20 bp, Homo sapiens
tttttgttctggtccttttt

SEQ ID NO: 1722969 - DNA, 13 bp, Homo sapiens
tttttgtttgcag

SEQ ID NO: 1722970 - DNA, 17 bp, Homo sapiens
tttttgttttacaatgt

SEQ ID NO: 1722971 - DNA, 14 bp, Homo sapiens
ttttttaaaaatta

SEQ ID NO: 1722972 - DNA, 14 bp, Homo sapiens
ttttttaaaataga

SEQ ID NO: 1722973 - DNA, 19 bp, Homo sapiens
ttttttaaatcttgaccaa

SEQ ID NO: 1722974 - DNA, 10 bp, Homo sapiens
ttttttaaga

SEQ ID NO: 1722975 - DNA, 15 bp, Homo sapiens
ttttttaagcttcag

SEQ ID NO: 1722976 - DNA, 13 bp, Homo sapiens
ttttttaaggttt

SEQ ID NO: 1722977 - DNA, 12 bp, Homo sapiens
ttttttaagtga

SEQ ID NO: 1722978 - DNA, 12 bp, Homo sapiens
ttttttaatgta

SEQ ID NO: 1722979 - DNA, 12 bp, Homo sapiens
ttttttaattta

SEQ ID NO: 1722980 - DNA, 11 bp, Homo sapiens
ttttttatact

SEQ ID NO: 1722981 - DNA, 15 bp, Homo sapiens
ttttttatgttttgt

SEQ ID NO: 1722982 - DNA, 19 bp, Homo sapiens
ttttttcattttgttctgt

SEQ ID NO: 1722983 - DNA, 12 bp, Homo sapiens
ttttttctaaga

SEQ ID NO: 1722984 - DNA, 15 bp, Homo sapiens
ttttttctaagagaa

SEQ ID NO: 1722985 - DNA, 16 bp, Homo sapiens
ttttttgaatccaaat

SEQ ID NO: 1722986 - DNA, 20 bp, Homo sapiens
ttttttgggttaaaagatgg

SEQ ID NO: 1722987 - DNA, 13 bp, Homo sapiens
ttttttgtaaact

SEQ ID NO: 1722988 - DNA, 14 bp, Homo sapiens
ttttttgtaccatt

SEQ ID NO: 1722989 - DNA, 16 bp, Homo sapiens
ttttgacactatatct

SEQ ID NO: 1722990 - DNA, 11 bp, Homo sapiens
ttttgacagaa

SEQ ID NO: 1722991 - DNA, 22 bp, Homo sapiens
ttttgacagaatatgtttcaaa

SEQ ID NO: 1722992 - DNA, 23 bp, Homo sapiens
ttttgacagaatatgtttcaaac

SEQ ID NO: 1722993 - DNA, 15 bp, Homo sapiens
ttttgacaggtgcct

SEQ ID NO: 1722994 - DNA, 19 bp, Homo sapiens
ttttgacagtgttgaaaat

SEQ ID NO: 1722995 - DNA, 15 bp, Homo sapiens
ttttgacctgtttca

SEQ ID NO: 1722996 - DNA, 19 bp, Homo sapiens
ttttgactaaagctatgtt

SEQ ID NO: 1722997 - DNA, 22 bp, Homo sapiens
ttttgactaagtttttatacca

SEQ ID NO: 1722998 - DNA, 14 bp, Homo sapiens
ttttgacttaatgt

SEQ ID NO: 1722999 - DNA, 17 bp, Homo sapiens
ttttgacttaatgtgat

SEQ ID NO: 1723000 - DNA, 18 bp, Homo sapiens
ttttgacttaatgtgatt

SEQ ID NO: 1723001 - DNA, 15 bp, Homo sapiens
ttttgagacagtctt

SEQ ID NO: 1723002 - DNA, 14 bp, Homo sapiens
ttttgagatgtaaa

SEQ ID NO: 1723003 - DNA, 11 bp, Homo sapiens
ttttgagctat

SEQ ID NO: 1723004 - DNA, 21 bp, Homo sapiens
ttttgagctgaaatgctgcat

SEQ ID NO: 1723005 - DNA, 13 bp, Homo sapiens
ttttgagtattcc

SEQ ID NO: 1723006 - DNA, 22 bp, Homo sapiens
ttttgagtgtttatagatcact

SEQ ID NO: 1723007 - DNA, 20 bp, Homo sapiens
ttttgataaagtttctcaga

SEQ ID NO: 1723008 - DNA, 13 bp, Homo sapiens
ttttgataacaat

SEQ ID NO: 1723009 - DNA, 15 bp, Homo sapiens
ttttgatagctttat

SEQ ID NO: 1723010 - DNA, 19 bp, Homo sapiens
ttttgatatgcatatttgt

SEQ ID NO: 1723011 - DNA, 14 bp, Homo sapiens
ttttgatctcacat

SEQ ID NO: 1723012 - DNA, 13 bp, Homo sapiens
ttttgatgtgaaa

SEQ ID NO: 1723013 - DNA, 17 bp, Homo sapiens
ttttgattaacaatgta

SEQ ID NO: 1723014 - DNA, 13 bp, Homo sapiens
ttttgattaatgt

SEQ ID NO: 1723015 - DNA, 21 bp, Homo sapiens
ttttgatttggtggatgtgat

SEQ ID NO: 1723016 - DNA, 13 bp, Homo sapiens
ttttgcaaaattt

SEQ ID NO: 1723017 - DNA, 17 bp, Homo sapiens
ttttgcaaagatttaat

SEQ ID NO: 1723018 - DNA, 19 bp, Homo sapiens
ttttgcaaagatttaatct

SEQ ID NO: 1723019 - DNA, 19 bp, Homo sapiens
ttttgcaaattatattttg

SEQ ID NO: 1723020 - DNA, 18 bp, Homo sapiens
ttttgcaaggtaaaattt

SEQ ID NO: 1723021 - DNA, 22 bp, Homo sapiens
ttttgcacaccttttccccagg

SEQ ID NO: 1723022 - DNA, 10 bp, Homo sapiens
ttttgcacag

SEQ ID NO: 1723023 - DNA, 20 bp, Homo sapiens
ttttgcacatgtttcctcta

SEQ ID NO: 1723024 - DNA, 13 bp, Homo sapiens
ttttgcacccctc

SEQ ID NO: 1723025 - DNA, 17 bp, Homo sapiens
ttttgcacccctcccat

SEQ ID NO: 1723026 - DNA, 21 bp, Homo sapiens
ttttgcacgtcttgctatttg

SEQ ID NO: 1723027 - DNA, 23 bp, Homo sapiens
ttttgcacgtcttgctatttgag

SEQ ID NO: 1723028 - DNA, 13 bp, Homo sapiens
ttttgcagtaact

SEQ ID NO: 1723029 - DNA, 14 bp, Homo sapiens
ttttgcagtaactg

SEQ ID NO: 1723030 - DNA, 15 bp, Homo sapiens
ttttgcagtaactgt

SEQ ID NO: 1723031 - DNA, 19 bp, Homo sapiens
ctgatgctgccccgttccc

SEQ ID NO: 1723032 - DNA, 16 bp, Homo sapiens
ctgatggaaaatacca

SEQ ID NO: 1723033 - DNA, 16 bp, Homo sapiens
ctgatggaagatggtc

SEQ ID NO: 1723034 - DNA, 22 bp, Homo sapiens
ctgatggaagatggtccgtgcc

SEQ ID NO: 1723035 - DNA, 23 bp, Homo sapiens
ctgatggaccgggtgggcctggc

SEQ ID NO: 1723036 - DNA, 20 bp, Homo sapiens
ctgatggagtgtgcagacag

SEQ ID NO: 1723037 - DNA, 21 bp, Homo sapiens
ctgatggagtgtgcagacagc

SEQ ID NO: 1723038 - DNA, 20 bp, Homo sapiens
ctgatggccaagggggtgga

SEQ ID NO: 1723039 - DNA, 13 bp, Homo sapiens
ctgatggcccctc

SEQ ID NO: 1723040 - DNA, 14 bp, Homo sapiens
ctgatggccttaat

SEQ ID NO: 1723041 - DNA, 20 bp, Homo sapiens
ctgatggccttaatttcctt

SEQ ID NO: 1723042 - DNA, 21 bp, Homo sapiens
ctgatggctcaagacaaggct

SEQ ID NO: 1723043 - DNA, 18 bp, Homo sapiens
ctgatggctgctagattt

SEQ ID NO: 1723044 - DNA, 15 bp, Homo sapiens
ctgatggctggcagg

SEQ ID NO: 1723045 - DNA, 22 bp, Homo sapiens
ctgatgggaaaactgccaatat

SEQ ID NO: 1723046 - DNA, 23 bp, Homo sapiens
ctgatggtcttaaatgctcattt

SEQ ID NO: 1723047 - DNA, 14 bp, Homo sapiens
ctgatggtgagctg

SEQ ID NO: 1723048 - DNA, 18 bp, Homo sapiens
ctgatggtgagctgggaa

SEQ ID NO: 1723049 - DNA, 21 bp, Homo sapiens
ctgatggtttctttttttccc

SEQ ID NO: 1723050 - DNA, 16 bp, Homo sapiens
ctgatgtaacaaggtg

SEQ ID NO: 1723051 - DNA, 17 bp, Homo sapiens
ctgatgtcatcttgagc

SEQ ID NO: 1723052 - DNA, 21 bp, Homo sapiens
ctgatgtcttaacgaataaag

SEQ ID NO: 1723053 - DNA, 16 bp, Homo sapiens
ctgatgtgatattctg

SEQ ID NO: 1723054 - DNA, 20 bp, Homo sapiens
ctgatgtgtcctcagggagc

SEQ ID NO: 1723055 - DNA, 18 bp, Homo sapiens
ctgatgttcctagtgaaa

SEQ ID NO: 1723056 - DNA, 20 bp, Homo sapiens
ctgatgttcctagtgaaaga

SEQ ID NO: 1723057 - DNA, 15 bp, Homo sapiens
ctgatgtttctgtga

SEQ ID NO: 1723058 - DNA, 18 bp, Homo sapiens
ctgatgtttctgtgaaat

SEQ ID NO: 1723059 - DNA, 15 bp, Homo sapiens
ctgatgtttgaagag

SEQ ID NO: 1723060 - DNA, 16 bp, Homo sapiens
ctgatgtttgaagagt

SEQ ID NO: 1723061 - DNA, 18 bp, Homo sapiens
ctgattaaatatttgaag

SEQ ID NO: 1723062 - DNA, 17 bp, Homo sapiens
ctgattaaatttaatat

SEQ ID NO: 1723063 - DNA, 14 bp, Homo sapiens
ctgattactgtcaa

SEQ ID NO: 1723064 - DNA, 17 bp, Homo sapiens
ctgattactgtcaataa

SEQ ID NO: 1723065 - DNA, 19 bp, Homo sapiens
ctgattactgtcaataaac

SEQ ID NO: 1723066 - DNA, 15 bp, Homo sapiens
ctgattcacctcttc

SEQ ID NO: 1723067 - DNA, 20 bp, Homo sapiens
ctgattcacctcttcctctg

SEQ ID NO: 1723068 - DNA, 21 bp, Homo sapiens
ctgattcacctcttcctctgg

SEQ ID NO: 1723069 - DNA, 18 bp, Homo sapiens
ctgattcactgcatggct

SEQ ID NO: 1723070 - DNA, 13 bp, Homo sapiens
ctgattctatgcc

SEQ ID NO: 1723071 - DNA, 20 bp, Homo sapiens
ctgattctatgcctgtattt

SEQ ID NO: 1723072 - DNA, 23 bp, Homo sapiens
ctgattctatgcctgtatttcca

SEQ ID NO: 1723073 - DNA, 14 bp, Homo sapiens
ctgattctgggatg

SEQ ID NO: 1723074 - DNA, 22 bp, Homo sapiens
ctgattcttgattcctggctct

SEQ ID NO: 1723075 - DNA, 13 bp, Homo sapiens
ctgattcttgtaa

SEQ ID NO: 1723076 - DNA, 16 bp, Homo sapiens
ctgattgcagaaagga

SEQ ID NO: 1723077 - DNA, 19 bp, Homo sapiens
ctgattgcagaaaggagag

SEQ ID NO: 1723078 - DNA, 13 bp, Homo sapiens
ctgattggctgct

SEQ ID NO: 1723079 - DNA, 21 bp, Homo sapiens
ctgatttaggagaagccagga

SEQ ID NO: 1723080 - DNA, 12 bp, Homo sapiens
ctgatttcagga

SEQ ID NO: 1723081 - DNA, 14 bp, Homo sapiens
ctgatttccaggcc

SEQ ID NO: 1723082 - DNA, 22 bp, Homo sapiens
ctgatttccaggcccctgagga

SEQ ID NO: 1723083 - DNA, 21 bp, Homo sapiens
ctgatttctagaacccgtgac

SEQ ID NO: 1723084 - DNA, 23 bp, Homo sapiens
ctgatttgatgatacatttcatt

SEQ ID NO: 1723085 - DNA, 16 bp, Homo sapiens
ctgatttgcaaatgca

SEQ ID NO: 1723086 - DNA, 17 bp, Homo sapiens
ctgatttgcaaatgcac

SEQ ID NO: 1723087 - DNA, 15 bp, Homo sapiens
ctgattttaatgaaa

SEQ ID NO: 1723088 - DNA, 17 bp, Homo sapiens
ctgattttaatgaaatc

SEQ ID NO: 1723089 - DNA, 22 bp, Homo sapiens
ctgattttaatgaaatcaaatg

SEQ ID NO: 1723090 - DNA, 23 bp, Homo sapiens
ctgattttaatgaaatcaaatgt

SEQ ID NO: 1723091 - DNA, 15 bp, Homo sapiens
ctgattttattcttg

SEQ ID NO: 1723092 - DNA, 18 bp, Homo sapiens
ctgattttcaaagctttt

SEQ ID NO: 1723093 - DNA, 13 bp, Homo sapiens
ctgatttttctct

SEQ ID NO: 1723094 - DNA, 15 bp, Homo sapiens
ctgatttttctcttt

SEQ ID NO: 1723095 - DNA, 17 bp, Homo sapiens
ctgatttttctcttttt

SEQ ID NO: 1723096 - DNA, 16 bp, Homo sapiens
ctgcaaaaaaagcctc

SEQ ID NO: 1723097 - DNA, 18 bp, Homo sapiens
ctgcaaaaaaagcctcca

SEQ ID NO: 1723098 - DNA, 21 bp, Homo sapiens
ctgcaaaaaaagcctccaagg

SEQ ID NO: 1723099 - DNA, 13 bp, Homo sapiens
ctgcaaaaatgga

SEQ ID NO: 1723100 - DNA, 20 bp, Homo sapiens
ctgcaaacctgacccctgct

SEQ ID NO: 1723101 - DNA, 22 bp, Homo sapiens
ctgcaaagatctgtcctcagcc

SEQ ID NO: 1723102 - DNA, 13 bp, Homo sapiens
ctgcaaagcatgt

SEQ ID NO: 1723103 - DNA, 15 bp, Homo sapiens
ctgcaaagctttggc

SEQ ID NO: 1723104 - DNA, 14 bp, Homo sapiens
ctgcaaaggagaag

SEQ ID NO: 1723105 - DNA, 19 bp, Homo sapiens
ctgcaaatctgatggcctt

SEQ ID NO: 1723106 - DNA, 14 bp, Homo sapiens
ctgcaaccccccag

SEQ ID NO: 1723107 - DNA, 17 bp, Homo sapiens
ttttgtgtgtatttgct

SEQ ID NO: 1723108 - DNA, 20 bp, Homo sapiens
ttttgtgtgtatttgctaat

SEQ ID NO: 1723109 - DNA, 14 bp, Homo sapiens
ttttgttaaagctg

SEQ ID NO: 1723110 - DNA, 22 bp, Homo sapiens
ttttgttaaagctggaacattt

SEQ ID NO: 1723111 - DNA, 20 bp, Homo sapiens
ttttgttactgattcaatta

SEQ ID NO: 1723112 - DNA, 16 bp, Homo sapiens
ttttgttagcaaagat

SEQ ID NO: 1723113 - DNA, 14 bp, Homo sapiens
ttttgttatagaat

SEQ ID NO: 1723114 - DNA, 15 bp, Homo sapiens
ttttgttccacaagt

SEQ ID NO: 1723115 - DNA, 15 bp, Homo sapiens
ttttgttccacttgt

SEQ ID NO: 1723116 - DNA, 14 bp, Homo sapiens
ttttgttcccctcc

SEQ ID NO: 1723117 - DNA, 15 bp, Homo sapiens
ttttgttcccctcct

SEQ ID NO: 1723118 - DNA, 19 bp, Homo sapiens
ttttgttcccctcctccac

SEQ ID NO: 1723119 - DNA, 14 bp, Homo sapiens
ttttgttctctggg

SEQ ID NO: 1723120 - DNA, 11 bp, Homo sapiens
ttttgttgaaa

SEQ ID NO: 1723121 - DNA, 16 bp, Homo sapiens
ttttgttgccccagaa

SEQ ID NO: 1723122 - DNA, 14 bp, Homo sapiens
ttttgttgctttct

SEQ ID NO: 1723123 - DNA, 21 bp, Homo sapiens
ttttgttggcatagctctggg

SEQ ID NO: 1723124 - DNA, 19 bp, Homo sapiens
ttttgttgtacttaaatgg

SEQ ID NO: 1723125 - DNA, 22 bp, Homo sapiens
ttttgttgttgttgtttgtaaa

SEQ ID NO: 1723126 - DNA, 16 bp, Homo sapiens
ttttgtttcatcctgt

SEQ ID NO: 1723127 - DNA, 15 bp, Homo sapiens
ttttgtttcttccaa

SEQ ID NO: 1723128 - DNA, 19 bp, Homo sapiens
ttttgtttggcaaggaaag

SEQ ID NO: 1723129 - DNA, 15 bp, Homo sapiens
ttttgtttggtaaat

SEQ ID NO: 1723130 - DNA, 16 bp, Homo sapiens
ttttgtttggtaaatg

SEQ ID NO: 1723131 - DNA, 15 bp, Homo sapiens
ttttgttttcattat

SEQ ID NO: 1723132 - DNA, 15 bp, Homo sapiens
ttttgttttgttgga

SEQ ID NO: 1723133 - DNA, 17 bp, Homo sapiens
ttttgtttttttgcaga

SEQ ID NO: 1723134 - DNA, 21 bp, Homo sapiens
tttttaaaaaaagctaaatta

SEQ ID NO: 1723135 - DNA, 22 bp, Homo sapiens
tttttaaaaaaatttttgcaaa

SEQ ID NO: 1723136 - DNA, 12 bp, Homo sapiens
tttttaaaaaat

SEQ ID NO: 1723137 - DNA, 19 bp, Homo sapiens
tttttaaaaaatattttct

SEQ ID NO: 1723138 - DNA, 17 bp, Homo sapiens
tttttaaaaacaaacaa

SEQ ID NO: 1723139 - DNA, 16 bp, Homo sapiens
tttttaaaatatttat

SEQ ID NO: 1723140 - DNA, 18 bp, Homo sapiens
tttttaaacttgaaatat

SEQ ID NO: 1723141 - DNA, 14 bp, Homo sapiens
tttttaaagcaagt

SEQ ID NO: 1723142 - DNA, 15 bp, Homo sapiens
tttttaaagctacaa

SEQ ID NO: 1723143 - DNA, 18 bp, Homo sapiens
tttttaaagttactttgt

SEQ ID NO: 1723144 - DNA, 16 bp, Homo sapiens
tttttaaatcaaggaa

SEQ ID NO: 1723145 - DNA, 15 bp, Homo sapiens
tttttaaatgtgaat

SEQ ID NO: 1723146 - DNA, 21 bp, Homo sapiens
ttttaatttgatgaaagctga

SEQ ID NO: 1723147 - DNA, 13 bp, Homo sapiens
ttttaattttgat

SEQ ID NO: 1723148 - DNA, 12 bp, Homo sapiens
ttttaattttta

SEQ ID NO: 1723149 - DNA, 10 bp, Homo sapiens
ttttacaaaa

SEQ ID NO: 1723150 - DNA, 18 bp, Homo sapiens
ttttacaataaataatct

SEQ ID NO: 1723151 - DNA, 16 bp, Homo sapiens
ttttacaattgaaatg

SEQ ID NO: 1723152 - DNA, 23 bp, Homo sapiens
ttttacagttagggttttgcaat

SEQ ID NO: 1723153 - DNA, 21 bp, Homo sapiens
ttttacatgaagctgtataat

SEQ ID NO: 1723154 - DNA, 12 bp, Homo sapiens
ttttacattgtg

SEQ ID NO: 1723155 - DNA, 12 bp, Homo sapiens
ttttaccaaagc

SEQ ID NO: 1723156 - DNA, 18 bp, Homo sapiens
ttttacctaccacagtgt

SEQ ID NO: 1723157 - DNA, 13 bp, Homo sapiens
ttttactaaagaa

SEQ ID NO: 1723158 - DNA, 13 bp, Homo sapiens
ttttactctgcct

SEQ ID NO: 1723159 - DNA, 11 bp, Homo sapiens
ttttactgttg

SEQ ID NO: 1723160 - DNA, 21 bp, Homo sapiens
ttttacttttcacactgtctt

SEQ ID NO: 1723161 - DNA, 17 bp, Homo sapiens
ttttagagactatggag

SEQ ID NO: 1723162 - DNA, 19 bp, Homo sapiens
ttttagagcttccaaatgt

SEQ ID NO: 1723163 - DNA, 19 bp, Homo sapiens
ttttagataataactgtct

SEQ ID NO: 1723164 - DNA, 13 bp, Homo sapiens
ttttagatgtatt

SEQ ID NO: 1723165 - DNA, 20 bp, Homo sapiens
ttttagattgagaaatgtgt

SEQ ID NO: 1723166 - DNA, 21 bp, Homo sapiens
ttttagcaatttatacaatat

SEQ ID NO: 1723167 - DNA, 14 bp, Homo sapiens
ttttagcattacct

SEQ ID NO: 1723168 - DNA, 15 bp, Homo sapiens
ttttagcattaccta

SEQ ID NO: 1723169 - DNA, 11 bp, Homo sapiens
ttttagcattt

SEQ ID NO: 1723170 - DNA, 15 bp, Homo sapiens
ttttaggattctgtc

SEQ ID NO: 1723171 - DNA, 14 bp, Homo sapiens
ttttaggctacagt

SEQ ID NO: 1723172 - DNA, 17 bp, Homo sapiens
ttttagggagctggtct

SEQ ID NO: 1723173 - DNA, 23 bp, Homo sapiens
ttttaggtcaagggcttactatt

SEQ ID NO: 1723174 - DNA, 14 bp, Homo sapiens
ttttaggtgcttta

SEQ ID NO: 1723175 - DNA, 14 bp, Homo sapiens
ttttaggttctaaa

SEQ ID NO: 1723176 - DNA, 18 bp, Homo sapiens
ttttaggttctaaagttc

SEQ ID NO: 1723177 - DNA, 12 bp, Homo sapiens
ttttagtgtctg

SEQ ID NO: 1723178 - DNA, 13 bp, Homo sapiens
ttttagtgtctga

SEQ ID NO: 1723179 - DNA, 14 bp, Homo sapiens
ttttagtgtctgac

SEQ ID NO: 1723180 - DNA, 17 bp, Homo sapiens
ttttagtttctgaactc

SEQ ID NO: 1723181 - DNA, 18 bp, Homo sapiens
ttttagtttttcattaaa

SEQ ID NO: 1723182 - DNA, 22 bp, Homo sapiens
ttttagtttttcattaaataaa

SEQ ID NO: 1723183 - DNA, 22 bp, Homo sapiens
ttttataaaatggctgtaatca

SEQ ID NO: 1723184 - DNA, 21 bp, Homo sapiens
ttttataaaccacttgagcct

SEQ ID NO: 1723185 - DNA, 17 bp, Homo sapiens
ttttataaagtctaagc

SEQ ID NO: 1723186 - DNA, 22 bp, Homo sapiens
ttttataaatactgcaaatcag

SEQ ID NO: 1723187 - DNA, 21 bp, Homo sapiens
ttttataacatctttattgaa

SEQ ID NO: 1723188 - DNA, 14 bp, Homo sapiens
ttttataagaaaaa

SEQ ID NO: 1723189 - DNA, 14 bp, Homo sapiens
ttttataagaattt

SEQ ID NO: 1723190 - DNA, 18 bp, Homo sapiens
ttttataatgttattcat

SEQ ID NO: 1723191 - DNA, 21 bp, Homo sapiens
ttttataatgttattcatttg

SEQ ID NO: 1723192 - DNA, 16 bp, Homo sapiens
ttttataattgtacaa

SEQ ID NO: 1723193 - DNA, 14 bp, Homo sapiens
ttttatacaaaata

SEQ ID NO: 1723194 - DNA, 14 bp, Homo sapiens
ttttatacaaacct

SEQ ID NO: 1723195 - DNA, 20 bp, Homo sapiens
ttttatacaagtaatttcct

SEQ ID NO: 1723196 - DNA, 21 bp, Homo sapiens
ttttatacggaaaaaattgta

SEQ ID NO: 1723197 - DNA, 15 bp, Homo sapiens
ttttatactgcacag

SEQ ID NO: 1723198 - DNA, 22 bp, Homo sapiens
ctgagtctgagtcctgtctctg

SEQ ID NO: 1723199 - DNA, 14 bp, Homo sapiens
ctgagtgaaaaatc

SEQ ID NO: 1723200 - DNA, 21 bp, Homo sapiens
ctgagtgaaaaatctgtggaa

SEQ ID NO: 1723201 - DNA, 14 bp, Homo sapiens
ctgagtgacacaag

SEQ ID NO: 1723202 - DNA, 20 bp, Homo sapiens
ctgagtgacacaagcacttt

SEQ ID NO: 1723203 - DNA, 14 bp, Homo sapiens
ctgagtgacagctt

SEQ ID NO: 1723204 - DNA, 15 bp, Homo sapiens
ctgagtgagccacag

SEQ ID NO: 1723205 - DNA, 23 bp, Homo sapiens
ctgagtgagccacagaccacctg

SEQ ID NO: 1723206 - DNA, 20 bp, Homo sapiens
ctgagtggaatgcagggaag

SEQ ID NO: 1723207 - DNA, 17 bp, Homo sapiens
ctgagtggcagcagccc

SEQ ID NO: 1723208 - DNA, 16 bp, Homo sapiens
ctgagtggcaggggac

SEQ ID NO: 1723209 - DNA, 14 bp, Homo sapiens
ctgagtggggagca

SEQ ID NO: 1723210 - DNA, 16 bp, Homo sapiens
ctgagtggggagcagt

SEQ ID NO: 1723211 - DNA, 17 bp, Homo sapiens
ctgagtgtcccaagccg

SEQ ID NO: 1723212 - DNA, 17 bp, Homo sapiens
ctgagttacattgtcat

SEQ ID NO: 1723213 - DNA, 16 bp, Homo sapiens
ctgagttacttgtctg

SEQ ID NO: 1723214 - DNA, 21 bp, Homo sapiens
ctgagttacttgtctgaggcc

SEQ ID NO: 1723215 - DNA, 24 bp, Homo sapiens
ctgagttacttgtctgaggcctca

SEQ ID NO: 1723216 - DNA, 18 bp, Homo sapiens
ctgagttataaatatttt

SEQ ID NO: 1723217 - DNA, 17 bp, Homo sapiens
ctgagttcaagggctgt

SEQ ID NO: 1723218 - DNA, 14 bp, Homo sapiens
ctgagttctggttc

SEQ ID NO: 1723219 - DNA, 14 bp, Homo sapiens
ctgagttgaagagg

SEQ ID NO: 1723220 - DNA, 21 bp, Homo sapiens
ctgagttggagctcattctgt

SEQ ID NO: 1723221 - DNA, 13 bp, Homo sapiens
ctgagttggcctg

SEQ ID NO: 1723222 - DNA, 11 bp, Homo sapiens
ctgagttgttc

SEQ ID NO: 1723223 - DNA, 17 bp, Homo sapiens
ctgagtttaccatttgt

SEQ ID NO: 1723224 - DNA, 19 bp, Homo sapiens
ctgagtttaccatttgtaa

SEQ ID NO: 1723225 - DNA, 21 bp, Homo sapiens
ctgagtttaccatttgtaata

SEQ ID NO: 1723226 - DNA, 23 bp, Homo sapiens
ctgagtttaccatttgtaataaa

SEQ ID NO: 1723227 - DNA, 19 bp, Homo sapiens
ctgagtttcctatgggaac

SEQ ID NO: 1723228 - DNA, 21 bp, Homo sapiens
ctgagtttctgttctccctgg

SEQ ID NO: 1723229 - DNA, 13 bp, Homo sapiens
ctgagttttgtgt

SEQ ID NO: 1723230 - DNA, 12 bp, Homo sapiens
ctgataaaatac

SEQ ID NO: 1723231 - DNA, 21 bp, Homo sapiens
ctgataaaccaaaattgagca

SEQ ID NO: 1723232 - DNA, 21 bp, Homo sapiens
ctgataaacctaatattcaat

SEQ ID NO: 1723233 - DNA, 17 bp, Homo sapiens
ctgataaagttccttaa

SEQ ID NO: 1723234 - DNA, 23 bp, Homo sapiens
ctgataacaaccttttacattgt

SEQ ID NO: 1723235 - DNA, 14 bp, Homo sapiens
ctgataataattga

SEQ ID NO: 1723236 - DNA, 12 bp, Homo sapiens
ctgatacctcaa

SEQ ID NO: 1723237 - DNA, 19 bp, Homo sapiens
ctgatagcatatgacaaat

SEQ ID NO: 1723238 - DNA, 22 bp, Homo sapiens
ctgatagcatatgacaaatgtt

SEQ ID NO: 1723239 - DNA, 18 bp, Homo sapiens
ctgatagcttacactgag

SEQ ID NO: 1723240 - DNA, 21 bp, Homo sapiens
ctgatagcttacactgaggac

SEQ ID NO: 1723241 - DNA, 17 bp, Homo sapiens
ctgatagtcacctgctg

SEQ ID NO: 1723242 - DNA, 18 bp, Homo sapiens
ctgatatattttacaatt

SEQ ID NO: 1723243 - DNA, 15 bp, Homo sapiens
ctgatatcaacagct

SEQ ID NO: 1723244 - DNA, 19 bp, Homo sapiens
ctgatatgatttaaaacat

SEQ ID NO: 1723245 - DNA, 23 bp, Homo sapiens
ctgatatgatttaaaacatgtaa

SEQ ID NO: 1723246 - DNA, 12 bp, Homo sapiens
ctgatattaatc

SEQ ID NO: 1723247 - DNA, 13 bp, Homo sapiens
ctgatattaatca

SEQ ID NO: 1723248 - DNA, 16 bp, Homo sapiens
ctgatattatggcaag

SEQ ID NO: 1723249 - DNA, 18 bp, Homo sapiens
ctgatattccatgaatgt

SEQ ID NO: 1723250 - DNA, 19 bp, Homo sapiens
ctgatattccatgaatgta

SEQ ID NO: 1723251 - DNA, 16 bp, Homo sapiens
ctgatcaaaaataaac

SEQ ID NO: 1723252 - DNA, 19 bp, Homo sapiens
ctgatcaaaaataaactag

SEQ ID NO: 1723253 - DNA, 22 bp, Homo sapiens
ctgatcaagagtccggatttct

SEQ ID NO: 1723254 - DNA, 23 bp, Homo sapiens
ctgatcaagagtccggatttcta

SEQ ID NO: 1723255 - DNA, 22 bp, Homo sapiens
ctgatcagtgggcctccaagga

SEQ ID NO: 1723256 - DNA, 19 bp, Homo sapiens
ctgatcatcgccagaggtg

SEQ ID NO: 1723257 - DNA, 14 bp, Homo sapiens
ctgatccagccttt

SEQ ID NO: 1723258 - DNA, 23 bp, Homo sapiens
ctgatcccaccccctcctccccc

SEQ ID NO: 1723259 - DNA, 15 bp, Homo sapiens
ctgatcccagacctg

SEQ ID NO: 1723260 - DNA, 12 bp, Homo sapiens
ctgatcccatgg

SEQ ID NO: 1723261 - DNA, 19 bp, Homo sapiens
ctgatccctgaacccctgg

SEQ ID NO: 1723262 - DNA, 23 bp, Homo sapiens
ctgatccctgaacccctggccag

SEQ ID NO: 1723263 - DNA, 20 bp, Homo sapiens
ctgatcctaagaatttttca

SEQ ID NO: 1723264 - DNA, 17 bp, Homo sapiens
ctgatcctgctccagca

SEQ ID NO: 1723265 - DNA, 12 bp, Homo sapiens
ttttcacttgta

SEQ ID NO: 1723266 - DNA, 14 bp, Homo sapiens
ttttcacttgtatt

SEQ ID NO: 1723267 - DNA, 17 bp, Homo sapiens
ttttcagaacctcttcc

SEQ ID NO: 1723268 - DNA, 22 bp, Homo sapiens
ttttcagaacctcttccccaga

SEQ ID NO: 1723269 - DNA, 14 bp, Homo sapiens
ttttcagactcaga

SEQ ID NO: 1723270 - DNA, 17 bp, Homo sapiens
ttttcaggagcgcaaga

SEQ ID NO: 1723271 - DNA, 22 bp, Homo sapiens
ttttcaggagcgcaagatagat

SEQ ID NO: 1723272 - DNA, 15 bp, Homo sapiens
ttttcagtatactgt

SEQ ID NO: 1723273 - DNA, 17 bp, Homo sapiens
ttttcagtatactgtgt

SEQ ID NO: 1723274 - DNA, 19 bp, Homo sapiens
ttttcagtcccctctctct

SEQ ID NO: 1723275 - DNA, 22 bp, Homo sapiens
ttttcagttgtttgtttttgct

SEQ ID NO: 1723276 - DNA, 14 bp, Homo sapiens
ttttcataaacaag

SEQ ID NO: 1723277 - DNA, 23 bp, Homo sapiens
ttttcataacttgctgaatttca

SEQ ID NO: 1723278 - DNA, 21 bp, Homo sapiens
ttttcatcccgtatcacagtg

SEQ ID NO: 1723279 - DNA, 17 bp, Homo sapiens
ttttcatctgaaaagca

SEQ ID NO: 1723280 - DNA, 21 bp, Homo sapiens
ttttcatgaatgtgctggtga

SEQ ID NO: 1723281 - DNA, 23 bp, Homo sapiens
ttttcatgttttagcatttgtat

SEQ ID NO: 1723282 - DNA, 11 bp, Homo sapiens
ttttcatttgt

SEQ ID NO: 1723283 - DNA, 13 bp, Homo sapiens
ttttcatttgtac

SEQ ID NO: 1723284 - DNA, 17 bp, Homo sapiens
ttttcattttagacatt

SEQ ID NO: 1723285 - DNA, 11 bp, Homo sapiens
ttttccaaatg

SEQ ID NO: 1723286 - DNA, 22 bp, Homo sapiens
ttttccacaagattcccagaga

SEQ ID NO: 1723287 - DNA, 20 bp, Homo sapiens
ttttccacattccagtgatg

SEQ ID NO: 1723288 - DNA, 18 bp, Homo sapiens
ttttccactcctatggaa

SEQ ID NO: 1723289 - DNA, 12 bp, Homo sapiens
ttttccaggctg

SEQ ID NO: 1723290 - DNA, 13 bp, Homo sapiens
ttttccaggctgg

SEQ ID NO: 1723291 - DNA, 9 bp, Homo sapiens
ttttccagt

SEQ ID NO: 1723292 - DNA, 16 bp, Homo sapiens
ttttccatatcctggt

SEQ ID NO: 1723293 - DNA, 14 bp, Homo sapiens
ttttccatctaaaa

SEQ ID NO: 1723294 - DNA, 16 bp, Homo sapiens
ttttccatctaaaata

SEQ ID NO: 1723295 - DNA, 20 bp, Homo sapiens
ttttccatgcgtgtttctga

SEQ ID NO: 1723296 - DNA, 18 bp, Homo sapiens
ttttccattgaccagctc

SEQ ID NO: 1723297 - DNA, 19 bp, Homo sapiens
ttttccattgaccagctct

SEQ ID NO: 1723298 - DNA, 19 bp, Homo sapiens
ttttcccaaagcactttta

SEQ ID NO: 1723299 - DNA, 13 bp, Homo sapiens
ttttcccaataaa

SEQ ID NO: 1723300 - DNA, 14 bp, Homo sapiens
ttttcccagtattt

SEQ ID NO: 1723301 - DNA, 17 bp, Homo sapiens
ttttcccatcatccttt

SEQ ID NO: 1723302 - DNA, 15 bp, Homo sapiens
ttttcccatttgtaa

SEQ ID NO: 1723303 - DNA, 12 bp, Homo sapiens
ttttcccccttc

SEQ ID NO: 1723304 - DNA, 15 bp, Homo sapiens
ttttcccccttccca

SEQ ID NO: 1723305 - DNA, 19 bp, Homo sapiens
ttttccccggtcccttgag

SEQ ID NO: 1723306 - DNA, 23 bp, Homo sapiens
ttttccccggtcccttgagacct

SEQ ID NO: 1723307 - DNA, 12 bp, Homo sapiens
ttttcccctccc

SEQ ID NO: 1723308 - DNA, 16 bp, Homo sapiens
ttttcccctttcctgt

SEQ ID NO: 1723309 - DNA, 19 bp, Homo sapiens
ttttccctggaactcctgg

SEQ ID NO: 1723310 - DNA, 15 bp, Homo sapiens
ttttcccttgcctta

SEQ ID NO: 1723311 - DNA, 14 bp, Homo sapiens
ttttcccttgctgt

SEQ ID NO: 1723312 - DNA, 20 bp, Homo sapiens
ttttccgtcacttaaatttg

SEQ ID NO: 1723313 - DNA, 18 bp, Homo sapiens
ctgccctctccttcctta

SEQ ID NO: 1723314 - DNA, 21 bp, Homo sapiens
ctgccctctctgcgctgaggc

SEQ ID NO: 1723315 - DNA, 15 bp, Homo sapiens
ctgccctctgctgct

SEQ ID NO: 1723316 - DNA, 13 bp, Homo sapiens
ctgccctgcctga

SEQ ID NO: 1723317 - DNA, 16 bp, Homo sapiens
ctgccctgcctgaggg

SEQ ID NO: 1723318 - DNA, 13 bp, Homo sapiens
ctgccctgcctgc

SEQ ID NO: 1723319 - DNA, 16 bp, Homo sapiens
ctgccctgcctgccca

SEQ ID NO: 1723320 - DNA, 18 bp, Homo sapiens
ctgccctgcctgcccact

SEQ ID NO: 1723321 - DNA, 15 bp, Homo sapiens
ctgccctggcagcag

SEQ ID NO: 1723322 - DNA, 16 bp, Homo sapiens
ctgccctggcagcagc

SEQ ID NO: 1723323 - DNA, 14 bp, Homo sapiens
ctgccctggccctg

SEQ ID NO: 1723324 - DNA, 17 bp, Homo sapiens
ctgccctggccctgagg

SEQ ID NO: 1723325 - DNA, 17 bp, Homo sapiens
ctgccctggctgctgcc

SEQ ID NO: 1723326 - DNA, 20 bp, Homo sapiens
ctgccctggctgctgccccc

SEQ ID NO: 1723327 - DNA, 15 bp, Homo sapiens
ctgccctggtccagg

SEQ ID NO: 1723328 - DNA, 12 bp, Homo sapiens
ctgccctggtgc

SEQ ID NO: 1723329 - DNA, 13 bp, Homo sapiens
ctgccctggtgct

SEQ ID NO: 1723330 - DNA, 14 bp, Homo sapiens
ctgccctggtgctg

SEQ ID NO: 1723331 - DNA, 15 bp, Homo sapiens
ctgccctggtgctgc

SEQ ID NO: 1723332 - DNA, 13 bp, Homo sapiens
ctgccctgtctgg

SEQ ID NO: 1723333 - DNA, 22 bp, Homo sapiens
ctgccctgtgatatgtctgctg

SEQ ID NO: 1723334 - DNA, 17 bp, Homo sapiens
ctgccctgtggacagga

SEQ ID NO: 1723335 - DNA, 22 bp, Homo sapiens
ctgcccttcctcagtttaatcc

SEQ ID NO: 1723336 - DNA, 19 bp, Homo sapiens
ctgcccttcctcctgatgg

SEQ ID NO: 1723337 - DNA, 22 bp, Homo sapiens
ctgcccttcctcctgatggagt

SEQ ID NO: 1723338 - DNA, 20 bp, Homo sapiens
ctgcccttgttgcctgcacc

SEQ ID NO: 1723339 - DNA, 17 bp, Homo sapiens
ctgccgacatccctccc

SEQ ID NO: 1723340 - DNA, 22 bp, Homo sapiens
ctgccgacatccctcccccagc

SEQ ID NO: 1723341 - DNA, 23 bp, Homo sapiens
ctgccgacatccctcccccagca

SEQ ID NO: 1723342 - DNA, 16 bp, Homo sapiens
ctgccgaccagagccc

SEQ ID NO: 1723343 - DNA, 15 bp, Homo sapiens
ctgccgacttggaga

SEQ ID NO: 1723344 - DNA, 16 bp, Homo sapiens
ctgccgagacagaccc

SEQ ID NO: 1723345 - DNA, 14 bp, Homo sapiens
ctgccgcaccagcc

SEQ ID NO: 1723346 - DNA, 17 bp, Homo sapiens
ctgccgcaccccagagt

SEQ ID NO: 1723347 - DNA, 21 bp, Homo sapiens
ctgccgcagacgggcacagac

SEQ ID NO: 1723348 - DNA, 22 bp, Homo sapiens
ctgccgcagacgggcacagaca

SEQ ID NO: 1723349 - DNA, 18 bp, Homo sapiens
ctgccgcagagctggccg

SEQ ID NO: 1723350 - DNA, 15 bp, Homo sapiens
ctgccgcatgctccc

SEQ ID NO: 1723351 - DNA, 18 bp, Homo sapiens
ctgccgcccccgcctggg

SEQ ID NO: 1723352 - DNA, 19 bp, Homo sapiens
ctgccgcccccgcctgggc

SEQ ID NO: 1723353 - DNA, 19 bp, Homo sapiens
ctgccgccccctcctgaac

SEQ ID NO: 1723354 - DNA, 14 bp, Homo sapiens
ctgccggatctggg

SEQ ID NO: 1723355 - DNA, 17 bp, Homo sapiens
ctgccggatctgggctg

SEQ ID NO: 1723356 - DNA, 14 bp, Homo sapiens
ctgccgggttctag

SEQ ID NO: 1723357 - DNA, 14 bp, Homo sapiens
ctgccggtccccca

SEQ ID NO: 1723358 - DNA, 17 bp, Homo sapiens
ctgccggtcccccatgc

SEQ ID NO: 1723359 - DNA, 19 bp, Homo sapiens
ctgccggtcccccatgcca

SEQ ID NO: 1723360 - DNA, 20 bp, Homo sapiens
ctgccggtgcacaggcctct

SEQ ID NO: 1723361 - DNA, 23 bp, Homo sapiens
ctgccggtgcacaggcctctgcc

SEQ ID NO: 1723362 - DNA, 15 bp, Homo sapiens
ctgccgtgcatggct

SEQ ID NO: 1723363 - DNA, 23 bp, Homo sapiens
ctgccgtgggcctgtcgtgccag

SEQ ID NO: 1723364 - DNA, 14 bp, Homo sapiens
ctgccgtgtgccct

SEQ ID NO: 1723365 - DNA, 14 bp, Homo sapiens
ctgcctaacaaaat

SEQ ID NO: 1723366 - DNA, 19 bp, Homo sapiens
ctgcctaagtggctgctga

SEQ ID NO: 1723367 - DNA, 12 bp, Homo sapiens
ctgcctagaaaa

SEQ ID NO: 1723368 - DNA, 15 bp, Homo sapiens
ctgcctagagtgtag

SEQ ID NO: 1723369 - DNA, 21 bp, Homo sapiens
ctgcctagagtgtagcctaaa

SEQ ID NO: 1723370 - DNA, 14 bp, Homo sapiens
ctgcctaggagctg

SEQ ID NO: 1723371 - DNA, 18 bp, Homo sapiens
ctgcctaggagctggctg

SEQ ID NO: 1723372 - DNA, 20 bp, Homo sapiens
ctgcctaggagctggctggc

SEQ ID NO: 1723373 - DNA, 20 bp, Homo sapiens
ctgcctaggaggctggccaa

SEQ ID NO: 1723374 - DNA, 21 bp, Homo sapiens
ctgcctaggaggctggccaag

SEQ ID NO: 1723375 - DNA, 17 bp, Homo sapiens
ctgcctattatctgtca

SEQ ID NO: 1723376 - DNA, 21 bp, Homo sapiens
ctgcctcaatgtgaatcagac

SEQ ID NO: 1723377 - DNA, 15 bp, Homo sapiens
ctgcctcagccagtg

SEQ ID NO: 1723378 - DNA, 19 bp, Homo sapiens
ctgcctcagcctcctgagt

SEQ ID NO: 1723379 - DNA, 22 bp, Homo sapiens
ctgcctcaggaggcaggacctt

SEQ ID NO: 1723380 - DNA, 12 bp, Homo sapiens
ctgcctcattta

SEQ ID NO: 1723381 - DNA, 15 bp, Homo sapiens
ctgcctccaccagca

SEQ ID NO: 1723382 - DNA, 15 bp, Homo sapiens
ctgcctccagggctg

SEQ ID NO: 1723383 - DNA, 16 bp, Homo sapiens
ctgcctccagggctgg

SEQ ID NO: 1723384 - DNA, 17 bp, Homo sapiens
ctgcctccagggctgga

SEQ ID NO: 1723385 - DNA, 18 bp, Homo sapiens
ctgcctccagggctggac

SEQ ID NO: 1723386 - DNA, 23 bp, Homo sapiens
ctgcctccatggcagcagccagg

SEQ ID NO: 1723387 - DNA, 18 bp, Homo sapiens
ctgcctccattctgacca

SEQ ID NO: 1723388 - DNA, 15 bp, Homo sapiens
ctgcctcccacttca

SEQ ID NO: 1723389 - DNA, 18 bp, Homo sapiens
ctgcctcccacttcactg

SEQ ID NO: 1723390 - DNA, 20 bp, Homo sapiens
ctgcctcccctctccttcct

SEQ ID NO: 1723391 - DNA, 15 bp, Homo sapiens
ctgcctccctgggga

SEQ ID NO: 1723392 - DNA, 21 bp, Homo sapiens
ctgcctccctggggaccagga

SEQ ID NO: 1723393 - DNA, 16 bp, Homo sapiens
ctgcctcctgccaccc

SEQ ID NO: 1723394 - DNA, 21 bp, Homo sapiens
ctgcctcctgccaccccttcc

SEQ ID NO: 1723395 - DNA, 15 bp, Homo sapiens
ctgcctcctgccctt

SEQ ID NO: 1723396 - DNA, 19 bp, Homo sapiens
ctgcctcctgcctgcccct

SEQ ID NO: 1723397 - DNA, 13 bp, Homo sapiens
ctgcctcctggct

SEQ ID NO: 1723398 - DNA, 22 bp, Homo sapiens
ctgcctctcatcaactgaatga

SEQ ID NO: 1723399 - DNA, 15 bp, Homo sapiens
ctgcctctcccatca

SEQ ID NO: 1723400 - DNA, 17 bp, Homo sapiens
ctgcctctccctggccc

SEQ ID NO: 1723401 - DNA, 14 bp, Homo sapiens
ctgcctctgaaaat

SEQ ID NO: 1723402 - DNA, 14 bp, Homo sapiens
ctgcctctgtgtag

SEQ ID NO: 1723403 - DNA, 22 bp, Homo sapiens
ctgcctgaaatgttacacatta

SEQ ID NO: 1723404 - DNA, 13 bp, Homo sapiens
ctgcctgagattc

SEQ ID NO: 1723405 - DNA, 14 bp, Homo sapiens
ctgcctgagattct

SEQ ID NO: 1723406 - DNA, 18 bp, Homo sapiens
ctgcctgagattctttaa

SEQ ID NO: 1723407 - DNA, 21 bp, Homo sapiens
ctgcctgagattctttaagga

SEQ ID NO: 1723408 - DNA, 20 bp, Homo sapiens
ctgcctgagcacctcccagc

SEQ ID NO: 1723409 - DNA, 12 bp, Homo sapiens
ctgcctgagccc

SEQ ID NO: 1723410 - DNA, 16 bp, Homo sapiens
ctgcctgagcccagga

SEQ ID NO: 1723411 - DNA, 20 bp, Homo sapiens
ctgcctgaggaggaggacac

SEQ ID NO: 1723412 - DNA, 17 bp, Homo sapiens
ctgcctgagggcccctc

SEQ ID NO: 1723413 - DNA, 20 bp, Homo sapiens
ctgcctgagggcccctctgc

SEQ ID NO: 1723414 - DNA, 18 bp, Homo sapiens
ctgcctgatccctgaacc

SEQ ID NO: 1723415 - DNA, 16 bp, Homo sapiens
ctgcctgcactccctg

SEQ ID NO: 1723416 - DNA, 19 bp, Homo sapiens
ctgcctgcagaggtctgtg

SEQ ID NO: 1723417 - DNA, 22 bp, Homo sapiens
ctgcctgcagaggtctgtgctg

SEQ ID NO: 1723418 - DNA, 13 bp, Homo sapiens
ctgcctgcagcac

SEQ ID NO: 1723419 - DNA, 14 bp, Homo sapiens
ctgcctgcagcaca

SEQ ID NO: 1723420 - DNA, 18 bp, Homo sapiens
ctgcctgcagcacatgcg

SEQ ID NO: 1723421 - DNA, 17 bp, Homo sapiens
ctgcctgcataggagtt

SEQ ID NO: 1723422 - DNA, 20 bp, Homo sapiens
ctgcctgcatgagctggcaa

SEQ ID NO: 1723423 - DNA, 19 bp, Homo sapiens
ctgcctgcatggcatcaga

SEQ ID NO: 1723424 - DNA, 19 bp, Homo sapiens
ctgcctgcccacttagccg

SEQ ID NO: 1723425 - DNA, 14 bp, Homo sapiens
ctgcctgccccgcc

SEQ ID NO: 1723426 - DNA, 15 bp, Homo sapiens
ctgcctgccccgccc

SEQ ID NO: 1723427 - DNA, 18 bp, Homo sapiens
ctgcctgccccgccccca

SEQ ID NO: 1723428 - DNA, 19 bp, Homo sapiens
ctgcctgccccgcccccag

SEQ ID NO: 1723429 - DNA, 21 bp, Homo sapiens
ctgcctgccccgcccccagtc

SEQ ID NO: 1723430 - DNA, 12 bp, Homo sapiens
tttccaacagca

SEQ ID NO: 1723431 - DNA, 12 bp, Homo sapiens
tttccaactact

SEQ ID NO: 1723432 - DNA, 18 bp, Homo sapiens
tttccaacttgtctggga

SEQ ID NO: 1723433 - DNA, 14 bp, Homo sapiens
tttccaatatgtga

SEQ ID NO: 1723434 - DNA, 14 bp, Homo sapiens
tttccactattttc

SEQ ID NO: 1723435 - DNA, 15 bp, Homo sapiens
tttccactgaacaaa

SEQ ID NO: 1723436 - DNA, 23 bp, Homo sapiens
tttccactggcttttgcctgtaa

SEQ ID NO: 1723437 - DNA, 21 bp, Homo sapiens
tttccagaaccacacttgaaa

SEQ ID NO: 1723438 - DNA, 15 bp, Homo sapiens
tttccagcattttta

SEQ ID NO: 1723439 - DNA, 12 bp, Homo sapiens
tttccagctgcc

SEQ ID NO: 1723440 - DNA, 16 bp, Homo sapiens
tttccaggaaaaaata

SEQ ID NO: 1723441 - DNA, 19 bp, Homo sapiens
tttccaggcccctgaggac

SEQ ID NO: 1723442 - DNA, 23 bp, Homo sapiens
tttccaggctatgtataaaatac

SEQ ID NO: 1723443 - DNA, 15 bp, Homo sapiens
tttccaggctggttc

SEQ ID NO: 1723444 - DNA, 11 bp, Homo sapiens
tttccagggag

SEQ ID NO: 1723445 - DNA, 18 bp, Homo sapiens
tttccaggttctgaaaga

SEQ ID NO: 1723446 - DNA, 18 bp, Homo sapiens
tttccagtgttctatttg

SEQ ID NO: 1723447 - DNA, 15 bp, Homo sapiens
tttccagttctgaca

SEQ ID NO: 1723448 - DNA, 22 bp, Homo sapiens
tttccataaatttggactgtct

SEQ ID NO: 1723449 - DNA, 21 bp, Homo sapiens
tttccatatccatagtgactt

SEQ ID NO: 1723450 - DNA, 12 bp, Homo sapiens
tttccatatgtt

SEQ ID NO: 1723451 - DNA, 14 bp, Homo sapiens
tttccatcatgtct

SEQ ID NO: 1723452 - DNA, 17 bp, Homo sapiens
tttccatcatgtctgta

SEQ ID NO: 1723453 - DNA, 19 bp, Homo sapiens
tttccatcttaatgttact

SEQ ID NO: 1723454 - DNA, 19 bp, Homo sapiens
tttccatgcgtgtttctga

SEQ ID NO: 1723455 - DNA, 18 bp, Homo sapiens
tttccatgggagccagct

SEQ ID NO: 1723456 - DNA, 14 bp, Homo sapiens
tttccatgttgctg

SEQ ID NO: 1723457 - DNA, 13 bp, Homo sapiens
tttccatgttttt

SEQ ID NO: 1723458 - DNA, 19 bp, Homo sapiens
tttccatttatttatgaaa

SEQ ID NO: 1723459 - DNA, 11 bp, Homo sapiens
tttccatttct

SEQ ID NO: 1723460 - DNA, 13 bp, Homo sapiens
tttcccaaagcac

SEQ ID NO: 1723461 - DNA, 14 bp, Homo sapiens
tttcccaaagcact

SEQ ID NO: 1723462 - DNA, 22 bp, Homo sapiens
tttcccaaagtcctctgctcca

SEQ ID NO: 1723463 - DNA, 14 bp, Homo sapiens
tttcccacatcttt

SEQ ID NO: 1723464 - DNA, 18 bp, Homo sapiens
tttcccaggaccctgaag

SEQ ID NO: 1723465 - DNA, 12 bp, Homo sapiens
tttcccaggacg

SEQ ID NO: 1723466 - DNA, 14 bp, Homo sapiens
tttcccaggagaaa

SEQ ID NO: 1723467 - DNA, 22 bp, Homo sapiens
tttcccaggcccactgtgcctc

SEQ ID NO: 1723468 - DNA, 16 bp, Homo sapiens
tttcccagttaaagat

SEQ ID NO: 1723469 - DNA, 12 bp, Homo sapiens
tttcccatctgc

SEQ ID NO: 1723470 - DNA, 14 bp, Homo sapiens
tttcccattggttc

SEQ ID NO: 1723471 - DNA, 19 bp, Homo sapiens
tttccccagccacaggcca

SEQ ID NO: 1723472 - DNA, 12 bp, Homo sapiens
tttccccctcct

SEQ ID NO: 1723473 - DNA, 22 bp, Homo sapiens
tttccccctgtttttagagctt

SEQ ID NO: 1723474 - DNA, 14 bp, Homo sapiens
tttcccccttcccg

SEQ ID NO: 1723475 - DNA, 21 bp, Homo sapiens
tttcccccttcccgccttcca

SEQ ID NO: 1723476 - DNA, 18 bp, Homo sapiens
tttcccctagcttactga

SEQ ID NO: 1723477 - DNA, 23 bp, Homo sapiens
tttcccctcccaatcctctctcc

SEQ ID NO: 1723478 - DNA, 16 bp, Homo sapiens
tttcccctccctgggt

SEQ ID NO: 1723479 - DNA, 22 bp, Homo sapiens
tttcccctccgtctttcccctc

SEQ ID NO: 1723480 - DNA, 21 bp, Homo sapiens
tttcccctggcctcagttccc

SEQ ID NO: 1723481 - DNA, 12 bp, Homo sapiens
tttccccttgga

SEQ ID NO: 1723482 - DNA, 18 bp, Homo sapiens
tttccctcgtccgtctgt

SEQ ID NO: 1723483 - DNA, 13 bp, Homo sapiens
tttccctgaagtt

SEQ ID NO: 1723484 - DNA, 13 bp, Homo sapiens
tttccctgaggaa

SEQ ID NO: 1723485 - DNA, 12 bp, Homo sapiens
tttccctgctga

SEQ ID NO: 1723486 - DNA, 14 bp, Homo sapiens
tttccctggaactc

SEQ ID NO: 1723487 - DNA, 23 bp, Homo sapiens
tttccctggacaggcagcctcct

SEQ ID NO: 1723488 - DNA, 22 bp, Homo sapiens
tttcccttaaatacagataatt

SEQ ID NO: 1723489 - DNA, 19 bp, Homo sapiens
tttcccttcagtaccctct

SEQ ID NO: 1723490 - DNA, 15 bp, Homo sapiens
tttcccttccaaaga

SEQ ID NO: 1723491 - DNA, 23 bp, Homo sapiens
tttcccttgccttatgggctgaa

SEQ ID NO: 1723492 - DNA, 21 bp, Homo sapiens
tttccctttagctgtgttatt

SEQ ID NO: 1723493 - DNA, 15 bp, Homo sapiens
tttccctttgccttc

SEQ ID NO: 1723494 - DNA, 16 bp, Homo sapiens
tttccgtttgcttttg

SEQ ID NO: 1723495 - DNA, 15 bp, Homo sapiens
tttcctaaatgcagt

SEQ ID NO: 1723496 - DNA, 16 bp, Homo sapiens
tttcctacagaaatac

SEQ ID NO: 1723497 - DNA, 18 bp, Homo sapiens
tttcctactgtcctcaga

SEQ ID NO: 1723498 - DNA, 19 bp, Homo sapiens
tttcctactgtcctcagag

SEQ ID NO: 1723499 - DNA, 21 bp, Homo sapiens
tttcctacttgcactcttcta

SEQ ID NO: 1723500 - DNA, 19 bp, Homo sapiens
tttcctagaagtggtttgt

SEQ ID NO: 1723501 - DNA, 17 bp, Homo sapiens
tttcctatcttccttcc

SEQ ID NO: 1723502 - DNA, 15 bp, Homo sapiens
tttcctatgggaaca

SEQ ID NO: 1723503 - DNA, 17 bp, Homo sapiens
tttcctatgggaacaat

SEQ ID NO: 1723504 - DNA, 18 bp, Homo sapiens
tttcctatttaatacagc

SEQ ID NO: 1723505 - DNA, 19 bp, Homo sapiens
tttcctcaagtatcttcta

SEQ ID NO: 1723506 - DNA, 16 bp, Homo sapiens
tttcctcatgtaacat

SEQ ID NO: 1723507 - DNA, 22 bp, Homo sapiens
tttcctcatgtaacattggtga

SEQ ID NO: 1723508 - DNA, 15 bp, Homo sapiens
tttcctccccctgca

SEQ ID NO: 1723509 - DNA, 17 bp, Homo sapiens
tttcctctttctgctct

SEQ ID NO: 1723510 - DNA, 21 bp, Homo sapiens
tttcctgaaacaacttggaaa

SEQ ID NO: 1723511 - DNA, 11 bp, Homo sapiens
ctgcagaggcc

SEQ ID NO: 1723512 - DNA, 21 bp, Homo sapiens
ctgcagaggccagaggccccc

SEQ ID NO: 1723513 - DNA, 21 bp, Homo sapiens
ctgcagaggggaaaccagtgt

SEQ ID NO: 1723514 - DNA, 22 bp, Homo sapiens
ctgcagaggggaaagacttcca

SEQ ID NO: 1723515 - DNA, 19 bp, Homo sapiens
ctgcagaggtctgtgctga

SEQ ID NO: 1723516 - DNA, 21 bp, Homo sapiens
ctgcagaggtctgtgctgagg

SEQ ID NO: 1723517 - DNA, 14 bp, Homo sapiens
ctgcagagtagtta

SEQ ID NO: 1723518 - DNA, 16 bp, Homo sapiens
ctgcagatcttccgtg

SEQ ID NO: 1723519 - DNA, 19 bp, Homo sapiens
ctgcagatcttccgtggtc

SEQ ID NO: 1723520 - DNA, 21 bp, Homo sapiens
ctgcagatgccaccctagcca

SEQ ID NO: 1723521 - DNA, 22 bp, Homo sapiens
ctgcagattagttctttttgcc

SEQ ID NO: 1723522 - DNA, 17 bp, Homo sapiens
ctgcagcaaacactcca

SEQ ID NO: 1723523 - DNA, 18 bp, Homo sapiens
ctgcagcaccgaggggcc

SEQ ID NO: 1723524 - DNA, 17 bp, Homo sapiens
ctgcagcacctccaggc

SEQ ID NO: 1723525 - DNA, 17 bp, Homo sapiens
ctgcagcatgacctgtg

SEQ ID NO: 1723526 - DNA, 22 bp, Homo sapiens
ctgcagcatgacctgtgaccag

SEQ ID NO: 1723527 - DNA, 20 bp, Homo sapiens
ctgcagcatgttgctgagga

SEQ ID NO: 1723528 - DNA, 21 bp, Homo sapiens
ctgcagcatgttgctgaggag

SEQ ID NO: 1723529 - DNA, 14 bp, Homo sapiens
ctgcagccagccca

SEQ ID NO: 1723530 - DNA, 16 bp, Homo sapiens
ctgcagccagcccagc

SEQ ID NO: 1723531 - DNA, 18 bp, Homo sapiens
ctgcagccagcccagccc

SEQ ID NO: 1723532 - DNA, 12 bp, Homo sapiens
ctgcagccagct

SEQ ID NO: 1723533 - DNA, 20 bp, Homo sapiens
ctgcagcccaaaacccaggg

SEQ ID NO: 1723534 - DNA, 19 bp, Homo sapiens
ctgcagccctctccaccct

SEQ ID NO: 1723535 - DNA, 17 bp, Homo sapiens
ctgcagcctccacttcc

SEQ ID NO: 1723536 - DNA, 20 bp, Homo sapiens
ctgcagcctccacttccctc

SEQ ID NO: 1723537 - DNA, 13 bp, Homo sapiens
ctgcagcctccct

SEQ ID NO: 1723538 - DNA, 22 bp, Homo sapiens
ctgcagcctccgcctcccgggt

SEQ ID NO: 1723539 - DNA, 20 bp, Homo sapiens
ctgcagcctcctcctgacca

SEQ ID NO: 1723540 - DNA, 17 bp, Homo sapiens
ctgcagcggcagagcaa

SEQ ID NO: 1723541 - DNA, 18 bp, Homo sapiens
ctgcagcggcagagcaat

SEQ ID NO: 1723542 - DNA, 17 bp, Homo sapiens
ctgcagcggcaggaccg

SEQ ID NO: 1723543 - DNA, 21 bp, Homo sapiens
ctgcagcggcaggaccgccat

SEQ ID NO: 1723544 - DNA, 22 bp, Homo sapiens
ctgcagcggcaggaccgccatg

SEQ ID NO: 1723545 - DNA, 21 bp, Homo sapiens
ctgcagctgacctctgttgtc

SEQ ID NO: 1723546 - DNA, 18 bp, Homo sapiens
ctgcagctgatccatagg

SEQ ID NO: 1723547 - DNA, 20 bp, Homo sapiens
ctgcagctgatccataggac

SEQ ID NO: 1723548 - DNA, 11 bp, Homo sapiens
ctgcagctgct

SEQ ID NO: 1723549 - DNA, 12 bp, Homo sapiens
ctgcagctgggc

SEQ ID NO: 1723550 - DNA, 13 bp, Homo sapiens
ctgcagctgggcc

SEQ ID NO: 1723551 - DNA, 15 bp, Homo sapiens
ctgcagctgggcccc

SEQ ID NO: 1723552 - DNA, 20 bp, Homo sapiens
ctgcagctgggccccatgct

SEQ ID NO: 1723553 - DNA, 21 bp, Homo sapiens
ctgcagctgggccccatgctc

SEQ ID NO: 1723554 - DNA, 24 bp, Homo sapiens
ctgcagctgggccccatgctctgc

SEQ ID NO: 1723555 - DNA, 17 bp, Homo sapiens
ctgcagctgtttcaaag

SEQ ID NO: 1723556 - DNA, 15 bp, Homo sapiens
ctgcaggaacgagca

SEQ ID NO: 1723557 - DNA, 18 bp, Homo sapiens
ctgcaggaacgagcactg

SEQ ID NO: 1723558 - DNA, 15 bp, Homo sapiens
ctgcaggacattaat

SEQ ID NO: 1723559 - DNA, 23 bp, Homo sapiens
ctgcaggacttgagaagacctca

SEQ ID NO: 1723560 - DNA, 20 bp, Homo sapiens
ctgcaggagtgtcctgccca

SEQ ID NO: 1723561 - DNA, 22 bp, Homo sapiens
ctgcaggccaagagcagaggca

SEQ ID NO: 1723562 - DNA, 23 bp, Homo sapiens
ctgcaggccaagagcagaggcag

SEQ ID NO: 1723563 - DNA, 24 bp, Homo sapiens
ctgcaggccaagagcagaggcagc

SEQ ID NO: 1723564 - DNA, 16 bp, Homo sapiens
ctgcaggccactgtga

SEQ ID NO: 1723565 - DNA, 14 bp, Homo sapiens
ctgcaggccccgct

SEQ ID NO: 1723566 - DNA, 23 bp, Homo sapiens
ctgcaggccccgcttgtccagcg

SEQ ID NO: 1723567 - DNA, 11 bp, Homo sapiens
ctgcaggctcc

SEQ ID NO: 1723568 - DNA, 12 bp, Homo sapiens
ctgcaggctcca

SEQ ID NO: 1723569 - DNA, 18 bp, Homo sapiens
ctgcaggctccatgcacc

SEQ ID NO: 1723570 - DNA, 18 bp, Homo sapiens
ctgcaggctggctgttgg

SEQ ID NO: 1723571 - DNA, 15 bp, Homo sapiens
ctgcagggccatctg

SEQ ID NO: 1723572 - DNA, 18 bp, Homo sapiens
ctgcagggccatggctca

SEQ ID NO: 1723573 - DNA, 23 bp, Homo sapiens
ctgcagggccatggctcagggtg

SEQ ID NO: 1723574 - DNA, 17 bp, Homo sapiens
ctgcagggcccttatgg

SEQ ID NO: 1723575 - DNA, 23 bp, Homo sapiens
ctgcagggccgcgagaggccgag

SEQ ID NO: 1723576 - DNA, 15 bp, Homo sapiens
ctgcagggctcccat

SEQ ID NO: 1723577 - DNA, 18 bp, Homo sapiens
ctgcagggctttaaaatt

SEQ ID NO: 1723578 - DNA, 18 bp, Homo sapiens
ctgcagggtggtgctggg

SEQ ID NO: 1723579 - DNA, 17 bp, Homo sapiens
ctgcaggtcagttgtaa

SEQ ID NO: 1723580 - DNA, 19 bp, Homo sapiens
ctgcaggtgggctgctgag

SEQ ID NO: 1723581 - DNA, 17 bp, Homo sapiens
ctgcagtagaaggtgcc

SEQ ID NO: 1723582 - DNA, 13 bp, Homo sapiens
ctgcagtcacagc

SEQ ID NO: 1723583 - DNA, 15 bp, Homo sapiens
ctgcagtcagccctg

SEQ ID NO: 1723584 - DNA, 23 bp, Homo sapiens
ctgcagtcagccctgattgtgcc

SEQ ID NO: 1723585 - DNA, 21 bp, Homo sapiens
ctgcagtcagtcatgatggca

SEQ ID NO: 1723586 - DNA, 13 bp, Homo sapiens
ctgcagtcctgga

SEQ ID NO: 1723587 - DNA, 14 bp, Homo sapiens
ctgcagtcctggtg

SEQ ID NO: 1723588 - DNA, 16 bp, Homo sapiens
ctgcagtcctggtggg

SEQ ID NO: 1723589 - DNA, 18 bp, Homo sapiens
ctgcagtcggcatgccag

SEQ ID NO: 1723590 - DNA, 12 bp, Homo sapiens
ctgcagtctcat

SEQ ID NO: 1723591 - DNA, 19 bp, Homo sapiens
ctgcagtctcatttctcat

SEQ ID NO: 1723592 - DNA, 19 bp, Homo sapiens
ctgcagtcttctctctggc

SEQ ID NO: 1723593 - DNA, 22 bp, Homo sapiens
ctgcagtcttctctctggctca

SEQ ID NO: 1723594 - DNA, 15 bp, Homo sapiens
ctgcagtgagctgtg

SEQ ID NO: 1723595 - DNA, 16 bp, Homo sapiens
ctgcagtgaggctgtg

SEQ ID NO: 1723596 - DNA, 18 bp, Homo sapiens
ctgcagtgattcagcagg

SEQ ID NO: 1723597 - DNA, 19 bp, Homo sapiens
ctgcagtgattcagcaggc

SEQ ID NO: 1723598 - DNA, 19 bp, Homo sapiens
ctgcagtgccagctccctc

SEQ ID NO: 1723599 - DNA, 16 bp, Homo sapiens
ctgcagtgtggagttc

SEQ ID NO: 1723600 - DNA, 15 bp, Homo sapiens
ctgcagttacttttg

SEQ ID NO: 1723601 - DNA, 19 bp, Homo sapiens
ctgcagtttggccctggag

SEQ ID NO: 1723602 - DNA, 22 bp, Homo sapiens
ctgcagtttggccctggagcca

SEQ ID NO: 1723603 - DNA, 18 bp, Homo sapiens
ctgcagtttttcaggagc

SEQ ID NO: 1723604 - DNA, 15 bp, Homo sapiens
ctgcagtttttccca

SEQ ID NO: 1723605 - DNA, 13 bp, Homo sapiens
ctgcatactttga

SEQ ID NO: 1723606 - DNA, 14 bp, Homo sapiens
ctgcatacttttta

SEQ ID NO: 1723607 - DNA, 20 bp, Homo sapiens
ctgcatactttttaaatgta

SEQ ID NO: 1723608 - DNA, 18 bp, Homo sapiens
ctgcatagctctatttta

SEQ ID NO: 1723609 - DNA, 20 bp, Homo sapiens
ctgcataggagtttggagga

SEQ ID NO: 1723610 - DNA, 20 bp, Homo sapiens
ctgcatcatatatttaacaa

SEQ ID NO: 1723611 - DNA, 17 bp, Homo sapiens
ctgcatcatctgtagat

SEQ ID NO: 1723612 - DNA, 18 bp, Homo sapiens
ctgcatcatctgtagata

SEQ ID NO: 1723613 - DNA, 19 bp, Homo sapiens
ctgcatcccattgctagca

SEQ ID NO: 1723614 - DNA, 12 bp, Homo sapiens
ctgcatccctgt

SEQ ID NO: 1723615 - DNA, 17 bp, Homo sapiens
ctgcatccctgtgtcca

SEQ ID NO: 1723616 - DNA, 21 bp, Homo sapiens
ctgcatccctgtgtccactga

SEQ ID NO: 1723617 - DNA, 14 bp, Homo sapiens
ctgcatccttcctg

SEQ ID NO: 1723618 - DNA, 16 bp, Homo sapiens
ctgcatccttcctggg

SEQ ID NO: 1723619 - DNA, 17 bp, Homo sapiens
ctgcatctactcccaag

SEQ ID NO: 1723620 - DNA, 18 bp, Homo sapiens
ctgcatctactcccaagt

SEQ ID NO: 1723621 - DNA, 14 bp, Homo sapiens
ctgcatctggggcc

SEQ ID NO: 1723622 - DNA, 14 bp, Homo sapiens
ctgcatgagctggc

SEQ ID NO: 1723623 - DNA, 13 bp, Homo sapiens
ctgcatgatgttt

SEQ ID NO: 1723624 - DNA, 15 bp, Homo sapiens
ctgcatgcgacagcg

SEQ ID NO: 1723625 - DNA, 18 bp, Homo sapiens
ctgcatgcgacagcgtcc

SEQ ID NO: 1723626 - DNA, 16 bp, Homo sapiens
ctgcatgctctggaag

SEQ ID NO: 1723627 - DNA, 23 bp, Homo sapiens
tttatgacctgaaataatatatt

SEQ ID NO: 1723628 - DNA, 20 bp, Homo sapiens
tttatgagatgctggttttc

SEQ ID NO: 1723629 - DNA, 12 bp, Homo sapiens
tttatgagccag

SEQ ID NO: 1723630 - DNA, 19 bp, Homo sapiens
tttatgagccagacaaatg

SEQ ID NO: 1723631 - DNA, 15 bp, Homo sapiens
tttatgatcagtgtt

SEQ ID NO: 1723632 - DNA, 14 bp, Homo sapiens
tttatgatgcaaat

SEQ ID NO: 1723633 - DNA, 15 bp, Homo sapiens
tttatgatgctaagc

SEQ ID NO: 1723634 - DNA, 20 bp, Homo sapiens
tttatgatggagcaactgaa

SEQ ID NO: 1723635 - DNA, 14 bp, Homo sapiens
tttatgatgtatat

SEQ ID NO: 1723636 - DNA, 20 bp, Homo sapiens
tttatgcatttgcatttgct

SEQ ID NO: 1723637 - DNA, 18 bp, Homo sapiens
tttatgccagttgttaaa

SEQ ID NO: 1723638 - DNA, 22 bp, Homo sapiens
tttatggggctgaacggggaga

SEQ ID NO: 1723639 - DNA, 19 bp, Homo sapiens
tttatggtaaaaaatttat

SEQ ID NO: 1723640 - DNA, 17 bp, Homo sapiens
tttatggttaatactat

SEQ ID NO: 1723641 - DNA, 16 bp, Homo sapiens
tttatggtttctccag

SEQ ID NO: 1723642 - DNA, 11 bp, Homo sapiens
tttatgtaaaa

SEQ ID NO: 1723643 - DNA, 17 bp, Homo sapiens
tttatgtcatagaaata

SEQ ID NO: 1723644 - DNA, 13 bp, Homo sapiens
tttatgtgaaatg

SEQ ID NO: 1723645 - DNA, 20 bp, Homo sapiens
tttatgttaagggaagaatt

SEQ ID NO: 1723646 - DNA, 22 bp, Homo sapiens
tttatgtttgtcttttaatgct

SEQ ID NO: 1723647 - DNA, 17 bp, Homo sapiens
tttatgttttgtttctg

SEQ ID NO: 1723648 - DNA, 18 bp, Homo sapiens
tttatgttttgtttctga

SEQ ID NO: 1723649 - DNA, 14 bp, Homo sapiens
tttatgtttttggt

SEQ ID NO: 1723650 - DNA, 22 bp, Homo sapiens
tttattaaacagatttttacaa

SEQ ID NO: 1723651 - DNA, 23 bp, Homo sapiens
tttattaaacagatttttacaaa

SEQ ID NO: 1723652 - DNA, 18 bp, Homo sapiens
tttattaaagcatttcct

SEQ ID NO: 1723653 - DNA, 12 bp, Homo sapiens
tttattaacaaa

SEQ ID NO: 1723654 - DNA, 12 bp, Homo sapiens
tttattaatgtt

SEQ ID NO: 1723655 - DNA, 16 bp, Homo sapiens
tttattaatttatatg

SEQ ID NO: 1723656 - DNA, 18 bp, Homo sapiens
tttattacaatgtatctt

SEQ ID NO: 1723657 - DNA, 20 bp, Homo sapiens
tttattacctctgatacctc

SEQ ID NO: 1723658 - DNA, 15 bp, Homo sapiens
tttattatgagctac

SEQ ID NO: 1723659 - DNA, 17 bp, Homo sapiens
tttattattttcacctg

SEQ ID NO: 1723660 - DNA, 14 bp, Homo sapiens
tttattcaaactga

SEQ ID NO: 1723661 - DNA, 18 bp, Homo sapiens
tttattcaaggaagtttt

SEQ ID NO: 1723662 - DNA, 17 bp, Homo sapiens
tttattcatctgtgaaa

SEQ ID NO: 1723663 - DNA, 20 bp, Homo sapiens
tttattcatgccatctgttt

SEQ ID NO: 1723664 - DNA, 12 bp, Homo sapiens
tttattcccaag

SEQ ID NO: 1723665 - DNA, 22 bp, Homo sapiens
tttattcccaagtatgccttaa

SEQ ID NO: 1723666 - DNA, 14 bp, Homo sapiens
tttattccttgtga

SEQ ID NO: 1723667 - DNA, 18 bp, Homo sapiens
tttattctatgtatgtta

SEQ ID NO: 1723668 - DNA, 15 bp, Homo sapiens
tttattcttctagag

SEQ ID NO: 1723669 - DNA, 16 bp, Homo sapiens
tttattcttctagagt

SEQ ID NO: 1723670 - DNA, 18 bp, Homo sapiens
tttattcttctagagttc

SEQ ID NO: 1723671 - DNA, 22 bp, Homo sapiens
tttattgactttgacaattact

SEQ ID NO: 1723672 - DNA, 13 bp, Homo sapiens
tttattgcaaagt

SEQ ID NO: 1723673 - DNA, 18 bp, Homo sapiens
tttattggaagtgttcaa

SEQ ID NO: 1723674 - DNA, 12 bp, Homo sapiens
tttattgtacag

SEQ ID NO: 1723675 - DNA, 13 bp, Homo sapiens
tttattgtacaga

SEQ ID NO: 1723676 - DNA, 22 bp, Homo sapiens
tttattgtctgtctacatttct

SEQ ID NO: 1723677 - DNA, 19 bp, Homo sapiens
tttattgttaatacaaggt

SEQ ID NO: 1723678 - DNA, 22 bp, Homo sapiens
tttattgtttaaaatcatttct

SEQ ID NO: 1723679 - DNA, 19 bp, Homo sapiens
tttatttaatgctgtggca

SEQ ID NO: 1723680 - DNA, 11 bp, Homo sapiens
tttatttaatt

SEQ ID NO: 1723681 - DNA, 19 bp, Homo sapiens
tttatttagtttttaacaa

SEQ ID NO: 1723682 - DNA, 19 bp, Homo sapiens
tttatttatatgtactgtt

SEQ ID NO: 1723683 - DNA, 15 bp, Homo sapiens
tttatttatcagtga

SEQ ID NO: 1723684 - DNA, 20 bp, Homo sapiens
tttatttccactattttcaa

SEQ ID NO: 1723685 - DNA, 20 bp, Homo sapiens
tttatttcttcgtgaacata

SEQ ID NO: 1723686 - DNA, 12 bp, Homo sapiens
tttatttggcat

SEQ ID NO: 1723687 - DNA, 23 bp, Homo sapiens
tttatttgtaattttaaaagtct

SEQ ID NO: 1723688 - DNA, 21 bp, Homo sapiens
tttattttacacagaaacact

SEQ ID NO: 1723689 - DNA, 21 bp, Homo sapiens
tttattttcagtatactgtgt

SEQ ID NO: 1723690 - DNA, 15 bp, Homo sapiens
tttattttcctaaag

SEQ ID NO: 1723691 - DNA, 11 bp, Homo sapiens
tttattttctt

SEQ ID NO: 1723692 - DNA, 18 bp, Homo sapiens
tttattttgagatgtaaa

SEQ ID NO: 1723693 - DNA, 16 bp, Homo sapiens
tttatttttagttaaa

SEQ ID NO: 1723694 - DNA, 23 bp, Homo sapiens
tttatttttgaacccctgtgtcc

SEQ ID NO: 1723695 - DNA, 18 bp, Homo sapiens
tttattttttaaaaatga

SEQ ID NO: 1723696 - DNA, 16 bp, Homo sapiens
tttattttttaaatgt

SEQ ID NO: 1723697 - DNA, 14 bp, Homo sapiens
tttattttttaagt

SEQ ID NO: 1723698 - DNA, 18 bp, Homo sapiens
tttattttttctacacag

SEQ ID NO: 1723699 - DNA, 17 bp, Homo sapiens
tttattttttcttctgt

SEQ ID NO: 1723700 - DNA, 17 bp, Homo sapiens
tttattttttttggcct

SEQ ID NO: 1723701 - DNA, 13 bp, Homo sapiens
tttcaaaaaccag

SEQ ID NO: 1723702 - DNA, 18 bp, Homo sapiens
tttcaaaaatataactta

SEQ ID NO: 1723703 - DNA, 21 bp, Homo sapiens
tttcaaaaatataacttaaaa

SEQ ID NO: 1723704 - DNA, 13 bp, Homo sapiens
tttcaaaatacat

SEQ ID NO: 1723705 - DNA, 15 bp, Homo sapiens
tttcaaaatacattt

SEQ ID NO: 1723706 - DNA, 21 bp, Homo sapiens
tttcaaaatatattttcagta

SEQ ID NO: 1723707 - DNA, 22 bp, Homo sapiens
tttcaaactgaatttgttctta

SEQ ID NO: 1723708 - DNA, 19 bp, Homo sapiens
tttcaaacttactattttg

SEQ ID NO: 1723709 - DNA, 14 bp, Homo sapiens
tttcaaagaaggaa

SEQ ID NO: 1723710 - DNA, 20 bp, Homo sapiens
tttcaaagccctgcctctgt

SEQ ID NO: 1723711 - DNA, 19 bp, Homo sapiens
tttcaaatagggtctaact

SEQ ID NO: 1723712 - DNA, 23 bp, Homo sapiens
tttcaacaaagatcatttaatac

SEQ ID NO: 1723713 - DNA, 16 bp, Homo sapiens
tttcaacatgagtgta

SEQ ID NO: 1723714 - DNA, 17 bp, Homo sapiens
tgcctgtgaggcagggg

SEQ ID NO: 1723715 - DNA, 11 bp, Homo sapiens
tgcctgtgcca

SEQ ID NO: 1723716 - DNA, 19 bp, Homo sapiens
tgcctgtgccacccaccag

SEQ ID NO: 1723717 - DNA, 20 bp, Homo sapiens
tgcctgtgccacccaccagg

SEQ ID NO: 1723718 - DNA, 13 bp, Homo sapiens
tgcctgtgctcct

SEQ ID NO: 1723719 - DNA, 15 bp, Homo sapiens
tgcctgtgctcctgc

SEQ ID NO: 1723720 - DNA, 18 bp, Homo sapiens
tgcctgtgctcctgccca

SEQ ID NO: 1723721 - DNA, 21 bp, Homo sapiens
tgcctgtggccttgcccgcca

SEQ ID NO: 1723722 - DNA, 18 bp, Homo sapiens
tgcctgttataactctgc

SEQ ID NO: 1723723 - DNA, 19 bp, Homo sapiens
tgcctgttataactctgca

SEQ ID NO: 1723724 - DNA, 15 bp, Homo sapiens
tgcctgttctgcttc

SEQ ID NO: 1723725 - DNA, 16 bp, Homo sapiens
tgcctgttggctgctg

SEQ ID NO: 1723726 - DNA, 21 bp, Homo sapiens
tgcctgttggctgctgcggct

SEQ ID NO: 1723727 - DNA, 14 bp, Homo sapiens
tgcctgtttcccag

SEQ ID NO: 1723728 - DNA, 19 bp, Homo sapiens
tgcctgtttcccaggccca

SEQ ID NO: 1723729 - DNA, 15 bp, Homo sapiens
tgccttaaaaccaaa

SEQ ID NO: 1723730 - DNA, 17 bp, Homo sapiens
tgccttaaaaggagaga

SEQ ID NO: 1723731 - DNA, 12 bp, Homo sapiens
tgccttaagcag

SEQ ID NO: 1723732 - DNA, 15 bp, Homo sapiens
tgccttaagcagaac

SEQ ID NO: 1723733 - DNA, 20 bp, Homo sapiens
tgccttaagcagaacaaatg

SEQ ID NO: 1723734 - DNA, 23 bp, Homo sapiens
tgccttaagcagaacaaatgtgt

SEQ ID NO: 1723735 - DNA, 18 bp, Homo sapiens
tgccttaagttttagtct

SEQ ID NO: 1723736 - DNA, 19 bp, Homo sapiens
tgccttaagttttagtctt

SEQ ID NO: 1723737 - DNA, 13 bp, Homo sapiens
tgccttaataaat

SEQ ID NO: 1723738 - DNA, 20 bp, Homo sapiens
tgccttaataaatatgtaat

SEQ ID NO: 1723739 - DNA, 21 bp, Homo sapiens
tgccttaataaatatgtaata

SEQ ID NO: 1723740 - DNA, 18 bp, Homo sapiens
tgccttacatcttttcta

SEQ ID NO: 1723741 - DNA, 20 bp, Homo sapiens
tgccttacatcttttctaat

SEQ ID NO: 1723742 - DNA, 14 bp, Homo sapiens
tgccttacctcctg

SEQ ID NO: 1723743 - DNA, 18 bp, Homo sapiens
tgccttacctcctgccca

SEQ ID NO: 1723744 - DNA, 18 bp, Homo sapiens
tgccttactcttcttgaa

SEQ ID NO: 1723745 - DNA, 19 bp, Homo sapiens
tgccttactcttcttgaaa

SEQ ID NO: 1723746 - DNA, 21 bp, Homo sapiens
tgccttagaacctttcttaca

SEQ ID NO: 1723747 - DNA, 21 bp, Homo sapiens
tgccttagggtttgcagagtg

SEQ ID NO: 1723748 - DNA, 16 bp, Homo sapiens
tgccttagtctcagtt

SEQ ID NO: 1723749 - DNA, 20 bp, Homo sapiens
tgccttagtctcagtttgtg

SEQ ID NO: 1723750 - DNA, 18 bp, Homo sapiens
tgccttatttgtctgtaa

SEQ ID NO: 1723751 - DNA, 23 bp, Homo sapiens
tgccttatttgtctgtaaaaaat

SEQ ID NO: 1723752 - DNA, 23 bp, Homo sapiens
tgccttcaacaacgtgagagaaa

SEQ ID NO: 1723753 - DNA, 19 bp, Homo sapiens
tgccttcaaggactgtttc

SEQ ID NO: 1723754 - DNA, 14 bp, Homo sapiens
tgccttcaataaat

SEQ ID NO: 1723755 - DNA, 15 bp, Homo sapiens
tgccttcacaaatgt

SEQ ID NO: 1723756 - DNA, 13 bp, Homo sapiens
tgccttcagccct

SEQ ID NO: 1723757 - DNA, 15 bp, Homo sapiens
tgccttcagccctaa

SEQ ID NO: 1723758 - DNA, 18 bp, Homo sapiens
tgccttcatcttcactgc

SEQ ID NO: 1723759 - DNA, 20 bp, Homo sapiens
tgccttccaaacctgagaat

SEQ ID NO: 1723760 - DNA, 21 bp, Homo sapiens
tgccttccataattatgacag

SEQ ID NO: 1723761 - DNA, 22 bp, Homo sapiens
tgccttcccttctctggtctcc

SEQ ID NO: 1723762 - DNA, 17 bp, Homo sapiens
tgccttcctcatcccct

SEQ ID NO: 1723763 - DNA, 21 bp, Homo sapiens
tgccttcctctctctaccagt

SEQ ID NO: 1723764 - DNA, 15 bp, Homo sapiens
tgccttcctgttttt

SEQ ID NO: 1723765 - DNA, 19 bp, Homo sapiens
tgccttcctgtttttcaca

SEQ ID NO: 1723766 - DNA, 17 bp, Homo sapiens
tgccttcgcttcttgcc

SEQ ID NO: 1723767 - DNA, 16 bp, Homo sapiens
tgccttctactcccct

SEQ ID NO: 1723768 - DNA, 16 bp, Homo sapiens
tgccttctacttttaa

SEQ ID NO: 1723769 - DNA, 16 bp, Homo sapiens
tgccttctctcagctc

SEQ ID NO: 1723770 - DNA, 23 bp, Homo sapiens
tgccttctctcagctcccaggcc

SEQ ID NO: 1723771 - DNA, 15 bp, Homo sapiens
tgccttctggagctg

SEQ ID NO: 1723772 - DNA, 21 bp, Homo sapiens
tgccttcttattctcactcca

SEQ ID NO: 1723773 - DNA, 14 bp, Homo sapiens
tgccttcttcaccc

SEQ ID NO: 1723774 - DNA, 16 bp, Homo sapiens
tgccttcttcacccag

SEQ ID NO: 1723775 - DNA, 23 bp, Homo sapiens
tgccttcttcggggaactcctgg

SEQ ID NO: 1723776 - DNA, 23 bp, Homo sapiens
tgccttgagacccccaagcttcc

SEQ ID NO: 1723777 - DNA, 19 bp, Homo sapiens
tgccttgctgacaataaag

SEQ ID NO: 1723778 - DNA, 17 bp, Homo sapiens
tgccttggcctcccaag

SEQ ID NO: 1723779 - DNA, 13 bp, Homo sapiens
tgccttggctcag

SEQ ID NO: 1723780 - DNA, 19 bp, Homo sapiens
tgccttgggctgctcctca

SEQ ID NO: 1723781 - DNA, 13 bp, Homo sapiens
tgccttggttttt

SEQ ID NO: 1723782 - DNA, 13 bp, Homo sapiens
tgccttgtataaa

SEQ ID NO: 1723783 - DNA, 16 bp, Homo sapiens
tgccttgtataatatt

SEQ ID NO: 1723784 - DNA, 16 bp, Homo sapiens
tgccttgtttcatagt

SEQ ID NO: 1723785 - DNA, 15 bp, Homo sapiens
tgcctttaaatctgt

SEQ ID NO: 1723786 - DNA, 19 bp, Homo sapiens
tgcctttaaatctgtgatg

SEQ ID NO: 1723787 - DNA, 14 bp, Homo sapiens
tgcctttaagccaa

SEQ ID NO: 1723788 - DNA, 18 bp, Homo sapiens
tgcctttagcctggacca

SEQ ID NO: 1723789 - DNA, 21 bp, Homo sapiens
tgcctttagcgtgtaaatgga

SEQ ID NO: 1723790 - DNA, 22 bp, Homo sapiens
tgcctttatgatgctaagctga

SEQ ID NO: 1723791 - DNA, 16 bp, Homo sapiens
tgcctttcgaggcctg

SEQ ID NO: 1723792 - DNA, 17 bp, Homo sapiens
tgcctttcgaggcctga

SEQ ID NO: 1723793 - DNA, 13 bp, Homo sapiens
tgcctttctagtc

SEQ ID NO: 1723794 - DNA, 15 bp, Homo sapiens
tgcctttctgcagtt

SEQ ID NO: 1723795 - DNA, 13 bp, Homo sapiens
tgcctttctttgc

SEQ ID NO: 1723796 - DNA, 21 bp, Homo sapiens
tgcctttgcagttggactctc

SEQ ID NO: 1723797 - DNA, 13 bp, Homo sapiens
tgcctttggcctg

SEQ ID NO: 1723798 - DNA, 13 bp, Homo sapiens
tgcctttgtaagt

SEQ ID NO: 1723799 - DNA, 16 bp, Homo sapiens
tgcctttgtaagttat

SEQ ID NO: 1723800 - DNA, 13 bp, Homo sapiens
tgccttttctgaa

SEQ ID NO: 1723801 - DNA, 13 bp, Homo sapiens
tgccttttctgga

SEQ ID NO: 1723802 - DNA, 14 bp, Homo sapiens
tgccttttgcaccc

SEQ ID NO: 1723803 - DNA, 17 bp, Homo sapiens
tgccttttgcacccctc

SEQ ID NO: 1723804 - DNA, 18 bp, Homo sapiens
tgccttttgcacccctcc

SEQ ID NO: 1723805 - DNA, 16 bp, Homo sapiens
tgccttttgcagaaga

SEQ ID NO: 1723806 - DNA, 21 bp, Homo sapiens
tgcctttttagatgtattttt

SEQ ID NO: 1723807 - DNA, 13 bp, Homo sapiens
tgcctttttattt

SEQ ID NO: 1723808 - DNA, 21 bp, Homo sapiens
tgccttttttctatatcaaaa

SEQ ID NO: 1723809 - DNA, 20 bp, Homo sapiens
tgcgaagaccctcttgccca

SEQ ID NO: 1723810 - DNA, 16 bp, Homo sapiens
tgcgaaggggccctgg

SEQ ID NO: 1723811 - DNA, 15 bp, Homo sapiens
tgcgacagagagagg

SEQ ID NO: 1723812 - DNA, 16 bp, Homo sapiens
tgcgacagagagaggg

SEQ ID NO: 1723813 - DNA, 18 bp, Homo sapiens
tgcgaccccccacccccg

SEQ ID NO: 1723814 - DNA, 14 bp, Homo sapiens
tgcgaccctggggg

SEQ ID NO: 1723815 - DNA, 17 bp, Homo sapiens
tgcgactttctgcctgg

SEQ ID NO: 1723816 - DNA, 18 bp, Homo sapiens
tgcgactttctgcctgga

SEQ ID NO: 1723817 - DNA, 23 bp, Homo sapiens
tgcgagacgcacacagctgagca

SEQ ID NO: 1723818 - DNA, 13 bp, Homo sapiens
tgcgatagagtct

SEQ ID NO: 1723819 - DNA, 12 bp, Homo sapiens
tgcgattctgga

SEQ ID NO: 1723820 - DNA, 15 bp, Homo sapiens
tgcgattctggataa

SEQ ID NO: 1723821 - DNA, 19 bp, Homo sapiens
tgcgcacaccgccagcagc

SEQ ID NO: 1723822 - DNA, 16 bp, Homo sapiens
tgcgcacaggtgggag

SEQ ID NO: 1723823 - DNA, 16 bp, Homo sapiens
tgcgcagaaaacaaga

SEQ ID NO: 1723824 - DNA, 12 bp, Homo sapiens
tgcgcagaggcc

SEQ ID NO: 1723825 - DNA, 16 bp, Homo sapiens
tgcgcagaggccagtt

SEQ ID NO: 1723826 - DNA, 19 bp, Homo sapiens
tgcgcaggtctcttctggg

SEQ ID NO: 1723827 - DNA, 15 bp, Homo sapiens
tgcgcatcttgcctc

SEQ ID NO: 1723828 - DNA, 23 bp, Homo sapiens
ttcctggggatgtcatagccaaa

SEQ ID NO: 1723829 - DNA, 16 bp, Homo sapiens
ttcctggggccccgct

SEQ ID NO: 1723830 - DNA, 16 bp, Homo sapiens
ttcctgggtcctgcct

SEQ ID NO: 1723831 - DNA, 18 bp, Homo sapiens
ttcctggtacccagccat

SEQ ID NO: 1723832 - DNA, 19 bp, Homo sapiens
ttcctggtgccaatttcaa

SEQ ID NO: 1723833 - DNA, 16 bp, Homo sapiens
ttcctggttgttcctg

SEQ ID NO: 1723834 - DNA, 19 bp, Homo sapiens
ttcctggttgttcctgcat

SEQ ID NO: 1723835 - DNA, 22 bp, Homo sapiens
ttcctgtaaagaaacatttcct

SEQ ID NO: 1723836 - DNA, 14 bp, Homo sapiens
ttcctgtaacaggt

SEQ ID NO: 1723837 - DNA, 12 bp, Homo sapiens
ttcctgtactgt

SEQ ID NO: 1723838 - DNA, 22 bp, Homo sapiens
ttcctgtccagctccaacctgc

SEQ ID NO: 1723839 - DNA, 14 bp, Homo sapiens
ttcctgtggccagg

SEQ ID NO: 1723840 - DNA, 18 bp, Homo sapiens
ttcctgtggccaggaggt

SEQ ID NO: 1723841 - DNA, 19 bp, Homo sapiens
ttcctgtgtacctctagaa

SEQ ID NO: 1723842 - DNA, 17 bp, Homo sapiens
ttcctgtgtgtactctg

SEQ ID NO: 1723843 - DNA, 18 bp, Homo sapiens
ttcctgttgatgggaaaa

SEQ ID NO: 1723844 - DNA, 21 bp, Homo sapiens
ttcctgtttgaaatatcatgt

SEQ ID NO: 1723845 - DNA, 21 bp, Homo sapiens
ttccttaaaattaagttgaaa

SEQ ID NO: 1723846 - DNA, 14 bp, Homo sapiens
ttccttaaacatga

SEQ ID NO: 1723847 - DNA, 13 bp, Homo sapiens
ttccttaaactgt

SEQ ID NO: 1723848 - DNA, 16 bp, Homo sapiens
ttccttaaactgtgtg

SEQ ID NO: 1723849 - DNA, 19 bp, Homo sapiens
ttccttaattgtattgttt

SEQ ID NO: 1723850 - DNA, 16 bp, Homo sapiens
ttccttactgcagaat

SEQ ID NO: 1723851 - DNA, 20 bp, Homo sapiens
ttccttagcttagacctcag

SEQ ID NO: 1723852 - DNA, 15 bp, Homo sapiens
ttccttatccctctc

SEQ ID NO: 1723853 - DNA, 17 bp, Homo sapiens
ttccttatccctctctt

SEQ ID NO: 1723854 - DNA, 21 bp, Homo sapiens
ttccttatccctctcttcccc

SEQ ID NO: 1723855 - DNA, 23 bp, Homo sapiens
ttccttatccctctcttcccctt

SEQ ID NO: 1723856 - DNA, 23 bp, Homo sapiens
ttccttatgtatcagtgtccttt

SEQ ID NO: 1723857 - DNA, 15 bp, Homo sapiens
ttccttatttgcctt

SEQ ID NO: 1723858 - DNA, 14 bp, Homo sapiens
ttccttcaggtttt

SEQ ID NO: 1723859 - DNA, 12 bp, Homo sapiens
ttccttcagttt

SEQ ID NO: 1723860 - DNA, 20 bp, Homo sapiens
ttccttcagtttgtaaagtc

SEQ ID NO: 1723861 - DNA, 23 bp, Homo sapiens
ttccttcagtttgtaaagtcggt

SEQ ID NO: 1723862 - DNA, 21 bp, Homo sapiens
ttccttccatcaaaagatgta

SEQ ID NO: 1723863 - DNA, 20 bp, Homo sapiens
ttccttcccaggccctttgg

SEQ ID NO: 1723864 - DNA, 15 bp, Homo sapiens
ttccttccctctcct

SEQ ID NO: 1723865 - DNA, 23 bp, Homo sapiens
ttccttccctctcctgcttcctc

SEQ ID NO: 1723866 - DNA, 13 bp, Homo sapiens
ttccttccctggc

SEQ ID NO: 1723867 - DNA, 16 bp, Homo sapiens
ttccttccctgggctg

SEQ ID NO: 1723868 - DNA, 21 bp, Homo sapiens
ttccttccctgggctgtgcta

SEQ ID NO: 1723869 - DNA, 14 bp, Homo sapiens
ttccttcctccttt

SEQ ID NO: 1723870 - DNA, 16 bp, Homo sapiens
ttccttccttccctgg

SEQ ID NO: 1723871 - DNA, 15 bp, Homo sapiens
ttccttccttcctcc

SEQ ID NO: 1723872 - DNA, 19 bp, Homo sapiens
ttccttcgaaaggccttca

SEQ ID NO: 1723873 - DNA, 17 bp, Homo sapiens
ttccttctcacttagaa

SEQ ID NO: 1723874 - DNA, 14 bp, Homo sapiens
ttccttctctgggt

SEQ ID NO: 1723875 - DNA, 17 bp, Homo sapiens
ttccttctgtgaaagta

SEQ ID NO: 1723876 - DNA, 13 bp, Homo sapiens
ttccttgaatctt

SEQ ID NO: 1723877 - DNA, 15 bp, Homo sapiens
ttccttgaccagcag

SEQ ID NO: 1723878 - DNA, 17 bp, Homo sapiens
ttccttgagaaaaacaa

SEQ ID NO: 1723879 - DNA, 13 bp, Homo sapiens
ttccttgccttaa

SEQ ID NO: 1723880 - DNA, 14 bp, Homo sapiens
ttccttggaggcca

SEQ ID NO: 1723881 - DNA, 18 bp, Homo sapiens
ttccttggaggccaccgg

SEQ ID NO: 1723882 - DNA, 23 bp, Homo sapiens
ttccttggtcctagtaagaagac

SEQ ID NO: 1723883 - DNA, 16 bp, Homo sapiens
ttccttgttcttccct

SEQ ID NO: 1723884 - DNA, 15 bp, Homo sapiens
ttcctttaaaaaact

SEQ ID NO: 1723885 - DNA, 17 bp, Homo sapiens
ttcctttcaggccaagg

SEQ ID NO: 1723886 - DNA, 19 bp, Homo sapiens
ttcctttcatctctctacc

SEQ ID NO: 1723887 - DNA, 13 bp, Homo sapiens
ttcctttctctcc

SEQ ID NO: 1723888 - DNA, 18 bp, Homo sapiens
ttcctttctctcctggct

SEQ ID NO: 1723889 - DNA, 17 bp, Homo sapiens
ttcctttggaagaaaaa

SEQ ID NO: 1723890 - DNA, 18 bp, Homo sapiens
ttcctttgtgtttctatt

SEQ ID NO: 1723891 - DNA, 17 bp, Homo sapiens
ttcctttgttgtctaca

SEQ ID NO: 1723892 - DNA, 18 bp, Homo sapiens
ttccttttctaactctcc

SEQ ID NO: 1723893 - DNA, 21 bp, Homo sapiens
ttccttttctgtataaagttc

SEQ ID NO: 1723894 - DNA, 13 bp, Homo sapiens
ttccttttcttta

SEQ ID NO: 1723895 - DNA, 22 bp, Homo sapiens
ttctaccgtggatttgtacttg

SEQ ID NO: 1723896 - DNA, 20 bp, Homo sapiens
ttctaccttgttgtgtttct

SEQ ID NO: 1723897 - DNA, 19 bp, Homo sapiens
ttctacggatcatcaacaa

SEQ ID NO: 1723898 - DNA, 20 bp, Homo sapiens
ttctactaaaaatacaaaaa

SEQ ID NO: 1723899 - DNA, 17 bp, Homo sapiens
ttctactctgtcttaaa

SEQ ID NO: 1723900 - DNA, 17 bp, Homo sapiens
ttctactcttgtcattt

SEQ ID NO: 1723901 - DNA, 17 bp, Homo sapiens
ttctactttcatcttaa

SEQ ID NO: 1723902 - DNA, 15 bp, Homo sapiens
ttctactttgcccct

SEQ ID NO: 1723903 - DNA, 16 bp, Homo sapiens
ttctagaagcacatgt

SEQ ID NO: 1723904 - DNA, 21 bp, Homo sapiens
ttctagaatttatcacacttc

SEQ ID NO: 1723905 - DNA, 17 bp, Homo sapiens
ttctagacttccccatc

SEQ ID NO: 1723906 - DNA, 20 bp, Homo sapiens
ttctagacttccccatcccg

SEQ ID NO: 1723907 - DNA, 15 bp, Homo sapiens
ttctagagacacatt

SEQ ID NO: 1723908 - DNA, 14 bp, Homo sapiens
ttctagatcctgca

SEQ ID NO: 1723909 - DNA, 16 bp, Homo sapiens
ttctagatcctgcacc

SEQ ID NO: 1723910 - DNA, 21 bp, Homo sapiens
ttctagatcctgcaccccagc

SEQ ID NO: 1723911 - DNA, 18 bp, Homo sapiens
ttctagcaaatatgctgt

SEQ ID NO: 1723912 - DNA, 16 bp, Homo sapiens
ttctagcaattttctt

SEQ ID NO: 1723913 - DNA, 18 bp, Homo sapiens
ttctagcaattttctttg

SEQ ID NO: 1723914 - DNA, 19 bp, Homo sapiens
ttctagcaattttctttgt

SEQ ID NO: 1723915 - DNA, 15 bp, Homo sapiens
ttctagcatggcata

SEQ ID NO: 1723916 - DNA, 20 bp, Homo sapiens
ttctagcatggcatattttt

SEQ ID NO: 1723917 - DNA, 22 bp, Homo sapiens
ttctagcatggcatatttttca

SEQ ID NO: 1723918 - DNA, 17 bp, Homo sapiens
ttctagcgcaaggcact

SEQ ID NO: 1723919 - DNA, 18 bp, Homo sapiens
ttctagctataacaactc

SEQ ID NO: 1723920 - DNA, 23 bp, Homo sapiens
ttctagctataacaactctattt

SEQ ID NO: 1723921 - DNA, 14 bp, Homo sapiens
ttctagctgtatga

SEQ ID NO: 1723922 - DNA, 12 bp, Homo sapiens
ttctagctgttg

SEQ ID NO: 1723923 - DNA, 20 bp, Homo sapiens
ttctagctgttgagctgttt

SEQ ID NO: 1723924 - DNA, 21 bp, Homo sapiens
ttctagctgttgagctgtttt

SEQ ID NO: 1723925 - DNA, 21 bp, Homo sapiens
ttctaggcactgtagttctaa

SEQ ID NO: 1723926 - DNA, 20 bp, Homo sapiens
ttctaggcatctctgtactt

SEQ ID NO: 1723927 - DNA, 20 bp, Homo sapiens
ttctaggtttcaaagatgct

SEQ ID NO: 1723928 - DNA, 15 bp, Homo sapiens
ttctagtcaactgct

SEQ ID NO: 1723929 - DNA, 19 bp, Homo sapiens
ttctagtcaactgctgttt

SEQ ID NO: 1723930 - DNA, 14 bp, Homo sapiens
ttctagtctctgat

SEQ ID NO: 1723931 - DNA, 16 bp, Homo sapiens
ttctagtctctgattt

SEQ ID NO: 1723932 - DNA, 12 bp, Homo sapiens
ttctagtgctgc

SEQ ID NO: 1723933 - DNA, 13 bp, Homo sapiens
ttctagtgctgct

SEQ ID NO: 1723934 - DNA, 14 bp, Homo sapiens
ttctagtgctgctg

SEQ ID NO: 1723935 - DNA, 16 bp, Homo sapiens
ttctagtgctgctgaa

SEQ ID NO: 1723936 - DNA, 18 bp, Homo sapiens
ttctagtgctgctgaaga

SEQ ID NO: 1723937 - DNA, 15 bp, Homo sapiens
ttctagtttcccaca

SEQ ID NO: 1723938 - DNA, 14 bp, Homo sapiens
ttctagtttgcatt

SEQ ID NO: 1723939 - DNA, 19 bp, Homo sapiens
ttctataaaatactggtat

SEQ ID NO: 1723940 - DNA, 12 bp, Homo sapiens
ttctataaatca

SEQ ID NO: 1723941 - DNA, 15 bp, Homo sapiens
ttctataaatcagta

SEQ ID NO: 1723942 - DNA, 20 bp, Homo sapiens
ttctataggaacatatgaaa

SEQ ID NO: 1723943 - DNA, 20 bp, Homo sapiens
ttctatatgaatttaaatat

SEQ ID NO: 1723944 - DNA, 15 bp, Homo sapiens
ttctatatttatttt

SEQ ID NO: 1723945 - DNA, 18 bp, Homo sapiens
ttctatattttaatagaa

SEQ ID NO: 1723946 - DNA, 17 bp, Homo sapiens
ttctatcaggaaaacaa

SEQ ID NO: 1723947 - DNA, 23 bp, Homo sapiens
ttctatcaggaaaacaaatcact

SEQ ID NO: 1723948 - DNA, 21 bp, Homo sapiens
ttctatcaggggtgcattctg

SEQ ID NO: 1723949 - DNA, 17 bp, Homo sapiens
ttctatccccaagctgg

SEQ ID NO: 1723950 - DNA, 17 bp, Homo sapiens
ttctatctctaagctgt

SEQ ID NO: 1723951 - DNA, 19 bp, Homo sapiens
ttgaggctgtcacagtcct

SEQ ID NO: 1723952 - DNA, 17 bp, Homo sapiens
ttgaggcttctccttct

SEQ ID NO: 1723953 - DNA, 19 bp, Homo sapiens
ttgagggaaggttcttcat

SEQ ID NO: 1723954 - DNA, 20 bp, Homo sapiens
ttgagggacgctttgtctgt

SEQ ID NO: 1723955 - DNA, 21 bp, Homo sapiens
ttgagggcccagccaggagca

SEQ ID NO: 1723956 - DNA, 22 bp, Homo sapiens
ttgaggtgcgctcacctcagag

SEQ ID NO: 1723957 - DNA, 22 bp, Homo sapiens
ttgaggtggaagccctccttcc

SEQ ID NO: 1723958 - DNA, 17 bp, Homo sapiens
ttgaggttttgtaaaac

SEQ ID NO: 1723959 - DNA, 18 bp, Homo sapiens
ttgaggttttgtaaaact

SEQ ID NO: 1723960 - DNA, 21 bp, Homo sapiens
ttgagtaatggtgtagaacac

SEQ ID NO: 1723961 - DNA, 13 bp, Homo sapiens
ttgagtaatgtga

SEQ ID NO: 1723962 - DNA, 16 bp, Homo sapiens
ttgagtaatgtgacta

SEQ ID NO: 1723963 - DNA, 18 bp, Homo sapiens
ttgagtacagtgaggagg

SEQ ID NO: 1723964 - DNA, 19 bp, Homo sapiens
ttgagtacagtgaggaggg

SEQ ID NO: 1723965 - DNA, 14 bp, Homo sapiens
ttgagtattgttta

SEQ ID NO: 1723966 - DNA, 13 bp, Homo sapiens
ttgagtccctgct

SEQ ID NO: 1723967 - DNA, 17 bp, Homo sapiens
ttgagtctcctctctga

SEQ ID NO: 1723968 - DNA, 18 bp, Homo sapiens
ttgagtctcctctctgag

SEQ ID NO: 1723969 - DNA, 17 bp, Homo sapiens
ttgagtctgtactaaac

SEQ ID NO: 1723970 - DNA, 19 bp, Homo sapiens
ttgagtggatgatgtttcg

SEQ ID NO: 1723971 - DNA, 15 bp, Homo sapiens
ttgagtgtatgagta

SEQ ID NO: 1723972 - DNA, 12 bp, Homo sapiens
ttgagtgtgtgt

SEQ ID NO: 1723973 - DNA, 15 bp, Homo sapiens
ttgagtgtgtgtgtg

SEQ ID NO: 1723974 - DNA, 18 bp, Homo sapiens
ttgagtgtgtgtgtgcat

SEQ ID NO: 1723975 - DNA, 17 bp, Homo sapiens
ttgagttggaacaacat

SEQ ID NO: 1723976 - DNA, 12 bp, Homo sapiens
ttgagttttgtt

SEQ ID NO: 1723977 - DNA, 11 bp, Homo sapiens
ttgataaaaga

SEQ ID NO: 1723978 - DNA, 14 bp, Homo sapiens
ttgataaaagagtt

SEQ ID NO: 1723979 - DNA, 18 bp, Homo sapiens
ttgataaattccactgga

SEQ ID NO: 1723980 - DNA, 19 bp, Homo sapiens
ttgataaattccactggac

SEQ ID NO: 1723981 - DNA, 12 bp, Homo sapiens
ttgataacaaaa

SEQ ID NO: 1723982 - DNA, 13 bp, Homo sapiens
ttgataacaaaaa

SEQ ID NO: 1723983 - DNA, 18 bp, Homo sapiens
ttgataacaaaaaataaa

SEQ ID NO: 1723984 - DNA, 18 bp, Homo sapiens
ttgataatattagtgatt

SEQ ID NO: 1723985 - DNA, 17 bp, Homo sapiens
ttgataattcaacattt

SEQ ID NO: 1723986 - DNA, 23 bp, Homo sapiens
ttgataattgcattcatcttgtg

SEQ ID NO: 1723987 - DNA, 20 bp, Homo sapiens
ttgatacttcaggtgctttt

SEQ ID NO: 1723988 - DNA, 20 bp, Homo sapiens
ttgatagcatggggcccctg

SEQ ID NO: 1723989 - DNA, 14 bp, Homo sapiens
ttgatagctttatt

SEQ ID NO: 1723990 - DNA, 17 bp, Homo sapiens
ttgatagtgatgtattt

SEQ ID NO: 1723991 - DNA, 18 bp, Homo sapiens
ttgatagttctataagaa

SEQ ID NO: 1723992 - DNA, 15 bp, Homo sapiens
ttgatatacattgtg

SEQ ID NO: 1723993 - DNA, 16 bp, Homo sapiens
ttgatatctataaaat

SEQ ID NO: 1723994 - DNA, 13 bp, Homo sapiens
ttgatatgtaaca

SEQ ID NO: 1723995 - DNA, 14 bp, Homo sapiens
ttgatatttttcca

SEQ ID NO: 1723996 - DNA, 15 bp, Homo sapiens
ttgatcacacagtgt

SEQ ID NO: 1723997 - DNA, 20 bp, Homo sapiens
ttgatcagccccaccctggc

SEQ ID NO: 1723998 - DNA, 14 bp, Homo sapiens
ttgatcagtataat

SEQ ID NO: 1723999 - DNA, 22 bp, Homo sapiens
ttgatcattttccccccactct

SEQ ID NO: 1724000 - DNA, 18 bp, Homo sapiens
ttgatcccacttcactgt

SEQ ID NO: 1724001 - DNA, 23 bp, Homo sapiens
ttgatcccacttcactgtgaggg

SEQ ID NO: 1724002 - DNA, 14 bp, Homo sapiens
ttgatctcacattt

SEQ ID NO: 1724003 - DNA, 13 bp, Homo sapiens
ttgatctctcttg

SEQ ID NO: 1724004 - DNA, 17 bp, Homo sapiens
ttgatctggaacccaga

SEQ ID NO: 1724005 - DNA, 15 bp, Homo sapiens
ttgatgaaagctgat

SEQ ID NO: 1724006 - DNA, 16 bp, Homo sapiens
ttgatgaaagctgatt

SEQ ID NO: 1724007 - DNA, 21 bp, Homo sapiens
ttgatgatacaatgaacactt

SEQ ID NO: 1724008 - DNA, 12 bp, Homo sapiens
ttgatgcaatat

SEQ ID NO: 1724009 - DNA, 13 bp, Homo sapiens
ttgatgccagagg

SEQ ID NO: 1724010 - DNA, 20 bp, Homo sapiens
ttgatgccagagggccagca

SEQ ID NO: 1724011 - DNA, 17 bp, Homo sapiens
ttgatgcccaatatatt

SEQ ID NO: 1724012 - DNA, 16 bp, Homo sapiens
ttgatgctatttatgc

SEQ ID NO: 1724013 - DNA, 17 bp, Homo sapiens
ttgatgctatttatgca

SEQ ID NO: 1724014 - DNA, 13 bp, Homo sapiens
ttgatggaaaata

SEQ ID NO: 1724015 - DNA, 21 bp, Homo sapiens
ttgatggaaaataaacatcag

SEQ ID NO: 1724016 - DNA, 16 bp, Homo sapiens
ttgatggagtgtgagc

SEQ ID NO: 1724017 - DNA, 21 bp, Homo sapiens
ttgatggagtgtgagccacct

SEQ ID NO: 1724018 - DNA, 22 bp, Homo sapiens
ttgatggccccatctggatgta

SEQ ID NO: 1724019 - DNA, 12 bp, Homo sapiens
ttgatggctggg

SEQ ID NO: 1724020 - DNA, 23 bp, Homo sapiens
ttgatgggaaaagcccccagtta

SEQ ID NO: 1724021 - DNA, 13 bp, Homo sapiens
ttgatggggagaa

SEQ ID NO: 1724022 - DNA, 12 bp, Homo sapiens
ttgatgtaagga

SEQ ID NO: 1724023 - DNA, 17 bp, Homo sapiens
ttgatgtaaggactgta

SEQ ID NO: 1724024 - DNA, 16 bp, Homo sapiens
ttgatgtacatgtgta

SEQ ID NO: 1724025 - DNA, 17 bp, Homo sapiens
ttgatgtacatgtgtag

SEQ ID NO: 1724026 - DNA, 20 bp, Homo sapiens
ttgatgtatatgtttatata

SEQ ID NO: 1724027 - DNA, 23 bp, Homo sapiens
ttgatgtatgtgtgaaacaatgt

SEQ ID NO: 1724028 - DNA, 13 bp, Homo sapiens
ttgatgttaacaa

SEQ ID NO: 1724029 - DNA, 20 bp, Homo sapiens
ttgatgttccacctgccaca

SEQ ID NO: 1724030 - DNA, 18 bp, Homo sapiens
ttgatgtttcctggaagc

SEQ ID NO: 1724031 - DNA, 18 bp, Homo sapiens
ttgatgtttgtggcctca

SEQ ID NO: 1724032 - DNA, 19 bp, Homo sapiens
ttgatgtttgtggcctcag

SEQ ID NO: 1724033 - DNA, 20 bp, Homo sapiens
ttgatgtttgtggcctcaga

SEQ ID NO: 1724034 - DNA, 17 bp, Homo sapiens
ttgatgttttttctgta

SEQ ID NO: 1724035 - DNA, 11 bp, Homo sapiens
ttgattacata

SEQ ID NO: 1724036 - DNA, 20 bp, Homo sapiens
ttgattacataatcaaagct

SEQ ID NO: 1724037 - DNA, 23 bp, Homo sapiens
ttgattacttcttatttttctta

SEQ ID NO: 1724038 - DNA, 16 bp, Homo sapiens
ctccccatgtgcctgc

SEQ ID NO: 1724039 - DNA, 21 bp, Homo sapiens
ctccccatgtgcctgcaccag

SEQ ID NO: 1724040 - DNA, 20 bp, Homo sapiens
ctccccatgtgtcctggttc

SEQ ID NO: 1724041 - DNA, 16 bp, Homo sapiens
ctccccattcacagag

SEQ ID NO: 1724042 - DNA, 18 bp, Homo sapiens
ctccccatttcccatctg

SEQ ID NO: 1724043 - DNA, 21 bp, Homo sapiens
ctccccatttcccatctgcac

SEQ ID NO: 1724044 - DNA, 14 bp, Homo sapiens
ctcccccagccagg

SEQ ID NO: 1724045 - DNA, 15 bp, Homo sapiens
ctcccccagccagga

SEQ ID NO: 1724046 - DNA, 13 bp, Homo sapiens
ctccccccagacc

SEQ ID NO: 1724047 - DNA, 23 bp, Homo sapiens
ctccccccagaccccgcccctgg

SEQ ID NO: 1724048 - DNA, 18 bp, Homo sapiens
ctcccccccatgcactgt

SEQ ID NO: 1724049 - DNA, 20 bp, Homo sapiens
ctcccccccatgcactgtga

SEQ ID NO: 1724050 - DNA, 18 bp, Homo sapiens
ctccccccgcccacccac

SEQ ID NO: 1724051 - DNA, 21 bp, Homo sapiens
ctcccccgcagtccccagccc

SEQ ID NO: 1724052 - DNA, 22 bp, Homo sapiens
ctcccccgcagtccccagccct

SEQ ID NO: 1724053 - DNA, 22 bp, Homo sapiens
ctcccccgtttctccttttcct

SEQ ID NO: 1724054 - DNA, 12 bp, Homo sapiens
ctccccctcctg

SEQ ID NO: 1724055 - DNA, 15 bp, Homo sapiens
ctccccctcctgctg

SEQ ID NO: 1724056 - DNA, 17 bp, Homo sapiens
ctccccctcctgctgtg

SEQ ID NO: 1724057 - DNA, 16 bp, Homo sapiens
ctccccctccttgtgc

SEQ ID NO: 1724058 - DNA, 12 bp, Homo sapiens
ctccccctctgc

SEQ ID NO: 1724059 - DNA, 22 bp, Homo sapiens
ctccccctttcacactggatcc

SEQ ID NO: 1724060 - DNA, 14 bp, Homo sapiens
ctccccgaggctgc

SEQ ID NO: 1724061 - DNA, 21 bp, Homo sapiens
ctccccgaggctgccccaggc

SEQ ID NO: 1724062 - DNA, 22 bp, Homo sapiens
ctccccgaggctgccccaggcc

SEQ ID NO: 1724063 - DNA, 20 bp, Homo sapiens
ctccccgcagcccgcctgcc

SEQ ID NO: 1724064 - DNA, 14 bp, Homo sapiens
ctccccgcccctgt

SEQ ID NO: 1724065 - DNA, 22 bp, Homo sapiens
ctccccgcccctgtggccctgg

SEQ ID NO: 1724066 - DNA, 18 bp, Homo sapiens
ttggaattctactggaaa

SEQ ID NO: 1724067 - DNA, 19 bp, Homo sapiens
ttggacaaatcacatattt

SEQ ID NO: 1724068 - DNA, 15 bp, Homo sapiens
ttggacactgtacaa

SEQ ID NO: 1724069 - DNA, 16 bp, Homo sapiens
ttggacagctgcttgt

SEQ ID NO: 1724070 - DNA, 20 bp, Homo sapiens
ttggacaggagatcagcagc

SEQ ID NO: 1724071 - DNA, 15 bp, Homo sapiens
ttggacagtttacca

SEQ ID NO: 1724072 - DNA, 20 bp, Homo sapiens
ttggacatggaaagaaaagt

SEQ ID NO: 1724073 - DNA, 18 bp, Homo sapiens
ttggaccactcctgtccc

SEQ ID NO: 1724074 - DNA, 14 bp, Homo sapiens
ttggaccccagctg

SEQ ID NO: 1724075 - DNA, 20 bp, Homo sapiens
ttggaccccagctgggaggc

SEQ ID NO: 1724076 - DNA, 21 bp, Homo sapiens
ttggacggcctgatgctccct

SEQ ID NO: 1724077 - DNA, 13 bp, Homo sapiens
ttggactacacaa

SEQ ID NO: 1724078 - DNA, 13 bp, Homo sapiens
ttggactattata

SEQ ID NO: 1724079 - DNA, 15 bp, Homo sapiens
ttggactccaggcct

SEQ ID NO: 1724080 - DNA, 14 bp, Homo sapiens
ttggactccatctc

SEQ ID NO: 1724081 - DNA, 15 bp, Homo sapiens
ttggactgacattta

SEQ ID NO: 1724082 - DNA, 18 bp, Homo sapiens
ttggacttttcgttaaca

SEQ ID NO: 1724083 - DNA, 19 bp, Homo sapiens
ttggagaaatgtcataaat

SEQ ID NO: 1724084 - DNA, 20 bp, Homo sapiens
ttggagaaatgtcataaatt

SEQ ID NO: 1724085 - DNA, 22 bp, Homo sapiens
ttggagaaccagggctcttctc

SEQ ID NO: 1724086 - DNA, 20 bp, Homo sapiens
ttggagactctgtggggcct

SEQ ID NO: 1724087 - DNA, 21 bp, Homo sapiens
ttggagacttaacagcatttg

SEQ ID NO: 1724088 - DNA, 15 bp, Homo sapiens
ttggagagacacagc

SEQ ID NO: 1724089 - DNA, 13 bp, Homo sapiens
ttggagaggagag

SEQ ID NO: 1724090 - DNA, 13 bp, Homo sapiens
ttggagagtaaaa

SEQ ID NO: 1724091 - DNA, 18 bp, Homo sapiens
ttggagagtttcctgaaa

SEQ ID NO: 1724092 - DNA, 21 bp, Homo sapiens
ttggagagtttcctgaaacaa

SEQ ID NO: 1724093 - DNA, 15 bp, Homo sapiens
ttggagcacaaaatt

SEQ ID NO: 1724094 - DNA, 11 bp, Homo sapiens
ttggagccact

SEQ ID NO: 1724095 - DNA, 20 bp, Homo sapiens
ttggagccactcctgtcccg

SEQ ID NO: 1724096 - DNA, 20 bp, Homo sapiens
ttggagccccaggggacaag

SEQ ID NO: 1724097 - DNA, 14 bp, Homo sapiens
ttggagcctgcagg

SEQ ID NO: 1724098 - DNA, 20 bp, Homo sapiens
ttggagctatcagtgctttg

SEQ ID NO: 1724099 - DNA, 11 bp, Homo sapiens
ttggagctgac

SEQ ID NO: 1724100 - DNA, 21 bp, Homo sapiens
ttggagctgactgttcttggt

SEQ ID NO: 1724101 - DNA, 17 bp, Homo sapiens
ttggagctgtcctccag

SEQ ID NO: 1724102 - DNA, 20 bp, Homo sapiens
ttggagctgtcctccagagg

SEQ ID NO: 1724103 - DNA, 17 bp, Homo sapiens
ttggagctttttcaaaa

SEQ ID NO: 1724104 - DNA, 14 bp, Homo sapiens
ttggaggaagttgg

SEQ ID NO: 1724105 - DNA, 15 bp, Homo sapiens
ttggagggaagggag

SEQ ID NO: 1724106 - DNA, 14 bp, Homo sapiens
ttggagtagaatgt

SEQ ID NO: 1724107 - DNA, 17 bp, Homo sapiens
ttggagtagaatgtagt

SEQ ID NO: 1724108 - DNA, 14 bp, Homo sapiens
ttggagtgtttcta

SEQ ID NO: 1724109 - DNA, 17 bp, Homo sapiens
ttggagttggagtagaa

SEQ ID NO: 1724110 - DNA, 19 bp, Homo sapiens
ttggatattttttacttta

SEQ ID NO: 1724111 - DNA, 17 bp, Homo sapiens
ttggatctgtgacacat

SEQ ID NO: 1724112 - DNA, 18 bp, Homo sapiens
ttggatgagttttgggaa

SEQ ID NO: 1724113 - DNA, 23 bp, Homo sapiens
ttggatgattttttaagcagact

SEQ ID NO: 1724114 - DNA, 16 bp, Homo sapiens
ttggatggcttgtcta

SEQ ID NO: 1724115 - DNA, 20 bp, Homo sapiens
ttggattattcatttaaaat

SEQ ID NO: 1724116 - DNA, 23 bp, Homo sapiens
ttggattattcatttaaaatgat

SEQ ID NO: 1724117 - DNA, 12 bp, Homo sapiens
ttggattatttt

SEQ ID NO: 1724118 - DNA, 17 bp, Homo sapiens
ttggattctaaatacat

SEQ ID NO: 1724119 - DNA, 14 bp, Homo sapiens
ttggatttcctaat

SEQ ID NO: 1724120 - DNA, 20 bp, Homo sapiens
ttggcacaatgtatacttca

SEQ ID NO: 1724121 - DNA, 16 bp, Homo sapiens
ttggcacatgccacct

SEQ ID NO: 1724122 - DNA, 20 bp, Homo sapiens
ttggcaccatggtatcatat

SEQ ID NO: 1724123 - DNA, 15 bp, Homo sapiens
ttggcacttgtattt

SEQ ID NO: 1724124 - DNA, 19 bp, Homo sapiens
ttggcacttgtatttaatt

SEQ ID NO: 1724125 - DNA, 13 bp, Homo sapiens
ttggcagagaagg

SEQ ID NO: 1724126 - DNA, 14 bp, Homo sapiens
ttggcagagaaggc

SEQ ID NO: 1724127 - DNA, 19 bp, Homo sapiens
ttggcagagacactttgtc

SEQ ID NO: 1724128 - DNA, 16 bp, Homo sapiens
ttggcaggagctcctg

SEQ ID NO: 1724129 - DNA, 18 bp, Homo sapiens
ttggcaggagctcctgga

SEQ ID NO: 1724130 - DNA, 21 bp, Homo sapiens
ttggcaggcccactccccagc

SEQ ID NO: 1724131 - DNA, 12 bp, Homo sapiens
ttggcaggctgg

SEQ ID NO: 1724132 - DNA, 14 bp, Homo sapiens
ttggcagtctgaat

SEQ ID NO: 1724133 - DNA, 12 bp, Homo sapiens
ttggcagtgttt

SEQ ID NO: 1724134 - DNA, 16 bp, Homo sapiens
ttggcatagctctggg

SEQ ID NO: 1724135 - DNA, 14 bp, Homo sapiens
ttggcatggcttta

SEQ ID NO: 1724136 - DNA, 22 bp, Homo sapiens
ttggcatgtctcctcaacccac

SEQ ID NO: 1724137 - DNA, 16 bp, Homo sapiens
ttggcattgatcttaa

SEQ ID NO: 1724138 - DNA, 11 bp, Homo sapiens
ttggcatttct

SEQ ID NO: 1724139 - DNA, 15 bp, Homo sapiens
ttggcatttgtgtta

SEQ ID NO: 1724140 - DNA, 15 bp, Homo sapiens
ttggccaagcagaaa

SEQ ID NO: 1724141 - DNA, 12 bp, Homo sapiens
ttggccacagac

SEQ ID NO: 1724142 - DNA, 21 bp, Homo sapiens
ttggccactccgagaggtggg

SEQ ID NO: 1724143 - DNA, 20 bp, Homo sapiens
ttggccactgggtctcactc

SEQ ID NO: 1724144 - DNA, 22 bp, Homo sapiens
ttggccactgggtctcactcct

SEQ ID NO: 1724145 - DNA, 12 bp, Homo sapiens
ttggcccaggag

SEQ ID NO: 1724146 - DNA, 14 bp, Homo sapiens
ttggcccaggagct

SEQ ID NO: 1724147 - DNA, 22 bp, Homo sapiens
ttggcccctgtgtgagttgagt

SEQ ID NO: 1724148 - DNA, 18 bp, Homo sapiens
ttggccctggagccaggg

SEQ ID NO: 1724149 - DNA, 22 bp, Homo sapiens
ttggccctggagccagggcaga

SEQ ID NO: 1724150 - DNA, 13 bp, Homo sapiens
ttggcctcagagg

SEQ ID NO: 1724151 - DNA, 19 bp, Homo sapiens
ttggcctccggcctcccct

SEQ ID NO: 1724152 - DNA, 13 bp, Homo sapiens
ttggcctgctgtg

SEQ ID NO: 1724153 - DNA, 11 bp, Homo sapiens
ttggcctggcc

SEQ ID NO: 1724154 - DNA, 14 bp, Homo sapiens
ttggcctggcctcc

SEQ ID NO: 1724155 - DNA, 16 bp, Homo sapiens
ttggcctggcctccag

SEQ ID NO: 1724156 - DNA, 16 bp, Homo sapiens
ttggcctgtctcatcc

SEQ ID NO: 1724157 - DNA, 22 bp, Homo sapiens
ttggcctgtctcatccccaggg

SEQ ID NO: 1724158 - DNA, 11 bp, Homo sapiens
ttggccttaag

SEQ ID NO: 1724159 - DNA, 21 bp, Homo sapiens
ttggccttaagaactgtgtct

SEQ ID NO: 1724160 - DNA, 20 bp, Homo sapiens
ttggccttgcagctggccca

SEQ ID NO: 1724161 - DNA, 19 bp, Homo sapiens
ttggcgtagcagagttaaa

SEQ ID NO: 1724162 - DNA, 21 bp, Homo sapiens
ttggctacgttttggttctat

SEQ ID NO: 1724163 - DNA, 19 bp, Homo sapiens
ttggctattgaagatgctg

SEQ ID NO: 1724164 - DNA, 17 bp, Homo sapiens
ttggctatttctgtgtc

SEQ ID NO: 1724165 - DNA, 18 bp, Homo sapiens
ttggctcacaaggcccag

SEQ ID NO: 1724166 - DNA, 15 bp, Homo sapiens
ttggctcaggcagac

SEQ ID NO: 1724167 - DNA, 20 bp, Homo sapiens
ttggctcgaatctctgtgcc

SEQ ID NO: 1724168 - DNA, 22 bp, Homo sapiens
ctcctttccttcccaggccctt

SEQ ID NO: 1724169 - DNA, 14 bp, Homo sapiens
ctcctttctccagc

SEQ ID NO: 1724170 - DNA, 17 bp, Homo sapiens
ctcctttctccagccag

SEQ ID NO: 1724171 - DNA, 19 bp, Homo sapiens
ctcctttctccagccagca

SEQ ID NO: 1724172 - DNA, 15 bp, Homo sapiens
ctcctttctgcagac

SEQ ID NO: 1724173 - DNA, 13 bp, Homo sapiens
ctcctttcttttt

SEQ ID NO: 1724174 - DNA, 19 bp, Homo sapiens
ctcctttctttttcttctt

SEQ ID NO: 1724175 - DNA, 20 bp, Homo sapiens
ctcctttctttttcttcttc

SEQ ID NO: 1724176 - DNA, 14 bp, Homo sapiens
ctcctttgcactga

SEQ ID NO: 1724177 - DNA, 18 bp, Homo sapiens
ctcctttgtattctgtct

SEQ ID NO: 1724178 - DNA, 12 bp, Homo sapiens
ctcctttgtgtg

SEQ ID NO: 1724179 - DNA, 17 bp, Homo sapiens
ctcctttgtgtggctgc

SEQ ID NO: 1724180 - DNA, 15 bp, Homo sapiens
ctcctttgtgtgtgt

SEQ ID NO: 1724181 - DNA, 18 bp, Homo sapiens
ttggtggctcacgcctgt

SEQ ID NO: 1724182 - DNA, 15 bp, Homo sapiens
ttggtggcttatggg

SEQ ID NO: 1724183 - DNA, 13 bp, Homo sapiens
ttggtggtacttt

SEQ ID NO: 1724184 - DNA, 20 bp, Homo sapiens
ttggtgtaaagccaacaccc

SEQ ID NO: 1724185 - DNA, 15 bp, Homo sapiens
ttggtgtaatttgaa

SEQ ID NO: 1724186 - DNA, 22 bp, Homo sapiens
ttggtgttacacagcccaagag

SEQ ID NO: 1724187 - DNA, 21 bp, Homo sapiens
ctctccaaccactgtgccact

SEQ ID NO: 1724188 - DNA, 14 bp, Homo sapiens
ctctccaagggctt

SEQ ID NO: 1724189 - DNA, 23 bp, Homo sapiens
ctctccaagggcttctgcaccct

SEQ ID NO: 1724190 - DNA, 16 bp, Homo sapiens
ctctccaagtgccaga

SEQ ID NO: 1724191 - DNA, 20 bp, Homo sapiens
ctctccaagtgccagaggtg

SEQ ID NO: 1724192 - DNA, 22 bp, Homo sapiens
ctctccaagtgccagaggtggg

SEQ ID NO: 1724193 - DNA, 15 bp, Homo sapiens
ctctccacagtgttg

SEQ ID NO: 1724194 - DNA, 15 bp, Homo sapiens
ctctccaccccccac

SEQ ID NO: 1724195 - DNA, 16 bp, Homo sapiens
ctctccaccctccggc

SEQ ID NO: 1724196 - DNA, 18 bp, Homo sapiens
ctctccacctcagccttg

SEQ ID NO: 1724197 - DNA, 14 bp, Homo sapiens
ctctccaccttagt

SEQ ID NO: 1724198 - DNA, 14 bp, Homo sapiens
ctctccactgcctt

SEQ ID NO: 1724199 - DNA, 18 bp, Homo sapiens
ctctccactgctctcagc

SEQ ID NO: 1724200 - DNA, 15 bp, Homo sapiens
ctctccactgctgga

SEQ ID NO: 1724201 - DNA, 14 bp, Homo sapiens
ctctccagcctgac

SEQ ID NO: 1724202 - DNA, 19 bp, Homo sapiens
ctctccagcggtccaaagt

SEQ ID NO: 1724203 - DNA, 16 bp, Homo sapiens
ctctccagctgactaa

SEQ ID NO: 1724204 - DNA, 18 bp, Homo sapiens
ctctccagctgactaaac

SEQ ID NO: 1724205 - DNA, 22 bp, Homo sapiens
ctctccaggaaggtagcccagc

SEQ ID NO: 1724206 - DNA, 13 bp, Homo sapiens
ctctccaggccag

SEQ ID NO: 1724207 - DNA, 15 bp, Homo sapiens
ctctccaggccaggt

SEQ ID NO: 1724208 - DNA, 16 bp, Homo sapiens
ctctccaggccaggtg

SEQ ID NO: 1724209 - DNA, 17 bp, Homo sapiens
ctctccaggcgccggcg

SEQ ID NO: 1724210 - DNA, 14 bp, Homo sapiens
ctctccagggtgct

SEQ ID NO: 1724211 - DNA, 17 bp, Homo sapiens
ctctccaggtcagcctg

SEQ ID NO: 1724212 - DNA, 22 bp, Homo sapiens
ctctccagtttgcacctgtccc

SEQ ID NO: 1724213 - DNA, 11 bp, Homo sapiens
ctctccatatc

SEQ ID NO: 1724214 - DNA, 15 bp, Homo sapiens
ctctccatatctcct

SEQ ID NO: 1724215 - DNA, 16 bp, Homo sapiens
ctctcccaccccctcc

SEQ ID NO: 1724216 - DNA, 13 bp, Homo sapiens
ctctcccaccccg

SEQ ID NO: 1724217 - DNA, 23 bp, Homo sapiens
ctctcccacccggccacagctgc

SEQ ID NO: 1724218 - DNA, 13 bp, Homo sapiens
ctctcccaggacc

SEQ ID NO: 1724219 - DNA, 12 bp, Homo sapiens
ctctcccatccc

SEQ ID NO: 1724220 - DNA, 18 bp, Homo sapiens
ctctcccatccccctgcc

SEQ ID NO: 1724221 - DNA, 12 bp, Homo sapiens
ctctccccacac

SEQ ID NO: 1724222 - DNA, 11 bp, Homo sapiens
ctctccccagc

SEQ ID NO: 1724223 - DNA, 13 bp, Homo sapiens
ctctccccagccc

SEQ ID NO: 1724224 - DNA, 16 bp, Homo sapiens
ctctccccagcccaga

SEQ ID NO: 1724225 - DNA, 18 bp, Homo sapiens
ctctccccagcccagaga

SEQ ID NO: 1724226 - DNA, 16 bp, Homo sapiens
ctctccccaggtccag

SEQ ID NO: 1724227 - DNA, 18 bp, Homo sapiens
ctctccccaggtccagct

SEQ ID NO: 1724228 - DNA, 16 bp, Homo sapiens
ctctccccagtgcctg

SEQ ID NO: 1724229 - DNA, 17 bp, Homo sapiens
ctctccccagtgcctgc

SEQ ID NO: 1724230 - DNA, 19 bp, Homo sapiens
ctctccccagtgcctgcca

SEQ ID NO: 1724231 - DNA, 21 bp, Homo sapiens
ctctccccagtgcctgccact

SEQ ID NO: 1724232 - DNA, 13 bp, Homo sapiens
ctctcccccaccc

SEQ ID NO: 1724233 - DNA, 16 bp, Homo sapiens
ctctccccgctcaggg

SEQ ID NO: 1724234 - DNA, 18 bp, Homo sapiens
ctctccccggcaggcctg

SEQ ID NO: 1724235 - DNA, 12 bp, Homo sapiens
ctctcccctctg

SEQ ID NO: 1724236 - DNA, 17 bp, Homo sapiens
ctctcccgcaccaggcc

SEQ ID NO: 1724237 - DNA, 23 bp, Homo sapiens
ctctcccggaggttgggtgggcc

SEQ ID NO: 1724238 - DNA, 15 bp, Homo sapiens
ctctcccggctgcct

SEQ ID NO: 1724239 - DNA, 16 bp, Homo sapiens
ctctcccggctgcctg

SEQ ID NO: 1724240 - DNA, 17 bp, Homo sapiens
ctctcccggctgcctgc

SEQ ID NO: 1724241 - DNA, 18 bp, Homo sapiens
ctctcccggctgcctgcc

SEQ ID NO: 1724242 - DNA, 15 bp, Homo sapiens
ctctcccgtcagggc

SEQ ID NO: 1724243 - DNA, 16 bp, Homo sapiens
ctctcccgtcagggcc

SEQ ID NO: 1724244 - DNA, 17 bp, Homo sapiens
ctctccctaccttgcct

SEQ ID NO: 1724245 - DNA, 10 bp, Homo sapiens
ctctccctct

SEQ ID NO: 1724246 - DNA, 12 bp, Homo sapiens
ctctccctctgg

SEQ ID NO: 1724247 - DNA, 22 bp, Homo sapiens
ctctccctctggccctgccttc

SEQ ID NO: 1724248 - DNA, 14 bp, Homo sapiens
ctctccctggtctc

SEQ ID NO: 1724249 - DNA, 12 bp, Homo sapiens
ctctccctgtca

SEQ ID NO: 1724250 - DNA, 20 bp, Homo sapiens
ctctccctgtcacgctcatg

SEQ ID NO: 1724251 - DNA, 23 bp, Homo sapiens
ctctccctgtcacgctcatgtcc

SEQ ID NO: 1724252 - DNA, 20 bp, Homo sapiens
ctctccgactctgcacccgc

SEQ ID NO: 1724253 - DNA, 23 bp, Homo sapiens
ctctccgactctgcacccgcctc

SEQ ID NO: 1724254 - DNA, 18 bp, Homo sapiens
ctctccgacttcccctgg

SEQ ID NO: 1724255 - DNA, 22 bp, Homo sapiens
ctctccgacttcccctgggcaa

SEQ ID NO: 1724256 - DNA, 16 bp, Homo sapiens
ctctccgagctctggt

SEQ ID NO: 1724257 - DNA, 17 bp, Homo sapiens
ctctccgagctctggtg

SEQ ID NO: 1724258 - DNA, 13 bp, Homo sapiens
ctctccgtgcagg

SEQ ID NO: 1724259 - DNA, 17 bp, Homo sapiens
ctctcctatgtggcagc

SEQ ID NO: 1724260 - DNA, 20 bp, Homo sapiens
ctctcctatgtggcagctgg

SEQ ID NO: 1724261 - DNA, 16 bp, Homo sapiens
ctctcctccacagccc

SEQ ID NO: 1724262 - DNA, 20 bp, Homo sapiens
ctctcctcccgccccgcccc

SEQ ID NO: 1724263 - DNA, 12 bp, Homo sapiens
ctctcctcctcc

SEQ ID NO: 1724264 - DNA, 15 bp, Homo sapiens
ctctcctgccctgtg

SEQ ID NO: 1724265 - DNA, 16 bp, Homo sapiens
ctctcctgccctgtga

SEQ ID NO: 1724266 - DNA, 17 bp, Homo sapiens
ctctcctgccctgtgat

SEQ ID NO: 1724267 - DNA, 14 bp, Homo sapiens
ctctcctgcttcct

SEQ ID NO: 1724268 - DNA, 12 bp, Homo sapiens
ctctcctggacg

SEQ ID NO: 1724269 - DNA, 23 bp, Homo sapiens
ctctcctggcctatccgctgcca

SEQ ID NO: 1724270 - DNA, 21 bp, Homo sapiens
ctctcctgtctgccctctggg

SEQ ID NO: 1724271 - DNA, 22 bp, Homo sapiens
ctctccttcatgacagcctcca

SEQ ID NO: 1724272 - DNA, 13 bp, Homo sapiens
ctctccttcctct

SEQ ID NO: 1724273 - DNA, 14 bp, Homo sapiens
ctctccttcctgtg

SEQ ID NO: 1724274 - DNA, 16 bp, Homo sapiens
ctctccttcgtgtctc

SEQ ID NO: 1724275 - DNA, 16 bp, Homo sapiens
ctctccttggccacag

SEQ ID NO: 1724276 - DNA, 16 bp, Homo sapiens
ctctccttgggctcct

SEQ ID NO: 1724277 - DNA, 19 bp, Homo sapiens
ctctccttgggctcctggc

SEQ ID NO: 1724278 - DNA, 15 bp, Homo sapiens
ctctcctttctgtgc

SEQ ID NO: 1724279 - DNA, 19 bp, Homo sapiens
ctctcctttggccattcca

SEQ ID NO: 1724280 - DNA, 21 bp, Homo sapiens
ctctcctttgtgtggctgccc

SEQ ID NO: 1724281 - DNA, 23 bp, Homo sapiens
ctctccttttgaggcttctcctt

SEQ ID NO: 1724282 - DNA, 22 bp, Homo sapiens
ctctcgacggcacgcacttgcc

SEQ ID NO: 1724283 - DNA, 19 bp, Homo sapiens
ctctcgactgtcagtgggg

SEQ ID NO: 1724284 - DNA, 19 bp, Homo sapiens
ctctcgcacctttccaaag

SEQ ID NO: 1724285 - DNA, 13 bp, Homo sapiens
ctctcgctcccct

SEQ ID NO: 1724286 - DNA, 15 bp, Homo sapiens
ctctcgctcccctct

SEQ ID NO: 1724287 - DNA, 15 bp, Homo sapiens
ctctcgctctctctc

SEQ ID NO: 1724288 - DNA, 21 bp, Homo sapiens
ctctcgctgccctgtggacag

SEQ ID NO: 1724289 - DNA, 13 bp, Homo sapiens
ctctcgctgcgtc

SEQ ID NO: 1724290 - DNA, 18 bp, Homo sapiens
ctctcgctgcgtcctcat

SEQ ID NO: 1724291 - DNA, 22 bp, Homo sapiens
ctctcgctgcgtcctcatttcc

SEQ ID NO: 1724292 - DNA, 18 bp, Homo sapiens
ctctcggctccccatgtg

SEQ ID NO: 1724293 - DNA, 19 bp, Homo sapiens
ctctcgggttcaagcaatt

SEQ ID NO: 1724294 - DNA, 22 bp, Homo sapiens
ctctctaagtgggcattgccat

SEQ ID NO: 1724295 - DNA, 14 bp, Homo sapiens
ctctctacctccac

SEQ ID NO: 1724296 - DNA, 22 bp, Homo sapiens
ctctctactcctacctcagcct

SEQ ID NO: 1724297 - DNA, 15 bp, Homo sapiens
ctctctactgctgga

SEQ ID NO: 1724298 - DNA, 14 bp, Homo sapiens
ctctctcaaaagag

SEQ ID NO: 1724299 - DNA, 14 bp, Homo sapiens
ctctctccaccccc

SEQ ID NO: 1724300 - DNA, 22 bp, Homo sapiens
ctctctccaccccccacgtctg

SEQ ID NO: 1724301 - DNA, 15 bp, Homo sapiens
ctctctccagggtgc

SEQ ID NO: 1724302 - DNA, 18 bp, Homo sapiens
ctctgcacatgtcttgta

SEQ ID NO: 1724303 - DNA, 16 bp, Homo sapiens
ctctgcacccagaaca

SEQ ID NO: 1724304 - DNA, 22 bp, Homo sapiens
ctctgcactactcctctgcagt

SEQ ID NO: 1724305 - DNA, 13 bp, Homo sapiens
ctctgcactccat

SEQ ID NO: 1724306 - DNA, 16 bp, Homo sapiens
ctctgcactccatggc

SEQ ID NO: 1724307 - DNA, 20 bp, Homo sapiens
ctctgcactcccacctgaca

SEQ ID NO: 1724308 - DNA, 18 bp, Homo sapiens
ttgttctgttgtctgcgc

SEQ ID NO: 1724309 - DNA, 18 bp, Homo sapiens
ttgttcttattctggcat

SEQ ID NO: 1724310 - DNA, 14 bp, Homo sapiens
ttgttcttgtattt

SEQ ID NO: 1724311 - DNA, 15 bp, Homo sapiens
ttgttcttgtattta

SEQ ID NO: 1724312 - DNA, 17 bp, Homo sapiens
ttgttctttgtttccag

SEQ ID NO: 1724313 - DNA, 22 bp, Homo sapiens
ttgttgaactgttagaatgtaa

SEQ ID NO: 1724314 - DNA, 15 bp, Homo sapiens
ttgttgacagcaaaa

SEQ ID NO: 1724315 - DNA, 17 bp, Homo sapiens
ttgttgacagcaaaatg

SEQ ID NO: 1724316 - DNA, 19 bp, Homo sapiens
ttgttgacagcaaaatgtt

SEQ ID NO: 1724317 - DNA, 23 bp, Homo sapiens
ttgttgacagcaaaatgttgaag

SEQ ID NO: 1724318 - DNA, 21 bp, Homo sapiens
ttgttgacccttttttgaacc

SEQ ID NO: 1724319 - DNA, 17 bp, Homo sapiens
ttgttgcaagatgtgaa

SEQ ID NO: 1724320 - DNA, 20 bp, Homo sapiens
ttgttgcaagatgtgaatta

SEQ ID NO: 1724321 - DNA, 12 bp, Homo sapiens
ttgttgccaact

SEQ ID NO: 1724322 - DNA, 20 bp, Homo sapiens
ttgttgccaggttgcagctg

SEQ ID NO: 1724323 - DNA, 15 bp, Homo sapiens
ttgttggagcctgca

SEQ ID NO: 1724324 - DNA, 16 bp, Homo sapiens
ttgttggcactcaaca

SEQ ID NO: 1724325 - DNA, 16 bp, Homo sapiens
ttgttggcatagctct

SEQ ID NO: 1724326 - DNA, 12 bp, Homo sapiens
ttgttgggaaag

SEQ ID NO: 1724327 - DNA, 21 bp, Homo sapiens
ttgttgggattcctgacccag

SEQ ID NO: 1724328 - DNA, 18 bp, Homo sapiens
ttgttggtagcatgtact

SEQ ID NO: 1724329 - DNA, 14 bp, Homo sapiens
ttgttgtacttaaa

SEQ ID NO: 1724330 - DNA, 21 bp, Homo sapiens
ttgttgttaatgaaaatgtca

SEQ ID NO: 1724331 - DNA, 22 bp, Homo sapiens
ttgttgttcctctatactttgt

SEQ ID NO: 1724332 - DNA, 15 bp, Homo sapiens
ttgttgttgctgctg

SEQ ID NO: 1724333 - DNA, 21 bp, Homo sapiens
ttgttgtttgccatactttgt

SEQ ID NO: 1724334 - DNA, 13 bp, Homo sapiens
ttgttgtttgtaa

SEQ ID NO: 1724335 - DNA, 23 bp, Homo sapiens
ttgtttaaaactcagaatataac

SEQ ID NO: 1724336 - DNA, 17 bp, Homo sapiens
ttgtttaaaatcatttc

SEQ ID NO: 1724337 - DNA, 20 bp, Homo sapiens
ttgtttaaagaagctctcca

SEQ ID NO: 1724338 - DNA, 21 bp, Homo sapiens
ttgtttacagcactactctgt

SEQ ID NO: 1724339 - DNA, 16 bp, Homo sapiens
ttgtttacttaaagat

SEQ ID NO: 1724340 - DNA, 23 bp, Homo sapiens
ttgtttacttaaagatttatcaa

SEQ ID NO: 1724341 - DNA, 14 bp, Homo sapiens
ttgtttagaaacag

SEQ ID NO: 1724342 - DNA, 19 bp, Homo sapiens
ttgtttagaaacagaaata

SEQ ID NO: 1724343 - DNA, 14 bp, Homo sapiens
ttgtttagagccct

SEQ ID NO: 1724344 - DNA, 20 bp, Homo sapiens
ttgtttatttatcagtgaca

SEQ ID NO: 1724345 - DNA, 18 bp, Homo sapiens
ttgtttcaaacacaaatg

SEQ ID NO: 1724346 - DNA, 20 bp, Homo sapiens
ttgtttcaagaacctggaaa

SEQ ID NO: 1724347 - DNA, 19 bp, Homo sapiens
ttgtttcccctagcttact

SEQ ID NO: 1724348 - DNA, 21 bp, Homo sapiens
ttgtttcctcttccaaagtaa

SEQ ID NO: 1724349 - DNA, 16 bp, Homo sapiens
ttgtttctatactgtt

SEQ ID NO: 1724350 - DNA, 22 bp, Homo sapiens
ttgtttctatactgtttgtaat

SEQ ID NO: 1724351 - DNA, 17 bp, Homo sapiens
ttgtttctctgttgtaa

SEQ ID NO: 1724352 - DNA, 14 bp, Homo sapiens
ttgtttctgaccca

SEQ ID NO: 1724353 - DNA, 15 bp, Homo sapiens
ttgtttcttccaaag

SEQ ID NO: 1724354 - DNA, 19 bp, Homo sapiens
ttgtttcttccaaagcaca

SEQ ID NO: 1724355 - DNA, 17 bp, Homo sapiens
ttgtttgattcagcaaa

SEQ ID NO: 1724356 - DNA, 14 bp, Homo sapiens
ttgtttgatttcaa

SEQ ID NO: 1724357 - DNA, 17 bp, Homo sapiens
ttgtttggcaaggaaag

SEQ ID NO: 1724358 - DNA, 18 bp, Homo sapiens
ttgtttggcaaggaaagg

SEQ ID NO: 1724359 - DNA, 13 bp, Homo sapiens
ttgtttgtaaata

SEQ ID NO: 1724360 - DNA, 22 bp, Homo sapiens
ttgtttgtattcatgttcatgt

SEQ ID NO: 1724361 - DNA, 15 bp, Homo sapiens
ttgtttgtcacaagt

SEQ ID NO: 1724362 - DNA, 14 bp, Homo sapiens
ttgtttgtcagcat

SEQ ID NO: 1724363 - DNA, 16 bp, Homo sapiens
ttgtttgtcagcatct

SEQ ID NO: 1724364 - DNA, 23 bp, Homo sapiens
ttgtttgtcagcatctgaccatc

SEQ ID NO: 1724365 - DNA, 13 bp, Homo sapiens
ttgttttaaaact

SEQ ID NO: 1724366 - DNA, 14 bp, Homo sapiens
ttgttttaaaactg

SEQ ID NO: 1724367 - DNA, 14 bp, Homo sapiens
ttgttttaatttta

SEQ ID NO: 1724368 - DNA, 20 bp, Homo sapiens
ttgttttaccagctcccagg

SEQ ID NO: 1724369 - DNA, 14 bp, Homo sapiens
ttgttttagcatta

SEQ ID NO: 1724370 - DNA, 16 bp, Homo sapiens
ttgttttcacttgtat

SEQ ID NO: 1724371 - DNA, 16 bp, Homo sapiens
ttgttttctgactaat

SEQ ID NO: 1724372 - DNA, 11 bp, Homo sapiens
ttgttttctgt

SEQ ID NO: 1724373 - DNA, 18 bp, Homo sapiens
ttgttttcttctgtatgt

SEQ ID NO: 1724374 - DNA, 14 bp, Homo sapiens
ttgttttgaaaata

SEQ ID NO: 1724375 - DNA, 24 bp, Homo sapiens
ttgttttgagctttccatgttgct

SEQ ID NO: 1724376 - DNA, 14 bp, Homo sapiens
ttgttttgcaaaag

SEQ ID NO: 1724377 - DNA, 14 bp, Homo sapiens
ttgttttgcttttg

SEQ ID NO: 1724378 - DNA, 22 bp, Homo sapiens
ttgttttggctgaaattctcct

SEQ ID NO: 1724379 - DNA, 15 bp, Homo sapiens
ttgttttgtgtttca

SEQ ID NO: 1724380 - DNA, 16 bp, Homo sapiens
ttgttttgttttttgg

SEQ ID NO: 1724381 - DNA, 19 bp, Homo sapiens
ttgtttttaagtttgcact

SEQ ID NO: 1724382 - DNA, 21 bp, Homo sapiens
ttgtttttgagtactgtacta

SEQ ID NO: 1724383 - DNA, 17 bp, Homo sapiens
ttgtttttgcatgaaat

SEQ ID NO: 1724384 - DNA, 18 bp, Homo sapiens
ttgttttttcctttataa

SEQ ID NO: 1724385 - DNA, 13 bp, Homo sapiens
ttgtttttttcct

SEQ ID NO: 1724386 - DNA, 23 bp, Homo sapiens
tttaaaaaaataacatctgaaaa

SEQ ID NO: 1724387 - DNA, 14 bp, Homo sapiens
tttaaaaaaatttt

SEQ ID NO: 1724388 - DNA, 16 bp, Homo sapiens
tttaaaaaaattttta

SEQ ID NO: 1724389 - DNA, 16 bp, Homo sapiens
tttaaaaaactctttg

SEQ ID NO: 1724390 - DNA, 14 bp, Homo sapiens
tttaaaaaataaca

SEQ ID NO: 1724391 - DNA, 21 bp, Homo sapiens
tttaaaaaataacatattctt

SEQ ID NO: 1724392 - DNA, 19 bp, Homo sapiens
tttaaaaaatagcagcttt

SEQ ID NO: 1724393 - DNA, 14 bp, Homo sapiens
tttaaaaagccagt

SEQ ID NO: 1724394 - DNA, 18 bp, Homo sapiens
tttaaaaaggaaatttgt

SEQ ID NO: 1724395 - DNA, 23 bp, Homo sapiens
tttaaaaataagtcaacagtaaa

SEQ ID NO: 1724396 - DNA, 12 bp, Homo sapiens
tttaaaaatatt

SEQ ID NO: 1724397 - DNA, 17 bp, Homo sapiens
tttaaaaccacagctgg

SEQ ID NO: 1724398 - DNA, 14 bp, Homo sapiens
tttaaaacccattt

SEQ ID NO: 1724399 - DNA, 21 bp, Homo sapiens
tttaaaacccatttaaatttt

SEQ ID NO: 1724400 - DNA, 23 bp, Homo sapiens
tttaaaactcagaatataacatg

SEQ ID NO: 1724401 - DNA, 13 bp, Homo sapiens
tttaaaactgtta

SEQ ID NO: 1724402 - DNA, 22 bp, Homo sapiens
tttaaaactgttggaatggatt

SEQ ID NO: 1724403 - DNA, 12 bp, Homo sapiens
tttaaaagaaat

SEQ ID NO: 1724404 - DNA, 21 bp, Homo sapiens
tttaaaagagagagagagaaa

SEQ ID NO: 1724405 - DNA, 13 bp, Homo sapiens
tttaaaagcctgc

SEQ ID NO: 1724406 - DNA, 14 bp, Homo sapiens
tttaaaagcctgct

SEQ ID NO: 1724407 - DNA, 20 bp, Homo sapiens
tttaaaaggatttttatctt

SEQ ID NO: 1724408 - DNA, 15 bp, Homo sapiens
tttaaaaggctccca

SEQ ID NO: 1724409 - DNA, 12 bp, Homo sapiens
tttaaaagtcta

SEQ ID NO: 1724410 - DNA, 22 bp, Homo sapiens
tttaaaagtctattttattatg

SEQ ID NO: 1724411 - DNA, 20 bp, Homo sapiens
tttaaaataccactgtaatt

SEQ ID NO: 1724412 - DNA, 12 bp, Homo sapiens
tttaaaatatat

SEQ ID NO: 1724413 - DNA, 14 bp, Homo sapiens
tttaaaatatttgt

SEQ ID NO: 1724414 - DNA, 22 bp, Homo sapiens
tttaaaatggaaaattttctcc

SEQ ID NO: 1724415 - DNA, 20 bp, Homo sapiens
tttaaaatgtacatgtatta

SEQ ID NO: 1724416 - DNA, 21 bp, Homo sapiens
tttaaaatgtagaaacttaaa

SEQ ID NO: 1724417 - DNA, 14 bp, Homo sapiens
tttaagttgtttgc

SEQ ID NO: 1724418 - DNA, 13 bp, Homo sapiens
tttaagtttgaag

SEQ ID NO: 1724419 - DNA, 14 bp, Homo sapiens
tttaagtttgaaga

SEQ ID NO: 1724420 - DNA, 14 bp, Homo sapiens
tttaagtttgcact

SEQ ID NO: 1724421 - DNA, 14 bp, Homo sapiens
tttaataaaaagga

SEQ ID NO: 1724422 - DNA, 18 bp, Homo sapiens
tttaataaaaatacacat

SEQ ID NO: 1724423 - DNA, 14 bp, Homo sapiens
tttaataaacagta

SEQ ID NO: 1724424 - DNA, 21 bp, Homo sapiens
tttaataaaggctgaagcttt

SEQ ID NO: 1724425 - DNA, 23 bp, Homo sapiens
tttaataacatatctaaagtcat

SEQ ID NO: 1724426 - DNA, 22 bp, Homo sapiens
tttaatagaaataaattcctaa

SEQ ID NO: 1724427 - DNA, 21 bp, Homo sapiens
tttaatagaatataattatcg

SEQ ID NO: 1724428 - DNA, 15 bp, Homo sapiens
tttaatagactgagt

SEQ ID NO: 1724429 - DNA, 13 bp, Homo sapiens
tttaatagcacta

SEQ ID NO: 1724430 - DNA, 15 bp, Homo sapiens
tttaatataaagcct

SEQ ID NO: 1724431 - DNA, 19 bp, Homo sapiens
tttaatatctggcactgtt

SEQ ID NO: 1724432 - DNA, 23 bp, Homo sapiens
ctctgcactcccacctgacacac

SEQ ID NO: 1724433 - DNA, 18 bp, Homo sapiens
ctctgcagaaactactga

SEQ ID NO: 1724434 - DNA, 23 bp, Homo sapiens
ctctgcagaagccaagggaagac

SEQ ID NO: 1724435 - DNA, 14 bp, Homo sapiens
ctctgcagccagcc

SEQ ID NO: 1724436 - DNA, 18 bp, Homo sapiens
ctctgcagccagcccagc

SEQ ID NO: 1724437 - DNA, 11 bp, Homo sapiens
ctctgcagctg

SEQ ID NO: 1724438 - DNA, 12 bp, Homo sapiens
ctctgcagctga

SEQ ID NO: 1724439 - DNA, 14 bp, Homo sapiens
ctctgcagtgcctt

SEQ ID NO: 1724440 - DNA, 19 bp, Homo sapiens
ctctgcatctactcccaag

SEQ ID NO: 1724441 - DNA, 22 bp, Homo sapiens
ctctgcatctactcccaagtat

SEQ ID NO: 1724442 - DNA, 15 bp, Homo sapiens
ctctgcattctagta

SEQ ID NO: 1724443 - DNA, 22 bp, Homo sapiens
ctctgccaacatgaggacagaa

SEQ ID NO: 1724444 - DNA, 22 bp, Homo sapiens
ctctgccaccctacctgttcag

SEQ ID NO: 1724445 - DNA, 19 bp, Homo sapiens
ctctgccactgactgcagg

SEQ ID NO: 1724446 - DNA, 14 bp, Homo sapiens
ctctgccaggcctg

SEQ ID NO: 1724447 - DNA, 13 bp, Homo sapiens
ctctgccagtgac

SEQ ID NO: 1724448 - DNA, 16 bp, Homo sapiens
ctctgccatcttcagg

SEQ ID NO: 1724449 - DNA, 14 bp, Homo sapiens
ctctgccccaagca

SEQ ID NO: 1724450 - DNA, 18 bp, Homo sapiens
ctctgccccaagccccca

SEQ ID NO: 1724451 - DNA, 14 bp, Homo sapiens
ctctgccccagcct

SEQ ID NO: 1724452 - DNA, 16 bp, Homo sapiens
ctctgccccagcctgt

SEQ ID NO: 1724453 - DNA, 18 bp, Homo sapiens
ctctgccccagctctggc

SEQ ID NO: 1724454 - DNA, 21 bp, Homo sapiens
ctctgccccagctctggcttc

SEQ ID NO: 1724455 - DNA, 16 bp, Homo sapiens
ctctgccccaggccct

SEQ ID NO: 1724456 - DNA, 14 bp, Homo sapiens
ctctgccccttggg

SEQ ID NO: 1724457 - DNA, 20 bp, Homo sapiens
ctctgccccttgggcatcca

SEQ ID NO: 1724458 - DNA, 22 bp, Homo sapiens
ctctgccccttgggcatccacc

SEQ ID NO: 1724459 - DNA, 13 bp, Homo sapiens
ctctgccctctgc

SEQ ID NO: 1724460 - DNA, 17 bp, Homo sapiens
ctctgccctgccctagc

SEQ ID NO: 1724461 - DNA, 13 bp, Homo sapiens
ctctgccctgtgt

SEQ ID NO: 1724462 - DNA, 21 bp, Homo sapiens
ctctgcccttgttccctaggg

SEQ ID NO: 1724463 - DNA, 15 bp, Homo sapiens
ctctgccgcctgcgt

SEQ ID NO: 1724464 - DNA, 15 bp, Homo sapiens
ctctgccgctacctc

SEQ ID NO: 1724465 - DNA, 19 bp, Homo sapiens
ctctgccgctacctccctc

SEQ ID NO: 1724466 - DNA, 19 bp, Homo sapiens
ctctgccggtcccccatgc

SEQ ID NO: 1724467 - DNA, 15 bp, Homo sapiens
ctctgcctccctagc

SEQ ID NO: 1724468 - DNA, 17 bp, Homo sapiens
ctctgcctccctctcca

SEQ ID NO: 1724469 - DNA, 18 bp, Homo sapiens
ctctgcctgaaccttcca

SEQ ID NO: 1724470 - DNA, 22 bp, Homo sapiens
ctctgcctgcactccctggcct

SEQ ID NO: 1724471 - DNA, 15 bp, Homo sapiens
ctctgcctgccccgc

SEQ ID NO: 1724472 - DNA, 10 bp, Homo sapiens
ctctgcctgg

SEQ ID NO: 1724473 - DNA, 21 bp, Homo sapiens
ctctgcctggggcctccagaa

SEQ ID NO: 1724474 - DNA, 12 bp, Homo sapiens
ctctgcctgtca

SEQ ID NO: 1724475 - DNA, 14 bp, Homo sapiens
ctctgcctgtctgg

SEQ ID NO: 1724476 - DNA, 18 bp, Homo sapiens
ctctgccttcaggcttct

SEQ ID NO: 1724477 - DNA, 16 bp, Homo sapiens
ctctgccttctcaggc

SEQ ID NO: 1724478 - DNA, 17 bp, Homo sapiens
ctctgccttctcaggcc

SEQ ID NO: 1724479 - DNA, 21 bp, Homo sapiens
ctctgcctttatgatgctaag

SEQ ID NO: 1724480 - DNA, 23 bp, Homo sapiens
ctctgcctttatgatgctaagct

SEQ ID NO: 1724481 - DNA, 15 bp, Homo sapiens
ctctgcctttgctct

SEQ ID NO: 1724482 - DNA, 19 bp, Homo sapiens
ctctgcgccaggcagagct

SEQ ID NO: 1724483 - DNA, 20 bp, Homo sapiens
ctctgcgccaggcagagctg

SEQ ID NO: 1724484 - DNA, 13 bp, Homo sapiens
ctctgctagactc

SEQ ID NO: 1724485 - DNA, 20 bp, Homo sapiens
ctctgctagactcctcagga

SEQ ID NO: 1724486 - DNA, 18 bp, Homo sapiens
ctctgctatttctcttgc

SEQ ID NO: 1724487 - DNA, 19 bp, Homo sapiens
ctctgctatttctcttgct

SEQ ID NO: 1724488 - DNA, 16 bp, Homo sapiens
ctctgctccaccacat

SEQ ID NO: 1724489 - DNA, 15 bp, Homo sapiens
ctctgctccagcaac

SEQ ID NO: 1724490 - DNA, 22 bp, Homo sapiens
ctctgctccagcaactgccctt

SEQ ID NO: 1724491 - DNA, 12 bp, Homo sapiens
ctctgctccctc

SEQ ID NO: 1724492 - DNA, 14 bp, Homo sapiens
ctctgctctagcca

SEQ ID NO: 1724493 - DNA, 17 bp, Homo sapiens
ctctgctctagccagga

SEQ ID NO: 1724494 - DNA, 18 bp, Homo sapiens
ctctgctctagccaggag

SEQ ID NO: 1724495 - DNA, 11 bp, Homo sapiens
ctctgctctgc

SEQ ID NO: 1724496 - DNA, 14 bp, Homo sapiens
ctctgctctgccct

SEQ ID NO: 1724497 - DNA, 15 bp, Homo sapiens
ctctgctctgcctgg

SEQ ID NO: 1724498 - DNA, 17 bp, Homo sapiens
ctctgctctgcctggag

SEQ ID NO: 1724499 - DNA, 20 bp, Homo sapiens
ctctgctgccggctctgggc

SEQ ID NO: 1724500 - DNA, 21 bp, Homo sapiens
ctctgctgctgtccctccccc

SEQ ID NO: 1724501 - DNA, 20 bp, Homo sapiens
ctctgctggaaggggcagca

SEQ ID NO: 1724502 - DNA, 13 bp, Homo sapiens
ctctgctggcagg

SEQ ID NO: 1724503 - DNA, 18 bp, Homo sapiens
ctctgctggcccagccaa

SEQ ID NO: 1724504 - DNA, 19 bp, Homo sapiens
ctctgcttacccttcacct

SEQ ID NO: 1724505 - DNA, 18 bp, Homo sapiens
ctctgcttctccaaggaa

SEQ ID NO: 1724506 - DNA, 19 bp, Homo sapiens
ctctgcttctcggggtcca

SEQ ID NO: 1724507 - DNA, 23 bp, Homo sapiens
ctctgcttctcggggtccagtgc

SEQ ID NO: 1724508 - DNA, 22 bp, Homo sapiens
ctctgcttgccgactggctgtg

SEQ ID NO: 1724509 - DNA, 18 bp, Homo sapiens
ctctgcttttgcacacct

SEQ ID NO: 1724510 - DNA, 13 bp, Homo sapiens
ctctggaaagcaa

SEQ ID NO: 1724511 - DNA, 20 bp, Homo sapiens
ctctggaaggccccttccct

SEQ ID NO: 1724512 - DNA, 21 bp, Homo sapiens
ctctggaaggccccttccctg

SEQ ID NO: 1724513 - DNA, 22 bp, Homo sapiens
ctctggaaggccccttccctgg

SEQ ID NO: 1724514 - DNA, 15 bp, Homo sapiens
ctctggaataaagtt

SEQ ID NO: 1724515 - DNA, 22 bp, Homo sapiens
ctctggaataaagttgcagatg

SEQ ID NO: 1724516 - DNA, 15 bp, Homo sapiens
ctctggacggcaggc

SEQ ID NO: 1724517 - DNA, 17 bp, Homo sapiens
ctctggacggcaggctc

SEQ ID NO: 1724518 - DNA, 13 bp, Homo sapiens
ctctggactggct

SEQ ID NO: 1724519 - DNA, 16 bp, Homo sapiens
ctctggactggctaga

SEQ ID NO: 1724520 - DNA, 19 bp, Homo sapiens
ctctggactggctagagtc

SEQ ID NO: 1724521 - DNA, 13 bp, Homo sapiens
ctctggagaacag

SEQ ID NO: 1724522 - DNA, 11 bp, Homo sapiens
ctctggagcag

SEQ ID NO: 1724523 - DNA, 15 bp, Homo sapiens
ctctggagcccctcc

SEQ ID NO: 1724524 - DNA, 13 bp, Homo sapiens
ctctggagcccta

SEQ ID NO: 1724525 - DNA, 20 bp, Homo sapiens
ctctggaggaagttctccag

SEQ ID NO: 1724526 - DNA, 23 bp, Homo sapiens
ctctggaggaagttctccagctt

SEQ ID NO: 1724527 - DNA, 17 bp, Homo sapiens
ctctggaggctgcagag

SEQ ID NO: 1724528 - DNA, 15 bp, Homo sapiens
ctctggaggggaggg

SEQ ID NO: 1724529 - DNA, 21 bp, Homo sapiens
ctctggagtgcccccagccca

SEQ ID NO: 1724530 - DNA, 17 bp, Homo sapiens
ctctggatctagaaggg

SEQ ID NO: 1724531 - DNA, 19 bp, Homo sapiens
ctctggatgaaggcaaaaa

SEQ ID NO: 1724532 - DNA, 21 bp, Homo sapiens
ctctggatgatggattccaca

SEQ ID NO: 1724533 - DNA, 13 bp, Homo sapiens
ctctggcaccatc

SEQ ID NO: 1724534 - DNA, 20 bp, Homo sapiens
ctctggcaccatcagcctgt

SEQ ID NO: 1724535 - DNA, 21 bp, Homo sapiens
ctctggcaccatcagcctgtt

SEQ ID NO: 1724536 - DNA, 22 bp, Homo sapiens
ctctggcaccatcagcctgttc

SEQ ID NO: 1724537 - DNA, 19 bp, Homo sapiens
ctctggcattagaattatt

SEQ ID NO: 1724538 - DNA, 14 bp, Homo sapiens
ctctggccacaaca

SEQ ID NO: 1724539 - DNA, 14 bp, Homo sapiens
ctctggccaccctg

SEQ ID NO: 1724540 - DNA, 17 bp, Homo sapiens
ctctggccaccctggcc

SEQ ID NO: 1724541 - DNA, 18 bp, Homo sapiens
ctctggccaccctggccc

SEQ ID NO: 1724542 - DNA, 18 bp, Homo sapiens
ctctggcccagaaagcct

SEQ ID NO: 1724543 - DNA, 21 bp, Homo sapiens
ctctggcccagaaagcctctc

SEQ ID NO: 1724544 - DNA, 13 bp, Homo sapiens
ctctggccccagg

SEQ ID NO: 1724545 - DNA, 15 bp, Homo sapiens
ctctggccccgctag

SEQ ID NO: 1724546 - DNA, 14 bp, Homo sapiens
ctctggccctgcct

SEQ ID NO: 1724547 - DNA, 18 bp, Homo sapiens
ctctggccctgccttctt

SEQ ID NO: 1724548 - DNA, 18 bp, Homo sapiens
ctctggccgccaccccca

SEQ ID NO: 1724549 - DNA, 14 bp, Homo sapiens
ctctggcctcccac

SEQ ID NO: 1724550 - DNA, 16 bp, Homo sapiens
ctctggcgacagtttt

SEQ ID NO: 1724551 - DNA, 16 bp, Homo sapiens
ctctggcggcttcctg

SEQ ID NO: 1724552 - DNA, 14 bp, Homo sapiens
ctctggctagagcc

SEQ ID NO: 1724553 - DNA, 16 bp, Homo sapiens
ctctggctagagccga

SEQ ID NO: 1724554 - DNA, 19 bp, Homo sapiens
ctctggctagagccgaggg

SEQ ID NO: 1724555 - DNA, 22 bp, Homo sapiens
ctctggctagaggccagcccca

SEQ ID NO: 1724556 - DNA, 14 bp, Homo sapiens
ctctggctctgttc

SEQ ID NO: 1724557 - DNA, 18 bp, Homo sapiens
ctctggctgaaccctgtg

SEQ ID NO: 1724558 - DNA, 21 bp, Homo sapiens
ctctggctgaaccctgtgctg

SEQ ID NO: 1724559 - DNA, 13 bp, Homo sapiens
ctctggctggcta

SEQ ID NO: 1724560 - DNA, 12 bp, Homo sapiens
ctctggcttccc

SEQ ID NO: 1724561 - DNA, 14 bp, Homo sapiens
ctctggcttctctc

SEQ ID NO: 1724562 - DNA, 16 bp, Homo sapiens
ctctggcttctctctt

SEQ ID NO: 1724563 - DNA, 19 bp, Homo sapiens
ctctgggaaataagagaga

SEQ ID NO: 1724564 - DNA, 21 bp, Homo sapiens
ctctgggacgtggacatgcct

SEQ ID NO: 1724565 - DNA, 17 bp, Homo sapiens
ctctgggactctcctcc

SEQ ID NO: 1724566 - DNA, 21 bp, Homo sapiens
ctctgggagaaaatcatcaag

SEQ ID NO: 1724567 - DNA, 19 bp, Homo sapiens
ctctgggagcccagaaccc

SEQ ID NO: 1724568 - DNA, 18 bp, Homo sapiens
ctctgggatttatgctca

SEQ ID NO: 1724569 - DNA, 19 bp, Homo sapiens
ctctgggatttatgctcat

SEQ ID NO: 1724570 - DNA, 22 bp, Homo sapiens
ctctgggatttatgctcatgaa

SEQ ID NO: 1724571 - DNA, 11 bp, Homo sapiens
ctctgggcaca

SEQ ID NO: 1724572 - DNA, 15 bp, Homo sapiens
ctctgggcagtgtgg

SEQ ID NO: 1724573 - DNA, 17 bp, Homo sapiens
ctctgggcagtgtggcc

SEQ ID NO: 1724574 - DNA, 23 bp, Homo sapiens
ctctgggccatgccaggccagag

SEQ ID NO: 1724575 - DNA, 20 bp, Homo sapiens
ctctgggccgggcctggggc

SEQ ID NO: 1724576 - DNA, 16 bp, Homo sapiens
ctctgggcctgagggt

SEQ ID NO: 1724577 - DNA, 15 bp, Homo sapiens
ctctgggcctgttct

SEQ ID NO: 1724578 - DNA, 16 bp, Homo sapiens
ctctgggcctgttctc

SEQ ID NO: 1724579 - DNA, 14 bp, Homo sapiens
ctctgggctcaggg

SEQ ID NO: 1724580 - DNA, 18 bp, Homo sapiens
ctctggggatttctggga

SEQ ID NO: 1724581 - DNA, 19 bp, Homo sapiens
ctctggtacgaatctcatc

SEQ ID NO: 1724582 - DNA, 17 bp, Homo sapiens
ctctggtctactctaga

SEQ ID NO: 1724583 - DNA, 15 bp, Homo sapiens
ctctggtctccttga

SEQ ID NO: 1724584 - DNA, 23 bp, Homo sapiens
ctctggtgagtcttggcggcagc

SEQ ID NO: 1724585 - DNA, 18 bp, Homo sapiens
ctctggtgcctccagagg

SEQ ID NO: 1724586 - DNA, 14 bp, Homo sapiens
ctctggtggctcct

SEQ ID NO: 1724587 - DNA, 21 bp, Homo sapiens
ctctggtggctcctcctagga

SEQ ID NO: 1724588 - DNA, 21 bp, Homo sapiens
ctctggtggcttaagtgagca

SEQ ID NO: 1724589 - DNA, 17 bp, Homo sapiens
ctctggtggtcttcctt

SEQ ID NO: 1724590 - DNA, 16 bp, Homo sapiens
ctctggtgtgtggtga

SEQ ID NO: 1724591 - DNA, 23 bp, Homo sapiens
ctctggttatttttctcttgtac

SEQ ID NO: 1724592 - DNA, 14 bp, Homo sapiens
ctctgtaccgcccg

SEQ ID NO: 1724593 - DNA, 20 bp, Homo sapiens
ctctgtaccgcccggcagcc

SEQ ID NO: 1724594 - DNA, 23 bp, Homo sapiens
ctctgtaccgcccggcagcccct

SEQ ID NO: 1724595 - DNA, 24 bp, Homo sapiens
ctctgtagctccctcctcccatct

SEQ ID NO: 1724596 - DNA, 17 bp, Homo sapiens
ctctgtaggcagcagag

SEQ ID NO: 1724597 - DNA, 18 bp, Homo sapiens
ctctgtagtttatggcag

SEQ ID NO: 1724598 - DNA, 21 bp, Homo sapiens
ctctgtataagttgaaggaaa

SEQ ID NO: 1724599 - DNA, 16 bp, Homo sapiens
ctctgtcacccttgtc

SEQ ID NO: 1724600 - DNA, 19 bp, Homo sapiens
ctctgtcacccttgtcctt

SEQ ID NO: 1724601 - DNA, 23 bp, Homo sapiens
ctctgtcagatgggaagacatga

SEQ ID NO: 1724602 - DNA, 17 bp, Homo sapiens
ctctgtcatcactccct

SEQ ID NO: 1724603 - DNA, 22 bp, Homo sapiens
ctctgtcatcactccctggatg

SEQ ID NO: 1724604 - DNA, 11 bp, Homo sapiens
ctctgtccaca

SEQ ID NO: 1724605 - DNA, 15 bp, Homo sapiens
ctctgtccaggccac

SEQ ID NO: 1724606 - DNA, 14 bp, Homo sapiens
ctctgtccagggcc

SEQ ID NO: 1724607 - DNA, 21 bp, Homo sapiens
ctctgtccagggccctgagct

SEQ ID NO: 1724608 - DNA, 22 bp, Homo sapiens
ctctgtccagggccctgagctc

SEQ ID NO: 1724609 - DNA, 13 bp, Homo sapiens
ctctgtctaggac

SEQ ID NO: 1724610 - DNA, 22 bp, Homo sapiens
ctctgtctaggactgcagtgtg

SEQ ID NO: 1724611 - DNA, 23 bp, Homo sapiens
ctctgtgacctgccccgcccagc

SEQ ID NO: 1724612 - DNA, 21 bp, Homo sapiens
ctctgtgagaaggtttattgt

SEQ ID NO: 1724613 - DNA, 18 bp, Homo sapiens
ctctgtgagactcgagaa

SEQ ID NO: 1724614 - DNA, 14 bp, Homo sapiens
ctctgtgcaggtgc

SEQ ID NO: 1724615 - DNA, 13 bp, Homo sapiens
ctctgtgccttcg

SEQ ID NO: 1724616 - DNA, 13 bp, Homo sapiens
ctctgtgctgtgt

SEQ ID NO: 1724617 - DNA, 22 bp, Homo sapiens
ctctgtgcttttaaatgcataa

SEQ ID NO: 1724618 - DNA, 17 bp, Homo sapiens
ctctgtggcctgtgtcc

SEQ ID NO: 1724619 - DNA, 18 bp, Homo sapiens
ctctgtggcctgtgtcca

SEQ ID NO: 1724620 - DNA, 19 bp, Homo sapiens
ctctgtggcctgtgtccag

SEQ ID NO: 1724621 - DNA, 16 bp, Homo sapiens
ctctgtgggtctctgg

SEQ ID NO: 1724622 - DNA, 20 bp, Homo sapiens
ctctgtggttttttttgaat

SEQ ID NO: 1724623 - DNA, 19 bp, Homo sapiens
ctctgtgtctaagattcta

SEQ ID NO: 1724624 - DNA, 23 bp, Homo sapiens
ctctgtgtctaagattctagatc

SEQ ID NO: 1724625 - DNA, 15 bp, Homo sapiens
ctctgtgtgcacaaa

SEQ ID NO: 1724626 - DNA, 13 bp, Homo sapiens
ctctgtgtgctcc

SEQ ID NO: 1724627 - DNA, 11 bp, Homo sapiens
ctctgttaaca

SEQ ID NO: 1724628 - DNA, 20 bp, Homo sapiens
ctctgttcacaaactacctc

SEQ ID NO: 1724629 - DNA, 19 bp, Homo sapiens
ctctgttcagatgtgcatt

SEQ ID NO: 1724630 - DNA, 19 bp, Homo sapiens
ctctgttcctgagccccca

SEQ ID NO: 1724631 - DNA, 16 bp, Homo sapiens
ctctgttcctttctct

SEQ ID NO: 1724632 - DNA, 23 bp, Homo sapiens
ctctgttctgtttggcacttgta

SEQ ID NO: 1724633 - DNA, 19 bp, Homo sapiens
ctctgttgcccaggctgga

SEQ ID NO: 1724634 - DNA, 20 bp, Homo sapiens
ctctgttgcccaggctggag

SEQ ID NO: 1724635 - DNA, 12 bp, Homo sapiens
ctctgttgtcct

SEQ ID NO: 1724636 - DNA, 22 bp, Homo sapiens
ctctgttgtcctccccttgggc

SEQ ID NO: 1724637 - DNA, 22 bp, Homo sapiens
ctctgtttataaaaacaaaaac

SEQ ID NO: 1724638 - DNA, 21 bp, Homo sapiens
ctcttaaattatatatttatt

SEQ ID NO: 1724639 - DNA, 15 bp, Homo sapiens
ctcttaagcagcatg

SEQ ID NO: 1724640 - DNA, 17 bp, Homo sapiens
ctcttaagcagcatgga

SEQ ID NO: 1724641 - DNA, 22 bp, Homo sapiens
ctcttaagcagcatggaaaaat

SEQ ID NO: 1724642 - DNA, 13 bp, Homo sapiens
ctcttaatgttgc

SEQ ID NO: 1724643 - DNA, 18 bp, Homo sapiens
ctcttaccgtagcctccg

SEQ ID NO: 1724644 - DNA, 16 bp, Homo sapiens
ctcttaccttcccgcc

SEQ ID NO: 1724645 - DNA, 15 bp, Homo sapiens
ctcttagaaatactt

SEQ ID NO: 1724646 - DNA, 22 bp, Homo sapiens
tttacttcttatacatttgata

SEQ ID NO: 1724647 - DNA, 20 bp, Homo sapiens
tttacttgtggtgtgaccat

SEQ ID NO: 1724648 - DNA, 18 bp, Homo sapiens
tttacttttaaacagtga

SEQ ID NO: 1724649 - DNA, 15 bp, Homo sapiens
tttacttttaaactg

SEQ ID NO: 1724650 - DNA, 22 bp, Homo sapiens
tttacttttcacactgtcttcc

SEQ ID NO: 1724651 - DNA, 23 bp, Homo sapiens
tttagaaaaaatggatgcccaga

SEQ ID NO: 1724652 - DNA, 23 bp, Homo sapiens
tttagaaagaagcccaatattat

SEQ ID NO: 1724653 - DNA, 14 bp, Homo sapiens
tttagaaatgcata

SEQ ID NO: 1724654 - DNA, 22 bp, Homo sapiens
tttagaaatgtgaagaggtctg

SEQ ID NO: 1724655 - DNA, 23 bp, Homo sapiens
tttagaacccagcagttacctta

SEQ ID NO: 1724656 - DNA, 14 bp, Homo sapiens
tttagaagcctgca

SEQ ID NO: 1724657 - DNA, 14 bp, Homo sapiens
tttagaatctagaa

SEQ ID NO: 1724658 - DNA, 21 bp, Homo sapiens
tttagaatggaggaagaacaa

SEQ ID NO: 1724659 - DNA, 19 bp, Homo sapiens
tttagacaactagatttgt

SEQ ID NO: 1724660 - DNA, 15 bp, Homo sapiens
tttagaccatttatc

SEQ ID NO: 1724661 - DNA, 15 bp, Homo sapiens
tttagagaaactttg

SEQ ID NO: 1724662 - DNA, 17 bp, Homo sapiens
tttagagaatgtgtttc

SEQ ID NO: 1724663 - DNA, 21 bp, Homo sapiens
tttagagaatgtgtttcaaaa

SEQ ID NO: 1724664 - DNA, 15 bp, Homo sapiens
tttagaggcattgtt

SEQ ID NO: 1724665 - DNA, 19 bp, Homo sapiens
tttagatgatgactcaaga

SEQ ID NO: 1724666 - DNA, 23 bp, Homo sapiens
ctcttcagtgactcctgctggta

SEQ ID NO: 1724667 - DNA, 17 bp, Homo sapiens
ctcttcatattcagctt

SEQ ID NO: 1724668 - DNA, 17 bp, Homo sapiens
ctcttcatcccattcca

SEQ ID NO: 1724669 - DNA, 19 bp, Homo sapiens
ctcttcatcccattccagg

SEQ ID NO: 1724670 - DNA, 22 bp, Homo sapiens
ctcttcatgcttgacataccta

SEQ ID NO: 1724671 - DNA, 23 bp, Homo sapiens
ctcttcatggcatcttcaatatg

SEQ ID NO: 1724672 - DNA, 18 bp, Homo sapiens
ctcttcattattctctgc

SEQ ID NO: 1724673 - DNA, 22 bp, Homo sapiens
ctcttcattccattgacttaga

SEQ ID NO: 1724674 - DNA, 14 bp, Homo sapiens
ctcttcattgtcta

SEQ ID NO: 1724675 - DNA, 21 bp, Homo sapiens
ctcttcatttttttttcaatc

SEQ ID NO: 1724676 - DNA, 16 bp, Homo sapiens
ctcttccaaccattta

SEQ ID NO: 1724677 - DNA, 18 bp, Homo sapiens
ctcttccagaatcccaag

SEQ ID NO: 1724678 - DNA, 18 bp, Homo sapiens
ctcttcccagttcagctt

SEQ ID NO: 1724679 - DNA, 12 bp, Homo sapiens
ctcttccccaga

SEQ ID NO: 1724680 - DNA, 14 bp, Homo sapiens
ctcttccccttccc

SEQ ID NO: 1724681 - DNA, 20 bp, Homo sapiens
ctcttccccttcctgtttca

SEQ ID NO: 1724682 - DNA, 21 bp, Homo sapiens
ctcttccccttcctgtttcag

SEQ ID NO: 1724683 - DNA, 14 bp, Homo sapiens
ctcttccctctccc

SEQ ID NO: 1724684 - DNA, 20 bp, Homo sapiens
ctcttccctctccctctctc

SEQ ID NO: 1724685 - DNA, 18 bp, Homo sapiens
ctcttccctctcgctccc

SEQ ID NO: 1724686 - DNA, 15 bp, Homo sapiens
ctcttccctctgggc

SEQ ID NO: 1724687 - DNA, 17 bp, Homo sapiens
ctcttccctctgggcct

SEQ ID NO: 1724688 - DNA, 23 bp, Homo sapiens
ctcttccctgaacttcctgcttc

SEQ ID NO: 1724689 - DNA, 20 bp, Homo sapiens
ctcttccgtgacgtcactgg

SEQ ID NO: 1724690 - DNA, 21 bp, Homo sapiens
ctcttcctctggttcctttca

SEQ ID NO: 1724691 - DNA, 14 bp, Homo sapiens
ctcttcctgccctt

SEQ ID NO: 1724692 - DNA, 19 bp, Homo sapiens
ctcttcctggacctgagtc

SEQ ID NO: 1724693 - DNA, 14 bp, Homo sapiens
ctcttcgctgtgat

SEQ ID NO: 1724694 - DNA, 16 bp, Homo sapiens
ctcttcgctgtgatgc

SEQ ID NO: 1724695 - DNA, 17 bp, Homo sapiens
ctcttcgctgtgatgca

SEQ ID NO: 1724696 - DNA, 18 bp, Homo sapiens
ctcttcggtttctgagca

SEQ ID NO: 1724697 - DNA, 15 bp, Homo sapiens
ctcttctagagccgt

SEQ ID NO: 1724698 - DNA, 20 bp, Homo sapiens
ctcttctagatggaccccag

SEQ ID NO: 1724699 - DNA, 16 bp, Homo sapiens
ctcttctcagtgtctg

SEQ ID NO: 1724700 - DNA, 12 bp, Homo sapiens
ctcttctccact

SEQ ID NO: 1724701 - DNA, 14 bp, Homo sapiens
ctcttctctccagc

SEQ ID NO: 1724702 - DNA, 22 bp, Homo sapiens
ctcttctctccagctgactaaa

SEQ ID NO: 1724703 - DNA, 12 bp, Homo sapiens
ctcttctcttcc

SEQ ID NO: 1724704 - DNA, 23 bp, Homo sapiens
ctcttctgagctatttcatctat

SEQ ID NO: 1724705 - DNA, 11 bp, Homo sapiens
ctcttctgcta

SEQ ID NO: 1724706 - DNA, 18 bp, Homo sapiens
ctcttctgctccaccctt

SEQ ID NO: 1724707 - DNA, 20 bp, Homo sapiens
ctcttctgctccacccttgg

SEQ ID NO: 1724708 - DNA, 19 bp, Homo sapiens
ctcttctgctcttttcctg

SEQ ID NO: 1724709 - DNA, 15 bp, Homo sapiens
ctcttctgggcctga

SEQ ID NO: 1724710 - DNA, 21 bp, Homo sapiens
ctcttctggggcaggctgggc

SEQ ID NO: 1724711 - DNA, 19 bp, Homo sapiens
ctcttcttaacttaaattt

SEQ ID NO: 1724712 - DNA, 15 bp, Homo sapiens
ctcttcttctgaaga

SEQ ID NO: 1724713 - DNA, 15 bp, Homo sapiens
ctcttcttcttcaga

SEQ ID NO: 1724714 - DNA, 17 bp, Homo sapiens
ctcttcttcttcagaag

SEQ ID NO: 1724715 - DNA, 19 bp, Homo sapiens
ctcttcttctttccttcca

SEQ ID NO: 1724716 - DNA, 15 bp, Homo sapiens
ctcttcttgaaattt

SEQ ID NO: 1724717 - DNA, 14 bp, Homo sapiens
ctcttcttgctata

SEQ ID NO: 1724718 - DNA, 16 bp, Homo sapiens
ctcttcttggggccca

SEQ ID NO: 1724719 - DNA, 12 bp, Homo sapiens
ctcttcttgttg

SEQ ID NO: 1724720 - DNA, 12 bp, Homo sapiens
ctcttctttaga

SEQ ID NO: 1724721 - DNA, 14 bp, Homo sapiens
ctcttctttctgag

SEQ ID NO: 1724722 - DNA, 16 bp, Homo sapiens
ctcttctttctgagag

SEQ ID NO: 1724723 - DNA, 16 bp, Homo sapiens
ctcttctttgtgcctt

SEQ ID NO: 1724724 - DNA, 17 bp, Homo sapiens
ctcttctttgtgccttt

SEQ ID NO: 1724725 - DNA, 20 bp, Homo sapiens
ctcttctttgtgcctttggc

SEQ ID NO: 1724726 - DNA, 13 bp, Homo sapiens
ctcttgaaaagtt

SEQ ID NO: 1724727 - DNA, 17 bp, Homo sapiens
ctcttgaaatgtagaat

SEQ ID NO: 1724728 - DNA, 16 bp, Homo sapiens
ctcttgaagtccagga

SEQ ID NO: 1724729 - DNA, 22 bp, Homo sapiens
ctcttgaataaagtattctagt

SEQ ID NO: 1724730 - DNA, 15 bp, Homo sapiens
ctcttgaatttttga

SEQ ID NO: 1724731 - DNA, 15 bp, Homo sapiens
ctcttgaccaggctg

SEQ ID NO: 1724732 - DNA, 20 bp, Homo sapiens
ctcttgagataaggttttaa

SEQ ID NO: 1724733 - DNA, 15 bp, Homo sapiens
ctcttgagcagtggc

SEQ ID NO: 1724734 - DNA, 22 bp, Homo sapiens
ctcttgagcagtggctggtcca

SEQ ID NO: 1724735 - DNA, 13 bp, Homo sapiens
ctcttgagctggc

SEQ ID NO: 1724736 - DNA, 15 bp, Homo sapiens
ctcttgagctggcct

SEQ ID NO: 1724737 - DNA, 15 bp, Homo sapiens
ctcttgagggagctt

SEQ ID NO: 1724738 - DNA, 18 bp, Homo sapiens
ctcttgatacccccctct

SEQ ID NO: 1724739 - DNA, 20 bp, Homo sapiens
ctcttgatctctcttgtcct

SEQ ID NO: 1724740 - DNA, 20 bp, Homo sapiens
ctcttgcacagtcactgctc

SEQ ID NO: 1724741 - DNA, 21 bp, Homo sapiens
ctcttgcacagtcactgctct

SEQ ID NO: 1724742 - DNA, 13 bp, Homo sapiens
ctcttgcacccgc

SEQ ID NO: 1724743 - DNA, 21 bp, Homo sapiens
ctcttgcacccgcctctcccg

SEQ ID NO: 1724744 - DNA, 16 bp, Homo sapiens
ctcttgcagttgctct

SEQ ID NO: 1724745 - DNA, 15 bp, Homo sapiens
ctcttgcccatcctg

SEQ ID NO: 1724746 - DNA, 16 bp, Homo sapiens
ctcttgcccatcctga

SEQ ID NO: 1724747 - DNA, 22 bp, Homo sapiens
ctcttgcccgcacccctccctg

SEQ ID NO: 1724748 - DNA, 15 bp, Homo sapiens
ctcttgcccttccct

SEQ ID NO: 1724749 - DNA, 19 bp, Homo sapiens
ctcttgcccttccctgtcc

SEQ ID NO: 1724750 - DNA, 16 bp, Homo sapiens
ctcttgcgggcctgga

SEQ ID NO: 1724751 - DNA, 12 bp, Homo sapiens
ctcttgctcaaa

SEQ ID NO: 1724752 - DNA, 19 bp, Homo sapiens
ctcttggagaagtctcagc

SEQ ID NO: 1724753 - DNA, 20 bp, Homo sapiens
ctcttggctatttctgtgtc

SEQ ID NO: 1724754 - DNA, 21 bp, Homo sapiens
ctcttggctatttctgtgtcc

SEQ ID NO: 1724755 - DNA, 15 bp, Homo sapiens
ctcttggctgacccc

SEQ ID NO: 1724756 - DNA, 18 bp, Homo sapiens
ctcttggctgacccctct

SEQ ID NO: 1724757 - DNA, 21 bp, Homo sapiens
ctcttggctgacccctctggt

SEQ ID NO: 1724758 - DNA, 16 bp, Homo sapiens
ctcttgggtcagagaa

SEQ ID NO: 1724759 - DNA, 13 bp, Homo sapiens
ctcttgtaagtca

SEQ ID NO: 1724760 - DNA, 19 bp, Homo sapiens
ttctggccggtgctgggtt

SEQ ID NO: 1724761 - DNA, 10 bp, Homo sapiens
ttctggctca

SEQ ID NO: 1724762 - DNA, 11 bp, Homo sapiens
ttctggctgcc

SEQ ID NO: 1724763 - DNA, 21 bp, Homo sapiens
ttctgggaaaaacaacatcat

SEQ ID NO: 1724764 - DNA, 19 bp, Homo sapiens
ttctgggaagcttgagcct

SEQ ID NO: 1724765 - DNA, 20 bp, Homo sapiens
ttctgggaagcttgagcctc

SEQ ID NO: 1724766 - DNA, 22 bp, Homo sapiens
ttctgggagacacccaaagggt

SEQ ID NO: 1724767 - DNA, 16 bp, Homo sapiens
ttctgggaggaagcag

SEQ ID NO: 1724768 - DNA, 15 bp, Homo sapiens
ttctgggatgtcaca

SEQ ID NO: 1724769 - DNA, 22 bp, Homo sapiens
ttctgggcgtctgagctggggt

SEQ ID NO: 1724770 - DNA, 19 bp, Homo sapiens
ttctgggcttggggtgtgg

SEQ ID NO: 1724771 - DNA, 14 bp, Homo sapiens
ttctggggaaagac

SEQ ID NO: 1724772 - DNA, 21 bp, Homo sapiens
ttctggggaaagacactgcct

SEQ ID NO: 1724773 - DNA, 23 bp, Homo sapiens
ttctggggaaagacactgcctgg

SEQ ID NO: 1724774 - DNA, 17 bp, Homo sapiens
ttctggggcaggctggg

SEQ ID NO: 1724775 - DNA, 19 bp, Homo sapiens
ttctggggggacccagtgc

SEQ ID NO: 1724776 - DNA, 22 bp, Homo sapiens
ttctggggggacccagtgcaga

SEQ ID NO: 1724777 - DNA, 18 bp, Homo sapiens
ttctgggtagtcccctgt

SEQ ID NO: 1724778 - DNA, 23 bp, Homo sapiens
ttctgggtagtcccctgttgatt

SEQ ID NO: 1724779 - DNA, 16 bp, Homo sapiens
ttctgggtcttttgct

SEQ ID NO: 1724780 - DNA, 13 bp, Homo sapiens
ttctggtaggaag

SEQ ID NO: 1724781 - DNA, 18 bp, Homo sapiens
ttctggtggggctgtcct

SEQ ID NO: 1724782 - DNA, 22 bp, Homo sapiens
ttctggtggggctgtcctgctg

SEQ ID NO: 1724783 - DNA, 18 bp, Homo sapiens
ttctggtgtatattttaa

SEQ ID NO: 1724784 - DNA, 22 bp, Homo sapiens
ttctggtgtttggtttcttcat

SEQ ID NO: 1724785 - DNA, 17 bp, Homo sapiens
ttctggttccagggtcc

SEQ ID NO: 1724786 - DNA, 12 bp, Homo sapiens
ttctggttctaa

SEQ ID NO: 1724787 - DNA, 20 bp, Homo sapiens
ttctggttgtttttgttctt

SEQ ID NO: 1724788 - DNA, 22 bp, Homo sapiens
ttctggtttaaacttgtttgct

SEQ ID NO: 1724789 - DNA, 14 bp, Homo sapiens
ttctggtttggcat

SEQ ID NO: 1724790 - DNA, 13 bp, Homo sapiens
ttctgtaaataac

SEQ ID NO: 1724791 - DNA, 15 bp, Homo sapiens
ttctgtaaataacct

SEQ ID NO: 1724792 - DNA, 17 bp, Homo sapiens
ttctgtaagagaaaata

SEQ ID NO: 1724793 - DNA, 11 bp, Homo sapiens
ttctgtaattc

SEQ ID NO: 1724794 - DNA, 21 bp, Homo sapiens
ttctgtaattcaggtttttcc

SEQ ID NO: 1724795 - DNA, 22 bp, Homo sapiens
ttctgtaattcaggtttttcct

SEQ ID NO: 1724796 - DNA, 13 bp, Homo sapiens
ttctgtaccagtt

SEQ ID NO: 1724797 - DNA, 21 bp, Homo sapiens
ttctgtactgttactgggccc

SEQ ID NO: 1724798 - DNA, 11 bp, Homo sapiens
ttctgtataaa

SEQ ID NO: 1724799 - DNA, 13 bp, Homo sapiens
ttctgtatacaac

SEQ ID NO: 1724800 - DNA, 13 bp, Homo sapiens
ttctgtatttcct

SEQ ID NO: 1724801 - DNA, 18 bp, Homo sapiens
ttctgtcaccaaatttgt

SEQ ID NO: 1724802 - DNA, 17 bp, Homo sapiens
ttctgtcacgtgaaata

SEQ ID NO: 1724803 - DNA, 16 bp, Homo sapiens
ttctgtcagtgttaaa

SEQ ID NO: 1724804 - DNA, 17 bp, Homo sapiens
ttctgtcctagcaagta

SEQ ID NO: 1724805 - DNA, 14 bp, Homo sapiens
ttctgtcctgggca

SEQ ID NO: 1724806 - DNA, 17 bp, Homo sapiens
ttctgtctcctgtcttc

SEQ ID NO: 1724807 - DNA, 19 bp, Homo sapiens
ttctgtgaaattctcagag

SEQ ID NO: 1724808 - DNA, 15 bp, Homo sapiens
ttctgtgacccatct

SEQ ID NO: 1724809 - DNA, 18 bp, Homo sapiens
ttctgtgacccatctgta

SEQ ID NO: 1724810 - DNA, 19 bp, Homo sapiens
ttctgtgagacccccacac

SEQ ID NO: 1724811 - DNA, 20 bp, Homo sapiens
ttctgtgcattcatgcaaga

SEQ ID NO: 1724812 - DNA, 11 bp, Homo sapiens
ttctgtgcctc

SEQ ID NO: 1724813 - DNA, 12 bp, Homo sapiens
ttctgtgcctcc

SEQ ID NO: 1724814 - DNA, 16 bp, Homo sapiens
ttctgtgcctcccccc

SEQ ID NO: 1724815 - DNA, 19 bp, Homo sapiens
ttctgtgcctccccccaga

SEQ ID NO: 1724816 - DNA, 16 bp, Homo sapiens
ttctgtgcctgaatat

SEQ ID NO: 1724817 - DNA, 16 bp, Homo sapiens
ttctgtgcttggattt

SEQ ID NO: 1724818 - DNA, 16 bp, Homo sapiens
ttctgtggattctata

SEQ ID NO: 1724819 - DNA, 19 bp, Homo sapiens
ttctgtggattctatattt

SEQ ID NO: 1724820 - DNA, 22 bp, Homo sapiens
ttctgtggctaaacagatgtaa

SEQ ID NO: 1724821 - DNA, 17 bp, Homo sapiens
ttctgtggttcctctgc

SEQ ID NO: 1724822 - DNA, 18 bp, Homo sapiens
ttctgtggtttcatgtta

SEQ ID NO: 1724823 - DNA, 13 bp, Homo sapiens
ttctgtgtacttt

SEQ ID NO: 1724824 - DNA, 22 bp, Homo sapiens
ttctgtgtctttcacagctcct

SEQ ID NO: 1724825 - DNA, 13 bp, Homo sapiens
ttctgtgttcatt

SEQ ID NO: 1724826 - DNA, 15 bp, Homo sapiens
ttctgtgttcatttt

SEQ ID NO: 1724827 - DNA, 16 bp, Homo sapiens
ttctgtgttcattttt

SEQ ID NO: 1724828 - DNA, 14 bp, Homo sapiens
ttctgttaaaatgg

SEQ ID NO: 1724829 - DNA, 23 bp, Homo sapiens
ttctgttactaaatccttttgtt

SEQ ID NO: 1724830 - DNA, 16 bp, Homo sapiens
ttctgttcagattaaa

SEQ ID NO: 1724831 - DNA, 19 bp, Homo sapiens
ttctgttcagattaaaaaa

SEQ ID NO: 1724832 - DNA, 16 bp, Homo sapiens
ctccacccttggcctg

SEQ ID NO: 1724833 - DNA, 21 bp, Homo sapiens
ctccacccttggcctgtctca

SEQ ID NO: 1724834 - DNA, 18 bp, Homo sapiens
ctccaccgaccaactgcc

SEQ ID NO: 1724835 - DNA, 15 bp, Homo sapiens
ctccaccgagccagc

SEQ ID NO: 1724836 - DNA, 18 bp, Homo sapiens
ctccaccgagccagcttg

SEQ ID NO: 1724837 - DNA, 19 bp, Homo sapiens
ctccaccgagccagcttgg

SEQ ID NO: 1724838 - DNA, 18 bp, Homo sapiens
ctccacctacacccctgt

SEQ ID NO: 1724839 - DNA, 13 bp, Homo sapiens
ctccacctcagcc

SEQ ID NO: 1724840 - DNA, 16 bp, Homo sapiens
ctccacctcagccttg

SEQ ID NO: 1724841 - DNA, 18 bp, Homo sapiens
ctccacctcagccttgga

SEQ ID NO: 1724842 - DNA, 14 bp, Homo sapiens
ctccacctccccca

SEQ ID NO: 1724843 - DNA, 14 bp, Homo sapiens
ctccacctctggtg

SEQ ID NO: 1724844 - DNA, 19 bp, Homo sapiens
ctccacggtgcgtggctgt

SEQ ID NO: 1724845 - DNA, 21 bp, Homo sapiens
ctccacggtgcgtggctgtgg

SEQ ID NO: 1724846 - DNA, 22 bp, Homo sapiens
ctccacggtgcgtggctgtggc

SEQ ID NO: 1724847 - DNA, 23 bp, Homo sapiens
ctccacggtgcgtggctgtggca

SEQ ID NO: 1724848 - DNA, 24 bp, Homo sapiens
ctccacgtgtccgtccacccttcc

SEQ ID NO: 1724849 - DNA, 21 bp, Homo sapiens
ctccactaaatgagctcctgc

SEQ ID NO: 1724850 - DNA, 14 bp, Homo sapiens
ctccactcagctgt

SEQ ID NO: 1724851 - DNA, 21 bp, Homo sapiens
ctccactcagctgtcctgcag

SEQ ID NO: 1724852 - DNA, 17 bp, Homo sapiens
ctccactccactgcctt

SEQ ID NO: 1724853 - DNA, 16 bp, Homo sapiens
ctccactctagttcta

SEQ ID NO: 1724854 - DNA, 13 bp, Homo sapiens
ctccactctcccc

SEQ ID NO: 1724855 - DNA, 15 bp, Homo sapiens
ctccactctccccca

SEQ ID NO: 1724856 - DNA, 23 bp, Homo sapiens
ctccactctgattcacctcttcc

SEQ ID NO: 1724857 - DNA, 16 bp, Homo sapiens
ctccactctgcttctc

SEQ ID NO: 1724858 - DNA, 21 bp, Homo sapiens
ctccactctgcttctctgact

SEQ ID NO: 1724859 - DNA, 17 bp, Homo sapiens
ctccactgccctggcag

SEQ ID NO: 1724860 - DNA, 11 bp, Homo sapiens
ctccactgcct

SEQ ID NO: 1724861 - DNA, 20 bp, Homo sapiens
ctccactgctctcagcctcc

SEQ ID NO: 1724862 - DNA, 13 bp, Homo sapiens
ctccactgctgga

SEQ ID NO: 1724863 - DNA, 16 bp, Homo sapiens
ctccactgctggacat

SEQ ID NO: 1724864 - DNA, 13 bp, Homo sapiens
ctccactggatgg

SEQ ID NO: 1724865 - DNA, 16 bp, Homo sapiens
ctccactgtgcacacc

SEQ ID NO: 1724866 - DNA, 22 bp, Homo sapiens
ctccagaaatgtctaaatgctg

SEQ ID NO: 1724867 - DNA, 17 bp, Homo sapiens
ctccagaagatgccagc

SEQ ID NO: 1724868 - DNA, 20 bp, Homo sapiens
ctccagaagatgccagcttc

SEQ ID NO: 1724869 - DNA, 14 bp, Homo sapiens
ctccagaagcctct

SEQ ID NO: 1724870 - DNA, 17 bp, Homo sapiens
ctccagaagcctctggc

SEQ ID NO: 1724871 - DNA, 13 bp, Homo sapiens
ctccagaagctgc

SEQ ID NO: 1724872 - DNA, 14 bp, Homo sapiens
ctccagaagctgct

SEQ ID NO: 1724873 - DNA, 15 bp, Homo sapiens
ctccagaagctgctc

SEQ ID NO: 1724874 - DNA, 19 bp, Homo sapiens
ctccagaagctgctccttt

SEQ ID NO: 1724875 - DNA, 21 bp, Homo sapiens
ttcttatgtgacattaacaaa

SEQ ID NO: 1724876 - DNA, 20 bp, Homo sapiens
ttcttattaatttcagtctt

SEQ ID NO: 1724877 - DNA, 17 bp, Homo sapiens
ttcttattactattatt

SEQ ID NO: 1724878 - DNA, 19 bp, Homo sapiens
ttcttattctcactccacc

SEQ ID NO: 1724879 - DNA, 19 bp, Homo sapiens
ttcttattgcgctgctacc

SEQ ID NO: 1724880 - DNA, 18 bp, Homo sapiens
ttcttatttaatcttttc

SEQ ID NO: 1724881 - DNA, 19 bp, Homo sapiens
ttcttatttaatgaaagac

SEQ ID NO: 1724882 - DNA, 23 bp, Homo sapiens
ttcttatttaatgaaagactgta

SEQ ID NO: 1724883 - DNA, 15 bp, Homo sapiens
ttcttatttcatttc

SEQ ID NO: 1724884 - DNA, 14 bp, Homo sapiens
ttcttattttgcat

SEQ ID NO: 1724885 - DNA, 15 bp, Homo sapiens
ttcttatttttctta

SEQ ID NO: 1724886 - DNA, 16 bp, Homo sapiens
ttcttcaactcctggg

SEQ ID NO: 1724887 - DNA, 19 bp, Homo sapiens
ttcttcaagggaagaaaca

SEQ ID NO: 1724888 - DNA, 21 bp, Homo sapiens
ttcttcacctaagtctctgtg

SEQ ID NO: 1724889 - DNA, 22 bp, Homo sapiens
ttcttcacctaagtctctgtga

SEQ ID NO: 1724890 - DNA, 16 bp, Homo sapiens
ttcttcacctcttcca

SEQ ID NO: 1724891 - DNA, 18 bp, Homo sapiens
ttcttcactcaaattttg

SEQ ID NO: 1724892 - DNA, 15 bp, Homo sapiens
ttcttcagagtgaag

SEQ ID NO: 1724893 - DNA, 21 bp, Homo sapiens
ttcttcatccggcagcctgga

SEQ ID NO: 1724894 - DNA, 14 bp, Homo sapiens
ttcttcatgcaatg

SEQ ID NO: 1724895 - DNA, 17 bp, Homo sapiens
ttcttcatgcaatgaca

SEQ ID NO: 1724896 - DNA, 18 bp, Homo sapiens
ttcttccatcatcactgt

SEQ ID NO: 1724897 - DNA, 12 bp, Homo sapiens
ttcttccccagt

SEQ ID NO: 1724898 - DNA, 20 bp, Homo sapiens
ttcttcccttttacatactg

SEQ ID NO: 1724899 - DNA, 21 bp, Homo sapiens
ttcttcccttttacatactgc

SEQ ID NO: 1724900 - DNA, 15 bp, Homo sapiens
ttcttccgggggaag

SEQ ID NO: 1724901 - DNA, 13 bp, Homo sapiens
ttcttcctgccag

SEQ ID NO: 1724902 - DNA, 23 bp, Homo sapiens
ttcttcgaggtggatcacagagg

SEQ ID NO: 1724903 - DNA, 16 bp, Homo sapiens
ttcttcgctgctctag

SEQ ID NO: 1724904 - DNA, 23 bp, Homo sapiens
ttcttcgctgctctagctggcag

SEQ ID NO: 1724905 - DNA, 21 bp, Homo sapiens
ttcttcgctggactattgtgc

SEQ ID NO: 1724906 - DNA, 12 bp, Homo sapiens
ttcttctaagaa

SEQ ID NO: 1724907 - DNA, 16 bp, Homo sapiens
ttcttctaagaagaca

SEQ ID NO: 1724908 - DNA, 18 bp, Homo sapiens
ttcttctaagaagacatt

SEQ ID NO: 1724909 - DNA, 23 bp, Homo sapiens
ttcttctaccacacctggaaaca

SEQ ID NO: 1724910 - DNA, 14 bp, Homo sapiens
ttcttctagagttc

SEQ ID NO: 1724911 - DNA, 15 bp, Homo sapiens
ttcttctctgtgaga

SEQ ID NO: 1724912 - DNA, 22 bp, Homo sapiens
ttcttctctgtgagaaggttta

SEQ ID NO: 1724913 - DNA, 16 bp, Homo sapiens
ttcttctcttatcctc

SEQ ID NO: 1724914 - DNA, 14 bp, Homo sapiens
ttcttctctttagt

SEQ ID NO: 1724915 - DNA, 20 bp, Homo sapiens
ttcttctgaactcaaactga

SEQ ID NO: 1724916 - DNA, 15 bp, Homo sapiens
ttcttcttattttgt

SEQ ID NO: 1724917 - DNA, 13 bp, Homo sapiens
ttcttcttcagaa

SEQ ID NO: 1724918 - DNA, 13 bp, Homo sapiens
ttcttcttccctc

SEQ ID NO: 1724919 - DNA, 14 bp, Homo sapiens
ttcttcttctaaga

SEQ ID NO: 1724920 - DNA, 14 bp, Homo sapiens
ttcttctttctaga

SEQ ID NO: 1724921 - DNA, 17 bp, Homo sapiens
ttcttctttttgcttca

SEQ ID NO: 1724922 - DNA, 21 bp, Homo sapiens
ttcttctttttgcttcaaaaa

SEQ ID NO: 1724923 - DNA, 20 bp, Homo sapiens
ttcttgaatcctctattaat

SEQ ID NO: 1724924 - DNA, 21 bp, Homo sapiens
ttcttgaatcctctattaatt

SEQ ID NO: 1724925 - DNA, 21 bp, Homo sapiens
ttcttgacaaaacctaacttg

SEQ ID NO: 1724926 - DNA, 15 bp, Homo sapiens
ttcttgacttatatt

SEQ ID NO: 1724927 - DNA, 19 bp, Homo sapiens
ttcttgatgtaaaatcttg

SEQ ID NO: 1724928 - DNA, 15 bp, Homo sapiens
ttcttgattttcaag

SEQ ID NO: 1724929 - DNA, 15 bp, Homo sapiens
ttcttgcaagcatgc

SEQ ID NO: 1724930 - DNA, 22 bp, Homo sapiens
ttcttgcataggctcttaagca

SEQ ID NO: 1724931 - DNA, 20 bp, Homo sapiens
ttcttgccatcactggtcca

SEQ ID NO: 1724932 - DNA, 18 bp, Homo sapiens
ttcttgcctctgtcccct

SEQ ID NO: 1724933 - DNA, 12 bp, Homo sapiens
ttcttgctgctt

SEQ ID NO: 1724934 - DNA, 15 bp, Homo sapiens
ttcttgctttcaatt

SEQ ID NO: 1724935 - DNA, 19 bp, Homo sapiens
ttcttgctttcacaaatat

SEQ ID NO: 1724936 - DNA, 19 bp, Homo sapiens
ttcttggaactgtcccagc

SEQ ID NO: 1724937 - DNA, 18 bp, Homo sapiens
ttcttggagctttggaat

SEQ ID NO: 1724938 - DNA, 12 bp, Homo sapiens
ttcttggggaga

SEQ ID NO: 1724939 - DNA, 18 bp, Homo sapiens
ttcttggggcccagtgca

SEQ ID NO: 1724940 - DNA, 19 bp, Homo sapiens
ttcttggtaactgattacc

SEQ ID NO: 1724941 - DNA, 17 bp, Homo sapiens
ttcttggtttggggaga

SEQ ID NO: 1724942 - DNA, 21 bp, Homo sapiens
ttcttgtaatttaaacaggcc

SEQ ID NO: 1724943 - DNA, 23 bp, Homo sapiens
ttcttgtagccatggctgggcgt

SEQ ID NO: 1724944 - DNA, 12 bp, Homo sapiens
ttcttgtattta

SEQ ID NO: 1724945 - DNA, 15 bp, Homo sapiens
ttcttgtttccttgt

SEQ ID NO: 1724946 - DNA, 13 bp, Homo sapiens
ttcttgtttgtca

SEQ ID NO: 1724947 - DNA, 16 bp, Homo sapiens
ttcttgtttgtcagca

SEQ ID NO: 1724948 - DNA, 18 bp, Homo sapiens
ttcttgtttgtcagcatc

SEQ ID NO: 1724949 - DNA, 12 bp, Homo sapiens
ttctttaactgc

SEQ ID NO: 1724950 - DNA, 20 bp, Homo sapiens
ctccaggcaggccaggctgc

SEQ ID NO: 1724951 - DNA, 12 bp, Homo sapiens
ctccaggccagg

SEQ ID NO: 1724952 - DNA, 21 bp, Homo sapiens
ctccaggccccaccaagaggg

SEQ ID NO: 1724953 - DNA, 18 bp, Homo sapiens
ctccaggccctcctctcc

SEQ ID NO: 1724954 - DNA, 10 bp, Homo sapiens
ctccaggcct

SEQ ID NO: 1724955 - DNA, 17 bp, Homo sapiens
ctccaggcctgaccagg

SEQ ID NO: 1724956 - DNA, 14 bp, Homo sapiens
ctccaggcctgcct

SEQ ID NO: 1724957 - DNA, 17 bp, Homo sapiens
ctccaggcctgcctccc

SEQ ID NO: 1724958 - DNA, 19 bp, Homo sapiens
ctccaggcctgcctcccac

SEQ ID NO: 1724959 - DNA, 20 bp, Homo sapiens
ctccaggcctgcctcccact

SEQ ID NO: 1724960 - DNA, 22 bp, Homo sapiens
ctccaggcctgcctcccacttc

SEQ ID NO: 1724961 - DNA, 20 bp, Homo sapiens
ctccaggcctgttgctatag

SEQ ID NO: 1724962 - DNA, 15 bp, Homo sapiens
ctccaggctttccca

SEQ ID NO: 1724963 - DNA, 20 bp, Homo sapiens
ctccagggagcaagacagag

SEQ ID NO: 1724964 - DNA, 17 bp, Homo sapiens
ctccagggagtcccctc

SEQ ID NO: 1724965 - DNA, 21 bp, Homo sapiens
ctccagggagtcccctccccg

SEQ ID NO: 1724966 - DNA, 18 bp, Homo sapiens
ctccagggccacgtgcca

SEQ ID NO: 1724967 - DNA, 19 bp, Homo sapiens
ctccagggccacgtgccag

SEQ ID NO: 1724968 - DNA, 14 bp, Homo sapiens
ctccagggcccagg

SEQ ID NO: 1724969 - DNA, 13 bp, Homo sapiens
ctccagggctcca

SEQ ID NO: 1724970 - DNA, 13 bp, Homo sapiens
ctccagggctgga

SEQ ID NO: 1724971 - DNA, 14 bp, Homo sapiens
ctccagggctggac

SEQ ID NO: 1724972 - DNA, 16 bp, Homo sapiens
ctccagggctggactg

SEQ ID NO: 1724973 - DNA, 17 bp, Homo sapiens
ctccagggctggactga

SEQ ID NO: 1724974 - DNA, 14 bp, Homo sapiens
ctccaggggcctgc

SEQ ID NO: 1724975 - DNA, 22 bp, Homo sapiens
ctccaggggctgcttcctcctg

SEQ ID NO: 1724976 - DNA, 13 bp, Homo sapiens
ctccagggtcttg

SEQ ID NO: 1724977 - DNA, 18 bp, Homo sapiens
ctccagggtcttgggcta

SEQ ID NO: 1724978 - DNA, 17 bp, Homo sapiens
ctccaggtcagcctgga

SEQ ID NO: 1724979 - DNA, 19 bp, Homo sapiens
ctccaggtcagcctggaag

SEQ ID NO: 1724980 - DNA, 22 bp, Homo sapiens
ctccaggtcctctacttaatga

SEQ ID NO: 1724981 - DNA, 14 bp, Homo sapiens
ctccaggtgcagag

SEQ ID NO: 1724982 - DNA, 16 bp, Homo sapiens
ctccaggtgcagaggt

SEQ ID NO: 1724983 - DNA, 14 bp, Homo sapiens
ctccaggtggctct

SEQ ID NO: 1724984 - DNA, 17 bp, Homo sapiens
ctccaggtggctctgag

SEQ ID NO: 1724985 - DNA, 16 bp, Homo sapiens
ctccagtaccttgctt

SEQ ID NO: 1724986 - DNA, 18 bp, Homo sapiens
ctccagtacgtcccgctg

SEQ ID NO: 1724987 - DNA, 13 bp, Homo sapiens
ctccagtcaacag

SEQ ID NO: 1724988 - DNA, 18 bp, Homo sapiens
ctccagtcaacagattca

SEQ ID NO: 1724989 - DNA, 17 bp, Homo sapiens
ctccagtgctcagctgt

SEQ ID NO: 1724990 - DNA, 18 bp, Homo sapiens
ttcttttccaagctcctt

SEQ ID NO: 1724991 - DNA, 22 bp, Homo sapiens
ttcttttcccttaaatacagat

SEQ ID NO: 1724992 - DNA, 22 bp, Homo sapiens
ttcttttctggtgattctccag

SEQ ID NO: 1724993 - DNA, 14 bp, Homo sapiens
ttcttttgcaattg

SEQ ID NO: 1724994 - DNA, 21 bp, Homo sapiens
ttcttttgcccttcacagtgt

SEQ ID NO: 1724995 - DNA, 16 bp, Homo sapiens
ttcttttgtaattgtg

SEQ ID NO: 1724996 - DNA, 14 bp, Homo sapiens
ttcttttgtttggt

SEQ ID NO: 1724997 - DNA, 13 bp, Homo sapiens
ttctttttacagc

SEQ ID NO: 1724998 - DNA, 21 bp, Homo sapiens
ttctttttacagcattgtctt

SEQ ID NO: 1724999 - DNA, 22 bp, Homo sapiens
ttctttttacagcattgtcttt

SEQ ID NO: 1725000 - DNA, 19 bp, Homo sapiens
ttctttttctgagacagct

SEQ ID NO: 1725001 - DNA, 13 bp, Homo sapiens
ttctttttgctct

SEQ ID NO: 1725002 - DNA, 21 bp, Homo sapiens
ttctttttgctctaaaatatt

SEQ ID NO: 1725003 - DNA, 23 bp, Homo sapiens
ttcttttttatgcagaatttgat

SEQ ID NO: 1725004 - DNA, 15 bp, Homo sapiens
ttctttttttaactg

SEQ ID NO: 1725005 - DNA, 17 bp, Homo sapiens
ttctttttttttaagtt

SEQ ID NO: 1725006 - DNA, 22 bp, Homo sapiens
ttcttttttttttttttgagac

SEQ ID NO: 1725007 - DNA, 20 bp, Homo sapiens
ttgaaaaaaattgaaataaa

SEQ ID NO: 1725008 - DNA, 13 bp, Homo sapiens
ttgaaaaatataa

SEQ ID NO: 1725009 - DNA, 15 bp, Homo sapiens
ttgaaaaatctagtt

SEQ ID NO: 1725010 - DNA, 13 bp, Homo sapiens
ttgaaaacaaaaa

SEQ ID NO: 1725011 - DNA, 21 bp, Homo sapiens
ttgaaaacaaaaaaaatgtta

SEQ ID NO: 1725012 - DNA, 14 bp, Homo sapiens
ttgaaaacttttct

SEQ ID NO: 1725013 - DNA, 14 bp, Homo sapiens
ttgaaaagaagaaa

SEQ ID NO: 1725014 - DNA, 19 bp, Homo sapiens
ttgaaaagaagaaagtcta

SEQ ID NO: 1725015 - DNA, 23 bp, Homo sapiens
ttgaaaagaagaaagtctatgct

SEQ ID NO: 1725016 - DNA, 19 bp, Homo sapiens
ttgaaaagaccaagacttt

SEQ ID NO: 1725017 - DNA, 14 bp, Homo sapiens
ttgaaaagccaaag

SEQ ID NO: 1725018 - DNA, 23 bp, Homo sapiens
ttgaaaaggtgtccttttccttt

SEQ ID NO: 1725019 - DNA, 16 bp, Homo sapiens
ttgaaaagtgttctgt

SEQ ID NO: 1725020 - DNA, 17 bp, Homo sapiens
ttgaaaataaaaagaga

SEQ ID NO: 1725021 - DNA, 23 bp, Homo sapiens
ttgaaaattatgcaaaagcagct

SEQ ID NO: 1725022 - DNA, 14 bp, Homo sapiens
ttgaaactgctata

SEQ ID NO: 1725023 - DNA, 20 bp, Homo sapiens
ttgaaactgtaaatatgttt

SEQ ID NO: 1725024 - DNA, 20 bp, Homo sapiens
ttgaaactttgggaaaacat

SEQ ID NO: 1725025 - DNA, 18 bp, Homo sapiens
ttgaaagaacttaagtct

SEQ ID NO: 1725026 - DNA, 15 bp, Homo sapiens
ttgaaagaagcaaga

SEQ ID NO: 1725027 - DNA, 19 bp, Homo sapiens
ttgaaagacatcaatgaaa

SEQ ID NO: 1725028 - DNA, 22 bp, Homo sapiens
ttgaaagattcaggtatgttgc

SEQ ID NO: 1725029 - DNA, 18 bp, Homo sapiens
ttgaaagattttattgta

SEQ ID NO: 1725030 - DNA, 20 bp, Homo sapiens
ttgaaagattttattgtata

SEQ ID NO: 1725031 - DNA, 22 bp, Homo sapiens
ttgaaagattttattgtataaa

SEQ ID NO: 1725032 - DNA, 12 bp, Homo sapiens
ttgaaagctgtg

SEQ ID NO: 1725033 - DNA, 19 bp, Homo sapiens
ttgaaagcttcaaagttta

SEQ ID NO: 1725034 - DNA, 21 bp, Homo sapiens
ttgaaagcttttaaaatgtag

SEQ ID NO: 1725035 - DNA, 19 bp, Homo sapiens
ttgaaaggcattctctgaa

SEQ ID NO: 1725036 - DNA, 20 bp, Homo sapiens
ttgaaaggcattctctgaag

SEQ ID NO: 1725037 - DNA, 15 bp, Homo sapiens
ttgaaagtagagcta

SEQ ID NO: 1725038 - DNA, 15 bp, Homo sapiens
ttgaaagttagagat

SEQ ID NO: 1725039 - DNA, 21 bp, Homo sapiens
ttgaaagttagagattttaca

SEQ ID NO: 1725040 - DNA, 17 bp, Homo sapiens
ttgaaagttttcagaac

SEQ ID NO: 1725041 - DNA, 20 bp, Homo sapiens
ttgaaataaggagggacatg

SEQ ID NO: 1725042 - DNA, 23 bp, Homo sapiens
ttgaaatagtatacattgtcttg

SEQ ID NO: 1725043 - DNA, 18 bp, Homo sapiens
ttgaaatattcagaaatt

SEQ ID NO: 1725044 - DNA, 19 bp, Homo sapiens
ttgaaatcaatgcaagagt

SEQ ID NO: 1725045 - DNA, 13 bp, Homo sapiens
ttgaaatgaaagg

SEQ ID NO: 1725046 - DNA, 14 bp, Homo sapiens
ttgaaatgaaaggg

SEQ ID NO: 1725047 - DNA, 19 bp, Homo sapiens
ttgaaattatgtatgttta

SEQ ID NO: 1725048 - DNA, 20 bp, Homo sapiens
ttgaacaaaaatgtttccac

SEQ ID NO: 1725049 - DNA, 23 bp, Homo sapiens
ttgaacaaaaatgtttccactgg

SEQ ID NO: 1725050 - DNA, 14 bp, Homo sapiens
ttgaacaaaataaa

SEQ ID NO: 1725051 - DNA, 20 bp, Homo sapiens
ttgaacaagatttccctaaa

SEQ ID NO: 1725052 - DNA, 19 bp, Homo sapiens
ttgaacatgtgccttttct

SEQ ID NO: 1725053 - DNA, 16 bp, Homo sapiens
ttgaaccaacatcttt

SEQ ID NO: 1725054 - DNA, 14 bp, Homo sapiens
ttgaaccatagtta

SEQ ID NO: 1725055 - DNA, 17 bp, Homo sapiens
ttgaaccccctccctgt

SEQ ID NO: 1725056 - DNA, 20 bp, Homo sapiens
ttgaacctggatccagcact

SEQ ID NO: 1725057 - DNA, 18 bp, Homo sapiens
ttgaacctgggaggcaga

SEQ ID NO: 1725058 - DNA, 17 bp, Homo sapiens
ttgaacgtgcttctttg

SEQ ID NO: 1725059 - DNA, 15 bp, Homo sapiens
ttgaactctggtggc

SEQ ID NO: 1725060 - DNA, 18 bp, Homo sapiens
ttgaactgttagaatgta

SEQ ID NO: 1725061 - DNA, 16 bp, Homo sapiens
ttgaacttgattgcct

SEQ ID NO: 1725062 - DNA, 16 bp, Homo sapiens
ttgaacttttttccac

SEQ ID NO: 1725063 - DNA, 22 bp, Homo sapiens
ttgaacttttttccactgaagt

SEQ ID NO: 1725064 - DNA, 19 bp, Homo sapiens
ttgaagaactgcaggccct

SEQ ID NO: 1725065 - DNA, 20 bp, Homo sapiens
ttgaagaactgcaggccctg

SEQ ID NO: 1725066 - DNA, 20 bp, Homo sapiens
ttgaagaatagtcataacta

SEQ ID NO: 1725067 - DNA, 22 bp, Homo sapiens
ctcccaatcctctctcccctct

SEQ ID NO: 1725068 - DNA, 19 bp, Homo sapiens
ctcccaatttcagactccc

SEQ ID NO: 1725069 - DNA, 18 bp, Homo sapiens
ctcccacacccaaagctg

SEQ ID NO: 1725070 - DNA, 15 bp, Homo sapiens
ctcccacactcccaa

SEQ ID NO: 1725071 - DNA, 15 bp, Homo sapiens
ctcccacagcctcct

SEQ ID NO: 1725072 - DNA, 19 bp, Homo sapiens
ctcccacagcctccttctg

SEQ ID NO: 1725073 - DNA, 14 bp, Homo sapiens
ctcccacaggccct

SEQ ID NO: 1725074 - DNA, 15 bp, Homo sapiens
ctcccacaggccctt

SEQ ID NO: 1725075 - DNA, 21 bp, Homo sapiens
ctcccacaggcccttcctctc

SEQ ID NO: 1725076 - DNA, 18 bp, Homo sapiens
ctcccaccaccagtgaga

SEQ ID NO: 1725077 - DNA, 13 bp, Homo sapiens
ctcccaccagagc

SEQ ID NO: 1725078 - DNA, 18 bp, Homo sapiens
ctcccaccagagccggga

SEQ ID NO: 1725079 - DNA, 14 bp, Homo sapiens
ctcccacccacctg

SEQ ID NO: 1725080 - DNA, 11 bp, Homo sapiens
ctcccacccca

SEQ ID NO: 1725081 - DNA, 12 bp, Homo sapiens
ctcccaccccac

SEQ ID NO: 1725082 - DNA, 23 bp, Homo sapiens
ctcccaccccacccccttcagtg

SEQ ID NO: 1725083 - DNA, 14 bp, Homo sapiens
ctcccaccccactc

SEQ ID NO: 1725084 - DNA, 16 bp, Homo sapiens
ctcccaccccactcca

SEQ ID NO: 1725085 - DNA, 19 bp, Homo sapiens
ctcccaccccactccagcc

SEQ ID NO: 1725086 - DNA, 22 bp, Homo sapiens
ctcccacccccatctctccctc

SEQ ID NO: 1725087 - DNA, 15 bp, Homo sapiens
ctcccaccccctccc

SEQ ID NO: 1725088 - DNA, 22 bp, Homo sapiens
ctcccaccccctccccaaagcc

SEQ ID NO: 1725089 - DNA, 22 bp, Homo sapiens
ctcccacccccttctctgctcc

SEQ ID NO: 1725090 - DNA, 16 bp, Homo sapiens
ctcccaccccggcctc

SEQ ID NO: 1725091 - DNA, 17 bp, Homo sapiens
ctcccaccccggcctcc

SEQ ID NO: 1725092 - DNA, 19 bp, Homo sapiens
ctcccaccccggcctccac

SEQ ID NO: 1725093 - DNA, 20 bp, Homo sapiens
ctcccacccgatgctgcttt

SEQ ID NO: 1725094 - DNA, 21 bp, Homo sapiens
ctcccacccgatgctgctttc

SEQ ID NO: 1725095 - DNA, 19 bp, Homo sapiens
ctcccacccggccacagct

SEQ ID NO: 1725096 - DNA, 23 bp, Homo sapiens
ctcccaccgcagcgtcccccgcc

SEQ ID NO: 1725097 - DNA, 19 bp, Homo sapiens
ctcccaccgcccccacccc

SEQ ID NO: 1725098 - DNA, 18 bp, Homo sapiens
ctcccacctagtgcccca

SEQ ID NO: 1725099 - DNA, 19 bp, Homo sapiens
ctcccacctagtgccccag

SEQ ID NO: 1725100 - DNA, 13 bp, Homo sapiens
ctcccacctccct

SEQ ID NO: 1725101 - DNA, 14 bp, Homo sapiens
ctcccacctgacac

SEQ ID NO: 1725102 - DNA, 15 bp, Homo sapiens
ctcccaccttggcct

SEQ ID NO: 1725103 - DNA, 18 bp, Homo sapiens
ctcccaccttggcctccc

SEQ ID NO: 1725104 - DNA, 21 bp, Homo sapiens
ttgaatgtccccattctataa

SEQ ID NO: 1725105 - DNA, 20 bp, Homo sapiens
ttgaatgtgtgaattcaata

SEQ ID NO: 1725106 - DNA, 14 bp, Homo sapiens
ttgaatgttaaagg

SEQ ID NO: 1725107 - DNA, 17 bp, Homo sapiens
ttgaatgttaagcagat

SEQ ID NO: 1725108 - DNA, 21 bp, Homo sapiens
ttgaattaggctaaaaggtct

SEQ ID NO: 1725109 - DNA, 12 bp, Homo sapiens
ttgaattatcag

SEQ ID NO: 1725110 - DNA, 13 bp, Homo sapiens
ttgaattcagtaa

SEQ ID NO: 1725111 - DNA, 19 bp, Homo sapiens
ttgaattgtgtattgatgc

SEQ ID NO: 1725112 - DNA, 15 bp, Homo sapiens
ttgaatttctggaag

SEQ ID NO: 1725113 - DNA, 15 bp, Homo sapiens
ttgaattttaaatct

SEQ ID NO: 1725114 - DNA, 22 bp, Homo sapiens
ttgaattttgttctctgggaga

SEQ ID NO: 1725115 - DNA, 14 bp, Homo sapiens
ttgacaaagtgcct

SEQ ID NO: 1725116 - DNA, 16 bp, Homo sapiens
ttgacaaagtgcctca

SEQ ID NO: 1725117 - DNA, 14 bp, Homo sapiens
ttgacaacctagaa

SEQ ID NO: 1725118 - DNA, 20 bp, Homo sapiens
ttgacaagctgacttggcac

SEQ ID NO: 1725119 - DNA, 17 bp, Homo sapiens
ttgacaaggaaaatcta

SEQ ID NO: 1725120 - DNA, 13 bp, Homo sapiens
ttgacaattttgt

SEQ ID NO: 1725121 - DNA, 16 bp, Homo sapiens
ttgacaattttgtctt

SEQ ID NO: 1725122 - DNA, 14 bp, Homo sapiens
ttgacacaaagctt

SEQ ID NO: 1725123 - DNA, 14 bp, Homo sapiens
ttgacacaagtgga

SEQ ID NO: 1725124 - DNA, 17 bp, Homo sapiens
ttgacacaagtggacct

SEQ ID NO: 1725125 - DNA, 17 bp, Homo sapiens
ttgacacatatgaacac

SEQ ID NO: 1725126 - DNA, 20 bp, Homo sapiens
ttgacacctgtcttgaataa

SEQ ID NO: 1725127 - DNA, 12 bp, Homo sapiens
ttgacactgaaa

SEQ ID NO: 1725128 - DNA, 17 bp, Homo sapiens
ttgacactgaaagtttt

SEQ ID NO: 1725129 - DNA, 22 bp, Homo sapiens
ttgacactgaaagttttgtaaa

SEQ ID NO: 1725130 - DNA, 14 bp, Homo sapiens
ttgacactgctcta

SEQ ID NO: 1725131 - DNA, 15 bp, Homo sapiens
ttgacactgctctaa

SEQ ID NO: 1725132 - DNA, 16 bp, Homo sapiens
ttgacactgctctaac

SEQ ID NO: 1725133 - DNA, 23 bp, Homo sapiens
ttgacactgctctaacagccctc

SEQ ID NO: 1725134 - DNA, 17 bp, Homo sapiens
ttgacagactatttgct

SEQ ID NO: 1725135 - DNA, 16 bp, Homo sapiens
ttgacagcaaaatgtt

SEQ ID NO: 1725136 - DNA, 19 bp, Homo sapiens
ttgacagtgttgaaaatgt

SEQ ID NO: 1725137 - DNA, 23 bp, Homo sapiens
ttgacatgagatttataaggttt

SEQ ID NO: 1725138 - DNA, 15 bp, Homo sapiens
ttgacatgggtattt

SEQ ID NO: 1725139 - DNA, 15 bp, Homo sapiens
ttgacatttgtagtt

SEQ ID NO: 1725140 - DNA, 18 bp, Homo sapiens
ttgaccaacagaaacctt

SEQ ID NO: 1725141 - DNA, 21 bp, Homo sapiens
ttgaccaagaactgcatggac

SEQ ID NO: 1725142 - DNA, 17 bp, Homo sapiens
ttgaccacggctgttcc

SEQ ID NO: 1725143 - DNA, 17 bp, Homo sapiens
ttgaccagatctttctc

SEQ ID NO: 1725144 - DNA, 22 bp, Homo sapiens
ttgaccagcagatcccagctca

SEQ ID NO: 1725145 - DNA, 20 bp, Homo sapiens
ttgaccagctctcttcctgt

SEQ ID NO: 1725146 - DNA, 19 bp, Homo sapiens
ttgacccaaatgtgtaata

SEQ ID NO: 1725147 - DNA, 18 bp, Homo sapiens
ttgacccttttttgaacc

SEQ ID NO: 1725148 - DNA, 23 bp, Homo sapiens
ttgacctcacagtgacccttccc

SEQ ID NO: 1725149 - DNA, 16 bp, Homo sapiens
ttgacctctataaact

SEQ ID NO: 1725150 - DNA, 15 bp, Homo sapiens
ttgacgaactggcta

SEQ ID NO: 1725151 - DNA, 15 bp, Homo sapiens
ttgacggatgattgg

SEQ ID NO: 1725152 - DNA, 15 bp, Homo sapiens
ttgacgtttcttctt

SEQ ID NO: 1725153 - DNA, 19 bp, Homo sapiens
ttgacgtttcttctttcta

SEQ ID NO: 1725154 - DNA, 21 bp, Homo sapiens
ttgactagggattcaggctgc

SEQ ID NO: 1725155 - DNA, 16 bp, Homo sapiens
ttgactcatggcagct

SEQ ID NO: 1725156 - DNA, 16 bp, Homo sapiens
ttgactcccaagtttc

SEQ ID NO: 1725157 - DNA, 14 bp, Homo sapiens
ttgactctaaatgc

SEQ ID NO: 1725158 - DNA, 23 bp, Homo sapiens
ttgactgggtttctctgtatagt

SEQ ID NO: 1725159 - DNA, 21 bp, Homo sapiens
ttgactgtgattagatcacat

SEQ ID NO: 1725160 - DNA, 14 bp, Homo sapiens
ttgactgtgattta

SEQ ID NO: 1725161 - DNA, 21 bp, Homo sapiens
ttgacttaatgtgattactgc

SEQ ID NO: 1725162 - DNA, 14 bp, Homo sapiens
ttgacttcttggtt

SEQ ID NO: 1725163 - DNA, 16 bp, Homo sapiens
ttgacttgaaaagaaa

SEQ ID NO: 1725164 - DNA, 19 bp, Homo sapiens
ttgacttgaaaagaaagaa

SEQ ID NO: 1725165 - DNA, 18 bp, Homo sapiens
ttgacttttataaagcat

SEQ ID NO: 1725166 - DNA, 13 bp, Homo sapiens
ttgacttttctgt

SEQ ID NO: 1725167 - DNA, 16 bp, Homo sapiens
ttgagaaatgcatatt

SEQ ID NO: 1725168 - DNA, 19 bp, Homo sapiens
ttgagaaatgcatattgta

SEQ ID NO: 1725169 - DNA, 21 bp, Homo sapiens
ttgagaagccttcagctccag

SEQ ID NO: 1725170 - DNA, 18 bp, Homo sapiens
ttgagaatggttacaaag

SEQ ID NO: 1725171 - DNA, 13 bp, Homo sapiens
ttgagaattttaa

SEQ ID NO: 1725172 - DNA, 14 bp, Homo sapiens
ttgagacaagccct

SEQ ID NO: 1725173 - DNA, 20 bp, Homo sapiens
ttgagacaagccctggcaac

SEQ ID NO: 1725174 - DNA, 15 bp, Homo sapiens
ttgagaccagcctgg

SEQ ID NO: 1725175 - DNA, 18 bp, Homo sapiens
ttgagacccccaagcttc

SEQ ID NO: 1725176 - DNA, 18 bp, Homo sapiens
ttgagacggagtctctca

SEQ ID NO: 1725177 - DNA, 14 bp, Homo sapiens
ttgagactagtttt

SEQ ID NO: 1725178 - DNA, 17 bp, Homo sapiens
ttgagagaagagacaaa

SEQ ID NO: 1725179 - DNA, 15 bp, Homo sapiens
ttgagagactgccat

SEQ ID NO: 1725180 - DNA, 12 bp, Homo sapiens
ttgagagctgct

SEQ ID NO: 1725181 - DNA, 15 bp, Homo sapiens
ttgagataaagtcaa

SEQ ID NO: 1725182 - DNA, 21 bp, Homo sapiens
ttgagataatatctgtgaggt

SEQ ID NO: 1725183 - DNA, 17 bp, Homo sapiens
ttgagatggtgaggctg

SEQ ID NO: 1725184 - DNA, 11 bp, Homo sapiens
ttgagatttct

SEQ ID NO: 1725185 - DNA, 14 bp, Homo sapiens
ttctatgacaaatt

SEQ ID NO: 1725186 - DNA, 19 bp, Homo sapiens
ttctatgcctgtatttcca

SEQ ID NO: 1725187 - DNA, 16 bp, Homo sapiens
ttctatgctaaactgt

SEQ ID NO: 1725188 - DNA, 18 bp, Homo sapiens
ttctatggaatagttctg

SEQ ID NO: 1725189 - DNA, 17 bp, Homo sapiens
ttctatgtagaactgtt

SEQ ID NO: 1725190 - DNA, 12 bp, Homo sapiens
ttctatgtatgt

SEQ ID NO: 1725191 - DNA, 18 bp, Homo sapiens
ttctatgtccaacagagt

SEQ ID NO: 1725192 - DNA, 15 bp, Homo sapiens
ttctattaaagtgct

SEQ ID NO: 1725193 - DNA, 15 bp, Homo sapiens
ttctattgaaaacag

SEQ ID NO: 1725194 - DNA, 18 bp, Homo sapiens
ttctattgaaaacagtgt

SEQ ID NO: 1725195 - DNA, 23 bp, Homo sapiens
ttctattgacttcaatgatagta

SEQ ID NO: 1725196 - DNA, 20 bp, Homo sapiens
ttctattgtactctgcttta

SEQ ID NO: 1725197 - DNA, 20 bp, Homo sapiens
ttctattgttaaacaaatga

SEQ ID NO: 1725198 - DNA, 19 bp, Homo sapiens
ttctatttataagtgactt

SEQ ID NO: 1725199 - DNA, 17 bp, Homo sapiens
ttctatttattcctgtt

SEQ ID NO: 1725200 - DNA, 15 bp, Homo sapiens
ttctatttctatctg

SEQ ID NO: 1725201 - DNA, 22 bp, Homo sapiens
ttctattttaagactgatttta

SEQ ID NO: 1725202 - DNA, 13 bp, Homo sapiens
ttctattttgtaa

SEQ ID NO: 1725203 - DNA, 17 bp, Homo sapiens
ttctatttttatcatga

SEQ ID NO: 1725204 - DNA, 13 bp, Homo sapiens
ttctcaaaagagg

SEQ ID NO: 1725205 - DNA, 17 bp, Homo sapiens
ttctcaaaagaggttac

SEQ ID NO: 1725206 - DNA, 18 bp, Homo sapiens
ttctcaaaagaggttact

SEQ ID NO: 1725207 - DNA, 23 bp, Homo sapiens
ttctcaaacacagttacacttgt

SEQ ID NO: 1725208 - DNA, 15 bp, Homo sapiens
ttctcaaatctgctt

SEQ ID NO: 1725209 - DNA, 17 bp, Homo sapiens
ttctcaagaatctagaa

SEQ ID NO: 1725210 - DNA, 13 bp, Homo sapiens
ttctcaagacttt

SEQ ID NO: 1725211 - DNA, 17 bp, Homo sapiens
ttctcaagactttagct

SEQ ID NO: 1725212 - DNA, 13 bp, Homo sapiens
ttctcaagttcta

SEQ ID NO: 1725213 - DNA, 15 bp, Homo sapiens
ttctcaatcagtgca

SEQ ID NO: 1725214 - DNA, 14 bp, Homo sapiens
ttctcacacccacc

SEQ ID NO: 1725215 - DNA, 14 bp, Homo sapiens
ttctcactcaccac

SEQ ID NO: 1725216 - DNA, 16 bp, Homo sapiens
ttctcactccaccacc

SEQ ID NO: 1725217 - DNA, 18 bp, Homo sapiens
ttctcactgaactccacc

SEQ ID NO: 1725218 - DNA, 19 bp, Homo sapiens
ttctcactgaactccaccg

SEQ ID NO: 1725219 - DNA, 20 bp, Homo sapiens
ttctcacttcaattaatgct

SEQ ID NO: 1725220 - DNA, 13 bp, Homo sapiens
ttctcagaacagc

SEQ ID NO: 1725221 - DNA, 13 bp, Homo sapiens
ttctcagaatctc

SEQ ID NO: 1725222 - DNA, 19 bp, Homo sapiens
ttctcagaatctcaaataa

SEQ ID NO: 1725223 - DNA, 15 bp, Homo sapiens
ttctcagaattcggt

SEQ ID NO: 1725224 - DNA, 21 bp, Homo sapiens
ttctcagaattcggtgtgctg

SEQ ID NO: 1725225 - DNA, 19 bp, Homo sapiens
ttctcagatctggtttcta

SEQ ID NO: 1725226 - DNA, 15 bp, Homo sapiens
ttctcaggccccggg

SEQ ID NO: 1725227 - DNA, 16 bp, Homo sapiens
ttctcataattttgca

SEQ ID NO: 1725228 - DNA, 22 bp, Homo sapiens
ttctcatagataagatataaat

SEQ ID NO: 1725229 - DNA, 16 bp, Homo sapiens
ttctcatagccccggt

SEQ ID NO: 1725230 - DNA, 24 bp, Homo sapiens
ttctcataggaaaagtacatttaa

SEQ ID NO: 1725231 - DNA, 23 bp, Homo sapiens
ttctcatcatattgtatgtaagt

SEQ ID NO: 1725232 - DNA, 17 bp, Homo sapiens
ttctcatgaagctaata

SEQ ID NO: 1725233 - DNA, 23 bp, Homo sapiens
ttctcatgataccacctttactg

SEQ ID NO: 1725234 - DNA, 19 bp, Homo sapiens
ttctcattctgtgccattt

SEQ ID NO: 1725235 - DNA, 20 bp, Homo sapiens
ttctcattgacttttataaa

SEQ ID NO: 1725236 - DNA, 16 bp, Homo sapiens
ttctcatttcacccct

SEQ ID NO: 1725237 - DNA, 19 bp, Homo sapiens
ttctcatttcacccctccc

SEQ ID NO: 1725238 - DNA, 23 bp, Homo sapiens
ttctcatttggtctgccagaata

SEQ ID NO: 1725239 - DNA, 15 bp, Homo sapiens
ttctccaaggaaacc

SEQ ID NO: 1725240 - DNA, 21 bp, Homo sapiens
ttctgaagaggaaaagtcaaa

SEQ ID NO: 1725241 - DNA, 23 bp, Homo sapiens
ttctgaagatcagaacattcagc

SEQ ID NO: 1725242 - DNA, 18 bp, Homo sapiens
ttctgaagctttaccagc

SEQ ID NO: 1725243 - DNA, 19 bp, Homo sapiens
ttctgaaggtagcattctt

SEQ ID NO: 1725244 - DNA, 13 bp, Homo sapiens
ttctgaagtactt

SEQ ID NO: 1725245 - DNA, 14 bp, Homo sapiens
ttctgaataaagca

SEQ ID NO: 1725246 - DNA, 16 bp, Homo sapiens
ttctgaataaagcaat

SEQ ID NO: 1725247 - DNA, 11 bp, Homo sapiens
ttctgaattgg

SEQ ID NO: 1725248 - DNA, 15 bp, Homo sapiens
ttctgaattggaagg

SEQ ID NO: 1725249 - DNA, 19 bp, Homo sapiens
ttctgaattggaagggaaa

SEQ ID NO: 1725250 - DNA, 19 bp, Homo sapiens
ttctgacaaaaagtttcca

SEQ ID NO: 1725251 - DNA, 19 bp, Homo sapiens
ttctgacaaaggtggtaaa

SEQ ID NO: 1725252 - DNA, 18 bp, Homo sapiens
ttctgacagtttttctgt

SEQ ID NO: 1725253 - DNA, 12 bp, Homo sapiens
ttctgacatgta

SEQ ID NO: 1725254 - DNA, 23 bp, Homo sapiens
ttctgacatgtaagaaaatgtta

SEQ ID NO: 1725255 - DNA, 21 bp, Homo sapiens
ttctgaccctgcttcaaatat

SEQ ID NO: 1725256 - DNA, 23 bp, Homo sapiens
ttctgaccgttaaaaaattcttg

SEQ ID NO: 1725257 - DNA, 18 bp, Homo sapiens
ttctgactagtttaaaga

SEQ ID NO: 1725258 - DNA, 11 bp, Homo sapiens
ttctgactgtc

SEQ ID NO: 1725259 - DNA, 15 bp, Homo sapiens
ttctgactgtccagg

SEQ ID NO: 1725260 - DNA, 20 bp, Homo sapiens
ttctgactgtttatttaagg

SEQ ID NO: 1725261 - DNA, 23 bp, Homo sapiens
ttctgactgtttatttaaggatg

SEQ ID NO: 1725262 - DNA, 15 bp, Homo sapiens
ttctgacttatgaat

SEQ ID NO: 1725263 - DNA, 15 bp, Homo sapiens
ttctgactttacttg

SEQ ID NO: 1725264 - DNA, 15 bp, Homo sapiens
ttctgagaaagacta

SEQ ID NO: 1725265 - DNA, 21 bp, Homo sapiens
ttctgagaaagactattcaaa

SEQ ID NO: 1725266 - DNA, 15 bp, Homo sapiens
ttctgagctccacct

SEQ ID NO: 1725267 - DNA, 20 bp, Homo sapiens
ttctgagctccacctctggt

SEQ ID NO: 1725268 - DNA, 19 bp, Homo sapiens
ttctgagcttttcatggaa

SEQ ID NO: 1725269 - DNA, 20 bp, Homo sapiens
ttctgagcttttcatggaag

SEQ ID NO: 1725270 - DNA, 23 bp, Homo sapiens
ttctgaggaccgctgataagcat

SEQ ID NO: 1725271 - DNA, 19 bp, Homo sapiens
ttctgaggagctgttactg

SEQ ID NO: 1725272 - DNA, 14 bp, Homo sapiens
ttctgagtgttttt

SEQ ID NO: 1725273 - DNA, 16 bp, Homo sapiens
ttctgagttttgtgtt

SEQ ID NO: 1725274 - DNA, 19 bp, Homo sapiens
ttctgataaaagatggcca

SEQ ID NO: 1725275 - DNA, 18 bp, Homo sapiens
ttctgatgtttctgtgaa

SEQ ID NO: 1725276 - DNA, 17 bp, Homo sapiens
ttctgatttcagttttt

SEQ ID NO: 1725277 - DNA, 14 bp, Homo sapiens
ttctgatttttctc

SEQ ID NO: 1725278 - DNA, 16 bp, Homo sapiens
ttctgcaccctccacc

SEQ ID NO: 1725279 - DNA, 17 bp, Homo sapiens
ttctgcaccctccaccc

SEQ ID NO: 1725280 - DNA, 22 bp, Homo sapiens
ttctgcaccctccaccctgtcc

SEQ ID NO: 1725281 - DNA, 14 bp, Homo sapiens
ttctgcactgaaaa

SEQ ID NO: 1725282 - DNA, 20 bp, Homo sapiens
ttctgcagacacgccttccc

SEQ ID NO: 1725283 - DNA, 21 bp, Homo sapiens
ttctgcagacgtctgccttgg

SEQ ID NO: 1725284 - DNA, 20 bp, Homo sapiens
ttctgcagcatgacctgtga

SEQ ID NO: 1725285 - DNA, 23 bp, Homo sapiens
ttctgcagcatgacctgtgacca

SEQ ID NO: 1725286 - DNA, 18 bp, Homo sapiens
ttctgcagcggcagagca

SEQ ID NO: 1725287 - DNA, 13 bp, Homo sapiens
ttctgcagctgtt

SEQ ID NO: 1725288 - DNA, 19 bp, Homo sapiens
ttctgcagtcatctcccct

SEQ ID NO: 1725289 - DNA, 23 bp, Homo sapiens
ttctgcatcagctgctgaaacaa

SEQ ID NO: 1725290 - DNA, 13 bp, Homo sapiens
ttctgcattgcta

SEQ ID NO: 1725291 - DNA, 16 bp, Homo sapiens
ttctgcattgctagat

SEQ ID NO: 1725292 - DNA, 19 bp, Homo sapiens
ttctgcccaaaaatatggt

SEQ ID NO: 1725293 - DNA, 18 bp, Homo sapiens
ttctgccctgcctgagga

SEQ ID NO: 1725294 - DNA, 22 bp, Homo sapiens
ttctgccctgcctgaggaggag

SEQ ID NO: 1725295 - DNA, 13 bp, Homo sapiens
ttctgccctggct

SEQ ID NO: 1725296 - DNA, 18 bp, Homo sapiens
ttctgccctggctgctgc

SEQ ID NO: 1725297 - DNA, 18 bp, Homo sapiens
ttctgccctgggttcttc

SEQ ID NO: 1725298 - DNA, 15 bp, Homo sapiens
ttctgccgccccctc

SEQ ID NO: 1725299 - DNA, 21 bp, Homo sapiens
ttctgccgccccctcctgaac

SEQ ID NO: 1725300 - DNA, 16 bp, Homo sapiens
ttctgcctagagtgta

SEQ ID NO: 1725301 - DNA, 20 bp, Homo sapiens
ttctgcctagagtgtagcct

SEQ ID NO: 1725302 - DNA, 22 bp, Homo sapiens
ttctgcctagagtgtagcctaa

SEQ ID NO: 1725303 - DNA, 17 bp, Homo sapiens
ttctgcctcagcctcct

SEQ ID NO: 1725304 - DNA, 18 bp, Homo sapiens
ttctgcctcagcctcctg

SEQ ID NO: 1725305 - DNA, 21 bp, Homo sapiens
ttcaataaaagataaattatt

SEQ ID NO: 1725306 - DNA, 19 bp, Homo sapiens
ttcaataaatctttggaaa

SEQ ID NO: 1725307 - DNA, 16 bp, Homo sapiens
ttcaataccagggaag

SEQ ID NO: 1725308 - DNA, 18 bp, Homo sapiens
ttcaatactcttgaaatg

SEQ ID NO: 1725309 - DNA, 23 bp, Homo sapiens
ttcaatactcttgaaatgtagaa

SEQ ID NO: 1725310 - DNA, 22 bp, Homo sapiens
ttcaatatgaatctataagtag

SEQ ID NO: 1725311 - DNA, 21 bp, Homo sapiens
ttcaatattgacatttgtagt

SEQ ID NO: 1725312 - DNA, 15 bp, Homo sapiens
ttcaatatttagaaa

SEQ ID NO: 1725313 - DNA, 18 bp, Homo sapiens
ttcaatcaactttactgt

SEQ ID NO: 1725314 - DNA, 21 bp, Homo sapiens
ttcaatcactgtaacctgatt

SEQ ID NO: 1725315 - DNA, 23 bp, Homo sapiens
ttcaatcagagctccagtttgca

SEQ ID NO: 1725316 - DNA, 12 bp, Homo sapiens
ttcaatctctgt

SEQ ID NO: 1725317 - DNA, 17 bp, Homo sapiens
ttcaatctgtaaactgt

SEQ ID NO: 1725318 - DNA, 18 bp, Homo sapiens
ttcaatcttctactttta

SEQ ID NO: 1725319 - DNA, 17 bp, Homo sapiens
ttcaatgacctgtattt

SEQ ID NO: 1725320 - DNA, 12 bp, Homo sapiens
ttcaatgcaaag

SEQ ID NO: 1725321 - DNA, 17 bp, Homo sapiens
ttcaatgcaaagtaaaa

SEQ ID NO: 1725322 - DNA, 13 bp, Homo sapiens
ttcaatgcattta

SEQ ID NO: 1725323 - DNA, 21 bp, Homo sapiens
ttcaatgcgttttgttgtaga

SEQ ID NO: 1725324 - DNA, 18 bp, Homo sapiens
ttcaatgggaagactcag

SEQ ID NO: 1725325 - DNA, 12 bp, Homo sapiens
ttcaatggtaga

SEQ ID NO: 1725326 - DNA, 13 bp, Homo sapiens
ttcaatgttccat

SEQ ID NO: 1725327 - DNA, 21 bp, Homo sapiens
ttcaattacaaagcagttact

SEQ ID NO: 1725328 - DNA, 15 bp, Homo sapiens
ttcaattcctggccc

SEQ ID NO: 1725329 - DNA, 14 bp, Homo sapiens
ttcaattcctgggc

SEQ ID NO: 1725330 - DNA, 14 bp, Homo sapiens
ttcaattgtcactt

SEQ ID NO: 1725331 - DNA, 15 bp, Homo sapiens
ttcaattttaaagac

SEQ ID NO: 1725332 - DNA, 13 bp, Homo sapiens
ttcacaaatatag

SEQ ID NO: 1725333 - DNA, 21 bp, Homo sapiens
ttcacaaccttctgtggctca

SEQ ID NO: 1725334 - DNA, 13 bp, Homo sapiens
ttcacaataaaag

SEQ ID NO: 1725335 - DNA, 13 bp, Homo sapiens
ttcacaatgtgaa

SEQ ID NO: 1725336 - DNA, 14 bp, Homo sapiens
ttcacaatgtgaaa

SEQ ID NO: 1725337 - DNA, 23 bp, Homo sapiens
ttcacaattccatttccagttca

SEQ ID NO: 1725338 - DNA, 21 bp, Homo sapiens
ttcacacacaggcaactgagg

SEQ ID NO: 1725339 - DNA, 22 bp, Homo sapiens
ttcacacatctgggtgccctga

SEQ ID NO: 1725340 - DNA, 21 bp, Homo sapiens
ttcacactgcaagagccttgg

SEQ ID NO: 1725341 - DNA, 19 bp, Homo sapiens
ttcacactggtaaatgtta

SEQ ID NO: 1725342 - DNA, 20 bp, Homo sapiens
ttcacagagcacgcctgcca

SEQ ID NO: 1725343 - DNA, 21 bp, Homo sapiens
ttcacagcacagtacacacaa

SEQ ID NO: 1725344 - DNA, 12 bp, Homo sapiens
ttcacagctcct

SEQ ID NO: 1725345 - DNA, 13 bp, Homo sapiens
ttcacaggcactc

SEQ ID NO: 1725346 - DNA, 15 bp, Homo sapiens
ttcacaggtcaataa

SEQ ID NO: 1725347 - DNA, 23 bp, Homo sapiens
ttcacagtacccaaactgctttt

SEQ ID NO: 1725348 - DNA, 19 bp, Homo sapiens
ttcacagtagagccagctt

SEQ ID NO: 1725349 - DNA, 20 bp, Homo sapiens
ttcacagtgcccaagagtgg

SEQ ID NO: 1725350 - DNA, 20 bp, Homo sapiens
ttcacataagctcagaatcc

SEQ ID NO: 1725351 - DNA, 15 bp, Homo sapiens
ttcacataccctccc

SEQ ID NO: 1725352 - DNA, 21 bp, Homo sapiens
ttcacatcctgtgtttctagg

SEQ ID NO: 1725353 - DNA, 18 bp, Homo sapiens
ttcacattaggctgttgg

SEQ ID NO: 1725354 - DNA, 15 bp, Homo sapiens
ttcacattcttggct

SEQ ID NO: 1725355 - DNA, 16 bp, Homo sapiens
ttcacattcttggctt

SEQ ID NO: 1725356 - DNA, 21 bp, Homo sapiens
ttcacatttaaatggttctgt

SEQ ID NO: 1725357 - DNA, 18 bp, Homo sapiens
ttcacatttgatgtacat

SEQ ID NO: 1725358 - DNA, 19 bp, Homo sapiens
ttcacattttccttttcaa

SEQ ID NO: 1725359 - DNA, 23 bp, Homo sapiens
ttcaccaaatgatgccacttccc

SEQ ID NO: 1725360 - DNA, 23 bp, Homo sapiens
ttcaccaagtccccttctgtgtt

SEQ ID NO: 1725361 - DNA, 22 bp, Homo sapiens
ttcaccaccaaatgccaagaaa

SEQ ID NO: 1725362 - DNA, 13 bp, Homo sapiens
ttcaccaccccct

SEQ ID NO: 1725363 - DNA, 18 bp, Homo sapiens
ttcaccaccccctgtccc

SEQ ID NO: 1725364 - DNA, 13 bp, Homo sapiens
ttcaccagcagca

SEQ ID NO: 1725365 - DNA, 21 bp, Homo sapiens
ttcaccagtctgtctactgtg

SEQ ID NO: 1725366 - DNA, 16 bp, Homo sapiens
ttcaccatggccccct

SEQ ID NO: 1725367 - DNA, 19 bp, Homo sapiens
ttcacccccctctgctgcc

SEQ ID NO: 1725368 - DNA, 12 bp, Homo sapiens
ttcacccctccc

SEQ ID NO: 1725369 - DNA, 16 bp, Homo sapiens
ttcacccctccctttc

SEQ ID NO: 1725370 - DNA, 14 bp, Homo sapiens
ttcacccctgcact

SEQ ID NO: 1725371 - DNA, 18 bp, Homo sapiens
ttcacccgagttcctctg

SEQ ID NO: 1725372 - DNA, 17 bp, Homo sapiens
ttcaccctccacttccc

SEQ ID NO: 1725373 - DNA, 19 bp, Homo sapiens
ttcaccgtgttagccagga

SEQ ID NO: 1725374 - DNA, 17 bp, Homo sapiens
ttcacctaagtctctgt

SEQ ID NO: 1725375 - DNA, 18 bp, Homo sapiens
ttcacctaccgagttcaa

SEQ ID NO: 1725376 - DNA, 16 bp, Homo sapiens
ttcacctgtaaacctg

SEQ ID NO: 1725377 - DNA, 22 bp, Homo sapiens
ttcacctgtttttaagctgttt

SEQ ID NO: 1725378 - DNA, 23 bp, Homo sapiens
ttcacctgtttttaagctgtttc

SEQ ID NO: 1725379 - DNA, 22 bp, Homo sapiens
ttcacctttggtgcagaggttt

SEQ ID NO: 1725380 - DNA, 23 bp, Homo sapiens
ttcacctttgtaagacatttgta

SEQ ID NO: 1725381 - DNA, 21 bp, Homo sapiens
ttcacgacaatgttgagaagt

SEQ ID NO: 1725382 - DNA, 20 bp, Homo sapiens
ttcacgccgtaattctttct

SEQ ID NO: 1725383 - DNA, 21 bp, Homo sapiens
ttcacgccgtaattctttctg

SEQ ID NO: 1725384 - DNA, 22 bp, Homo sapiens
ttcacgccgtaattctttctgt

SEQ ID NO: 1725385 - DNA, 19 bp, Homo sapiens
ttcacgcctgaggcaatta

SEQ ID NO: 1725386 - DNA, 15 bp, Homo sapiens
ttcactagaaaatga

SEQ ID NO: 1725387 - DNA, 23 bp, Homo sapiens
ttcactagaagccgtgggaagaa

SEQ ID NO: 1725388 - DNA, 14 bp, Homo sapiens
ttcactatttcctt

SEQ ID NO: 1725389 - DNA, 16 bp, Homo sapiens
ttcactccagtcaaca

SEQ ID NO: 1725390 - DNA, 24 bp, Homo sapiens
ttcactccggtgtgcctgcagccc

SEQ ID NO: 1725391 - DNA, 21 bp, Homo sapiens
ttcactctccattagaaaatt

SEQ ID NO: 1725392 - DNA, 19 bp, Homo sapiens
ttcactgaccagcggctgc

SEQ ID NO: 1725393 - DNA, 21 bp, Homo sapiens
ttcactgaccagcggctgctc

SEQ ID NO: 1725394 - DNA, 15 bp, Homo sapiens
ttcactgcaattttg

SEQ ID NO: 1725395 - DNA, 17 bp, Homo sapiens
ttcactgccagttgtct

SEQ ID NO: 1725396 - DNA, 20 bp, Homo sapiens
ttcactgccatgatagctgg

SEQ ID NO: 1725397 - DNA, 13 bp, Homo sapiens
ttcactgctggct

SEQ ID NO: 1725398 - DNA, 16 bp, Homo sapiens
ttcactgctggctgcc

SEQ ID NO: 1725399 - DNA, 17 bp, Homo sapiens
ttcactgctggctgcct

SEQ ID NO: 1725400 - DNA, 18 bp, Homo sapiens
ttcactgctggctgcctt

SEQ ID NO: 1725401 - DNA, 19 bp, Homo sapiens
ttcactgctggctgcctta

SEQ ID NO: 1725402 - DNA, 17 bp, Homo sapiens
ttcactggagttacatt

SEQ ID NO: 1725403 - DNA, 18 bp, Homo sapiens
ctcatcccccctgctgcc

SEQ ID NO: 1725404 - DNA, 16 bp, Homo sapiens
ctcatccctcaactga

SEQ ID NO: 1725405 - DNA, 18 bp, Homo sapiens
ctcatccctcaactgagg

SEQ ID NO: 1725406 - DNA, 23 bp, Homo sapiens
ctcatccctcaactgagggccag

SEQ ID NO: 1725407 - DNA, 14 bp, Homo sapiens
ctcatccgaggcag

SEQ ID NO: 1725408 - DNA, 18 bp, Homo sapiens
ctcatcctgatttttact

SEQ ID NO: 1725409 - DNA, 23 bp, Homo sapiens
ctcatcctgctcttttgtgatga

SEQ ID NO: 1725410 - DNA, 14 bp, Homo sapiens
ctcatctatctcaa

SEQ ID NO: 1725411 - DNA, 17 bp, Homo sapiens
ctcatctcttagctccc

SEQ ID NO: 1725412 - DNA, 19 bp, Homo sapiens
ctcatctcttagctcccct

SEQ ID NO: 1725413 - DNA, 13 bp, Homo sapiens
ctcatctcttcag

SEQ ID NO: 1725414 - DNA, 12 bp, Homo sapiens
ctcatctgctgg

SEQ ID NO: 1725415 - DNA, 16 bp, Homo sapiens
ctcatctgctggtccg

SEQ ID NO: 1725416 - DNA, 19 bp, Homo sapiens
ctcatctgtacatactgtt

SEQ ID NO: 1725417 - DNA, 23 bp, Homo sapiens
ctcatctgtggagctgccacaga

SEQ ID NO: 1725418 - DNA, 14 bp, Homo sapiens
ctcatctttctcct

SEQ ID NO: 1725419 - DNA, 13 bp, Homo sapiens
ctcatctttcttg

SEQ ID NO: 1725420 - DNA, 14 bp, Homo sapiens
ctcatgaagcagga

SEQ ID NO: 1725421 - DNA, 16 bp, Homo sapiens
ctcatgaagcaggagg

SEQ ID NO: 1725422 - DNA, 17 bp, Homo sapiens
ctcatgaagcaggaggc

SEQ ID NO: 1725423 - DNA, 16 bp, Homo sapiens
ctcatgaatgtaaatt

SEQ ID NO: 1725424 - DNA, 21 bp, Homo sapiens
ctcatgaatgtaaatttgtac

SEQ ID NO: 1725425 - DNA, 22 bp, Homo sapiens
ctcatgaatgtaaatttgtact

SEQ ID NO: 1725426 - DNA, 20 bp, Homo sapiens
ctcatgacagccagagcctg

SEQ ID NO: 1725427 - DNA, 10 bp, Homo sapiens
ctcatgagaa

SEQ ID NO: 1725428 - DNA, 14 bp, Homo sapiens
ctcatgaggggaga

SEQ ID NO: 1725429 - DNA, 14 bp, Homo sapiens
ctcatgccacacct

SEQ ID NO: 1725430 - DNA, 17 bp, Homo sapiens
ctcatgcccaccccctg

SEQ ID NO: 1725431 - DNA, 19 bp, Homo sapiens
ctcatgcccaccccctgcc

SEQ ID NO: 1725432 - DNA, 20 bp, Homo sapiens
ctcatgcccaccccctgccc

SEQ ID NO: 1725433 - DNA, 23 bp, Homo sapiens
ctcatgcccaccccctgccctgc

SEQ ID NO: 1725434 - DNA, 14 bp, Homo sapiens
ctcatgcccagctc

SEQ ID NO: 1725435 - DNA, 23 bp, Homo sapiens
ctcatgcccagctctctgacgct

SEQ ID NO: 1725436 - DNA, 22 bp, Homo sapiens
ctcatgccccctttcagatgtc

SEQ ID NO: 1725437 - DNA, 14 bp, Homo sapiens
ctcatgcctcagcc

SEQ ID NO: 1725438 - DNA, 15 bp, Homo sapiens
ctcatggcagctgtt

SEQ ID NO: 1725439 - DNA, 21 bp, Homo sapiens
ctcatggcagctgtttctcat

SEQ ID NO: 1725440 - DNA, 18 bp, Homo sapiens
ctcatggcccccaggggc

SEQ ID NO: 1725441 - DNA, 20 bp, Homo sapiens
ctcatggcccccaggggcag

SEQ ID NO: 1725442 - DNA, 19 bp, Homo sapiens
ctcatggcccctctgacct

SEQ ID NO: 1725443 - DNA, 23 bp, Homo sapiens
ctcatggcgtaatgggcctgccc

SEQ ID NO: 1725444 - DNA, 22 bp, Homo sapiens
ttcctaacctgtcagaataata

SEQ ID NO: 1725445 - DNA, 14 bp, Homo sapiens
ttcctaacttttca

SEQ ID NO: 1725446 - DNA, 19 bp, Homo sapiens
ttcctaagagtggaggagg

SEQ ID NO: 1725447 - DNA, 21 bp, Homo sapiens
ttcctaagagtggaggaggag

SEQ ID NO: 1725448 - DNA, 21 bp, Homo sapiens
ttcctaagccacttgaaatgt

SEQ ID NO: 1725449 - DNA, 22 bp, Homo sapiens
ttcctaagccacttgaaatgtt

SEQ ID NO: 1725450 - DNA, 13 bp, Homo sapiens
ttcctacaactta

SEQ ID NO: 1725451 - DNA, 23 bp, Homo sapiens
ttcctacgtaggatgaaaagatt

SEQ ID NO: 1725452 - DNA, 16 bp, Homo sapiens
ttcctactcacacttc

SEQ ID NO: 1725453 - DNA, 15 bp, Homo sapiens
ttcctactgtcctca

SEQ ID NO: 1725454 - DNA, 19 bp, Homo sapiens
ttcctagaagttactgaat

SEQ ID NO: 1725455 - DNA, 22 bp, Homo sapiens
ttcctagaagttactgaatgca

SEQ ID NO: 1725456 - DNA, 18 bp, Homo sapiens
ttcctagatctgcaggct

SEQ ID NO: 1725457 - DNA, 22 bp, Homo sapiens
ttcctagggatctgaaatccat

SEQ ID NO: 1725458 - DNA, 12 bp, Homo sapiens
ttcctagtgaaa

SEQ ID NO: 1725459 - DNA, 15 bp, Homo sapiens
ttcctagttttctcc

SEQ ID NO: 1725460 - DNA, 19 bp, Homo sapiens
ttcctatatagtttattga

SEQ ID NO: 1725461 - DNA, 14 bp, Homo sapiens
ttcctatgtaactg

SEQ ID NO: 1725462 - DNA, 13 bp, Homo sapiens
ttcctatttcaga

SEQ ID NO: 1725463 - DNA, 16 bp, Homo sapiens
ttcctcaaaaagcaga

SEQ ID NO: 1725464 - DNA, 19 bp, Homo sapiens
ttcctcaaaaagcagaagg

SEQ ID NO: 1725465 - DNA, 19 bp, Homo sapiens
ttcctcaaaataaagaagt

SEQ ID NO: 1725466 - DNA, 21 bp, Homo sapiens
ttcctcaaaataaagaagtat

SEQ ID NO: 1725467 - DNA, 20 bp, Homo sapiens
ttcctcaagcaataattgtt

SEQ ID NO: 1725468 - DNA, 16 bp, Homo sapiens
ttcctcagcttatctc

SEQ ID NO: 1725469 - DNA, 23 bp, Homo sapiens
ttcctcagtttaatccttctagt

SEQ ID NO: 1725470 - DNA, 18 bp, Homo sapiens
ttcctcatccaccccatc

SEQ ID NO: 1725471 - DNA, 17 bp, Homo sapiens
ttcctcatgaatgtaaa

SEQ ID NO: 1725472 - DNA, 18 bp, Homo sapiens
ttcctcatgaatgtaaat

SEQ ID NO: 1725473 - DNA, 14 bp, Homo sapiens
ttcctccacatcct

SEQ ID NO: 1725474 - DNA, 15 bp, Homo sapiens
ttcctccacatcctt

SEQ ID NO: 1725475 - DNA, 23 bp, Homo sapiens
ttcctccacatcctttctaaaca

SEQ ID NO: 1725476 - DNA, 22 bp, Homo sapiens
ttcctcccaggaggtgcttgag

SEQ ID NO: 1725477 - DNA, 23 bp, Homo sapiens
ttcctccccacactccactctga

SEQ ID NO: 1725478 - DNA, 19 bp, Homo sapiens
ttcctcccggggccttcct

SEQ ID NO: 1725479 - DNA, 15 bp, Homo sapiens
ttcctcccttacaga

SEQ ID NO: 1725480 - DNA, 18 bp, Homo sapiens
ttcctccgtccacccagg

SEQ ID NO: 1725481 - DNA, 21 bp, Homo sapiens
ttcctccgtccacccaggctg

SEQ ID NO: 1725482 - DNA, 22 bp, Homo sapiens
ttcctcctacttacaacccagg

SEQ ID NO: 1725483 - DNA, 20 bp, Homo sapiens
ttcctcctcaggcacacagc

SEQ ID NO: 1725484 - DNA, 20 bp, Homo sapiens
ttcctcctccacagtgctgc

SEQ ID NO: 1725485 - DNA, 13 bp, Homo sapiens
ttcctcctccacc

SEQ ID NO: 1725486 - DNA, 21 bp, Homo sapiens
ttcctcctcccagtgccttct

SEQ ID NO: 1725487 - DNA, 13 bp, Homo sapiens
ttcctcctgctca

SEQ ID NO: 1725488 - DNA, 15 bp, Homo sapiens
ttcctcctgctcata

SEQ ID NO: 1725489 - DNA, 18 bp, Homo sapiens
ttcctcctttacctttca

SEQ ID NO: 1725490 - DNA, 14 bp, Homo sapiens
ttcctcgccctggg

SEQ ID NO: 1725491 - DNA, 21 bp, Homo sapiens
ttcctcggtgggccagagctg

SEQ ID NO: 1725492 - DNA, 19 bp, Homo sapiens
ttcctctagtgccctccac

SEQ ID NO: 1725493 - DNA, 16 bp, Homo sapiens
ttcctctatactttgt

SEQ ID NO: 1725494 - DNA, 21 bp, Homo sapiens
ttcctctattgatgtacagtc

SEQ ID NO: 1725495 - DNA, 18 bp, Homo sapiens
ttcctctcaagctagcca

SEQ ID NO: 1725496 - DNA, 18 bp, Homo sapiens
ttcctctccactgccttc

SEQ ID NO: 1725497 - DNA, 19 bp, Homo sapiens
ttcctctccactgccttcg

SEQ ID NO: 1725498 - DNA, 18 bp, Homo sapiens
ttcctctccactgctgga

SEQ ID NO: 1725499 - DNA, 14 bp, Homo sapiens
ttcctctccacttc

SEQ ID NO: 1725500 - DNA, 14 bp, Homo sapiens
ttcctctccaggcc

SEQ ID NO: 1725501 - DNA, 16 bp, Homo sapiens
ttcctctcgcggccct

SEQ ID NO: 1725502 - DNA, 10 bp, Homo sapiens
ttcctctgca

SEQ ID NO: 1725503 - DNA, 17 bp, Homo sapiens
ttcctctgcagctgacc

SEQ ID NO: 1725504 - DNA, 20 bp, Homo sapiens
ttcctctgcccttcctgcag

SEQ ID NO: 1725505 - DNA, 16 bp, Homo sapiens
ttcctctggttccttt

SEQ ID NO: 1725506 - DNA, 22 bp, Homo sapiens
ttcctctgttcaaagctgcctg

SEQ ID NO: 1725507 - DNA, 14 bp, Homo sapiens
ttcctctgttcaca

SEQ ID NO: 1725508 - DNA, 12 bp, Homo sapiens
ttcctcttagcc

SEQ ID NO: 1725509 - DNA, 17 bp, Homo sapiens
ttcctcttagcctctgg

SEQ ID NO: 1725510 - DNA, 13 bp, Homo sapiens
ttcctcttcccca

SEQ ID NO: 1725511 - DNA, 17 bp, Homo sapiens
ttcctcttcctgccctt

SEQ ID NO: 1725512 - DNA, 20 bp, Homo sapiens
ttcctcttctattttgtaaa

SEQ ID NO: 1725513 - DNA, 13 bp, Homo sapiens
ttcctctttctgc

SEQ ID NO: 1725514 - DNA, 13 bp, Homo sapiens
ttcctcttttgct

SEQ ID NO: 1725515 - DNA, 15 bp, Homo sapiens
ttcctgaaatgcagt

SEQ ID NO: 1725516 - DNA, 15 bp, Homo sapiens
ttcctgaagaaccag

SEQ ID NO: 1725517 - DNA, 20 bp, Homo sapiens
cctatgacattactgtattt

SEQ ID NO: 1725518 - DNA, 17 bp, Homo sapiens
cctatgatattttctgt

SEQ ID NO: 1725519 - DNA, 13 bp, Homo sapiens
cctatgatcccag

SEQ ID NO: 1725520 - DNA, 14 bp, Homo sapiens
cctatgcacatatg

SEQ ID NO: 1725521 - DNA, 18 bp, Homo sapiens
cctatgccagtgctcaag

SEQ ID NO: 1725522 - DNA, 19 bp, Homo sapiens
cctatgctggtagatgctg

SEQ ID NO: 1725523 - DNA, 23 bp, Homo sapiens
cctatgctggtagatgctgaggc

SEQ ID NO: 1725524 - DNA, 21 bp, Homo sapiens
cctatggaaaagggtcttctt

SEQ ID NO: 1725525 - DNA, 19 bp, Homo sapiens
cctatgtagtgtctttatt

SEQ ID NO: 1725526 - DNA, 19 bp, Homo sapiens
cctatgtcaatttgtatat

SEQ ID NO: 1725527 - DNA, 23 bp, Homo sapiens
cctatgtcctaaggacacactaa

SEQ ID NO: 1725528 - DNA, 15 bp, Homo sapiens
cctatgtctcaggag

SEQ ID NO: 1725529 - DNA, 17 bp, Homo sapiens
cctatgtggcagctggg

SEQ ID NO: 1725530 - DNA, 17 bp, Homo sapiens
cctattatctgtcagct

SEQ ID NO: 1725531 - DNA, 23 bp, Homo sapiens
cctattcacgccgtaattctttc

SEQ ID NO: 1725532 - DNA, 21 bp, Homo sapiens
cctattccaggaattcctctt

SEQ ID NO: 1725533 - DNA, 21 bp, Homo sapiens
cctattctatccatctcctgg

SEQ ID NO: 1725534 - DNA, 22 bp, Homo sapiens
cctattgtgactcttctaaaaa

SEQ ID NO: 1725535 - DNA, 14 bp, Homo sapiens
cctatttctatgtc

SEQ ID NO: 1725536 - DNA, 14 bp, Homo sapiens
cctattttcatttg

SEQ ID NO: 1725537 - DNA, 15 bp, Homo sapiens
cctattttcatttgt

SEQ ID NO: 1725538 - DNA, 17 bp, Homo sapiens
cctattttcatttgtac

SEQ ID NO: 1725539 - DNA, 19 bp, Homo sapiens
cctcaaaaagcagaaggag

SEQ ID NO: 1725540 - DNA, 16 bp, Homo sapiens
cctcaaacatggaaga

SEQ ID NO: 1725541 - DNA, 15 bp, Homo sapiens
cctcaaacctcctct

SEQ ID NO: 1725542 - DNA, 13 bp, Homo sapiens
cctcaaatatagt

SEQ ID NO: 1725543 - DNA, 16 bp, Homo sapiens
tgccctgtgtggctgg

SEQ ID NO: 1725544 - DNA, 15 bp, Homo sapiens
tgcccttccctgtcc

SEQ ID NO: 1725545 - DNA, 14 bp, Homo sapiens
tgcccttctcccca

SEQ ID NO: 1725546 - DNA, 19 bp, Homo sapiens
tgcccttgcccttggagct

SEQ ID NO: 1725547 - DNA, 13 bp, Homo sapiens
tgcccttgggcca

SEQ ID NO: 1725548 - DNA, 22 bp, Homo sapiens
tgcccttggggtaagccagagc

SEQ ID NO: 1725549 - DNA, 20 bp, Homo sapiens
tgcccttggtagcagcctgg

SEQ ID NO: 1725550 - DNA, 16 bp, Homo sapiens
tgcccttttcaggaag

SEQ ID NO: 1725551 - DNA, 14 bp, Homo sapiens
tgccgaacacacat

SEQ ID NO: 1725552 - DNA, 22 bp, Homo sapiens
tgccgaccagagccccacacgg

SEQ ID NO: 1725553 - DNA, 18 bp, Homo sapiens
tgccgcaccccagagtgt

SEQ ID NO: 1725554 - DNA, 18 bp, Homo sapiens
tgccgcagacgggcacag

SEQ ID NO: 1725555 - DNA, 13 bp, Homo sapiens
tgccgcagagctg

SEQ ID NO: 1725556 - DNA, 17 bp, Homo sapiens
tgccgcagagctggccg

SEQ ID NO: 1725557 - DNA, 16 bp, Homo sapiens
tgccgccagctgccgc

SEQ ID NO: 1725558 - DNA, 23 bp, Homo sapiens
tgccgccagctgccgcaccagcc

SEQ ID NO: 1725559 - DNA, 17 bp, Homo sapiens
tgccgcccccgcctggg

SEQ ID NO: 1725560 - DNA, 21 bp, Homo sapiens
tgccgcccccgcctgggcacc

SEQ ID NO: 1725561 - DNA, 18 bp, Homo sapiens
tgccgccccctcctgaac

SEQ ID NO: 1725562 - DNA, 12 bp, Homo sapiens
tgccgcctgcgt

SEQ ID NO: 1725563 - DNA, 15 bp, Homo sapiens
tgccgcctgctcctc

SEQ ID NO: 1725564 - DNA, 19 bp, Homo sapiens
tgccgcgggcggccaggca

SEQ ID NO: 1725565 - DNA, 15 bp, Homo sapiens
tgccgctctctctga

SEQ ID NO: 1725566 - DNA, 14 bp, Homo sapiens
tgccgctgtctctg

SEQ ID NO: 1725567 - DNA, 16 bp, Homo sapiens
tgccggatacaaactg

SEQ ID NO: 1725568 - DNA, 19 bp, Homo sapiens
tgccggcatctcccctagc

SEQ ID NO: 1725569 - DNA, 21 bp, Homo sapiens
tgccggcatctcccctagctc

SEQ ID NO: 1725570 - DNA, 16 bp, Homo sapiens
tgccggccggggctga

SEQ ID NO: 1725571 - DNA, 13 bp, Homo sapiens
tgccgggcctggg

SEQ ID NO: 1725572 - DNA, 23 bp, Homo sapiens
tgccgggctgagggcctgctgga

SEQ ID NO: 1725573 - DNA, 19 bp, Homo sapiens
tgccgggttctagtctcct

SEQ ID NO: 1725574 - DNA, 14 bp, Homo sapiens
tgccgggttttata

SEQ ID NO: 1725575 - DNA, 18 bp, Homo sapiens
tgccgggttttatatttt

SEQ ID NO: 1725576 - DNA, 16 bp, Homo sapiens
tgccggtgggaccctg

SEQ ID NO: 1725577 - DNA, 19 bp, Homo sapiens
tgccggtgggaccctgtcc

SEQ ID NO: 1725578 - DNA, 22 bp, Homo sapiens
tgccgtggattgcacgtggcct

SEQ ID NO: 1725579 - DNA, 23 bp, Homo sapiens
tgccgtgggcctgtcgtgccagt

SEQ ID NO: 1725580 - DNA, 14 bp, Homo sapiens
tgccgttctgttcc

SEQ ID NO: 1725581 - DNA, 18 bp, Homo sapiens
tgcctaaaattgtatgaa

SEQ ID NO: 1725582 - DNA, 15 bp, Homo sapiens
tgcctaaatccaaag

SEQ ID NO: 1725583 - DNA, 16 bp, Homo sapiens
tgcctaaatccaaaga

SEQ ID NO: 1725584 - DNA, 15 bp, Homo sapiens
tgcctaaatcccaag

SEQ ID NO: 1725585 - DNA, 21 bp, Homo sapiens
tgcctaaatcccaagaaatgg

SEQ ID NO: 1725586 - DNA, 14 bp, Homo sapiens
tgcctaaattaaat

SEQ ID NO: 1725587 - DNA, 14 bp, Homo sapiens
tgcctaacttgtaa

SEQ ID NO: 1725588 - DNA, 15 bp, Homo sapiens
tgcctaattatgaat

SEQ ID NO: 1725589 - DNA, 14 bp, Homo sapiens
tgcctacaataaaa

SEQ ID NO: 1725590 - DNA, 16 bp, Homo sapiens
tgcctagaaatatctt

SEQ ID NO: 1725591 - DNA, 18 bp, Homo sapiens
tgcctagaaatatctttc

SEQ ID NO: 1725592 - DNA, 22 bp, Homo sapiens
tgcctagaaatatctttctctt

SEQ ID NO: 1725593 - DNA, 23 bp, Homo sapiens
tgcctagaaatatctttctctta

SEQ ID NO: 1725594 - DNA, 23 bp, Homo sapiens
tgcctagattaggtagactttgc

SEQ ID NO: 1725595 - DNA, 22 bp, Homo sapiens
tgcctaggagctggctggcagg

SEQ ID NO: 1725596 - DNA, 21 bp, Homo sapiens
tgcctaggaggctggccaagg

SEQ ID NO: 1725597 - DNA, 23 bp, Homo sapiens
tgcctaggccaaatgcacaagct

SEQ ID NO: 1725598 - DNA, 21 bp, Homo sapiens
tgcctaggcgattttgtctac

SEQ ID NO: 1725599 - DNA, 20 bp, Homo sapiens
tgcctagtgggagttaggac

SEQ ID NO: 1725600 - DNA, 14 bp, Homo sapiens
tgcctatagtccca

SEQ ID NO: 1725601 - DNA, 15 bp, Homo sapiens
tgcctatatctgaga

SEQ ID NO: 1725602 - DNA, 22 bp, Homo sapiens
tgcctatatctgagagacctgt

SEQ ID NO: 1725603 - DNA, 15 bp, Homo sapiens
tgcctatattttcct

SEQ ID NO: 1725604 - DNA, 19 bp, Homo sapiens
tgcctattcacgccgtaat

SEQ ID NO: 1725605 - DNA, 14 bp, Homo sapiens
tgcctatttgaagt

SEQ ID NO: 1725606 - DNA, 17 bp, Homo sapiens
tgcctatttgtgtggac

SEQ ID NO: 1725607 - DNA, 17 bp, Homo sapiens
tgcctcaactccaggat

SEQ ID NO: 1725608 - DNA, 18 bp, Homo sapiens
tgcctcaactccaggatt

SEQ ID NO: 1725609 - DNA, 13 bp, Homo sapiens
tgcctcaatgcca

SEQ ID NO: 1725610 - DNA, 16 bp, Homo sapiens
tgcctcaatgccagta

SEQ ID NO: 1725611 - DNA, 24 bp, Homo sapiens
tgcctcaatgtgaatcagacccta

SEQ ID NO: 1725612 - DNA, 15 bp, Homo sapiens
tgcctcacctcgaaa

SEQ ID NO: 1725613 - DNA, 15 bp, Homo sapiens
tgcctcactaatttt

SEQ ID NO: 1725614 - DNA, 18 bp, Homo sapiens
tgcctcactaatttttgt

SEQ ID NO: 1725615 - DNA, 22 bp, Homo sapiens
tgcctcactaatttttgtatta

SEQ ID NO: 1725616 - DNA, 19 bp, Homo sapiens
tgcctcagagaccagggct

SEQ ID NO: 1725617 - DNA, 20 bp, Homo sapiens
tgcctcagccagtggcacag

SEQ ID NO: 1725618 - DNA, 17 bp, Homo sapiens
tgcctcagcctcctgag

SEQ ID NO: 1725619 - DNA, 18 bp, Homo sapiens
tgcctcagcctcctgagt

SEQ ID NO: 1725620 - DNA, 12 bp, Homo sapiens
tgcctcaggcca

SEQ ID NO: 1725621 - DNA, 19 bp, Homo sapiens
tgcctcagttttccttctg

SEQ ID NO: 1725622 - DNA, 23 bp, Homo sapiens
tgcctcatgcaaccgggccctct

SEQ ID NO: 1725623 - DNA, 15 bp, Homo sapiens
tgcctcatgccacac

SEQ ID NO: 1725624 - DNA, 17 bp, Homo sapiens
tgcctcatgccacacct

SEQ ID NO: 1725625 - DNA, 15 bp, Homo sapiens
tgcctccaccaccac

SEQ ID NO: 1725626 - DNA, 17 bp, Homo sapiens
tgcctccaccaccactg

SEQ ID NO: 1725627 - DNA, 22 bp, Homo sapiens
tgcctccaccaccactggccac

SEQ ID NO: 1725628 - DNA, 17 bp, Homo sapiens
tgcctccaccagcaagg

SEQ ID NO: 1725629 - DNA, 21 bp, Homo sapiens
tgcctccaccgagccagcttg

SEQ ID NO: 1725630 - DNA, 18 bp, Homo sapiens
tgcctccaccgctgccta

SEQ ID NO: 1725631 - DNA, 14 bp, Homo sapiens
tgcctccagggctg

SEQ ID NO: 1725632 - DNA, 17 bp, Homo sapiens
tgcctccagggctggac

SEQ ID NO: 1725633 - DNA, 11 bp, Homo sapiens
tgcctccaggt

SEQ ID NO: 1725634 - DNA, 14 bp, Homo sapiens
tgcctccaggtgca

SEQ ID NO: 1725635 - DNA, 21 bp, Homo sapiens
tgcctccaggtgcagaggtac

SEQ ID NO: 1725636 - DNA, 13 bp, Homo sapiens
tgcctccaggtgt

SEQ ID NO: 1725637 - DNA, 15 bp, Homo sapiens
tgcctccaggtgtgc

SEQ ID NO: 1725638 - DNA, 22 bp, Homo sapiens
tgcctcccaaggtcctctcagt

SEQ ID NO: 1725639 - DNA, 16 bp, Homo sapiens
tgcctcccacttcact

SEQ ID NO: 1725640 - DNA, 17 bp, Homo sapiens
tgcctcccaggcaagca

SEQ ID NO: 1725641 - DNA, 15 bp, Homo sapiens
tgcctccccccagac

SEQ ID NO: 1725642 - DNA, 17 bp, Homo sapiens
tgcctccccccagaccc

SEQ ID NO: 1725643 - DNA, 21 bp, Homo sapiens
tgcctccccccagaccccgcc

SEQ ID NO: 1725644 - DNA, 18 bp, Homo sapiens
tgcctccccggctcgagc

SEQ ID NO: 1725645 - DNA, 14 bp, Homo sapiens
tgcctcccctccgc

SEQ ID NO: 1725646 - DNA, 15 bp, Homo sapiens
tgcctcccctccgca

SEQ ID NO: 1725647 - DNA, 18 bp, Homo sapiens
tgcctcccctctccttcc

SEQ ID NO: 1725648 - DNA, 16 bp, Homo sapiens
tgcctcccgccccctt

SEQ ID NO: 1725649 - DNA, 23 bp, Homo sapiens
tgcctccctggggaccaggagct

SEQ ID NO: 1725650 - DNA, 22 bp, Homo sapiens
tgcctcccttccgctgcgggcc

SEQ ID NO: 1725651 - DNA, 12 bp, Homo sapiens
tgcctcctcacc

SEQ ID NO: 1725652 - DNA, 19 bp, Homo sapiens
tgcctcctcacccccagct

SEQ ID NO: 1725653 - DNA, 23 bp, Homo sapiens
tgcctcctgccaccccttcctcc

SEQ ID NO: 1725654 - DNA, 19 bp, Homo sapiens
tgcctcctgttctgcccac

SEQ ID NO: 1725655 - DNA, 22 bp, Homo sapiens
tgcctccttgatatttgtattt

SEQ ID NO: 1725656 - DNA, 17 bp, Homo sapiens
tgcctccttttttctta

SEQ ID NO: 1725657 - DNA, 20 bp, Homo sapiens
tgtatgctgatgatcaaaac

SEQ ID NO: 1725658 - DNA, 23 bp, Homo sapiens
tgtatggaaataaatgtatcata

SEQ ID NO: 1725659 - DNA, 18 bp, Homo sapiens
tgtatggaatacagtgtt

SEQ ID NO: 1725660 - DNA, 19 bp, Homo sapiens
tgtatggaatcccactgta

SEQ ID NO: 1725661 - DNA, 23 bp, Homo sapiens
tgtatggacgtgtgtgaatggtt

SEQ ID NO: 1725662 - DNA, 14 bp, Homo sapiens
tgtatggatatatt

SEQ ID NO: 1725663 - DNA, 18 bp, Homo sapiens
tgtatggatatatttgaa

SEQ ID NO: 1725664 - DNA, 19 bp, Homo sapiens
tgtatgtacaatacaatgt

SEQ ID NO: 1725665 - DNA, 20 bp, Homo sapiens
tgtatgtacaatacaatgta

SEQ ID NO: 1725666 - DNA, 20 bp, Homo sapiens
tgtatgtacttagctgtact

SEQ ID NO: 1725667 - DNA, 14 bp, Homo sapiens
tgtatgtctgtgta

SEQ ID NO: 1725668 - DNA, 20 bp, Homo sapiens
tgtatgtctgtgtatgtata

SEQ ID NO: 1725669 - DNA, 16 bp, Homo sapiens
tgtatgtggtgtgggg

SEQ ID NO: 1725670 - DNA, 14 bp, Homo sapiens
tgtatgtgtaagta

SEQ ID NO: 1725671 - DNA, 12 bp, Homo sapiens
tgtatgtgtcac

SEQ ID NO: 1725672 - DNA, 13 bp, Homo sapiens
tgtatgtgtgaaa

SEQ ID NO: 1725673 - DNA, 18 bp, Homo sapiens
tgtatgtgtgaaacaatg

SEQ ID NO: 1725674 - DNA, 13 bp, Homo sapiens
tgtatgtgtgtgt

SEQ ID NO: 1725675 - DNA, 13 bp, Homo sapiens
tgtatgtttacat

SEQ ID NO: 1725676 - DNA, 15 bp, Homo sapiens
tgtatgtttacatat

SEQ ID NO: 1725677 - DNA, 13 bp, Homo sapiens
tgtattaaatctt

SEQ ID NO: 1725678 - DNA, 16 bp, Homo sapiens
tgtattaaatcttaaa

SEQ ID NO: 1725679 - DNA, 18 bp, Homo sapiens
tgtattaaatcttaaaca

SEQ ID NO: 1725680 - DNA, 18 bp, Homo sapiens
tgtattaaattacatttg

SEQ ID NO: 1725681 - DNA, 18 bp, Homo sapiens
tgtattaagagtgaaaat

SEQ ID NO: 1725682 - DNA, 13 bp, Homo sapiens
tgtattaataaag

SEQ ID NO: 1725683 - DNA, 17 bp, Homo sapiens
tgtattaataaagcatt

SEQ ID NO: 1725684 - DNA, 19 bp, Homo sapiens
tgtattaatttctgataaa

SEQ ID NO: 1725685 - DNA, 14 bp, Homo sapiens
tgtattacagatgc

SEQ ID NO: 1725686 - DNA, 19 bp, Homo sapiens
tgtattacatctaatgctt

SEQ ID NO: 1725687 - DNA, 19 bp, Homo sapiens
tgtattactagaagatgaa

SEQ ID NO: 1725688 - DNA, 23 bp, Homo sapiens
tgtattacttaggttattttgct

SEQ ID NO: 1725689 - DNA, 15 bp, Homo sapiens
tgtattaggaaaata

SEQ ID NO: 1725690 - DNA, 16 bp, Homo sapiens
tgtattattctgcagc

SEQ ID NO: 1725691 - DNA, 18 bp, Homo sapiens
tgtattatttacatttaa

SEQ ID NO: 1725692 - DNA, 15 bp, Homo sapiens
tgtattatttataat

SEQ ID NO: 1725693 - DNA, 15 bp, Homo sapiens
tgtattatttgcaca

SEQ ID NO: 1725694 - DNA, 22 bp, Homo sapiens
tgtattcaaatttgtgtcatac

SEQ ID NO: 1725695 - DNA, 17 bp, Homo sapiens
tgtattcacacacccct

SEQ ID NO: 1725696 - DNA, 16 bp, Homo sapiens
tgtattcatgttcatg

SEQ ID NO: 1725697 - DNA, 19 bp, Homo sapiens
tgtattcatgttcatgtga

SEQ ID NO: 1725698 - DNA, 13 bp, Homo sapiens
tgtattccaagac

SEQ ID NO: 1725699 - DNA, 15 bp, Homo sapiens
tgtattccaagacat

SEQ ID NO: 1725700 - DNA, 20 bp, Homo sapiens
tgtattccaagacatgtctg

SEQ ID NO: 1725701 - DNA, 12 bp, Homo sapiens
tgtattctgtat

SEQ ID NO: 1725702 - DNA, 16 bp, Homo sapiens
tgtattctgtcttcat

SEQ ID NO: 1725703 - DNA, 18 bp, Homo sapiens
tgtattcttgttcccgaa

SEQ ID NO: 1725704 - DNA, 15 bp, Homo sapiens
tgtattcttgtttga

SEQ ID NO: 1725705 - DNA, 19 bp, Homo sapiens
tgtattcttttccaagctc

SEQ ID NO: 1725706 - DNA, 13 bp, Homo sapiens
tgtattgacttta

SEQ ID NO: 1725707 - DNA, 19 bp, Homo sapiens
tgtattgatcaatgcatgt

SEQ ID NO: 1725708 - DNA, 16 bp, Homo sapiens
tgtattgatgcaatat

SEQ ID NO: 1725709 - DNA, 17 bp, Homo sapiens
tgtattgatgcaatata

SEQ ID NO: 1725710 - DNA, 12 bp, Homo sapiens
tgtattgattca

SEQ ID NO: 1725711 - DNA, 18 bp, Homo sapiens
tgtattgattcaacaggg

SEQ ID NO: 1725712 - DNA, 15 bp, Homo sapiens
tgtattgcatgcaat

SEQ ID NO: 1725713 - DNA, 13 bp, Homo sapiens
tgtattgcttatt

SEQ ID NO: 1725714 - DNA, 13 bp, Homo sapiens
tgtattggcctgg

SEQ ID NO: 1725715 - DNA, 16 bp, Homo sapiens
tgtattggttaaaact

SEQ ID NO: 1725716 - DNA, 18 bp, Homo sapiens
tgtattgttgaaaaagtt

SEQ ID NO: 1725717 - DNA, 16 bp, Homo sapiens
tgtattgttttcccaa

SEQ ID NO: 1725718 - DNA, 15 bp, Homo sapiens
tgtatttaattttga

SEQ ID NO: 1725719 - DNA, 19 bp, Homo sapiens
tgtatttagctacagcttg

SEQ ID NO: 1725720 - DNA, 15 bp, Homo sapiens
tgtatttattctttt

SEQ ID NO: 1725721 - DNA, 18 bp, Homo sapiens
tgtatttatttaaaagat

SEQ ID NO: 1725722 - DNA, 15 bp, Homo sapiens
tgtatttctcttgtc

SEQ ID NO: 1725723 - DNA, 17 bp, Homo sapiens
tgtatttgaaataagaa

SEQ ID NO: 1725724 - DNA, 15 bp, Homo sapiens
tgtatttgagagact

SEQ ID NO: 1725725 - DNA, 16 bp, Homo sapiens
tgtatttgagagactg

SEQ ID NO: 1725726 - DNA, 14 bp, Homo sapiens
tgtatttgatttat

SEQ ID NO: 1725727 - DNA, 17 bp, Homo sapiens
tgtatttgctaattttt

SEQ ID NO: 1725728 - DNA, 15 bp, Homo sapiens
tgtatttgctgttga

SEQ ID NO: 1725729 - DNA, 17 bp, Homo sapiens
tgtatttgttatatata

SEQ ID NO: 1725730 - DNA, 17 bp, Homo sapiens
tgtattttatcttattt

SEQ ID NO: 1725731 - DNA, 22 bp, Homo sapiens
tgtattttatttagacaagaga

SEQ ID NO: 1725732 - DNA, 13 bp, Homo sapiens
tgtattttcaact

SEQ ID NO: 1725733 - DNA, 19 bp, Homo sapiens
tgtattttcatagatgtgt

SEQ ID NO: 1725734 - DNA, 12 bp, Homo sapiens
tgtattttcatg

SEQ ID NO: 1725735 - DNA, 20 bp, Homo sapiens
tgtattttcttttatatctg

SEQ ID NO: 1725736 - DNA, 21 bp, Homo sapiens
tgtattttcttttatatctgt

SEQ ID NO: 1725737 - DNA, 19 bp, Homo sapiens
tgtattttgtaaataataa

SEQ ID NO: 1725738 - DNA, 23 bp, Homo sapiens
tgtattttgtgatgaatctacat

SEQ ID NO: 1725739 - DNA, 12 bp, Homo sapiens
tgtattttgtta

SEQ ID NO: 1725740 - DNA, 14 bp, Homo sapiens
tgtatttttaatgg

SEQ ID NO: 1725741 - DNA, 21 bp, Homo sapiens
tgtatttttgtgaagtattca

SEQ ID NO: 1725742 - DNA, 22 bp, Homo sapiens
tgtattttttaaaattgatttt

SEQ ID NO: 1725743 - DNA, 20 bp, Homo sapiens
tgtattttttatttacattt

SEQ ID NO: 1725744 - DNA, 22 bp, Homo sapiens
tgtatttttttaactacataaa

SEQ ID NO: 1725745 - DNA, 21 bp, Homo sapiens
tgtatttttttttctaagaga

SEQ ID NO: 1725746 - DNA, 13 bp, Homo sapiens
tgtcaaagaagct

SEQ ID NO: 1725747 - DNA, 23 bp, Homo sapiens
tgtcaaagaagcttccacaaaat

SEQ ID NO: 1725748 - DNA, 13 bp, Homo sapiens
tgtcaaagctttg

SEQ ID NO: 1725749 - DNA, 17 bp, Homo sapiens
tgtcaaatgtttcctta

SEQ ID NO: 1725750 - DNA, 15 bp, Homo sapiens
tgtcaactatgatat

SEQ ID NO: 1725751 - DNA, 15 bp, Homo sapiens
tgtcaacttcaacat

SEQ ID NO: 1725752 - DNA, 15 bp, Homo sapiens
tgtcaagaaaaggag

SEQ ID NO: 1725753 - DNA, 14 bp, Homo sapiens
tgtcaagaaagagc

SEQ ID NO: 1725754 - DNA, 15 bp, Homo sapiens
tgtcaagacagggaa

SEQ ID NO: 1725755 - DNA, 14 bp, Homo sapiens
tgtcaagacatttc

SEQ ID NO: 1725756 - DNA, 14 bp, Homo sapiens
tgtcaagctgctct

SEQ ID NO: 1725757 - DNA, 15 bp, Homo sapiens
tgtcaagctgctctg

SEQ ID NO: 1725758 - DNA, 17 bp, Homo sapiens
tgtcaaggtgaagcaca

SEQ ID NO: 1725759 - DNA, 19 bp, Homo sapiens
tgtcaagtctctgctggcc

SEQ ID NO: 1725760 - DNA, 18 bp, Homo sapiens
tgtcaagttaacaaggaa

SEQ ID NO: 1725761 - DNA, 21 bp, Homo sapiens
tgtcaagttaacaaggaatgc

SEQ ID NO: 1725762 - DNA, 17 bp, Homo sapiens
tgtcaagttgtgcttgt

SEQ ID NO: 1725763 - DNA, 16 bp, Homo sapiens
tgtcaataaacagctt

SEQ ID NO: 1725764 - DNA, 13 bp, Homo sapiens
tgtcaatattaaa

SEQ ID NO: 1725765 - DNA, 15 bp, Homo sapiens
tgtcaatttgtatat

SEQ ID NO: 1725766 - DNA, 21 bp, Homo sapiens
tgtcacaaattgatcaagata

SEQ ID NO: 1725767 - DNA, 18 bp, Homo sapiens
tgtcacaacctctctgat

SEQ ID NO: 1725768 - DNA, 23 bp, Homo sapiens
tgtcacaagtggtgtttattgca

SEQ ID NO: 1725769 - DNA, 19 bp, Homo sapiens
tgtcacagtccaaccagaa

SEQ ID NO: 1725770 - DNA, 21 bp, Homo sapiens
tgtcacatcagcaatttcaga

SEQ ID NO: 1725771 - DNA, 14 bp, Homo sapiens
tgtcacattctatt

SEQ ID NO: 1725772 - DNA, 20 bp, Homo sapiens
tgtcacatttagctgtgctc

SEQ ID NO: 1725773 - DNA, 15 bp, Homo sapiens
tgtcaccaaggaaac

SEQ ID NO: 1725774 - DNA, 14 bp, Homo sapiens
tgttaattttgcta

SEQ ID NO: 1725775 - DNA, 15 bp, Homo sapiens
tgttaattttgctaa

SEQ ID NO: 1725776 - DNA, 18 bp, Homo sapiens
tgttaattttgctaactg

SEQ ID NO: 1725777 - DNA, 23 bp, Homo sapiens
tgttacaaaagaaaaaagcaagt

SEQ ID NO: 1725778 - DNA, 15 bp, Homo sapiens
tgttacaagaggcca

SEQ ID NO: 1725779 - DNA, 17 bp, Homo sapiens
tgttacaagtgttctta

SEQ ID NO: 1725780 - DNA, 19 bp, Homo sapiens
tgttacactgggctgggtt

SEQ ID NO: 1725781 - DNA, 19 bp, Homo sapiens
tgttacataagataaatgt

SEQ ID NO: 1725782 - DNA, 23 bp, Homo sapiens
tgttaccaaaaataaatatatct

SEQ ID NO: 1725783 - DNA, 14 bp, Homo sapiens
tgttaccattcaca

SEQ ID NO: 1725784 - DNA, 18 bp, Homo sapiens
tgttacctaattattaca

SEQ ID NO: 1725785 - DNA, 16 bp, Homo sapiens
tgttacctgtcatttt

SEQ ID NO: 1725786 - DNA, 18 bp, Homo sapiens
tgttacctgtcattttgc

SEQ ID NO: 1725787 - DNA, 15 bp, Homo sapiens
tgttacctgtgtgct

SEQ ID NO: 1725788 - DNA, 21 bp, Homo sapiens
tgttactatggtaacactttg

SEQ ID NO: 1725789 - DNA, 14 bp, Homo sapiens
tgttactattttct

SEQ ID NO: 1725790 - DNA, 23 bp, Homo sapiens
tgttactccacagcggaggagac

SEQ ID NO: 1725791 - DNA, 24 bp, Homo sapiens
tgttactccattactgtgatttct

SEQ ID NO: 1725792 - DNA, 15 bp, Homo sapiens
tgttactccctgtta

SEQ ID NO: 1725793 - DNA, 18 bp, Homo sapiens
tgttactccctgttttag

SEQ ID NO: 1725794 - DNA, 15 bp, Homo sapiens
tgttactgaccagca

SEQ ID NO: 1725795 - DNA, 19 bp, Homo sapiens
tgttactgattcaattata

SEQ ID NO: 1725796 - DNA, 13 bp, Homo sapiens
tgttactgctttg

SEQ ID NO: 1725797 - DNA, 16 bp, Homo sapiens
tgttactgctttgcaa

SEQ ID NO: 1725798 - DNA, 17 bp, Homo sapiens
tgttactgctttgcaaa

SEQ ID NO: 1725799 - DNA, 14 bp, Homo sapiens
tgttacttccttat

SEQ ID NO: 1725800 - DNA, 15 bp, Homo sapiens
tgttacttccttatg

SEQ ID NO: 1725801 - DNA, 23 bp, Homo sapiens
tgttactttggcaatttcctggc

SEQ ID NO: 1725802 - DNA, 17 bp, Homo sapiens
tgttagaaaacaaaatt

SEQ ID NO: 1725803 - DNA, 17 bp, Homo sapiens
tgttagaaaatgactta

SEQ ID NO: 1725804 - DNA, 22 bp, Homo sapiens
tgttagaaaatgacttatttct

SEQ ID NO: 1725805 - DNA, 18 bp, Homo sapiens
tgttagaatcaaatactc

SEQ ID NO: 1725806 - DNA, 19 bp, Homo sapiens
tgttagaatgtaaggtata

SEQ ID NO: 1725807 - DNA, 23 bp, Homo sapiens
tgttagcaaatgacagatttctg

SEQ ID NO: 1725808 - DNA, 21 bp, Homo sapiens
tgttagcccaaggttaaaaag

SEQ ID NO: 1725809 - DNA, 19 bp, Homo sapiens
tgttagctacacagtgcag

SEQ ID NO: 1725810 - DNA, 19 bp, Homo sapiens
tgttaggaggctgcatgct

SEQ ID NO: 1725811 - DNA, 23 bp, Homo sapiens
tgttaggaggctgcatgctctgg

SEQ ID NO: 1725812 - DNA, 19 bp, Homo sapiens
tgttaggcttttctgcctg

SEQ ID NO: 1725813 - DNA, 17 bp, Homo sapiens
tgttagggtcagccatt

SEQ ID NO: 1725814 - DNA, 14 bp, Homo sapiens
tgttagtagaaatt

SEQ ID NO: 1725815 - DNA, 15 bp, Homo sapiens
tgttagtcatttgct

SEQ ID NO: 1725816 - DNA, 16 bp, Homo sapiens
tgttagtgtgtgtgca

SEQ ID NO: 1725817 - DNA, 14 bp, Homo sapiens
tgttagttcacttc

SEQ ID NO: 1725818 - DNA, 15 bp, Homo sapiens
tgttatagatttagc

SEQ ID NO: 1725819 - DNA, 21 bp, Homo sapiens
tgttatatatctcttttggtc

SEQ ID NO: 1725820 - DNA, 14 bp, Homo sapiens
tgttatatcaggga

SEQ ID NO: 1725821 - DNA, 20 bp, Homo sapiens
tgttatcttctcaagttcta

SEQ ID NO: 1725822 - DNA, 22 bp, Homo sapiens
tgttatcttctcaagttctaag

SEQ ID NO: 1725823 - DNA, 14 bp, Homo sapiens
tgttatgaacagct

SEQ ID NO: 1725824 - DNA, 17 bp, Homo sapiens
tgttatgaacagctgtg

SEQ ID NO: 1725825 - DNA, 13 bp, Homo sapiens
tgttatgaacatc

SEQ ID NO: 1725826 - DNA, 23 bp, Homo sapiens
tgttatgcactgtggtttcagat

SEQ ID NO: 1725827 - DNA, 18 bp, Homo sapiens
tgttatggcttaatgaca

SEQ ID NO: 1725828 - DNA, 20 bp, Homo sapiens
tgttatgggatgtaaacaat

SEQ ID NO: 1725829 - DNA, 17 bp, Homo sapiens
tgttatgtagataacaa

SEQ ID NO: 1725830 - DNA, 15 bp, Homo sapiens
tgttatgtatatggt

SEQ ID NO: 1725831 - DNA, 14 bp, Homo sapiens
tgttattagatgtt

SEQ ID NO: 1725832 - DNA, 22 bp, Homo sapiens
tgttattattacttatttttga

SEQ ID NO: 1725833 - DNA, 16 bp, Homo sapiens
tgttattattcattat

SEQ ID NO: 1725834 - DNA, 15 bp, Homo sapiens
tgttattcaaatttg

SEQ ID NO: 1725835 - DNA, 22 bp, Homo sapiens
tgttattcaaatttgatgatgt

SEQ ID NO: 1725836 - DNA, 20 bp, Homo sapiens
cgtgatccatccatctccag

SEQ ID NO: 1725837 - DNA, 17 bp, Homo sapiens
cgtgatccgcctgcctc

SEQ ID NO: 1725838 - DNA, 18 bp, Homo sapiens
cgtgatccgcctgcctct

SEQ ID NO: 1725839 - DNA, 17 bp, Homo sapiens
cgtgatgcctccctgtt

SEQ ID NO: 1725840 - DNA, 15 bp, Homo sapiens
cgtgatgtgccacta

SEQ ID NO: 1725841 - DNA, 17 bp, Homo sapiens
cgtgatgtggaggaaga

SEQ ID NO: 1725842 - DNA, 20 bp, Homo sapiens
cgtgatgtggaggaagagcc

SEQ ID NO: 1725843 - DNA, 23 bp, Homo sapiens
cgtgatgtggaggaagagccacc

SEQ ID NO: 1725844 - DNA, 22 bp, Homo sapiens
cgtgcactgtgaatcctggcaa

SEQ ID NO: 1725845 - DNA, 15 bp, Homo sapiens
cgtgcacttcccaga

SEQ ID NO: 1725846 - DNA, 12 bp, Homo sapiens
cgtgcaggacag

SEQ ID NO: 1725847 - DNA, 14 bp, Homo sapiens
cgtgcaggacagct

SEQ ID NO: 1725848 - DNA, 16 bp, Homo sapiens
cgtgcaggacagctct

SEQ ID NO: 1725849 - DNA, 19 bp, Homo sapiens
cgtgcaggacagctcttga

SEQ ID NO: 1725850 - DNA, 18 bp, Homo sapiens
cgtgcatccttgtaatac

SEQ ID NO: 1725851 - DNA, 20 bp, Homo sapiens
cgtgcattaaaatttcttat

SEQ ID NO: 1725852 - DNA, 19 bp, Homo sapiens
cgtgccagatataactgtc

SEQ ID NO: 1725853 - DNA, 22 bp, Homo sapiens
cgtgccagatataactgtcttg

SEQ ID NO: 1725854 - DNA, 13 bp, Homo sapiens
cgtgccagcagcc

SEQ ID NO: 1725855 - DNA, 16 bp, Homo sapiens
cgtgccagcagcctcg

SEQ ID NO: 1725856 - DNA, 17 bp, Homo sapiens
cgtgccagcagcctcgc

SEQ ID NO: 1725857 - DNA, 18 bp, Homo sapiens
cgtgccagcagcctcgca

SEQ ID NO: 1725858 - DNA, 16 bp, Homo sapiens
cgtgccagctctagtt

SEQ ID NO: 1725859 - DNA, 13 bp, Homo sapiens
cgtgccaggcccg

SEQ ID NO: 1725860 - DNA, 20 bp, Homo sapiens
cgtgcccccctcctccagta

SEQ ID NO: 1725861 - DNA, 20 bp, Homo sapiens
cgtgcccccgcctgccaccg

SEQ ID NO: 1725862 - DNA, 17 bp, Homo sapiens
cgtgccccgcctccccg

SEQ ID NO: 1725863 - DNA, 18 bp, Homo sapiens
cgtgcccttgcccttgga

SEQ ID NO: 1725864 - DNA, 16 bp, Homo sapiens
cgtgccgcctgcactc

SEQ ID NO: 1725865 - DNA, 22 bp, Homo sapiens
cgtgccgcctgctcctcactgg

SEQ ID NO: 1725866 - DNA, 21 bp, Homo sapiens
cgtgccggcggcagccccact

SEQ ID NO: 1725867 - DNA, 17 bp, Homo sapiens
cgtgccgttactctcca

SEQ ID NO: 1725868 - DNA, 19 bp, Homo sapiens
cgtgccgttactctccaac

SEQ ID NO: 1725869 - DNA, 17 bp, Homo sapiens
cgtgcctccaccaccac

SEQ ID NO: 1725870 - DNA, 21 bp, Homo sapiens
cgtgcctccaccaccactggc

SEQ ID NO: 1725871 - DNA, 23 bp, Homo sapiens
cgtgcctccaccaccactggcca

SEQ ID NO: 1725872 - DNA, 20 bp, Homo sapiens
cgtgccttttgcacccctcc

SEQ ID NO: 1725873 - DNA, 19 bp, Homo sapiens
cgtgcgtgttagtgtgtgt

SEQ ID NO: 1725874 - DNA, 17 bp, Homo sapiens
cgtgctactgcactcca

SEQ ID NO: 1725875 - DNA, 21 bp, Homo sapiens
cgtgctgagaggcgagctcct

SEQ ID NO: 1725876 - DNA, 14 bp, Homo sapiens
cgtgctggccccag

SEQ ID NO: 1725877 - DNA, 18 bp, Homo sapiens
cgtgctgtgggcctcagg

SEQ ID NO: 1725878 - DNA, 14 bp, Homo sapiens
cgtgcttctttgta

SEQ ID NO: 1725879 - DNA, 19 bp, Homo sapiens
cgtggaaacaatcctgtta

SEQ ID NO: 1725880 - DNA, 15 bp, Homo sapiens
cgtggacaggcccag

SEQ ID NO: 1725881 - DNA, 14 bp, Homo sapiens
cgtggaccacctag

SEQ ID NO: 1725882 - DNA, 18 bp, Homo sapiens
cgtggaccacctagtctg

SEQ ID NO: 1725883 - DNA, 21 bp, Homo sapiens
cgtggactctgctagactcct

SEQ ID NO: 1725884 - DNA, 19 bp, Homo sapiens
cgtggactgtgctggtgca

SEQ ID NO: 1725885 - DNA, 17 bp, Homo sapiens
cgtggagagctggtgcc

SEQ ID NO: 1725886 - DNA, 19 bp, Homo sapiens
cgtggagggaggccccagg

SEQ ID NO: 1725887 - DNA, 15 bp, Homo sapiens
cgtggatcgagtgta

SEQ ID NO: 1725888 - DNA, 18 bp, Homo sapiens
ttactggcctttttcatt

SEQ ID NO: 1725889 - DNA, 16 bp, Homo sapiens
ttactggcttctcttg

SEQ ID NO: 1725890 - DNA, 23 bp, Homo sapiens
ttactgggtttgtttttcaaagc

SEQ ID NO: 1725891 - DNA, 14 bp, Homo sapiens
ttactggtccaaaa

SEQ ID NO: 1725892 - DNA, 15 bp, Homo sapiens
ttactggtccaaaag

SEQ ID NO: 1725893 - DNA, 14 bp, Homo sapiens
ttactgtaaaatgc

SEQ ID NO: 1725894 - DNA, 16 bp, Homo sapiens
ttactgtaaaatgcaa

SEQ ID NO: 1725895 - DNA, 12 bp, Homo sapiens
ttactgtaaatg

SEQ ID NO: 1725896 - DNA, 20 bp, Homo sapiens
ttactgtaaatgccttgctt

SEQ ID NO: 1725897 - DNA, 13 bp, Homo sapiens
ttactgtaaattt

SEQ ID NO: 1725898 - DNA, 19 bp, Homo sapiens
ttactgtaactgtcagtgt

SEQ ID NO: 1725899 - DNA, 14 bp, Homo sapiens
ttactgtatatgta

SEQ ID NO: 1725900 - DNA, 21 bp, Homo sapiens
ttactgtatatgtattccctt

SEQ ID NO: 1725901 - DNA, 23 bp, Homo sapiens
ttactgtatatgtattcccttgt

SEQ ID NO: 1725902 - DNA, 19 bp, Homo sapiens
ttactgtatttaagaaaac

SEQ ID NO: 1725903 - DNA, 14 bp, Homo sapiens
ttactgtcaataaa

SEQ ID NO: 1725904 - DNA, 18 bp, Homo sapiens
ttactgtcaataaacagc

SEQ ID NO: 1725905 - DNA, 14 bp, Homo sapiens
ttactgtcagagaa

SEQ ID NO: 1725906 - DNA, 19 bp, Homo sapiens
ttactgtctattaatattc

SEQ ID NO: 1725907 - DNA, 14 bp, Homo sapiens
ttactgtcttgaat

SEQ ID NO: 1725908 - DNA, 20 bp, Homo sapiens
ttactgtgaagagaatgtat

SEQ ID NO: 1725909 - DNA, 15 bp, Homo sapiens
ttactgtgatttctg

SEQ ID NO: 1725910 - DNA, 16 bp, Homo sapiens
ttactgtgtaattagt

SEQ ID NO: 1725911 - DNA, 17 bp, Homo sapiens
ttactgttagaattctt

SEQ ID NO: 1725912 - DNA, 15 bp, Homo sapiens
ttactgttgcactga

SEQ ID NO: 1725913 - DNA, 15 bp, Homo sapiens
ttactgttgcattta

SEQ ID NO: 1725914 - DNA, 16 bp, Homo sapiens
ttactgttgcatttac

SEQ ID NO: 1725915 - DNA, 20 bp, Homo sapiens
ttacttagaggaaataagaa

SEQ ID NO: 1725916 - DNA, 20 bp, Homo sapiens
ttacttaggttattttgctt

SEQ ID NO: 1725917 - DNA, 17 bp, Homo sapiens
ttacttatcatccacat

SEQ ID NO: 1725918 - DNA, 15 bp, Homo sapiens
ttacttcctatcaag

SEQ ID NO: 1725919 - DNA, 23 bp, Homo sapiens
ttacttcttatacatttgataaa

SEQ ID NO: 1725920 - DNA, 17 bp, Homo sapiens
ttacttgataagggact

SEQ ID NO: 1725921 - DNA, 19 bp, Homo sapiens
ttacttgcattgaatatat

SEQ ID NO: 1725922 - DNA, 14 bp, Homo sapiens
ttacttgcttcagt

SEQ ID NO: 1725923 - DNA, 18 bp, Homo sapiens
ttacttgtaaataaagtc

SEQ ID NO: 1725924 - DNA, 13 bp, Homo sapiens
ttacttgtctgta

SEQ ID NO: 1725925 - DNA, 15 bp, Homo sapiens
ttacttgtctgtaca

SEQ ID NO: 1725926 - DNA, 13 bp, Homo sapiens
ttacttgtggtgt

SEQ ID NO: 1725927 - DNA, 20 bp, Homo sapiens
ttacttgtggtgtgaccatg

SEQ ID NO: 1725928 - DNA, 19 bp, Homo sapiens
ttacttgtgttacttgcca

SEQ ID NO: 1725929 - DNA, 19 bp, Homo sapiens
ttactttaattactggaat

SEQ ID NO: 1725930 - DNA, 18 bp, Homo sapiens
ttactttagaagcctgca

SEQ ID NO: 1725931 - DNA, 11 bp, Homo sapiens
ttactttctgt

SEQ ID NO: 1725932 - DNA, 20 bp, Homo sapiens
ttactttgctgccttaatga

SEQ ID NO: 1725933 - DNA, 13 bp, Homo sapiens
ttactttttatgg

SEQ ID NO: 1725934 - DNA, 15 bp, Homo sapiens
ttacttttttatagc

SEQ ID NO: 1725935 - DNA, 13 bp, Homo sapiens
ttagaaaaaaact

SEQ ID NO: 1725936 - DNA, 15 bp, Homo sapiens
ttagaaaaaaattac

SEQ ID NO: 1725937 - DNA, 12 bp, Homo sapiens
ttagaaaaaaca

SEQ ID NO: 1725938 - DNA, 14 bp, Homo sapiens
ttagaaaaaacaat

SEQ ID NO: 1725939 - DNA, 19 bp, Homo sapiens
ttagaaaaaacaatttttg

SEQ ID NO: 1725940 - DNA, 23 bp, Homo sapiens
ttagaaaaaagtttacaacataa

SEQ ID NO: 1725941 - DNA, 22 bp, Homo sapiens
ttagaaaataggggttaagact

SEQ ID NO: 1725942 - DNA, 12 bp, Homo sapiens
ttagaaactgga

SEQ ID NO: 1725943 - DNA, 23 bp, Homo sapiens
ttagaaaggacaacagttctgag

SEQ ID NO: 1725944 - DNA, 12 bp, Homo sapiens
ttagaaatactt

SEQ ID NO: 1725945 - DNA, 14 bp, Homo sapiens
ttagaaatataatt

SEQ ID NO: 1725946 - DNA, 15 bp, Homo sapiens
ttagaaatattcaca

SEQ ID NO: 1725947 - DNA, 13 bp, Homo sapiens
ttagaacctttct

SEQ ID NO: 1725948 - DNA, 18 bp, Homo sapiens
ttagaacgttaaactatt

SEQ ID NO: 1725949 - DNA, 20 bp, Homo sapiens
ttagaagaggtagtgtgaat

SEQ ID NO: 1725950 - DNA, 14 bp, Homo sapiens
ttagaagcccattc

SEQ ID NO: 1725951 - DNA, 13 bp, Homo sapiens
ttagaagcctgca

SEQ ID NO: 1725952 - DNA, 23 bp, Homo sapiens
ttagaagcctgcataatgtttct

SEQ ID NO: 1725953 - DNA, 16 bp, Homo sapiens
ttagaagggttcagga

SEQ ID NO: 1725954 - DNA, 13 bp, Homo sapiens
ttagaaggtatta

SEQ ID NO: 1725955 - DNA, 18 bp, Homo sapiens
ttagaaggtattaagatt

SEQ ID NO: 1725956 - DNA, 21 bp, Homo sapiens
ttagaatcagccttgaaacat

SEQ ID NO: 1725957 - DNA, 13 bp, Homo sapiens
ttagaatctagaa

SEQ ID NO: 1725958 - DNA, 17 bp, Homo sapiens
ttagaatgaatttatct

SEQ ID NO: 1725959 - DNA, 21 bp, Homo sapiens
ttagaatggaggaagaacaac

SEQ ID NO: 1725960 - DNA, 13 bp, Homo sapiens
ttagaattaaaaa

SEQ ID NO: 1725961 - DNA, 15 bp, Homo sapiens
ttagacaactagatt

SEQ ID NO: 1725962 - DNA, 23 bp, Homo sapiens
ttagacaactagatttgtccttt

SEQ ID NO: 1725963 - DNA, 14 bp, Homo sapiens
ttagacagaacacc

SEQ ID NO: 1725964 - DNA, 20 bp, Homo sapiens
ttagactgtagcctggatat

SEQ ID NO: 1725965 - DNA, 21 bp, Homo sapiens
ttagacttcgactcaggatcc

SEQ ID NO: 1725966 - DNA, 18 bp, Homo sapiens
ttagagagcctgtcacca

SEQ ID NO: 1725967 - DNA, 22 bp, Homo sapiens
ttagagagcctgtcaccagagc

SEQ ID NO: 1725968 - DNA, 14 bp, Homo sapiens
ttagagataattgc

SEQ ID NO: 1725969 - DNA, 17 bp, Homo sapiens
ttagagataattgcttg

SEQ ID NO: 1725970 - DNA, 18 bp, Homo sapiens
ttagagataggaaactga

SEQ ID NO: 1725971 - DNA, 17 bp, Homo sapiens
ttagagatggagtttgc

SEQ ID NO: 1725972 - DNA, 18 bp, Homo sapiens
ttagagattttacaaaat

SEQ ID NO: 1725973 - DNA, 13 bp, Homo sapiens
ttagaggaaaagg

SEQ ID NO: 1725974 - DNA, 23 bp, Homo sapiens
ttagaggcattcagttagcaaag

SEQ ID NO: 1725975 - DNA, 12 bp, Homo sapiens
ttagaggccagc

SEQ ID NO: 1725976 - DNA, 20 bp, Homo sapiens
ttagaggttttaaagtgatt

SEQ ID NO: 1725977 - DNA, 22 bp, Homo sapiens
ttagagtatttcccttccaaag

SEQ ID NO: 1725978 - DNA, 14 bp, Homo sapiens
ttagagtcagcctt

SEQ ID NO: 1725979 - DNA, 14 bp, Homo sapiens
ttagagttcttctt

SEQ ID NO: 1725980 - DNA, 19 bp, Homo sapiens
ttagataaacacaggcagg

SEQ ID NO: 1725981 - DNA, 22 bp, Homo sapiens
ttagataataactgtcttctgg

SEQ ID NO: 1725982 - DNA, 13 bp, Homo sapiens
ttagatatttgcc

SEQ ID NO: 1725983 - DNA, 22 bp, Homo sapiens
ttagatatttgcctgtctgttt

SEQ ID NO: 1725984 - DNA, 18 bp, Homo sapiens
ttagatcccatgtcacct

SEQ ID NO: 1725985 - DNA, 17 bp, Homo sapiens
ttagatggattctccac

SEQ ID NO: 1725986 - DNA, 16 bp, Homo sapiens
ttagatgttgccatgt

SEQ ID NO: 1725987 - DNA, 22 bp, Homo sapiens
ttagattctctgtgtctaagat

SEQ ID NO: 1725988 - DNA, 14 bp, Homo sapiens
ttagattgtgttcc

SEQ ID NO: 1725989 - DNA, 14 bp, Homo sapiens
ttagatttctttga

SEQ ID NO: 1725990 - DNA, 12 bp, Homo sapiens
ttagatttgtgc

SEQ ID NO: 1725991 - DNA, 19 bp, Homo sapiens
ttagattttctggttctaa

SEQ ID NO: 1725992 - DNA, 20 bp, Homo sapiens
ttagattttctggttctaac

SEQ ID NO: 1725993 - DNA, 21 bp, Homo sapiens
ttagattttctggttctaaca

SEQ ID NO: 1725994 - DNA, 16 bp, Homo sapiens
ttagattttgtgttta

SEQ ID NO: 1725995 - DNA, 18 bp, Homo sapiens
ttagattttgtgtttatt

SEQ ID NO: 1725996 - DNA, 18 bp, Homo sapiens
ctaggcatacactgtagt

SEQ ID NO: 1725997 - DNA, 18 bp, Homo sapiens
ctaggcattgcaggacct

SEQ ID NO: 1725998 - DNA, 22 bp, Homo sapiens
ctaggccaaatgcacaagctca

SEQ ID NO: 1725999 - DNA, 17 bp, Homo sapiens
ctaggccactcctccaa

SEQ ID NO: 1726000 - DNA, 21 bp, Homo sapiens
ctaggcccattgtcctccttt

SEQ ID NO: 1726001 - DNA, 22 bp, Homo sapiens
ctaggcccccaaattgccttca

SEQ ID NO: 1726002 - DNA, 20 bp, Homo sapiens
ctaggcccccacttgcctct

SEQ ID NO: 1726003 - DNA, 18 bp, Homo sapiens
ttagcattttaattctct

SEQ ID NO: 1726004 - DNA, 18 bp, Homo sapiens
ttagcatttttatgcaga

SEQ ID NO: 1726005 - DNA, 21 bp, Homo sapiens
ttagcatttttatgcagacag

SEQ ID NO: 1726006 - DNA, 22 bp, Homo sapiens
ttagccaactgtttccctgctg

SEQ ID NO: 1726007 - DNA, 20 bp, Homo sapiens
ttagccactggtttctcaga

SEQ ID NO: 1726008 - DNA, 21 bp, Homo sapiens
ttagccagttcaaagtgtata

SEQ ID NO: 1726009 - DNA, 22 bp, Homo sapiens
ttagcccaagaggtctgagccc

SEQ ID NO: 1726010 - DNA, 18 bp, Homo sapiens
ttagccccagaaaatgaa

SEQ ID NO: 1726011 - DNA, 21 bp, Homo sapiens
ttagccgggcatgatggtgca

SEQ ID NO: 1726012 - DNA, 12 bp, Homo sapiens
ttagcctctccc

SEQ ID NO: 1726013 - DNA, 13 bp, Homo sapiens
ttagcctctccca

SEQ ID NO: 1726014 - DNA, 17 bp, Homo sapiens
ttagcctctcccacccg

SEQ ID NO: 1726015 - DNA, 14 bp, Homo sapiens
ttagcctctggatc

SEQ ID NO: 1726016 - DNA, 20 bp, Homo sapiens
ttagcctctggatctagaag

SEQ ID NO: 1726017 - DNA, 18 bp, Homo sapiens
ttagcctttgccctgtca

SEQ ID NO: 1726018 - DNA, 16 bp, Homo sapiens
ttagcctttgtcccag

SEQ ID NO: 1726019 - DNA, 19 bp, Homo sapiens
ttagcgggactcagtgagc

SEQ ID NO: 1726020 - DNA, 16 bp, Homo sapiens
ttagcgtcaagacatt

SEQ ID NO: 1726021 - DNA, 18 bp, Homo sapiens
ttagcgtcaagacatttg

SEQ ID NO: 1726022 - DNA, 21 bp, Homo sapiens
ttagcgttctggactctgccc

SEQ ID NO: 1726023 - DNA, 17 bp, Homo sapiens
ttagctcactgaatctt

SEQ ID NO: 1726024 - DNA, 13 bp, Homo sapiens
ttagctcctgtgg

SEQ ID NO: 1726025 - DNA, 22 bp, Homo sapiens
ttagctctggacgtgaaatact

SEQ ID NO: 1726026 - DNA, 23 bp, Homo sapiens
ttagctctggacgtgaaatactt

SEQ ID NO: 1726027 - DNA, 23 bp, Homo sapiens
ttagctgatgaacttattctgta

SEQ ID NO: 1726028 - DNA, 16 bp, Homo sapiens
ttagctggcattacag

SEQ ID NO: 1726029 - DNA, 21 bp, Homo sapiens
ttagcttagacctcagcctgt

SEQ ID NO: 1726030 - DNA, 17 bp, Homo sapiens
ttagcttgcaccttgtc

SEQ ID NO: 1726031 - DNA, 15 bp, Homo sapiens
ttagctttactgttt

SEQ ID NO: 1726032 - DNA, 13 bp, Homo sapiens
ttagctttgaaac

SEQ ID NO: 1726033 - DNA, 14 bp, Homo sapiens
ttagctttgaaact

SEQ ID NO: 1726034 - DNA, 21 bp, Homo sapiens
ttaggaaaatcactttgtcta

SEQ ID NO: 1726035 - DNA, 16 bp, Homo sapiens
ttaggaaaggagatca

SEQ ID NO: 1726036 - DNA, 15 bp, Homo sapiens
ttaggaagagaaacc

SEQ ID NO: 1726037 - DNA, 15 bp, Homo sapiens
ttaggaatatgttca

SEQ ID NO: 1726038 - DNA, 12 bp, Homo sapiens
ttaggacaaatc

SEQ ID NO: 1726039 - DNA, 13 bp, Homo sapiens
ttaggacatctta

SEQ ID NO: 1726040 - DNA, 19 bp, Homo sapiens
ttaggaggctgcatgctct

SEQ ID NO: 1726041 - DNA, 20 bp, Homo sapiens
ttaggagtggttctcatttg

SEQ ID NO: 1726042 - DNA, 16 bp, Homo sapiens
ttaggatgtgtgcatg

SEQ ID NO: 1726043 - DNA, 11 bp, Homo sapiens
ttaggattcag

SEQ ID NO: 1726044 - DNA, 20 bp, Homo sapiens
ttaggattcaggcagcagtg

SEQ ID NO: 1726045 - DNA, 22 bp, Homo sapiens
ttaggatttaacagtcatttaa

SEQ ID NO: 1726046 - DNA, 13 bp, Homo sapiens
ttaggcagcagct

SEQ ID NO: 1726047 - DNA, 19 bp, Homo sapiens
ttaggcatttcctgctgaa

SEQ ID NO: 1726048 - DNA, 22 bp, Homo sapiens
ttaggccaaaaaaatgtaagat

SEQ ID NO: 1726049 - DNA, 10 bp, Homo sapiens
ttaggccagc

SEQ ID NO: 1726050 - DNA, 23 bp, Homo sapiens
ttaggctatttgtaaatctgcca

SEQ ID NO: 1726051 - DNA, 14 bp, Homo sapiens
ttaggctgtaacta

SEQ ID NO: 1726052 - DNA, 16 bp, Homo sapiens
ttaggcttttaagaaa

SEQ ID NO: 1726053 - DNA, 14 bp, Homo sapiens
ttagggaatgagag

SEQ ID NO: 1726054 - DNA, 21 bp, Homo sapiens
ttagggagagagaagcaggca

SEQ ID NO: 1726055 - DNA, 12 bp, Homo sapiens
ttagggaggggt

SEQ ID NO: 1726056 - DNA, 17 bp, Homo sapiens
ttagggcaccaggggtt

SEQ ID NO: 1726057 - DNA, 14 bp, Homo sapiens
ttagggcagcttgc

SEQ ID NO: 1726058 - DNA, 13 bp, Homo sapiens
ttagggctgcttt

SEQ ID NO: 1726059 - DNA, 17 bp, Homo sapiens
ttagggcttttattttt

SEQ ID NO: 1726060 - DNA, 15 bp, Homo sapiens
ttaggggttcattct

SEQ ID NO: 1726061 - DNA, 17 bp, Homo sapiens
ttaggggttctatttat

SEQ ID NO: 1726062 - DNA, 13 bp, Homo sapiens
ttagggttttgca

SEQ ID NO: 1726063 - DNA, 15 bp, Homo sapiens
ttagggttttgcaat

SEQ ID NO: 1726064 - DNA, 17 bp, Homo sapiens
ttagggttttgcaataa

SEQ ID NO: 1726065 - DNA, 14 bp, Homo sapiens
ttaggtgtctgtcc

SEQ ID NO: 1726066 - DNA, 20 bp, Homo sapiens
ttaggttaaaaaaaggcatt

SEQ ID NO: 1726067 - DNA, 15 bp, Homo sapiens
ttaggttatgctatt

SEQ ID NO: 1726068 - DNA, 22 bp, Homo sapiens
ttaggttccatcctttacgtgt

SEQ ID NO: 1726069 - DNA, 14 bp, Homo sapiens
ttaggttctaaagt

SEQ ID NO: 1726070 - DNA, 20 bp, Homo sapiens
ttaggtttactgtgaagaga

SEQ ID NO: 1726071 - DNA, 19 bp, Homo sapiens
ttaggtttttttgtatagt

SEQ ID NO: 1726072 - DNA, 18 bp, Homo sapiens
ttagtaagaaatttgcag

SEQ ID NO: 1726073 - DNA, 16 bp, Homo sapiens
ttagtacaataatctc

SEQ ID NO: 1726074 - DNA, 19 bp, Homo sapiens
ttagtactttgtgctcata

SEQ ID NO: 1726075 - DNA, 16 bp, Homo sapiens
ttagtatgcagttgat

SEQ ID NO: 1726076 - DNA, 15 bp, Homo sapiens
ttagtatgtctgttt

SEQ ID NO: 1726077 - DNA, 22 bp, Homo sapiens
ttagtatgtctgtttttgtatc

SEQ ID NO: 1726078 - DNA, 14 bp, Homo sapiens
ttagtattcattct

SEQ ID NO: 1726079 - DNA, 17 bp, Homo sapiens
ttagtattcattctgca

SEQ ID NO: 1726080 - DNA, 19 bp, Homo sapiens
ttagtatttatttatgtac

SEQ ID NO: 1726081 - DNA, 17 bp, Homo sapiens
ttagtatttcagtgttt

SEQ ID NO: 1726082 - DNA, 20 bp, Homo sapiens
ttagtatttcagtgttttca

SEQ ID NO: 1726083 - DNA, 15 bp, Homo sapiens
ttagtccccatcccg

SEQ ID NO: 1726084 - DNA, 18 bp, Homo sapiens
ttagtcgttatatttgac

SEQ ID NO: 1726085 - DNA, 12 bp, Homo sapiens
ttagtctcagtt

SEQ ID NO: 1726086 - DNA, 21 bp, Homo sapiens
ttagtctcagtttgtgtgtct

SEQ ID NO: 1726087 - DNA, 21 bp, Homo sapiens
ttagtgaaccaaaaatagaaa

SEQ ID NO: 1726088 - DNA, 15 bp, Homo sapiens
ttagtgattctgatt

SEQ ID NO: 1726089 - DNA, 18 bp, Homo sapiens
ttagtgattctgatttca

SEQ ID NO: 1726090 - DNA, 21 bp, Homo sapiens
ttagtgattctgatttcagtt

SEQ ID NO: 1726091 - DNA, 18 bp, Homo sapiens
ttagtgccacttaatgta

SEQ ID NO: 1726092 - DNA, 17 bp, Homo sapiens
ttagtgcttcagagttt

SEQ ID NO: 1726093 - DNA, 16 bp, Homo sapiens
ttagtggatggaatat

SEQ ID NO: 1726094 - DNA, 12 bp, Homo sapiens
ttagtggcaccg

SEQ ID NO: 1726095 - DNA, 13 bp, Homo sapiens
ttagtggcaccgc

SEQ ID NO: 1726096 - DNA, 16 bp, Homo sapiens
ttagtggctcaacatt

SEQ ID NO: 1726097 - DNA, 15 bp, Homo sapiens
ttagtggtatgtctc

SEQ ID NO: 1726098 - DNA, 16 bp, Homo sapiens
ttagtggtatgtctct

SEQ ID NO: 1726099 - DNA, 18 bp, Homo sapiens
ttagtggtatgtctcttt

SEQ ID NO: 1726100 - DNA, 19 bp, Homo sapiens
ttagtggtcataaaataga

SEQ ID NO: 1726101 - DNA, 18 bp, Homo sapiens
ttagtgtatgattactgg

SEQ ID NO: 1726102 - DNA, 13 bp, Homo sapiens
ttagtgtctgacc

SEQ ID NO: 1726103 - DNA, 17 bp, Homo sapiens
ttagtgtgacagtttcc

SEQ ID NO: 1726104 - DNA, 19 bp, Homo sapiens
ttagtgtgacagtttccaa

SEQ ID NO: 1726105 - DNA, 20 bp, Homo sapiens
ttagtgtgacagtttccaaa

SEQ ID NO: 1726106 - DNA, 16 bp, Homo sapiens
ttagtgtgtgtgcatg

SEQ ID NO: 1726107 - DNA, 15 bp, Homo sapiens
ttagttaatgagcca

SEQ ID NO: 1726108 - DNA, 18 bp, Homo sapiens
ttagttaccttatagtta

SEQ ID NO: 1726109 - DNA, 19 bp, Homo sapiens
ttagttaccttatagttac

SEQ ID NO: 1726110 - DNA, 13 bp, Homo sapiens
ttagttctgttga

SEQ ID NO: 1726111 - DNA, 22 bp, Homo sapiens
ttagttctgttgacctgtgcac

SEQ ID NO: 1726112 - DNA, 19 bp, Homo sapiens
ttagttctttttgccagtt

SEQ ID NO: 1726113 - DNA, 13 bp, Homo sapiens
ttagttgaaaaat

SEQ ID NO: 1726114 - DNA, 22 bp, Homo sapiens
ctataaccccagctccctagga

SEQ ID NO: 1726115 - DNA, 21 bp, Homo sapiens
ctataagcaaattgctttttt

SEQ ID NO: 1726116 - DNA, 14 bp, Homo sapiens
ctataaggtgcctc

SEQ ID NO: 1726117 - DNA, 22 bp, Homo sapiens
ctataagtagttggtttgtatg

SEQ ID NO: 1726118 - DNA, 15 bp, Homo sapiens
ttagttggctttgcc

SEQ ID NO: 1726119 - DNA, 22 bp, Homo sapiens
ttagttgggatgccaatttcct

SEQ ID NO: 1726120 - DNA, 20 bp, Homo sapiens
ttagttgtatctcttttgaa

SEQ ID NO: 1726121 - DNA, 17 bp, Homo sapiens
ttagtttaccaatcaac

SEQ ID NO: 1726122 - DNA, 21 bp, Homo sapiens
ttagtttagtgtgtgtgcaga

SEQ ID NO: 1726123 - DNA, 21 bp, Homo sapiens
ttagtttcaagagtctaaacc

SEQ ID NO: 1726124 - DNA, 22 bp, Homo sapiens
ttagtttgcagttacactaaaa

SEQ ID NO: 1726125 - DNA, 15 bp, Homo sapiens
ttagtttgtatatat

SEQ ID NO: 1726126 - DNA, 15 bp, Homo sapiens
ttagtttgtgtgttg

SEQ ID NO: 1726127 - DNA, 20 bp, Homo sapiens
ttagttttagaggcattgtt

SEQ ID NO: 1726128 - DNA, 13 bp, Homo sapiens
ttagttttgcata

SEQ ID NO: 1726129 - DNA, 23 bp, Homo sapiens
ttagtttttaacaatctaacaat

SEQ ID NO: 1726130 - DNA, 13 bp, Homo sapiens
ttagtttttcatt

SEQ ID NO: 1726131 - DNA, 16 bp, Homo sapiens
ttagtttttgatcaag

SEQ ID NO: 1726132 - DNA, 20 bp, Homo sapiens
ttagttttttttttttacaa

SEQ ID NO: 1726133 - DNA, 23 bp, Homo sapiens
ttagttttttttttttacaacta

SEQ ID NO: 1726134 - DNA, 17 bp, Homo sapiens
ttataaaaacaaaaaca

SEQ ID NO: 1726135 - DNA, 22 bp, Homo sapiens
ttataaaaccatcaaaaatatt

SEQ ID NO: 1726136 - DNA, 18 bp, Homo sapiens
ttataaaatcctgtgcaa

SEQ ID NO: 1726137 - DNA, 21 bp, Homo sapiens
ttataaaatgggaagactgag

SEQ ID NO: 1726138 - DNA, 13 bp, Homo sapiens
ttataaacaagaa

SEQ ID NO: 1726139 - DNA, 17 bp, Homo sapiens
ttataaacagaaatgga

SEQ ID NO: 1726140 - DNA, 20 bp, Homo sapiens
ttataaactaccaaattagt

SEQ ID NO: 1726141 - DNA, 14 bp, Homo sapiens
ttataaactataaa

SEQ ID NO: 1726142 - DNA, 22 bp, Homo sapiens
ttataaagataaaatatcctca

SEQ ID NO: 1726143 - DNA, 18 bp, Homo sapiens
ttataaataaaatcatgt

SEQ ID NO: 1726144 - DNA, 18 bp, Homo sapiens
ttataaattactatctgt

SEQ ID NO: 1726145 - DNA, 12 bp, Homo sapiens
ttataacaatat

SEQ ID NO: 1726146 - DNA, 18 bp, Homo sapiens
ttataacaatataactga

SEQ ID NO: 1726147 - DNA, 15 bp, Homo sapiens
ttataactaacatgt

SEQ ID NO: 1726148 - DNA, 18 bp, Homo sapiens
ttataagaagaagttcat

SEQ ID NO: 1726149 - DNA, 12 bp, Homo sapiens
ttataagactct

SEQ ID NO: 1726150 - DNA, 20 bp, Homo sapiens
ttataagactctcacactca

SEQ ID NO: 1726151 - DNA, 18 bp, Homo sapiens
ttataagtgactttaaac

SEQ ID NO: 1726152 - DNA, 15 bp, Homo sapiens
ttataagttctattt

SEQ ID NO: 1726153 - DNA, 18 bp, Homo sapiens
ttataataatgttaacat

SEQ ID NO: 1726154 - DNA, 15 bp, Homo sapiens
ttataatacaaataa

SEQ ID NO: 1726155 - DNA, 13 bp, Homo sapiens
ttataatatgtgc

SEQ ID NO: 1726156 - DNA, 14 bp, Homo sapiens
ttataatatgtgcc

SEQ ID NO: 1726157 - DNA, 15 bp, Homo sapiens
ttataatctcaaagg

SEQ ID NO: 1726158 - DNA, 13 bp, Homo sapiens
ttataatgtattc

SEQ ID NO: 1726159 - DNA, 20 bp, Homo sapiens
ttataatgttgtatttaatt

SEQ ID NO: 1726160 - DNA, 14 bp, Homo sapiens
ttataattctcatt

SEQ ID NO: 1726161 - DNA, 15 bp, Homo sapiens
ttataattgttgcat

SEQ ID NO: 1726162 - DNA, 16 bp, Homo sapiens
ttataatttttttcaa

SEQ ID NO: 1726163 - DNA, 19 bp, Homo sapiens
ttatacaagtaatttcctg

SEQ ID NO: 1726164 - DNA, 15 bp, Homo sapiens
ttatacaatatcatc

SEQ ID NO: 1726165 - DNA, 13 bp, Homo sapiens
ttatacagctgta

SEQ ID NO: 1726166 - DNA, 21 bp, Homo sapiens
ttataccagcttaatagctgt

SEQ ID NO: 1726167 - DNA, 18 bp, Homo sapiens
ttataccccaataatcaa

SEQ ID NO: 1726168 - DNA, 17 bp, Homo sapiens
ttatacccccaggaaac

SEQ ID NO: 1726169 - DNA, 17 bp, Homo sapiens
ttatactccatacataa

SEQ ID NO: 1726170 - DNA, 24 bp, Homo sapiens
ttatactgggacaccattaccaaa

SEQ ID NO: 1726171 - DNA, 14 bp, Homo sapiens
ttatactgtattaa

SEQ ID NO: 1726172 - DNA, 22 bp, Homo sapiens
ttatagaaggaatttgtacttc

SEQ ID NO: 1726173 - DNA, 12 bp, Homo sapiens
ttatagaataaa

SEQ ID NO: 1726174 - DNA, 16 bp, Homo sapiens
ttatagaataaaagct

SEQ ID NO: 1726175 - DNA, 23 bp, Homo sapiens
ttatagaataaaagctataaagt

SEQ ID NO: 1726176 - DNA, 15 bp, Homo sapiens
ttatagaatatttat

SEQ ID NO: 1726177 - DNA, 16 bp, Homo sapiens
ttatagacaaaagaat

SEQ ID NO: 1726178 - DNA, 23 bp, Homo sapiens
ttatagagtgtacttaactattc

SEQ ID NO: 1726179 - DNA, 17 bp, Homo sapiens
ttatagatatataaata

SEQ ID NO: 1726180 - DNA, 19 bp, Homo sapiens
ttatagatgtgagccagca

SEQ ID NO: 1726181 - DNA, 12 bp, Homo sapiens
ttatagattcta

SEQ ID NO: 1726182 - DNA, 15 bp, Homo sapiens
ttatagattctaaag

SEQ ID NO: 1726183 - DNA, 19 bp, Homo sapiens
ttatagattctaaagattc

SEQ ID NO: 1726184 - DNA, 20 bp, Homo sapiens
ttatagattctaaagattct

SEQ ID NO: 1726185 - DNA, 15 bp, Homo sapiens
ttatagatttagcta

SEQ ID NO: 1726186 - DNA, 18 bp, Homo sapiens
ttatagcaactaatgttt

SEQ ID NO: 1726187 - DNA, 22 bp, Homo sapiens
ttataggagaaagcaaaataca

SEQ ID NO: 1726188 - DNA, 18 bp, Homo sapiens
ttatagtatatctggaca

SEQ ID NO: 1726189 - DNA, 20 bp, Homo sapiens
ttatagtctaagactatata

SEQ ID NO: 1726190 - DNA, 17 bp, Homo sapiens
ttatagttgatatgtaa

SEQ ID NO: 1726191 - DNA, 12 bp, Homo sapiens
ttatataactgt

SEQ ID NO: 1726192 - DNA, 16 bp, Homo sapiens
ttatataagtattcta

SEQ ID NO: 1726193 - DNA, 15 bp, Homo sapiens
ttatatactgctatt

SEQ ID NO: 1726194 - DNA, 17 bp, Homo sapiens
ttatatacttagctata

SEQ ID NO: 1726195 - DNA, 12 bp, Homo sapiens
ttatatataata

SEQ ID NO: 1726196 - DNA, 15 bp, Homo sapiens
ttatatataataaat

SEQ ID NO: 1726197 - DNA, 17 bp, Homo sapiens
ttatatataataaatac

SEQ ID NO: 1726198 - DNA, 18 bp, Homo sapiens
ttatatataataaatact

SEQ ID NO: 1726199 - DNA, 13 bp, Homo sapiens
ttatatatatcta

SEQ ID NO: 1726200 - DNA, 13 bp, Homo sapiens
ttatatatgtgaa

SEQ ID NO: 1726201 - DNA, 23 bp, Homo sapiens
ttatatatttataactcatcata

SEQ ID NO: 1726202 - DNA, 14 bp, Homo sapiens
ttatatatttctaa

SEQ ID NO: 1726203 - DNA, 19 bp, Homo sapiens
ttatatatttctaactata

SEQ ID NO: 1726204 - DNA, 18 bp, Homo sapiens
ttatatcacacaatatag

SEQ ID NO: 1726205 - DNA, 16 bp, Homo sapiens
ttatatcatatgtata

SEQ ID NO: 1726206 - DNA, 18 bp, Homo sapiens
ttatatcatcaatacttt

SEQ ID NO: 1726207 - DNA, 16 bp, Homo sapiens
ttatatctggcctctg

SEQ ID NO: 1726208 - DNA, 14 bp, Homo sapiens
ttatatctgtaaat

SEQ ID NO: 1726209 - DNA, 15 bp, Homo sapiens
ttatatcttgtagct

SEQ ID NO: 1726210 - DNA, 22 bp, Homo sapiens
ttatatcttgtagctttatcaa

SEQ ID NO: 1726211 - DNA, 19 bp, Homo sapiens
ttatatgaagaaaatcact

SEQ ID NO: 1726212 - DNA, 13 bp, Homo sapiens
ttatatgcttact

SEQ ID NO: 1726213 - DNA, 19 bp, Homo sapiens
ttatatgctttttctcaga

SEQ ID NO: 1726214 - DNA, 20 bp, Homo sapiens
ttatatgctttttctcagat

SEQ ID NO: 1726215 - DNA, 18 bp, Homo sapiens
ttatatggaagaaagtaa

SEQ ID NO: 1726216 - DNA, 14 bp, Homo sapiens
ttatatgtactgtt

SEQ ID NO: 1726217 - DNA, 20 bp, Homo sapiens
ttatattaaagtaaatggca

SEQ ID NO: 1726218 - DNA, 19 bp, Homo sapiens
ttatattactgacatttct

SEQ ID NO: 1726219 - DNA, 16 bp, Homo sapiens
ttatattatttacatt

SEQ ID NO: 1726220 - DNA, 15 bp, Homo sapiens
ttatattgaagacaa

SEQ ID NO: 1726221 - DNA, 16 bp, Homo sapiens
ttatattgaagacaat

SEQ ID NO: 1726222 - DNA, 20 bp, Homo sapiens
ttatattgaagacaatttga

SEQ ID NO: 1726223 - DNA, 22 bp, Homo sapiens
ttatattggaattataaatatt

SEQ ID NO: 1726224 - DNA, 12 bp, Homo sapiens
ttatatttcctt

SEQ ID NO: 1726225 - DNA, 20 bp, Homo sapiens
ttatatttcctttatgtgaa

SEQ ID NO: 1726226 - DNA, 14 bp, Homo sapiens
ttatatttgacatg

SEQ ID NO: 1726227 - DNA, 15 bp, Homo sapiens
ttatatttgtaggag

SEQ ID NO: 1726228 - DNA, 15 bp, Homo sapiens
ttatattttatgaac

SEQ ID NO: 1726229 - DNA, 22 bp, Homo sapiens
ttatatttttgtacatattgtt

SEQ ID NO: 1726230 - DNA, 16 bp, Homo sapiens
ttatattttttcagtt

SEQ ID NO: 1726231 - DNA, 16 bp, Homo sapiens
ttatattttttctata

SEQ ID NO: 1726232 - DNA, 19 bp, Homo sapiens
ttatattttttgtctgttt

SEQ ID NO: 1726233 - DNA, 13 bp, Homo sapiens
ctatttctatgtc

SEQ ID NO: 1726234 - DNA, 14 bp, Homo sapiens
ctatttctatgtca

SEQ ID NO: 1726235 - DNA, 12 bp, Homo sapiens
ttatcaaaaagc

SEQ ID NO: 1726236 - DNA, 22 bp, Homo sapiens
ttatcaaaaagctaatgtgcag

SEQ ID NO: 1726237 - DNA, 16 bp, Homo sapiens
ttatcaaaaatttcat

SEQ ID NO: 1726238 - DNA, 19 bp, Homo sapiens
ttatcaaaccctagccttg

SEQ ID NO: 1726239 - DNA, 20 bp, Homo sapiens
ttatcaaatcagtcagtgca

SEQ ID NO: 1726240 - DNA, 16 bp, Homo sapiens
ttatcaagcaaaatgt

SEQ ID NO: 1726241 - DNA, 19 bp, Homo sapiens
ttatcaatatctaatatat

SEQ ID NO: 1726242 - DNA, 22 bp, Homo sapiens
ttatcaatttttcccagtattt

SEQ ID NO: 1726243 - DNA, 12 bp, Homo sapiens
ttatcacatttt

SEQ ID NO: 1726244 - DNA, 17 bp, Homo sapiens
ttatcacattttattaa

SEQ ID NO: 1726245 - DNA, 19 bp, Homo sapiens
ttatcacctcattctgaac

SEQ ID NO: 1726246 - DNA, 17 bp, Homo sapiens
ttatcacctctgatggc

SEQ ID NO: 1726247 - DNA, 17 bp, Homo sapiens
ttatcagtgacagagtt

SEQ ID NO: 1726248 - DNA, 16 bp, Homo sapiens
ttatcatccacattgt

SEQ ID NO: 1726249 - DNA, 15 bp, Homo sapiens
ttatcattaaaaatt

SEQ ID NO: 1726250 - DNA, 21 bp, Homo sapiens
ttatccaaaatgtgtatttct

SEQ ID NO: 1726251 - DNA, 23 bp, Homo sapiens
ttatcccaaagttgttgtaacct

SEQ ID NO: 1726252 - DNA, 14 bp, Homo sapiens
ttatccctctcttc

SEQ ID NO: 1726253 - DNA, 17 bp, Homo sapiens
ttatccctctcttcccc

SEQ ID NO: 1726254 - DNA, 19 bp, Homo sapiens
ttatccctctcttcccctt

SEQ ID NO: 1726255 - DNA, 15 bp, Homo sapiens
ttatccgaaagtttc

SEQ ID NO: 1726256 - DNA, 16 bp, Homo sapiens
ttatcctccaccgtct

SEQ ID NO: 1726257 - DNA, 13 bp, Homo sapiens
ttatcctctctct

SEQ ID NO: 1726258 - DNA, 20 bp, Homo sapiens
ttatcctgagtcccttaatc

SEQ ID NO: 1726259 - DNA, 21 bp, Homo sapiens
ttatcctgctagctgtagaaa

SEQ ID NO: 1726260 - DNA, 17 bp, Homo sapiens
ttatcctggcatgtgct

SEQ ID NO: 1726261 - DNA, 18 bp, Homo sapiens
ttatcctgtattcttgtt

SEQ ID NO: 1726262 - DNA, 24 bp, Homo sapiens
ttatccttttttaaaagtaaatgt

SEQ ID NO: 1726263 - DNA, 14 bp, Homo sapiens
ttatcgctttatgt

SEQ ID NO: 1726264 - DNA, 22 bp, Homo sapiens
ttatcggattactgaattgtat

SEQ ID NO: 1726265 - DNA, 22 bp, Homo sapiens
ttatcggctctattctctaaac

SEQ ID NO: 1726266 - DNA, 23 bp, Homo sapiens
ttatcgggaacagtgtttcccat

SEQ ID NO: 1726267 - DNA, 17 bp, Homo sapiens
ttatctaatttataaaa

SEQ ID NO: 1726268 - DNA, 23 bp, Homo sapiens
ttatctagaaagaaaagaccctg

SEQ ID NO: 1726269 - DNA, 14 bp, Homo sapiens
ttatctagcaagaa

SEQ ID NO: 1726270 - DNA, 15 bp, Homo sapiens
ttatctataatttac

SEQ ID NO: 1726271 - DNA, 22 bp, Homo sapiens
ttatctataatttacctaagat

SEQ ID NO: 1726272 - DNA, 14 bp, Homo sapiens
ttatctatagcaac

SEQ ID NO: 1726273 - DNA, 12 bp, Homo sapiens
ttatctctgtgt

SEQ ID NO: 1726274 - DNA, 19 bp, Homo sapiens
ttatctcttttatatttgt

SEQ ID NO: 1726275 - DNA, 15 bp, Homo sapiens
ttatctgcctggcct

SEQ ID NO: 1726276 - DNA, 21 bp, Homo sapiens
ttatctgtggagttcctgctc

SEQ ID NO: 1726277 - DNA, 13 bp, Homo sapiens
ttatctgttttct

SEQ ID NO: 1726278 - DNA, 23 bp, Homo sapiens
ttatctgttttctacctcctcct

SEQ ID NO: 1726279 - DNA, 15 bp, Homo sapiens
ttatcttacaatatt

SEQ ID NO: 1726280 - DNA, 20 bp, Homo sapiens
ttatcttacaatattgattg

SEQ ID NO: 1726281 - DNA, 17 bp, Homo sapiens
ttatcttatgccacggg

SEQ ID NO: 1726282 - DNA, 19 bp, Homo sapiens
ttatcttcaccctcatcct

SEQ ID NO: 1726283 - DNA, 22 bp, Homo sapiens
ttatcttctcaagttctaagat

SEQ ID NO: 1726284 - DNA, 17 bp, Homo sapiens
ttatcttgaagtcagcc

SEQ ID NO: 1726285 - DNA, 17 bp, Homo sapiens
ttatcttggttgaaaat

SEQ ID NO: 1726286 - DNA, 12 bp, Homo sapiens
ttatctttacca

SEQ ID NO: 1726287 - DNA, 12 bp, Homo sapiens
ttatctttatat

SEQ ID NO: 1726288 - DNA, 23 bp, Homo sapiens
ttatctttccatgggagccagct

SEQ ID NO: 1726289 - DNA, 16 bp, Homo sapiens
ttatcttttgtatatc

SEQ ID NO: 1726290 - DNA, 17 bp, Homo sapiens
ttatcttttgtatatct

SEQ ID NO: 1726291 - DNA, 18 bp, Homo sapiens
ttatgaaaggtttacatt

SEQ ID NO: 1726292 - DNA, 19 bp, Homo sapiens
ttatgaaattcaccccctt

SEQ ID NO: 1726293 - DNA, 14 bp, Homo sapiens
ttatgaacattgta

SEQ ID NO: 1726294 - DNA, 19 bp, Homo sapiens
ttatgaacattgtactgtt

SEQ ID NO: 1726295 - DNA, 23 bp, Homo sapiens
ttatgaagaaaatacttaaatgt

SEQ ID NO: 1726296 - DNA, 19 bp, Homo sapiens
ttatgatcaccatgtattt

SEQ ID NO: 1726297 - DNA, 18 bp, Homo sapiens
ttatgatctaataaactt

SEQ ID NO: 1726298 - DNA, 20 bp, Homo sapiens
ttatgatctaataaacttta

SEQ ID NO: 1726299 - DNA, 21 bp, Homo sapiens
ttatgatctggcccttgctta

SEQ ID NO: 1726300 - DNA, 17 bp, Homo sapiens
ttatgatgcaaatctgc

SEQ ID NO: 1726301 - DNA, 16 bp, Homo sapiens
ttatgatgcatacagt

SEQ ID NO: 1726302 - DNA, 18 bp, Homo sapiens
ttatgatgcatacagttt

SEQ ID NO: 1726303 - DNA, 19 bp, Homo sapiens
ttatgatttttttttcata

SEQ ID NO: 1726304 - DNA, 15 bp, Homo sapiens
ttatgcaaaagcagc

SEQ ID NO: 1726305 - DNA, 23 bp, Homo sapiens
ttatgcaaaagcagctaaatgta

SEQ ID NO: 1726306 - DNA, 14 bp, Homo sapiens
ttatgcaaatacaa

SEQ ID NO: 1726307 - DNA, 13 bp, Homo sapiens
ttatgcaagtcat

SEQ ID NO: 1726308 - DNA, 22 bp, Homo sapiens
ttatgcactgtggtttcagatg

SEQ ID NO: 1726309 - DNA, 18 bp, Homo sapiens
ttatgcacttttagaaat

SEQ ID NO: 1726310 - DNA, 17 bp, Homo sapiens
ttatgccagttgttaaa

SEQ ID NO: 1726311 - DNA, 15 bp, Homo sapiens
ttatgcctgagttat

SEQ ID NO: 1726312 - DNA, 14 bp, Homo sapiens
ttatgctcagggtc

SEQ ID NO: 1726313 - DNA, 17 bp, Homo sapiens
ttatgctctcactgttt

SEQ ID NO: 1726314 - DNA, 19 bp, Homo sapiens
ttatgctctcactgtttgt

SEQ ID NO: 1726315 - DNA, 14 bp, Homo sapiens
ttatgctgtcatgg

SEQ ID NO: 1726316 - DNA, 21 bp, Homo sapiens
ttatgcttccacaggcaaaac

SEQ ID NO: 1726317 - DNA, 19 bp, Homo sapiens
ttatggaagattttaaatt

SEQ ID NO: 1726318 - DNA, 16 bp, Homo sapiens
ttatggcagaagggaa

SEQ ID NO: 1726319 - DNA, 13 bp, Homo sapiens
ttatggcctcagc

SEQ ID NO: 1726320 - DNA, 14 bp, Homo sapiens
ttatggctgcatag

SEQ ID NO: 1726321 - DNA, 23 bp, Homo sapiens
ttatgggaaccccttcatcctct

SEQ ID NO: 1726322 - DNA, 19 bp, Homo sapiens
ttatgggaataattgcttt

SEQ ID NO: 1726323 - DNA, 15 bp, Homo sapiens
ttatgggatgtaaac

SEQ ID NO: 1726324 - DNA, 16 bp, Homo sapiens
ttatgggatgtaaaca

SEQ ID NO: 1726325 - DNA, 15 bp, Homo sapiens
ttatgggggggaggg

SEQ ID NO: 1726326 - DNA, 11 bp, Homo sapiens
ttatgggtcac

SEQ ID NO: 1726327 - DNA, 15 bp, Homo sapiens
ttatgggtcctgcaa

SEQ ID NO: 1726328 - DNA, 17 bp, Homo sapiens
ttatggttttgtgatgt

SEQ ID NO: 1726329 - DNA, 22 bp, Homo sapiens
ttatgtaaacaaatctttccat

SEQ ID NO: 1726330 - DNA, 20 bp, Homo sapiens
ttatgtactagtgttctgtt

SEQ ID NO: 1726331 - DNA, 15 bp, Homo sapiens
ttatgtagatgtgca

SEQ ID NO: 1726332 - DNA, 19 bp, Homo sapiens
ttatgtagtttcttgtctt

SEQ ID NO: 1726333 - DNA, 19 bp, Homo sapiens
ttatgtatcagtgtccttt

SEQ ID NO: 1726334 - DNA, 22 bp, Homo sapiens
ttatgtatcagtgtcctttcca

SEQ ID NO: 1726335 - DNA, 16 bp, Homo sapiens
ttatgtcagcagctct

SEQ ID NO: 1726336 - DNA, 13 bp, Homo sapiens
ttatgtcatactc

SEQ ID NO: 1726337 - DNA, 23 bp, Homo sapiens
ttatgtcatactctgtgtaatct

SEQ ID NO: 1726338 - DNA, 15 bp, Homo sapiens
ttatgtccactgtgt

SEQ ID NO: 1726339 - DNA, 13 bp, Homo sapiens
ttatgtctcttga

SEQ ID NO: 1726340 - DNA, 19 bp, Homo sapiens
ttatgtctcttgagcatca

SEQ ID NO: 1726341 - DNA, 21 bp, Homo sapiens
ttatgtctcttgagcatcaat

SEQ ID NO: 1726342 - DNA, 19 bp, Homo sapiens
ttatgtctgctgaataata

SEQ ID NO: 1726343 - DNA, 16 bp, Homo sapiens
ttatgtcttcttttgt

SEQ ID NO: 1726344 - DNA, 17 bp, Homo sapiens
ttatgtcttcttttgtg

SEQ ID NO: 1726345 - DNA, 18 bp, Homo sapiens
ttatgtgaaatgctttct

SEQ ID NO: 1726346 - DNA, 21 bp, Homo sapiens
ttatgtgaaatgctttctgta

SEQ ID NO: 1726347 - DNA, 13 bp, Homo sapiens
ctcaatcagtgca

SEQ ID NO: 1726348 - DNA, 15 bp, Homo sapiens
ctcaatccctgagga

SEQ ID NO: 1726349 - DNA, 22 bp, Homo sapiens
ctcaatcctaatttctcctccc

SEQ ID NO: 1726350 - DNA, 16 bp, Homo sapiens
ctcaatctccagggct

SEQ ID NO: 1726351 - DNA, 16 bp, Homo sapiens
ctcaatgaagccagct

SEQ ID NO: 1726352 - DNA, 12 bp, Homo sapiens
ctcaatgagctc

SEQ ID NO: 1726353 - DNA, 12 bp, Homo sapiens
ttatgtgtgtgt

SEQ ID NO: 1726354 - DNA, 23 bp, Homo sapiens
ttatgttaactagaatgcttttg

SEQ ID NO: 1726355 - DNA, 15 bp, Homo sapiens
ttatgttacatctgt

SEQ ID NO: 1726356 - DNA, 15 bp, Homo sapiens
ttatgttcctgctgt

SEQ ID NO: 1726357 - DNA, 19 bp, Homo sapiens
ttatgttcctgctgtattt

SEQ ID NO: 1726358 - DNA, 16 bp, Homo sapiens
ttatgttgtatgattc

SEQ ID NO: 1726359 - DNA, 15 bp, Homo sapiens
ttatgtttaaaaagt

SEQ ID NO: 1726360 - DNA, 15 bp, Homo sapiens
ttattaaaaacatga

SEQ ID NO: 1726361 - DNA, 16 bp, Homo sapiens
ttattaaaaacatgac

SEQ ID NO: 1726362 - DNA, 15 bp, Homo sapiens
ttattaaaacaaaag

SEQ ID NO: 1726363 - DNA, 22 bp, Homo sapiens
ttattaaacgatttctaaaatc

SEQ ID NO: 1726364 - DNA, 15 bp, Homo sapiens
ttattaaatgcttca

SEQ ID NO: 1726365 - DNA, 20 bp, Homo sapiens
ttattaaatttatttgaaaa

SEQ ID NO: 1726366 - DNA, 19 bp, Homo sapiens
ttattaacaaattatgtta

SEQ ID NO: 1726367 - DNA, 19 bp, Homo sapiens
ttattaagctttttggaat

SEQ ID NO: 1726368 - DNA, 13 bp, Homo sapiens
ttattaatgtttt

SEQ ID NO: 1726369 - DNA, 16 bp, Homo sapiens
ttattaatgttttcaa

SEQ ID NO: 1726370 - DNA, 22 bp, Homo sapiens
ttattaattgttttgcactttt

SEQ ID NO: 1726371 - DNA, 16 bp, Homo sapiens
ttattacaatgtatct

SEQ ID NO: 1726372 - DNA, 17 bp, Homo sapiens
ttattacaatgtatctt

SEQ ID NO: 1726373 - DNA, 13 bp, Homo sapiens
ttattacaatttt

SEQ ID NO: 1726374 - DNA, 14 bp, Homo sapiens
ttattacacaaaga

SEQ ID NO: 1726375 - DNA, 15 bp, Homo sapiens
ttattacctctgata

SEQ ID NO: 1726376 - DNA, 14 bp, Homo sapiens
ttattactattatt

SEQ ID NO: 1726377 - DNA, 20 bp, Homo sapiens
ttattagagattttctcttc

SEQ ID NO: 1726378 - DNA, 18 bp, Homo sapiens
ttattagcatttgtttta

SEQ ID NO: 1726379 - DNA, 18 bp, Homo sapiens
ttattagtttacatcatt

SEQ ID NO: 1726380 - DNA, 12 bp, Homo sapiens
ttattataaact

SEQ ID NO: 1726381 - DNA, 17 bp, Homo sapiens
ttattatatttgacatg

SEQ ID NO: 1726382 - DNA, 20 bp, Homo sapiens
ttattatgatgttagaagaa

SEQ ID NO: 1726383 - DNA, 14 bp, Homo sapiens
ttattatgcataaa

SEQ ID NO: 1726384 - DNA, 13 bp, Homo sapiens
ttattatgttctt

SEQ ID NO: 1726385 - DNA, 15 bp, Homo sapiens
ttattcaaaaaatca

SEQ ID NO: 1726386 - DNA, 20 bp, Homo sapiens
ttattcaaaaaatcatgttt

SEQ ID NO: 1726387 - DNA, 19 bp, Homo sapiens
ttattcaagaatgaaaaat

SEQ ID NO: 1726388 - DNA, 15 bp, Homo sapiens
ttattcacccctgcc

SEQ ID NO: 1726389 - DNA, 20 bp, Homo sapiens
ttattcacctttttaataaa

SEQ ID NO: 1726390 - DNA, 24 bp, Homo sapiens
ttattcataatgaattataacagt

SEQ ID NO: 1726391 - DNA, 12 bp, Homo sapiens
ttattcatttaa

SEQ ID NO: 1726392 - DNA, 16 bp, Homo sapiens
ttattcatttaaaatg

SEQ ID NO: 1726393 - DNA, 20 bp, Homo sapiens
ttattcctatatagtttatt

SEQ ID NO: 1726394 - DNA, 22 bp, Homo sapiens
ttattcctatatagtttattga

SEQ ID NO: 1726395 - DNA, 17 bp, Homo sapiens
ttattcctgataataat

SEQ ID NO: 1726396 - DNA, 17 bp, Homo sapiens
ttattcctgtatgttgt

SEQ ID NO: 1726397 - DNA, 19 bp, Homo sapiens
ttattctaaacagactcat

SEQ ID NO: 1726398 - DNA, 16 bp, Homo sapiens
ttattctcaaagcagg

SEQ ID NO: 1726399 - DNA, 20 bp, Homo sapiens
ttattctgtagattctgtgg

SEQ ID NO: 1726400 - DNA, 16 bp, Homo sapiens
ttattctgttttgcac

SEQ ID NO: 1726401 - DNA, 16 bp, Homo sapiens
ttattcttgctgggca

SEQ ID NO: 1726402 - DNA, 21 bp, Homo sapiens
ttattcttgctgggcatactt

SEQ ID NO: 1726403 - DNA, 12 bp, Homo sapiens
ttattcttggtt

SEQ ID NO: 1726404 - DNA, 22 bp, Homo sapiens
ttattctttttttctctagagt

SEQ ID NO: 1726405 - DNA, 18 bp, Homo sapiens
ttattgacaataatttca

SEQ ID NO: 1726406 - DNA, 12 bp, Homo sapiens
ttattgacactg

SEQ ID NO: 1726407 - DNA, 15 bp, Homo sapiens
ttattgacactgaac

SEQ ID NO: 1726408 - DNA, 22 bp, Homo sapiens
ttattgaccattttttaattta

SEQ ID NO: 1726409 - DNA, 17 bp, Homo sapiens
ttattgacgaactggct

SEQ ID NO: 1726410 - DNA, 23 bp, Homo sapiens
ttattgacgaactggctacagta

SEQ ID NO: 1726411 - DNA, 19 bp, Homo sapiens
ttattgagcccaaaaacaa

SEQ ID NO: 1726412 - DNA, 15 bp, Homo sapiens
ttattgataagttca

SEQ ID NO: 1726413 - DNA, 20 bp, Homo sapiens
ttattgataagttcatacat

SEQ ID NO: 1726414 - DNA, 14 bp, Homo sapiens
ttattgcagaatgt

SEQ ID NO: 1726415 - DNA, 18 bp, Homo sapiens
ttattgcctcccaggcaa

SEQ ID NO: 1726416 - DNA, 19 bp, Homo sapiens
ttattggaagtgttcaaga

SEQ ID NO: 1726417 - DNA, 15 bp, Homo sapiens
ttattggactccagg

SEQ ID NO: 1726418 - DNA, 20 bp, Homo sapiens
ttattggactccaggcctga

SEQ ID NO: 1726419 - DNA, 16 bp, Homo sapiens
ttattggctgagatat

SEQ ID NO: 1726420 - DNA, 22 bp, Homo sapiens
ttattggctgagatatgaacat

SEQ ID NO: 1726421 - DNA, 18 bp, Homo sapiens
ttattgtccttcagagct

SEQ ID NO: 1726422 - DNA, 17 bp, Homo sapiens
ttattgtgtgcgctgcc

SEQ ID NO: 1726423 - DNA, 17 bp, Homo sapiens
ttattgtttaaaatcat

SEQ ID NO: 1726424 - DNA, 21 bp, Homo sapiens
ttatttaaaaatatttcagat

SEQ ID NO: 1726425 - DNA, 16 bp, Homo sapiens
ttatttaaaagattca

SEQ ID NO: 1726426 - DNA, 18 bp, Homo sapiens
ttatttaaaagattcatt

SEQ ID NO: 1726427 - DNA, 12 bp, Homo sapiens
ttatttaaatga

SEQ ID NO: 1726428 - DNA, 14 bp, Homo sapiens
ttatttaaatttta

SEQ ID NO: 1726429 - DNA, 15 bp, Homo sapiens
ttatttaaggatgga

SEQ ID NO: 1726430 - DNA, 20 bp, Homo sapiens
ttatttaaggatggatggca

SEQ ID NO: 1726431 - DNA, 22 bp, Homo sapiens
ttatttaaggatggatggcacc

SEQ ID NO: 1726432 - DNA, 21 bp, Homo sapiens
ttatttacactggtctaatgt

SEQ ID NO: 1726433 - DNA, 13 bp, Homo sapiens
ttatttacattta

SEQ ID NO: 1726434 - DNA, 16 bp, Homo sapiens
ttatttacatttaata

SEQ ID NO: 1726435 - DNA, 22 bp, Homo sapiens
ttatttactgagcttctctgtg

SEQ ID NO: 1726436 - DNA, 17 bp, Homo sapiens
ttatttagactcatctt

SEQ ID NO: 1726437 - DNA, 18 bp, Homo sapiens
ttatttagactcatctta

SEQ ID NO: 1726438 - DNA, 23 bp, Homo sapiens
ttatttagactcatcttactgta

SEQ ID NO: 1726439 - DNA, 17 bp, Homo sapiens
ttatttagggaactgct

SEQ ID NO: 1726440 - DNA, 21 bp, Homo sapiens
ttatttagggaactgcttgac

SEQ ID NO: 1726441 - DNA, 20 bp, Homo sapiens
ttatttagggccttttctgt

SEQ ID NO: 1726442 - DNA, 21 bp, Homo sapiens
ttatttatatgtactgtttta

SEQ ID NO: 1726443 - DNA, 19 bp, Homo sapiens
ttatttatgacctgaaata

SEQ ID NO: 1726444 - DNA, 14 bp, Homo sapiens
ttatttatgcctct

SEQ ID NO: 1726445 - DNA, 13 bp, Homo sapiens
ttatttattcact

SEQ ID NO: 1726446 - DNA, 14 bp, Homo sapiens
ttatttcacttgat

SEQ ID NO: 1726447 - DNA, 21 bp, Homo sapiens
ttatttcactttagatgctga

SEQ ID NO: 1726448 - DNA, 22 bp, Homo sapiens
ttatttccaggtaatatgtctt

SEQ ID NO: 1726449 - DNA, 21 bp, Homo sapiens
ttatttcctatagctacatgt

SEQ ID NO: 1726450 - DNA, 13 bp, Homo sapiens
ttatttctaacta

SEQ ID NO: 1726451 - DNA, 22 bp, Homo sapiens
ttatttctagaagcacatgtgt

SEQ ID NO: 1726452 - DNA, 22 bp, Homo sapiens
ttatttctagtccaaaattaca

SEQ ID NO: 1726453 - DNA, 17 bp, Homo sapiens
ttatttctgctctggaa

SEQ ID NO: 1726454 - DNA, 12 bp, Homo sapiens
ttatttgaaaat

SEQ ID NO: 1726455 - DNA, 13 bp, Homo sapiens
ttatttgaatgaa

SEQ ID NO: 1726456 - DNA, 14 bp, Homo sapiens
ttatttgacaaaat

SEQ ID NO: 1726457 - DNA, 13 bp, Homo sapiens
ttatttggcataa

SEQ ID NO: 1726458 - DNA, 19 bp, Homo sapiens
ttatttggcataactgtga

SEQ ID NO: 1726459 - DNA, 13 bp, Homo sapiens
ttatttgtattac

SEQ ID NO: 1726460 - DNA, 13 bp, Homo sapiens
ttatttgtattca

SEQ ID NO: 1726461 - DNA, 20 bp, Homo sapiens
ttattttaaaatatatgaag

SEQ ID NO: 1726462 - DNA, 13 bp, Homo sapiens
ctcactaattttt

SEQ ID NO: 1726463 - DNA, 15 bp, Homo sapiens
ctcactaatttttgt

SEQ ID NO: 1726464 - DNA, 17 bp, Homo sapiens
ctcactaatttttgtat

SEQ ID NO: 1726465 - DNA, 17 bp, Homo sapiens
ctcactaccgtggacca

SEQ ID NO: 1726466 - DNA, 21 bp, Homo sapiens
ctcactactgaacacatgtgt

SEQ ID NO: 1726467 - DNA, 18 bp, Homo sapiens
ctcactaggcccccactt

SEQ ID NO: 1726468 - DNA, 13 bp, Homo sapiens
ctcactatatata

SEQ ID NO: 1726469 - DNA, 16 bp, Homo sapiens
ctcactatatatattt

SEQ ID NO: 1726470 - DNA, 22 bp, Homo sapiens
ctcactatgaatctattatact

SEQ ID NO: 1726471 - DNA, 17 bp, Homo sapiens
ctcactcaagaccaggc

SEQ ID NO: 1726472 - DNA, 18 bp, Homo sapiens
ttattttgtattacatct

SEQ ID NO: 1726473 - DNA, 16 bp, Homo sapiens
ttattttgttcataca

SEQ ID NO: 1726474 - DNA, 17 bp, Homo sapiens
ttattttgttcatacat

SEQ ID NO: 1726475 - DNA, 14 bp, Homo sapiens
ttatttttaaagat

SEQ ID NO: 1726476 - DNA, 18 bp, Homo sapiens
ttatttttataattgtac

SEQ ID NO: 1726477 - DNA, 10 bp, Homo sapiens
ttatttttct

SEQ ID NO: 1726478 - DNA, 14 bp, Homo sapiens
ttatttttctaaaa

SEQ ID NO: 1726479 - DNA, 19 bp, Homo sapiens
ttatttttctcttgtacca

SEQ ID NO: 1726480 - DNA, 20 bp, Homo sapiens
ttatttttctcttgtaccat

SEQ ID NO: 1726481 - DNA, 14 bp, Homo sapiens
ttatttttctgtga

SEQ ID NO: 1726482 - DNA, 11 bp, Homo sapiens
ttatttttgaa

SEQ ID NO: 1726483 - DNA, 23 bp, Homo sapiens
ttatttttgacagtgttgaaaat

SEQ ID NO: 1726484 - DNA, 17 bp, Homo sapiens
ttattttttaaatgtaa

SEQ ID NO: 1726485 - DNA, 16 bp, Homo sapiens
ttattttttaattatt

SEQ ID NO: 1726486 - DNA, 18 bp, Homo sapiens
ttattttttacattatta

SEQ ID NO: 1726487 - DNA, 19 bp, Homo sapiens
ttattttttagtgatgaga

SEQ ID NO: 1726488 - DNA, 20 bp, Homo sapiens
ttattttttctacacagtaa

SEQ ID NO: 1726489 - DNA, 23 bp, Homo sapiens
ttattttttggtggtgaaattga

SEQ ID NO: 1726490 - DNA, 24 bp, Homo sapiens
ttatttttttctacataattgtga

SEQ ID NO: 1726491 - DNA, 17 bp, Homo sapiens
ttcaaaaaaacactagt

SEQ ID NO: 1726492 - DNA, 18 bp, Homo sapiens
ttcaaaaaaataaaataa

SEQ ID NO: 1726493 - DNA, 18 bp, Homo sapiens
ttcaaaaaccagccaggc

SEQ ID NO: 1726494 - DNA, 21 bp, Homo sapiens
ttcaaaaagtcacagttaagg

SEQ ID NO: 1726495 - DNA, 15 bp, Homo sapiens
ttcaaaaatataact

SEQ ID NO: 1726496 - DNA, 19 bp, Homo sapiens
ttcaaaaccaaggaagcag

SEQ ID NO: 1726497 - DNA, 21 bp, Homo sapiens
ttcaaaagaatcagaaacagg

SEQ ID NO: 1726498 - DNA, 21 bp, Homo sapiens
ttcaaaaggtattatacatgt

SEQ ID NO: 1726499 - DNA, 12 bp, Homo sapiens
ttcaaaagtatt

SEQ ID NO: 1726500 - DNA, 19 bp, Homo sapiens
ttcaaaagtattgaaagcc

SEQ ID NO: 1726501 - DNA, 12 bp, Homo sapiens
ttcaaaagttcc

SEQ ID NO: 1726502 - DNA, 15 bp, Homo sapiens
ttcaaaagttccaag

SEQ ID NO: 1726503 - DNA, 16 bp, Homo sapiens
ttcaaaataaaaagta

SEQ ID NO: 1726504 - DNA, 17 bp, Homo sapiens
ttcaaaatagttctatt

SEQ ID NO: 1726505 - DNA, 21 bp, Homo sapiens
ttcaaaatagttctatttcta

SEQ ID NO: 1726506 - DNA, 22 bp, Homo sapiens
ttcaaaatcgtttttaatttaa

SEQ ID NO: 1726507 - DNA, 16 bp, Homo sapiens
ttcaaaatggagggaa

SEQ ID NO: 1726508 - DNA, 19 bp, Homo sapiens
ttcaaacatcagctgaatt

SEQ ID NO: 1726509 - DNA, 18 bp, Homo sapiens
ttcaaacctcaaatatag

SEQ ID NO: 1726510 - DNA, 14 bp, Homo sapiens
ttcaaactgctgca

SEQ ID NO: 1726511 - DNA, 13 bp, Homo sapiens
ttcaaactgtgaa

SEQ ID NO: 1726512 - DNA, 18 bp, Homo sapiens
ttcaaacttaaacaaaaa

SEQ ID NO: 1726513 - DNA, 21 bp, Homo sapiens
ttcaaacttaaacaaaaaact

SEQ ID NO: 1726514 - DNA, 19 bp, Homo sapiens
ttcaaacttactattttga

SEQ ID NO: 1726515 - DNA, 13 bp, Homo sapiens
ttcaaactttcac

SEQ ID NO: 1726516 - DNA, 17 bp, Homo sapiens
ttcaaactttcactttg

SEQ ID NO: 1726517 - DNA, 21 bp, Homo sapiens
ttcaaagacggagtattcttt

SEQ ID NO: 1726518 - DNA, 22 bp, Homo sapiens
ttcaaagaggtgaacattaaaa

SEQ ID NO: 1726519 - DNA, 13 bp, Homo sapiens
ttcaaagatgcat

SEQ ID NO: 1726520 - DNA, 18 bp, Homo sapiens
ttcaaagatgctgtgagt

SEQ ID NO: 1726521 - DNA, 23 bp, Homo sapiens
ttcaaagccaagtttatatacaa

SEQ ID NO: 1726522 - DNA, 13 bp, Homo sapiens
ttcaaagccctgc

SEQ ID NO: 1726523 - DNA, 20 bp, Homo sapiens
ttcaaagccctgcctctgtg

SEQ ID NO: 1726524 - DNA, 12 bp, Homo sapiens
ttcaaagccttc

SEQ ID NO: 1726525 - DNA, 17 bp, Homo sapiens
ttcaaagccttctccct

SEQ ID NO: 1726526 - DNA, 22 bp, Homo sapiens
ttcaaagctttttccagaggct

SEQ ID NO: 1726527 - DNA, 16 bp, Homo sapiens
ttcaaaggttctaggt

SEQ ID NO: 1726528 - DNA, 13 bp, Homo sapiens
ttcaaagtgtata

SEQ ID NO: 1726529 - DNA, 22 bp, Homo sapiens
ttcaaagtgtatatttattcat

SEQ ID NO: 1726530 - DNA, 21 bp, Homo sapiens
ttcaaagttttgttgtactta

SEQ ID NO: 1726531 - DNA, 15 bp, Homo sapiens
ttcaaatcagtgatc

SEQ ID NO: 1726532 - DNA, 13 bp, Homo sapiens
ttcaaatctgtaa

SEQ ID NO: 1726533 - DNA, 21 bp, Homo sapiens
ttcaaatctgtaatcagcaat

SEQ ID NO: 1726534 - DNA, 16 bp, Homo sapiens
ttcaaatgtttgaaaa

SEQ ID NO: 1726535 - DNA, 19 bp, Homo sapiens
ttcaaattagaagacattt

SEQ ID NO: 1726536 - DNA, 13 bp, Homo sapiens
ttcaaatttgtac

SEQ ID NO: 1726537 - DNA, 14 bp, Homo sapiens
ttcaaatttgtaca

SEQ ID NO: 1726538 - DNA, 15 bp, Homo sapiens
ttcaaatttgtacag

SEQ ID NO: 1726539 - DNA, 16 bp, Homo sapiens
ttcaaatttgtacagg

SEQ ID NO: 1726540 - DNA, 21 bp, Homo sapiens
ttcaacaaagaaacaaagatg

SEQ ID NO: 1726541 - DNA, 22 bp, Homo sapiens
ttcaacaaagaaacaaagatgt

SEQ ID NO: 1726542 - DNA, 13 bp, Homo sapiens
ttcaacaaatgat

SEQ ID NO: 1726543 - DNA, 15 bp, Homo sapiens
ttcaacacttatttt

SEQ ID NO: 1726544 - DNA, 17 bp, Homo sapiens
ttcaacatgagtgtatt

SEQ ID NO: 1726545 - DNA, 22 bp, Homo sapiens
ttcaaccagcctacaagctggc

SEQ ID NO: 1726546 - DNA, 17 bp, Homo sapiens
ttcaaccattccccatg

SEQ ID NO: 1726547 - DNA, 20 bp, Homo sapiens
ttcaaccattccccatggga

SEQ ID NO: 1726548 - DNA, 17 bp, Homo sapiens
ttcaacccacagctact

SEQ ID NO: 1726549 - DNA, 13 bp, Homo sapiens
ttcaacgcagccc

SEQ ID NO: 1726550 - DNA, 16 bp, Homo sapiens
ttcaacgcagccctgc

SEQ ID NO: 1726551 - DNA, 20 bp, Homo sapiens
ttcaacgcagccctgctttg

SEQ ID NO: 1726552 - DNA, 16 bp, Homo sapiens
ttcaacggaaagtgct

SEQ ID NO: 1726553 - DNA, 12 bp, Homo sapiens
ttcaactaatgt

SEQ ID NO: 1726554 - DNA, 19 bp, Homo sapiens
ttcaactgtcttcctcaaa

SEQ ID NO: 1726555 - DNA, 16 bp, Homo sapiens
ttcaacttttctaaga

SEQ ID NO: 1726556 - DNA, 23 bp, Homo sapiens
ttcaagaagttctttgattctgt

SEQ ID NO: 1726557 - DNA, 14 bp, Homo sapiens
ttcaagaccagcct

SEQ ID NO: 1726558 - DNA, 19 bp, Homo sapiens
ttcaagacttgagcggagc

SEQ ID NO: 1726559 - DNA, 23 bp, Homo sapiens
ttcaagagctagaaaaataaaat

SEQ ID NO: 1726560 - DNA, 18 bp, Homo sapiens
ttcaagagggcaagtgga

SEQ ID NO: 1726561 - DNA, 16 bp, Homo sapiens
ttcaagattgttgata

SEQ ID NO: 1726562 - DNA, 14 bp, Homo sapiens
ttcaagcaatcctc

SEQ ID NO: 1726563 - DNA, 19 bp, Homo sapiens
ttcaagcacaacccaccac

SEQ ID NO: 1726564 - DNA, 16 bp, Homo sapiens
ttcaagcacactggaa

SEQ ID NO: 1726565 - DNA, 17 bp, Homo sapiens
ttcaagcagtcgtgcct

SEQ ID NO: 1726566 - DNA, 18 bp, Homo sapiens
ttcaagcagtcgtgcctg

SEQ ID NO: 1726567 - DNA, 15 bp, Homo sapiens
ttcaagcattaagaa

SEQ ID NO: 1726568 - DNA, 12 bp, Homo sapiens
ttcaagcccagg

SEQ ID NO: 1726569 - DNA, 15 bp, Homo sapiens
ttcaagcccaggctt

SEQ ID NO: 1726570 - DNA, 20 bp, Homo sapiens
ttcaagcccaggcttcctgg

SEQ ID NO: 1726571 - DNA, 21 bp, Homo sapiens
ttcaagcgattctcctgcctc

SEQ ID NO: 1726572 - DNA, 22 bp, Homo sapiens
ttcaaggcactctagattccat

SEQ ID NO: 1726573 - DNA, 14 bp, Homo sapiens
ttcaaggcatttat

SEQ ID NO: 1726574 - DNA, 11 bp, Homo sapiens
ttcaaggcctt

SEQ ID NO: 1726575 - DNA, 12 bp, Homo sapiens
ttcaaggccttc

SEQ ID NO: 1726576 - DNA, 14 bp, Homo sapiens
ttcaaggccttcag

SEQ ID NO: 1726577 - DNA, 15 bp, Homo sapiens
tgtacattcttccat

SEQ ID NO: 1726578 - DNA, 18 bp, Homo sapiens
tgtacattcttccatcat

SEQ ID NO: 1726579 - DNA, 23 bp, Homo sapiens
tgtacattcttccatcatcactg

SEQ ID NO: 1726580 - DNA, 24 bp, Homo sapiens
tgtacattgtgagctctggttatt

SEQ ID NO: 1726581 - DNA, 18 bp, Homo sapiens
tgtacatttctataaata

SEQ ID NO: 1726582 - DNA, 13 bp, Homo sapiens
tgtaccaaaattt

SEQ ID NO: 1726583 - DNA, 14 bp, Homo sapiens
tgtaccaagtgaaa

SEQ ID NO: 1726584 - DNA, 16 bp, Homo sapiens
tgtaccaagtgaaatt

SEQ ID NO: 1726585 - DNA, 22 bp, Homo sapiens
tgtaccacttcctgaggcctca

SEQ ID NO: 1726586 - DNA, 14 bp, Homo sapiens
tgtaccagttaatt

SEQ ID NO: 1726587 - DNA, 14 bp, Homo sapiens
tgtaccatagaaaa

SEQ ID NO: 1726588 - DNA, 22 bp, Homo sapiens
tgtaccatagaaaaatgtataa

SEQ ID NO: 1726589 - DNA, 12 bp, Homo sapiens
tgtaccatcaat

SEQ ID NO: 1726590 - DNA, 18 bp, Homo sapiens
tgtaccattttaaagtta

SEQ ID NO: 1726591 - DNA, 18 bp, Homo sapiens
tgtacccctctcagtctg

SEQ ID NO: 1726592 - DNA, 16 bp, Homo sapiens
tgtacccttccacctc

SEQ ID NO: 1726593 - DNA, 20 bp, Homo sapiens
tgtacccttccacctcctag

SEQ ID NO: 1726594 - DNA, 15 bp, Homo sapiens
tgtaccctttaagat

SEQ ID NO: 1726595 - DNA, 23 bp, Homo sapiens
tgtaccgcccggcagccccttct

SEQ ID NO: 1726596 - DNA, 18 bp, Homo sapiens
tgtacctctaagtacata

SEQ ID NO: 1726597 - DNA, 17 bp, Homo sapiens
tgtacgtccagcctgcc

SEQ ID NO: 1726598 - DNA, 20 bp, Homo sapiens
tgtacgtttgtatgtgtgta

SEQ ID NO: 1726599 - DNA, 13 bp, Homo sapiens
tgtacgttttgca

SEQ ID NO: 1726600 - DNA, 20 bp, Homo sapiens
tgtacgttttgcacattttg

SEQ ID NO: 1726601 - DNA, 20 bp, Homo sapiens
tgtactaaacagtaagatat

SEQ ID NO: 1726602 - DNA, 20 bp, Homo sapiens
tgtactaagaatgtccttat

SEQ ID NO: 1726603 - DNA, 18 bp, Homo sapiens
tgtactaatctgagattg

SEQ ID NO: 1726604 - DNA, 22 bp, Homo sapiens
tgtactaatctgagattgtgtt

SEQ ID NO: 1726605 - DNA, 14 bp, Homo sapiens
tgtactacagctat

SEQ ID NO: 1726606 - DNA, 16 bp, Homo sapiens
tgtactacagctatat

SEQ ID NO: 1726607 - DNA, 18 bp, Homo sapiens
tgtactacagctatattt

SEQ ID NO: 1726608 - DNA, 18 bp, Homo sapiens
tgtactatcttatctcag

SEQ ID NO: 1726609 - DNA, 12 bp, Homo sapiens
tgtactatgtta

SEQ ID NO: 1726610 - DNA, 14 bp, Homo sapiens
tgtactcacatata

SEQ ID NO: 1726611 - DNA, 21 bp, Homo sapiens
tgtactcacatataacatgca

SEQ ID NO: 1726612 - DNA, 14 bp, Homo sapiens
tgtactcagagcag

SEQ ID NO: 1726613 - DNA, 18 bp, Homo sapiens
tgtactcaggaggctgag

SEQ ID NO: 1726614 - DNA, 21 bp, Homo sapiens
tgtactccagagggacagggt

SEQ ID NO: 1726615 - DNA, 19 bp, Homo sapiens
tgtactccagcctgggcaa

SEQ ID NO: 1726616 - DNA, 23 bp, Homo sapiens
tgtactcttccgatgtttgtgtc

SEQ ID NO: 1726617 - DNA, 23 bp, Homo sapiens
tgtactgaatttttttgtaataa

SEQ ID NO: 1726618 - DNA, 12 bp, Homo sapiens
tgtactgataaa

SEQ ID NO: 1726619 - DNA, 17 bp, Homo sapiens
tgtactgatttcagtaa

SEQ ID NO: 1726620 - DNA, 22 bp, Homo sapiens
tgtactgcaaagtcgccagtca

SEQ ID NO: 1726621 - DNA, 16 bp, Homo sapiens
tgtactggtaattgta

SEQ ID NO: 1726622 - DNA, 20 bp, Homo sapiens
tgtactggtaattgtacaat

SEQ ID NO: 1726623 - DNA, 18 bp, Homo sapiens
tgtactgttactgggccc

SEQ ID NO: 1726624 - DNA, 16 bp, Homo sapiens
tgtactgttctgtgtc

SEQ ID NO: 1726625 - DNA, 19 bp, Homo sapiens
tgtactgttctgtgtcttt

SEQ ID NO: 1726626 - DNA, 16 bp, Homo sapiens
tgtacttaataaattc

SEQ ID NO: 1726627 - DNA, 18 bp, Homo sapiens
tgtacttagctgtactat

SEQ ID NO: 1726628 - DNA, 17 bp, Homo sapiens
tgtacttcaaccagcct

SEQ ID NO: 1726629 - DNA, 21 bp, Homo sapiens
tgtacttcactgtcaggaaga

SEQ ID NO: 1726630 - DNA, 21 bp, Homo sapiens
tgtacttcccgggccagggct

SEQ ID NO: 1726631 - DNA, 17 bp, Homo sapiens
tgtacttctctgtgtgc

SEQ ID NO: 1726632 - DNA, 21 bp, Homo sapiens
tgtacttctctgtgtgcacac

SEQ ID NO: 1726633 - DNA, 16 bp, Homo sapiens
tgtacttctgtgttca

SEQ ID NO: 1726634 - DNA, 20 bp, Homo sapiens
tgtacttctgtgttcatttt

SEQ ID NO: 1726635 - DNA, 20 bp, Homo sapiens
tgtacttcttattgcaaggc

SEQ ID NO: 1726636 - DNA, 14 bp, Homo sapiens
tgtacttgtttgct

SEQ ID NO: 1726637 - DNA, 16 bp, Homo sapiens
tgtacttgtttgctat

SEQ ID NO: 1726638 - DNA, 20 bp, Homo sapiens
tgtactttatcatgaatgct

SEQ ID NO: 1726639 - DNA, 19 bp, Homo sapiens
tgtactttctgttaaaatg

SEQ ID NO: 1726640 - DNA, 22 bp, Homo sapiens
tgtactttgccatttttctata

SEQ ID NO: 1726641 - DNA, 18 bp, Homo sapiens
tgtacttttcattctctt

SEQ ID NO: 1726642 - DNA, 22 bp, Homo sapiens
tgtacttttcattctcttttaa

SEQ ID NO: 1726643 - DNA, 20 bp, Homo sapiens
tgtactttttagtaatttct

SEQ ID NO: 1726644 - DNA, 16 bp, Homo sapiens
tgtacttttttcttaa

SEQ ID NO: 1726645 - DNA, 21 bp, Homo sapiens
tgtagaaatgatgatgtggaa

SEQ ID NO: 1726646 - DNA, 17 bp, Homo sapiens
tgtagaacactaattca

SEQ ID NO: 1726647 - DNA, 21 bp, Homo sapiens
tgtagaactcactctgggctg

SEQ ID NO: 1726648 - DNA, 16 bp, Homo sapiens
tgtagaactcagcagt

SEQ ID NO: 1726649 - DNA, 13 bp, Homo sapiens
tgtagaagatgga

SEQ ID NO: 1726650 - DNA, 13 bp, Homo sapiens
tgtagaaggcaca

SEQ ID NO: 1726651 - DNA, 16 bp, Homo sapiens
tgtagaatgatttcat

SEQ ID NO: 1726652 - DNA, 17 bp, Homo sapiens
tgtagaattgaaaatgc

SEQ ID NO: 1726653 - DNA, 19 bp, Homo sapiens
tgtagaatttgaaatggtt

SEQ ID NO: 1726654 - DNA, 19 bp, Homo sapiens
tgtagacaaagtacattct

SEQ ID NO: 1726655 - DNA, 17 bp, Homo sapiens
tgtagagacaatacagt

SEQ ID NO: 1726656 - DNA, 22 bp, Homo sapiens
tgtagagtaacacataacattg

SEQ ID NO: 1726657 - DNA, 17 bp, Homo sapiens
tgtagagtgtagactgt

SEQ ID NO: 1726658 - DNA, 20 bp, Homo sapiens
tgtagagttgctgagagggc

SEQ ID NO: 1726659 - DNA, 20 bp, Homo sapiens
tgtagagttttgtcattcag

SEQ ID NO: 1726660 - DNA, 21 bp, Homo sapiens
tgtagatagttaaaagactgc

SEQ ID NO: 1726661 - DNA, 19 bp, Homo sapiens
tgtagatattgtgaagtac

SEQ ID NO: 1726662 - DNA, 21 bp, Homo sapiens
tgtagatattgttttctgtaa

SEQ ID NO: 1726663 - DNA, 14 bp, Homo sapiens
tgtagatcaggttt

SEQ ID NO: 1726664 - DNA, 15 bp, Homo sapiens
tgtagatcaggtttg

SEQ ID NO: 1726665 - DNA, 12 bp, Homo sapiens
tgtagatgatgt

SEQ ID NO: 1726666 - DNA, 19 bp, Homo sapiens
tgtagatgctaacgtgtca

SEQ ID NO: 1726667 - DNA, 20 bp, Homo sapiens
tgtagcaaccttctgcattc

SEQ ID NO: 1726668 - DNA, 13 bp, Homo sapiens
tgtagcactgagg

SEQ ID NO: 1726669 - DNA, 12 bp, Homo sapiens
tgtagcacttac

SEQ ID NO: 1726670 - DNA, 21 bp, Homo sapiens
tgtagcacttacgtaaaacat

SEQ ID NO: 1726671 - DNA, 12 bp, Homo sapiens
tgtagcagaaag

SEQ ID NO: 1726672 - DNA, 13 bp, Homo sapiens
tgtagcagaaagg

SEQ ID NO: 1726673 - DNA, 15 bp, Homo sapiens
tgtagcatataggtg

SEQ ID NO: 1726674 - DNA, 18 bp, Homo sapiens
tgtagcatttcttgatgt

SEQ ID NO: 1726675 - DNA, 16 bp, Homo sapiens
tgtagccactggcata

SEQ ID NO: 1726676 - DNA, 14 bp, Homo sapiens
tgtagccatggctc

SEQ ID NO: 1726677 - DNA, 21 bp, Homo sapiens
tgtagccatggctcaggcaag

SEQ ID NO: 1726678 - DNA, 18 bp, Homo sapiens
tgtagccccctggcctct

SEQ ID NO: 1726679 - DNA, 13 bp, Homo sapiens
tgtagcctgtgca

SEQ ID NO: 1726680 - DNA, 22 bp, Homo sapiens
tgtagctcagtcatcaaagcag

SEQ ID NO: 1726681 - DNA, 20 bp, Homo sapiens
tgtagctcccctgctgaggc

SEQ ID NO: 1726682 - DNA, 18 bp, Homo sapiens
tgtagctccctcctccca

SEQ ID NO: 1726683 - DNA, 21 bp, Homo sapiens
tgtagctccctcctcccatct

SEQ ID NO: 1726684 - DNA, 11 bp, Homo sapiens
tgtagctccta

SEQ ID NO: 1726685 - DNA, 13 bp, Homo sapiens
tgtagctgatgaa

SEQ ID NO: 1726686 - DNA, 14 bp, Homo sapiens
tgtagctggtttcc

SEQ ID NO: 1726687 - DNA, 20 bp, Homo sapiens
tgtagctgtaagggcagtgc

SEQ ID NO: 1726688 - DNA, 21 bp, Homo sapiens
tgtagctgtaagggcagtgcc

SEQ ID NO: 1726689 - DNA, 22 bp, Homo sapiens
tgtagctgtaagggcagtgccc

SEQ ID NO: 1726690 - DNA, 13 bp, Homo sapiens
tgtagctgtcctc

SEQ ID NO: 1726691 - DNA, 17 bp, Homo sapiens
tgtagctttcctggtcc

SEQ ID NO: 1726692 - DNA, 20 bp, Homo sapiens
tgtagctttcctggtccctc

SEQ ID NO: 1726693 - DNA, 23 bp, Homo sapiens
cctttcttgacaaaacctaactt

SEQ ID NO: 1726694 - DNA, 21 bp, Homo sapiens
cctttctttgcaacttcccag

SEQ ID NO: 1726695 - DNA, 17 bp, Homo sapiens
cctttctttgcctctgc

SEQ ID NO: 1726696 - DNA, 17 bp, Homo sapiens
cctttctttttcttctt

SEQ ID NO: 1726697 - DNA, 23 bp, Homo sapiens
cctttctttttcttcttccctcc

SEQ ID NO: 1726698 - DNA, 15 bp, Homo sapiens
cctttgaacgtgctt

SEQ ID NO: 1726699 - DNA, 16 bp, Homo sapiens
cctttgaacgtgcttc

SEQ ID NO: 1726700 - DNA, 18 bp, Homo sapiens
cctttgagaatgtgattc

SEQ ID NO: 1726701 - DNA, 20 bp, Homo sapiens
cctttgagatctggggaggc

SEQ ID NO: 1726702 - DNA, 13 bp, Homo sapiens
cctttgcactgag

SEQ ID NO: 1726703 - DNA, 19 bp, Homo sapiens
cctttgcactgagggccac

SEQ ID NO: 1726704 - DNA, 18 bp, Homo sapiens
cctttgcagttggactct

SEQ ID NO: 1726705 - DNA, 15 bp, Homo sapiens
cctttgccctgtcac

SEQ ID NO: 1726706 - DNA, 12 bp, Homo sapiens
cctttgctcccg

SEQ ID NO: 1726707 - DNA, 15 bp, Homo sapiens
cctttgctcccggca

SEQ ID NO: 1726708 - DNA, 13 bp, Homo sapiens
cctttgctctttc

SEQ ID NO: 1726709 - DNA, 17 bp, Homo sapiens
cctttgctgtgaggctg

SEQ ID NO: 1726710 - DNA, 20 bp, Homo sapiens
cctttggaacaagacagcct

SEQ ID NO: 1726711 - DNA, 21 bp, Homo sapiens
cctttggagaacgccagtctc

SEQ ID NO: 1726712 - DNA, 11 bp, Homo sapiens
cctttggcctg

SEQ ID NO: 1726713 - DNA, 16 bp, Homo sapiens
cctttggctggtagca

SEQ ID NO: 1726714 - DNA, 22 bp, Homo sapiens
cctttggctggtagcagcaggc

SEQ ID NO: 1726715 - DNA, 21 bp, Homo sapiens
cctttggcttctgatttttct

SEQ ID NO: 1726716 - DNA, 23 bp, Homo sapiens
cctttggcttctgatttttctct

SEQ ID NO: 1726717 - DNA, 19 bp, Homo sapiens
cctttgggaggctgaggcg

SEQ ID NO: 1726718 - DNA, 21 bp, Homo sapiens
cctttgggttctttctggggg

SEQ ID NO: 1726719 - DNA, 23 bp, Homo sapiens
cctttggtttgacaattttgtct

SEQ ID NO: 1726720 - DNA, 14 bp, Homo sapiens
cctttgtattctgt

SEQ ID NO: 1726721 - DNA, 18 bp, Homo sapiens
cctttgtcatctttcttc

SEQ ID NO: 1726722 - DNA, 16 bp, Homo sapiens
cctttgtcttgtactt

SEQ ID NO: 1726723 - DNA, 15 bp, Homo sapiens
cctttgtgtggctgc

SEQ ID NO: 1726724 - DNA, 20 bp, Homo sapiens
cctttgtgtggctgccccac

SEQ ID NO: 1726725 - DNA, 16 bp, Homo sapiens
cctttgtgtgtgtgtc

SEQ ID NO: 1726726 - DNA, 23 bp, Homo sapiens
cctttgttgtctacattaaatca

SEQ ID NO: 1726727 - DNA, 22 bp, Homo sapiens
cctttgtttaataaaggctgaa

SEQ ID NO: 1726728 - DNA, 21 bp, Homo sapiens
ccttttagcctagttcatcca

SEQ ID NO: 1726729 - DNA, 15 bp, Homo sapiens
ccttttcactacacc

SEQ ID NO: 1726730 - DNA, 19 bp, Homo sapiens
ccttttcactttattgcta

SEQ ID NO: 1726731 - DNA, 12 bp, Homo sapiens
ccttttcattta

SEQ ID NO: 1726732 - DNA, 16 bp, Homo sapiens
ccttttccacacgcat

SEQ ID NO: 1726733 - DNA, 13 bp, Homo sapiens
ccttttccccagg

SEQ ID NO: 1726734 - DNA, 15 bp, Homo sapiens
ccttttccccaggag

SEQ ID NO: 1726735 - DNA, 16 bp, Homo sapiens
ccttttccccaggagc

SEQ ID NO: 1726736 - DNA, 10 bp, Homo sapiens
ccttttccta

SEQ ID NO: 1726737 - DNA, 10 bp, Homo sapiens
ccttttcctt

SEQ ID NO: 1726738 - DNA, 14 bp, Homo sapiens
ccttttctcttttc

SEQ ID NO: 1726739 - DNA, 18 bp, Homo sapiens
ccttttcttttctaccct

SEQ ID NO: 1726740 - DNA, 12 bp, Homo sapiens
ccttttgaactt

SEQ ID NO: 1726741 - DNA, 22 bp, Homo sapiens
ccttttgaatacatttgtattt

SEQ ID NO: 1726742 - DNA, 13 bp, Homo sapiens
ccttttgacactg

SEQ ID NO: 1726743 - DNA, 15 bp, Homo sapiens
ccttttgacactgct

SEQ ID NO: 1726744 - DNA, 18 bp, Homo sapiens
ccttttgacactgctcta

SEQ ID NO: 1726745 - DNA, 16 bp, Homo sapiens
ccttttgatggggaga

SEQ ID NO: 1726746 - DNA, 22 bp, Homo sapiens
ccttttgatggggagaaagggc

SEQ ID NO: 1726747 - DNA, 12 bp, Homo sapiens
ccttttgcaccc

SEQ ID NO: 1726748 - DNA, 15 bp, Homo sapiens
ccttttgcacccctc

SEQ ID NO: 1726749 - DNA, 17 bp, Homo sapiens
ccttttgcacccctccc

SEQ ID NO: 1726750 - DNA, 19 bp, Homo sapiens
ccttttgcacccctcccat

SEQ ID NO: 1726751 - DNA, 20 bp, Homo sapiens
ccttttgcacccctcccatt

SEQ ID NO: 1726752 - DNA, 19 bp, Homo sapiens
ccttttgcagaagagggtg

SEQ ID NO: 1726753 - DNA, 17 bp, Homo sapiens
ccttttgcataagatta

SEQ ID NO: 1726754 - DNA, 14 bp, Homo sapiens
ccttttgcctggct

SEQ ID NO: 1726755 - DNA, 16 bp, Homo sapiens
ccttttgcctggctgt

SEQ ID NO: 1726756 - DNA, 18 bp, Homo sapiens
ccttttgcctggctgtgg

SEQ ID NO: 1726757 - DNA, 11 bp, Homo sapiens
ccttttgctct

SEQ ID NO: 1726758 - DNA, 19 bp, Homo sapiens
ccttttgctctctgtgacc

SEQ ID NO: 1726759 - DNA, 17 bp, Homo sapiens
ccttttggaacatttct

SEQ ID NO: 1726760 - DNA, 12 bp, Homo sapiens
ccttttggcact

SEQ ID NO: 1726761 - DNA, 15 bp, Homo sapiens
ccttttgtccccagg

SEQ ID NO: 1726762 - DNA, 19 bp, Homo sapiens
ccttttgtccccagggccc

SEQ ID NO: 1726763 - DNA, 20 bp, Homo sapiens
ccttttgtccccagggcccc

SEQ ID NO: 1726764 - DNA, 13 bp, Homo sapiens
cctttttatttat

SEQ ID NO: 1726765 - DNA, 17 bp, Homo sapiens
cctttttatttgcatgt

SEQ ID NO: 1726766 - DNA, 18 bp, Homo sapiens
cctttttatttgcatgtg

SEQ ID NO: 1726767 - DNA, 13 bp, Homo sapiens
cctttttcattta

SEQ ID NO: 1726768 - DNA, 17 bp, Homo sapiens
cctttttcccaataaat

SEQ ID NO: 1726769 - DNA, 17 bp, Homo sapiens
cctttttctccacactc

SEQ ID NO: 1726770 - DNA, 15 bp, Homo sapiens
cctttttgacactga

SEQ ID NO: 1726771 - DNA, 14 bp, Homo sapiens
ccttttttgaacca

SEQ ID NO: 1726772 - DNA, 10 bp, Homo sapiens
ccttttttgt

SEQ ID NO: 1726773 - DNA, 17 bp, Homo sapiens
ccttttttgtcccccaa

SEQ ID NO: 1726774 - DNA, 13 bp, Homo sapiens
ccttttttgtcta

SEQ ID NO: 1726775 - DNA, 16 bp, Homo sapiens
ccttttttgtctatga

SEQ ID NO: 1726776 - DNA, 19 bp, Homo sapiens
ccttttttgtctatgaagt

SEQ ID NO: 1726777 - DNA, 15 bp, Homo sapiens
cgaaaagagtcttcc

SEQ ID NO: 1726778 - DNA, 14 bp, Homo sapiens
cgaaaccccatctc

SEQ ID NO: 1726779 - DNA, 18 bp, Homo sapiens
cgaaagctctagaatctg

SEQ ID NO: 1726780 - DNA, 22 bp, Homo sapiens
cgaaaggatgtaaacagtgcct

SEQ ID NO: 1726781 - DNA, 14 bp, Homo sapiens
cgaaaggccttcag

SEQ ID NO: 1726782 - DNA, 21 bp, Homo sapiens
cgaaaggccttcagacacatg

SEQ ID NO: 1726783 - DNA, 22 bp, Homo sapiens
cgaaatgttattttttaattat

SEQ ID NO: 1726784 - DNA, 14 bp, Homo sapiens
cgaacagggacttg

SEQ ID NO: 1726785 - DNA, 12 bp, Homo sapiens
cgaaccaaggca

SEQ ID NO: 1726786 - DNA, 11 bp, Homo sapiens
cgaacccactc

SEQ ID NO: 1726787 - DNA, 18 bp, Homo sapiens
cgaagaaaaaaaataaca

SEQ ID NO: 1726788 - DNA, 21 bp, Homo sapiens
cgaagagggaatggatgggga

SEQ ID NO: 1726789 - DNA, 23 bp, Homo sapiens
cgaagagggaatggatggggaga

SEQ ID NO: 1726790 - DNA, 22 bp, Homo sapiens
cgaagaggggtggtggggggca

SEQ ID NO: 1726791 - DNA, 15 bp, Homo sapiens
cgaagagttcccttg

SEQ ID NO: 1726792 - DNA, 20 bp, Homo sapiens
cgaagctctggctgaaccct

SEQ ID NO: 1726793 - DNA, 18 bp, Homo sapiens
cgaaggaacctctcgcca

SEQ ID NO: 1726794 - DNA, 16 bp, Homo sapiens
cgaaggggaggcacac

SEQ ID NO: 1726795 - DNA, 19 bp, Homo sapiens
cgaaggggccccggggctg

SEQ ID NO: 1726796 - DNA, 17 bp, Homo sapiens
cgaagtctttgccttct

SEQ ID NO: 1726797 - DNA, 22 bp, Homo sapiens
cgaataaaggtcccatgctcca

SEQ ID NO: 1726798 - DNA, 18 bp, Homo sapiens
cgaatcccctccctgtca

SEQ ID NO: 1726799 - DNA, 15 bp, Homo sapiens
cgaatctcatccctc

SEQ ID NO: 1726800 - DNA, 22 bp, Homo sapiens
cgaatgaaaataactgaatttg

SEQ ID NO: 1726801 - DNA, 22 bp, Homo sapiens
cgaatgacggtaagtgttctca

SEQ ID NO: 1726802 - DNA, 14 bp, Homo sapiens
cgaatgggttttct

SEQ ID NO: 1726803 - DNA, 15 bp, Homo sapiens
cgaatgtgtacaact

SEQ ID NO: 1726804 - DNA, 20 bp, Homo sapiens
cgacaagagtgagactccac

SEQ ID NO: 1726805 - DNA, 16 bp, Homo sapiens
cgacactgctgcacca

SEQ ID NO: 1726806 - DNA, 21 bp, Homo sapiens
cgacactgctgcaccagagtg

SEQ ID NO: 1726807 - DNA, 14 bp, Homo sapiens
cgacagcattttaa

SEQ ID NO: 1726808 - DNA, 12 bp, Homo sapiens
cgacagcctggc

SEQ ID NO: 1726809 - DNA, 15 bp, Homo sapiens
cgacagcggccttga

SEQ ID NO: 1726810 - DNA, 15 bp, Homo sapiens
tgtaggaacaagcat

SEQ ID NO: 1726811 - DNA, 13 bp, Homo sapiens
tgtaggagaaact

SEQ ID NO: 1726812 - DNA, 22 bp, Homo sapiens
tgtaggagacttgccagagccg

SEQ ID NO: 1726813 - DNA, 23 bp, Homo sapiens
tgtaggagagtcggtctgctttg

SEQ ID NO: 1726814 - DNA, 12 bp, Homo sapiens
tgtaggagctgc

SEQ ID NO: 1726815 - DNA, 15 bp, Homo sapiens
tgtaggagctgcctt

SEQ ID NO: 1726816 - DNA, 17 bp, Homo sapiens
tgtaggcatcatgcatg

SEQ ID NO: 1726817 - DNA, 18 bp, Homo sapiens
tgtaggcatcatgcatgt

SEQ ID NO: 1726818 - DNA, 16 bp, Homo sapiens
tgtagggaaaccttgg

SEQ ID NO: 1726819 - DNA, 18 bp, Homo sapiens
tgtagggaaaccttggag

SEQ ID NO: 1726820 - DNA, 13 bp, Homo sapiens
tgtagggagggcg

SEQ ID NO: 1726821 - DNA, 19 bp, Homo sapiens
tgtaggggacgagaaagat

SEQ ID NO: 1726822 - DNA, 15 bp, Homo sapiens
tgtaggggccacctc

SEQ ID NO: 1726823 - DNA, 18 bp, Homo sapiens
tgtaggggccacctcctc

SEQ ID NO: 1726824 - DNA, 20 bp, Homo sapiens
tgtaggggccacctcctccc

SEQ ID NO: 1726825 - DNA, 18 bp, Homo sapiens
tgtagggtaaggtgcctt

SEQ ID NO: 1726826 - DNA, 23 bp, Homo sapiens
tgtagggtagcggaaaagttgtc

SEQ ID NO: 1726827 - DNA, 17 bp, Homo sapiens
tgtagggttataataat

SEQ ID NO: 1726828 - DNA, 14 bp, Homo sapiens
tgtaggtcctcaga

SEQ ID NO: 1726829 - DNA, 14 bp, Homo sapiens
tgtagtaaaagtgg

SEQ ID NO: 1726830 - DNA, 23 bp, Homo sapiens
tgtagtaaaagtggtctctgctg

SEQ ID NO: 1726831 - DNA, 19 bp, Homo sapiens
tgtagtaatgttttttaga

SEQ ID NO: 1726832 - DNA, 13 bp, Homo sapiens
tgtagtaatttat

SEQ ID NO: 1726833 - DNA, 18 bp, Homo sapiens
tgtagtattttttgtata

SEQ ID NO: 1726834 - DNA, 14 bp, Homo sapiens
tgtagtcccagcta

SEQ ID NO: 1726835 - DNA, 23 bp, Homo sapiens
tgtagtcctagccactcaggagg

SEQ ID NO: 1726836 - DNA, 12 bp, Homo sapiens
tgtagtctctga

SEQ ID NO: 1726837 - DNA, 12 bp, Homo sapiens
tgtagtcttgtc

SEQ ID NO: 1726838 - DNA, 18 bp, Homo sapiens
tgtagtctttttataggt

SEQ ID NO: 1726839 - DNA, 20 bp, Homo sapiens
tgtagtctttttataggttt

SEQ ID NO: 1726840 - DNA, 21 bp, Homo sapiens
tgtagtggaagagcagcctga

SEQ ID NO: 1726841 - DNA, 18 bp, Homo sapiens
tgtagtggccccctcctc

SEQ ID NO: 1726842 - DNA, 23 bp, Homo sapiens
tgtagtgtgtgcttacagtaact

SEQ ID NO: 1726843 - DNA, 18 bp, Homo sapiens
tgtagttctgtgtacttt

SEQ ID NO: 1726844 - DNA, 22 bp, Homo sapiens
tgtagttttccctgcactgtgt

SEQ ID NO: 1726845 - DNA, 19 bp, Homo sapiens
tgtagtttttatatgttgt

SEQ ID NO: 1726846 - DNA, 14 bp, Homo sapiens
tgtataaaaataaa

SEQ ID NO: 1726847 - DNA, 22 bp, Homo sapiens
tgtataaaaataaaaaagatcc

SEQ ID NO: 1726848 - DNA, 17 bp, Homo sapiens
tgtataaaaattatcaa

SEQ ID NO: 1726849 - DNA, 23 bp, Homo sapiens
tgtataaaaattatcaaaaagct

SEQ ID NO: 1726850 - DNA, 14 bp, Homo sapiens
tgtataaaatacat

SEQ ID NO: 1726851 - DNA, 15 bp, Homo sapiens
tgtataaaatagaca

SEQ ID NO: 1726852 - DNA, 19 bp, Homo sapiens
tgtataaaatccaaaatga

SEQ ID NO: 1726853 - DNA, 21 bp, Homo sapiens
tgtataaaatctgaattttgc

SEQ ID NO: 1726854 - DNA, 14 bp, Homo sapiens
tgtataaagaaact

SEQ ID NO: 1726855 - DNA, 17 bp, Homo sapiens
tgtataaagattgtact

SEQ ID NO: 1726856 - DNA, 13 bp, Homo sapiens
tgtataaataata

SEQ ID NO: 1726857 - DNA, 19 bp, Homo sapiens
tgtataaatggacctttta

SEQ ID NO: 1726858 - DNA, 15 bp, Homo sapiens
tgtataagtcaagca

SEQ ID NO: 1726859 - DNA, 16 bp, Homo sapiens
tgtataagtcaagcac

SEQ ID NO: 1726860 - DNA, 22 bp, Homo sapiens
tgtataagtcaagcacatgtaa

SEQ ID NO: 1726861 - DNA, 17 bp, Homo sapiens
tgtataagttgaaggaa

SEQ ID NO: 1726862 - DNA, 18 bp, Homo sapiens
tgtataagttgaaggaaa

SEQ ID NO: 1726863 - DNA, 15 bp, Homo sapiens
tgtataatatatatc

SEQ ID NO: 1726864 - DNA, 16 bp, Homo sapiens
tgtataatatatatct

SEQ ID NO: 1726865 - DNA, 17 bp, Homo sapiens
tgtataatatatatcta

SEQ ID NO: 1726866 - DNA, 20 bp, Homo sapiens
tgtataatattgaaaattga

SEQ ID NO: 1726867 - DNA, 21 bp, Homo sapiens
tgtataatattgaaaattgaa

SEQ ID NO: 1726868 - DNA, 14 bp, Homo sapiens
tgtataattggatt

SEQ ID NO: 1726869 - DNA, 19 bp, Homo sapiens
tgtataattggatttccta

SEQ ID NO: 1726870 - DNA, 22 bp, Homo sapiens
tgtatacattttgttatagaat

SEQ ID NO: 1726871 - DNA, 19 bp, Homo sapiens
tgtatactcctgtcaccta

SEQ ID NO: 1726872 - DNA, 16 bp, Homo sapiens
tgtatagaccaaagca

SEQ ID NO: 1726873 - DNA, 23 bp, Homo sapiens
tgtatagcttacctgaacaggaa

SEQ ID NO: 1726874 - DNA, 19 bp, Homo sapiens
tgtatagtgcctaaaattg

SEQ ID NO: 1726875 - DNA, 16 bp, Homo sapiens
tgtatagtgttcacaa

SEQ ID NO: 1726876 - DNA, 22 bp, Homo sapiens
tgtatagttttataaaactcag

SEQ ID NO: 1726877 - DNA, 14 bp, Homo sapiens
tgtatataaatgtg

SEQ ID NO: 1726878 - DNA, 17 bp, Homo sapiens
tgtatatacaataacat

SEQ ID NO: 1726879 - DNA, 18 bp, Homo sapiens
tgtatatacaataacata

SEQ ID NO: 1726880 - DNA, 14 bp, Homo sapiens
tgtatatatacatg

SEQ ID NO: 1726881 - DNA, 17 bp, Homo sapiens
tgtatatatattaagag

SEQ ID NO: 1726882 - DNA, 20 bp, Homo sapiens
tgtatatattttgtgtgaaa

SEQ ID NO: 1726883 - DNA, 22 bp, Homo sapiens
tgtatatattttgtgtgaaatt

SEQ ID NO: 1726884 - DNA, 18 bp, Homo sapiens
tgtatatgacatttaaat

SEQ ID NO: 1726885 - DNA, 19 bp, Homo sapiens
tgtatatggtatatataca

SEQ ID NO: 1726886 - DNA, 17 bp, Homo sapiens
tgtatatgttggtttaa

SEQ ID NO: 1726887 - DNA, 19 bp, Homo sapiens
tgtatatgtttatatactg

SEQ ID NO: 1726888 - DNA, 16 bp, Homo sapiens
tgtatattccaccatt

SEQ ID NO: 1726889 - DNA, 22 bp, Homo sapiens
tgtatatttattcataatgaat

SEQ ID NO: 1726890 - DNA, 16 bp, Homo sapiens
tgtatatttgtaaagc

SEQ ID NO: 1726891 - DNA, 22 bp, Homo sapiens
tgtatatttgtaaagctattta

SEQ ID NO: 1726892 - DNA, 17 bp, Homo sapiens
tgtatattttaatgaat

SEQ ID NO: 1726893 - DNA, 17 bp, Homo sapiens
tgtatcaaatctgtata

SEQ ID NO: 1726894 - DNA, 21 bp, Homo sapiens
tgtatcaaatctgtatatgtt

SEQ ID NO: 1726895 - DNA, 15 bp, Homo sapiens
tgtatcacaaatctt

SEQ ID NO: 1726896 - DNA, 16 bp, Homo sapiens
tgtatcacacctaatc

SEQ ID NO: 1726897 - DNA, 21 bp, Homo sapiens
tgtatcaggaaatatatatgt

SEQ ID NO: 1726898 - DNA, 15 bp, Homo sapiens
tgtatcattaatgta

SEQ ID NO: 1726899 - DNA, 18 bp, Homo sapiens
tgtatccattaacctggg

SEQ ID NO: 1726900 - DNA, 18 bp, Homo sapiens
tgtatccgtgaattgctt

SEQ ID NO: 1726901 - DNA, 19 bp, Homo sapiens
tgtatcctccctggcagac

SEQ ID NO: 1726902 - DNA, 14 bp, Homo sapiens
tgtatcctggggct

SEQ ID NO: 1726903 - DNA, 21 bp, Homo sapiens
tgtatccttccaatttggaat

SEQ ID NO: 1726904 - DNA, 18 bp, Homo sapiens
tgtatctaaaaaataact

SEQ ID NO: 1726905 - DNA, 21 bp, Homo sapiens
tgtatctaaaaaataactgtg

SEQ ID NO: 1726906 - DNA, 19 bp, Homo sapiens
tgtatctatttgtacaatt

SEQ ID NO: 1726907 - DNA, 17 bp, Homo sapiens
tgtatctcatactgtct

SEQ ID NO: 1726908 - DNA, 11 bp, Homo sapiens
tgtatctgtgt

SEQ ID NO: 1726909 - DNA, 16 bp, Homo sapiens
tgtatctgtgtagact

SEQ ID NO: 1726910 - DNA, 17 bp, Homo sapiens
tgtatctttatgctgta

SEQ ID NO: 1726911 - DNA, 14 bp, Homo sapiens
tgtatctttattaa

SEQ ID NO: 1726912 - DNA, 15 bp, Homo sapiens
tgtatctttattaaa

SEQ ID NO: 1726913 - DNA, 19 bp, Homo sapiens
tgtatctttctttctctaa

SEQ ID NO: 1726914 - DNA, 18 bp, Homo sapiens
tgtatgaaaaattgggga

SEQ ID NO: 1726915 - DNA, 22 bp, Homo sapiens
tgtatgaaaatccttttaacca

SEQ ID NO: 1726916 - DNA, 23 bp, Homo sapiens
tgtatgacagtgaagcagcactg

SEQ ID NO: 1726917 - DNA, 15 bp, Homo sapiens
tgtatgactaaagag

SEQ ID NO: 1726918 - DNA, 16 bp, Homo sapiens
tgtatgactaaagaga

SEQ ID NO: 1726919 - DNA, 21 bp, Homo sapiens
tgtatgactaaagagagaatg

SEQ ID NO: 1726920 - DNA, 20 bp, Homo sapiens
tgtatgagatggttaaaaag

SEQ ID NO: 1726921 - DNA, 15 bp, Homo sapiens
tgtatgatactaaag

SEQ ID NO: 1726922 - DNA, 18 bp, Homo sapiens
tgtatgatttaggcttct

SEQ ID NO: 1726923 - DNA, 13 bp, Homo sapiens
tgtatgatttgtt

SEQ ID NO: 1726924 - DNA, 12 bp, Homo sapiens
tgtatgccttta

SEQ ID NO: 1726925 - DNA, 14 bp, Homo sapiens
tgtatgctgatcat

SEQ ID NO: 1726926 - DNA, 15 bp, Homo sapiens
cgacagttctgaact

SEQ ID NO: 1726927 - DNA, 21 bp, Homo sapiens
cgacatccctcccccagcaga

SEQ ID NO: 1726928 - DNA, 23 bp, Homo sapiens
cgacatggctccggcctctgcct

SEQ ID NO: 1726929 - DNA, 21 bp, Homo sapiens
cgaccaggctggacaccctct

SEQ ID NO: 1726930 - DNA, 22 bp, Homo sapiens
cgaccaggctggacaccctctg

SEQ ID NO: 1726931 - DNA, 14 bp, Homo sapiens
cgaccccaaaggaa

SEQ ID NO: 1726932 - DNA, 22 bp, Homo sapiens
cgaccccaaaggaacactgaca

SEQ ID NO: 1726933 - DNA, 19 bp, Homo sapiens
cgaccccccgtgggctccc

SEQ ID NO: 1726934 - DNA, 21 bp, Homo sapiens
cgacccgggtctggtgctgag

SEQ ID NO: 1726935 - DNA, 13 bp, Homo sapiens
cgaccgccccagt

SEQ ID NO: 1726936 - DNA, 13 bp, Homo sapiens
cgaccgccccctc

SEQ ID NO: 1726937 - DNA, 13 bp, Homo sapiens
cgacctcagcctt

SEQ ID NO: 1726938 - DNA, 14 bp, Homo sapiens
cgacctcagccttc

SEQ ID NO: 1726939 - DNA, 12 bp, Homo sapiens
cgacctcggtgg

SEQ ID NO: 1726940 - DNA, 14 bp, Homo sapiens
cgaccttggccgca

SEQ ID NO: 1726941 - DNA, 16 bp, Homo sapiens
cgaccttggccgcacc

SEQ ID NO: 1726942 - DNA, 23 bp, Homo sapiens
cgacgccacagcccagccacgga

SEQ ID NO: 1726943 - DNA, 14 bp, Homo sapiens
cgacggctgtgacg

SEQ ID NO: 1726944 - DNA, 22 bp, Homo sapiens
cgacggtgggcatttgtgaggc

SEQ ID NO: 1726945 - DNA, 16 bp, Homo sapiens
cgactactgctcctgt

SEQ ID NO: 1726946 - DNA, 18 bp, Homo sapiens
cgactactgctcctgtgg

SEQ ID NO: 1726947 - DNA, 13 bp, Homo sapiens
cgactagccagga

SEQ ID NO: 1726948 - DNA, 16 bp, Homo sapiens
cgactccgttggccac

SEQ ID NO: 1726949 - DNA, 19 bp, Homo sapiens
cgactccgttggccactcc

SEQ ID NO: 1726950 - DNA, 20 bp, Homo sapiens
cgactctatagactctagga

SEQ ID NO: 1726951 - DNA, 16 bp, Homo sapiens
cgactctgcacccgcc

SEQ ID NO: 1726952 - DNA, 13 bp, Homo sapiens
cgactgcctgtct

SEQ ID NO: 1726953 - DNA, 14 bp, Homo sapiens
cgactgcctgtctc

SEQ ID NO: 1726954 - DNA, 20 bp, Homo sapiens
cgactggccagggccacgct

SEQ ID NO: 1726955 - DNA, 15 bp, Homo sapiens
cgactggctgtgaga

SEQ ID NO: 1726956 - DNA, 13 bp, Homo sapiens
cgactggtccagc

SEQ ID NO: 1726957 - DNA, 14 bp, Homo sapiens
cgactggtccagct

SEQ ID NO: 1726958 - DNA, 16 bp, Homo sapiens
cgactggtccagctct

SEQ ID NO: 1726959 - DNA, 17 bp, Homo sapiens
cgactggtccagctctg

SEQ ID NO: 1726960 - DNA, 18 bp, Homo sapiens
cgactggtccagctctga

SEQ ID NO: 1726961 - DNA, 19 bp, Homo sapiens
cgactgtcagtggggcagc

SEQ ID NO: 1726962 - DNA, 23 bp, Homo sapiens
cgactgtcagtggggcagcctct

SEQ ID NO: 1726963 - DNA, 19 bp, Homo sapiens
cgactgtcatgtggcttgg

SEQ ID NO: 1726964 - DNA, 21 bp, Homo sapiens
cgacttgctgttttgttctgt

SEQ ID NO: 1726965 - DNA, 20 bp, Homo sapiens
cgagaaataaagtttgctta

SEQ ID NO: 1726966 - DNA, 15 bp, Homo sapiens
cgagaaccctgagca

SEQ ID NO: 1726967 - DNA, 16 bp, Homo sapiens
cgagaactttcatttt

SEQ ID NO: 1726968 - DNA, 17 bp, Homo sapiens
cgagaactttcattttt

SEQ ID NO: 1726969 - DNA, 18 bp, Homo sapiens
cgagaaggggaaaaatgg

SEQ ID NO: 1726970 - DNA, 16 bp, Homo sapiens
cgagacacattgcctt

SEQ ID NO: 1726971 - DNA, 19 bp, Homo sapiens
cgagacaccatcctgagcc

SEQ ID NO: 1726972 - DNA, 13 bp, Homo sapiens
cgagaccagcctg

SEQ ID NO: 1726973 - DNA, 15 bp, Homo sapiens
cgagaccagcctggc

SEQ ID NO: 1726974 - DNA, 16 bp, Homo sapiens
cgagaccatcctggcc

SEQ ID NO: 1726975 - DNA, 18 bp, Homo sapiens
cgagaccatcctggcccc

SEQ ID NO: 1726976 - DNA, 17 bp, Homo sapiens
cgagaccatcctggcta

SEQ ID NO: 1726977 - DNA, 21 bp, Homo sapiens
cgagaccccatcttccagcca

SEQ ID NO: 1726978 - DNA, 15 bp, Homo sapiens
cgagacccccatcca

SEQ ID NO: 1726979 - DNA, 17 bp, Homo sapiens
cgagacccccatccagc

SEQ ID NO: 1726980 - DNA, 23 bp, Homo sapiens
cgagacccccatccagcctccag

SEQ ID NO: 1726981 - DNA, 18 bp, Homo sapiens
cgagagagctctggcccc

SEQ ID NO: 1726982 - DNA, 16 bp, Homo sapiens
cgagagatcaaagatg

SEQ ID NO: 1726983 - DNA, 16 bp, Homo sapiens
cgagagcagtgggcag

SEQ ID NO: 1726984 - DNA, 15 bp, Homo sapiens
cgagagcctgctccc

SEQ ID NO: 1726985 - DNA, 23 bp, Homo sapiens
cgagagctggccaaagagccttt

SEQ ID NO: 1726986 - DNA, 13 bp, Homo sapiens
cgagagggagaga

SEQ ID NO: 1726987 - DNA, 12 bp, Homo sapiens
cgagagggctgt

SEQ ID NO: 1726988 - DNA, 22 bp, Homo sapiens
cgagaggtgggccagtctgtgg

SEQ ID NO: 1726989 - DNA, 20 bp, Homo sapiens
cgagagtagccgagagcctg

SEQ ID NO: 1726990 - DNA, 21 bp, Homo sapiens
cgagatcacaccactgtactc

SEQ ID NO: 1726991 - DNA, 18 bp, Homo sapiens
cgagatccccagggcagc

SEQ ID NO: 1726992 - DNA, 16 bp, Homo sapiens
cgagatgtgacccacc

SEQ ID NO: 1726993 - DNA, 20 bp, Homo sapiens
cgagatgtgacccaccagtg

SEQ ID NO: 1726994 - DNA, 23 bp, Homo sapiens
cgagatgtgacccaccagtgcct

SEQ ID NO: 1726995 - DNA, 23 bp, Homo sapiens
cgagcacatagagctttttaata

SEQ ID NO: 1726996 - DNA, 17 bp, Homo sapiens
cgagcactggccagaga

SEQ ID NO: 1726997 - DNA, 19 bp, Homo sapiens
cgagcactggccagagagg

SEQ ID NO: 1726998 - DNA, 21 bp, Homo sapiens
cgagcactggccagagagggc

SEQ ID NO: 1726999 - DNA, 14 bp, Homo sapiens
cgagcagcccaggg

SEQ ID NO: 1727000 - DNA, 22 bp, Homo sapiens
cgagcagcccagggcctagagg

SEQ ID NO: 1727001 - DNA, 21 bp, Homo sapiens
cgagcagtcctgcctcagcct

SEQ ID NO: 1727002 - DNA, 23 bp, Homo sapiens
cgagcagtcctgcctcagcctcc

SEQ ID NO: 1727003 - DNA, 18 bp, Homo sapiens
cgagcatgggggctgcca

SEQ ID NO: 1727004 - DNA, 19 bp, Homo sapiens
cgagcatgggggctgccag

SEQ ID NO: 1727005 - DNA, 18 bp, Homo sapiens
cgagcattccagtaactt

SEQ ID NO: 1727006 - DNA, 14 bp, Homo sapiens
cgagccacaagctg

SEQ ID NO: 1727007 - DNA, 13 bp, Homo sapiens
cgagcccagctac

SEQ ID NO: 1727008 - DNA, 17 bp, Homo sapiens
cgagcccctccttctcc

SEQ ID NO: 1727009 - DNA, 18 bp, Homo sapiens
cgagcccctcggctctgg

SEQ ID NO: 1727010 - DNA, 11 bp, Homo sapiens
cgagccctgga

SEQ ID NO: 1727011 - DNA, 14 bp, Homo sapiens
cgagccctggagag

SEQ ID NO: 1727012 - DNA, 17 bp, Homo sapiens
cgagcggtggccccgag

SEQ ID NO: 1727013 - DNA, 17 bp, Homo sapiens
cgagctcgtgtatcctg

SEQ ID NO: 1727014 - DNA, 22 bp, Homo sapiens
cgagctcgtgtatcctggggct

SEQ ID NO: 1727015 - DNA, 13 bp, Homo sapiens
cgagctttctctc

SEQ ID NO: 1727016 - DNA, 22 bp, Homo sapiens
cgaggaaacgaaacccactcta

SEQ ID NO: 1727017 - DNA, 13 bp, Homo sapiens
cgaggaaaggatt

SEQ ID NO: 1727018 - DNA, 15 bp, Homo sapiens
cgaggaaaggatttt

SEQ ID NO: 1727019 - DNA, 23 bp, Homo sapiens
cgaggaaaggattttaccaaagc

SEQ ID NO: 1727020 - DNA, 18 bp, Homo sapiens
cgaggaactcgcctcagc

SEQ ID NO: 1727021 - DNA, 16 bp, Homo sapiens
cgaggaatctgtgggt

SEQ ID NO: 1727022 - DNA, 15 bp, Homo sapiens
cgaggacccaggaaa

SEQ ID NO: 1727023 - DNA, 11 bp, Homo sapiens
cgaggagctgg

SEQ ID NO: 1727024 - DNA, 14 bp, Homo sapiens
cgaggagctgggcc

SEQ ID NO: 1727025 - DNA, 13 bp, Homo sapiens
cgaggagtaacaa

SEQ ID NO: 1727026 - DNA, 16 bp, Homo sapiens
cgaggcaccggcgctg

SEQ ID NO: 1727027 - DNA, 20 bp, Homo sapiens
cgaggcaccggcgctgcagg

SEQ ID NO: 1727028 - DNA, 14 bp, Homo sapiens
cgaggcagggtcag

SEQ ID NO: 1727029 - DNA, 22 bp, Homo sapiens
cgaggcagggtcaggagagggg

SEQ ID NO: 1727030 - DNA, 22 bp, Homo sapiens
cgaggccacattgctggctgcc

SEQ ID NO: 1727031 - DNA, 15 bp, Homo sapiens
cgaggcccagcgggc

SEQ ID NO: 1727032 - DNA, 18 bp, Homo sapiens
cgaggcccagcgggcaga

SEQ ID NO: 1727033 - DNA, 19 bp, Homo sapiens
cgaggcccagcgggcagat

SEQ ID NO: 1727034 - DNA, 17 bp, Homo sapiens
cgaggcctaccccgcag

SEQ ID NO: 1727035 - DNA, 15 bp, Homo sapiens
cgaggctagaggcat

SEQ ID NO: 1727036 - DNA, 13 bp, Homo sapiens
cgaggctccccgc

SEQ ID NO: 1727037 - DNA, 13 bp, Homo sapiens
cgaggctgagaat

SEQ ID NO: 1727038 - DNA, 20 bp, Homo sapiens
cgaggctgcagtcagccctg

SEQ ID NO: 1727039 - DNA, 12 bp, Homo sapiens
cgaggctgcccc

SEQ ID NO: 1727040 - DNA, 15 bp, Homo sapiens
cgaggctgccccagg

SEQ ID NO: 1727041 - DNA, 19 bp, Homo sapiens
cgaggctgccccaggccgg

SEQ ID NO: 1727042 - DNA, 11 bp, Homo sapiens
cgaggctgcta

SEQ ID NO: 1727043 - DNA, 18 bp, Homo sapiens
cgagggcaacagggagca

SEQ ID NO: 1727044 - DNA, 16 bp, Homo sapiens
cgagggcagctgctat

SEQ ID NO: 1727045 - DNA, 21 bp, Homo sapiens
cgagggcagggaccacaccct

SEQ ID NO: 1727046 - DNA, 21 bp, Homo sapiens
cgagggctgatggaggaaaaa

SEQ ID NO: 1727047 - DNA, 14 bp, Homo sapiens
cgagggctggctgg

SEQ ID NO: 1727048 - DNA, 19 bp, Homo sapiens
cgagggctggctggcctca

SEQ ID NO: 1727049 - DNA, 16 bp, Homo sapiens
cgaggggaaaggcctg

SEQ ID NO: 1727050 - DNA, 13 bp, Homo sapiens
cgaggggagagag

SEQ ID NO: 1727051 - DNA, 18 bp, Homo sapiens
cgaggggtgtcttgggca

SEQ ID NO: 1727052 - DNA, 15 bp, Homo sapiens
cgagggtcctggctc

SEQ ID NO: 1727053 - DNA, 21 bp, Homo sapiens
cgaggtcaacagagaaggcag

SEQ ID NO: 1727054 - DNA, 13 bp, Homo sapiens
cgaggtctggcca

SEQ ID NO: 1727055 - DNA, 20 bp, Homo sapiens
cgaggtggatcacagaggct

SEQ ID NO: 1727056 - DNA, 23 bp, Homo sapiens
cgaggtggatcacagaggcttct

SEQ ID NO: 1727057 - DNA, 14 bp, Homo sapiens
cgagtcaaagttga

SEQ ID NO: 1727058 - DNA, 16 bp, Homo sapiens
cgagtcaatcccctca

SEQ ID NO: 1727059 - DNA, 15 bp, Homo sapiens
cgagtcacctgcaag

SEQ ID NO: 1727060 - DNA, 20 bp, Homo sapiens
cgagtcacctgcaagcccca

SEQ ID NO: 1727061 - DNA, 18 bp, Homo sapiens
cgagtcactgcctctccc

SEQ ID NO: 1727062 - DNA, 22 bp, Homo sapiens
cgagtcactgcctctccctggc

SEQ ID NO: 1727063 - DNA, 20 bp, Homo sapiens
cgagtctccgggactgccct

SEQ ID NO: 1727064 - DNA, 16 bp, Homo sapiens
cgagtctcttctccac

SEQ ID NO: 1727065 - DNA, 14 bp, Homo sapiens
cgagtgaatttcta

SEQ ID NO: 1727066 - DNA, 22 bp, Homo sapiens
cgagtgaatttctaaatgttgg

SEQ ID NO: 1727067 - DNA, 17 bp, Homo sapiens
cgagtgtagctgtgaaa

SEQ ID NO: 1727068 - DNA, 17 bp, Homo sapiens
cgagttctctttggaaa

SEQ ID NO: 1727069 - DNA, 23 bp, Homo sapiens
cgatacccaggaccaagccacag

SEQ ID NO: 1727070 - DNA, 20 bp, Homo sapiens
cgatactgcgactttctgcc

SEQ ID NO: 1727071 - DNA, 23 bp, Homo sapiens
cgatactgcgactttctgcctgg

SEQ ID NO: 1727072 - DNA, 22 bp, Homo sapiens
cgatcaacatttatgacctaag

SEQ ID NO: 1727073 - DNA, 20 bp, Homo sapiens
cgatcacaggccttgctttt

SEQ ID NO: 1727074 - DNA, 20 bp, Homo sapiens
cgatccacctgtctcagcct

SEQ ID NO: 1727075 - DNA, 13 bp, Homo sapiens
cgatcccctcccc

SEQ ID NO: 1727076 - DNA, 15 bp, Homo sapiens
cgatcccctccccca

SEQ ID NO: 1727077 - DNA, 22 bp, Homo sapiens
cgatctaaccccttacccatct

SEQ ID NO: 1727078 - DNA, 21 bp, Homo sapiens
cgatctcagctcactgcaagc

SEQ ID NO: 1727079 - DNA, 17 bp, Homo sapiens
cgatctctcctggccta

SEQ ID NO: 1727080 - DNA, 17 bp, Homo sapiens
cgatctcttattttaca

SEQ ID NO: 1727081 - DNA, 23 bp, Homo sapiens
cgatgaatttggagactctgtgg

SEQ ID NO: 1727082 - DNA, 21 bp, Homo sapiens
cgatgaggggacattttctgg

SEQ ID NO: 1727083 - DNA, 16 bp, Homo sapiens
cgatgcagctctcttt

SEQ ID NO: 1727084 - DNA, 23 bp, Homo sapiens
cgatgcatttaataaagatgagt

SEQ ID NO: 1727085 - DNA, 13 bp, Homo sapiens
cgatgccaccggc

SEQ ID NO: 1727086 - DNA, 14 bp, Homo sapiens
cgatgccaccggcc

SEQ ID NO: 1727087 - DNA, 15 bp, Homo sapiens
cgatgccagccttgg

SEQ ID NO: 1727088 - DNA, 12 bp, Homo sapiens
cgatgcctgatt

SEQ ID NO: 1727089 - DNA, 20 bp, Homo sapiens
cgatgctgctttcccctgtg

SEQ ID NO: 1727090 - DNA, 19 bp, Homo sapiens
cgatggggcaagacagaaa

SEQ ID NO: 1727091 - DNA, 22 bp, Homo sapiens
cgatggggcaagacagaaaagt

SEQ ID NO: 1727092 - DNA, 18 bp, Homo sapiens
cgatgtaggcattctgga

SEQ ID NO: 1727093 - DNA, 16 bp, Homo sapiens
cgatgtttgtgtcaca

SEQ ID NO: 1727094 - DNA, 19 bp, Homo sapiens
cgatgtttgtgtcacacaa

SEQ ID NO: 1727095 - DNA, 14 bp, Homo sapiens
cgattatacttgag

SEQ ID NO: 1727096 - DNA, 17 bp, Homo sapiens
cgattcaaactgctcca

SEQ ID NO: 1727097 - DNA, 18 bp, Homo sapiens
cgattctcccgcctcagc

SEQ ID NO: 1727098 - DNA, 23 bp, Homo sapiens
cgattctcctgtctcagcctcct

SEQ ID NO: 1727099 - DNA, 21 bp, Homo sapiens
cgattgcaggagtccctgcca

SEQ ID NO: 1727100 - DNA, 13 bp, Homo sapiens
cgattggctttaa

SEQ ID NO: 1727101 - DNA, 22 bp, Homo sapiens
cgatttcactaggactcagaaa

SEQ ID NO: 1727102 - DNA, 11 bp, Homo sapiens
cgatttctaaa

SEQ ID NO: 1727103 - DNA, 16 bp, Homo sapiens
cgatttctgctaagtt

SEQ ID NO: 1727104 - DNA, 17 bp, Homo sapiens
cgattttcaagattcta

SEQ ID NO: 1727105 - DNA, 16 bp, Homo sapiens
cgcaacccacagctca

SEQ ID NO: 1727106 - DNA, 12 bp, Homo sapiens
cgcaactcttgt

SEQ ID NO: 1727107 - DNA, 21 bp, Homo sapiens
cgcaagcctgtaatcccagct

SEQ ID NO: 1727108 - DNA, 14 bp, Homo sapiens
cgcaagctctcagc

SEQ ID NO: 1727109 - DNA, 15 bp, Homo sapiens
cgcaagctctcagca

SEQ ID NO: 1727110 - DNA, 16 bp, Homo sapiens
cgcaaggcctgtgctg

SEQ ID NO: 1727111 - DNA, 22 bp, Homo sapiens
cgcaaggcctgtgctgcatgcg

SEQ ID NO: 1727112 - DNA, 20 bp, Homo sapiens
cgcaagggcatcaggcactg

SEQ ID NO: 1727113 - DNA, 15 bp, Homo sapiens
cgcaagtctgcagcc

SEQ ID NO: 1727114 - DNA, 20 bp, Homo sapiens
cgcaatctcggctcactgca

SEQ ID NO: 1727115 - DNA, 20 bp, Homo sapiens
cgcaatgtggagcagcagcc

SEQ ID NO: 1727116 - DNA, 22 bp, Homo sapiens
cgcaattgtgggatgtcctctt

SEQ ID NO: 1727117 - DNA, 16 bp, Homo sapiens
cgcacaaggctgacca

SEQ ID NO: 1727118 - DNA, 17 bp, Homo sapiens
cgcacacagctgagcac

SEQ ID NO: 1727119 - DNA, 23 bp, Homo sapiens
cgcacatgccgcgggcggccagg

SEQ ID NO: 1727120 - DNA, 16 bp, Homo sapiens
cgcaccactgcttccc

SEQ ID NO: 1727121 - DNA, 22 bp, Homo sapiens
cgcaccactgcttcccactggg

SEQ ID NO: 1727122 - DNA, 16 bp, Homo sapiens
cgcaccagctgctctg

SEQ ID NO: 1727123 - DNA, 17 bp, Homo sapiens
cgcaccagctgctctgc

SEQ ID NO: 1727124 - DNA, 19 bp, Homo sapiens
cgcaccagctgctctgccc

SEQ ID NO: 1727125 - DNA, 20 bp, Homo sapiens
cgcaccagctgctctgcccc

SEQ ID NO: 1727126 - DNA, 23 bp, Homo sapiens
cgcaccagctgctctgccccttg

SEQ ID NO: 1727127 - DNA, 16 bp, Homo sapiens
cgcaccattctcctgc

SEQ ID NO: 1727128 - DNA, 21 bp, Homo sapiens
cgcaccattctcctgcctcag

SEQ ID NO: 1727129 - DNA, 20 bp, Homo sapiens
cgcaccccggcctcagggcg

SEQ ID NO: 1727130 - DNA, 13 bp, Homo sapiens
cgcaccctgcacc

SEQ ID NO: 1727131 - DNA, 13 bp, Homo sapiens
cgcacctaaagca

SEQ ID NO: 1727132 - DNA, 18 bp, Homo sapiens
cgcacgacgtcagcctct

SEQ ID NO: 1727133 - DNA, 15 bp, Homo sapiens
cgcacgcacacacac

SEQ ID NO: 1727134 - DNA, 13 bp, Homo sapiens
cgcagaagcagac

SEQ ID NO: 1727135 - DNA, 19 bp, Homo sapiens
cgcagacgggcacagacac

SEQ ID NO: 1727136 - DNA, 14 bp, Homo sapiens
cgcagagccctcca

SEQ ID NO: 1727137 - DNA, 21 bp, Homo sapiens
cgcagagccctccaggcctgc

SEQ ID NO: 1727138 - DNA, 14 bp, Homo sapiens
cgcagagctggccg

SEQ ID NO: 1727139 - DNA, 22 bp, Homo sapiens
cgcagatttttatgttttgaaa

SEQ ID NO: 1727140 - DNA, 14 bp, Homo sapiens
cgcagcaccctgca

SEQ ID NO: 1727141 - DNA, 18 bp, Homo sapiens
cgcagcaccctgcagagc

SEQ ID NO: 1727142 - DNA, 22 bp, Homo sapiens
cgcagcacccttctcggagacc

SEQ ID NO: 1727143 - DNA, 13 bp, Homo sapiens
cgcagccaaggcc

SEQ ID NO: 1727144 - DNA, 10 bp, Homo sapiens
cgcagccctg

SEQ ID NO: 1727145 - DNA, 15 bp, Homo sapiens
cgcagccctgctttg

SEQ ID NO: 1727146 - DNA, 24 bp, Homo sapiens
cgcagccctgctttgggctgccct

SEQ ID NO: 1727147 - DNA, 19 bp, Homo sapiens
cgcagcctgaagcctggat

SEQ ID NO: 1727148 - DNA, 15 bp, Homo sapiens
cgcagctaccctcag

SEQ ID NO: 1727149 - DNA, 21 bp, Homo sapiens
cgcagctaccctcagcctcca

SEQ ID NO: 1727150 - DNA, 13 bp, Homo sapiens
cgcagctcttgcc

SEQ ID NO: 1727151 - DNA, 17 bp, Homo sapiens
cgcagctcttgcccttc

SEQ ID NO: 1727152 - DNA, 18 bp, Homo sapiens
cgcagctcttgcccttcc

SEQ ID NO: 1727153 - DNA, 19 bp, Homo sapiens
cgcagctcttgcccttccc

SEQ ID NO: 1727154 - DNA, 20 bp, Homo sapiens
cgcagctcttgcccttccct

SEQ ID NO: 1727155 - DNA, 15 bp, Homo sapiens
cgcaggatccgctgc

SEQ ID NO: 1727156 - DNA, 18 bp, Homo sapiens
cgcagggaatgcagcagg

SEQ ID NO: 1727157 - DNA, 19 bp, Homo sapiens
cgcagggaatgcagcagga

SEQ ID NO: 1727158 - DNA, 18 bp, Homo sapiens
cgcagggccatccactgt

SEQ ID NO: 1727159 - DNA, 14 bp, Homo sapiens
tgtccacctggccc

SEQ ID NO: 1727160 - DNA, 13 bp, Homo sapiens
tgtccactgtgta

SEQ ID NO: 1727161 - DNA, 22 bp, Homo sapiens
tgtccagaaattgtgtgtgcaa

SEQ ID NO: 1727162 - DNA, 20 bp, Homo sapiens
tgtccagcaccttgtgcctg

SEQ ID NO: 1727163 - DNA, 12 bp, Homo sapiens
tgtccagcagct

SEQ ID NO: 1727164 - DNA, 22 bp, Homo sapiens
tgtccagcagctgcgggtctga

SEQ ID NO: 1727165 - DNA, 13 bp, Homo sapiens
tgtccagcttcca

SEQ ID NO: 1727166 - DNA, 18 bp, Homo sapiens
tgtccagcttccaaagcc

SEQ ID NO: 1727167 - DNA, 21 bp, Homo sapiens
tgtccaggaaaccctggcttg

SEQ ID NO: 1727168 - DNA, 12 bp, Homo sapiens
tgtccaggccac

SEQ ID NO: 1727169 - DNA, 16 bp, Homo sapiens
tgtccaggccactgtg

SEQ ID NO: 1727170 - DNA, 18 bp, Homo sapiens
tgtccaggccactgtggc

SEQ ID NO: 1727171 - DNA, 19 bp, Homo sapiens
tgtccaggccactgtggcc

SEQ ID NO: 1727172 - DNA, 20 bp, Homo sapiens
tgtccaggccactgtggcca

SEQ ID NO: 1727173 - DNA, 18 bp, Homo sapiens
tgtccagggtcctctagc

SEQ ID NO: 1727174 - DNA, 11 bp, Homo sapiens
tgtccaggtct

SEQ ID NO: 1727175 - DNA, 13 bp, Homo sapiens
tgtccatacactt

SEQ ID NO: 1727176 - DNA, 13 bp, Homo sapiens
tgtccatgtcccc

SEQ ID NO: 1727177 - DNA, 18 bp, Homo sapiens
tgtcccaatagctctact

SEQ ID NO: 1727178 - DNA, 20 bp, Homo sapiens
tgtcccaccaactctgcact

SEQ ID NO: 1727179 - DNA, 23 bp, Homo sapiens
tgtcccaccaactctgcactcca

SEQ ID NO: 1727180 - DNA, 18 bp, Homo sapiens
tgtcccaccatacgagca

SEQ ID NO: 1727181 - DNA, 11 bp, Homo sapiens
tgtcccaccca

SEQ ID NO: 1727182 - DNA, 19 bp, Homo sapiens
tgtcccacccacacagctg

SEQ ID NO: 1727183 - DNA, 21 bp, Homo sapiens
tgtcccacccacacagctgcc

SEQ ID NO: 1727184 - DNA, 22 bp, Homo sapiens
tgtcccacccacacagctgccc

SEQ ID NO: 1727185 - DNA, 17 bp, Homo sapiens
tgtcccacccccacccc

SEQ ID NO: 1727186 - DNA, 23 bp, Homo sapiens
tgtcccacccccacccccagctc

SEQ ID NO: 1727187 - DNA, 19 bp, Homo sapiens
tgtcccacccccttccccc

SEQ ID NO: 1727188 - DNA, 21 bp, Homo sapiens
cgcagggccatccactgtgac

SEQ ID NO: 1727189 - DNA, 14 bp, Homo sapiens
cgcagggccatgca

SEQ ID NO: 1727190 - DNA, 16 bp, Homo sapiens
cgcaggggactgtctc

SEQ ID NO: 1727191 - DNA, 18 bp, Homo sapiens
cgcaggggactgtctcag

SEQ ID NO: 1727192 - DNA, 22 bp, Homo sapiens
cgcaggggactgtctcagaaga

SEQ ID NO: 1727193 - DNA, 16 bp, Homo sapiens
cgcaggtctcttctgg

SEQ ID NO: 1727194 - DNA, 16 bp, Homo sapiens
cgcaggtgccatgcct

SEQ ID NO: 1727195 - DNA, 13 bp, Homo sapiens
cgcagtccccagc

SEQ ID NO: 1727196 - DNA, 14 bp, Homo sapiens
cgcagtctggcctg

SEQ ID NO: 1727197 - DNA, 20 bp, Homo sapiens
cgcagtgctgggaccagagc

SEQ ID NO: 1727198 - DNA, 23 bp, Homo sapiens
cgcatacacacatgccctcctgg

SEQ ID NO: 1727199 - DNA, 18 bp, Homo sapiens
cgcatattaagcacttta

SEQ ID NO: 1727200 - DNA, 12 bp, Homo sapiens
cgcatcatatgc

SEQ ID NO: 1727201 - DNA, 12 bp, Homo sapiens
cgcatccagcaa

SEQ ID NO: 1727202 - DNA, 14 bp, Homo sapiens
cgcatccagcaaga

SEQ ID NO: 1727203 - DNA, 18 bp, Homo sapiens
cgcatccctgcttctggc

SEQ ID NO: 1727204 - DNA, 21 bp, Homo sapiens
cgcatccctgcttctggcgcc

SEQ ID NO: 1727205 - DNA, 19 bp, Homo sapiens
cgcatcttgcctccaggtg

SEQ ID NO: 1727206 - DNA, 21 bp, Homo sapiens
cgcatgcctgtaatcccagaa

SEQ ID NO: 1727207 - DNA, 12 bp, Homo sapiens
cgcatggcagaa

SEQ ID NO: 1727208 - DNA, 15 bp, Homo sapiens
cgcattaagcacaca

SEQ ID NO: 1727209 - DNA, 18 bp, Homo sapiens
cgcattaagcacacacat

SEQ ID NO: 1727210 - DNA, 13 bp, Homo sapiens
cgcattccctgag

SEQ ID NO: 1727211 - DNA, 19 bp, Homo sapiens
cgccaaataatgtctctgt

SEQ ID NO: 1727212 - DNA, 14 bp, Homo sapiens
cgccaaatgttcat

SEQ ID NO: 1727213 - DNA, 12 bp, Homo sapiens
cgccacccccat

SEQ ID NO: 1727214 - DNA, 13 bp, Homo sapiens
cgccacccccatc

SEQ ID NO: 1727215 - DNA, 22 bp, Homo sapiens
cgccacccccatcttccacctg

SEQ ID NO: 1727216 - DNA, 13 bp, Homo sapiens
cgccacctcaggg

SEQ ID NO: 1727217 - DNA, 14 bp, Homo sapiens
cgccacctcagggc

SEQ ID NO: 1727218 - DNA, 23 bp, Homo sapiens
cgccacctcagggcacgcaggac

SEQ ID NO: 1727219 - DNA, 14 bp, Homo sapiens
cgccacggccaccc

SEQ ID NO: 1727220 - DNA, 23 bp, Homo sapiens
cgccactaggtgtccccaacgtc

SEQ ID NO: 1727221 - DNA, 22 bp, Homo sapiens
cgccactgcactccagcctggg

SEQ ID NO: 1727222 - DNA, 22 bp, Homo sapiens
cgccagcacagaaacagaggag

SEQ ID NO: 1727223 - DNA, 18 bp, Homo sapiens
cgccagccccgctcccac

SEQ ID NO: 1727224 - DNA, 20 bp, Homo sapiens
cgccagcctcagtgccactt

SEQ ID NO: 1727225 - DNA, 14 bp, Homo sapiens
cgccagcctcctct

SEQ ID NO: 1727226 - DNA, 15 bp, Homo sapiens
cgccagcctcctctg

SEQ ID NO: 1727227 - DNA, 16 bp, Homo sapiens
cgccagcctcctctgg

SEQ ID NO: 1727228 - DNA, 19 bp, Homo sapiens
cgccagcgtgtggagcaga

SEQ ID NO: 1727229 - DNA, 20 bp, Homo sapiens
cgccagcgtgtggagcagag

SEQ ID NO: 1727230 - DNA, 19 bp, Homo sapiens
cgccagctgggagcactgg

SEQ ID NO: 1727231 - DNA, 12 bp, Homo sapiens
cgccaggactgt

SEQ ID NO: 1727232 - DNA, 16 bp, Homo sapiens
cgccaggcagagctga

SEQ ID NO: 1727233 - DNA, 21 bp, Homo sapiens
cgccagggctggggacagagg

SEQ ID NO: 1727234 - DNA, 14 bp, Homo sapiens
cgccagtcactgct

SEQ ID NO: 1727235 - DNA, 17 bp, Homo sapiens
cgccagtcactgctgca

SEQ ID NO: 1727236 - DNA, 13 bp, Homo sapiens
cgccatccttcac

SEQ ID NO: 1727237 - DNA, 17 bp, Homo sapiens
cgccatccttcaccaga

SEQ ID NO: 1727238 - DNA, 20 bp, Homo sapiens
cgccatccttcaccagagcc

SEQ ID NO: 1727239 - DNA, 14 bp, Homo sapiens
cgccatcttcttcc

SEQ ID NO: 1727240 - DNA, 18 bp, Homo sapiens
cgccattctcaagccctg

SEQ ID NO: 1727241 - DNA, 17 bp, Homo sapiens
cgccattgccaccagga

SEQ ID NO: 1727242 - DNA, 21 bp, Homo sapiens
cgccattggttggaagctacc

SEQ ID NO: 1727243 - DNA, 13 bp, Homo sapiens
cgccatttcctca

SEQ ID NO: 1727244 - DNA, 15 bp, Homo sapiens
cgcccaccctgggct

SEQ ID NO: 1727245 - DNA, 12 bp, Homo sapiens
cgcccactgtcc

SEQ ID NO: 1727246 - DNA, 18 bp, Homo sapiens
cgcccactgtcctgggcg

SEQ ID NO: 1727247 - DNA, 20 bp, Homo sapiens
cgcccagctgcacctgccag

SEQ ID NO: 1727248 - DNA, 11 bp, Homo sapiens
cgcccaggaga

SEQ ID NO: 1727249 - DNA, 13 bp, Homo sapiens
cgcccaggctgga

SEQ ID NO: 1727250 - DNA, 19 bp, Homo sapiens
cgcccagtgccctggggct

SEQ ID NO: 1727251 - DNA, 18 bp, Homo sapiens
cgcccatgcactggggac

SEQ ID NO: 1727252 - DNA, 22 bp, Homo sapiens
cgcccattcgtctgtcccagag

SEQ ID NO: 1727253 - DNA, 13 bp, Homo sapiens
cgcccccagtgtg

SEQ ID NO: 1727254 - DNA, 13 bp, Homo sapiens
cgcccccgcctgg

SEQ ID NO: 1727255 - DNA, 16 bp, Homo sapiens
cgcccccgcctgggca

SEQ ID NO: 1727256 - DNA, 13 bp, Homo sapiens
cgccccgccccca

SEQ ID NO: 1727257 - DNA, 12 bp, Homo sapiens
cgcccctccaaa

SEQ ID NO: 1727258 - DNA, 14 bp, Homo sapiens
cgcccctcccaagc

SEQ ID NO: 1727259 - DNA, 15 bp, Homo sapiens
cgcccctcccaagcg

SEQ ID NO: 1727260 - DNA, 18 bp, Homo sapiens
cgcccctcgctgctgcta

SEQ ID NO: 1727261 - DNA, 12 bp, Homo sapiens
cgcccctgaggc

SEQ ID NO: 1727262 - DNA, 16 bp, Homo sapiens
cgcccctgcccgagag

SEQ ID NO: 1727263 - DNA, 22 bp, Homo sapiens
cgcccctgggctaccatctgca

SEQ ID NO: 1727264 - DNA, 17 bp, Homo sapiens
cgcccctgtggccctgg

SEQ ID NO: 1727265 - DNA, 21 bp, Homo sapiens
cgcccgagggatggtgcccct

SEQ ID NO: 1727266 - DNA, 16 bp, Homo sapiens
cgcccgcccactgtcc

SEQ ID NO: 1727267 - DNA, 21 bp, Homo sapiens
cgcccgctcccttcctgccac

SEQ ID NO: 1727268 - DNA, 13 bp, Homo sapiens
cgcccgctcctgc

SEQ ID NO: 1727269 - DNA, 16 bp, Homo sapiens
cgcccgctgggctgag

SEQ ID NO: 1727270 - DNA, 14 bp, Homo sapiens
cgccctcccccatg

SEQ ID NO: 1727271 - DNA, 20 bp, Homo sapiens
cgccctcctcgggccgaggc

SEQ ID NO: 1727272 - DNA, 12 bp, Homo sapiens
cgccctctctgc

SEQ ID NO: 1727273 - DNA, 17 bp, Homo sapiens
cgccctctctgctcctt

SEQ ID NO: 1727274 - DNA, 12 bp, Homo sapiens
cgccctgagaga

SEQ ID NO: 1727275 - DNA, 12 bp, Homo sapiens
cgccctgccact

SEQ ID NO: 1727276 - DNA, 14 bp, Homo sapiens
cgccctgccactca

SEQ ID NO: 1727277 - DNA, 12 bp, Homo sapiens
cgccctggaagc

SEQ ID NO: 1727278 - DNA, 22 bp, Homo sapiens
cgccctggaagccggcggccca

SEQ ID NO: 1727279 - DNA, 16 bp, Homo sapiens
cgccctgtgagggcga

SEQ ID NO: 1727280 - DNA, 15 bp, Homo sapiens
cgcccttaccttccc

SEQ ID NO: 1727281 - DNA, 15 bp, Homo sapiens
cgcccttcagcccac

SEQ ID NO: 1727282 - DNA, 15 bp, Homo sapiens
cgcccttccatgtgc

SEQ ID NO: 1727283 - DNA, 14 bp, Homo sapiens
cgcccttccttccc

SEQ ID NO: 1727284 - DNA, 15 bp, Homo sapiens
cgcccttgcgcgcaa

SEQ ID NO: 1727285 - DNA, 20 bp, Homo sapiens
cgcccttggcttctgtgatg

SEQ ID NO: 1727286 - DNA, 13 bp, Homo sapiens
cgccctttccttg

SEQ ID NO: 1727287 - DNA, 16 bp, Homo sapiens
cgccctttccttgcct

SEQ ID NO: 1727288 - DNA, 17 bp, Homo sapiens
cgccctttccttgcctt

SEQ ID NO: 1727289 - DNA, 22 bp, Homo sapiens
cgccctttccttgccttcttta

SEQ ID NO: 1727290 - DNA, 12 bp, Homo sapiens
cgccgatgccac

SEQ ID NO: 1727291 - DNA, 15 bp, Homo sapiens
cgccgccaggactgt

SEQ ID NO: 1727292 - DNA, 16 bp, Homo sapiens
cgccgccgcgcgcccc

SEQ ID NO: 1727293 - DNA, 16 bp, Homo sapiens
cgccgcgcgcccctgc

SEQ ID NO: 1727294 - DNA, 17 bp, Homo sapiens
cgccgcgcgcccctgcc

SEQ ID NO: 1727295 - DNA, 22 bp, Homo sapiens
cgccggcaaaactttggcactg

SEQ ID NO: 1727296 - DNA, 18 bp, Homo sapiens
cgccggcgggcgggccgg

SEQ ID NO: 1727297 - DNA, 21 bp, Homo sapiens
cgccgggagaagccaccttcc

SEQ ID NO: 1727298 - DNA, 18 bp, Homo sapiens
cgccgggcaccaactcca

SEQ ID NO: 1727299 - DNA, 17 bp, Homo sapiens
cgccgtaattctttctg

SEQ ID NO: 1727300 - DNA, 12 bp, Homo sapiens
cgccgtgaccta

SEQ ID NO: 1727301 - DNA, 22 bp, Homo sapiens
cgccgtgccggcggcagcccca

SEQ ID NO: 1727302 - DNA, 22 bp, Homo sapiens
cgccgtgttactgttgcactga

SEQ ID NO: 1727303 - DNA, 22 bp, Homo sapiens
cgcctacccttcccgcctccct

SEQ ID NO: 1727304 - DNA, 17 bp, Homo sapiens
cgcctataatcccagct

SEQ ID NO: 1727305 - DNA, 22 bp, Homo sapiens
cgcctcaatgtggttgcaaggc

SEQ ID NO: 1727306 - DNA, 20 bp, Homo sapiens
tgtcccacccccttccccca

SEQ ID NO: 1727307 - DNA, 22 bp, Homo sapiens
tgtcccagagcttattggccac

SEQ ID NO: 1727308 - DNA, 22 bp, Homo sapiens
tgtcccagaggttatctgcctg

SEQ ID NO: 1727309 - DNA, 13 bp, Homo sapiens
tgtcccagccacg

SEQ ID NO: 1727310 - DNA, 16 bp, Homo sapiens
tgtcccagcctggggc

SEQ ID NO: 1727311 - DNA, 18 bp, Homo sapiens
tgtcccagcctggggctc

SEQ ID NO: 1727312 - DNA, 16 bp, Homo sapiens
tgtcccaggtcctcac

SEQ ID NO: 1727313 - DNA, 17 bp, Homo sapiens
tgtcccagtagccaagg

SEQ ID NO: 1727314 - DNA, 17 bp, Homo sapiens
tgtcccagtcagaaata

SEQ ID NO: 1727315 - DNA, 18 bp, Homo sapiens
tgtcccatgacccacccc

SEQ ID NO: 1727316 - DNA, 19 bp, Homo sapiens
tgtcccatgacccacccct

SEQ ID NO: 1727317 - DNA, 17 bp, Homo sapiens
tgtcccatgatccctgt

SEQ ID NO: 1727318 - DNA, 13 bp, Homo sapiens
tgtcccatgggga

SEQ ID NO: 1727319 - DNA, 14 bp, Homo sapiens
tgtcccattctaga

SEQ ID NO: 1727320 - DNA, 20 bp, Homo sapiens
tgtcccatttccttggaggc

SEQ ID NO: 1727321 - DNA, 22 bp, Homo sapiens
tgtccccaacgtcccctccgcc

SEQ ID NO: 1727322 - DNA, 18 bp, Homo sapiens
tgtccccaccctccactc

SEQ ID NO: 1727323 - DNA, 22 bp, Homo sapiens
tgtccccaccctccactcagct

SEQ ID NO: 1727324 - DNA, 12 bp, Homo sapiens
tgtccccagggc

SEQ ID NO: 1727325 - DNA, 14 bp, Homo sapiens
tgtccccagggccc

SEQ ID NO: 1727326 - DNA, 17 bp, Homo sapiens
tgtccccagggcccctc

SEQ ID NO: 1727327 - DNA, 19 bp, Homo sapiens
tgtccccagtttgcagaaa

SEQ ID NO: 1727328 - DNA, 22 bp, Homo sapiens
tgtccccataagacaaacactg

SEQ ID NO: 1727329 - DNA, 14 bp, Homo sapiens
tgtccccattctat

SEQ ID NO: 1727330 - DNA, 15 bp, Homo sapiens
tgtccccattctata

SEQ ID NO: 1727331 - DNA, 22 bp, Homo sapiens
tgtccccattctataaattcaa

SEQ ID NO: 1727332 - DNA, 13 bp, Homo sapiens
tgtcccccaactt

SEQ ID NO: 1727333 - DNA, 14 bp, Homo sapiens
tgtcccccaacttg

SEQ ID NO: 1727334 - DNA, 18 bp, Homo sapiens
tgtccccgctgctgtgca

SEQ ID NO: 1727335 - DNA, 11 bp, Homo sapiens
tgtccccttct

SEQ ID NO: 1727336 - DNA, 16 bp, Homo sapiens
tgtccccttctctcat

SEQ ID NO: 1727337 - DNA, 17 bp, Homo sapiens
tgtcccgcggtgctgac

SEQ ID NO: 1727338 - DNA, 22 bp, Homo sapiens
tgtccctaatttaacccagctc

SEQ ID NO: 1727339 - DNA, 21 bp, Homo sapiens
tgtccctccaggcccatctca

SEQ ID NO: 1727340 - DNA, 18 bp, Homo sapiens
tgtccctcccccgcttcc

SEQ ID NO: 1727341 - DNA, 21 bp, Homo sapiens
tgtccctctcagtgccttctc

SEQ ID NO: 1727342 - DNA, 24 bp, Homo sapiens
tgtccctctcagtgccttctctca

SEQ ID NO: 1727343 - DNA, 21 bp, Homo sapiens
tgtccctctcggaaggctggc

SEQ ID NO: 1727344 - DNA, 14 bp, Homo sapiens
tgtccctgccttca

SEQ ID NO: 1727345 - DNA, 15 bp, Homo sapiens
tgtccctggacacag

SEQ ID NO: 1727346 - DNA, 17 bp, Homo sapiens
tgtccctggacacagct

SEQ ID NO: 1727347 - DNA, 21 bp, Homo sapiens
tgtccctggacacagctcttc

SEQ ID NO: 1727348 - DNA, 13 bp, Homo sapiens
tgtccctgtagct

SEQ ID NO: 1727349 - DNA, 16 bp, Homo sapiens
tgtccctgtagctcag

SEQ ID NO: 1727350 - DNA, 17 bp, Homo sapiens
tgtccctgtagctcagt

SEQ ID NO: 1727351 - DNA, 19 bp, Homo sapiens
tgtccctgtagctcagtca

SEQ ID NO: 1727352 - DNA, 19 bp, Homo sapiens
tgtcccttcgagtccagga

SEQ ID NO: 1727353 - DNA, 12 bp, Homo sapiens
tgtcccttgcct

SEQ ID NO: 1727354 - DNA, 15 bp, Homo sapiens
tgtcccttgcctctg

SEQ ID NO: 1727355 - DNA, 16 bp, Homo sapiens
tgtcccttgcctctgc

SEQ ID NO: 1727356 - DNA, 23 bp, Homo sapiens
tgtcccttgcttgcctgcagggc

SEQ ID NO: 1727357 - DNA, 17 bp, Homo sapiens
tgtccctttcttggcca

SEQ ID NO: 1727358 - DNA, 12 bp, Homo sapiens
tgtcccttttcc

SEQ ID NO: 1727359 - DNA, 16 bp, Homo sapiens
tgtcccttttccctta

SEQ ID NO: 1727360 - DNA, 12 bp, Homo sapiens
tgtcccttttct

SEQ ID NO: 1727361 - DNA, 14 bp, Homo sapiens
tgtcccttttgcta

SEQ ID NO: 1727362 - DNA, 14 bp, Homo sapiens
tgtccgatgctgga

SEQ ID NO: 1727363 - DNA, 22 bp, Homo sapiens
tgtccgctgggtggtaccctct

SEQ ID NO: 1727364 - DNA, 23 bp, Homo sapiens
tgtccgctgggtggtaccctctg

SEQ ID NO: 1727365 - DNA, 15 bp, Homo sapiens
tgtccggcccagtgc

SEQ ID NO: 1727366 - DNA, 23 bp, Homo sapiens
tgtccggccgctttgtgattcca

SEQ ID NO: 1727367 - DNA, 20 bp, Homo sapiens
tgtccgtctctcttgcttga

SEQ ID NO: 1727368 - DNA, 15 bp, Homo sapiens
tgtcctaaggacaca

SEQ ID NO: 1727369 - DNA, 18 bp, Homo sapiens
tgtcctaattcttctgtc

SEQ ID NO: 1727370 - DNA, 13 bp, Homo sapiens
tgtcctatagttt

SEQ ID NO: 1727371 - DNA, 20 bp, Homo sapiens
tgtcctatctccagcggccc

SEQ ID NO: 1727372 - DNA, 20 bp, Homo sapiens
tgtcctatgtcaatttgtat

SEQ ID NO: 1727373 - DNA, 16 bp, Homo sapiens
tgtcctccagaagcct

SEQ ID NO: 1727374 - DNA, 17 bp, Homo sapiens
tgtcctccagaagcctc

SEQ ID NO: 1727375 - DNA, 18 bp, Homo sapiens
tgtcctccagaagcctct

SEQ ID NO: 1727376 - DNA, 21 bp, Homo sapiens
tgtcctccagaagcctctggc

SEQ ID NO: 1727377 - DNA, 17 bp, Homo sapiens
tgtcctcccctcaagga

SEQ ID NO: 1727378 - DNA, 18 bp, Homo sapiens
tgtcctcccctcaaggac

SEQ ID NO: 1727379 - DNA, 14 bp, Homo sapiens
tgtcctccccttgg

SEQ ID NO: 1727380 - DNA, 11 bp, Homo sapiens
tgtcctccttt

SEQ ID NO: 1727381 - DNA, 18 bp, Homo sapiens
tgtcctccttttcacttt

SEQ ID NO: 1727382 - DNA, 18 bp, Homo sapiens
tgtcctctcagaactcct

SEQ ID NO: 1727383 - DNA, 22 bp, Homo sapiens
tgtcctctgcaagcttcttgct

SEQ ID NO: 1727384 - DNA, 13 bp, Homo sapiens
tgtcctcttccct

SEQ ID NO: 1727385 - DNA, 13 bp, Homo sapiens
tgtcctcttctgc

SEQ ID NO: 1727386 - DNA, 22 bp, Homo sapiens
tgtcctcttctgctcttttcct

SEQ ID NO: 1727387 - DNA, 23 bp, Homo sapiens
tgtcctcttctgctcttttcctg

SEQ ID NO: 1727388 - DNA, 15 bp, Homo sapiens
tgtcctcttgctcaa

SEQ ID NO: 1727389 - DNA, 12 bp, Homo sapiens
tgtcctgaccac

SEQ ID NO: 1727390 - DNA, 18 bp, Homo sapiens
cgctcaggggcctggagg

SEQ ID NO: 1727391 - DNA, 22 bp, Homo sapiens
cgctcaggggcctggaggtctg

SEQ ID NO: 1727392 - DNA, 21 bp, Homo sapiens
cgctcaggtgatcaaaataaa

SEQ ID NO: 1727393 - DNA, 15 bp, Homo sapiens
cgctcagtaaacggg

SEQ ID NO: 1727394 - DNA, 20 bp, Homo sapiens
cgctcatgtcctgtcctggt

SEQ ID NO: 1727395 - DNA, 22 bp, Homo sapiens
cgctcatgtcctgtcctggtcc

SEQ ID NO: 1727396 - DNA, 18 bp, Homo sapiens
cgctcatgttgagccagt

SEQ ID NO: 1727397 - DNA, 16 bp, Homo sapiens
cgctccagctgccccg

SEQ ID NO: 1727398 - DNA, 18 bp, Homo sapiens
cgctccagctgccccggc

SEQ ID NO: 1727399 - DNA, 13 bp, Homo sapiens
cgctcccaccgcc

SEQ ID NO: 1727400 - DNA, 16 bp, Homo sapiens
cgctcccaccgccccc

SEQ ID NO: 1727401 - DNA, 18 bp, Homo sapiens
cgctcccacctagtgccc

SEQ ID NO: 1727402 - DNA, 21 bp, Homo sapiens
cgctcccaggttcccccagca

SEQ ID NO: 1727403 - DNA, 18 bp, Homo sapiens
cgctcccccgcagtcccc

SEQ ID NO: 1727404 - DNA, 20 bp, Homo sapiens
cgctcccccgcagtccccag

SEQ ID NO: 1727405 - DNA, 13 bp, Homo sapiens
cgctcccctctgc

SEQ ID NO: 1727406 - DNA, 13 bp, Homo sapiens
cgctccctggaag

SEQ ID NO: 1727407 - DNA, 17 bp, Homo sapiens
cgctcccttccctccat

SEQ ID NO: 1727408 - DNA, 14 bp, Homo sapiens
cgctccgtctctgt

SEQ ID NO: 1727409 - DNA, 20 bp, Homo sapiens
cgctcctttgtgtgtgtgtc

SEQ ID NO: 1727410 - DNA, 15 bp, Homo sapiens
cgctcgcccagcagg

SEQ ID NO: 1727411 - DNA, 16 bp, Homo sapiens
cgctcgcccagcagga

SEQ ID NO: 1727412 - DNA, 13 bp, Homo sapiens
cgctcgcgggcag

SEQ ID NO: 1727413 - DNA, 12 bp, Homo sapiens
cgctctccctgt

SEQ ID NO: 1727414 - DNA, 13 bp, Homo sapiens
cgctctcctggac

SEQ ID NO: 1727415 - DNA, 15 bp, Homo sapiens
cgctctcgctctcgc

SEQ ID NO: 1727416 - DNA, 12 bp, Homo sapiens
cgctgatgcaga

SEQ ID NO: 1727417 - DNA, 14 bp, Homo sapiens
cgctgatggagccc

SEQ ID NO: 1727418 - DNA, 20 bp, Homo sapiens
cgctgatggagccccacctt

SEQ ID NO: 1727419 - DNA, 14 bp, Homo sapiens
cgctgcagcctccc

SEQ ID NO: 1727420 - DNA, 20 bp, Homo sapiens
cgctgcagcctcccttccat

SEQ ID NO: 1727421 - DNA, 13 bp, Homo sapiens
cgctgcagggccg

SEQ ID NO: 1727422 - DNA, 23 bp, Homo sapiens
cgctgccaccacgtctgccaggc

SEQ ID NO: 1727423 - DNA, 23 bp, Homo sapiens
cgctgccagccttgagccctggc

SEQ ID NO: 1727424 - DNA, 15 bp, Homo sapiens
cgctgcccgctcagc

SEQ ID NO: 1727425 - DNA, 14 bp, Homo sapiens
tgtcctttcttgca

SEQ ID NO: 1727426 - DNA, 18 bp, Homo sapiens
tgtcctttttcactttga

SEQ ID NO: 1727427 - DNA, 20 bp, Homo sapiens
tgtcctttttcactttgaaa

SEQ ID NO: 1727428 - DNA, 16 bp, Homo sapiens
tgtcctttttgttatt

SEQ ID NO: 1727429 - DNA, 17 bp, Homo sapiens
tgtcctttttgttatta

SEQ ID NO: 1727430 - DNA, 20 bp, Homo sapiens
tgtcgaaaagagtcttccaa

SEQ ID NO: 1727431 - DNA, 20 bp, Homo sapiens
tgtcgaggccacattgctgg

SEQ ID NO: 1727432 - DNA, 18 bp, Homo sapiens
tgtcgaggctagaggcat

SEQ ID NO: 1727433 - DNA, 21 bp, Homo sapiens
tgtcgccgcctgctccctgca

SEQ ID NO: 1727434 - DNA, 21 bp, Homo sapiens
tgtcgcgtctcattttgtcca

SEQ ID NO: 1727435 - DNA, 16 bp, Homo sapiens
tgtcgctatgtgactt

SEQ ID NO: 1727436 - DNA, 22 bp, Homo sapiens
tgtcgctatgtgacttgcgctt

SEQ ID NO: 1727437 - DNA, 13 bp, Homo sapiens
tgtcggcaccatg

SEQ ID NO: 1727438 - DNA, 15 bp, Homo sapiens
tgtcgggcaccagcc

SEQ ID NO: 1727439 - DNA, 19 bp, Homo sapiens
tgtcgggcaccagccagcg

SEQ ID NO: 1727440 - DNA, 20 bp, Homo sapiens
tgtcggtcatagtttcctga

SEQ ID NO: 1727441 - DNA, 23 bp, Homo sapiens
tgtcgtagaattccttcgaaagg

SEQ ID NO: 1727442 - DNA, 21 bp, Homo sapiens
tgtcgtctctcccaccccctc

SEQ ID NO: 1727443 - DNA, 20 bp, Homo sapiens
tgtcgtggacacacacagac

SEQ ID NO: 1727444 - DNA, 16 bp, Homo sapiens
tgtcgtgggatggcat

SEQ ID NO: 1727445 - DNA, 13 bp, Homo sapiens
tgtctaaaaacac

SEQ ID NO: 1727446 - DNA, 20 bp, Homo sapiens
tgtctaaaaataaaatgcat

SEQ ID NO: 1727447 - DNA, 23 bp, Homo sapiens
tgtctaaaaataaaatgcattta

SEQ ID NO: 1727448 - DNA, 16 bp, Homo sapiens
tgtctaaacaatgctg

SEQ ID NO: 1727449 - DNA, 22 bp, Homo sapiens
tgtctaaacaatgctgatttgg

SEQ ID NO: 1727450 - DNA, 18 bp, Homo sapiens
tgtctaaatttgaatgtt

SEQ ID NO: 1727451 - DNA, 21 bp, Homo sapiens
tgtctaacttttgtgaagaac

SEQ ID NO: 1727452 - DNA, 14 bp, Homo sapiens
tgtctaagatagta

SEQ ID NO: 1727453 - DNA, 15 bp, Homo sapiens
tgtctaagatagtaa

SEQ ID NO: 1727454 - DNA, 15 bp, Homo sapiens
tgtctaagattctag

SEQ ID NO: 1727455 - DNA, 18 bp, Homo sapiens
tgtctaagattctagatc

SEQ ID NO: 1727456 - DNA, 21 bp, Homo sapiens
tgtctaagcagttttgtaaat

SEQ ID NO: 1727457 - DNA, 22 bp, Homo sapiens
tgtctaagcagttttgtaaatg

SEQ ID NO: 1727458 - DNA, 24 bp, Homo sapiens
tgtctaagcagttttgtaaatgta

SEQ ID NO: 1727459 - DNA, 22 bp, Homo sapiens
tgtctaatatcttaattctttg

SEQ ID NO: 1727460 - DNA, 15 bp, Homo sapiens
tgtctacctggcaga

SEQ ID NO: 1727461 - DNA, 19 bp, Homo sapiens
tgtctactcagcatttgat

SEQ ID NO: 1727462 - DNA, 22 bp, Homo sapiens
tgtctactcagcatttgattaa

SEQ ID NO: 1727463 - DNA, 18 bp, Homo sapiens
tgtctactcctagaagaa

SEQ ID NO: 1727464 - DNA, 19 bp, Homo sapiens
tgtctactcctagaagaac

SEQ ID NO: 1727465 - DNA, 12 bp, Homo sapiens
tgtctagaatgt

SEQ ID NO: 1727466 - DNA, 17 bp, Homo sapiens
tgtctagaatgtggatt

SEQ ID NO: 1727467 - DNA, 13 bp, Homo sapiens
tgtctagagcaac

SEQ ID NO: 1727468 - DNA, 15 bp, Homo sapiens
tgtctaggagacaga

SEQ ID NO: 1727469 - DNA, 18 bp, Homo sapiens
tgtctaggagacagagcc

SEQ ID NO: 1727470 - DNA, 22 bp, Homo sapiens
tgtctataatcccagcactttg

SEQ ID NO: 1727471 - DNA, 18 bp, Homo sapiens
tgtctataatggaaacat

SEQ ID NO: 1727472 - DNA, 20 bp, Homo sapiens
tgtctatgaagttgctgttt

SEQ ID NO: 1727473 - DNA, 21 bp, Homo sapiens
tgtctatgaagttgctgttta

SEQ ID NO: 1727474 - DNA, 16 bp, Homo sapiens
tgtctattaaaattct

SEQ ID NO: 1727475 - DNA, 19 bp, Homo sapiens
tgtctattcaaaatatcaa

SEQ ID NO: 1727476 - DNA, 19 bp, Homo sapiens
tgtctattctgagccttga

SEQ ID NO: 1727477 - DNA, 11 bp, Homo sapiens
tgtctatttta

SEQ ID NO: 1727478 - DNA, 16 bp, Homo sapiens
tgtctattttaaaata

SEQ ID NO: 1727479 - DNA, 22 bp, Homo sapiens
tgtctattttaaaataaattag

SEQ ID NO: 1727480 - DNA, 13 bp, Homo sapiens
tgtctattttctt

SEQ ID NO: 1727481 - DNA, 12 bp, Homo sapiens
tgtctcaaaaaa

SEQ ID NO: 1727482 - DNA, 22 bp, Homo sapiens
tgtctcaaaggagctttctcaa

SEQ ID NO: 1727483 - DNA, 18 bp, Homo sapiens
tgtctcaagagggcactg

SEQ ID NO: 1727484 - DNA, 19 bp, Homo sapiens
tgtctcaagagggcactgg

SEQ ID NO: 1727485 - DNA, 17 bp, Homo sapiens
tgtctcactgaaacatt

SEQ ID NO: 1727486 - DNA, 14 bp, Homo sapiens
tgtctcagcctccc

SEQ ID NO: 1727487 - DNA, 15 bp, Homo sapiens
tgtctcagcctccca

SEQ ID NO: 1727488 - DNA, 16 bp, Homo sapiens
tgtctcagcctcctga

SEQ ID NO: 1727489 - DNA, 17 bp, Homo sapiens
tgtctcagcctcctgag

SEQ ID NO: 1727490 - DNA, 18 bp, Homo sapiens
tgtctcagcctcctgagt

SEQ ID NO: 1727491 - DNA, 17 bp, Homo sapiens
tgtctcagcctctgcca

SEQ ID NO: 1727492 - DNA, 16 bp, Homo sapiens
tgtctcatccccaggg

SEQ ID NO: 1727493 - DNA, 11 bp, Homo sapiens
tgtctccaacc

SEQ ID NO: 1727494 - DNA, 16 bp, Homo sapiens
tgtctccaacccccca

SEQ ID NO: 1727495 - DNA, 17 bp, Homo sapiens
tgtctccaaccccccag

SEQ ID NO: 1727496 - DNA, 21 bp, Homo sapiens
tgtctccaaccccccagcact

SEQ ID NO: 1727497 - DNA, 22 bp, Homo sapiens
tgtctccaaccccccagcactg

SEQ ID NO: 1727498 - DNA, 18 bp, Homo sapiens
tgtctccacccaccttga

SEQ ID NO: 1727499 - DNA, 22 bp, Homo sapiens
tgtctccacctacacccctgtg

SEQ ID NO: 1727500 - DNA, 12 bp, Homo sapiens
tgtctccagctg

SEQ ID NO: 1727501 - DNA, 18 bp, Homo sapiens
tgtctccctcccctctca

SEQ ID NO: 1727502 - DNA, 20 bp, Homo sapiens
tgtctccctcccctctcaga

SEQ ID NO: 1727503 - DNA, 13 bp, Homo sapiens
tgtctcccttctc

SEQ ID NO: 1727504 - DNA, 18 bp, Homo sapiens
tgtctcctatatatttct

SEQ ID NO: 1727505 - DNA, 12 bp, Homo sapiens
tgtctcctatcc

SEQ ID NO: 1727506 - DNA, 13 bp, Homo sapiens
tgtctcctgtctt

SEQ ID NO: 1727507 - DNA, 17 bp, Homo sapiens
tgtctccttaagctgca

SEQ ID NO: 1727508 - DNA, 21 bp, Homo sapiens
tgtctccttaagctgcagaga

SEQ ID NO: 1727509 - DNA, 15 bp, Homo sapiens
tgtctctaaaaagaa

SEQ ID NO: 1727510 - DNA, 15 bp, Homo sapiens
tgtctctaaccattc

SEQ ID NO: 1727511 - DNA, 18 bp, Homo sapiens
tgtctctagctgttctgg

SEQ ID NO: 1727512 - DNA, 12 bp, Homo sapiens
tgtctctctggg

SEQ ID NO: 1727513 - DNA, 12 bp, Homo sapiens
tgtctctgcctt

SEQ ID NO: 1727514 - DNA, 13 bp, Homo sapiens
tgtctctgtgaga

SEQ ID NO: 1727515 - DNA, 20 bp, Homo sapiens
tgtctctgttcagatgtgca

SEQ ID NO: 1727516 - DNA, 13 bp, Homo sapiens
tgtctcttgagca

SEQ ID NO: 1727517 - DNA, 23 bp, Homo sapiens
tgtctcttgagcatcaatcttgt

SEQ ID NO: 1727518 - DNA, 14 bp, Homo sapiens
tgtctcttgagttt

SEQ ID NO: 1727519 - DNA, 15 bp, Homo sapiens
tgtctcttgtagaag

SEQ ID NO: 1727520 - DNA, 22 bp, Homo sapiens
tgtctcttttctcttttgcttt

SEQ ID NO: 1727521 - DNA, 19 bp, Homo sapiens
tgtctgaaacagagaacca

SEQ ID NO: 1727522 - DNA, 12 bp, Homo sapiens
tgtctgaacaaa

SEQ ID NO: 1727523 - DNA, 18 bp, Homo sapiens
tgtctgaacttgcattgt

SEQ ID NO: 1727524 - DNA, 23 bp, Homo sapiens
tgtctgaaggacacttcctgcct

SEQ ID NO: 1727525 - DNA, 17 bp, Homo sapiens
tgtctgaagtcactgca

SEQ ID NO: 1727526 - DNA, 16 bp, Homo sapiens
tgtctgaccagagaat

SEQ ID NO: 1727527 - DNA, 19 bp, Homo sapiens
tgtctgaccagagaatgca

SEQ ID NO: 1727528 - DNA, 21 bp, Homo sapiens
tgtctgacttttgttaaattc

SEQ ID NO: 1727529 - DNA, 21 bp, Homo sapiens
tgtctgagcggcgcagagccc

SEQ ID NO: 1727530 - DNA, 14 bp, Homo sapiens
tgtctgaggcctca

SEQ ID NO: 1727531 - DNA, 18 bp, Homo sapiens
tgtctgaggcctcatccc

SEQ ID NO: 1727532 - DNA, 12 bp, Homo sapiens
tgtctgcagctc

SEQ ID NO: 1727533 - DNA, 15 bp, Homo sapiens
tgtctgcattgttat

SEQ ID NO: 1727534 - DNA, 19 bp, Homo sapiens
tgtctgccaacctaaaact

SEQ ID NO: 1727535 - DNA, 19 bp, Homo sapiens
tgtctgccccagcccagat

SEQ ID NO: 1727536 - DNA, 15 bp, Homo sapiens
tgtctgccttcacaa

SEQ ID NO: 1727537 - DNA, 17 bp, Homo sapiens
tgtctgccttcacaaat

SEQ ID NO: 1727538 - DNA, 18 bp, Homo sapiens
tgtctgccttcacaaatg

SEQ ID NO: 1727539 - DNA, 17 bp, Homo sapiens
tgtctgcgcctgaaaag

SEQ ID NO: 1727540 - DNA, 23 bp, Homo sapiens
tgtctgctaggcgctggggagac

SEQ ID NO: 1727541 - DNA, 20 bp, Homo sapiens
cgctgccgcaccccagagtg

SEQ ID NO: 1727542 - DNA, 21 bp, Homo sapiens
cgctgccgcaccccagagtgt

SEQ ID NO: 1727543 - DNA, 16 bp, Homo sapiens
cgctgcctccatggca

SEQ ID NO: 1727544 - DNA, 18 bp, Homo sapiens
cgctgcctccatggcagc

SEQ ID NO: 1727545 - DNA, 12 bp, Homo sapiens
cgctgcctggcc

SEQ ID NO: 1727546 - DNA, 22 bp, Homo sapiens
cgctgcctttatcttgaagtca

SEQ ID NO: 1727547 - DNA, 22 bp, Homo sapiens
cgctgccttttgtttctagaat

SEQ ID NO: 1727548 - DNA, 18 bp, Homo sapiens
cgctgctacatcagactc

SEQ ID NO: 1727549 - DNA, 14 bp, Homo sapiens
cgctgctctagctg

SEQ ID NO: 1727550 - DNA, 19 bp, Homo sapiens
cgctgctctagctggcagg

SEQ ID NO: 1727551 - DNA, 13 bp, Homo sapiens
cgctgctgtcaca

SEQ ID NO: 1727552 - DNA, 17 bp, Homo sapiens
cgctgctgtgctctggg

SEQ ID NO: 1727553 - DNA, 19 bp, Homo sapiens
cgctgctgtgctctgggga

SEQ ID NO: 1727554 - DNA, 15 bp, Homo sapiens
cgctgcttccaggct

SEQ ID NO: 1727555 - DNA, 13 bp, Homo sapiens
cgctggcccagcc

SEQ ID NO: 1727556 - DNA, 15 bp, Homo sapiens
cgctggcccagccgg

SEQ ID NO: 1727557 - DNA, 24 bp, Homo sapiens
cgctggcccagccggcctctctgg

SEQ ID NO: 1727558 - DNA, 15 bp, Homo sapiens
cgctggccctgccgt

SEQ ID NO: 1727559 - DNA, 11 bp, Homo sapiens
cgctggctact

SEQ ID NO: 1727560 - DNA, 13 bp, Homo sapiens
cgctggctcccca

SEQ ID NO: 1727561 - DNA, 16 bp, Homo sapiens
cgctggctccccaaag

SEQ ID NO: 1727562 - DNA, 15 bp, Homo sapiens
cgctggctttctctc

SEQ ID NO: 1727563 - DNA, 16 bp, Homo sapiens
cgctggctttctctct

SEQ ID NO: 1727564 - DNA, 17 bp, Homo sapiens
cgctgggctgagcccct

SEQ ID NO: 1727565 - DNA, 14 bp, Homo sapiens
cgctgggtggtacc

SEQ ID NO: 1727566 - DNA, 22 bp, Homo sapiens
cgctgggtggtaccctctggag

SEQ ID NO: 1727567 - DNA, 15 bp, Homo sapiens
cgctggtccctgccc

SEQ ID NO: 1727568 - DNA, 16 bp, Homo sapiens
cgctggtccctgccct

SEQ ID NO: 1727569 - DNA, 13 bp, Homo sapiens
cgctggtggacca

SEQ ID NO: 1727570 - DNA, 14 bp, Homo sapiens
cgctgtatgattta

SEQ ID NO: 1727571 - DNA, 10 bp, Homo sapiens
cgctgtctct

SEQ ID NO: 1727572 - DNA, 20 bp, Homo sapiens
cgctgtctctgaggggtggg

SEQ ID NO: 1727573 - DNA, 19 bp, Homo sapiens
cgctgtgatgcatgagctc

SEQ ID NO: 1727574 - DNA, 15 bp, Homo sapiens
cgcttaatccaatat

SEQ ID NO: 1727575 - DNA, 13 bp, Homo sapiens
cgcttcacccctg

SEQ ID NO: 1727576 - DNA, 13 bp, Homo sapiens
cgcttccccacag

SEQ ID NO: 1727577 - DNA, 17 bp, Homo sapiens
cgcttcctcagcctcca

SEQ ID NO: 1727578 - DNA, 12 bp, Homo sapiens
cgcttcctggcc

SEQ ID NO: 1727579 - DNA, 16 bp, Homo sapiens
cgcttcctggcctccc

SEQ ID NO: 1727580 - DNA, 15 bp, Homo sapiens
cgcttcttgcctctg

SEQ ID NO: 1727581 - DNA, 17 bp, Homo sapiens
cgcttcttgcctctgtg

SEQ ID NO: 1727582 - DNA, 21 bp, Homo sapiens
cgcttgaacctgggaggcaga

SEQ ID NO: 1727583 - DNA, 14 bp, Homo sapiens
cgcttgagcccagg

SEQ ID NO: 1727584 - DNA, 20 bp, Homo sapiens
cgcttgccgggcctgggcct

SEQ ID NO: 1727585 - DNA, 12 bp, Homo sapiens
cgcttgtagaac

SEQ ID NO: 1727586 - DNA, 22 bp, Homo sapiens
cgcttgtagaactcactctggg

SEQ ID NO: 1727587 - DNA, 14 bp, Homo sapiens
cgctttcctgaatc

SEQ ID NO: 1727588 - DNA, 10 bp, Homo sapiens
cgctttctcc

SEQ ID NO: 1727589 - DNA, 12 bp, Homo sapiens
cgctttgtcaca

SEQ ID NO: 1727590 - DNA, 12 bp, Homo sapiens
cggaaagaagag

SEQ ID NO: 1727591 - DNA, 18 bp, Homo sapiens
cggaaagaagagcgagag

SEQ ID NO: 1727592 - DNA, 20 bp, Homo sapiens
cggaagagttacaataaagt

SEQ ID NO: 1727593 - DNA, 20 bp, Homo sapiens
cggaagcagtgccttccata

SEQ ID NO: 1727594 - DNA, 22 bp, Homo sapiens
cggaagcagtgccttccataat

SEQ ID NO: 1727595 - DNA, 23 bp, Homo sapiens
cggaagcagtgccttccataatt

SEQ ID NO: 1727596 - DNA, 24 bp, Homo sapiens
cggaagccccctcttcctccctgg

SEQ ID NO: 1727597 - DNA, 13 bp, Homo sapiens
cggaaggaggcca

SEQ ID NO: 1727598 - DNA, 21 bp, Homo sapiens
cggaagggctttggttccttc

SEQ ID NO: 1727599 - DNA, 17 bp, Homo sapiens
cggaaggggttcctcaa

SEQ ID NO: 1727600 - DNA, 16 bp, Homo sapiens
cggacaagacccccag

SEQ ID NO: 1727601 - DNA, 18 bp, Homo sapiens
cggacaagacccccagca

SEQ ID NO: 1727602 - DNA, 15 bp, Homo sapiens
cggacacggcttcac

SEQ ID NO: 1727603 - DNA, 22 bp, Homo sapiens
cggacacggcttcactgaccag

SEQ ID NO: 1727604 - DNA, 17 bp, Homo sapiens
cggacccaccccaactc

SEQ ID NO: 1727605 - DNA, 23 bp, Homo sapiens
cggacccaccccaactctcccca

SEQ ID NO: 1727606 - DNA, 21 bp, Homo sapiens
cggaccttggcagcccaggcc

SEQ ID NO: 1727607 - DNA, 20 bp, Homo sapiens
cggacggccaatggtgcttc

SEQ ID NO: 1727608 - DNA, 12 bp, Homo sapiens
cggacgggctgt

SEQ ID NO: 1727609 - DNA, 22 bp, Homo sapiens
cggactcaccaacttgccacat

SEQ ID NO: 1727610 - DNA, 23 bp, Homo sapiens
cggactcaccaacttgccacatg

SEQ ID NO: 1727611 - DNA, 14 bp, Homo sapiens
cggactccatggct

SEQ ID NO: 1727612 - DNA, 17 bp, Homo sapiens
cggactctcccaggcct

SEQ ID NO: 1727613 - DNA, 13 bp, Homo sapiens
cggactgccaaat

SEQ ID NO: 1727614 - DNA, 15 bp, Homo sapiens
cggactggcagaagc

SEQ ID NO: 1727615 - DNA, 16 bp, Homo sapiens
cggactggtgccctcc

SEQ ID NO: 1727616 - DNA, 14 bp, Homo sapiens
cggacttttctgca

SEQ ID NO: 1727617 - DNA, 16 bp, Homo sapiens
cggacttttctgcaaa

SEQ ID NO: 1727618 - DNA, 23 bp, Homo sapiens
cggagaagagctgttcacagcca

SEQ ID NO: 1727619 - DNA, 24 bp, Homo sapiens
cggagaagagctgttcacagccag

SEQ ID NO: 1727620 - DNA, 17 bp, Homo sapiens
tgtcttttttttccttt

SEQ ID NO: 1727621 - DNA, 15 bp, Homo sapiens
tgtctttttttttct

SEQ ID NO: 1727622 - DNA, 13 bp, Homo sapiens
tgtgaaaaaggaa

SEQ ID NO: 1727623 - DNA, 14 bp, Homo sapiens
tgtgaaaatgtgtt

SEQ ID NO: 1727624 - DNA, 22 bp, Homo sapiens
tgtgaaacagggagctatgaga

SEQ ID NO: 1727625 - DNA, 22 bp, Homo sapiens
tgtgaaagaaagctgagaagaa

SEQ ID NO: 1727626 - DNA, 23 bp, Homo sapiens
tgtgaaataccacaagcctgaga

SEQ ID NO: 1727627 - DNA, 19 bp, Homo sapiens
tgtgaacctgggcactccg

SEQ ID NO: 1727628 - DNA, 15 bp, Homo sapiens
tgtgaagacattttt

SEQ ID NO: 1727629 - DNA, 18 bp, Homo sapiens
tgtgaagagaatgtattc

SEQ ID NO: 1727630 - DNA, 20 bp, Homo sapiens
tgtgaagaggtctgattggc

SEQ ID NO: 1727631 - DNA, 20 bp, Homo sapiens
tgtgaagcaaactctaaaat

SEQ ID NO: 1727632 - DNA, 22 bp, Homo sapiens
tgtgaagctgaaccccctccag

SEQ ID NO: 1727633 - DNA, 13 bp, Homo sapiens
tgtgaaggaccct

SEQ ID NO: 1727634 - DNA, 14 bp, Homo sapiens
tgtgaaggaccctt

SEQ ID NO: 1727635 - DNA, 20 bp, Homo sapiens
tgtgaagtttaattgtctca

SEQ ID NO: 1727636 - DNA, 14 bp, Homo sapiens
tgtgaatacattct

SEQ ID NO: 1727637 - DNA, 19 bp, Homo sapiens
tgtgaataggttatatgca

SEQ ID NO: 1727638 - DNA, 21 bp, Homo sapiens
tgtgaatccaggaggcagtgg

SEQ ID NO: 1727639 - DNA, 14 bp, Homo sapiens
tgtgaatcgcaagg

SEQ ID NO: 1727640 - DNA, 17 bp, Homo sapiens
tgtgaatcgcagctgtg

SEQ ID NO: 1727641 - DNA, 17 bp, Homo sapiens
tgtgaatgccactgcct

SEQ ID NO: 1727642 - DNA, 21 bp, Homo sapiens
tgtgaatgttgtgatgtattc

SEQ ID NO: 1727643 - DNA, 18 bp, Homo sapiens
tgtgaattaaaaaagctc

SEQ ID NO: 1727644 - DNA, 22 bp, Homo sapiens
tgtgaattaggctgtaactact

SEQ ID NO: 1727645 - DNA, 24 bp, Homo sapiens
tgtgaattaggctgtaactacttt

SEQ ID NO: 1727646 - DNA, 18 bp, Homo sapiens
tgtgaattgagctgcaga

SEQ ID NO: 1727647 - DNA, 19 bp, Homo sapiens
tgtgaatttttaagctgca

SEQ ID NO: 1727648 - DNA, 22 bp, Homo sapiens
tgtgaatttttaagctgcaaat

SEQ ID NO: 1727649 - DNA, 17 bp, Homo sapiens
tgtgaatttttattgtt

SEQ ID NO: 1727650 - DNA, 21 bp, Homo sapiens
tgtgacaattctgtttttaat

SEQ ID NO: 1727651 - DNA, 14 bp, Homo sapiens
tgtgacacctggtg

SEQ ID NO: 1727652 - DNA, 14 bp, Homo sapiens
tgtgacactgatga

SEQ ID NO: 1727653 - DNA, 15 bp, Homo sapiens
tgtgacagtgcctct

SEQ ID NO: 1727654 - DNA, 21 bp, Homo sapiens
tgtgacagtgcctcttccagt

SEQ ID NO: 1727655 - DNA, 17 bp, Homo sapiens
tgtgacagtttccaaat

SEQ ID NO: 1727656 - DNA, 15 bp, Homo sapiens
tgtgacattcgtgaa

SEQ ID NO: 1727657 - DNA, 22 bp, Homo sapiens
tgtgacatttggagagggggcc

SEQ ID NO: 1727658 - DNA, 17 bp, Homo sapiens
tgtgaccaatacatttg

SEQ ID NO: 1727659 - DNA, 21 bp, Homo sapiens
cggaggtctctgggagcccag

SEQ ID NO: 1727660 - DNA, 22 bp, Homo sapiens
cggaggtctctgggagcccaga

SEQ ID NO: 1727661 - DNA, 16 bp, Homo sapiens
cggagtaatcaggcag

SEQ ID NO: 1727662 - DNA, 19 bp, Homo sapiens
cggagtaatcaggcagcct

SEQ ID NO: 1727663 - DNA, 17 bp, Homo sapiens
cggagtcaaaaattaaa

SEQ ID NO: 1727664 - DNA, 19 bp, Homo sapiens
cggagtcagccaggagctg

SEQ ID NO: 1727665 - DNA, 22 bp, Homo sapiens
cggagtcgtggggtgtgctggg

SEQ ID NO: 1727666 - DNA, 23 bp, Homo sapiens
cggagtcgtggggtgtgctggga

SEQ ID NO: 1727667 - DNA, 19 bp, Homo sapiens
cggagtgaagaggggcagc

SEQ ID NO: 1727668 - DNA, 14 bp, Homo sapiens
cggagtgcctggag

SEQ ID NO: 1727669 - DNA, 16 bp, Homo sapiens
cggagtgcctggagtc

SEQ ID NO: 1727670 - DNA, 19 bp, Homo sapiens
cggagtgtgtatgccaaga

SEQ ID NO: 1727671 - DNA, 17 bp, Homo sapiens
cggagttcctaacagga

SEQ ID NO: 1727672 - DNA, 23 bp, Homo sapiens
cggagttcggaaaccgtcctgtg

SEQ ID NO: 1727673 - DNA, 15 bp, Homo sapiens
cggatcatcaacaag

SEQ ID NO: 1727674 - DNA, 19 bp, Homo sapiens
cggatcatcaacaagattt

SEQ ID NO: 1727675 - DNA, 21 bp, Homo sapiens
cggatcatcaacaagatttcc

SEQ ID NO: 1727676 - DNA, 12 bp, Homo sapiens
cggatcctgctg

SEQ ID NO: 1727677 - DNA, 17 bp, Homo sapiens
cggatcctgtgagtagg

SEQ ID NO: 1727678 - DNA, 19 bp, Homo sapiens
cggatctcacaggctgaga

SEQ ID NO: 1727679 - DNA, 16 bp, Homo sapiens
cggatctgctgggctc

SEQ ID NO: 1727680 - DNA, 15 bp, Homo sapiens
cggatgacaccctgg

SEQ ID NO: 1727681 - DNA, 17 bp, Homo sapiens
cggatgacaccctggcc

SEQ ID NO: 1727682 - DNA, 18 bp, Homo sapiens
cggatgacaccctggcct

SEQ ID NO: 1727683 - DNA, 16 bp, Homo sapiens
cggatggatggaaggt

SEQ ID NO: 1727684 - DNA, 18 bp, Homo sapiens
cggatgggccctatgtct

SEQ ID NO: 1727685 - DNA, 13 bp, Homo sapiens
cggatgtgctttt

SEQ ID NO: 1727686 - DNA, 20 bp, Homo sapiens
cggattgctctggagcagcc

SEQ ID NO: 1727687 - DNA, 12 bp, Homo sapiens
cggatttctaac

SEQ ID NO: 1727688 - DNA, 17 bp, Homo sapiens
cggcaacgtagcctggg

SEQ ID NO: 1727689 - DNA, 20 bp, Homo sapiens
cggcaacgtagcctgggctc

SEQ ID NO: 1727690 - DNA, 16 bp, Homo sapiens
cggcacccaggcctcc

SEQ ID NO: 1727691 - DNA, 17 bp, Homo sapiens
cggcacccaggcctccc

SEQ ID NO: 1727692 - DNA, 18 bp, Homo sapiens
cggcacccaggcctccct

SEQ ID NO: 1727693 - DNA, 19 bp, Homo sapiens
cggcacccaggcctccctg

SEQ ID NO: 1727694 - DNA, 23 bp, Homo sapiens
cggcacctacatccccaggtctc

SEQ ID NO: 1727695 - DNA, 15 bp, Homo sapiens
cggcacgcacttgcc

SEQ ID NO: 1727696 - DNA, 21 bp, Homo sapiens
cggcacgcacttgcctgttgg

SEQ ID NO: 1727697 - DNA, 19 bp, Homo sapiens
cggcagagcaattccaggc

SEQ ID NO: 1727698 - DNA, 21 bp, Homo sapiens
cggcagagtccttagtggagg

SEQ ID NO: 1727699 - DNA, 13 bp, Homo sapiens
cggcagccccact

SEQ ID NO: 1727700 - DNA, 14 bp, Homo sapiens
cggcagccccactt

SEQ ID NO: 1727701 - DNA, 16 bp, Homo sapiens
cggcagccccacttca

SEQ ID NO: 1727702 - DNA, 19 bp, Homo sapiens
cggcaggcctgagaatgag

SEQ ID NO: 1727703 - DNA, 21 bp, Homo sapiens
cggcaggcctgagaatgagtg

SEQ ID NO: 1727704 - DNA, 17 bp, Homo sapiens
cggcaggctcactgcca

SEQ ID NO: 1727705 - DNA, 19 bp, Homo sapiens
cggcaggctcactgccagg

SEQ ID NO: 1727706 - DNA, 22 bp, Homo sapiens
cggcaggctcactgccaggcca

SEQ ID NO: 1727707 - DNA, 14 bp, Homo sapiens
cggcaggggcctgg

SEQ ID NO: 1727708 - DNA, 19 bp, Homo sapiens
cggcaggggcctggagatc

SEQ ID NO: 1727709 - DNA, 15 bp, Homo sapiens
cggcatccctgcaga

SEQ ID NO: 1727710 - DNA, 16 bp, Homo sapiens
cggcatgccaggaccc

SEQ ID NO: 1727711 - DNA, 14 bp, Homo sapiens
cggcattcctgctt

SEQ ID NO: 1727712 - DNA, 12 bp, Homo sapiens
cggccaagaatg

SEQ ID NO: 1727713 - DNA, 14 bp, Homo sapiens
cggccaagaatgta

SEQ ID NO: 1727714 - DNA, 18 bp, Homo sapiens
cggccaatggtgcttccc

SEQ ID NO: 1727715 - DNA, 21 bp, Homo sapiens
cggccaatggtgcttccccca

SEQ ID NO: 1727716 - DNA, 11 bp, Homo sapiens
cggccacatgc

SEQ ID NO: 1727717 - DNA, 21 bp, Homo sapiens
cggccacatgccgcgtccctg

SEQ ID NO: 1727718 - DNA, 18 bp, Homo sapiens
cggccacgcactgggcca

SEQ ID NO: 1727719 - DNA, 19 bp, Homo sapiens
cggccacgcactgggccac

SEQ ID NO: 1727720 - DNA, 13 bp, Homo sapiens
cggccacgctccc

SEQ ID NO: 1727721 - DNA, 19 bp, Homo sapiens
cggccagcgggcacagggc

SEQ ID NO: 1727722 - DNA, 23 bp, Homo sapiens
cggccagcgggcacagggcacca

SEQ ID NO: 1727723 - DNA, 13 bp, Homo sapiens
cggccagctctgg

SEQ ID NO: 1727724 - DNA, 15 bp, Homo sapiens
cggccagctctggag

SEQ ID NO: 1727725 - DNA, 23 bp, Homo sapiens
cggccaggcacccatgtgggcgc

SEQ ID NO: 1727726 - DNA, 11 bp, Homo sapiens
cggccagggtt

SEQ ID NO: 1727727 - DNA, 22 bp, Homo sapiens
cggcccacagctcccaccccac

SEQ ID NO: 1727728 - DNA, 17 bp, Homo sapiens
cggcccactttcctgag

SEQ ID NO: 1727729 - DNA, 18 bp, Homo sapiens
cggcccactttcctgagc

SEQ ID NO: 1727730 - DNA, 21 bp, Homo sapiens
cggcccagaagtttccctcaa

SEQ ID NO: 1727731 - DNA, 19 bp, Homo sapiens
cggcccagtgccactgccc

SEQ ID NO: 1727732 - DNA, 12 bp, Homo sapiens
cggccccagcca

SEQ ID NO: 1727733 - DNA, 14 bp, Homo sapiens
cggccccagccaga

SEQ ID NO: 1727734 - DNA, 23 bp, Homo sapiens
tgtgattccatggattgattcag

SEQ ID NO: 1727735 - DNA, 12 bp, Homo sapiens
tgtgattctgtt

SEQ ID NO: 1727736 - DNA, 14 bp, Homo sapiens
tgtgattctgttta

SEQ ID NO: 1727737 - DNA, 15 bp, Homo sapiens
tgtgattgaatctga

SEQ ID NO: 1727738 - DNA, 13 bp, Homo sapiens
tgtgattgctgcc

SEQ ID NO: 1727739 - DNA, 12 bp, Homo sapiens
tgtgattggctg

SEQ ID NO: 1727740 - DNA, 16 bp, Homo sapiens
tgtgattggctggtta

SEQ ID NO: 1727741 - DNA, 22 bp, Homo sapiens
tgtgattggcttaaatccagtt

SEQ ID NO: 1727742 - DNA, 15 bp, Homo sapiens
tgtgatttatttgga

SEQ ID NO: 1727743 - DNA, 16 bp, Homo sapiens
tgtgatttgaattctg

SEQ ID NO: 1727744 - DNA, 14 bp, Homo sapiens
tgtgattttatgtt

SEQ ID NO: 1727745 - DNA, 17 bp, Homo sapiens
tgtgatttttgtttgca

SEQ ID NO: 1727746 - DNA, 13 bp, Homo sapiens
tgtgcaaacatgg

SEQ ID NO: 1727747 - DNA, 18 bp, Homo sapiens
tgtgcaaagatctctaga

SEQ ID NO: 1727748 - DNA, 15 bp, Homo sapiens
tgtgcaacagacaag

SEQ ID NO: 1727749 - DNA, 12 bp, Homo sapiens
tgtgcaacggcc

SEQ ID NO: 1727750 - DNA, 14 bp, Homo sapiens
tgtgcaagaaaact

SEQ ID NO: 1727751 - DNA, 14 bp, Homo sapiens
tgtgcaataatttg

SEQ ID NO: 1727752 - DNA, 23 bp, Homo sapiens
tgtgcacatccgcgtgtgcctgt

SEQ ID NO: 1727753 - DNA, 17 bp, Homo sapiens
tgtgcacccctccccat

SEQ ID NO: 1727754 - DNA, 19 bp, Homo sapiens
tgtgcacgtggcatgtggc

SEQ ID NO: 1727755 - DNA, 19 bp, Homo sapiens
tgtgcactgcctgcatgag

SEQ ID NO: 1727756 - DNA, 19 bp, Homo sapiens
tgtgcagaaaatatttaat

SEQ ID NO: 1727757 - DNA, 13 bp, Homo sapiens
tgtgcagacagcc

SEQ ID NO: 1727758 - DNA, 16 bp, Homo sapiens
tgtgcagacagccatg

SEQ ID NO: 1727759 - DNA, 12 bp, Homo sapiens
tgtgcagcagcc

SEQ ID NO: 1727760 - DNA, 16 bp, Homo sapiens
tgtgcagcagcccagc

SEQ ID NO: 1727761 - DNA, 18 bp, Homo sapiens
tgtgcagcagcccagctt

SEQ ID NO: 1727762 - DNA, 21 bp, Homo sapiens
tgtgcagcagcccagcttcct

SEQ ID NO: 1727763 - DNA, 22 bp, Homo sapiens
tgtgcagcagcccagcttcctg

SEQ ID NO: 1727764 - DNA, 20 bp, Homo sapiens
tgtgcaggaagaaaagcccc

SEQ ID NO: 1727765 - DNA, 13 bp, Homo sapiens
tgtgcaggatatt

SEQ ID NO: 1727766 - DNA, 15 bp, Homo sapiens
tgtgcagggagggca

SEQ ID NO: 1727767 - DNA, 21 bp, Homo sapiens
tgtgcaggtgctgccttgaga

SEQ ID NO: 1727768 - DNA, 19 bp, Homo sapiens
tgtgcagtactttgtgcat

SEQ ID NO: 1727769 - DNA, 12 bp, Homo sapiens
tgtgcagtgttg

SEQ ID NO: 1727770 - DNA, 13 bp, Homo sapiens
tgtgcagttctag

SEQ ID NO: 1727771 - DNA, 22 bp, Homo sapiens
tgtgcagttctagtttgcattc

SEQ ID NO: 1727772 - DNA, 16 bp, Homo sapiens
tgtgcatagcgtcctg

SEQ ID NO: 1727773 - DNA, 17 bp, Homo sapiens
tgtgcatagcgtcctgc

SEQ ID NO: 1727774 - DNA, 13 bp, Homo sapiens
tgtgcatgggtga

SEQ ID NO: 1727775 - DNA, 19 bp, Homo sapiens
tgtgcatgggtgaagggag

SEQ ID NO: 1727776 - DNA, 20 bp, Homo sapiens
tgtgcatgtatgtcttggac

SEQ ID NO: 1727777 - DNA, 23 bp, Homo sapiens
tgtgcatgtatgtcttggacact

SEQ ID NO: 1727778 - DNA, 20 bp, Homo sapiens
cggcggcacccaggcctccc

SEQ ID NO: 1727779 - DNA, 12 bp, Homo sapiens
cggcggccacgc

SEQ ID NO: 1727780 - DNA, 14 bp, Homo sapiens
cggcgggtgacagc

SEQ ID NO: 1727781 - DNA, 22 bp, Homo sapiens
cggcgggtgctctgaggcctca

SEQ ID NO: 1727782 - DNA, 17 bp, Homo sapiens
cggcgtcttgcccagca

SEQ ID NO: 1727783 - DNA, 20 bp, Homo sapiens
cggcgtggtgtgtccctgga

SEQ ID NO: 1727784 - DNA, 22 bp, Homo sapiens
cggcgtggtgtgtccctggaca

SEQ ID NO: 1727785 - DNA, 23 bp, Homo sapiens
cggcgtggtgtgtccctggacac

SEQ ID NO: 1727786 - DNA, 12 bp, Homo sapiens
cggctactcagc

SEQ ID NO: 1727787 - DNA, 18 bp, Homo sapiens
cggctactcagcagccct

SEQ ID NO: 1727788 - DNA, 19 bp, Homo sapiens
cggctactcagcagccctc

SEQ ID NO: 1727789 - DNA, 19 bp, Homo sapiens
cggctcactgaaacctctg

SEQ ID NO: 1727790 - DNA, 23 bp, Homo sapiens
cggctcccctcccaggggagcca

SEQ ID NO: 1727791 - DNA, 14 bp, Homo sapiens
cggctcgtgtattt

SEQ ID NO: 1727792 - DNA, 17 bp, Homo sapiens
cggctctattctctaaa

SEQ ID NO: 1727793 - DNA, 13 bp, Homo sapiens
cggctctggaggc

SEQ ID NO: 1727794 - DNA, 19 bp, Homo sapiens
cggctctgggcctgagggt

SEQ ID NO: 1727795 - DNA, 16 bp, Homo sapiens
cggctgagagccccag

SEQ ID NO: 1727796 - DNA, 18 bp, Homo sapiens
cggctgagagccccagct

SEQ ID NO: 1727797 - DNA, 19 bp, Homo sapiens
cggctgagagccccagctg

SEQ ID NO: 1727798 - DNA, 19 bp, Homo sapiens
cggctgagccccccatgcc

SEQ ID NO: 1727799 - DNA, 20 bp, Homo sapiens
cggctgagtcatgatctccc

SEQ ID NO: 1727800 - DNA, 23 bp, Homo sapiens
cggctgagtcatgatctccctgc

SEQ ID NO: 1727801 - DNA, 16 bp, Homo sapiens
cggctgagtggcagca

SEQ ID NO: 1727802 - DNA, 15 bp, Homo sapiens
cggctgcagaggcca

SEQ ID NO: 1727803 - DNA, 18 bp, Homo sapiens
cggctgccaggttcctgt

SEQ ID NO: 1727804 - DNA, 16 bp, Homo sapiens
cggctggggactgcta

SEQ ID NO: 1727805 - DNA, 20 bp, Homo sapiens
cggctggtcactctgccctc

SEQ ID NO: 1727806 - DNA, 18 bp, Homo sapiens
cggctgtgacgcagccgg

SEQ ID NO: 1727807 - DNA, 18 bp, Homo sapiens
cggctgtgattgctgcca

SEQ ID NO: 1727808 - DNA, 23 bp, Homo sapiens
cggctgtggaccgtggacaggcc

SEQ ID NO: 1727809 - DNA, 17 bp, Homo sapiens
cggctgtttactgcttt

SEQ ID NO: 1727810 - DNA, 16 bp, Homo sapiens
cggcttcactgaccag

SEQ ID NO: 1727811 - DNA, 14 bp, Homo sapiens
cggcttcctttccc

SEQ ID NO: 1727812 - DNA, 20 bp, Homo sapiens
cggcttcttggaccttggcg

SEQ ID NO: 1727813 - DNA, 21 bp, Homo sapiens
cggcttggatcctgggctggg

SEQ ID NO: 1727814 - DNA, 13 bp, Homo sapiens
cgggaacagtgtt

SEQ ID NO: 1727815 - DNA, 16 bp, Homo sapiens
cgggaacatgccccct

SEQ ID NO: 1727816 - DNA, 17 bp, Homo sapiens
cgggaacatgccccctg

SEQ ID NO: 1727817 - DNA, 12 bp, Homo sapiens
cgggaaggaggg

SEQ ID NO: 1727818 - DNA, 20 bp, Homo sapiens
cgggaagggcatgcacgggc

SEQ ID NO: 1727819 - DNA, 21 bp, Homo sapiens
cgggaagggcatgcacgggca

SEQ ID NO: 1727820 - DNA, 14 bp, Homo sapiens
cgggaatcacaggt

SEQ ID NO: 1727821 - DNA, 22 bp, Homo sapiens
cgggaccacagctgctggccag

SEQ ID NO: 1727822 - DNA, 13 bp, Homo sapiens
cgggaccagctca

SEQ ID NO: 1727823 - DNA, 19 bp, Homo sapiens
cgggaccccctggccctgc

SEQ ID NO: 1727824 - DNA, 20 bp, Homo sapiens
cgggacggatagtagacagc

SEQ ID NO: 1727825 - DNA, 19 bp, Homo sapiens
cgggagaagccaccttccc

SEQ ID NO: 1727826 - DNA, 20 bp, Homo sapiens
cgggagcattggcccctgag

SEQ ID NO: 1727827 - DNA, 22 bp, Homo sapiens
cgggagccatgcgccccctccg

SEQ ID NO: 1727828 - DNA, 13 bp, Homo sapiens
cgggaggcaccag

SEQ ID NO: 1727829 - DNA, 20 bp, Homo sapiens
cgggaggcaccagctctgtg

SEQ ID NO: 1727830 - DNA, 20 bp, Homo sapiens
cgggaggcagaggttgcagt

SEQ ID NO: 1727831 - DNA, 19 bp, Homo sapiens
cgggataaactgagcctgt

SEQ ID NO: 1727832 - DNA, 18 bp, Homo sapiens
cgggatcctccacagaga

SEQ ID NO: 1727833 - DNA, 23 bp, Homo sapiens
cgggatcctccacagagaggagg

SEQ ID NO: 1727834 - DNA, 24 bp, Homo sapiens
cgggatgattgcttgagctcagga

SEQ ID NO: 1727835 - DNA, 15 bp, Homo sapiens
cgggatgcgaggctc

SEQ ID NO: 1727836 - DNA, 18 bp, Homo sapiens
cgggatggtcctggggct

SEQ ID NO: 1727837 - DNA, 21 bp, Homo sapiens
cgggattgaagggtcctgccg

SEQ ID NO: 1727838 - DNA, 15 bp, Homo sapiens
cgggcacacagactg

SEQ ID NO: 1727839 - DNA, 19 bp, Homo sapiens
cgggcacagggcaccagag

SEQ ID NO: 1727840 - DNA, 21 bp, Homo sapiens
cgggcacagggcaccagaggc

SEQ ID NO: 1727841 - DNA, 14 bp, Homo sapiens
cgggcacagtggct

SEQ ID NO: 1727842 - DNA, 15 bp, Homo sapiens
cgggcaccagccagc

SEQ ID NO: 1727843 - DNA, 14 bp, Homo sapiens
cgggcagagggctg

SEQ ID NO: 1727844 - DNA, 18 bp, Homo sapiens
cgggcagagggctggagg

SEQ ID NO: 1727845 - DNA, 22 bp, Homo sapiens
cgggcagagggctggaggccca

SEQ ID NO: 1727846 - DNA, 13 bp, Homo sapiens
cgggcagccaccc

SEQ ID NO: 1727847 - DNA, 19 bp, Homo sapiens
cgggcagccacccaagcct

SEQ ID NO: 1727848 - DNA, 12 bp, Homo sapiens
tgtgctctcccc

SEQ ID NO: 1727849 - DNA, 21 bp, Homo sapiens
tgtgctgaggccttatcattc

SEQ ID NO: 1727850 - DNA, 23 bp, Homo sapiens
tgtgctgccatttgatttttcta

SEQ ID NO: 1727851 - DNA, 23 bp, Homo sapiens
tgtgctgcggtcactcaggcctc

SEQ ID NO: 1727852 - DNA, 20 bp, Homo sapiens
tgtgctggaattccacaggg

SEQ ID NO: 1727853 - DNA, 13 bp, Homo sapiens
tgtgctggagatg

SEQ ID NO: 1727854 - DNA, 21 bp, Homo sapiens
tgtgctgggagctccactctg

SEQ ID NO: 1727855 - DNA, 13 bp, Homo sapiens
tgtgctgggccag

SEQ ID NO: 1727856 - DNA, 21 bp, Homo sapiens
tgtgctgggccagtggctggg

SEQ ID NO: 1727857 - DNA, 23 bp, Homo sapiens
tgtgctggtgtcctgaccaccct

SEQ ID NO: 1727858 - DNA, 12 bp, Homo sapiens
tgtgctgtgact

SEQ ID NO: 1727859 - DNA, 21 bp, Homo sapiens
tgtgctgtgcctgctagagca

SEQ ID NO: 1727860 - DNA, 16 bp, Homo sapiens
tgtgcttcgactactg

SEQ ID NO: 1727861 - DNA, 21 bp, Homo sapiens
tgtgcttgaaggccctgctga

SEQ ID NO: 1727862 - DNA, 22 bp, Homo sapiens
tgtgcttggatttgcatattta

SEQ ID NO: 1727863 - DNA, 14 bp, Homo sapiens
tgtgcttgttttat

SEQ ID NO: 1727864 - DNA, 17 bp, Homo sapiens
tgtgctttgcattccta

SEQ ID NO: 1727865 - DNA, 15 bp, Homo sapiens
tgtgcttttctccaa

SEQ ID NO: 1727866 - DNA, 15 bp, Homo sapiens
tgtgctttttaagaa

SEQ ID NO: 1727867 - DNA, 17 bp, Homo sapiens
tgtgctttttttgtgtg

SEQ ID NO: 1727868 - DNA, 14 bp, Homo sapiens
tgtggaaaaccagg

SEQ ID NO: 1727869 - DNA, 12 bp, Homo sapiens
tgtggaaagcct

SEQ ID NO: 1727870 - DNA, 17 bp, Homo sapiens
tgtggaagaactgtgat

SEQ ID NO: 1727871 - DNA, 22 bp, Homo sapiens
tgtggacatgtgggtggagaag

SEQ ID NO: 1727872 - DNA, 22 bp, Homo sapiens
tgtggacgagagggctgtgagc

SEQ ID NO: 1727873 - DNA, 22 bp, Homo sapiens
tgtggactctggtgcctccaga

SEQ ID NO: 1727874 - DNA, 17 bp, Homo sapiens
tgtggagagggaatgtg

SEQ ID NO: 1727875 - DNA, 15 bp, Homo sapiens
tgtggagcagagctc

SEQ ID NO: 1727876 - DNA, 19 bp, Homo sapiens
tgtggagccgaggcctacc

SEQ ID NO: 1727877 - DNA, 18 bp, Homo sapiens
tgtggaggaagagccacc

SEQ ID NO: 1727878 - DNA, 22 bp, Homo sapiens
tgtggaggggcagcctgtgcct

SEQ ID NO: 1727879 - DNA, 13 bp, Homo sapiens
tgtggagggttgc

SEQ ID NO: 1727880 - DNA, 20 bp, Homo sapiens
tgtggagttcaccttggaag

SEQ ID NO: 1727881 - DNA, 22 bp, Homo sapiens
tgtggagttcctgctccgtgga

SEQ ID NO: 1727882 - DNA, 15 bp, Homo sapiens
tgtggatataaaatg

SEQ ID NO: 1727883 - DNA, 22 bp, Homo sapiens
tgtggatatcagggtataaatt

SEQ ID NO: 1727884 - DNA, 14 bp, Homo sapiens
tgtggatcagagat

SEQ ID NO: 1727885 - DNA, 17 bp, Homo sapiens
tgtggatcagagatgca

SEQ ID NO: 1727886 - DNA, 22 bp, Homo sapiens
tgtggatgctccagggcagcct

SEQ ID NO: 1727887 - DNA, 13 bp, Homo sapiens
tgtggatgtgttc

SEQ ID NO: 1727888 - DNA, 15 bp, Homo sapiens
tgtggattaatgtca

SEQ ID NO: 1727889 - DNA, 18 bp, Homo sapiens
tgtggattataaaaaatg

SEQ ID NO: 1727890 - DNA, 19 bp, Homo sapiens
tgtggattataaaaaatgt

SEQ ID NO: 1727891 - DNA, 17 bp, Homo sapiens
tgtggattctgaggccc

SEQ ID NO: 1727892 - DNA, 22 bp, Homo sapiens
tgtggattctgaggccctgccc

SEQ ID NO: 1727893 - DNA, 23 bp, Homo sapiens
tgtggatttgattcattttcctg

SEQ ID NO: 1727894 - DNA, 21 bp, Homo sapiens
tgtggatttttgtggtagtga

SEQ ID NO: 1727895 - DNA, 12 bp, Homo sapiens
cggggccaggag

SEQ ID NO: 1727896 - DNA, 20 bp, Homo sapiens
cggggcccagcgctctcctg

SEQ ID NO: 1727897 - DNA, 23 bp, Homo sapiens
cggggcccagcgctctcctggac

SEQ ID NO: 1727898 - DNA, 19 bp, Homo sapiens
cggggcccttggggcctgg

SEQ ID NO: 1727899 - DNA, 20 bp, Homo sapiens
cggggcccttggggcctggc

SEQ ID NO: 1727900 - DNA, 22 bp, Homo sapiens
cggggcccttggggcctggctt

SEQ ID NO: 1727901 - DNA, 17 bp, Homo sapiens
cggggcctcgggacctc

SEQ ID NO: 1727902 - DNA, 18 bp, Homo sapiens
cggggcctcgggacctca

SEQ ID NO: 1727903 - DNA, 21 bp, Homo sapiens
cggggccttatcgggctccag

SEQ ID NO: 1727904 - DNA, 17 bp, Homo sapiens
cggggctcttctcattt

SEQ ID NO: 1727905 - DNA, 12 bp, Homo sapiens
cggggctggcaa

SEQ ID NO: 1727906 - DNA, 16 bp, Homo sapiens
cggggctggcaagcag

SEQ ID NO: 1727907 - DNA, 13 bp, Homo sapiens
cgggggagagagt

SEQ ID NO: 1727908 - DNA, 18 bp, Homo sapiens
cgggggagagggacactc

SEQ ID NO: 1727909 - DNA, 14 bp, Homo sapiens
cgggggagcccagt

SEQ ID NO: 1727910 - DNA, 15 bp, Homo sapiens
cgggggagcccagtg

SEQ ID NO: 1727911 - DNA, 13 bp, Homo sapiens
cgggggcctgtgg

SEQ ID NO: 1727912 - DNA, 15 bp, Homo sapiens
cgggggcctgtggtg

SEQ ID NO: 1727913 - DNA, 16 bp, Homo sapiens
cgggggctgaggggca

SEQ ID NO: 1727914 - DNA, 20 bp, Homo sapiens
cgggggctgcccttgggcca

SEQ ID NO: 1727915 - DNA, 14 bp, Homo sapiens
cgggggctgcttct

SEQ ID NO: 1727916 - DNA, 17 bp, Homo sapiens
cgggggctgcttctcca

SEQ ID NO: 1727917 - DNA, 17 bp, Homo sapiens
cggggggaaagaaaagg

SEQ ID NO: 1727918 - DNA, 18 bp, Homo sapiens
cggggggaaagaaaagga

SEQ ID NO: 1727919 - DNA, 15 bp, Homo sapiens
cggggtaaaaagtgg

SEQ ID NO: 1727920 - DNA, 18 bp, Homo sapiens
cggggtaaaaagtggctg

SEQ ID NO: 1727921 - DNA, 21 bp, Homo sapiens
cggggtatcctgggggaccca

SEQ ID NO: 1727922 - DNA, 15 bp, Homo sapiens
cggggtcccctctgt

SEQ ID NO: 1727923 - DNA, 13 bp, Homo sapiens
cggggtctgtgct

SEQ ID NO: 1727924 - DNA, 22 bp, Homo sapiens
cggggtgagtccattctcccag

SEQ ID NO: 1727925 - DNA, 15 bp, Homo sapiens
cggggtgctgtggtg

SEQ ID NO: 1727926 - DNA, 14 bp, Homo sapiens
cggggtggcggtgg

SEQ ID NO: 1727927 - DNA, 22 bp, Homo sapiens
cggggtggtggacagggccccc

SEQ ID NO: 1727928 - DNA, 19 bp, Homo sapiens
cgggtcaacatttccaaaa

SEQ ID NO: 1727929 - DNA, 15 bp, Homo sapiens
cgggtccccagctcc

SEQ ID NO: 1727930 - DNA, 17 bp, Homo sapiens
cgggtccccagctcccc

SEQ ID NO: 1727931 - DNA, 15 bp, Homo sapiens
cgggtcccggccgcg

SEQ ID NO: 1727932 - DNA, 19 bp, Homo sapiens
cgggtctcctcccagcggc

SEQ ID NO: 1727933 - DNA, 20 bp, Homo sapiens
cgggtctccttggctgtctg

SEQ ID NO: 1727934 - DNA, 18 bp, Homo sapiens
cgggtctcgcagcctgaa

SEQ ID NO: 1727935 - DNA, 22 bp, Homo sapiens
cgggtctcgcagcctgaagcct

SEQ ID NO: 1727936 - DNA, 19 bp, Homo sapiens
cgggtctctcactgttgca

SEQ ID NO: 1727937 - DNA, 23 bp, Homo sapiens
cgggtctctcactgttgcagtgg

SEQ ID NO: 1727938 - DNA, 15 bp, Homo sapiens
cgggtggatcacctg

SEQ ID NO: 1727939 - DNA, 21 bp, Homo sapiens
cgggtgggagggatggggcca

SEQ ID NO: 1727940 - DNA, 17 bp, Homo sapiens
cgggtgggcctggcctg

SEQ ID NO: 1727941 - DNA, 20 bp, Homo sapiens
cgggtgggcggcggccacgc

SEQ ID NO: 1727942 - DNA, 12 bp, Homo sapiens
cgggtggtcccc

SEQ ID NO: 1727943 - DNA, 13 bp, Homo sapiens
cgggttctagacg

SEQ ID NO: 1727944 - DNA, 21 bp, Homo sapiens
cgggttctagacgcccctccc

SEQ ID NO: 1727945 - DNA, 21 bp, Homo sapiens
cgggttctgcagcggcagagc

SEQ ID NO: 1727946 - DNA, 15 bp, Homo sapiens
cgggttgaaagacat

SEQ ID NO: 1727947 - DNA, 18 bp, Homo sapiens
cgggttgaaagacatcaa

SEQ ID NO: 1727948 - DNA, 16 bp, Homo sapiens
cgggttgtgtgtctgt

SEQ ID NO: 1727949 - DNA, 15 bp, Homo sapiens
cggtaactgtcctgt

SEQ ID NO: 1727950 - DNA, 13 bp, Homo sapiens
cggtaagtgttct

SEQ ID NO: 1727951 - DNA, 18 bp, Homo sapiens
cggtaggttcagccaagg

SEQ ID NO: 1727952 - DNA, 12 bp, Homo sapiens
cggtatcctaaa

SEQ ID NO: 1727953 - DNA, 15 bp, Homo sapiens
cggtatctggcttcc

SEQ ID NO: 1727954 - DNA, 18 bp, Homo sapiens
cggtcactcaggcctctg

SEQ ID NO: 1727955 - DNA, 21 bp, Homo sapiens
cggtcactcaggcctctgcag

SEQ ID NO: 1727956 - DNA, 17 bp, Homo sapiens
cggtcatagtttcctga

SEQ ID NO: 1727957 - DNA, 13 bp, Homo sapiens
cggtccaaagtta

SEQ ID NO: 1727958 - DNA, 21 bp, Homo sapiens
cggtccagctggcctggacag

SEQ ID NO: 1727959 - DNA, 21 bp, Homo sapiens
cggtcccagttttgttgcccc

SEQ ID NO: 1727960 - DNA, 14 bp, Homo sapiens
cggtccctgtccct

SEQ ID NO: 1727961 - DNA, 16 bp, Homo sapiens
cggtctcctgactggt

SEQ ID NO: 1727962 - DNA, 17 bp, Homo sapiens
tgtggtaatctacacca

SEQ ID NO: 1727963 - DNA, 15 bp, Homo sapiens
tgtggtagctccagc

SEQ ID NO: 1727964 - DNA, 17 bp, Homo sapiens
tgtggtaggggcaggga

SEQ ID NO: 1727965 - DNA, 17 bp, Homo sapiens
tgtggtctattgtcgct

SEQ ID NO: 1727966 - DNA, 12 bp, Homo sapiens
tgtggtgagggg

SEQ ID NO: 1727967 - DNA, 20 bp, Homo sapiens
tgtggtgaggggctttctct

SEQ ID NO: 1727968 - DNA, 20 bp, Homo sapiens
tgtggtgatacctataaaga

SEQ ID NO: 1727969 - DNA, 23 bp, Homo sapiens
tgtggtgatacctataaagagga

SEQ ID NO: 1727970 - DNA, 20 bp, Homo sapiens
tgtggtgatggagatgcagt

SEQ ID NO: 1727971 - DNA, 22 bp, Homo sapiens
tgtggtggctccccctctgctt

SEQ ID NO: 1727972 - DNA, 15 bp, Homo sapiens
tgtggtgtagactgt

SEQ ID NO: 1727973 - DNA, 21 bp, Homo sapiens
tgtggttcagtgccttcctct

SEQ ID NO: 1727974 - DNA, 16 bp, Homo sapiens
tgtggttccatgcagc

SEQ ID NO: 1727975 - DNA, 19 bp, Homo sapiens
tgtggttgaaaaccacagt

SEQ ID NO: 1727976 - DNA, 17 bp, Homo sapiens
tgtggtttcatgttagt

SEQ ID NO: 1727977 - DNA, 12 bp, Homo sapiens
tgtggtttcttt

SEQ ID NO: 1727978 - DNA, 21 bp, Homo sapiens
tgtggttttcccctccctggg

SEQ ID NO: 1727979 - DNA, 22 bp, Homo sapiens
tgtggttttcccctccctgggt

SEQ ID NO: 1727980 - DNA, 23 bp, Homo sapiens
tgtggttttcccctccctgggtt

SEQ ID NO: 1727981 - DNA, 16 bp, Homo sapiens
tgtgtaaaaaatggaa

SEQ ID NO: 1727982 - DNA, 18 bp, Homo sapiens
tgtgtaacacttggctct

SEQ ID NO: 1727983 - DNA, 21 bp, Homo sapiens
tgtgtaacatccaagccagag

SEQ ID NO: 1727984 - DNA, 14 bp, Homo sapiens
tgtgtaatatgaaa

SEQ ID NO: 1727985 - DNA, 13 bp, Homo sapiens
tgtgtaatgaaaa

SEQ ID NO: 1727986 - DNA, 22 bp, Homo sapiens
tgtgtaatttaaaattgtgatg

SEQ ID NO: 1727987 - DNA, 14 bp, Homo sapiens
tgtgtacaatgtga

SEQ ID NO: 1727988 - DNA, 15 bp, Homo sapiens
tgtgtacaatgtgag

SEQ ID NO: 1727989 - DNA, 19 bp, Homo sapiens
tgtgtacacctgcggggcc

SEQ ID NO: 1727990 - DNA, 21 bp, Homo sapiens
tgtgtacacctgcggggccac

SEQ ID NO: 1727991 - DNA, 21 bp, Homo sapiens
tgtgtacagatgaatgataaa

SEQ ID NO: 1727992 - DNA, 13 bp, Homo sapiens
tgtgtacagtgaa

SEQ ID NO: 1727993 - DNA, 19 bp, Homo sapiens
tgtgtacagtgtgtaaagt

SEQ ID NO: 1727994 - DNA, 17 bp, Homo sapiens
tgtgtacataactgaaa

SEQ ID NO: 1727995 - DNA, 15 bp, Homo sapiens
tgtgtacctctagaa

SEQ ID NO: 1727996 - DNA, 22 bp, Homo sapiens
tgtgtacctctagaatcccagc

SEQ ID NO: 1727997 - DNA, 19 bp, Homo sapiens
tgtgtacgtgcatgctgta

SEQ ID NO: 1727998 - DNA, 23 bp, Homo sapiens
tgtgtactctttatttctagcag

SEQ ID NO: 1727999 - DNA, 21 bp, Homo sapiens
tgtgtactgattcaagaacaa

SEQ ID NO: 1728000 - DNA, 21 bp, Homo sapiens
tgtgtagacaaatatttggag

SEQ ID NO: 1728001 - DNA, 19 bp, Homo sapiens
tgtgtagcatactggcttc

SEQ ID NO: 1728002 - DNA, 14 bp, Homo sapiens
tgtgtagccgccct

SEQ ID NO: 1728003 - DNA, 14 bp, Homo sapiens
tgtgtagcctgtgc

SEQ ID NO: 1728004 - DNA, 12 bp, Homo sapiens
tgtgtagccttt

SEQ ID NO: 1728005 - DNA, 14 bp, Homo sapiens
tgtgtagccttttt

SEQ ID NO: 1728006 - DNA, 18 bp, Homo sapiens
tgtgtagctgcaaaaata

SEQ ID NO: 1728007 - DNA, 21 bp, Homo sapiens
tgtgtataaaaataaaaaaga

SEQ ID NO: 1728008 - DNA, 21 bp, Homo sapiens
tgtgtatagatgcaagatatt

SEQ ID NO: 1728009 - DNA, 19 bp, Homo sapiens
tgtgtatatgttggtttaa

SEQ ID NO: 1728010 - DNA, 19 bp, Homo sapiens
tgtgtatgctgatgatcaa

SEQ ID NO: 1728011 - DNA, 20 bp, Homo sapiens
tgtgtatgctgatgatcaaa

SEQ ID NO: 1728012 - DNA, 11 bp, Homo sapiens
tgtgtatgtac

SEQ ID NO: 1728013 - DNA, 20 bp, Homo sapiens
tgtgtatgtacttagctgta

SEQ ID NO: 1728014 - DNA, 17 bp, Homo sapiens
cgtacattcaatgttta

SEQ ID NO: 1728015 - DNA, 13 bp, Homo sapiens
cgtaccccaccct

SEQ ID NO: 1728016 - DNA, 15 bp, Homo sapiens
cgtacgcccaggaca

SEQ ID NO: 1728017 - DNA, 22 bp, Homo sapiens
cgtactaggttggacagccccc

SEQ ID NO: 1728018 - DNA, 16 bp, Homo sapiens
cgtagaattccttcga

SEQ ID NO: 1728019 - DNA, 22 bp, Homo sapiens
cgtagcttctaccatgaacaga

SEQ ID NO: 1728020 - DNA, 13 bp, Homo sapiens
cgtaggcagccac

SEQ ID NO: 1728021 - DNA, 20 bp, Homo sapiens
cgtaggcagcctctctgcta

SEQ ID NO: 1728022 - DNA, 19 bp, Homo sapiens
cgtagttaacttgaagaaa

SEQ ID NO: 1728023 - DNA, 21 bp, Homo sapiens
cgtataaatatcagtattctg

SEQ ID NO: 1728024 - DNA, 14 bp, Homo sapiens
cgtatcacagtgtt

SEQ ID NO: 1728025 - DNA, 21 bp, Homo sapiens
cgtatctttaaaaagcagtcc

SEQ ID NO: 1728026 - DNA, 16 bp, Homo sapiens
cgtattcattcagtga

SEQ ID NO: 1728027 - DNA, 21 bp, Homo sapiens
cgtatttatatttggaaagag

SEQ ID NO: 1728028 - DNA, 17 bp, Homo sapiens
cgtcaacgtgcatttta

SEQ ID NO: 1728029 - DNA, 12 bp, Homo sapiens
cgtcaagacatt

SEQ ID NO: 1728030 - DNA, 17 bp, Homo sapiens
cgtcaagagcatgcaca

SEQ ID NO: 1728031 - DNA, 14 bp, Homo sapiens
cgtcaccacctctc

SEQ ID NO: 1728032 - DNA, 16 bp, Homo sapiens
cgtcactccagtgctc

SEQ ID NO: 1728033 - DNA, 22 bp, Homo sapiens
cgtcactccagtgctcagctgt

SEQ ID NO: 1728034 - DNA, 15 bp, Homo sapiens
cgtcagtgcctaccc

SEQ ID NO: 1728035 - DNA, 16 bp, Homo sapiens
cgtcattgctgctgct

SEQ ID NO: 1728036 - DNA, 21 bp, Homo sapiens
cgtcattgctgctgctaccag

SEQ ID NO: 1728037 - DNA, 22 bp, Homo sapiens
cgtcattgctgctgctaccagc

SEQ ID NO: 1728038 - DNA, 18 bp, Homo sapiens
cgtccaatcatgggccac

SEQ ID NO: 1728039 - DNA, 14 bp, Homo sapiens
cgtccacaggggca

SEQ ID NO: 1728040 - DNA, 19 bp, Homo sapiens
cgtccacaggggcaggcct

SEQ ID NO: 1728041 - DNA, 17 bp, Homo sapiens
cgtccacccaggctgca

SEQ ID NO: 1728042 - DNA, 23 bp, Homo sapiens
cgtccacccaggctgcactgcag

SEQ ID NO: 1728043 - DNA, 15 bp, Homo sapiens
cgtccacccttccat

SEQ ID NO: 1728044 - DNA, 16 bp, Homo sapiens
cgtccacccttccatc

SEQ ID NO: 1728045 - DNA, 21 bp, Homo sapiens
cgtccagccgccattgccacc

SEQ ID NO: 1728046 - DNA, 19 bp, Homo sapiens
cgtccaggagcctgtgcct

SEQ ID NO: 1728047 - DNA, 12 bp, Homo sapiens
cgtccaggcccc

SEQ ID NO: 1728048 - DNA, 21 bp, Homo sapiens
cgtccaggccgcgccctttcc

SEQ ID NO: 1728049 - DNA, 21 bp, Homo sapiens
cgtccaggggagatggggagg

SEQ ID NO: 1728050 - DNA, 21 bp, Homo sapiens
cgtccaggttcaacccacagc

SEQ ID NO: 1728051 - DNA, 18 bp, Homo sapiens
cgtccatagcagtacccc

SEQ ID NO: 1728052 - DNA, 20 bp, Homo sapiens
cgtccatatcagaactgtgc

SEQ ID NO: 1728053 - DNA, 23 bp, Homo sapiens
cgtccatcacgttagctgtccca

SEQ ID NO: 1728054 - DNA, 16 bp, Homo sapiens
cgtccatggcaccagc

SEQ ID NO: 1728055 - DNA, 19 bp, Homo sapiens
cgtcccacgtctcctcctc

SEQ ID NO: 1728056 - DNA, 15 bp, Homo sapiens
cgtcccagcatccct

SEQ ID NO: 1728057 - DNA, 17 bp, Homo sapiens
cgtcccagcatccctgg

SEQ ID NO: 1728058 - DNA, 18 bp, Homo sapiens
cgtcccagcatccctgga

SEQ ID NO: 1728059 - DNA, 19 bp, Homo sapiens
cgtcccagctgaaggcagt

SEQ ID NO: 1728060 - DNA, 12 bp, Homo sapiens
cgtcccagggct

SEQ ID NO: 1728061 - DNA, 23 bp, Homo sapiens
cgtcccagggtacccgcctgagc

SEQ ID NO: 1728062 - DNA, 13 bp, Homo sapiens
cgtccccactccc

SEQ ID NO: 1728063 - DNA, 21 bp, Homo sapiens
cgtcccctccgccgtgccggc

SEQ ID NO: 1728064 - DNA, 13 bp, Homo sapiens
cgtcccctgctac

SEQ ID NO: 1728065 - DNA, 22 bp, Homo sapiens
cgtcccgctgctgtgctctggg

SEQ ID NO: 1728066 - DNA, 11 bp, Homo sapiens
cgtccctggcg

SEQ ID NO: 1728067 - DNA, 14 bp, Homo sapiens
cgtccctggcgcag

SEQ ID NO: 1728068 - DNA, 17 bp, Homo sapiens
cgtcccttggtgagaaa

SEQ ID NO: 1728069 - DNA, 12 bp, Homo sapiens
cgtccgccctgc

SEQ ID NO: 1728070 - DNA, 17 bp, Homo sapiens
cgtcctccccctgccag

SEQ ID NO: 1728071 - DNA, 17 bp, Homo sapiens
cgtcctcccgggccctc

SEQ ID NO: 1728072 - DNA, 18 bp, Homo sapiens
cgtcctcccgggccctcc

SEQ ID NO: 1728073 - DNA, 14 bp, Homo sapiens
cgtcctcgtggcgg

SEQ ID NO: 1728074 - DNA, 23 bp, Homo sapiens
cgtcctgacggcgcccccagtgt

SEQ ID NO: 1728075 - DNA, 12 bp, Homo sapiens
cgtcctgccctg

SEQ ID NO: 1728076 - DNA, 14 bp, Homo sapiens
tgtgtgcatgtgtg

SEQ ID NO: 1728077 - DNA, 15 bp, Homo sapiens
tgtgtgcatgtgtgt

SEQ ID NO: 1728078 - DNA, 13 bp, Homo sapiens
tgtgtgcctgtgg

SEQ ID NO: 1728079 - DNA, 16 bp, Homo sapiens
tgtgtgcgctgcctgg

SEQ ID NO: 1728080 - DNA, 17 bp, Homo sapiens
tgtgtgcgctgcctggc

SEQ ID NO: 1728081 - DNA, 19 bp, Homo sapiens
tgtgtgcggagtcattttg

SEQ ID NO: 1728082 - DNA, 16 bp, Homo sapiens
tgtgtggactgtggca

SEQ ID NO: 1728083 - DNA, 22 bp, Homo sapiens
tgtgtggagctcgctaaagtca

SEQ ID NO: 1728084 - DNA, 23 bp, Homo sapiens
tgtgtggattgcctctgaaaagt

SEQ ID NO: 1728085 - DNA, 15 bp, Homo sapiens
tgtgtggcagggggc

SEQ ID NO: 1728086 - DNA, 14 bp, Homo sapiens
tgtgtggcctgcct

SEQ ID NO: 1728087 - DNA, 12 bp, Homo sapiens
tgtgtggctcct

SEQ ID NO: 1728088 - DNA, 13 bp, Homo sapiens
tgtgtgggcaggg

SEQ ID NO: 1728089 - DNA, 14 bp, Homo sapiens
tgtgtgggcagggt

SEQ ID NO: 1728090 - DNA, 20 bp, Homo sapiens
tgtgtggtgaggggctttct

SEQ ID NO: 1728091 - DNA, 15 bp, Homo sapiens
tgtgtgtatgctgat

SEQ ID NO: 1728092 - DNA, 15 bp, Homo sapiens
tgtgtgtatgtgtgt

SEQ ID NO: 1728093 - DNA, 20 bp, Homo sapiens
tgtgtgtatttgtattaata

SEQ ID NO: 1728094 - DNA, 14 bp, Homo sapiens
tgtgtgtcaggccc

SEQ ID NO: 1728095 - DNA, 16 bp, Homo sapiens
tgtgtgtccaaaactg

SEQ ID NO: 1728096 - DNA, 16 bp, Homo sapiens
tgtgtgtgagctaccg

SEQ ID NO: 1728097 - DNA, 13 bp, Homo sapiens
tgtgtgtggcagg

SEQ ID NO: 1728098 - DNA, 13 bp, Homo sapiens
tgtgtgtgtatgt

SEQ ID NO: 1728099 - DNA, 14 bp, Homo sapiens
tgtgtgtgtatgtt

SEQ ID NO: 1728100 - DNA, 12 bp, Homo sapiens
tgtgtgtgtgca

SEQ ID NO: 1728101 - DNA, 12 bp, Homo sapiens
tgtgtgtgtgta

SEQ ID NO: 1728102 - DNA, 13 bp, Homo sapiens
tgtgtgtgtgtat

SEQ ID NO: 1728103 - DNA, 15 bp, Homo sapiens
tgtgtgtgtgtatga

SEQ ID NO: 1728104 - DNA, 14 bp, Homo sapiens
tgtgtgtgtgtgcg

SEQ ID NO: 1728105 - DNA, 14 bp, Homo sapiens
tgtgtgtgtgtgtg

SEQ ID NO: 1728106 - DNA, 14 bp, Homo sapiens
tgtgtgtgtgtttg

SEQ ID NO: 1728107 - DNA, 23 bp, Homo sapiens
tgtgtgttctgtaatggaactga

SEQ ID NO: 1728108 - DNA, 22 bp, Homo sapiens
tgtgtgttgatcccaagacaat

SEQ ID NO: 1728109 - DNA, 15 bp, Homo sapiens
tgtgtgttttcccaa

SEQ ID NO: 1728110 - DNA, 14 bp, Homo sapiens
tgtgttaaaaggaa

SEQ ID NO: 1728111 - DNA, 17 bp, Homo sapiens
tgtgttaaacatgctaa

SEQ ID NO: 1728112 - DNA, 19 bp, Homo sapiens
tgtgttaagtatgtgtaaa

SEQ ID NO: 1728113 - DNA, 18 bp, Homo sapiens
tgtgttactgctttgcaa

SEQ ID NO: 1728114 - DNA, 14 bp, Homo sapiens
tgtgttagttccca

SEQ ID NO: 1728115 - DNA, 17 bp, Homo sapiens
tgtgttagttcccaaca

SEQ ID NO: 1728116 - DNA, 19 bp, Homo sapiens
tgtgttcaatatttagaaa

SEQ ID NO: 1728117 - DNA, 16 bp, Homo sapiens
tgtgttcattcaagct

SEQ ID NO: 1728118 - DNA, 12 bp, Homo sapiens
tgtgttcatttc

SEQ ID NO: 1728119 - DNA, 15 bp, Homo sapiens
tgtgttcatttcatt

SEQ ID NO: 1728120 - DNA, 22 bp, Homo sapiens
tgtgttcatttggtgttcctgg

SEQ ID NO: 1728121 - DNA, 17 bp, Homo sapiens
tgtgttcccatttcagc

SEQ ID NO: 1728122 - DNA, 19 bp, Homo sapiens
tgtgttcccatttcagctg

SEQ ID NO: 1728123 - DNA, 18 bp, Homo sapiens
tgtgttcctggcccactc

SEQ ID NO: 1728124 - DNA, 13 bp, Homo sapiens
tgtgttcctggct

SEQ ID NO: 1728125 - DNA, 18 bp, Homo sapiens
tgtgttctgtttgttaaa

SEQ ID NO: 1728126 - DNA, 15 bp, Homo sapiens
tgtgttgctatcctg

SEQ ID NO: 1728127 - DNA, 19 bp, Homo sapiens
tgtgttgttttttgttcaa

SEQ ID NO: 1728128 - DNA, 14 bp, Homo sapiens
tgtgtttaaataaa

SEQ ID NO: 1728129 - DNA, 12 bp, Homo sapiens
tgtgtttattca

SEQ ID NO: 1728130 - DNA, 23 bp, Homo sapiens
tgtgtttattcaaactgaaaagc

SEQ ID NO: 1728131 - DNA, 12 bp, Homo sapiens
tgtgtttattct

SEQ ID NO: 1728132 - DNA, 14 bp, Homo sapiens
tgtgtttatttcac

SEQ ID NO: 1728133 - DNA, 18 bp, Homo sapiens
tgtgtttccaaaggttcc

SEQ ID NO: 1728134 - DNA, 17 bp, Homo sapiens
tggtctggttgggcagc

SEQ ID NO: 1728135 - DNA, 14 bp, Homo sapiens
tggtctgttggcag

SEQ ID NO: 1728136 - DNA, 14 bp, Homo sapiens
tggtcttaaatgct

SEQ ID NO: 1728137 - DNA, 16 bp, Homo sapiens
tggtcttgtggaattg

SEQ ID NO: 1728138 - DNA, 14 bp, Homo sapiens
tggtctttaatgaa

SEQ ID NO: 1728139 - DNA, 17 bp, Homo sapiens
tggtctttctggagagg

SEQ ID NO: 1728140 - DNA, 14 bp, Homo sapiens
tggtctttctgtgc

SEQ ID NO: 1728141 - DNA, 15 bp, Homo sapiens
tggtctttgctccag

SEQ ID NO: 1728142 - DNA, 17 bp, Homo sapiens
tggtctttgctccagat

SEQ ID NO: 1728143 - DNA, 15 bp, Homo sapiens
tggtgaacacacacg

SEQ ID NO: 1728144 - DNA, 16 bp, Homo sapiens
tggtgaacactgtgac

SEQ ID NO: 1728145 - DNA, 20 bp, Homo sapiens
tggtgaagggaagtggggag

SEQ ID NO: 1728146 - DNA, 16 bp, Homo sapiens
tggtgaatttcacaag

SEQ ID NO: 1728147 - DNA, 20 bp, Homo sapiens
tggtgaattttcaaggcctt

SEQ ID NO: 1728148 - DNA, 14 bp, Homo sapiens
tggtgacattgaaa

SEQ ID NO: 1728149 - DNA, 15 bp, Homo sapiens
tggtgacctgggtat

SEQ ID NO: 1728150 - DNA, 16 bp, Homo sapiens
tggtgagagtcaaagc

SEQ ID NO: 1728151 - DNA, 20 bp, Homo sapiens
tggtgagcctagccctggga

SEQ ID NO: 1728152 - DNA, 13 bp, Homo sapiens
tggtgagctggga

SEQ ID NO: 1728153 - DNA, 21 bp, Homo sapiens
tggtgaggctgacatgctcac

SEQ ID NO: 1728154 - DNA, 22 bp, Homo sapiens
tggtgagtcttggcggcagcag

SEQ ID NO: 1728155 - DNA, 15 bp, Homo sapiens
tggtgatctgtagac

SEQ ID NO: 1728156 - DNA, 18 bp, Homo sapiens
tggtgattttaaatgtgt

SEQ ID NO: 1728157 - DNA, 19 bp, Homo sapiens
tggtgattttaaatgtgtg

SEQ ID NO: 1728158 - DNA, 14 bp, Homo sapiens
tggtgcaaatccta

SEQ ID NO: 1728159 - DNA, 17 bp, Homo sapiens
tggtgcaaattcagaac

SEQ ID NO: 1728160 - DNA, 20 bp, Homo sapiens
tggtgcagaggtttcttgaa

SEQ ID NO: 1728161 - DNA, 14 bp, Homo sapiens
tggtgcatgggctc

SEQ ID NO: 1728162 - DNA, 15 bp, Homo sapiens
tggtgcattgctgtg

SEQ ID NO: 1728163 - DNA, 19 bp, Homo sapiens
tggtgccaaatagccccag

SEQ ID NO: 1728164 - DNA, 23 bp, Homo sapiens
tggtgccacttcttaaaggcctg

SEQ ID NO: 1728165 - DNA, 20 bp, Homo sapiens
tggtgccatttctgaactgt

SEQ ID NO: 1728166 - DNA, 21 bp, Homo sapiens
tggtgccatttctgaactgtt

SEQ ID NO: 1728167 - DNA, 22 bp, Homo sapiens
tggtgccatttctgaactgtta

SEQ ID NO: 1728168 - DNA, 17 bp, Homo sapiens
tggtgcccatcctcccg

SEQ ID NO: 1728169 - DNA, 19 bp, Homo sapiens
tggtgccccacctgcctgg

SEQ ID NO: 1728170 - DNA, 20 bp, Homo sapiens
tggtgccccacctgcctggt

SEQ ID NO: 1728171 - DNA, 17 bp, Homo sapiens
tggtgccccaggaccag

SEQ ID NO: 1728172 - DNA, 18 bp, Homo sapiens
tggtgccccaggaccagc

SEQ ID NO: 1728173 - DNA, 21 bp, Homo sapiens
tggtgccccaggaccagctca

SEQ ID NO: 1728174 - DNA, 23 bp, Homo sapiens
tggtgccccccacccctggaaga

SEQ ID NO: 1728175 - DNA, 17 bp, Homo sapiens
tggtgcccgtgcccgca

SEQ ID NO: 1728176 - DNA, 17 bp, Homo sapiens
tggtgccctcctcactc

SEQ ID NO: 1728177 - DNA, 13 bp, Homo sapiens
tggtgcctctgtg

SEQ ID NO: 1728178 - DNA, 14 bp, Homo sapiens
tggtgcctctgtgc

SEQ ID NO: 1728179 - DNA, 18 bp, Homo sapiens
tggtgcctgagaggcagg

SEQ ID NO: 1728180 - DNA, 19 bp, Homo sapiens
tggtgcctgagaggcaggc

SEQ ID NO: 1728181 - DNA, 20 bp, Homo sapiens
tggtgcctgagaggcaggca

SEQ ID NO: 1728182 - DNA, 17 bp, Homo sapiens
tggtgcctggcctggca

SEQ ID NO: 1728183 - DNA, 18 bp, Homo sapiens
tggtgcgggcacaataaa

SEQ ID NO: 1728184 - DNA, 14 bp, Homo sapiens
tggtgcgggcctgg

SEQ ID NO: 1728185 - DNA, 15 bp, Homo sapiens
tggtgcgggcctggc

SEQ ID NO: 1728186 - DNA, 20 bp, Homo sapiens
tggtgcgggcctggccctca

SEQ ID NO: 1728187 - DNA, 16 bp, Homo sapiens
tggtgctctctgccac

SEQ ID NO: 1728188 - DNA, 13 bp, Homo sapiens
tggtgctgccaca

SEQ ID NO: 1728189 - DNA, 18 bp, Homo sapiens
tggtgctgccacacttca

SEQ ID NO: 1728190 - DNA, 18 bp, Homo sapiens
tggtgctgccttgcttct

SEQ ID NO: 1728191 - DNA, 23 bp, Homo sapiens
tggtgctgtgtgccccactccag

SEQ ID NO: 1728192 - DNA, 21 bp, Homo sapiens
tggtgctgtttaaagtcacat

SEQ ID NO: 1728193 - DNA, 18 bp, Homo sapiens
tggtgcttcccccacccc

SEQ ID NO: 1728194 - DNA, 23 bp, Homo sapiens
tggtgcttcccccacccctccac

SEQ ID NO: 1728195 - DNA, 17 bp, Homo sapiens
tggtggagcagccagag

SEQ ID NO: 1728196 - DNA, 17 bp, Homo sapiens
tggtggagccagggcct

SEQ ID NO: 1728197 - DNA, 19 bp, Homo sapiens
tggtggatctaagaagggc

SEQ ID NO: 1728198 - DNA, 16 bp, Homo sapiens
tggtggcactgagccc

SEQ ID NO: 1728199 - DNA, 19 bp, Homo sapiens
tggtggcccgacagcctgg

SEQ ID NO: 1728200 - DNA, 12 bp, Homo sapiens
tggtggccctgt

SEQ ID NO: 1728201 - DNA, 15 bp, Homo sapiens
tggtggcctggtccc

SEQ ID NO: 1728202 - DNA, 14 bp, Homo sapiens
tggtggccttgggc

SEQ ID NO: 1728203 - DNA, 16 bp, Homo sapiens
tggtggcgcaagcctg

SEQ ID NO: 1728204 - DNA, 17 bp, Homo sapiens
tggtggcgcaagcctgt

SEQ ID NO: 1728205 - DNA, 23 bp, Homo sapiens
tggtggcgctttctcctgtgccc

SEQ ID NO: 1728206 - DNA, 17 bp, Homo sapiens
tggtggcgggcacctgt

SEQ ID NO: 1728207 - DNA, 14 bp, Homo sapiens
tggtggctcatggc

SEQ ID NO: 1728208 - DNA, 21 bp, Homo sapiens
tggtggctgggcccagcaggg

SEQ ID NO: 1728209 - DNA, 21 bp, Homo sapiens
tggtgggaagcgtctgtccgt

SEQ ID NO: 1728210 - DNA, 23 bp, Homo sapiens
tggtgggaaggccggcagcgggc

SEQ ID NO: 1728211 - DNA, 19 bp, Homo sapiens
tggtgggacactgggcagc

SEQ ID NO: 1728212 - DNA, 15 bp, Homo sapiens
tggtgggagggggag

SEQ ID NO: 1728213 - DNA, 22 bp, Homo sapiens
tggtgggcccagaccactgtct

SEQ ID NO: 1728214 - DNA, 23 bp, Homo sapiens
tggtggggaggggcgctggccca

SEQ ID NO: 1728215 - DNA, 16 bp, Homo sapiens
tggtggggatattttt

SEQ ID NO: 1728216 - DNA, 19 bp, Homo sapiens
tggtggggctgagcctgag

SEQ ID NO: 1728217 - DNA, 15 bp, Homo sapiens
tggtggggggcaggg

SEQ ID NO: 1728218 - DNA, 18 bp, Homo sapiens
tggtggggggtccagtct

SEQ ID NO: 1728219 - DNA, 19 bp, Homo sapiens
tggtggggggtccagtctg

SEQ ID NO: 1728220 - DNA, 20 bp, Homo sapiens
tggtgggtaattgtacaata

SEQ ID NO: 1728221 - DNA, 21 bp, Homo sapiens
tggtgggtcagcccagcacct

SEQ ID NO: 1728222 - DNA, 16 bp, Homo sapiens
tggtgggtgtggccag

SEQ ID NO: 1728223 - DNA, 19 bp, Homo sapiens
tggtgggttcaggggactc

SEQ ID NO: 1728224 - DNA, 14 bp, Homo sapiens
tggtggtagagaag

SEQ ID NO: 1728225 - DNA, 15 bp, Homo sapiens
tggtgtaatttgaag

SEQ ID NO: 1728226 - DNA, 15 bp, Homo sapiens
tggtgtagaacacta

SEQ ID NO: 1728227 - DNA, 17 bp, Homo sapiens
tggtgtagaacactaat

SEQ ID NO: 1728228 - DNA, 13 bp, Homo sapiens
tggtgtagctgtc

SEQ ID NO: 1728229 - DNA, 15 bp, Homo sapiens
tggtgtatgcacagg

SEQ ID NO: 1728230 - DNA, 17 bp, Homo sapiens
tggtgtattatcatttt

SEQ ID NO: 1728231 - DNA, 21 bp, Homo sapiens
tggtgtatttttcaggtaggc

SEQ ID NO: 1728232 - DNA, 13 bp, Homo sapiens
tggtgtccacctg

SEQ ID NO: 1728233 - DNA, 17 bp, Homo sapiens
tggtgtcctgaccaccc

SEQ ID NO: 1728234 - DNA, 11 bp, Homo sapiens
tggtgtctcca

SEQ ID NO: 1728235 - DNA, 15 bp, Homo sapiens
tggtgtgaaagtcag

SEQ ID NO: 1728236 - DNA, 16 bp, Homo sapiens
tggtgtggctgctccc

SEQ ID NO: 1728237 - DNA, 17 bp, Homo sapiens
tggtgtgggtgtcctgc

SEQ ID NO: 1728238 - DNA, 21 bp, Homo sapiens
tggtgtgtccctggacacagc

SEQ ID NO: 1728239 - DNA, 16 bp, Homo sapiens
ccttcccaggcccttt

SEQ ID NO: 1728240 - DNA, 15 bp, Homo sapiens
ccttcccatcgctgt

SEQ ID NO: 1728241 - DNA, 17 bp, Homo sapiens
ccttcccatttctctac

SEQ ID NO: 1728242 - DNA, 15 bp, Homo sapiens
ccttcccatttcttc

SEQ ID NO: 1728243 - DNA, 15 bp, Homo sapiens
ccttccccagacttg

SEQ ID NO: 1728244 - DNA, 19 bp, Homo sapiens
ccttccccagacttgcact

SEQ ID NO: 1728245 - DNA, 13 bp, Homo sapiens
ccttccccagcct

SEQ ID NO: 1728246 - DNA, 17 bp, Homo sapiens
ccttcccccagcccatc

SEQ ID NO: 1728247 - DNA, 19 bp, Homo sapiens
ccttccccctccaatccca

SEQ ID NO: 1728248 - DNA, 13 bp, Homo sapiens
ccttcccctgcac

SEQ ID NO: 1728249 - DNA, 15 bp, Homo sapiens
ccttcccctgcacct

SEQ ID NO: 1728250 - DNA, 18 bp, Homo sapiens
ccttccccttgcccaggg

SEQ ID NO: 1728251 - DNA, 22 bp, Homo sapiens
ccttccccttgcccagggctca

SEQ ID NO: 1728252 - DNA, 18 bp, Homo sapiens
ccttcccctttactcagc

SEQ ID NO: 1728253 - DNA, 19 bp, Homo sapiens
ccttcccctttactcagcc

SEQ ID NO: 1728254 - DNA, 18 bp, Homo sapiens
ccttccccttttgcctgg

SEQ ID NO: 1728255 - DNA, 16 bp, Homo sapiens
ccttcccgcctcggct

SEQ ID NO: 1728256 - DNA, 15 bp, Homo sapiens
ccttccctagcttta

SEQ ID NO: 1728257 - DNA, 14 bp, Homo sapiens
ccttccctcttccc

SEQ ID NO: 1728258 - DNA, 16 bp, Homo sapiens
ccttccctcttccctc

SEQ ID NO: 1728259 - DNA, 14 bp, Homo sapiens
ccttccctgccact

SEQ ID NO: 1728260 - DNA, 14 bp, Homo sapiens
ccttccctggcctt

SEQ ID NO: 1728261 - DNA, 14 bp, Homo sapiens
ccttccctgggaag

SEQ ID NO: 1728262 - DNA, 13 bp, Homo sapiens
ccttccctgggag

SEQ ID NO: 1728263 - DNA, 14 bp, Homo sapiens
ccttccctgggctg

SEQ ID NO: 1728264 - DNA, 18 bp, Homo sapiens
ccttccctgggctgtgct

SEQ ID NO: 1728265 - DNA, 16 bp, Homo sapiens
ccttccctgtccctct

SEQ ID NO: 1728266 - DNA, 13 bp, Homo sapiens
ccttcccttctct

SEQ ID NO: 1728267 - DNA, 21 bp, Homo sapiens
ccttccgggtctcgcagcctg

SEQ ID NO: 1728268 - DNA, 22 bp, Homo sapiens
ccttccgggtctcgcagcctga

SEQ ID NO: 1728269 - DNA, 22 bp, Homo sapiens
ccttcctcagtttaatccttct

SEQ ID NO: 1728270 - DNA, 13 bp, Homo sapiens
ccttcctcatccc

SEQ ID NO: 1728271 - DNA, 14 bp, Homo sapiens
ccttcctccccaca

SEQ ID NO: 1728272 - DNA, 20 bp, Homo sapiens
ccttcctcctccacagtgct

SEQ ID NO: 1728273 - DNA, 12 bp, Homo sapiens
ccttcctcctga

SEQ ID NO: 1728274 - DNA, 14 bp, Homo sapiens
ccttcctctccact

SEQ ID NO: 1728275 - DNA, 16 bp, Homo sapiens
ccttcctctccactgc

SEQ ID NO: 1728276 - DNA, 17 bp, Homo sapiens
ccttcctctccactgcc

SEQ ID NO: 1728277 - DNA, 18 bp, Homo sapiens
ccttcctctgcagctgac

SEQ ID NO: 1728278 - DNA, 19 bp, Homo sapiens
ccttcctcttcctgccctt

SEQ ID NO: 1728279 - DNA, 20 bp, Homo sapiens
ccttcctcttcctgcccttg

SEQ ID NO: 1728280 - DNA, 16 bp, Homo sapiens
ccttcctcttggctga

SEQ ID NO: 1728281 - DNA, 21 bp, Homo sapiens
ccttcctcttgtctgatttct

SEQ ID NO: 1728282 - DNA, 17 bp, Homo sapiens
ccttcctgagacctcgc

SEQ ID NO: 1728283 - DNA, 16 bp, Homo sapiens
ccttcctgctgctgct

SEQ ID NO: 1728284 - DNA, 18 bp, Homo sapiens
ccttcctgctgctgctac

SEQ ID NO: 1728285 - DNA, 11 bp, Homo sapiens
ccttcctggaa

SEQ ID NO: 1728286 - DNA, 21 bp, Homo sapiens
ccttcctggagcccagaggag

SEQ ID NO: 1728287 - DNA, 13 bp, Homo sapiens
ccttcctggcctc

SEQ ID NO: 1728288 - DNA, 15 bp, Homo sapiens
ccttcctggcctcac

SEQ ID NO: 1728289 - DNA, 22 bp, Homo sapiens
ccttcctggcctcactggctgg

SEQ ID NO: 1728290 - DNA, 23 bp, Homo sapiens
ccttcctggcctcactggctggg

SEQ ID NO: 1728291 - DNA, 16 bp, Homo sapiens
ccttcctggcctgaga

SEQ ID NO: 1728292 - DNA, 19 bp, Homo sapiens
ccttcctggggcatctggc

SEQ ID NO: 1728293 - DNA, 17 bp, Homo sapiens
ccttcctgtttcagacc

SEQ ID NO: 1728294 - DNA, 17 bp, Homo sapiens
ccttccttaagccagga

SEQ ID NO: 1728295 - DNA, 12 bp, Homo sapiens
ccttccttcagg

SEQ ID NO: 1728296 - DNA, 13 bp, Homo sapiens
ccttccttcccac

SEQ ID NO: 1728297 - DNA, 12 bp, Homo sapiens
ccttccttccct

SEQ ID NO: 1728298 - DNA, 23 bp, Homo sapiens
ccttccttccctggctacttccc

SEQ ID NO: 1728299 - DNA, 20 bp, Homo sapiens
ccttccttgctgtcctaggc

SEQ ID NO: 1728300 - DNA, 20 bp, Homo sapiens
ccttcctttctcctgcccca

SEQ ID NO: 1728301 - DNA, 14 bp, Homo sapiens
ccttcgaaaggcct

SEQ ID NO: 1728302 - DNA, 18 bp, Homo sapiens
ccttcgaaaggccttcag

SEQ ID NO: 1728303 - DNA, 15 bp, Homo sapiens
ccttcgatacaccgg

SEQ ID NO: 1728304 - DNA, 20 bp, Homo sapiens
ccttcgatacaccgggcctg

SEQ ID NO: 1728305 - DNA, 22 bp, Homo sapiens
ccttcgatacaccgggcctgga

SEQ ID NO: 1728306 - DNA, 19 bp, Homo sapiens
ccttcgcttcttgcctctg

SEQ ID NO: 1728307 - DNA, 21 bp, Homo sapiens
ccttcgcttcttgcctctgtg

SEQ ID NO: 1728308 - DNA, 17 bp, Homo sapiens
ccttcgtctttcccatg

SEQ ID NO: 1728309 - DNA, 13 bp, Homo sapiens
ccttcgtgccccc

SEQ ID NO: 1728310 - DNA, 21 bp, Homo sapiens
ccttcgtggttatagccctgc

SEQ ID NO: 1728311 - DNA, 13 bp, Homo sapiens
ccttcgtgtctct

SEQ ID NO: 1728312 - DNA, 18 bp, Homo sapiens
ccttcgtgtctctcccac

SEQ ID NO: 1728313 - DNA, 22 bp, Homo sapiens
ccttcgtgtctctcccaccccg

SEQ ID NO: 1728314 - DNA, 17 bp, Homo sapiens
ccttcgttaactgtgta

SEQ ID NO: 1728315 - DNA, 10 bp, Homo sapiens
ccttctaaaa

SEQ ID NO: 1728316 - DNA, 14 bp, Homo sapiens
ccttctacaaggac

SEQ ID NO: 1728317 - DNA, 21 bp, Homo sapiens
ccttctaccccaaggccagta

SEQ ID NO: 1728318 - DNA, 15 bp, Homo sapiens
ccttctactcccctt

SEQ ID NO: 1728319 - DNA, 14 bp, Homo sapiens
ccttctactgagcc

SEQ ID NO: 1728320 - DNA, 22 bp, Homo sapiens
ccttctagtcttggccagccaa

SEQ ID NO: 1728321 - DNA, 17 bp, Homo sapiens
ccttctagtttcccaca

SEQ ID NO: 1728322 - DNA, 19 bp, Homo sapiens
ccttctatacccacccaga

SEQ ID NO: 1728323 - DNA, 20 bp, Homo sapiens
ccttctatacccacccagaa

SEQ ID NO: 1728324 - DNA, 15 bp, Homo sapiens
ccttctattctagcc

SEQ ID NO: 1728325 - DNA, 15 bp, Homo sapiens
ccttctattggtctc

SEQ ID NO: 1728326 - DNA, 15 bp, Homo sapiens
ccttctcaggccccg

SEQ ID NO: 1728327 - DNA, 15 bp, Homo sapiens
ccttctccaaatgag

SEQ ID NO: 1728328 - DNA, 12 bp, Homo sapiens
ccttctcccctg

SEQ ID NO: 1728329 - DNA, 15 bp, Homo sapiens
ccttctcccctgcac

SEQ ID NO: 1728330 - DNA, 19 bp, Homo sapiens
ccttctcccttgccctccc

SEQ ID NO: 1728331 - DNA, 14 bp, Homo sapiens
ccttctccttccca

SEQ ID NO: 1728332 - DNA, 12 bp, Homo sapiens
ccttctcctttc

SEQ ID NO: 1728333 - DNA, 14 bp, Homo sapiens
ccttctcctttcct

SEQ ID NO: 1728334 - DNA, 17 bp, Homo sapiens
ccttctcctttccttcc

SEQ ID NO: 1728335 - DNA, 19 bp, Homo sapiens
ccttctcctttccttccca

SEQ ID NO: 1728336 - DNA, 22 bp, Homo sapiens
ccttctcggagctggcccaggg

SEQ ID NO: 1728337 - DNA, 14 bp, Homo sapiens
ccttctctcagctc

SEQ ID NO: 1728338 - DNA, 15 bp, Homo sapiens
ccttctctcagctcc

SEQ ID NO: 1728339 - DNA, 16 bp, Homo sapiens
ccttctctcagctccc

SEQ ID NO: 1728340 - DNA, 19 bp, Homo sapiens
ccttctctcagctcccagg

SEQ ID NO: 1728341 - DNA, 21 bp, Homo sapiens
ccttctctcagctcccaggcc

SEQ ID NO: 1728342 - DNA, 15 bp, Homo sapiens
ccttctctcatctct

SEQ ID NO: 1728343 - DNA, 21 bp, Homo sapiens
ccttctctcatctcttagctc

SEQ ID NO: 1728344 - DNA, 16 bp, Homo sapiens
ccttctctgctccacc

SEQ ID NO: 1728345 - DNA, 22 bp, Homo sapiens
ccttctctgctccaccacatcc

SEQ ID NO: 1728346 - DNA, 13 bp, Homo sapiens
ccttctctgggtc

SEQ ID NO: 1728347 - DNA, 20 bp, Homo sapiens
ccttctctgggtctgatttt

SEQ ID NO: 1728348 - DNA, 23 bp, Homo sapiens
ccttctctgggtctgattttctc

SEQ ID NO: 1728349 - DNA, 19 bp, Homo sapiens
ccttctgactgtttattta

SEQ ID NO: 1728350 - DNA, 16 bp, Homo sapiens
ccttctgagctccacc

SEQ ID NO: 1728351 - DNA, 17 bp, Homo sapiens
ccttctgagctccacct

SEQ ID NO: 1728352 - DNA, 21 bp, Homo sapiens
ccttctgagctccacctctgg

SEQ ID NO: 1728353 - DNA, 22 bp, Homo sapiens
ccttctgagctccacctctggt

SEQ ID NO: 1728354 - DNA, 15 bp, Homo sapiens
ccttctgagtattct

SEQ ID NO: 1728355 - DNA, 23 bp, Homo sapiens
ccttctgatcttggaaaaacagc

SEQ ID NO: 1728356 - DNA, 16 bp, Homo sapiens
tggtgttcctgaagca

SEQ ID NO: 1728357 - DNA, 13 bp, Homo sapiens
tggtgttcctgga

SEQ ID NO: 1728358 - DNA, 20 bp, Homo sapiens
tggtgttcctggaagcaggt

SEQ ID NO: 1728359 - DNA, 18 bp, Homo sapiens
tggtgttcgtttccatca

SEQ ID NO: 1728360 - DNA, 16 bp, Homo sapiens
tggtgttgtatgcctt

SEQ ID NO: 1728361 - DNA, 13 bp, Homo sapiens
tggtgtttattgc

SEQ ID NO: 1728362 - DNA, 16 bp, Homo sapiens
tggtgtttgtctgtgt

SEQ ID NO: 1728363 - DNA, 18 bp, Homo sapiens
tggtgttttggatttgga

SEQ ID NO: 1728364 - DNA, 19 bp, Homo sapiens
tggtgttttggatttggag

SEQ ID NO: 1728365 - DNA, 17 bp, Homo sapiens
tggtgttttgtcagact

SEQ ID NO: 1728366 - DNA, 17 bp, Homo sapiens
tggttaaaaaaaagaat

SEQ ID NO: 1728367 - DNA, 20 bp, Homo sapiens
tggttaaaaaaaagaataaa

SEQ ID NO: 1728368 - DNA, 13 bp, Homo sapiens
tggttaaaaaggc

SEQ ID NO: 1728369 - DNA, 14 bp, Homo sapiens
tggttaaaaaggcc

SEQ ID NO: 1728370 - DNA, 16 bp, Homo sapiens
tggttaagagtccaag

SEQ ID NO: 1728371 - DNA, 13 bp, Homo sapiens
tggttaataaaac

SEQ ID NO: 1728372 - DNA, 12 bp, Homo sapiens
tggttaattttt

SEQ ID NO: 1728373 - DNA, 15 bp, Homo sapiens
tggttaatttttcct

SEQ ID NO: 1728374 - DNA, 14 bp, Homo sapiens
tggttacttcttct

SEQ ID NO: 1728375 - DNA, 15 bp, Homo sapiens
tggttacttcttctc

SEQ ID NO: 1728376 - DNA, 15 bp, Homo sapiens
tggttagtgtggagg

SEQ ID NO: 1728377 - DNA, 21 bp, Homo sapiens
tggttatagttgatatgtaac

SEQ ID NO: 1728378 - DNA, 14 bp, Homo sapiens
tggttattggactc

SEQ ID NO: 1728379 - DNA, 19 bp, Homo sapiens
tggttattggactccaggc

SEQ ID NO: 1728380 - DNA, 21 bp, Homo sapiens
tggttatttttctcttgtacc

SEQ ID NO: 1728381 - DNA, 18 bp, Homo sapiens
tggttcacctgtgactcc

SEQ ID NO: 1728382 - DNA, 20 bp, Homo sapiens
tggttcacttcaaagctaaa

SEQ ID NO: 1728383 - DNA, 16 bp, Homo sapiens
tggttcagctaagcta

SEQ ID NO: 1728384 - DNA, 19 bp, Homo sapiens
tggttcatatttatacttt

SEQ ID NO: 1728385 - DNA, 18 bp, Homo sapiens
tggttcatcagtgttaaa

SEQ ID NO: 1728386 - DNA, 19 bp, Homo sapiens
tggttcatgcagacaaagc

SEQ ID NO: 1728387 - DNA, 22 bp, Homo sapiens
tggttccagggtccctctgtgt

SEQ ID NO: 1728388 - DNA, 13 bp, Homo sapiens
tggttccatgcct

SEQ ID NO: 1728389 - DNA, 20 bp, Homo sapiens
tggttcccctgttcactcta

SEQ ID NO: 1728390 - DNA, 13 bp, Homo sapiens
tggttcctctgct

SEQ ID NO: 1728391 - DNA, 13 bp, Homo sapiens
tggttcctgctgt

SEQ ID NO: 1728392 - DNA, 17 bp, Homo sapiens
tggttcctgctgtcctg

SEQ ID NO: 1728393 - DNA, 22 bp, Homo sapiens
tggttcctgctgtcctggtggc

SEQ ID NO: 1728394 - DNA, 14 bp, Homo sapiens
tggttccttctctg

SEQ ID NO: 1728395 - DNA, 17 bp, Homo sapiens
tggttcctttctcagcc

SEQ ID NO: 1728396 - DNA, 23 bp, Homo sapiens
tggttctatgctaaactgtgaaa

SEQ ID NO: 1728397 - DNA, 20 bp, Homo sapiens
tggttctcagatcttgacag

SEQ ID NO: 1728398 - DNA, 11 bp, Homo sapiens
tggttctcatc

SEQ ID NO: 1728399 - DNA, 13 bp, Homo sapiens
tggttctcatctt

SEQ ID NO: 1728400 - DNA, 17 bp, Homo sapiens
tggttctggctgtttga

SEQ ID NO: 1728401 - DNA, 18 bp, Homo sapiens
tggttctgtgacccatct

SEQ ID NO: 1728402 - DNA, 14 bp, Homo sapiens
tggttcttcccctc

SEQ ID NO: 1728403 - DNA, 14 bp, Homo sapiens
tggttgaatgaata

SEQ ID NO: 1728404 - DNA, 17 bp, Homo sapiens
tggttgagaaatgaata

SEQ ID NO: 1728405 - DNA, 15 bp, Homo sapiens
tggttgatggaaaat

SEQ ID NO: 1728406 - DNA, 18 bp, Homo sapiens
tggttgatggaaaataaa

SEQ ID NO: 1728407 - DNA, 20 bp, Homo sapiens
tggttgatttgtaacacagt

SEQ ID NO: 1728408 - DNA, 23 bp, Homo sapiens
tggttggaagctaccagagctct

SEQ ID NO: 1728409 - DNA, 21 bp, Homo sapiens
tggttggccgtggtccagctc

SEQ ID NO: 1728410 - DNA, 18 bp, Homo sapiens
tggttgtaaatgctcgtg

SEQ ID NO: 1728411 - DNA, 14 bp, Homo sapiens
tggttgtatttcta

SEQ ID NO: 1728412 - DNA, 15 bp, Homo sapiens
tggttgtcaatatta

SEQ ID NO: 1728413 - DNA, 16 bp, Homo sapiens
tggttgtcttattgca

SEQ ID NO: 1728414 - DNA, 22 bp, Homo sapiens
tggttgttagttatagatgtct

SEQ ID NO: 1728415 - DNA, 16 bp, Homo sapiens
tggttgttcctgcatc

SEQ ID NO: 1728416 - DNA, 22 bp, Homo sapiens
tggttgttgcaccatctgcttg

SEQ ID NO: 1728417 - DNA, 12 bp, Homo sapiens
tggttgttgcca

SEQ ID NO: 1728418 - DNA, 16 bp, Homo sapiens
tggttgttgccaggtt

SEQ ID NO: 1728419 - DNA, 17 bp, Homo sapiens
tggttgttgccaggttg

SEQ ID NO: 1728420 - DNA, 22 bp, Homo sapiens
tggttgttgccaggttgcagct

SEQ ID NO: 1728421 - DNA, 22 bp, Homo sapiens
tggttgtttttgttctttgtgt

SEQ ID NO: 1728422 - DNA, 19 bp, Homo sapiens
tggtttaaatatgaatgaa

SEQ ID NO: 1728423 - DNA, 13 bp, Homo sapiens
tggtttatatttt

SEQ ID NO: 1728424 - DNA, 20 bp, Homo sapiens
tggtttatattttttcagtt

SEQ ID NO: 1728425 - DNA, 20 bp, Homo sapiens
tggtttattcccaagtatgc

SEQ ID NO: 1728426 - DNA, 22 bp, Homo sapiens
tggtttattggtgagttaggaa

SEQ ID NO: 1728427 - DNA, 16 bp, Homo sapiens
tggtttcaaagattca

SEQ ID NO: 1728428 - DNA, 21 bp, Homo sapiens
tggtttcaagttattcaaatt

SEQ ID NO: 1728429 - DNA, 15 bp, Homo sapiens
tggtttcatgttagt

SEQ ID NO: 1728430 - DNA, 18 bp, Homo sapiens
tggtttcccattggttca

SEQ ID NO: 1728431 - DNA, 17 bp, Homo sapiens
tggtttcccccttctac

SEQ ID NO: 1728432 - DNA, 13 bp, Homo sapiens
tggtttccttcct

SEQ ID NO: 1728433 - DNA, 18 bp, Homo sapiens
tggtttctcagaatccaa

SEQ ID NO: 1728434 - DNA, 21 bp, Homo sapiens
tggtttctcagaatccaaaga

SEQ ID NO: 1728435 - DNA, 12 bp, Homo sapiens
tggtttctccag

SEQ ID NO: 1728436 - DNA, 16 bp, Homo sapiens
tggtttcttcattctt

SEQ ID NO: 1728437 - DNA, 22 bp, Homo sapiens
tggtttgaaagattatgatgca

SEQ ID NO: 1728438 - DNA, 17 bp, Homo sapiens
tggtttgacaattttgt

SEQ ID NO: 1728439 - DNA, 21 bp, Homo sapiens
tggtttgacaattttgtctta

SEQ ID NO: 1728440 - DNA, 22 bp, Homo sapiens
tggtttgccatgtcgcttttgg

SEQ ID NO: 1728441 - DNA, 19 bp, Homo sapiens
tggtttgcctgaggctgta

SEQ ID NO: 1728442 - DNA, 16 bp, Homo sapiens
tggtttgggaaagatg

SEQ ID NO: 1728443 - DNA, 16 bp, Homo sapiens
tggtttggggagaaat

SEQ ID NO: 1728444 - DNA, 13 bp, Homo sapiens
tggtttgtatgag

SEQ ID NO: 1728445 - DNA, 21 bp, Homo sapiens
tggtttgtttataatgttatc

SEQ ID NO: 1728446 - DNA, 15 bp, Homo sapiens
tggttttcaaaataa

SEQ ID NO: 1728447 - DNA, 14 bp, Homo sapiens
tggttttccagagg

SEQ ID NO: 1728448 - DNA, 14 bp, Homo sapiens
tggttttcccctcc

SEQ ID NO: 1728449 - DNA, 16 bp, Homo sapiens
tggttttcctaaatgc

SEQ ID NO: 1728450 - DNA, 22 bp, Homo sapiens
tggttttcctaaatgcagtgaa

SEQ ID NO: 1728451 - DNA, 13 bp, Homo sapiens
tggttttcctgtg

SEQ ID NO: 1728452 - DNA, 13 bp, Homo sapiens
tggttttgctgag

SEQ ID NO: 1728453 - DNA, 18 bp, Homo sapiens
tggttttgtaagatgctg

SEQ ID NO: 1728454 - DNA, 13 bp, Homo sapiens
tggttttgtaatt

SEQ ID NO: 1728455 - DNA, 16 bp, Homo sapiens
tggttttgttcccctc

SEQ ID NO: 1728456 - DNA, 17 bp, Homo sapiens
tggttttgttcccctcc

SEQ ID NO: 1728457 - DNA, 20 bp, Homo sapiens
tggttttgttcccctcctcc

SEQ ID NO: 1728458 - DNA, 23 bp, Homo sapiens
tggtttttaaaaaatgttttctg

SEQ ID NO: 1728459 - DNA, 20 bp, Homo sapiens
tggtttttactgctctgaga

SEQ ID NO: 1728460 - DNA, 14 bp, Homo sapiens
tggtttttgctctc

SEQ ID NO: 1728461 - DNA, 14 bp, Homo sapiens
tggttttttataaa

SEQ ID NO: 1728462 - DNA, 20 bp, Homo sapiens
tggtttttttttttcttaaa

SEQ ID NO: 1728463 - DNA, 22 bp, Homo sapiens
tggttttttttttttttttggc

SEQ ID NO: 1728464 - DNA, 23 bp, Homo sapiens
tggttttttttttttttttggct

SEQ ID NO: 1728465 - DNA, 15 bp, Homo sapiens
tgtaaaaaaagcaaa

SEQ ID NO: 1728466 - DNA, 20 bp, Homo sapiens
tgtaaaaaaagcaaaaatga

SEQ ID NO: 1728467 - DNA, 15 bp, Homo sapiens
tgtaaaaaatggaaa

SEQ ID NO: 1728468 - DNA, 20 bp, Homo sapiens
tgtaaaaacagcattgcttt

SEQ ID NO: 1728469 - DNA, 24 bp, Homo sapiens
tgtaaaaacagcattgctttctga

SEQ ID NO: 1728470 - DNA, 22 bp, Homo sapiens
tgtaaaaacccaagtccctgtc

SEQ ID NO: 1728471 - DNA, 23 bp, Homo sapiens
tgtaaaaatcttttgaagcatag

SEQ ID NO: 1728472 - DNA, 22 bp, Homo sapiens
tgtaaaacaaagattgattgat

SEQ ID NO: 1728473 - DNA, 21 bp, Homo sapiens
ccttctgcccccgttccagct

SEQ ID NO: 1728474 - DNA, 17 bp, Homo sapiens
ccttctgcctttgatgt

SEQ ID NO: 1728475 - DNA, 15 bp, Homo sapiens
ccttctggatccatg

SEQ ID NO: 1728476 - DNA, 10 bp, Homo sapiens
ccttctggcc

SEQ ID NO: 1728477 - DNA, 22 bp, Homo sapiens
ccttctggccggtgctgggttc

SEQ ID NO: 1728478 - DNA, 16 bp, Homo sapiens
ccttctggccttgtaa

SEQ ID NO: 1728479 - DNA, 14 bp, Homo sapiens
ccttctgggaaaca

SEQ ID NO: 1728480 - DNA, 16 bp, Homo sapiens
ccttctgggaactctc

SEQ ID NO: 1728481 - DNA, 19 bp, Homo sapiens
ccttctgggactggacagc

SEQ ID NO: 1728482 - DNA, 14 bp, Homo sapiens
ccttctgggcttca

SEQ ID NO: 1728483 - DNA, 15 bp, Homo sapiens
ccttctggttgcttc

SEQ ID NO: 1728484 - DNA, 16 bp, Homo sapiens
ccttctggttgcttca

SEQ ID NO: 1728485 - DNA, 15 bp, Homo sapiens
ccttctgtgaaagta

SEQ ID NO: 1728486 - DNA, 14 bp, Homo sapiens
ccttctgtggctca

SEQ ID NO: 1728487 - DNA, 21 bp, Homo sapiens
ccttctgtggctcacagaacc

SEQ ID NO: 1728488 - DNA, 18 bp, Homo sapiens
ccttctgtgtttctggag

SEQ ID NO: 1728489 - DNA, 22 bp, Homo sapiens
ccttcttattctcactccacca

SEQ ID NO: 1728490 - DNA, 18 bp, Homo sapiens
ccttcttccacttctcca

SEQ ID NO: 1728491 - DNA, 14 bp, Homo sapiens
ccttgaaaaacaaa

SEQ ID NO: 1728492 - DNA, 15 bp, Homo sapiens
ccttgaagacagagc

SEQ ID NO: 1728493 - DNA, 12 bp, Homo sapiens
ccttgaaggaag

SEQ ID NO: 1728494 - DNA, 14 bp, Homo sapiens
ccttgaatgctgcc

SEQ ID NO: 1728495 - DNA, 18 bp, Homo sapiens
ccttgaatgctgccagtg

SEQ ID NO: 1728496 - DNA, 22 bp, Homo sapiens
ccttgaatgctgccagtgtgga

SEQ ID NO: 1728497 - DNA, 18 bp, Homo sapiens
ccttgaatttcatctcat

SEQ ID NO: 1728498 - DNA, 14 bp, Homo sapiens
ccttgacacattac

SEQ ID NO: 1728499 - DNA, 12 bp, Homo sapiens
ccttgacagagc

SEQ ID NO: 1728500 - DNA, 14 bp, Homo sapiens
ccttgacagagcag

SEQ ID NO: 1728501 - DNA, 23 bp, Homo sapiens
ccttgaccctgaaaggaacactg

SEQ ID NO: 1728502 - DNA, 20 bp, Homo sapiens
ccttgacgtcaagtctcctt

SEQ ID NO: 1728503 - DNA, 11 bp, Homo sapiens
ccttgagacca

SEQ ID NO: 1728504 - DNA, 16 bp, Homo sapiens
ccttgagacctcagcc

SEQ ID NO: 1728505 - DNA, 18 bp, Homo sapiens
ccttgagacctcagccat

SEQ ID NO: 1728506 - DNA, 19 bp, Homo sapiens
ccttgagacctcagccatg

SEQ ID NO: 1728507 - DNA, 21 bp, Homo sapiens
ccttgagagacccagctgcag

SEQ ID NO: 1728508 - DNA, 16 bp, Homo sapiens
ccttgagaggagaaat

SEQ ID NO: 1728509 - DNA, 14 bp, Homo sapiens
ccttgagccctggc

SEQ ID NO: 1728510 - DNA, 15 bp, Homo sapiens
ccttgagccctggct

SEQ ID NO: 1728511 - DNA, 16 bp, Homo sapiens
ccttgagctgttgtga

SEQ ID NO: 1728512 - DNA, 17 bp, Homo sapiens
ccttgaggattgtggaa

SEQ ID NO: 1728513 - DNA, 21 bp, Homo sapiens
ccttgagggtgcttgttccct

SEQ ID NO: 1728514 - DNA, 17 bp, Homo sapiens
ccttgagtagaaaagtc

SEQ ID NO: 1728515 - DNA, 18 bp, Homo sapiens
ccttgatgccagagggcc

SEQ ID NO: 1728516 - DNA, 23 bp, Homo sapiens
ccttgatgccagagggccagcag

SEQ ID NO: 1728517 - DNA, 19 bp, Homo sapiens
ccttgattgattagataaa

SEQ ID NO: 1728518 - DNA, 21 bp, Homo sapiens
ccttgcaatggatcagccaag

SEQ ID NO: 1728519 - DNA, 12 bp, Homo sapiens
ccttgcacctgc

SEQ ID NO: 1728520 - DNA, 15 bp, Homo sapiens
ccttgcagctggccc

SEQ ID NO: 1728521 - DNA, 13 bp, Homo sapiens
ccttgccagacat

SEQ ID NO: 1728522 - DNA, 23 bp, Homo sapiens
ccttgccatcctaaaagccaccc

SEQ ID NO: 1728523 - DNA, 11 bp, Homo sapiens
ccttgcccaga

SEQ ID NO: 1728524 - DNA, 20 bp, Homo sapiens
ccttgcccagactacagggc

SEQ ID NO: 1728525 - DNA, 12 bp, Homo sapiens
ccttgcccagag

SEQ ID NO: 1728526 - DNA, 21 bp, Homo sapiens
ccttgcccagagatgcctcca

SEQ ID NO: 1728527 - DNA, 17 bp, Homo sapiens
ccttgcccagggctcag

SEQ ID NO: 1728528 - DNA, 20 bp, Homo sapiens
ccttgcccccatccctcgga

SEQ ID NO: 1728529 - DNA, 18 bp, Homo sapiens
ccttgcccgccagcctca

SEQ ID NO: 1728530 - DNA, 20 bp, Homo sapiens
ccttgcccgccagcctcagt

SEQ ID NO: 1728531 - DNA, 19 bp, Homo sapiens
ccttgcccgtcgtgtgctg

SEQ ID NO: 1728532 - DNA, 19 bp, Homo sapiens
ccttgccctccgcctggga

SEQ ID NO: 1728533 - DNA, 22 bp, Homo sapiens
ccttgcctaaatttaatgctgc

SEQ ID NO: 1728534 - DNA, 14 bp, Homo sapiens
ccttgcctccccat

SEQ ID NO: 1728535 - DNA, 23 bp, Homo sapiens
ccttgcctccccatttcccatct

SEQ ID NO: 1728536 - DNA, 12 bp, Homo sapiens
ccttgcctctgc

SEQ ID NO: 1728537 - DNA, 18 bp, Homo sapiens
ccttgcctttcgaggcct

SEQ ID NO: 1728538 - DNA, 19 bp, Homo sapiens
ccttgcctttcgaggcctg

SEQ ID NO: 1728539 - DNA, 12 bp, Homo sapiens
ccttgctacctc

SEQ ID NO: 1728540 - DNA, 18 bp, Homo sapiens
ccttgctagacagccagg

SEQ ID NO: 1728541 - DNA, 16 bp, Homo sapiens
ccttgctagccctggg

SEQ ID NO: 1728542 - DNA, 13 bp, Homo sapiens
ccttgctctcctc

SEQ ID NO: 1728543 - DNA, 14 bp, Homo sapiens
ccttgctctcctca

SEQ ID NO: 1728544 - DNA, 17 bp, Homo sapiens
ccttgctctcctcatct

SEQ ID NO: 1728545 - DNA, 19 bp, Homo sapiens
ccttgctcttctttctgag

SEQ ID NO: 1728546 - DNA, 17 bp, Homo sapiens
ccttgctgacaataaag

SEQ ID NO: 1728547 - DNA, 13 bp, Homo sapiens
ccttgctgctctg

SEQ ID NO: 1728548 - DNA, 14 bp, Homo sapiens
ccttgctgctctgc

SEQ ID NO: 1728549 - DNA, 16 bp, Homo sapiens
ccttgctgctctgcgt

SEQ ID NO: 1728550 - DNA, 17 bp, Homo sapiens
ccttgctggaaaaccca

SEQ ID NO: 1728551 - DNA, 13 bp, Homo sapiens
ccttgctggcccc

SEQ ID NO: 1728552 - DNA, 22 bp, Homo sapiens
ccttgctggccccagccctgct

SEQ ID NO: 1728553 - DNA, 16 bp, Homo sapiens
ccttgctgggccaggg

SEQ ID NO: 1728554 - DNA, 21 bp, Homo sapiens
ccttgctgtttgtcctgagat

SEQ ID NO: 1728555 - DNA, 18 bp, Homo sapiens
ccttgctgttttttggag

SEQ ID NO: 1728556 - DNA, 13 bp, Homo sapiens
ccttgcttcctga

SEQ ID NO: 1728557 - DNA, 12 bp, Homo sapiens
ccttgcttctgt

SEQ ID NO: 1728558 - DNA, 20 bp, Homo sapiens
ccttgcttctgtatttcctt

SEQ ID NO: 1728559 - DNA, 16 bp, Homo sapiens
ccttgcttgcctgcag

SEQ ID NO: 1728560 - DNA, 18 bp, Homo sapiens
ccttgcttgcctgcaggg

SEQ ID NO: 1728561 - DNA, 15 bp, Homo sapiens
ccttgctttcctggg

SEQ ID NO: 1728562 - DNA, 16 bp, Homo sapiens
ccttgctttcctgggc

SEQ ID NO: 1728563 - DNA, 19 bp, Homo sapiens
ccttgctttcctgggcctt

SEQ ID NO: 1728564 - DNA, 15 bp, Homo sapiens
ccttgctttgggctt

SEQ ID NO: 1728565 - DNA, 18 bp, Homo sapiens
ccttgctttgggctttgc

SEQ ID NO: 1728566 - DNA, 17 bp, Homo sapiens
ccttggaaacctgccct

SEQ ID NO: 1728567 - DNA, 11 bp, Homo sapiens
ccttggaaatg

SEQ ID NO: 1728568 - DNA, 18 bp, Homo sapiens
ccttggaaatgtctgctg

SEQ ID NO: 1728569 - DNA, 21 bp, Homo sapiens
ccttggaacaccctggatgct

SEQ ID NO: 1728570 - DNA, 16 bp, Homo sapiens
ccttggacatcctcct

SEQ ID NO: 1728571 - DNA, 23 bp, Homo sapiens
ccttggaccactcctgtccctgt

SEQ ID NO: 1728572 - DNA, 15 bp, Homo sapiens
ccttggactcatttt

SEQ ID NO: 1728573 - DNA, 16 bp, Homo sapiens
ccttggagagacacag

SEQ ID NO: 1728574 - DNA, 22 bp, Homo sapiens
ccttggagagagaggctgcctc

SEQ ID NO: 1728575 - DNA, 14 bp, Homo sapiens
ccttggagagctca

SEQ ID NO: 1728576 - DNA, 12 bp, Homo sapiens
ccttggagagga

SEQ ID NO: 1728577 - DNA, 16 bp, Homo sapiens
ccttggagctgccgtg

SEQ ID NO: 1728578 - DNA, 15 bp, Homo sapiens
ccttggaggagagag

SEQ ID NO: 1728579 - DNA, 18 bp, Homo sapiens
ccttggaggagagagacc

SEQ ID NO: 1728580 - DNA, 15 bp, Homo sapiens
ccttggagtcccagg

SEQ ID NO: 1728581 - DNA, 15 bp, Homo sapiens
ccttggattttcctg

SEQ ID NO: 1728582 - DNA, 17 bp, Homo sapiens
ccttggattttcctgaa

SEQ ID NO: 1728583 - DNA, 15 bp, Homo sapiens
ccttggcaccagaca

SEQ ID NO: 1728584 - DNA, 21 bp, Homo sapiens
ccttggcaccagacacccagg

SEQ ID NO: 1728585 - DNA, 22 bp, Homo sapiens
ccttggcaccagacacccagga

SEQ ID NO: 1728586 - DNA, 23 bp, Homo sapiens
ccttggcaccagacacccaggac

SEQ ID NO: 1728587 - DNA, 17 bp, Homo sapiens
ccttggcatgccttcca

SEQ ID NO: 1728588 - DNA, 14 bp, Homo sapiens
ccttggcatttctt

SEQ ID NO: 1728589 - DNA, 13 bp, Homo sapiens
ccttggcccagag

SEQ ID NO: 1728590 - DNA, 15 bp, Homo sapiens
ccttggcccaggagc

SEQ ID NO: 1728591 - DNA, 13 bp, Homo sapiens
tgtaaaacaatgc

SEQ ID NO: 1728592 - DNA, 16 bp, Homo sapiens
tgtaaaacaatgccat

SEQ ID NO: 1728593 - DNA, 20 bp, Homo sapiens
tgtaaaacaatgccatgaac

SEQ ID NO: 1728594 - DNA, 23 bp, Homo sapiens
tgtaaaacaatgccatgaacaaa

SEQ ID NO: 1728595 - DNA, 12 bp, Homo sapiens
tgtaaaacaggt

SEQ ID NO: 1728596 - DNA, 19 bp, Homo sapiens
tgtaaaagaacagtaaaca

SEQ ID NO: 1728597 - DNA, 23 bp, Homo sapiens
tgtaaaagcacatgagaatgcta

SEQ ID NO: 1728598 - DNA, 14 bp, Homo sapiens
tgtaaaataaaatt

SEQ ID NO: 1728599 - DNA, 16 bp, Homo sapiens
tgtaaaataattctga

SEQ ID NO: 1728600 - DNA, 12 bp, Homo sapiens
tgtaaaatcttg

SEQ ID NO: 1728601 - DNA, 21 bp, Homo sapiens
tgtaaaatcttggcacagaaa

SEQ ID NO: 1728602 - DNA, 22 bp, Homo sapiens
tgtaaaatcttgtcatgtgtat

SEQ ID NO: 1728603 - DNA, 14 bp, Homo sapiens
tgtaaaatgaaatt

SEQ ID NO: 1728604 - DNA, 21 bp, Homo sapiens
tgtaaaatgaattgaaaaaca

SEQ ID NO: 1728605 - DNA, 14 bp, Homo sapiens
tgtaaaattcatag

SEQ ID NO: 1728606 - DNA, 13 bp, Homo sapiens
tgtaaaatttgga

SEQ ID NO: 1728607 - DNA, 19 bp, Homo sapiens
tgtaaacaaatctttccat

SEQ ID NO: 1728608 - DNA, 16 bp, Homo sapiens
tgtaaacagtgcctgc

SEQ ID NO: 1728609 - DNA, 17 bp, Homo sapiens
tgtaaacagtgcctgct

SEQ ID NO: 1728610 - DNA, 19 bp, Homo sapiens
tgtaaacctgagtcgtaca

SEQ ID NO: 1728611 - DNA, 20 bp, Homo sapiens
tgtaaactcaaaatatttgt

SEQ ID NO: 1728612 - DNA, 18 bp, Homo sapiens
tgtaaactgcattagaaa

SEQ ID NO: 1728613 - DNA, 13 bp, Homo sapiens
tgtaaactgtgta

SEQ ID NO: 1728614 - DNA, 14 bp, Homo sapiens
tgtaaactgtgtat

SEQ ID NO: 1728615 - DNA, 18 bp, Homo sapiens
tgtaaactgtgtattcca

SEQ ID NO: 1728616 - DNA, 22 bp, Homo sapiens
tgtaaactgtgtattccaagac

SEQ ID NO: 1728617 - DNA, 15 bp, Homo sapiens
tgtaaagaaaaatat

SEQ ID NO: 1728618 - DNA, 11 bp, Homo sapiens
tgtaaagatgt

SEQ ID NO: 1728619 - DNA, 13 bp, Homo sapiens
tgtaaaggaggga

SEQ ID NO: 1728620 - DNA, 16 bp, Homo sapiens
tgtaaaggagggagat

SEQ ID NO: 1728621 - DNA, 19 bp, Homo sapiens
tgtaaagtaggaaaaataa

SEQ ID NO: 1728622 - DNA, 20 bp, Homo sapiens
tgtaaagtgtgtgattgaag

SEQ ID NO: 1728623 - DNA, 20 bp, Homo sapiens
tgtaaagttatgtatttaaa

SEQ ID NO: 1728624 - DNA, 20 bp, Homo sapiens
tgtaaataaaatgtgtacag

SEQ ID NO: 1728625 - DNA, 22 bp, Homo sapiens
tgtaaataaactatttatatca

SEQ ID NO: 1728626 - DNA, 14 bp, Homo sapiens
tgtaaataaagtct

SEQ ID NO: 1728627 - DNA, 20 bp, Homo sapiens
tgtaaataagttttttttct

SEQ ID NO: 1728628 - DNA, 19 bp, Homo sapiens
tgtaaatacaatttgtact

SEQ ID NO: 1728629 - DNA, 21 bp, Homo sapiens
tgtaaatacacatagcatgta

SEQ ID NO: 1728630 - DNA, 24 bp, Homo sapiens
tgtaaatactggactcaggaactt

SEQ ID NO: 1728631 - DNA, 16 bp, Homo sapiens
tgtaaatagtatttga

SEQ ID NO: 1728632 - DNA, 13 bp, Homo sapiens
tgtaaatatgttt

SEQ ID NO: 1728633 - DNA, 17 bp, Homo sapiens
tgtaaatatgtttgtgc

SEQ ID NO: 1728634 - DNA, 20 bp, Homo sapiens
tgtaaatatgtttgtgcctt

SEQ ID NO: 1728635 - DNA, 14 bp, Homo sapiens
tgtaaatattctat

SEQ ID NO: 1728636 - DNA, 12 bp, Homo sapiens
tgtaaatcactt

SEQ ID NO: 1728637 - DNA, 14 bp, Homo sapiens
tgtaaatctgccac

SEQ ID NO: 1728638 - DNA, 16 bp, Homo sapiens
tgtaaatctgccacaa

SEQ ID NO: 1728639 - DNA, 18 bp, Homo sapiens
tgtaaatgcctcttaaat

SEQ ID NO: 1728640 - DNA, 23 bp, Homo sapiens
tgtaaatgccttgcttgtatgat

SEQ ID NO: 1728641 - DNA, 22 bp, Homo sapiens
tgtaaatgctgtcaactatgat

SEQ ID NO: 1728642 - DNA, 15 bp, Homo sapiens
tgtaaatggtgtaca

SEQ ID NO: 1728643 - DNA, 16 bp, Homo sapiens
tgtaaatgtactggta

SEQ ID NO: 1728644 - DNA, 20 bp, Homo sapiens
tgtaaatgtactggtaattg

SEQ ID NO: 1728645 - DNA, 15 bp, Homo sapiens
tgtaaattaatactt

SEQ ID NO: 1728646 - DNA, 14 bp, Homo sapiens
tgtaaatttgtact

SEQ ID NO: 1728647 - DNA, 21 bp, Homo sapiens
tgtaacaagggttttaatgta

SEQ ID NO: 1728648 - DNA, 15 bp, Homo sapiens
tgtaacaattgtgta

SEQ ID NO: 1728649 - DNA, 16 bp, Homo sapiens
tgtaacaattgtgtag

SEQ ID NO: 1728650 - DNA, 22 bp, Homo sapiens
tgtaacaattgtgtagcctttt

SEQ ID NO: 1728651 - DNA, 21 bp, Homo sapiens
tgtaacacagtcattctagga

SEQ ID NO: 1728652 - DNA, 18 bp, Homo sapiens
tgtaacagccaggagtgt

SEQ ID NO: 1728653 - DNA, 20 bp, Homo sapiens
tgtaacaggtctcctcttaa

SEQ ID NO: 1728654 - DNA, 21 bp, Homo sapiens
tgtaacagtcaaatatcattt

SEQ ID NO: 1728655 - DNA, 22 bp, Homo sapiens
tgtaacagttggtgattttaga

SEQ ID NO: 1728656 - DNA, 17 bp, Homo sapiens
tgtaacatactggcctg

SEQ ID NO: 1728657 - DNA, 18 bp, Homo sapiens
tgtaacatccaagccaga

SEQ ID NO: 1728658 - DNA, 14 bp, Homo sapiens
tgtaaccaagctgt

SEQ ID NO: 1728659 - DNA, 20 bp, Homo sapiens
tgtaaccagttataaataca

SEQ ID NO: 1728660 - DNA, 15 bp, Homo sapiens
tgtaaccatatgatt

SEQ ID NO: 1728661 - DNA, 18 bp, Homo sapiens
tgtaactacaaagctttg

SEQ ID NO: 1728662 - DNA, 19 bp, Homo sapiens
tgtaactacaaagctttgc

SEQ ID NO: 1728663 - DNA, 17 bp, Homo sapiens
tgtaactactttataac

SEQ ID NO: 1728664 - DNA, 19 bp, Homo sapiens
tgtaactatttcttcagag

SEQ ID NO: 1728665 - DNA, 19 bp, Homo sapiens
tgtaactccagatagagaa

SEQ ID NO: 1728666 - DNA, 16 bp, Homo sapiens
tgtaactctaaaagat

SEQ ID NO: 1728667 - DNA, 17 bp, Homo sapiens
tgtaactctaaaagatc

SEQ ID NO: 1728668 - DNA, 16 bp, Homo sapiens
tgtaacttatattgaa

SEQ ID NO: 1728669 - DNA, 12 bp, Homo sapiens
tgtaacttcctg

SEQ ID NO: 1728670 - DNA, 23 bp, Homo sapiens
tgtaacttcctgctgcaccctgc

SEQ ID NO: 1728671 - DNA, 20 bp, Homo sapiens
tgtaacttgcttaaatttct

SEQ ID NO: 1728672 - DNA, 19 bp, Homo sapiens
tgtaactttcataccactt

SEQ ID NO: 1728673 - DNA, 20 bp, Homo sapiens
tgtaacttttgtaagacaaa

SEQ ID NO: 1728674 - DNA, 14 bp, Homo sapiens
tgtaagaactgtac

SEQ ID NO: 1728675 - DNA, 15 bp, Homo sapiens
tgtaagaactgtaca

SEQ ID NO: 1728676 - DNA, 17 bp, Homo sapiens
tgtaagaagagactggg

SEQ ID NO: 1728677 - DNA, 19 bp, Homo sapiens
tgtaagaagagactgggaa

SEQ ID NO: 1728678 - DNA, 22 bp, Homo sapiens
tgtaagaataggcattaacaca

SEQ ID NO: 1728679 - DNA, 16 bp, Homo sapiens
tgtaagaattcagaag

SEQ ID NO: 1728680 - DNA, 17 bp, Homo sapiens
tgtaagaattctgattg

SEQ ID NO: 1728681 - DNA, 20 bp, Homo sapiens
tgtaagacaaaggttttcct

SEQ ID NO: 1728682 - DNA, 21 bp, Homo sapiens
tgtaagacaaaggttttcctc

SEQ ID NO: 1728683 - DNA, 19 bp, Homo sapiens
tgtaagacaatccatgtaa

SEQ ID NO: 1728684 - DNA, 20 bp, Homo sapiens
tgtaagacagtgccctgaga

SEQ ID NO: 1728685 - DNA, 15 bp, Homo sapiens
tgtaagacatttcct

SEQ ID NO: 1728686 - DNA, 14 bp, Homo sapiens
tgtaagacatttgt

SEQ ID NO: 1728687 - DNA, 16 bp, Homo sapiens
tgtaagacatttgtat

SEQ ID NO: 1728688 - DNA, 20 bp, Homo sapiens
tgtaagacatttgtatattg

SEQ ID NO: 1728689 - DNA, 22 bp, Homo sapiens
tgtaagacccttattgctgtcc

SEQ ID NO: 1728690 - DNA, 15 bp, Homo sapiens
tgtaagagcttgctc

SEQ ID NO: 1728691 - DNA, 20 bp, Homo sapiens
tgtaagcaagtcacttaatc

SEQ ID NO: 1728692 - DNA, 22 bp, Homo sapiens
tgtaagcatactttgtaaatag

SEQ ID NO: 1728693 - DNA, 19 bp, Homo sapiens
tgtaagcggtggtttgtaa

SEQ ID NO: 1728694 - DNA, 17 bp, Homo sapiens
tgtaaggactgtaaaca

SEQ ID NO: 1728695 - DNA, 19 bp, Homo sapiens
tgtaaggatccggaaagaa

SEQ ID NO: 1728696 - DNA, 22 bp, Homo sapiens
tgtaaggcactgtcaggaatgg

SEQ ID NO: 1728697 - DNA, 14 bp, Homo sapiens
tgtaagtaacacag

SEQ ID NO: 1728698 - DNA, 16 bp, Homo sapiens
tgtaagtaacacagta

SEQ ID NO: 1728699 - DNA, 17 bp, Homo sapiens
tgtaagtaacacagtat

SEQ ID NO: 1728700 - DNA, 23 bp, Homo sapiens
tgtaagtaacacagtattatgcc

SEQ ID NO: 1728701 - DNA, 21 bp, Homo sapiens
tgtaagtaattgcatttctgc

SEQ ID NO: 1728702 - DNA, 13 bp, Homo sapiens
tgtaagtgtagct

SEQ ID NO: 1728703 - DNA, 15 bp, Homo sapiens
tgtaagtgtagctca

SEQ ID NO: 1728704 - DNA, 16 bp, Homo sapiens
tgtaagtgtagctcaa

SEQ ID NO: 1728705 - DNA, 12 bp, Homo sapiens
tgtaagtgtgag

SEQ ID NO: 1728706 - DNA, 17 bp, Homo sapiens
tgtaagtgtgagtaaga

SEQ ID NO: 1728707 - DNA, 17 bp, Homo sapiens
ccttggcccaggagctc

SEQ ID NO: 1728708 - DNA, 19 bp, Homo sapiens
ccttggcccaggagctctg

SEQ ID NO: 1728709 - DNA, 20 bp, Homo sapiens
ccttggcccaggagctctgc

SEQ ID NO: 1728710 - DNA, 19 bp, Homo sapiens
ccttggccgtgaggacacg

SEQ ID NO: 1728711 - DNA, 14 bp, Homo sapiens
ccttggcctcagaa

SEQ ID NO: 1728712 - DNA, 22 bp, Homo sapiens
ccttggcctgtctcatccccag

SEQ ID NO: 1728713 - DNA, 18 bp, Homo sapiens
ccttggctcaatcctcta

SEQ ID NO: 1728714 - DNA, 12 bp, Homo sapiens
ccttggctcaga

SEQ ID NO: 1728715 - DNA, 12 bp, Homo sapiens
ccttggctgcag

SEQ ID NO: 1728716 - DNA, 13 bp, Homo sapiens
ccttggcttcctc

SEQ ID NO: 1728717 - DNA, 13 bp, Homo sapiens
ccttggcttgtta

SEQ ID NO: 1728718 - DNA, 17 bp, Homo sapiens
ccttggctttcagagcc

SEQ ID NO: 1728719 - DNA, 18 bp, Homo sapiens
ccttggctttcagagcca

SEQ ID NO: 1728720 - DNA, 22 bp, Homo sapiens
ccttggctttcagagccagcct

SEQ ID NO: 1728721 - DNA, 16 bp, Homo sapiens
ccttgggcatccaccc

SEQ ID NO: 1728722 - DNA, 24 bp, Homo sapiens
ccttgggcatccacccagtgctgc

SEQ ID NO: 1728723 - DNA, 22 bp, Homo sapiens
ccttgggccctttttcccttcc

SEQ ID NO: 1728724 - DNA, 21 bp, Homo sapiens
ccttgggcctggccagtcttc

SEQ ID NO: 1728725 - DNA, 11 bp, Homo sapiens
ccttgggcctt

SEQ ID NO: 1728726 - DNA, 14 bp, Homo sapiens
ccttgggcggctga

SEQ ID NO: 1728727 - DNA, 12 bp, Homo sapiens
ccttgggctcct

SEQ ID NO: 1728728 - DNA, 13 bp, Homo sapiens
ccttgggctcctg

SEQ ID NO: 1728729 - DNA, 14 bp, Homo sapiens
ccttgggctgctcc

SEQ ID NO: 1728730 - DNA, 18 bp, Homo sapiens
ccttgggctgctcctcat

SEQ ID NO: 1728731 - DNA, 17 bp, Homo sapiens
ccttggggaatttcctc

SEQ ID NO: 1728732 - DNA, 23 bp, Homo sapiens
ccttggggaatttcctctattga

SEQ ID NO: 1728733 - DNA, 16 bp, Homo sapiens
ccttggggcagggcct

SEQ ID NO: 1728734 - DNA, 23 bp, Homo sapiens
ccttggggcagggcctgggcctc

SEQ ID NO: 1728735 - DNA, 15 bp, Homo sapiens
ccttggggcctggct

SEQ ID NO: 1728736 - DNA, 16 bp, Homo sapiens
ccttggggcctggctt

SEQ ID NO: 1728737 - DNA, 21 bp, Homo sapiens
ccttggggtccctccacccca

SEQ ID NO: 1728738 - DNA, 20 bp, Homo sapiens
ccttggggtgagggacagag

SEQ ID NO: 1728739 - DNA, 13 bp, Homo sapiens
ccttgggtccccc

SEQ ID NO: 1728740 - DNA, 22 bp, Homo sapiens
ccttggtctctccttcctcttg

SEQ ID NO: 1728741 - DNA, 13 bp, Homo sapiens
ccttggtgctgtg

SEQ ID NO: 1728742 - DNA, 23 bp, Homo sapiens
ccttggtgctgtgtgccccactc

SEQ ID NO: 1728743 - DNA, 23 bp, Homo sapiens
ccttggtggagcagccagagctg

SEQ ID NO: 1728744 - DNA, 24 bp, Homo sapiens
ccttggtggagcagccagagctgt

SEQ ID NO: 1728745 - DNA, 20 bp, Homo sapiens
ccttggtgtccacctggccc

SEQ ID NO: 1728746 - DNA, 21 bp, Homo sapiens
ccttggtgtccacctggcccc

SEQ ID NO: 1728747 - DNA, 21 bp, Homo sapiens
ccttggttgtctggcaaggac

SEQ ID NO: 1728748 - DNA, 22 bp, Homo sapiens
ccttggttgtctggcaaggact

SEQ ID NO: 1728749 - DNA, 16 bp, Homo sapiens
ccttgtaaaaaaagca

SEQ ID NO: 1728750 - DNA, 14 bp, Homo sapiens
ccttgtaagttatt

SEQ ID NO: 1728751 - DNA, 15 bp, Homo sapiens
ccttgtaatacctga

SEQ ID NO: 1728752 - DNA, 19 bp, Homo sapiens
ccttgtaattctaaatgaa

SEQ ID NO: 1728753 - DNA, 16 bp, Homo sapiens
ccttgtatttaaatat

SEQ ID NO: 1728754 - DNA, 15 bp, Homo sapiens
ccttgtcctgccagc

SEQ ID NO: 1728755 - DNA, 12 bp, Homo sapiens
ccttgtgaggat

SEQ ID NO: 1728756 - DNA, 16 bp, Homo sapiens
ccttgtgccctgcccc

SEQ ID NO: 1728757 - DNA, 17 bp, Homo sapiens
ccttgtgccctgccccc

SEQ ID NO: 1728758 - DNA, 18 bp, Homo sapiens
ccttgtgccctgcctcca

SEQ ID NO: 1728759 - DNA, 12 bp, Homo sapiens
ccttgtgcttgg

SEQ ID NO: 1728760 - DNA, 22 bp, Homo sapiens
ccttgtggactggctgtgcccc

SEQ ID NO: 1728761 - DNA, 19 bp, Homo sapiens
ccttgtgggaccagtccca

SEQ ID NO: 1728762 - DNA, 21 bp, Homo sapiens
ccttgtgggaccagtcccaca

SEQ ID NO: 1728763 - DNA, 17 bp, Homo sapiens
ccttgtgtgtcaggccc

SEQ ID NO: 1728764 - DNA, 19 bp, Homo sapiens
ccttgttacttctgaggta

SEQ ID NO: 1728765 - DNA, 23 bp, Homo sapiens
ccttgttgcctgcacccttccct

SEQ ID NO: 1728766 - DNA, 19 bp, Homo sapiens
ccttgtttacacataccct

SEQ ID NO: 1728767 - DNA, 23 bp, Homo sapiens
ccttgtttctgttgttcccgtga

SEQ ID NO: 1728768 - DNA, 18 bp, Homo sapiens
cctttaaagaaacatggt

SEQ ID NO: 1728769 - DNA, 20 bp, Homo sapiens
cctttaactgacaagccatc

SEQ ID NO: 1728770 - DNA, 18 bp, Homo sapiens
cctttaacttttttttct

SEQ ID NO: 1728771 - DNA, 19 bp, Homo sapiens
cctttaagatatccatctt

SEQ ID NO: 1728772 - DNA, 16 bp, Homo sapiens
cctttaattttcttgt

SEQ ID NO: 1728773 - DNA, 18 bp, Homo sapiens
cctttacaagggagaaga

SEQ ID NO: 1728774 - DNA, 17 bp, Homo sapiens
cctttacattcaacttt

SEQ ID NO: 1728775 - DNA, 22 bp, Homo sapiens
cctttaccctctttgctgcaga

SEQ ID NO: 1728776 - DNA, 17 bp, Homo sapiens
cctttactcagcccagc

SEQ ID NO: 1728777 - DNA, 19 bp, Homo sapiens
cctttactcagcccagctg

SEQ ID NO: 1728778 - DNA, 13 bp, Homo sapiens
cctttagggcagc

SEQ ID NO: 1728779 - DNA, 13 bp, Homo sapiens
cctttaggttctt

SEQ ID NO: 1728780 - DNA, 18 bp, Homo sapiens
cctttagtacctgaaaag

SEQ ID NO: 1728781 - DNA, 9 bp, Homo sapiens
cctttataa

SEQ ID NO: 1728782 - DNA, 19 bp, Homo sapiens
cctttatcttgaagtcagc

SEQ ID NO: 1728783 - DNA, 14 bp, Homo sapiens
cctttatgatgcta

SEQ ID NO: 1728784 - DNA, 22 bp, Homo sapiens
cctttatgatgctaagctgata

SEQ ID NO: 1728785 - DNA, 16 bp, Homo sapiens
cctttattaaaatctt

SEQ ID NO: 1728786 - DNA, 14 bp, Homo sapiens
cctttattgcagtt

SEQ ID NO: 1728787 - DNA, 13 bp, Homo sapiens
cctttcaaagctt

SEQ ID NO: 1728788 - DNA, 15 bp, Homo sapiens
cctttcaaggaaagt

SEQ ID NO: 1728789 - DNA, 17 bp, Homo sapiens
cctttcaaggaaagtga

SEQ ID NO: 1728790 - DNA, 21 bp, Homo sapiens
cctttcacaaaattttattcc

SEQ ID NO: 1728791 - DNA, 21 bp, Homo sapiens
cctttcacagagcagagtctg

SEQ ID NO: 1728792 - DNA, 14 bp, Homo sapiens
cctttcagatgtct

SEQ ID NO: 1728793 - DNA, 17 bp, Homo sapiens
cctttcagatgtcttct

SEQ ID NO: 1728794 - DNA, 22 bp, Homo sapiens
cctttcagatgtcttctgcctg

SEQ ID NO: 1728795 - DNA, 12 bp, Homo sapiens
cctttcagggaa

SEQ ID NO: 1728796 - DNA, 13 bp, Homo sapiens
cctttccaaagag

SEQ ID NO: 1728797 - DNA, 19 bp, Homo sapiens
cctttccaccacagccagc

SEQ ID NO: 1728798 - DNA, 18 bp, Homo sapiens
cctttcccccttctctta

SEQ ID NO: 1728799 - DNA, 21 bp, Homo sapiens
cctttcctctaactcactgcc

SEQ ID NO: 1728800 - DNA, 24 bp, Homo sapiens
cctttcctgtgtgtactctgtcca

SEQ ID NO: 1728801 - DNA, 13 bp, Homo sapiens
cctttccttcctt

SEQ ID NO: 1728802 - DNA, 13 bp, Homo sapiens
cctttcgaggcct

SEQ ID NO: 1728803 - DNA, 14 bp, Homo sapiens
cctttcgaggcctg

SEQ ID NO: 1728804 - DNA, 15 bp, Homo sapiens
cctttcgaggcctga

SEQ ID NO: 1728805 - DNA, 18 bp, Homo sapiens
cctttcgaggcctgaagc

SEQ ID NO: 1728806 - DNA, 23 bp, Homo sapiens
cctttctaaacaagattttaaag

SEQ ID NO: 1728807 - DNA, 22 bp, Homo sapiens
cctttctagtcctattctattg

SEQ ID NO: 1728808 - DNA, 17 bp, Homo sapiens
cctttctccactgggtg

SEQ ID NO: 1728809 - DNA, 15 bp, Homo sapiens
cctttctccagccag

SEQ ID NO: 1728810 - DNA, 16 bp, Homo sapiens
cctttctccagccagc

SEQ ID NO: 1728811 - DNA, 20 bp, Homo sapiens
cctttctccagccagcaatg

SEQ ID NO: 1728812 - DNA, 14 bp, Homo sapiens
cctttctcccaggc

SEQ ID NO: 1728813 - DNA, 16 bp, Homo sapiens
cctttctcctgcccca

SEQ ID NO: 1728814 - DNA, 22 bp, Homo sapiens
cctttctcggggcttggggctc

SEQ ID NO: 1728815 - DNA, 15 bp, Homo sapiens
cctttctctcctggc

SEQ ID NO: 1728816 - DNA, 16 bp, Homo sapiens
cctttctctcctggct

SEQ ID NO: 1728817 - DNA, 15 bp, Homo sapiens
cctttctctctccac

SEQ ID NO: 1728818 - DNA, 22 bp, Homo sapiens
cctttctctctttatacagctg

SEQ ID NO: 1728819 - DNA, 17 bp, Homo sapiens
cctttctggaagtttct

SEQ ID NO: 1728820 - DNA, 22 bp, Homo sapiens
cctttctgtaggtttctctctt

SEQ ID NO: 1728821 - DNA, 20 bp, Homo sapiens
cctttctgttgccagtcagc

SEQ ID NO: 1728822 - DNA, 14 bp, Homo sapiens
cctttcttgacaaa

SEQ ID NO: 1728823 - DNA, 22 bp, Homo sapiens
tgtaagtttattttttctacac

SEQ ID NO: 1728824 - DNA, 19 bp, Homo sapiens
tgtaataaagtatataatt

SEQ ID NO: 1728825 - DNA, 23 bp, Homo sapiens
tgtaataaatctaggatgtgatg

SEQ ID NO: 1728826 - DNA, 12 bp, Homo sapiens
tgtaataaattc

SEQ ID NO: 1728827 - DNA, 14 bp, Homo sapiens
tgtaataactgtga

SEQ ID NO: 1728828 - DNA, 14 bp, Homo sapiens
tgtaataagaaagt

SEQ ID NO: 1728829 - DNA, 16 bp, Homo sapiens
tgtaatataaagtatt

SEQ ID NO: 1728830 - DNA, 19 bp, Homo sapiens
tgtaatataaatttaagca

SEQ ID NO: 1728831 - DNA, 15 bp, Homo sapiens
tgtaatataatgtat

SEQ ID NO: 1728832 - DNA, 16 bp, Homo sapiens
tgtaatataatgtatt

SEQ ID NO: 1728833 - DNA, 18 bp, Homo sapiens
tgtaatataatgtatttt

SEQ ID NO: 1728834 - DNA, 18 bp, Homo sapiens
tgtaatatattgtacaaa

SEQ ID NO: 1728835 - DNA, 20 bp, Homo sapiens
tgtaatatattgtacaaatg

SEQ ID NO: 1728836 - DNA, 21 bp, Homo sapiens
tgtaatatattgtacaaatgt

SEQ ID NO: 1728837 - DNA, 20 bp, Homo sapiens
tgtaatcaatgtttcttcta

SEQ ID NO: 1728838 - DNA, 14 bp, Homo sapiens
tgtaatcatttatc

SEQ ID NO: 1728839 - DNA, 14 bp, Homo sapiens
tgtaatcatttgtt

SEQ ID NO: 1728840 - DNA, 19 bp, Homo sapiens
tgtaatcatttgtttacat

SEQ ID NO: 1728841 - DNA, 13 bp, Homo sapiens
tgtaatcccagca

SEQ ID NO: 1728842 - DNA, 14 bp, Homo sapiens
tgtaatcccagcac

SEQ ID NO: 1728843 - DNA, 22 bp, Homo sapiens
tgtaatcccagctacttgggag

SEQ ID NO: 1728844 - DNA, 16 bp, Homo sapiens
tgtaatctaccagtgg

SEQ ID NO: 1728845 - DNA, 14 bp, Homo sapiens
tgtaatctctctgc

SEQ ID NO: 1728846 - DNA, 18 bp, Homo sapiens
tgtaatctctctgcagct

SEQ ID NO: 1728847 - DNA, 21 bp, Homo sapiens
tgtaatctctctgcagctgcc

SEQ ID NO: 1728848 - DNA, 19 bp, Homo sapiens
tgtaatctctgattaaatt

SEQ ID NO: 1728849 - DNA, 12 bp, Homo sapiens
tgtaatcttaaa

SEQ ID NO: 1728850 - DNA, 16 bp, Homo sapiens
tgtaatgaggaaaaaa

SEQ ID NO: 1728851 - DNA, 19 bp, Homo sapiens
tgtaatgaggaaaaaatgg

SEQ ID NO: 1728852 - DNA, 12 bp, Homo sapiens
tgtaatgcaaaa

SEQ ID NO: 1728853 - DNA, 18 bp, Homo sapiens
tgtaatgctgcacttcct

SEQ ID NO: 1728854 - DNA, 20 bp, Homo sapiens
tgtaatgctgcacttcctgt

SEQ ID NO: 1728855 - DNA, 17 bp, Homo sapiens
tgtaatggaactgaccc

SEQ ID NO: 1728856 - DNA, 13 bp, Homo sapiens
tgtaatgtcacca

SEQ ID NO: 1728857 - DNA, 16 bp, Homo sapiens
tgtaatgtcaccacct

SEQ ID NO: 1728858 - DNA, 20 bp, Homo sapiens
tgtaatgtcaccaccttccc

SEQ ID NO: 1728859 - DNA, 13 bp, Homo sapiens
tgtaatgtgactt

SEQ ID NO: 1728860 - DNA, 15 bp, Homo sapiens
tgtaattaaattctg

SEQ ID NO: 1728861 - DNA, 23 bp, Homo sapiens
tgtaattaagtactatgtatcaa

SEQ ID NO: 1728862 - DNA, 15 bp, Homo sapiens
tgtaattaatatctt

SEQ ID NO: 1728863 - DNA, 16 bp, Homo sapiens
tgtaattatttgaatg

SEQ ID NO: 1728864 - DNA, 13 bp, Homo sapiens
tgtaattccccta

SEQ ID NO: 1728865 - DNA, 13 bp, Homo sapiens
tgtaattctaaat

SEQ ID NO: 1728866 - DNA, 15 bp, Homo sapiens
tgtaattgcttacat

SEQ ID NO: 1728867 - DNA, 18 bp, Homo sapiens
tgtaattgcttacatttt

SEQ ID NO: 1728868 - DNA, 13 bp, Homo sapiens
tgtaattgtgtaa

SEQ ID NO: 1728869 - DNA, 18 bp, Homo sapiens
tgtaatttaaaattgtga

SEQ ID NO: 1728870 - DNA, 15 bp, Homo sapiens
tgtaatttaaacagg

SEQ ID NO: 1728871 - DNA, 21 bp, Homo sapiens
tgtaatttaaacaggcccagc

SEQ ID NO: 1728872 - DNA, 15 bp, Homo sapiens
tgtaatttaaatgaa

SEQ ID NO: 1728873 - DNA, 19 bp, Homo sapiens
tgtaatttaaggtctgttt

SEQ ID NO: 1728874 - DNA, 18 bp, Homo sapiens
tgtaatttaagtgacaca

SEQ ID NO: 1728875 - DNA, 18 bp, Homo sapiens
tgtaatttatattccatt

SEQ ID NO: 1728876 - DNA, 14 bp, Homo sapiens
tgtaatttatgcaa

SEQ ID NO: 1728877 - DNA, 19 bp, Homo sapiens
tgtaatttcgccttaaact

SEQ ID NO: 1728878 - DNA, 21 bp, Homo sapiens
tgtaattttaaaagtctattt

SEQ ID NO: 1728879 - DNA, 16 bp, Homo sapiens
tgtacaaaactgtaaa

SEQ ID NO: 1728880 - DNA, 17 bp, Homo sapiens
tgtacaaaataaacaaa

SEQ ID NO: 1728881 - DNA, 13 bp, Homo sapiens
tgtacaaaattaa

SEQ ID NO: 1728882 - DNA, 15 bp, Homo sapiens
tgtacaaataaacct

SEQ ID NO: 1728883 - DNA, 16 bp, Homo sapiens
tgtacaaataaacctg

SEQ ID NO: 1728884 - DNA, 22 bp, Homo sapiens
tgtacaaataaacctgaggcag

SEQ ID NO: 1728885 - DNA, 19 bp, Homo sapiens
tgtacaaatgtaagcaaag

SEQ ID NO: 1728886 - DNA, 13 bp, Homo sapiens
tgtacaataaatt

SEQ ID NO: 1728887 - DNA, 14 bp, Homo sapiens
tgtacaataaattt

SEQ ID NO: 1728888 - DNA, 22 bp, Homo sapiens
tgtacaatggtttattcccaag

SEQ ID NO: 1728889 - DNA, 16 bp, Homo sapiens
tgtacaattatgtctc

SEQ ID NO: 1728890 - DNA, 15 bp, Homo sapiens
tgtacaattttaaag

SEQ ID NO: 1728891 - DNA, 22 bp, Homo sapiens
tgtacacatgggagtttagtgt

SEQ ID NO: 1728892 - DNA, 15 bp, Homo sapiens
tgtacacattaaggt

SEQ ID NO: 1728893 - DNA, 18 bp, Homo sapiens
tgtacacgggaccagctc

SEQ ID NO: 1728894 - DNA, 14 bp, Homo sapiens
tgtacacgggactg

SEQ ID NO: 1728895 - DNA, 20 bp, Homo sapiens
tgtacacgggactgacgcaa

SEQ ID NO: 1728896 - DNA, 16 bp, Homo sapiens
tgtacacgtgtcctgt

SEQ ID NO: 1728897 - DNA, 12 bp, Homo sapiens
tgtacactgaat

SEQ ID NO: 1728898 - DNA, 14 bp, Homo sapiens
tgtacactgaatat

SEQ ID NO: 1728899 - DNA, 16 bp, Homo sapiens
tgtacactgaatattt

SEQ ID NO: 1728900 - DNA, 20 bp, Homo sapiens
tgtacactgaatatttatat

SEQ ID NO: 1728901 - DNA, 23 bp, Homo sapiens
tgtacagaatatttctattgaat

SEQ ID NO: 1728902 - DNA, 18 bp, Homo sapiens
tgtacagaccacctttca

SEQ ID NO: 1728903 - DNA, 21 bp, Homo sapiens
tgtacagaccacctttcacaa

SEQ ID NO: 1728904 - DNA, 18 bp, Homo sapiens
tgtacagactgttttact

SEQ ID NO: 1728905 - DNA, 20 bp, Homo sapiens
tgtacagattttatttgtaa

SEQ ID NO: 1728906 - DNA, 22 bp, Homo sapiens
tgtacagattttatttgtaatt

SEQ ID NO: 1728907 - DNA, 19 bp, Homo sapiens
tgtacaggaagtagttcta

SEQ ID NO: 1728908 - DNA, 20 bp, Homo sapiens
tgtacaggaagtagttctaa

SEQ ID NO: 1728909 - DNA, 13 bp, Homo sapiens
tgtacaggtcacc

SEQ ID NO: 1728910 - DNA, 18 bp, Homo sapiens
tgtacagtctgtcatgaa

SEQ ID NO: 1728911 - DNA, 23 bp, Homo sapiens
tgtacagtctgtcatgaacatgt

SEQ ID NO: 1728912 - DNA, 18 bp, Homo sapiens
tgtacagtgaattgtctt

SEQ ID NO: 1728913 - DNA, 19 bp, Homo sapiens
tgtacagtgtgtaaagtgt

SEQ ID NO: 1728914 - DNA, 17 bp, Homo sapiens
tgtacagttatttatgc

SEQ ID NO: 1728915 - DNA, 17 bp, Homo sapiens
tgtacataactcctgtc

SEQ ID NO: 1728916 - DNA, 14 bp, Homo sapiens
tgtacataactgaa

SEQ ID NO: 1728917 - DNA, 15 bp, Homo sapiens
tgtacataactgaaa

SEQ ID NO: 1728918 - DNA, 19 bp, Homo sapiens
tgtacataactgaaaatgt

SEQ ID NO: 1728919 - DNA, 21 bp, Homo sapiens
tgtacatacgatttaaggtat

SEQ ID NO: 1728920 - DNA, 17 bp, Homo sapiens
tgtacatagaccctctt

SEQ ID NO: 1728921 - DNA, 20 bp, Homo sapiens
tgtacatagagcaatgttgg

SEQ ID NO: 1728922 - DNA, 18 bp, Homo sapiens
tgtacatagtaaagtatt

SEQ ID NO: 1728923 - DNA, 16 bp, Homo sapiens
tgtacatatatgtata

SEQ ID NO: 1728924 - DNA, 20 bp, Homo sapiens
tgtacatatatgtataatat

SEQ ID NO: 1728925 - DNA, 22 bp, Homo sapiens
tgtacatatatgtataatatat

SEQ ID NO: 1728926 - DNA, 15 bp, Homo sapiens
tgtacatatgtaaaa

SEQ ID NO: 1728927 - DNA, 19 bp, Homo sapiens
tgtacatatgtaaaataaa

SEQ ID NO: 1728928 - DNA, 15 bp, Homo sapiens
tgtacatattactgt

SEQ ID NO: 1728929 - DNA, 17 bp, Homo sapiens
tgtacatggcagagttt

SEQ ID NO: 1728930 - DNA, 15 bp, Homo sapiens
tgtacatgtacatag

SEQ ID NO: 1728931 - DNA, 16 bp, Homo sapiens
tgtacatgtacatagt

SEQ ID NO: 1728932 - DNA, 20 bp, Homo sapiens
tgtacatgtacatagtaaag

SEQ ID NO: 1728933 - DNA, 17 bp, Homo sapiens
tgtacatgtatgaaatt

SEQ ID NO: 1728934 - DNA, 21 bp, Homo sapiens
tgtacatgtattaaattacat

SEQ ID NO: 1728935 - DNA, 15 bp, Homo sapiens
tgtacatgtgtagcc

SEQ ID NO: 1728936 - DNA, 17 bp, Homo sapiens
tgtacatgtgtagcctg

SEQ ID NO: 1728937 - DNA, 14 bp, Homo sapiens
tgtacattaattac

SEQ ID NO: 1728938 - DNA, 16 bp, Homo sapiens
tgtacattacactaaa

SEQ ID NO: 1728939 - DNA, 14 bp, Homo sapiens
tgtacattcttcca

SEQ ID NO: 1728940 - DNA, 20 bp, Homo sapiens
tgcttaatcttcaaagcctt

SEQ ID NO: 1728941 - DNA, 21 bp, Homo sapiens
tgcttacagtaactaattttg

SEQ ID NO: 1728942 - DNA, 12 bp, Homo sapiens
tgcttacatttt

SEQ ID NO: 1728943 - DNA, 13 bp, Homo sapiens
tgcttacccttca

SEQ ID NO: 1728944 - DNA, 22 bp, Homo sapiens
tgcttacctctcagccttagct

SEQ ID NO: 1728945 - DNA, 20 bp, Homo sapiens
tgcttaccttggttggaagg

SEQ ID NO: 1728946 - DNA, 14 bp, Homo sapiens
tgcttactttggaa

SEQ ID NO: 1728947 - DNA, 13 bp, Homo sapiens
tgcttagataact

SEQ ID NO: 1728948 - DNA, 14 bp, Homo sapiens
tgcttagtcactgc

SEQ ID NO: 1728949 - DNA, 19 bp, Homo sapiens
tgcttagtcactgcctgca

SEQ ID NO: 1728950 - DNA, 21 bp, Homo sapiens
tgcttagtcacttatttcata

SEQ ID NO: 1728951 - DNA, 20 bp, Homo sapiens
tgcttagtgtacttggagta

SEQ ID NO: 1728952 - DNA, 23 bp, Homo sapiens
tgcttataacctagttaaagaaa

SEQ ID NO: 1728953 - DNA, 21 bp, Homo sapiens
tgcttatgacatcacttgtac

SEQ ID NO: 1728954 - DNA, 12 bp, Homo sapiens
tgcttatgttgt

SEQ ID NO: 1728955 - DNA, 15 bp, Homo sapiens
tgcttattgtaacag

SEQ ID NO: 1728956 - DNA, 15 bp, Homo sapiens
tgcttattttattat

SEQ ID NO: 1728957 - DNA, 13 bp, Homo sapiens
tgcttcaaaaaca

SEQ ID NO: 1728958 - DNA, 16 bp, Homo sapiens
tgcttcaagtgttgct

SEQ ID NO: 1728959 - DNA, 19 bp, Homo sapiens
tgcttcaagtgttgctctt

SEQ ID NO: 1728960 - DNA, 16 bp, Homo sapiens
tgcttcaataaatctt

SEQ ID NO: 1728961 - DNA, 15 bp, Homo sapiens
tgcttcaattaataa

SEQ ID NO: 1728962 - DNA, 14 bp, Homo sapiens
tgcttcacaatgtt

SEQ ID NO: 1728963 - DNA, 13 bp, Homo sapiens
tgcttcacagtag

SEQ ID NO: 1728964 - DNA, 16 bp, Homo sapiens
tgcttcacagtagagc

SEQ ID NO: 1728965 - DNA, 21 bp, Homo sapiens
tgcttcacagtagagccagct

SEQ ID NO: 1728966 - DNA, 17 bp, Homo sapiens
tgcttcagagtttgtgt

SEQ ID NO: 1728967 - DNA, 19 bp, Homo sapiens
tgcttcagagtttgtgtgt

SEQ ID NO: 1728968 - DNA, 20 bp, Homo sapiens
tgcttcagagtttgtgtgta

SEQ ID NO: 1728969 - DNA, 22 bp, Homo sapiens
tgcttcagagtttgtgtgtatt

SEQ ID NO: 1728970 - DNA, 17 bp, Homo sapiens
tgcttcagcctgaggct

SEQ ID NO: 1728971 - DNA, 23 bp, Homo sapiens
tgcttcagcctgaggctgagact

SEQ ID NO: 1728972 - DNA, 17 bp, Homo sapiens
tgcttcatcattccctc

SEQ ID NO: 1728973 - DNA, 15 bp, Homo sapiens
tgcttcattcaatat

SEQ ID NO: 1728974 - DNA, 19 bp, Homo sapiens
tgcttcattcaatattgac

SEQ ID NO: 1728975 - DNA, 20 bp, Homo sapiens
tgcttcatttgtatgtcaaa

SEQ ID NO: 1728976 - DNA, 23 bp, Homo sapiens
tgcttccaaaagtgatagtgtgt

SEQ ID NO: 1728977 - DNA, 19 bp, Homo sapiens
tgcttccaacaaggacagc

SEQ ID NO: 1728978 - DNA, 13 bp, Homo sapiens
tgcttcccactgg

SEQ ID NO: 1728979 - DNA, 17 bp, Homo sapiens
tgcttcccactggggcc

SEQ ID NO: 1728980 - DNA, 14 bp, Homo sapiens
tgcttcccatccta

SEQ ID NO: 1728981 - DNA, 15 bp, Homo sapiens
tgcttcccattgagt

SEQ ID NO: 1728982 - DNA, 20 bp, Homo sapiens
tgcttcccattgtggctcct

SEQ ID NO: 1728983 - DNA, 21 bp, Homo sapiens
tgcttcccccacccctccacg

SEQ ID NO: 1728984 - DNA, 15 bp, Homo sapiens
tgcttcccttacttt

SEQ ID NO: 1728985 - DNA, 15 bp, Homo sapiens
tgcttccgccactca

SEQ ID NO: 1728986 - DNA, 21 bp, Homo sapiens
tgcttcctagaagttactgaa

SEQ ID NO: 1728987 - DNA, 22 bp, Homo sapiens
tgcttcctagaagttactgaat

SEQ ID NO: 1728988 - DNA, 14 bp, Homo sapiens
tgcttcctcctgga

SEQ ID NO: 1728989 - DNA, 19 bp, Homo sapiens
tgcttcctcttttcctgct

SEQ ID NO: 1728990 - DNA, 11 bp, Homo sapiens
tgcttcctgat

SEQ ID NO: 1728991 - DNA, 13 bp, Homo sapiens
tgcttccttcagt

SEQ ID NO: 1728992 - DNA, 16 bp, Homo sapiens
tgcttcctttctctcc

SEQ ID NO: 1728993 - DNA, 21 bp, Homo sapiens
tgcttcgactactgctcctgt

SEQ ID NO: 1728994 - DNA, 16 bp, Homo sapiens
tgcttctaaaacaata

SEQ ID NO: 1728995 - DNA, 17 bp, Homo sapiens
tgcttctccacctcccc

SEQ ID NO: 1728996 - DNA, 20 bp, Homo sapiens
tgcttctcggggtccagtgc

SEQ ID NO: 1728997 - DNA, 21 bp, Homo sapiens
tgcttctcggggtccagtgca

SEQ ID NO: 1728998 - DNA, 14 bp, Homo sapiens
tgcttctctacaga

SEQ ID NO: 1728999 - DNA, 23 bp, Homo sapiens
tgcttctctctctctcacacaca

SEQ ID NO: 1729000 - DNA, 13 bp, Homo sapiens
tgcttctctgact

SEQ ID NO: 1729001 - DNA, 21 bp, Homo sapiens
tgcttctctgacttctgcctg

SEQ ID NO: 1729002 - DNA, 22 bp, Homo sapiens
tgcttctctgacttctgcctgg

SEQ ID NO: 1729003 - DNA, 19 bp, Homo sapiens
tgcttctgaactcaagctg

SEQ ID NO: 1729004 - DNA, 14 bp, Homo sapiens
tgcttctttctaga

SEQ ID NO: 1729005 - DNA, 13 bp, Homo sapiens
tgcttctttgtaa

SEQ ID NO: 1729006 - DNA, 16 bp, Homo sapiens
tgcttctttgtaatga

SEQ ID NO: 1729007 - DNA, 17 bp, Homo sapiens
tgcttgaacccaggaga

SEQ ID NO: 1729008 - DNA, 14 bp, Homo sapiens
tgcttgaacttaca

SEQ ID NO: 1729009 - DNA, 20 bp, Homo sapiens
tgcttgacatacctaccagt

SEQ ID NO: 1729010 - DNA, 22 bp, Homo sapiens
tgcttgacatacctaccagtat

SEQ ID NO: 1729011 - DNA, 14 bp, Homo sapiens
tgcttgagaatcct

SEQ ID NO: 1729012 - DNA, 17 bp, Homo sapiens
tgcttgataatatataa

SEQ ID NO: 1729013 - DNA, 21 bp, Homo sapiens
tgcttgatatgtaagtacttc

SEQ ID NO: 1729014 - DNA, 16 bp, Homo sapiens
tgcttgcataagagct

SEQ ID NO: 1729015 - DNA, 22 bp, Homo sapiens
tgcttgccaaggcagaggcctg

SEQ ID NO: 1729016 - DNA, 23 bp, Homo sapiens
tgcttgccgactggctgtgagac

SEQ ID NO: 1729017 - DNA, 15 bp, Homo sapiens
tgcttgcctgatata

SEQ ID NO: 1729018 - DNA, 14 bp, Homo sapiens
tgcttggaagccag

SEQ ID NO: 1729019 - DNA, 15 bp, Homo sapiens
tgcttggaagccagg

SEQ ID NO: 1729020 - DNA, 18 bp, Homo sapiens
tgcttggagcaatcagaa

SEQ ID NO: 1729021 - DNA, 21 bp, Homo sapiens
tgcttggatccatacaaaact

SEQ ID NO: 1729022 - DNA, 20 bp, Homo sapiens
tgcttggattctctgagaaa

SEQ ID NO: 1729023 - DNA, 16 bp, Homo sapiens
tgcttgggccctgcat

SEQ ID NO: 1729024 - DNA, 23 bp, Homo sapiens
tggctggtagaaaaaggggcctg

SEQ ID NO: 1729025 - DNA, 17 bp, Homo sapiens
tggctggtagcagcagg

SEQ ID NO: 1729026 - DNA, 23 bp, Homo sapiens
tggctggtagcagcaggctcagg

SEQ ID NO: 1729027 - DNA, 13 bp, Homo sapiens
tggctggtccagg

SEQ ID NO: 1729028 - DNA, 15 bp, Homo sapiens
tggctggtccagggc

SEQ ID NO: 1729029 - DNA, 14 bp, Homo sapiens
tggctggtctcacc

SEQ ID NO: 1729030 - DNA, 14 bp, Homo sapiens
tggctggtgggccc

SEQ ID NO: 1729031 - DNA, 19 bp, Homo sapiens
tggctggtgtatgcacagg

SEQ ID NO: 1729032 - DNA, 20 bp, Homo sapiens
tggctgtaaggctctagatc

SEQ ID NO: 1729033 - DNA, 16 bp, Homo sapiens
tggctgtaatcatttg

SEQ ID NO: 1729034 - DNA, 15 bp, Homo sapiens
tggctgtatttgctg

SEQ ID NO: 1729035 - DNA, 10 bp, Homo sapiens
tggctgtctg

SEQ ID NO: 1729036 - DNA, 22 bp, Homo sapiens
tggctgtctgaccagagaatgc

SEQ ID NO: 1729037 - DNA, 21 bp, Homo sapiens
tggctgtgaatgccaaagcca

SEQ ID NO: 1729038 - DNA, 17 bp, Homo sapiens
tggctgtgacacctggt

SEQ ID NO: 1729039 - DNA, 15 bp, Homo sapiens
tggctgtgagcagcc

SEQ ID NO: 1729040 - DNA, 19 bp, Homo sapiens
tggctgtgcccagcaggcc

SEQ ID NO: 1729041 - DNA, 23 bp, Homo sapiens
tggctgtgcccagcaggcccagc

SEQ ID NO: 1729042 - DNA, 13 bp, Homo sapiens
tggctgtggaggc

SEQ ID NO: 1729043 - DNA, 20 bp, Homo sapiens
tggctgtggaggcctgatgc

SEQ ID NO: 1729044 - DNA, 15 bp, Homo sapiens
tggctgtggcacaga

SEQ ID NO: 1729045 - DNA, 13 bp, Homo sapiens
tggctgttgagat

SEQ ID NO: 1729046 - DNA, 17 bp, Homo sapiens
tggctgttgagggccac

SEQ ID NO: 1729047 - DNA, 21 bp, Homo sapiens
tggcttaaagcatcctcctcc

SEQ ID NO: 1729048 - DNA, 19 bp, Homo sapiens
tggcttaagtgagcagaac

SEQ ID NO: 1729049 - DNA, 14 bp, Homo sapiens
tggcttagtgccac

SEQ ID NO: 1729050 - DNA, 22 bp, Homo sapiens
tggcttccagaaaaccccagca

SEQ ID NO: 1729051 - DNA, 14 bp, Homo sapiens
tggcttccagattt

SEQ ID NO: 1729052 - DNA, 15 bp, Homo sapiens
tggcttccccactcc

SEQ ID NO: 1729053 - DNA, 17 bp, Homo sapiens
tggcttcccgctcagcc

SEQ ID NO: 1729054 - DNA, 18 bp, Homo sapiens
tggcttcccgctcagccc

SEQ ID NO: 1729055 - DNA, 19 bp, Homo sapiens
tggcttcccgctcagccct

SEQ ID NO: 1729056 - DNA, 14 bp, Homo sapiens
tggcttccctggaa

SEQ ID NO: 1729057 - DNA, 21 bp, Homo sapiens
tggcttcctccgtccacccag

SEQ ID NO: 1729058 - DNA, 22 bp, Homo sapiens
tggcttcctccgtccacccagg

SEQ ID NO: 1729059 - DNA, 23 bp, Homo sapiens
tggcttcctccgtccacccaggc

SEQ ID NO: 1729060 - DNA, 13 bp, Homo sapiens
tggcttcctcctg

SEQ ID NO: 1729061 - DNA, 13 bp, Homo sapiens
tggcttctcctgt

SEQ ID NO: 1729062 - DNA, 18 bp, Homo sapiens
tggcttctgcttgtcatc

SEQ ID NO: 1729063 - DNA, 15 bp, Homo sapiens
tggcttctgggagat

SEQ ID NO: 1729064 - DNA, 14 bp, Homo sapiens
tggcttctgtgatg

SEQ ID NO: 1729065 - DNA, 12 bp, Homo sapiens
tggcttctgtgc

SEQ ID NO: 1729066 - DNA, 14 bp, Homo sapiens
tggcttctgtgcac

SEQ ID NO: 1729067 - DNA, 16 bp, Homo sapiens
tggcttgaaggactgc

SEQ ID NO: 1729068 - DNA, 13 bp, Homo sapiens
tggcttgctccag

SEQ ID NO: 1729069 - DNA, 19 bp, Homo sapiens
tggcttgctccagggtctt

SEQ ID NO: 1729070 - DNA, 22 bp, Homo sapiens
tggcttggggattgtacacggg

SEQ ID NO: 1729071 - DNA, 22 bp, Homo sapiens
tggcttggggtcaagaaacagc

SEQ ID NO: 1729072 - DNA, 23 bp, Homo sapiens
tggctttaattgtataagtcaag

SEQ ID NO: 1729073 - DNA, 22 bp, Homo sapiens
tggctttcagagccagcctggc

SEQ ID NO: 1729074 - DNA, 12 bp, Homo sapiens
tggctttctctc

SEQ ID NO: 1729075 - DNA, 13 bp, Homo sapiens
tggctttctctct

SEQ ID NO: 1729076 - DNA, 15 bp, Homo sapiens
tggctttctctctgg

SEQ ID NO: 1729077 - DNA, 16 bp, Homo sapiens
tggctttctctctggc

SEQ ID NO: 1729078 - DNA, 17 bp, Homo sapiens
tggctttgcctcttctt

SEQ ID NO: 1729079 - DNA, 14 bp, Homo sapiens
tggctttgccttta

SEQ ID NO: 1729080 - DNA, 17 bp, Homo sapiens
tggctttggcagtgttt

SEQ ID NO: 1729081 - DNA, 21 bp, Homo sapiens
tggctttgggcaggtctgaga

SEQ ID NO: 1729082 - DNA, 15 bp, Homo sapiens
tggcttttactttat

SEQ ID NO: 1729083 - DNA, 14 bp, Homo sapiens
tggcttttcactgc

SEQ ID NO: 1729084 - DNA, 22 bp, Homo sapiens
tggcttttcttacccagattgt

SEQ ID NO: 1729085 - DNA, 20 bp, Homo sapiens
tggcttttgccacatacata

SEQ ID NO: 1729086 - DNA, 17 bp, Homo sapiens
tggctttttctgccact

SEQ ID NO: 1729087 - DNA, 17 bp, Homo sapiens
tggctttttgttcagaa

SEQ ID NO: 1729088 - DNA, 13 bp, Homo sapiens
tgggaaaaaaaga

SEQ ID NO: 1729089 - DNA, 23 bp, Homo sapiens
tgggaaaaatgcccttaaatcat

SEQ ID NO: 1729090 - DNA, 21 bp, Homo sapiens
tgggaaaacatgttaatgaca

SEQ ID NO: 1729091 - DNA, 18 bp, Homo sapiens
tgggaaaagaccagggct

SEQ ID NO: 1729092 - DNA, 18 bp, Homo sapiens
tgggaaacttggctcgaa

SEQ ID NO: 1729093 - DNA, 19 bp, Homo sapiens
tgggaaagatggataaact

SEQ ID NO: 1729094 - DNA, 17 bp, Homo sapiens
tgggaacactggcctgg

SEQ ID NO: 1729095 - DNA, 18 bp, Homo sapiens
tgggaacatgacccagcc

SEQ ID NO: 1729096 - DNA, 19 bp, Homo sapiens
tgggaacatgacccagcct

SEQ ID NO: 1729097 - DNA, 19 bp, Homo sapiens
tgggaacatgctggaaata

SEQ ID NO: 1729098 - DNA, 14 bp, Homo sapiens
tgggaaccccgcag

SEQ ID NO: 1729099 - DNA, 20 bp, Homo sapiens
tgggaaccccgcagcccgtg

SEQ ID NO: 1729100 - DNA, 13 bp, Homo sapiens
cctggctcgcagg

SEQ ID NO: 1729101 - DNA, 20 bp, Homo sapiens
cctggctctaccctgtctgt

SEQ ID NO: 1729102 - DNA, 14 bp, Homo sapiens
cctggctctcagag

SEQ ID NO: 1729103 - DNA, 16 bp, Homo sapiens
cctggctctcagagga

SEQ ID NO: 1729104 - DNA, 15 bp, Homo sapiens
cctggctctgccccc

SEQ ID NO: 1729105 - DNA, 18 bp, Homo sapiens
cctggctgagcctggctg

SEQ ID NO: 1729106 - DNA, 19 bp, Homo sapiens
cctggctgagcctggctgg

SEQ ID NO: 1729107 - DNA, 19 bp, Homo sapiens
cctggctgaggttcctctg

SEQ ID NO: 1729108 - DNA, 18 bp, Homo sapiens
cctggctgccaggcgttg

SEQ ID NO: 1729109 - DNA, 13 bp, Homo sapiens
cctggctgccctg

SEQ ID NO: 1729110 - DNA, 14 bp, Homo sapiens
cctggctgccctgg

SEQ ID NO: 1729111 - DNA, 18 bp, Homo sapiens
cctggctgccctggccct

SEQ ID NO: 1729112 - DNA, 19 bp, Homo sapiens
cctggctgccctggccctg

SEQ ID NO: 1729113 - DNA, 16 bp, Homo sapiens
cctggctgctgccccc

SEQ ID NO: 1729114 - DNA, 18 bp, Homo sapiens
cctggctgctgcccccac

SEQ ID NO: 1729115 - DNA, 18 bp, Homo sapiens
cctggctggagagctgct

SEQ ID NO: 1729116 - DNA, 19 bp, Homo sapiens
cctggctggtgggaaggcc

SEQ ID NO: 1729117 - DNA, 14 bp, Homo sapiens
cctggctgtgagca

SEQ ID NO: 1729118 - DNA, 19 bp, Homo sapiens
cctggctgtgagcagcctc

SEQ ID NO: 1729119 - DNA, 20 bp, Homo sapiens
cctggctgtgagcagcctcc

SEQ ID NO: 1729120 - DNA, 15 bp, Homo sapiens
cctggctgtgcccag

SEQ ID NO: 1729121 - DNA, 16 bp, Homo sapiens
cctggctgtgcccagc

SEQ ID NO: 1729122 - DNA, 18 bp, Homo sapiens
cctggctgtgcccagcag

SEQ ID NO: 1729123 - DNA, 20 bp, Homo sapiens
cctggctgtgcccagcaggc

SEQ ID NO: 1729124 - DNA, 18 bp, Homo sapiens
cctggctgtggaggcctg

SEQ ID NO: 1729125 - DNA, 19 bp, Homo sapiens
cctggctgtggaggcctga

SEQ ID NO: 1729126 - DNA, 21 bp, Homo sapiens
cctggctgtggaggcctgatg

SEQ ID NO: 1729127 - DNA, 21 bp, Homo sapiens
cctggctgttctgtggttcct

SEQ ID NO: 1729128 - DNA, 20 bp, Homo sapiens
cctggcttctggagcccttg

SEQ ID NO: 1729129 - DNA, 22 bp, Homo sapiens
cctggcttctggagcccttggg

SEQ ID NO: 1729130 - DNA, 12 bp, Homo sapiens
cctggcttggag

SEQ ID NO: 1729131 - DNA, 15 bp, Homo sapiens
cctggcttggaggct

SEQ ID NO: 1729132 - DNA, 15 bp, Homo sapiens
cctggctttgcctct

SEQ ID NO: 1729133 - DNA, 17 bp, Homo sapiens
cctggctttgcctcttc

SEQ ID NO: 1729134 - DNA, 18 bp, Homo sapiens
cctggctttgcctcttct

SEQ ID NO: 1729135 - DNA, 19 bp, Homo sapiens
cctggctttgcctcttctt

SEQ ID NO: 1729136 - DNA, 17 bp, Homo sapiens
cctggcttttcactgct

SEQ ID NO: 1729137 - DNA, 22 bp, Homo sapiens
cctggcttttcactgctggctg

SEQ ID NO: 1729138 - DNA, 15 bp, Homo sapiens
cctgggaaaggaccc

SEQ ID NO: 1729139 - DNA, 22 bp, Homo sapiens
cctggtccagggaagctggccg

SEQ ID NO: 1729140 - DNA, 20 bp, Homo sapiens
cctggtccagtcgggaggag

SEQ ID NO: 1729141 - DNA, 16 bp, Homo sapiens
cctggtccctgggagg

SEQ ID NO: 1729142 - DNA, 17 bp, Homo sapiens
cctggtccctggtcctt

SEQ ID NO: 1729143 - DNA, 15 bp, Homo sapiens
cctggtcctggcctc

SEQ ID NO: 1729144 - DNA, 17 bp, Homo sapiens
cctggtcctggcctcct

SEQ ID NO: 1729145 - DNA, 13 bp, Homo sapiens
cctggtcctggct

SEQ ID NO: 1729146 - DNA, 16 bp, Homo sapiens
cctggtcctggctgca

SEQ ID NO: 1729147 - DNA, 22 bp, Homo sapiens
cctggtccttcactggcgcctt

SEQ ID NO: 1729148 - DNA, 23 bp, Homo sapiens
cctggtccttcactggcgccttc

SEQ ID NO: 1729149 - DNA, 15 bp, Homo sapiens
cctggtccttccagg

SEQ ID NO: 1729150 - DNA, 16 bp, Homo sapiens
cctggtctgaggatgt

SEQ ID NO: 1729151 - DNA, 16 bp, Homo sapiens
cctggtgagctcagat

SEQ ID NO: 1729152 - DNA, 22 bp, Homo sapiens
cctggtgcacgcaggcacagca

SEQ ID NO: 1729153 - DNA, 16 bp, Homo sapiens
cctggtgcctctgtgc

SEQ ID NO: 1729154 - DNA, 13 bp, Homo sapiens
cctggtgctctct

SEQ ID NO: 1729155 - DNA, 17 bp, Homo sapiens
cctggtgctctctgcca

SEQ ID NO: 1729156 - DNA, 15 bp, Homo sapiens
cctggtgctgccaca

SEQ ID NO: 1729157 - DNA, 12 bp, Homo sapiens
cctggtggacag

SEQ ID NO: 1729158 - DNA, 17 bp, Homo sapiens
cctggtggctgggccca

SEQ ID NO: 1729159 - DNA, 20 bp, Homo sapiens
cctggtggctgggcccagca

SEQ ID NO: 1729160 - DNA, 13 bp, Homo sapiens
cctggtgggagca

SEQ ID NO: 1729161 - DNA, 20 bp, Homo sapiens
cctggtgggagcacctgcca

SEQ ID NO: 1729162 - DNA, 20 bp, Homo sapiens
cctggtggggtgtgcatgcc

SEQ ID NO: 1729163 - DNA, 17 bp, Homo sapiens
cctggtgggtcagccca

SEQ ID NO: 1729164 - DNA, 22 bp, Homo sapiens
cctggtgggtcagcccagcacc

SEQ ID NO: 1729165 - DNA, 14 bp, Homo sapiens
cctggtgtcaggca

SEQ ID NO: 1729166 - DNA, 16 bp, Homo sapiens
cctggtgtctagtttg

SEQ ID NO: 1729167 - DNA, 20 bp, Homo sapiens
cctggttagctgacagtcag

SEQ ID NO: 1729168 - DNA, 13 bp, Homo sapiens
cctggttcctgct

SEQ ID NO: 1729169 - DNA, 14 bp, Homo sapiens
cctggttcctgctg

SEQ ID NO: 1729170 - DNA, 18 bp, Homo sapiens
cctggttcctgctgtcct

SEQ ID NO: 1729171 - DNA, 22 bp, Homo sapiens
cctggttcctgctgtcctggtg

SEQ ID NO: 1729172 - DNA, 15 bp, Homo sapiens
cctggttctcatctt

SEQ ID NO: 1729173 - DNA, 22 bp, Homo sapiens
cctggttggccgtggtccagct

SEQ ID NO: 1729174 - DNA, 17 bp, Homo sapiens
cctggttgttcctgcat

SEQ ID NO: 1729175 - DNA, 21 bp, Homo sapiens
cctggtttacttctttagcat

SEQ ID NO: 1729176 - DNA, 18 bp, Homo sapiens
cctggtttctgttctgtt

SEQ ID NO: 1729177 - DNA, 22 bp, Homo sapiens
cctggtttgactcagttccagg

SEQ ID NO: 1729178 - DNA, 18 bp, Homo sapiens
cctggtttttgtagcctt

SEQ ID NO: 1729179 - DNA, 17 bp, Homo sapiens
cctgtaaataagagttg

SEQ ID NO: 1729180 - DNA, 17 bp, Homo sapiens
cctgtaacactcctctg

SEQ ID NO: 1729181 - DNA, 14 bp, Homo sapiens
cctgtaatcccagc

SEQ ID NO: 1729182 - DNA, 15 bp, Homo sapiens
cctgtaatcccagca

SEQ ID NO: 1729183 - DNA, 16 bp, Homo sapiens
cctgtaatcccagcac

SEQ ID NO: 1729184 - DNA, 17 bp, Homo sapiens
cctgtaatcccagcact

SEQ ID NO: 1729185 - DNA, 15 bp, Homo sapiens
cctgtaatcccagct

SEQ ID NO: 1729186 - DNA, 18 bp, Homo sapiens
cctgtaatcccagctact

SEQ ID NO: 1729187 - DNA, 23 bp, Homo sapiens
cctgtaatcccagctactcagga

SEQ ID NO: 1729188 - DNA, 22 bp, Homo sapiens
cctgtacacattcctgcattca

SEQ ID NO: 1729189 - DNA, 21 bp, Homo sapiens
cctgtacagtagattttccaa

SEQ ID NO: 1729190 - DNA, 16 bp, Homo sapiens
cctgtacattcttcca

SEQ ID NO: 1729191 - DNA, 15 bp, Homo sapiens
cctgtacccagctcc

SEQ ID NO: 1729192 - DNA, 17 bp, Homo sapiens
cctgtaccccagcactt

SEQ ID NO: 1729193 - DNA, 15 bp, Homo sapiens
cctgtaccttgctgt

SEQ ID NO: 1729194 - DNA, 22 bp, Homo sapiens
cctgtaccttttgaggagcccc

SEQ ID NO: 1729195 - DNA, 23 bp, Homo sapiens
cctgtaccttttgaggagcccca

SEQ ID NO: 1729196 - DNA, 17 bp, Homo sapiens
cctgtactattgcagac

SEQ ID NO: 1729197 - DNA, 13 bp, Homo sapiens
cctgtactcagga

SEQ ID NO: 1729198 - DNA, 14 bp, Homo sapiens
cctgtactcaggag

SEQ ID NO: 1729199 - DNA, 22 bp, Homo sapiens
cctgtactcaggaggctgaggg

SEQ ID NO: 1729200 - DNA, 17 bp, Homo sapiens
cctgtactgttctgtgt

SEQ ID NO: 1729201 - DNA, 12 bp, Homo sapiens
cctgtacttttt

SEQ ID NO: 1729202 - DNA, 13 bp, Homo sapiens
cctgtagagttgc

SEQ ID NO: 1729203 - DNA, 15 bp, Homo sapiens
cctgtagcacttact

SEQ ID NO: 1729204 - DNA, 16 bp, Homo sapiens
cctgtagctcagtcat

SEQ ID NO: 1729205 - DNA, 14 bp, Homo sapiens
cctgtagctctgcc

SEQ ID NO: 1729206 - DNA, 16 bp, Homo sapiens
cctgtagctctgcctc

SEQ ID NO: 1729207 - DNA, 22 bp, Homo sapiens
cctgtagctttaaaaccacagc

SEQ ID NO: 1729208 - DNA, 17 bp, Homo sapiens
cctgtagctttcctggt

SEQ ID NO: 1729209 - DNA, 22 bp, Homo sapiens
cctgtagctttcctggtccctc

SEQ ID NO: 1729210 - DNA, 21 bp, Homo sapiens
cctgtagggaaaccttggaga

SEQ ID NO: 1729211 - DNA, 14 bp, Homo sapiens
cctgtagtgagaaa

SEQ ID NO: 1729212 - DNA, 19 bp, Homo sapiens
cctgtagttgcgtggactc

SEQ ID NO: 1729213 - DNA, 23 bp, Homo sapiens
cctgtagttgcgtggactctgca

SEQ ID NO: 1729214 - DNA, 14 bp, Homo sapiens
cctgtatacagtgc

SEQ ID NO: 1729215 - DNA, 18 bp, Homo sapiens
cctgtatacagtgcagag

SEQ ID NO: 1729216 - DNA, 21 bp, Homo sapiens
cctgtatacagtgcagagcct

SEQ ID NO: 1729217 - DNA, 21 bp, Homo sapiens
cctgtatcctccctggcagac

SEQ ID NO: 1729218 - DNA, 15 bp, Homo sapiens
cctgtatgtggtgtg

SEQ ID NO: 1729219 - DNA, 23 bp, Homo sapiens
tgggataaagatgcaaggaccag

SEQ ID NO: 1729220 - DNA, 20 bp, Homo sapiens
tgggataaaggcccagactc

SEQ ID NO: 1729221 - DNA, 16 bp, Homo sapiens
tgggataattccttgg

SEQ ID NO: 1729222 - DNA, 20 bp, Homo sapiens
tgggatataagaggcagcgt

SEQ ID NO: 1729223 - DNA, 22 bp, Homo sapiens
tgggatatatggaggattcttt

SEQ ID NO: 1729224 - DNA, 19 bp, Homo sapiens
tgggatatggctgcccagg

SEQ ID NO: 1729225 - DNA, 15 bp, Homo sapiens
tgggatcatccagag

SEQ ID NO: 1729226 - DNA, 15 bp, Homo sapiens
tgggatctggggaga

SEQ ID NO: 1729227 - DNA, 16 bp, Homo sapiens
tgggatctggggagag

SEQ ID NO: 1729228 - DNA, 20 bp, Homo sapiens
tgggatctttctgggagctg

SEQ ID NO: 1729229 - DNA, 22 bp, Homo sapiens
tgggatctttctgggagctgcg

SEQ ID NO: 1729230 - DNA, 13 bp, Homo sapiens
tgggatgaccagg

SEQ ID NO: 1729231 - DNA, 12 bp, Homo sapiens
tgggatgctcct

SEQ ID NO: 1729232 - DNA, 17 bp, Homo sapiens
tgggatgggttccagag

SEQ ID NO: 1729233 - DNA, 13 bp, Homo sapiens
tgggatgtagaac

SEQ ID NO: 1729234 - DNA, 16 bp, Homo sapiens
tgggatgtcacagtcc

SEQ ID NO: 1729235 - DNA, 17 bp, Homo sapiens
tgggatgtcacagtcca

SEQ ID NO: 1729236 - DNA, 19 bp, Homo sapiens
tgggatgtccacagatgcc

SEQ ID NO: 1729237 - DNA, 13 bp, Homo sapiens
tgggatgtcctct

SEQ ID NO: 1729238 - DNA, 22 bp, Homo sapiens
tgggatgtcctctttactccct

SEQ ID NO: 1729239 - DNA, 21 bp, Homo sapiens
tgggattacagggatgagcca

SEQ ID NO: 1729240 - DNA, 20 bp, Homo sapiens
tgggattatgggtcacagga

SEQ ID NO: 1729241 - DNA, 21 bp, Homo sapiens
tgggattatgggtcacaggaa

SEQ ID NO: 1729242 - DNA, 17 bp, Homo sapiens
tgggattcaggaatgtg

SEQ ID NO: 1729243 - DNA, 20 bp, Homo sapiens
tgggattcctgacccaggcc

SEQ ID NO: 1729244 - DNA, 22 bp, Homo sapiens
tgggattcctgacccaggccgc

SEQ ID NO: 1729245 - DNA, 10 bp, Homo sapiens
tgggattgct

SEQ ID NO: 1729246 - DNA, 19 bp, Homo sapiens
tgggattgggggctggtgc

SEQ ID NO: 1729247 - DNA, 18 bp, Homo sapiens
tgggatttcttcgctgct

SEQ ID NO: 1729248 - DNA, 13 bp, Homo sapiens
tgggattttgcaa

SEQ ID NO: 1729249 - DNA, 16 bp, Homo sapiens
tgggcaaacagagcta

SEQ ID NO: 1729250 - DNA, 16 bp, Homo sapiens
tgggcaaagggaagta

SEQ ID NO: 1729251 - DNA, 19 bp, Homo sapiens
tgggcaagacctcttccct

SEQ ID NO: 1729252 - DNA, 20 bp, Homo sapiens
tgggcaattgttacaagtgt

SEQ ID NO: 1729253 - DNA, 19 bp, Homo sapiens
tgggcctgtgcagcagccc

SEQ ID NO: 1729254 - DNA, 20 bp, Homo sapiens
tgggcctgtgcagcagccca

SEQ ID NO: 1729255 - DNA, 14 bp, Homo sapiens
tgggcctgttcctt

SEQ ID NO: 1729256 - DNA, 22 bp, Homo sapiens
tgggcgagcatgggggctgcca

SEQ ID NO: 1729257 - DNA, 13 bp, Homo sapiens
tgggcgagtcccg

SEQ ID NO: 1729258 - DNA, 16 bp, Homo sapiens
tgggcgcccaccctgg

SEQ ID NO: 1729259 - DNA, 19 bp, Homo sapiens
tgggcgcccaccctgggct

SEQ ID NO: 1729260 - DNA, 22 bp, Homo sapiens
tgggcgcccaccctgggctcca

SEQ ID NO: 1729261 - DNA, 16 bp, Homo sapiens
tgggcgccctggaagc

SEQ ID NO: 1729262 - DNA, 21 bp, Homo sapiens
tgggcgctctccctaccttgc

SEQ ID NO: 1729263 - DNA, 23 bp, Homo sapiens
tgggcggccagtgcggctgccag

SEQ ID NO: 1729264 - DNA, 16 bp, Homo sapiens
tgggcggcggccacgc

SEQ ID NO: 1729265 - DNA, 15 bp, Homo sapiens
tgggcggctgagagc

SEQ ID NO: 1729266 - DNA, 21 bp, Homo sapiens
tgggcggctgagagccccagc

SEQ ID NO: 1729267 - DNA, 15 bp, Homo sapiens
tgggcgtctgagctg

SEQ ID NO: 1729268 - DNA, 17 bp, Homo sapiens
tgggcgttgggagccta

SEQ ID NO: 1729269 - DNA, 19 bp, Homo sapiens
tgggcgttgggagcctagc

SEQ ID NO: 1729270 - DNA, 20 bp, Homo sapiens
tgggctaccctaaagggaga

SEQ ID NO: 1729271 - DNA, 22 bp, Homo sapiens
tgggctaccctaaagggagaag

SEQ ID NO: 1729272 - DNA, 21 bp, Homo sapiens
tgggctcactgtgctggggca

SEQ ID NO: 1729273 - DNA, 14 bp, Homo sapiens
tgggctcagggctg

SEQ ID NO: 1729274 - DNA, 15 bp, Homo sapiens
tgggctcagggctgg

SEQ ID NO: 1729275 - DNA, 16 bp, Homo sapiens
tgggctcagggctgga

SEQ ID NO: 1729276 - DNA, 21 bp, Homo sapiens
tgggctccggaggactcacca

SEQ ID NO: 1729277 - DNA, 11 bp, Homo sapiens
tgggctcctgg

SEQ ID NO: 1729278 - DNA, 13 bp, Homo sapiens
tgggctcctggct

SEQ ID NO: 1729279 - DNA, 14 bp, Homo sapiens
tgggctcctggctg

SEQ ID NO: 1729280 - DNA, 14 bp, Homo sapiens
tgggctctcaccca

SEQ ID NO: 1729281 - DNA, 18 bp, Homo sapiens
tgggctctcacccagtcc

SEQ ID NO: 1729282 - DNA, 19 bp, Homo sapiens
tgggctctccacctcagcc

SEQ ID NO: 1729283 - DNA, 21 bp, Homo sapiens
tgggctctccacctcagcctt

SEQ ID NO: 1729284 - DNA, 23 bp, Homo sapiens
tgggctctccacctcagccttgg

SEQ ID NO: 1729285 - DNA, 20 bp, Homo sapiens
tgggctctgcaattcccctc

SEQ ID NO: 1729286 - DNA, 18 bp, Homo sapiens
tgggctctgccaccctac

SEQ ID NO: 1729287 - DNA, 12 bp, Homo sapiens
tgggctctgccc

SEQ ID NO: 1729288 - DNA, 20 bp, Homo sapiens
tgggctgaactgagcctagc

SEQ ID NO: 1729289 - DNA, 19 bp, Homo sapiens
tgggctgacacctaccatg

SEQ ID NO: 1729290 - DNA, 22 bp, Homo sapiens
tgggctgacacctaccatgctg

SEQ ID NO: 1729291 - DNA, 15 bp, Homo sapiens
tgggctgacccagca

SEQ ID NO: 1729292 - DNA, 21 bp, Homo sapiens
tgggctgaccccggtggcggc

SEQ ID NO: 1729293 - DNA, 20 bp, Homo sapiens
tgggctgcagagtctgcccc

SEQ ID NO: 1729294 - DNA, 16 bp, Homo sapiens
tgggctgccatgtgaa

SEQ ID NO: 1729295 - DNA, 15 bp, Homo sapiens
tgggctgcctgctgt

SEQ ID NO: 1729296 - DNA, 17 bp, Homo sapiens
tgggctgctacccagaa

SEQ ID NO: 1729297 - DNA, 15 bp, Homo sapiens
tgggctgctgcaggc

SEQ ID NO: 1729298 - DNA, 19 bp, Homo sapiens
tgggctggcagtcctggaa

SEQ ID NO: 1729299 - DNA, 16 bp, Homo sapiens
tgggctggctgaagaa

SEQ ID NO: 1729300 - DNA, 19 bp, Homo sapiens
tgggctggggaggaggaga

SEQ ID NO: 1729301 - DNA, 21 bp, Homo sapiens
tgggctggtatctcagaaagt

SEQ ID NO: 1729302 - DNA, 12 bp, Homo sapiens
tgggctgtgcta

SEQ ID NO: 1729303 - DNA, 14 bp, Homo sapiens
tgggctgtggggcc

SEQ ID NO: 1729304 - DNA, 17 bp, Homo sapiens
tgggctgttggcactca

SEQ ID NO: 1729305 - DNA, 19 bp, Homo sapiens
tgggctgttggcactcaca

SEQ ID NO: 1729306 - DNA, 18 bp, Homo sapiens
tgggcttagtatttctca

SEQ ID NO: 1729307 - DNA, 18 bp, Homo sapiens
tgggcttatgtctctgcc

SEQ ID NO: 1729308 - DNA, 20 bp, Homo sapiens
tgggcttatgtctctgcctt

SEQ ID NO: 1729309 - DNA, 17 bp, Homo sapiens
tgggcttcaggtgtttt

SEQ ID NO: 1729310 - DNA, 16 bp, Homo sapiens
tgggcttcattccgga

SEQ ID NO: 1729311 - DNA, 15 bp, Homo sapiens
tgggcttccatgcct

SEQ ID NO: 1729312 - DNA, 22 bp, Homo sapiens
tgggcttccccaggtggcctgg

SEQ ID NO: 1729313 - DNA, 18 bp, Homo sapiens
tgggcttgacacctgtct

SEQ ID NO: 1729314 - DNA, 18 bp, Homo sapiens
tgggcttggcctgctgtg

SEQ ID NO: 1729315 - DNA, 19 bp, Homo sapiens
tgggcttggcctgctgtga

SEQ ID NO: 1729316 - DNA, 14 bp, Homo sapiens
tgggcttgttttct

SEQ ID NO: 1729317 - DNA, 15 bp, Homo sapiens
tgggctttgcaggct

SEQ ID NO: 1729318 - DNA, 20 bp, Homo sapiens
tgggcttttggggagccaga

SEQ ID NO: 1729319 - DNA, 22 bp, Homo sapiens
tgggcttttggggagccagaag

SEQ ID NO: 1729320 - DNA, 22 bp, Homo sapiens
tgggctttttttttctctttct

SEQ ID NO: 1729321 - DNA, 21 bp, Homo sapiens
tggggaaaatggccatgcagg

SEQ ID NO: 1729322 - DNA, 20 bp, Homo sapiens
tggggaaaccctggagccat

SEQ ID NO: 1729323 - DNA, 18 bp, Homo sapiens
tggggaaagacactgcct

SEQ ID NO: 1729324 - DNA, 19 bp, Homo sapiens
tggggaaagacactgcctg

SEQ ID NO: 1729325 - DNA, 20 bp, Homo sapiens
tggggaaagacactgcctgg

SEQ ID NO: 1729326 - DNA, 21 bp, Homo sapiens
tggggaaagacactgcctggg

SEQ ID NO: 1729327 - DNA, 23 bp, Homo sapiens
tggggaaaggggtcggctgacca

SEQ ID NO: 1729328 - DNA, 18 bp, Homo sapiens
tggggaaataaagtgcct

SEQ ID NO: 1729329 - DNA, 20 bp, Homo sapiens
tggggaaataaagtgcctta

SEQ ID NO: 1729330 - DNA, 20 bp, Homo sapiens
tggggaacatggctggcctg

SEQ ID NO: 1729331 - DNA, 22 bp, Homo sapiens
tggggaacatggctggcctggt

SEQ ID NO: 1729332 - DNA, 13 bp, Homo sapiens
tggggaagacagt

SEQ ID NO: 1729333 - DNA, 14 bp, Homo sapiens
tggggaagactgtg

SEQ ID NO: 1729334 - DNA, 16 bp, Homo sapiens
tggggaagactgtggc

SEQ ID NO: 1729335 - DNA, 24 bp, Homo sapiens
tggggaagactgtggctgctagca

SEQ ID NO: 1729336 - DNA, 20 bp, Homo sapiens
tggggaagaggggctggggc

SEQ ID NO: 1729337 - DNA, 21 bp, Homo sapiens
tggggaagaggggctggggca

SEQ ID NO: 1729338 - DNA, 16 bp, Homo sapiens
tggggaaggagccagt

SEQ ID NO: 1729339 - DNA, 16 bp, Homo sapiens
tggggaagggcctgcc

SEQ ID NO: 1729340 - DNA, 18 bp, Homo sapiens
cctgtatgtggtgtgggg

SEQ ID NO: 1729341 - DNA, 19 bp, Homo sapiens
cctgtatgtggtgtggggc

SEQ ID NO: 1729342 - DNA, 22 bp, Homo sapiens
cctgtattctcaaacacagtta

SEQ ID NO: 1729343 - DNA, 18 bp, Homo sapiens
cctgtcaagttaacaagg

SEQ ID NO: 1729344 - DNA, 14 bp, Homo sapiens
cctgtcaccaagct

SEQ ID NO: 1729345 - DNA, 20 bp, Homo sapiens
cctgtcacctagaacgtgca

SEQ ID NO: 1729346 - DNA, 23 bp, Homo sapiens
cctgtcacgctcatgtcctgtcc

SEQ ID NO: 1729347 - DNA, 17 bp, Homo sapiens
cctgtcacgctctggtg

SEQ ID NO: 1729348 - DNA, 15 bp, Homo sapiens
cctgtcactcagctg

SEQ ID NO: 1729349 - DNA, 23 bp, Homo sapiens
cctgtcataggttttaaatctgc

SEQ ID NO: 1729350 - DNA, 14 bp, Homo sapiens
cctgtcatgccccc

SEQ ID NO: 1729351 - DNA, 15 bp, Homo sapiens
cctgtcatgcccccc

SEQ ID NO: 1729352 - DNA, 18 bp, Homo sapiens
cctgtcatgcccccctca

SEQ ID NO: 1729353 - DNA, 19 bp, Homo sapiens
cctgtcatgcccccctcaa

SEQ ID NO: 1729354 - DNA, 16 bp, Homo sapiens
cctgtcattttgcact

SEQ ID NO: 1729355 - DNA, 23 bp, Homo sapiens
cctgtccaaactgcctaagccct

SEQ ID NO: 1729356 - DNA, 16 bp, Homo sapiens
cctgtccaatctttga

SEQ ID NO: 1729357 - DNA, 16 bp, Homo sapiens
cctgtccaccctgcca

SEQ ID NO: 1729358 - DNA, 23 bp, Homo sapiens
cctgtccactctcggggcccttg

SEQ ID NO: 1729359 - DNA, 15 bp, Homo sapiens
cctgtccagctccaa

SEQ ID NO: 1729360 - DNA, 21 bp, Homo sapiens
cctgtcccaccaactctgcac

SEQ ID NO: 1729361 - DNA, 21 bp, Homo sapiens
cctgtcccacccacacagctg

SEQ ID NO: 1729362 - DNA, 23 bp, Homo sapiens
cctgtcccacccacacagctgcc

SEQ ID NO: 1729363 - DNA, 13 bp, Homo sapiens
cctgtcccacccc

SEQ ID NO: 1729364 - DNA, 22 bp, Homo sapiens
cctgtcccacccccttccccca

SEQ ID NO: 1729365 - DNA, 14 bp, Homo sapiens
cctgtcccagaggt

SEQ ID NO: 1729366 - DNA, 23 bp, Homo sapiens
cctgtcccagaggttatctgcct

SEQ ID NO: 1729367 - DNA, 17 bp, Homo sapiens
cctgtcccattctagat

SEQ ID NO: 1729368 - DNA, 14 bp, Homo sapiens
cctgtccccaccct

SEQ ID NO: 1729369 - DNA, 14 bp, Homo sapiens
cctgtcccccaagg

SEQ ID NO: 1729370 - DNA, 15 bp, Homo sapiens
cctgtcccccaaggt

SEQ ID NO: 1729371 - DNA, 16 bp, Homo sapiens
cctgtcccctgaaaaa

SEQ ID NO: 1729372 - DNA, 20 bp, Homo sapiens
cctgtcccctgaaaaactga

SEQ ID NO: 1729373 - DNA, 14 bp, Homo sapiens
cctgtcccgccttc

SEQ ID NO: 1729374 - DNA, 16 bp, Homo sapiens
cctgtcccgccttcct

SEQ ID NO: 1729375 - DNA, 22 bp, Homo sapiens
cctgtcccgccttcctcctcca

SEQ ID NO: 1729376 - DNA, 14 bp, Homo sapiens
cctgtccctccagg

SEQ ID NO: 1729377 - DNA, 17 bp, Homo sapiens
cctgtccctccaggccc

SEQ ID NO: 1729378 - DNA, 13 bp, Homo sapiens
cctgtccctctag

SEQ ID NO: 1729379 - DNA, 14 bp, Homo sapiens
cctgtccctctagt

SEQ ID NO: 1729380 - DNA, 15 bp, Homo sapiens
cctgtcccttgacct

SEQ ID NO: 1729381 - DNA, 16 bp, Homo sapiens
cctgtcccttgcctct

SEQ ID NO: 1729382 - DNA, 18 bp, Homo sapiens
cctgtcccttgcctctgc

SEQ ID NO: 1729383 - DNA, 19 bp, Homo sapiens
cctgtcccttgcctctgcc

SEQ ID NO: 1729384 - DNA, 12 bp, Homo sapiens
cctgtccctttt

SEQ ID NO: 1729385 - DNA, 14 bp, Homo sapiens
cctgtcccttttcc

SEQ ID NO: 1729386 - DNA, 15 bp, Homo sapiens
cctgtcccttttccc

SEQ ID NO: 1729387 - DNA, 18 bp, Homo sapiens
cctgtcccttttccctta

SEQ ID NO: 1729388 - DNA, 20 bp, Homo sapiens
cctgtccggcccagtgccac

SEQ ID NO: 1729389 - DNA, 13 bp, Homo sapiens
cctgtcctcctcg

SEQ ID NO: 1729390 - DNA, 14 bp, Homo sapiens
cctgtcctcctcgg

SEQ ID NO: 1729391 - DNA, 15 bp, Homo sapiens
cctgtcctcctcgga

SEQ ID NO: 1729392 - DNA, 19 bp, Homo sapiens
cctgtcctgacctgtctca

SEQ ID NO: 1729393 - DNA, 15 bp, Homo sapiens
cctgtcctggtcctg

SEQ ID NO: 1729394 - DNA, 17 bp, Homo sapiens
cctgtcctggtcctgat

SEQ ID NO: 1729395 - DNA, 14 bp, Homo sapiens
cctgtcgagacact

SEQ ID NO: 1729396 - DNA, 18 bp, Homo sapiens
cctgtcgagacacttgcc

SEQ ID NO: 1729397 - DNA, 19 bp, Homo sapiens
cctgtcgtctctcccaccc

SEQ ID NO: 1729398 - DNA, 16 bp, Homo sapiens
cctgtctcagcctccc

SEQ ID NO: 1729399 - DNA, 14 bp, Homo sapiens
cctgtctccagctg

SEQ ID NO: 1729400 - DNA, 17 bp, Homo sapiens
cctgtctccagctgcct

SEQ ID NO: 1729401 - DNA, 21 bp, Homo sapiens
cctgtctcctttgcaggctca

SEQ ID NO: 1729402 - DNA, 12 bp, Homo sapiens
cctgtctctaaa

SEQ ID NO: 1729403 - DNA, 13 bp, Homo sapiens
cctgtctctgcct

SEQ ID NO: 1729404 - DNA, 18 bp, Homo sapiens
cctgtctctgttcagatg

SEQ ID NO: 1729405 - DNA, 20 bp, Homo sapiens
cctgtctgaaggacacttcc

SEQ ID NO: 1729406 - DNA, 15 bp, Homo sapiens
cctgtctgccagcca

SEQ ID NO: 1729407 - DNA, 12 bp, Homo sapiens
cctgtctgcccc

SEQ ID NO: 1729408 - DNA, 19 bp, Homo sapiens
cctgtctgccccagcccag

SEQ ID NO: 1729409 - DNA, 19 bp, Homo sapiens
cctgtctgccctctgggtc

SEQ ID NO: 1729410 - DNA, 18 bp, Homo sapiens
cctgtctgctaggcgctg

SEQ ID NO: 1729411 - DNA, 22 bp, Homo sapiens
cctgtctgctaggcgctgggga

SEQ ID NO: 1729412 - DNA, 20 bp, Homo sapiens
cctgtctgctgccagcacag

SEQ ID NO: 1729413 - DNA, 21 bp, Homo sapiens
cctgtctggctcggacccacc

SEQ ID NO: 1729414 - DNA, 21 bp, Homo sapiens
cctgtctgtcccttttctttg

SEQ ID NO: 1729415 - DNA, 22 bp, Homo sapiens
cctgtctgtcccttttctttga

SEQ ID NO: 1729416 - DNA, 19 bp, Homo sapiens
cctgtctgtctctccatct

SEQ ID NO: 1729417 - DNA, 22 bp, Homo sapiens
cctgtctgtgtcccagccacgc

SEQ ID NO: 1729418 - DNA, 24 bp, Homo sapiens
cctgtctgtgtcccagccacgcag

SEQ ID NO: 1729419 - DNA, 14 bp, Homo sapiens
cctgtctgtttgct

SEQ ID NO: 1729420 - DNA, 15 bp, Homo sapiens
cctgtcttccaagga

SEQ ID NO: 1729421 - DNA, 14 bp, Homo sapiens
cctgtcttctgggc

SEQ ID NO: 1729422 - DNA, 21 bp, Homo sapiens
cctgtcttctgggcacagtgg

SEQ ID NO: 1729423 - DNA, 13 bp, Homo sapiens
cctgtcttggcct

SEQ ID NO: 1729424 - DNA, 16 bp, Homo sapiens
cctgtcttggcctccc

SEQ ID NO: 1729425 - DNA, 19 bp, Homo sapiens
cctgtgaatgccactgcct

SEQ ID NO: 1729426 - DNA, 23 bp, Homo sapiens
cctgtgacaacactcatcacact

SEQ ID NO: 1729427 - DNA, 13 bp, Homo sapiens
cctgtgagcatcc

SEQ ID NO: 1729428 - DNA, 13 bp, Homo sapiens
cctgtgagccagt

SEQ ID NO: 1729429 - DNA, 23 bp, Homo sapiens
cctgtgagccagtctagttcctg

SEQ ID NO: 1729430 - DNA, 22 bp, Homo sapiens
cctgtgatctagtccttgtctt

SEQ ID NO: 1729431 - DNA, 14 bp, Homo sapiens
cctgtgcagcagcc

SEQ ID NO: 1729432 - DNA, 14 bp, Homo sapiens
cctgtgcatgtatg

SEQ ID NO: 1729433 - DNA, 15 bp, Homo sapiens
cctgtgccaggctga

SEQ ID NO: 1729434 - DNA, 17 bp, Homo sapiens
cctgtgccaggctgaat

SEQ ID NO: 1729435 - DNA, 16 bp, Homo sapiens
cctgtgcccacccgtc

SEQ ID NO: 1729436 - DNA, 21 bp, Homo sapiens
cctgtgccctagatgcacgtg

SEQ ID NO: 1729437 - DNA, 20 bp, Homo sapiens
cctgtgcctcctcaccccca

SEQ ID NO: 1729438 - DNA, 19 bp, Homo sapiens
cctgtgcctctgggactgg

SEQ ID NO: 1729439 - DNA, 15 bp, Homo sapiens
cctgtgcctgaccct

SEQ ID NO: 1729440 - DNA, 13 bp, Homo sapiens
cctgtgcctgggc

SEQ ID NO: 1729441 - DNA, 15 bp, Homo sapiens
cctgtgcctgggccc

SEQ ID NO: 1729442 - DNA, 17 bp, Homo sapiens
cctgtgcctgggccctg

SEQ ID NO: 1729443 - DNA, 21 bp, Homo sapiens
cctgtgcctgggccctgggct

SEQ ID NO: 1729444 - DNA, 14 bp, Homo sapiens
cctgtgctatttgt

SEQ ID NO: 1729445 - DNA, 18 bp, Homo sapiens
cctgtgctatttgtacaa

SEQ ID NO: 1729446 - DNA, 20 bp, Homo sapiens
cctgtgctatttgtacaaat

SEQ ID NO: 1729447 - DNA, 21 bp, Homo sapiens
cctgtgctatttgtacaaata

SEQ ID NO: 1729448 - DNA, 21 bp, Homo sapiens
cctgtgctccgtgcctccacc

SEQ ID NO: 1729449 - DNA, 19 bp, Homo sapiens
cctgtgctcctgcccagga

SEQ ID NO: 1729450 - DNA, 13 bp, Homo sapiens
cctgtgctctgga

SEQ ID NO: 1729451 - DNA, 14 bp, Homo sapiens
cctgtgctgcatgc

SEQ ID NO: 1729452 - DNA, 21 bp, Homo sapiens
cctgtgctgcccgtcttcagc

SEQ ID NO: 1729453 - DNA, 23 bp, Homo sapiens
cctgtgctgcccgtcttcagcct

SEQ ID NO: 1729454 - DNA, 20 bp, Homo sapiens
cctgtgctgggccagtggct

SEQ ID NO: 1729455 - DNA, 12 bp, Homo sapiens
cctgtgctggtg

SEQ ID NO: 1729456 - DNA, 16 bp, Homo sapiens
tggggaaggtggagca

SEQ ID NO: 1729457 - DNA, 14 bp, Homo sapiens
tggggacacagcag

SEQ ID NO: 1729458 - DNA, 13 bp, Homo sapiens
tggggacagggct

SEQ ID NO: 1729459 - DNA, 21 bp, Homo sapiens
tggggaccagcagtctgcctg

SEQ ID NO: 1729460 - DNA, 17 bp, Homo sapiens
tggggaccaggagctag

SEQ ID NO: 1729461 - DNA, 18 bp, Homo sapiens
tggggacgaattccactc

SEQ ID NO: 1729462 - DNA, 21 bp, Homo sapiens
tggggacgctccgctgccgtg

SEQ ID NO: 1729463 - DNA, 24 bp, Homo sapiens
tggggacttgatgttccttccaga

SEQ ID NO: 1729464 - DNA, 19 bp, Homo sapiens
tggggagaaataaattttg

SEQ ID NO: 1729465 - DNA, 16 bp, Homo sapiens
tggggagacagttgag

SEQ ID NO: 1729466 - DNA, 14 bp, Homo sapiens
tggggagacctggt

SEQ ID NO: 1729467 - DNA, 18 bp, Homo sapiens
tggggagagcggctggag

SEQ ID NO: 1729468 - DNA, 20 bp, Homo sapiens
tggggagcacttgcgtcctg

SEQ ID NO: 1729469 - DNA, 23 bp, Homo sapiens
tggggagcacttgcgtcctgcag

SEQ ID NO: 1729470 - DNA, 19 bp, Homo sapiens
tggggagcagttttcccct

SEQ ID NO: 1729471 - DNA, 12 bp, Homo sapiens
tggggagctaag

SEQ ID NO: 1729472 - DNA, 13 bp, Homo sapiens
tggggaggcactc

SEQ ID NO: 1729473 - DNA, 21 bp, Homo sapiens
tggggaggcaggcattcctga

SEQ ID NO: 1729474 - DNA, 15 bp, Homo sapiens
tggggagggacaagg

SEQ ID NO: 1729475 - DNA, 21 bp, Homo sapiens
tggggagggctgcagtcacat

SEQ ID NO: 1729476 - DNA, 12 bp, Homo sapiens
tggggaggggcg

SEQ ID NO: 1729477 - DNA, 21 bp, Homo sapiens
tggggaggggcgctggcccag

SEQ ID NO: 1729478 - DNA, 22 bp, Homo sapiens
tggggaggggcgctggcccagc

SEQ ID NO: 1729479 - DNA, 16 bp, Homo sapiens
tggggagggggaagag

SEQ ID NO: 1729480 - DNA, 19 bp, Homo sapiens
tggggagtaggacatacca

SEQ ID NO: 1729481 - DNA, 15 bp, Homo sapiens
cctgtggcctgtgtc

SEQ ID NO: 1729482 - DNA, 14 bp, Homo sapiens
cctgtggccttgcc

SEQ ID NO: 1729483 - DNA, 17 bp, Homo sapiens
cctgtggcggtgcctgg

SEQ ID NO: 1729484 - DNA, 18 bp, Homo sapiens
cctgtggcggtgcctggg

SEQ ID NO: 1729485 - DNA, 19 bp, Homo sapiens
cctgtggcggtgcctgggt

SEQ ID NO: 1729486 - DNA, 20 bp, Homo sapiens
cctgtggcggtgcctgggtg

SEQ ID NO: 1729487 - DNA, 20 bp, Homo sapiens
cctgtgggcttatgtctctg

SEQ ID NO: 1729488 - DNA, 13 bp, Homo sapiens
cctgtggggagcc

SEQ ID NO: 1729489 - DNA, 22 bp, Homo sapiens
cctgtggggatctcaggggctg

SEQ ID NO: 1729490 - DNA, 23 bp, Homo sapiens
cctgtggggcaggagtgccagga

SEQ ID NO: 1729491 - DNA, 22 bp, Homo sapiens
cctgtggttacagtgcagacag

SEQ ID NO: 1729492 - DNA, 16 bp, Homo sapiens
cctgtgtccactgaga

SEQ ID NO: 1729493 - DNA, 16 bp, Homo sapiens
cctgtgtccagcagct

SEQ ID NO: 1729494 - DNA, 17 bp, Homo sapiens
cctgtgtccagcagctg

SEQ ID NO: 1729495 - DNA, 18 bp, Homo sapiens
cctgtgtccagcagctgc

SEQ ID NO: 1729496 - DNA, 19 bp, Homo sapiens
cctgtgtcccatgacccac

SEQ ID NO: 1729497 - DNA, 20 bp, Homo sapiens
cctgtgtcccatgacccacc

SEQ ID NO: 1729498 - DNA, 18 bp, Homo sapiens
cctgtgtccgatgctgga

SEQ ID NO: 1729499 - DNA, 16 bp, Homo sapiens
cctgtgtgagttgagt

SEQ ID NO: 1729500 - DNA, 10 bp, Homo sapiens
cctgtgtgca

SEQ ID NO: 1729501 - DNA, 12 bp, Homo sapiens
cctgtgtgcagg

SEQ ID NO: 1729502 - DNA, 14 bp, Homo sapiens
cctgtgtgcccagc

SEQ ID NO: 1729503 - DNA, 21 bp, Homo sapiens
cctgtgtgcccagcacctgga

SEQ ID NO: 1729504 - DNA, 15 bp, Homo sapiens
cctgtgtgcttggtc

SEQ ID NO: 1729505 - DNA, 22 bp, Homo sapiens
cctgtgtggagagggaatgtga

SEQ ID NO: 1729506 - DNA, 20 bp, Homo sapiens
cctgtgtgtactctgtccag

SEQ ID NO: 1729507 - DNA, 16 bp, Homo sapiens
cctgtgtgtggaaggc

SEQ ID NO: 1729508 - DNA, 22 bp, Homo sapiens
cctgtgttcaagcgattctcct

SEQ ID NO: 1729509 - DNA, 15 bp, Homo sapiens
cctgtgttcatttgg

SEQ ID NO: 1729510 - DNA, 20 bp, Homo sapiens
cctgtgttgtctctagagca

SEQ ID NO: 1729511 - DNA, 21 bp, Homo sapiens
cctgttaaaagatgaaaatat

SEQ ID NO: 1729512 - DNA, 17 bp, Homo sapiens
cctgttaaaatgtacac

SEQ ID NO: 1729513 - DNA, 19 bp, Homo sapiens
cctgttaacgtcatctcag

SEQ ID NO: 1729514 - DNA, 16 bp, Homo sapiens
cctgttacactgggct

SEQ ID NO: 1729515 - DNA, 17 bp, Homo sapiens
cctgttacactgggctg

SEQ ID NO: 1729516 - DNA, 21 bp, Homo sapiens
cctgttacactgggctgggtt

SEQ ID NO: 1729517 - DNA, 17 bp, Homo sapiens
cctgttacctactttga

SEQ ID NO: 1729518 - DNA, 19 bp, Homo sapiens
cctgttacctactttgact

SEQ ID NO: 1729519 - DNA, 22 bp, Homo sapiens
cctgttactatggtaacacttt

SEQ ID NO: 1729520 - DNA, 14 bp, Homo sapiens
cctgttactctgtc

SEQ ID NO: 1729521 - DNA, 18 bp, Homo sapiens
cctgttacttgcttcagt

SEQ ID NO: 1729522 - DNA, 14 bp, Homo sapiens
cctgttatttatca

SEQ ID NO: 1729523 - DNA, 15 bp, Homo sapiens
cctgttatttatcaa

SEQ ID NO: 1729524 - DNA, 18 bp, Homo sapiens
cctgttatttttctgccc

SEQ ID NO: 1729525 - DNA, 23 bp, Homo sapiens
cctgttatttttctgccctgggt

SEQ ID NO: 1729526 - DNA, 22 bp, Homo sapiens
cctgttcaaagatgcattttga

SEQ ID NO: 1729527 - DNA, 22 bp, Homo sapiens
cctgttcatgccgacgcttgca

SEQ ID NO: 1729528 - DNA, 14 bp, Homo sapiens
cctgttcattctga

SEQ ID NO: 1729529 - DNA, 13 bp, Homo sapiens
cctgttccctacc

SEQ ID NO: 1729530 - DNA, 12 bp, Homo sapiens
cctgttccctag

SEQ ID NO: 1729531 - DNA, 16 bp, Homo sapiens
cctgttccctagagag

SEQ ID NO: 1729532 - DNA, 11 bp, Homo sapiens
cctgttccctg

SEQ ID NO: 1729533 - DNA, 13 bp, Homo sapiens
cctgttccctgga

SEQ ID NO: 1729534 - DNA, 15 bp, Homo sapiens
cctgttccctggagt

SEQ ID NO: 1729535 - DNA, 17 bp, Homo sapiens
cctgttctatgccttta

SEQ ID NO: 1729536 - DNA, 20 bp, Homo sapiens
cctgttctcctgtccctcca

SEQ ID NO: 1729537 - DNA, 16 bp, Homo sapiens
cctgttctgaaacctt

SEQ ID NO: 1729538 - DNA, 12 bp, Homo sapiens
cctgttctgcgc

SEQ ID NO: 1729539 - DNA, 13 bp, Homo sapiens
cctgttctgcttc

SEQ ID NO: 1729540 - DNA, 16 bp, Homo sapiens
cctgttcttagagtgt

SEQ ID NO: 1729541 - DNA, 21 bp, Homo sapiens
cctgttgaattggtgaataaa

SEQ ID NO: 1729542 - DNA, 16 bp, Homo sapiens
cctgttgattatcttc

SEQ ID NO: 1729543 - DNA, 17 bp, Homo sapiens
cctgttgattatcttca

SEQ ID NO: 1729544 - DNA, 14 bp, Homo sapiens
cctgttgctctgtt

SEQ ID NO: 1729545 - DNA, 14 bp, Homo sapiens
cctgttgctgtctt

SEQ ID NO: 1729546 - DNA, 16 bp, Homo sapiens
cctgttggcaggccca

SEQ ID NO: 1729547 - DNA, 18 bp, Homo sapiens
cctgttggcaggcccact

SEQ ID NO: 1729548 - DNA, 21 bp, Homo sapiens
cctgttggctgctgcggctgt

SEQ ID NO: 1729549 - DNA, 23 bp, Homo sapiens
cctgttggctgctgcggctgtgg

SEQ ID NO: 1729550 - DNA, 13 bp, Homo sapiens
cctgtttgcaggc

SEQ ID NO: 1729551 - DNA, 21 bp, Homo sapiens
cctgtttggcctctctatcct

SEQ ID NO: 1729552 - DNA, 19 bp, Homo sapiens
cctgttttatactgtactt

SEQ ID NO: 1729553 - DNA, 23 bp, Homo sapiens
cctgttttcccacgaggaatctg

SEQ ID NO: 1729554 - DNA, 14 bp, Homo sapiens
cctgttttctgaaa

SEQ ID NO: 1729555 - DNA, 13 bp, Homo sapiens
cctgttttctgag

SEQ ID NO: 1729556 - DNA, 17 bp, Homo sapiens
cctgttttctgagcccg

SEQ ID NO: 1729557 - DNA, 17 bp, Homo sapiens
cctgtttttaagctgtt

SEQ ID NO: 1729558 - DNA, 18 bp, Homo sapiens
cctgtttttaagctgttt

SEQ ID NO: 1729559 - DNA, 19 bp, Homo sapiens
cctgtttttaagctgtttc

SEQ ID NO: 1729560 - DNA, 23 bp, Homo sapiens
cctgtttttagagcttccaaatg

SEQ ID NO: 1729561 - DNA, 13 bp, Homo sapiens
cctgtttttcaca

SEQ ID NO: 1729562 - DNA, 13 bp, Homo sapiens
cctgttttttgta

SEQ ID NO: 1729563 - DNA, 23 bp, Homo sapiens
ccttaaaaactggcccgtggaga

SEQ ID NO: 1729564 - DNA, 16 bp, Homo sapiens
ccttaaaaccaaagag

SEQ ID NO: 1729565 - DNA, 17 bp, Homo sapiens
ccttaaaaggggcccaa

SEQ ID NO: 1729566 - DNA, 17 bp, Homo sapiens
ccttaaacacaggctgt

SEQ ID NO: 1729567 - DNA, 18 bp, Homo sapiens
ccttaaactctggacact

SEQ ID NO: 1729568 - DNA, 20 bp, Homo sapiens
ccttaacccacctctcctgc

SEQ ID NO: 1729569 - DNA, 23 bp, Homo sapiens
ccttaaccctaaaattttaaggc

SEQ ID NO: 1729570 - DNA, 17 bp, Homo sapiens
ccttaactggagcccca

SEQ ID NO: 1729571 - DNA, 21 bp, Homo sapiens
ccttaactttcccatggtcaa

SEQ ID NO: 1729572 - DNA, 15 bp, Homo sapiens
ccttaagaatgccaa

SEQ ID NO: 1729573 - DNA, 17 bp, Homo sapiens
ccttaagagtcatccag

SEQ ID NO: 1729574 - DNA, 20 bp, Homo sapiens
tggggtgaacagctggtgcc

SEQ ID NO: 1729575 - DNA, 13 bp, Homo sapiens
tggggtgagggag

SEQ ID NO: 1729576 - DNA, 14 bp, Homo sapiens
tggggtgcttcctt

SEQ ID NO: 1729577 - DNA, 13 bp, Homo sapiens
tggggtgggccca

SEQ ID NO: 1729578 - DNA, 15 bp, Homo sapiens
tggggtgtgcatgcc

SEQ ID NO: 1729579 - DNA, 13 bp, Homo sapiens
tggggtgtgctgg

SEQ ID NO: 1729580 - DNA, 18 bp, Homo sapiens
tggggtgtggggtggggt

SEQ ID NO: 1729581 - DNA, 18 bp, Homo sapiens
tggggtgttacagtagcc

SEQ ID NO: 1729582 - DNA, 16 bp, Homo sapiens
tggggtgtttgggagg

SEQ ID NO: 1729583 - DNA, 18 bp, Homo sapiens
tggggttcaagcccaggc

SEQ ID NO: 1729584 - DNA, 20 bp, Homo sapiens
tggggttcaagcccaggctt

SEQ ID NO: 1729585 - DNA, 22 bp, Homo sapiens
tggggttctggaaatccagata

SEQ ID NO: 1729586 - DNA, 16 bp, Homo sapiens
tggggttgcaaccact

SEQ ID NO: 1729587 - DNA, 19 bp, Homo sapiens
tggggttgggattgggggc

SEQ ID NO: 1729588 - DNA, 12 bp, Homo sapiens
tggggttgtttt

SEQ ID NO: 1729589 - DNA, 23 bp, Homo sapiens
tgggtaacagggagactgcatct

SEQ ID NO: 1729590 - DNA, 14 bp, Homo sapiens
tgggtaagaagaaa

SEQ ID NO: 1729591 - DNA, 22 bp, Homo sapiens
tgggtaagaggagcagagggca

SEQ ID NO: 1729592 - DNA, 19 bp, Homo sapiens
tgggtaattgtacaataaa

SEQ ID NO: 1729593 - DNA, 19 bp, Homo sapiens
tgggtacttcttgaaggtg

SEQ ID NO: 1729594 - DNA, 18 bp, Homo sapiens
tgggtagggtaaatcagt

SEQ ID NO: 1729595 - DNA, 13 bp, Homo sapiens
tgggtatcccctg

SEQ ID NO: 1729596 - DNA, 19 bp, Homo sapiens
tggtacttattactgctaa

SEQ ID NO: 1729597 - DNA, 16 bp, Homo sapiens
tggtacttcctttctc

SEQ ID NO: 1729598 - DNA, 16 bp, Homo sapiens
tggtactttattcttg

SEQ ID NO: 1729599 - DNA, 23 bp, Homo sapiens
tggtacttttatgatgtatattt

SEQ ID NO: 1729600 - DNA, 21 bp, Homo sapiens
tggtagaaaaaggggcctgag

SEQ ID NO: 1729601 - DNA, 15 bp, Homo sapiens
tggtagatgctgagg

SEQ ID NO: 1729602 - DNA, 18 bp, Homo sapiens
tggtagattcgctgtccc

SEQ ID NO: 1729603 - DNA, 21 bp, Homo sapiens
tggtagatttcctcctcccag

SEQ ID NO: 1729604 - DNA, 18 bp, Homo sapiens
tggtagccatcaagcact

SEQ ID NO: 1729605 - DNA, 13 bp, Homo sapiens
tggtaggaactgc

SEQ ID NO: 1729606 - DNA, 16 bp, Homo sapiens
tggtaggaccaagcat

SEQ ID NO: 1729607 - DNA, 22 bp, Homo sapiens
tggtaggatcagccctcatttt

SEQ ID NO: 1729608 - DNA, 17 bp, Homo sapiens
tggtagggacttaaaaa

SEQ ID NO: 1729609 - DNA, 23 bp, Homo sapiens
tggtaggggagggcaggcttggg

SEQ ID NO: 1729610 - DNA, 14 bp, Homo sapiens
tggtaggggcaggg

SEQ ID NO: 1729611 - DNA, 16 bp, Homo sapiens
tggtaggggcagggag

SEQ ID NO: 1729612 - DNA, 17 bp, Homo sapiens
tggtaggggcagggagg

SEQ ID NO: 1729613 - DNA, 13 bp, Homo sapiens
tggtagggtggga

SEQ ID NO: 1729614 - DNA, 21 bp, Homo sapiens
tggtagtatctcgtaatagct

SEQ ID NO: 1729615 - DNA, 14 bp, Homo sapiens
tggtagttaacaca

SEQ ID NO: 1729616 - DNA, 11 bp, Homo sapiens
tggtataaaag

SEQ ID NO: 1729617 - DNA, 13 bp, Homo sapiens
tggtataattatg

SEQ ID NO: 1729618 - DNA, 13 bp, Homo sapiens
tggtataattgtg

SEQ ID NO: 1729619 - DNA, 16 bp, Homo sapiens
tggtatatccaaaagc

SEQ ID NO: 1729620 - DNA, 19 bp, Homo sapiens
tggtatatccaaaagcttt

SEQ ID NO: 1729621 - DNA, 22 bp, Homo sapiens
tggtatatccaaaagcttttta

SEQ ID NO: 1729622 - DNA, 16 bp, Homo sapiens
tggtatcatatattaa

SEQ ID NO: 1729623 - DNA, 23 bp, Homo sapiens
tggtatcattacaattttctgta

SEQ ID NO: 1729624 - DNA, 16 bp, Homo sapiens
tggtatctcagaaagt

SEQ ID NO: 1729625 - DNA, 22 bp, Homo sapiens
tggtatctcagaaagtgcctga

SEQ ID NO: 1729626 - DNA, 23 bp, Homo sapiens
tggtatgaaataaattctgactt

SEQ ID NO: 1729627 - DNA, 14 bp, Homo sapiens
tggtatgagggggt

SEQ ID NO: 1729628 - DNA, 15 bp, Homo sapiens
tggtatgttgggata

SEQ ID NO: 1729629 - DNA, 19 bp, Homo sapiens
tggtatgttgggataagga

SEQ ID NO: 1729630 - DNA, 15 bp, Homo sapiens
tggtattacaaaaca

SEQ ID NO: 1729631 - DNA, 19 bp, Homo sapiens
tggtattcaggattacatg

SEQ ID NO: 1729632 - DNA, 12 bp, Homo sapiens
tggtatttctaa

SEQ ID NO: 1729633 - DNA, 18 bp, Homo sapiens
tggtattttaagagaaaa

SEQ ID NO: 1729634 - DNA, 22 bp, Homo sapiens
tggtcaagattttgaatgcttc

SEQ ID NO: 1729635 - DNA, 16 bp, Homo sapiens
tggtcaagttcccaac

SEQ ID NO: 1729636 - DNA, 14 bp, Homo sapiens
tggtcaccatgaaa

SEQ ID NO: 1729637 - DNA, 20 bp, Homo sapiens
tggtcacccgactttggaat

SEQ ID NO: 1729638 - DNA, 15 bp, Homo sapiens
tggtcagagtgccac

SEQ ID NO: 1729639 - DNA, 17 bp, Homo sapiens
tggtcagagtgccactg

SEQ ID NO: 1729640 - DNA, 15 bp, Homo sapiens
tggtcagatttgaac

SEQ ID NO: 1729641 - DNA, 20 bp, Homo sapiens
tggtcagtagtttcatgttt

SEQ ID NO: 1729642 - DNA, 22 bp, Homo sapiens
tggtcagtagtttcatgtttta

SEQ ID NO: 1729643 - DNA, 18 bp, Homo sapiens
tggtcagtctttgctcag

SEQ ID NO: 1729644 - DNA, 17 bp, Homo sapiens
tggtcagtgtggagagg

SEQ ID NO: 1729645 - DNA, 21 bp, Homo sapiens
tggtcagtgtggagaggggtg

SEQ ID NO: 1729646 - DNA, 13 bp, Homo sapiens
tggtcataaaata

SEQ ID NO: 1729647 - DNA, 21 bp, Homo sapiens
tggtcataaaatagaataatt

SEQ ID NO: 1729648 - DNA, 22 bp, Homo sapiens
tggtcatgctcagccttgctgc

SEQ ID NO: 1729649 - DNA, 13 bp, Homo sapiens
tggtcatggaggc

SEQ ID NO: 1729650 - DNA, 23 bp, Homo sapiens
tggtccaaaagattgctgaaatt

SEQ ID NO: 1729651 - DNA, 15 bp, Homo sapiens
tggtccaagattccg

SEQ ID NO: 1729652 - DNA, 15 bp, Homo sapiens
tggtccaattagttt

SEQ ID NO: 1729653 - DNA, 13 bp, Homo sapiens
tggtccagaaact

SEQ ID NO: 1729654 - DNA, 18 bp, Homo sapiens
tggtccagcgtcactcca

SEQ ID NO: 1729655 - DNA, 22 bp, Homo sapiens
tggtccagcgtcactccagtgc

SEQ ID NO: 1729656 - DNA, 14 bp, Homo sapiens
tggtccagctctga

SEQ ID NO: 1729657 - DNA, 16 bp, Homo sapiens
tggtccagctctgaca

SEQ ID NO: 1729658 - DNA, 18 bp, Homo sapiens
tggtccagctctgacatc

SEQ ID NO: 1729659 - DNA, 21 bp, Homo sapiens
tggtccagctctgacatccct

SEQ ID NO: 1729660 - DNA, 19 bp, Homo sapiens
tggtccaggccctgtggca

SEQ ID NO: 1729661 - DNA, 13 bp, Homo sapiens
tggtccagggcta

SEQ ID NO: 1729662 - DNA, 21 bp, Homo sapiens
tggtccagggctagtgacttg

SEQ ID NO: 1729663 - DNA, 16 bp, Homo sapiens
tggtccatttgttcct

SEQ ID NO: 1729664 - DNA, 14 bp, Homo sapiens
tggtcccaagcctg

SEQ ID NO: 1729665 - DNA, 13 bp, Homo sapiens
tggtcccatccag

SEQ ID NO: 1729666 - DNA, 16 bp, Homo sapiens
tggtcccatccaggca

SEQ ID NO: 1729667 - DNA, 17 bp, Homo sapiens
tggtcccatccaggcag

SEQ ID NO: 1729668 - DNA, 15 bp, Homo sapiens
tggtcccctcctcag

SEQ ID NO: 1729669 - DNA, 17 bp, Homo sapiens
tggtcccctcctcagtg

SEQ ID NO: 1729670 - DNA, 14 bp, Homo sapiens
tggtccctcgtcca

SEQ ID NO: 1729671 - DNA, 22 bp, Homo sapiens
tggtccctgccctcccctgctc

SEQ ID NO: 1729672 - DNA, 13 bp, Homo sapiens
tggtccctgggag

SEQ ID NO: 1729673 - DNA, 14 bp, Homo sapiens
tggtccctgggagg

SEQ ID NO: 1729674 - DNA, 11 bp, Homo sapiens
tggtccctggt

SEQ ID NO: 1729675 - DNA, 15 bp, Homo sapiens
tggtccctggtcctt

SEQ ID NO: 1729676 - DNA, 13 bp, Homo sapiens
tggtcccttcagt

SEQ ID NO: 1729677 - DNA, 17 bp, Homo sapiens
tggtcctagtaagaaga

SEQ ID NO: 1729678 - DNA, 17 bp, Homo sapiens
tggtcctccgcctactg

SEQ ID NO: 1729679 - DNA, 22 bp, Homo sapiens
tggtcctccgcctactgtccct

SEQ ID NO: 1729680 - DNA, 23 bp, Homo sapiens
tggtcctccgcctactgtccctc

SEQ ID NO: 1729681 - DNA, 21 bp, Homo sapiens
tggtcctcctatctccctggc

SEQ ID NO: 1729682 - DNA, 16 bp, Homo sapiens
tggtcctctctctgtg

SEQ ID NO: 1729683 - DNA, 19 bp, Homo sapiens
tggtcctgactcaacatgt

SEQ ID NO: 1729684 - DNA, 18 bp, Homo sapiens
tggtcctgacttccctgg

SEQ ID NO: 1729685 - DNA, 14 bp, Homo sapiens
tggtcctggggctc

SEQ ID NO: 1729686 - DNA, 16 bp, Homo sapiens
tggtcctggggctctg

SEQ ID NO: 1729687 - DNA, 13 bp, Homo sapiens
tggtcctgtagga

SEQ ID NO: 1729688 - DNA, 20 bp, Homo sapiens
tggtcctgtaggagttctat

SEQ ID NO: 1729689 - DNA, 13 bp, Homo sapiens
tggtccttattta

SEQ ID NO: 1729690 - DNA, 16 bp, Homo sapiens
tggtccttatttattt

SEQ ID NO: 1729691 - DNA, 23 bp, Homo sapiens
tggtccttccaggcccccaccac

SEQ ID NO: 1729692 - DNA, 20 bp, Homo sapiens
tggtcgaggagtaacaatac

SEQ ID NO: 1729693 - DNA, 13 bp, Homo sapiens
tggtcgcccagga

SEQ ID NO: 1729694 - DNA, 22 bp, Homo sapiens
tggtcggatctcacaggctgag

SEQ ID NO: 1729695 - DNA, 18 bp, Homo sapiens
tggtctaaggttcagcct

SEQ ID NO: 1729696 - DNA, 19 bp, Homo sapiens
tgatctggaacccagactc

SEQ ID NO: 1729697 - DNA, 15 bp, Homo sapiens
tgatctgttataggt

SEQ ID NO: 1729698 - DNA, 13 bp, Homo sapiens
tgatcttaaagat

SEQ ID NO: 1729699 - DNA, 21 bp, Homo sapiens
tgatcttaattactttcagaa

SEQ ID NO: 1729700 - DNA, 19 bp, Homo sapiens
tgatcttctgggagcagga

SEQ ID NO: 1729701 - DNA, 22 bp, Homo sapiens
tgatcttgagaaccttttcaaa

SEQ ID NO: 1729702 - DNA, 21 bp, Homo sapiens
tgatcttgcctgtctggctca

SEQ ID NO: 1729703 - DNA, 21 bp, Homo sapiens
tgatcttggcttactgcagcc

SEQ ID NO: 1729704 - DNA, 16 bp, Homo sapiens
tgatcttgtgctcagc

SEQ ID NO: 1729705 - DNA, 13 bp, Homo sapiens
tgatcttttaaaa

SEQ ID NO: 1729706 - DNA, 15 bp, Homo sapiens
tgatcttttaaagtg

SEQ ID NO: 1729707 - DNA, 19 bp, Homo sapiens
tgatcttttaaagtgttac

SEQ ID NO: 1729708 - DNA, 21 bp, Homo sapiens
tgatcttttaaagtgttactt

SEQ ID NO: 1729709 - DNA, 20 bp, Homo sapiens
tgatgaaaactaaggatttt

SEQ ID NO: 1729710 - DNA, 23 bp, Homo sapiens
tgatgaaaagctttgtttgttct

SEQ ID NO: 1729711 - DNA, 22 bp, Homo sapiens
tgatgaaactcctgattttgta

SEQ ID NO: 1729712 - DNA, 22 bp, Homo sapiens
tgatgaacatattcatgaaatg

SEQ ID NO: 1729713 - DNA, 19 bp, Homo sapiens
tgatgaagaagggggtggg

SEQ ID NO: 1729714 - DNA, 18 bp, Homo sapiens
tgatgaatctacatttgt

SEQ ID NO: 1729715 - DNA, 20 bp, Homo sapiens
tgatgaatctacatttgttt

SEQ ID NO: 1729716 - DNA, 17 bp, Homo sapiens
tgatgaatgtaaagtta

SEQ ID NO: 1729717 - DNA, 14 bp, Homo sapiens
tgatgaccaatggg

SEQ ID NO: 1729718 - DNA, 14 bp, Homo sapiens
tgatgacccactaa

SEQ ID NO: 1729719 - DNA, 22 bp, Homo sapiens
tgatgacccaggctgcctgagc

SEQ ID NO: 1729720 - DNA, 23 bp, Homo sapiens
tgatgacttagcgtcaagacatt

SEQ ID NO: 1729721 - DNA, 13 bp, Homo sapiens
tgatgaggtattt

SEQ ID NO: 1729722 - DNA, 16 bp, Homo sapiens
tgatgaggtatttttt

SEQ ID NO: 1729723 - DNA, 19 bp, Homo sapiens
tgatgaggtattttttcct

SEQ ID NO: 1729724 - DNA, 22 bp, Homo sapiens
tgatgaggtattttttcctttt

SEQ ID NO: 1729725 - DNA, 19 bp, Homo sapiens
tgatgagttaactgtgaaa

SEQ ID NO: 1729726 - DNA, 13 bp, Homo sapiens
tgatgataataat

SEQ ID NO: 1729727 - DNA, 15 bp, Homo sapiens
tgatgatacaagatt

SEQ ID NO: 1729728 - DNA, 21 bp, Homo sapiens
tgatgatcagctgtttgtcat

SEQ ID NO: 1729729 - DNA, 14 bp, Homo sapiens
tgatgatctttaaa

SEQ ID NO: 1729730 - DNA, 15 bp, Homo sapiens
tgatgatgaaaacta

SEQ ID NO: 1729731 - DNA, 16 bp, Homo sapiens
tgatgatgataataat

SEQ ID NO: 1729732 - DNA, 16 bp, Homo sapiens
tgatgatgatgaaaac

SEQ ID NO: 1729733 - DNA, 13 bp, Homo sapiens
tgatgatgatgat

SEQ ID NO: 1729734 - DNA, 16 bp, Homo sapiens
tgatgatgatgatgat

SEQ ID NO: 1729735 - DNA, 15 bp, Homo sapiens
tgatgatgtctcttg

SEQ ID NO: 1729736 - DNA, 13 bp, Homo sapiens
tgatgattttcct

SEQ ID NO: 1729737 - DNA, 14 bp, Homo sapiens
tgatgcaatataag

SEQ ID NO: 1729738 - DNA, 12 bp, Homo sapiens
tgatgcagacac

SEQ ID NO: 1729739 - DNA, 17 bp, Homo sapiens
tgatgcatgagctccct

SEQ ID NO: 1729740 - DNA, 15 bp, Homo sapiens
tgatgcccaatatat

SEQ ID NO: 1729741 - DNA, 12 bp, Homo sapiens
tgatgcctgccc

SEQ ID NO: 1729742 - DNA, 18 bp, Homo sapiens
tgatgcgtctacccagac

SEQ ID NO: 1729743 - DNA, 17 bp, Homo sapiens
tgatgctccctcccctg

SEQ ID NO: 1729744 - DNA, 11 bp, Homo sapiens
tgatgctgccc

SEQ ID NO: 1729745 - DNA, 20 bp, Homo sapiens
tgatgctgtgctatgaattt

SEQ ID NO: 1729746 - DNA, 22 bp, Homo sapiens
tgatgcttgtaacaagaaaaca

SEQ ID NO: 1729747 - DNA, 23 bp, Homo sapiens
tgatgcttgtaacaagaaaacat

SEQ ID NO: 1729748 - DNA, 19 bp, Homo sapiens
tgatggaaaataccagtgt

SEQ ID NO: 1729749 - DNA, 24 bp, Homo sapiens
tgatggaaaataccagtgttgggt

SEQ ID NO: 1729750 - DNA, 22 bp, Homo sapiens
tgatggaccgggtgggcctggc

SEQ ID NO: 1729751 - DNA, 17 bp, Homo sapiens
tgatggagcaactgaaa

SEQ ID NO: 1729752 - DNA, 11 bp, Homo sapiens
tgatggagccc

SEQ ID NO: 1729753 - DNA, 22 bp, Homo sapiens
tgatggagccccaccttgtctg

SEQ ID NO: 1729754 - DNA, 17 bp, Homo sapiens
tgatggaggtatttgaa

SEQ ID NO: 1729755 - DNA, 20 bp, Homo sapiens
tgatggagtgtgcagacagc

SEQ ID NO: 1729756 - DNA, 20 bp, Homo sapiens
tgatggattccaaaccagga

SEQ ID NO: 1729757 - DNA, 16 bp, Homo sapiens
tgatggcaacagatct

SEQ ID NO: 1729758 - DNA, 15 bp, Homo sapiens
tgatggcaattttgt

SEQ ID NO: 1729759 - DNA, 17 bp, Homo sapiens
tgatggcacagaaggat

SEQ ID NO: 1729760 - DNA, 22 bp, Homo sapiens
tgatggcaccactgcactccag

SEQ ID NO: 1729761 - DNA, 15 bp, Homo sapiens
tgatggccaaggggg

SEQ ID NO: 1729762 - DNA, 16 bp, Homo sapiens
tgatggcccctccagc

SEQ ID NO: 1729763 - DNA, 19 bp, Homo sapiens
tgatggccttaatttcctt

SEQ ID NO: 1729764 - DNA, 18 bp, Homo sapiens
tgatggccttacactgaa

SEQ ID NO: 1729765 - DNA, 22 bp, Homo sapiens
tgatggcgattccctctcaccc

SEQ ID NO: 1729766 - DNA, 18 bp, Homo sapiens
tgatggctcaagacaagg

SEQ ID NO: 1729767 - DNA, 22 bp, Homo sapiens
tgatggctgctagattttaatt

SEQ ID NO: 1729768 - DNA, 19 bp, Homo sapiens
tgatgggaaaatatttcct

SEQ ID NO: 1729769 - DNA, 19 bp, Homo sapiens
tgatgggaaagcattgtaa

SEQ ID NO: 1729770 - DNA, 15 bp, Homo sapiens
tgatggggaaggagt

SEQ ID NO: 1729771 - DNA, 22 bp, Homo sapiens
ccgcaccagctgctctgcccct

SEQ ID NO: 1729772 - DNA, 20 bp, Homo sapiens
ccgcaccccggcctcagggc

SEQ ID NO: 1729773 - DNA, 15 bp, Homo sapiens
ccgcacccctccctg

SEQ ID NO: 1729774 - DNA, 14 bp, Homo sapiens
ccgcaccttcctcc

SEQ ID NO: 1729775 - DNA, 18 bp, Homo sapiens
ccgcacgcctctccctgc

SEQ ID NO: 1729776 - DNA, 19 bp, Homo sapiens
ccgcacgtccgcgggtccc

SEQ ID NO: 1729777 - DNA, 14 bp, Homo sapiens
ccgcactctgcccc

SEQ ID NO: 1729778 - DNA, 14 bp, Homo sapiens
ccgcagaagcagac

SEQ ID NO: 1729779 - DNA, 11 bp, Homo sapiens
ccgcagcaccc

SEQ ID NO: 1729780 - DNA, 20 bp, Homo sapiens
ccgcagccagccggtgcctg

SEQ ID NO: 1729781 - DNA, 23 bp, Homo sapiens
ccgcagccagccggtgcctggcg

SEQ ID NO: 1729782 - DNA, 21 bp, Homo sapiens
ccgcagcccccacccccaagg

SEQ ID NO: 1729783 - DNA, 16 bp, Homo sapiens
ccgcagcccgcctgcc

SEQ ID NO: 1729784 - DNA, 14 bp, Homo sapiens
ccgcagctcttgcc

SEQ ID NO: 1729785 - DNA, 18 bp, Homo sapiens
ccgcagctcttgcccttc

SEQ ID NO: 1729786 - DNA, 22 bp, Homo sapiens
ccgcagctcttgcccttccctg

SEQ ID NO: 1729787 - DNA, 20 bp, Homo sapiens
ccgcaggatccctcctgagc

SEQ ID NO: 1729788 - DNA, 22 bp, Homo sapiens
ccgcaggatccctcctgagctc

SEQ ID NO: 1729789 - DNA, 17 bp, Homo sapiens
ccgcagggccatgcaga

SEQ ID NO: 1729790 - DNA, 13 bp, Homo sapiens
ccgcagtccccag

SEQ ID NO: 1729791 - DNA, 15 bp, Homo sapiens
ccgcagtccccagcc

SEQ ID NO: 1729792 - DNA, 16 bp, Homo sapiens
ccgcagtccccagccc

SEQ ID NO: 1729793 - DNA, 17 bp, Homo sapiens
ccgcagtccccagccct

SEQ ID NO: 1729794 - DNA, 21 bp, Homo sapiens
ccgcagtgctgggaccagagc

SEQ ID NO: 1729795 - DNA, 22 bp, Homo sapiens
ccgcagtgctgggaccagagcc

SEQ ID NO: 1729796 - DNA, 15 bp, Homo sapiens
ccgcatccctgcttc

SEQ ID NO: 1729797 - DNA, 20 bp, Homo sapiens
ccgcatccctgcttctggcg

SEQ ID NO: 1729798 - DNA, 19 bp, Homo sapiens
ccgcatgacaactgaaggc

SEQ ID NO: 1729799 - DNA, 17 bp, Homo sapiens
ccgccacccccatcttc

SEQ ID NO: 1729800 - DNA, 15 bp, Homo sapiens
ccgccacctcagggc

SEQ ID NO: 1729801 - DNA, 19 bp, Homo sapiens
ccgccacggccaccctcct

SEQ ID NO: 1729802 - DNA, 15 bp, Homo sapiens
ccgccacggcctggc

SEQ ID NO: 1729803 - DNA, 17 bp, Homo sapiens
ccgccacggcctggctg

SEQ ID NO: 1729804 - DNA, 19 bp, Homo sapiens
ccgccactaggtgtcccca

SEQ ID NO: 1729805 - DNA, 13 bp, Homo sapiens
ccgccagcctcct

SEQ ID NO: 1729806 - DNA, 14 bp, Homo sapiens
ccgccagcctcctc

SEQ ID NO: 1729807 - DNA, 22 bp, Homo sapiens
ccgccagctgccgcaccagccc

SEQ ID NO: 1729808 - DNA, 11 bp, Homo sapiens
ccgccagggct

SEQ ID NO: 1729809 - DNA, 12 bp, Homo sapiens
ccgccagggctg

SEQ ID NO: 1729810 - DNA, 14 bp, Homo sapiens
ccgccagggctggg

SEQ ID NO: 1729811 - DNA, 17 bp, Homo sapiens
ccgccagggctggggac

SEQ ID NO: 1729812 - DNA, 18 bp, Homo sapiens
ccgccatccttcaccaga

SEQ ID NO: 1729813 - DNA, 13 bp, Homo sapiens
ccgcccactgtcc

SEQ ID NO: 1729814 - DNA, 21 bp, Homo sapiens
tgatgttctaaggctctgaga

SEQ ID NO: 1729815 - DNA, 13 bp, Homo sapiens
tgatgtttcctgg

SEQ ID NO: 1729816 - DNA, 14 bp, Homo sapiens
tgatgtttcctgga

SEQ ID NO: 1729817 - DNA, 15 bp, Homo sapiens
tgatgtttcctggaa

SEQ ID NO: 1729818 - DNA, 19 bp, Homo sapiens
tgatgtttctgtgaaattc

SEQ ID NO: 1729819 - DNA, 13 bp, Homo sapiens
tgatgtttgaaat

SEQ ID NO: 1729820 - DNA, 13 bp, Homo sapiens
tgatgtttgctct

SEQ ID NO: 1729821 - DNA, 18 bp, Homo sapiens
tgatgtttgtggcctcag

SEQ ID NO: 1729822 - DNA, 20 bp, Homo sapiens
tgatgtttgtgtgttttgta

SEQ ID NO: 1729823 - DNA, 16 bp, Homo sapiens
tgattaaaaatgcttt

SEQ ID NO: 1729824 - DNA, 20 bp, Homo sapiens
tgattaaaaatgcttttaga

SEQ ID NO: 1729825 - DNA, 22 bp, Homo sapiens
tgattaaataagattctaacgg

SEQ ID NO: 1729826 - DNA, 19 bp, Homo sapiens
tgattaaatatttgaagag

SEQ ID NO: 1729827 - DNA, 18 bp, Homo sapiens
tgattaaatttaatatac

SEQ ID NO: 1729828 - DNA, 19 bp, Homo sapiens
tgattaaatttaatatact

SEQ ID NO: 1729829 - DNA, 14 bp, Homo sapiens
tgattaacaatgta

SEQ ID NO: 1729830 - DNA, 16 bp, Homo sapiens
tgattaacaatgtatt

SEQ ID NO: 1729831 - DNA, 24 bp, Homo sapiens
tgattaactcttagaagtgttgta

SEQ ID NO: 1729832 - DNA, 21 bp, Homo sapiens
tgattaacttggatgagtttt

SEQ ID NO: 1729833 - DNA, 17 bp, Homo sapiens
tgattaataagaacttg

SEQ ID NO: 1729834 - DNA, 13 bp, Homo sapiens
tgattaatcaaag

SEQ ID NO: 1729835 - DNA, 13 bp, Homo sapiens
tgattacacagtt

SEQ ID NO: 1729836 - DNA, 20 bp, Homo sapiens
tgattacataatcaaagcta

SEQ ID NO: 1729837 - DNA, 14 bp, Homo sapiens
tgattacctgccaa

SEQ ID NO: 1729838 - DNA, 13 bp, Homo sapiens
tgattactgtcaa

SEQ ID NO: 1729839 - DNA, 16 bp, Homo sapiens
tgattactgtcaataa

SEQ ID NO: 1729840 - DNA, 21 bp, Homo sapiens
tgattagaaggcaagtttcta

SEQ ID NO: 1729841 - DNA, 13 bp, Homo sapiens
tgattagacagaa

SEQ ID NO: 1729842 - DNA, 15 bp, Homo sapiens
tgattagacagaaca

SEQ ID NO: 1729843 - DNA, 17 bp, Homo sapiens
tgattagagctgcataa

SEQ ID NO: 1729844 - DNA, 14 bp, Homo sapiens
tgattagttgaaag

SEQ ID NO: 1729845 - DNA, 15 bp, Homo sapiens
tgattagttgaaagg

SEQ ID NO: 1729846 - DNA, 20 bp, Homo sapiens
tgattatagcaactaatgtt

SEQ ID NO: 1729847 - DNA, 16 bp, Homo sapiens
tgattatattgttttt

SEQ ID NO: 1729848 - DNA, 21 bp, Homo sapiens
tgattattatgtttattacaa

SEQ ID NO: 1729849 - DNA, 15 bp, Homo sapiens
tgattattcaacaca

SEQ ID NO: 1729850 - DNA, 13 bp, Homo sapiens
tgattatttatga

SEQ ID NO: 1729851 - DNA, 21 bp, Homo sapiens
tgattattttttttttcttct

SEQ ID NO: 1729852 - DNA, 20 bp, Homo sapiens
tgattcaaggctcagaagga

SEQ ID NO: 1729853 - DNA, 21 bp, Homo sapiens
tgattcaaggctcagaaggaa

SEQ ID NO: 1729854 - DNA, 22 bp, Homo sapiens
tgattcaatctgtaaactgtgt

SEQ ID NO: 1729855 - DNA, 13 bp, Homo sapiens
tgattcactgcat

SEQ ID NO: 1729856 - DNA, 17 bp, Homo sapiens
tgattcactgcatggct

SEQ ID NO: 1729857 - DNA, 20 bp, Homo sapiens
tgattcagactttcacacca

SEQ ID NO: 1729858 - DNA, 16 bp, Homo sapiens
tgattcagccctcaga

SEQ ID NO: 1729859 - DNA, 13 bp, Homo sapiens
tgattcagtcaca

SEQ ID NO: 1729860 - DNA, 14 bp, Homo sapiens
tgattcagtcacat

SEQ ID NO: 1729861 - DNA, 18 bp, Homo sapiens
tgattcagtcttctggat

SEQ ID NO: 1729862 - DNA, 17 bp, Homo sapiens
tgattcataataaatat

SEQ ID NO: 1729863 - DNA, 15 bp, Homo sapiens
tgattcatcctggga

SEQ ID NO: 1729864 - DNA, 19 bp, Homo sapiens
tgattcatgccaattagca

SEQ ID NO: 1729865 - DNA, 16 bp, Homo sapiens
tgattcattttcctgt

SEQ ID NO: 1729866 - DNA, 17 bp, Homo sapiens
tgattcattttcctgtt

SEQ ID NO: 1729867 - DNA, 18 bp, Homo sapiens
tgattcattttcctgttc

SEQ ID NO: 1729868 - DNA, 19 bp, Homo sapiens
tgattcattttcctgttca

SEQ ID NO: 1729869 - DNA, 11 bp, Homo sapiens
tgattccaaat

SEQ ID NO: 1729870 - DNA, 21 bp, Homo sapiens
tgattccactacacctggctg

SEQ ID NO: 1729871 - DNA, 13 bp, Homo sapiens
tgattcccaactc

SEQ ID NO: 1729872 - DNA, 14 bp, Homo sapiens
tgattcccaactcc

SEQ ID NO: 1729873 - DNA, 15 bp, Homo sapiens
tgattcccaactcct

SEQ ID NO: 1729874 - DNA, 20 bp, Homo sapiens
tgattcccaactcctttctg

SEQ ID NO: 1729875 - DNA, 17 bp, Homo sapiens
tgattccctcctgctac

SEQ ID NO: 1729876 - DNA, 11 bp, Homo sapiens
tgattcctggc

SEQ ID NO: 1729877 - DNA, 20 bp, Homo sapiens
tgattcctggctctaccctg

SEQ ID NO: 1729878 - DNA, 21 bp, Homo sapiens
tgattcctggctctaccctgt

SEQ ID NO: 1729879 - DNA, 11 bp, Homo sapiens
tgattcctggt

SEQ ID NO: 1729880 - DNA, 12 bp, Homo sapiens
tgattcctggtt

SEQ ID NO: 1729881 - DNA, 14 bp, Homo sapiens
tgattccttttgat

SEQ ID NO: 1729882 - DNA, 15 bp, Homo sapiens
tgattccttttgatg

SEQ ID NO: 1729883 - DNA, 21 bp, Homo sapiens
tgattccttttgatggggaga

SEQ ID NO: 1729884 - DNA, 17 bp, Homo sapiens
tgattccttttttcaaa

SEQ ID NO: 1729885 - DNA, 19 bp, Homo sapiens
tgattctccttcagccctc

SEQ ID NO: 1729886 - DNA, 22 bp, Homo sapiens
ccgcgttcaagacttgagcgga

SEQ ID NO: 1729887 - DNA, 15 bp, Homo sapiens
ccgctagaggcctga

SEQ ID NO: 1729888 - DNA, 21 bp, Homo sapiens
ccgctcagccctccctgcccc

SEQ ID NO: 1729889 - DNA, 20 bp, Homo sapiens
ccgctcaggggcctggaggt

SEQ ID NO: 1729890 - DNA, 16 bp, Homo sapiens
ccgctcccacacccct

SEQ ID NO: 1729891 - DNA, 22 bp, Homo sapiens
ccgctcccacctagtgccccag

SEQ ID NO: 1729892 - DNA, 17 bp, Homo sapiens
ccgctccccacctaccc

SEQ ID NO: 1729893 - DNA, 15 bp, Homo sapiens
ccgctcccgctccca

SEQ ID NO: 1729894 - DNA, 17 bp, Homo sapiens
ccgctcccgctcccagg

SEQ ID NO: 1729895 - DNA, 18 bp, Homo sapiens
ccgctcccgctcccaggt

SEQ ID NO: 1729896 - DNA, 18 bp, Homo sapiens
ccgctccgtctctgtcct

SEQ ID NO: 1729897 - DNA, 14 bp, Homo sapiens
ccgctctccctgtc

SEQ ID NO: 1729898 - DNA, 15 bp, Homo sapiens
ccgctctccctgtca

SEQ ID NO: 1729899 - DNA, 19 bp, Homo sapiens
ccgctctctctgagggggt

SEQ ID NO: 1729900 - DNA, 13 bp, Homo sapiens
ccgctctggcagt

SEQ ID NO: 1729901 - DNA, 18 bp, Homo sapiens
ccgctgatggagccccac

SEQ ID NO: 1729902 - DNA, 19 bp, Homo sapiens
ccgctgatggagccccacc

SEQ ID NO: 1729903 - DNA, 14 bp, Homo sapiens
ccgctgcagggctc

SEQ ID NO: 1729904 - DNA, 16 bp, Homo sapiens
ccgctgcagggctccc

SEQ ID NO: 1729905 - DNA, 23 bp, Homo sapiens
ccgctgccaccacgtctgccagg

SEQ ID NO: 1729906 - DNA, 18 bp, Homo sapiens
ccgctgccagcacagagc

SEQ ID NO: 1729907 - DNA, 13 bp, Homo sapiens
ccgctgccagcct

SEQ ID NO: 1729908 - DNA, 15 bp, Homo sapiens
ccgctgccagccttg

SEQ ID NO: 1729909 - DNA, 14 bp, Homo sapiens
ccgctgcctggaac

SEQ ID NO: 1729910 - DNA, 14 bp, Homo sapiens
ccgctgctgtgcaa

SEQ ID NO: 1729911 - DNA, 14 bp, Homo sapiens
ccgctgctgtgctc

SEQ ID NO: 1729912 - DNA, 15 bp, Homo sapiens
ccgctgctgtgctct

SEQ ID NO: 1729913 - DNA, 19 bp, Homo sapiens
ccgctgcttccaggctggg

SEQ ID NO: 1729914 - DNA, 15 bp, Homo sapiens
ccgctggccctgccg

SEQ ID NO: 1729915 - DNA, 21 bp, Homo sapiens
ccgctggctggtgggccccca

SEQ ID NO: 1729916 - DNA, 21 bp, Homo sapiens
ccgctgggctgagcccctacc

SEQ ID NO: 1729917 - DNA, 23 bp, Homo sapiens
ccgctgggcttcattccggactg

SEQ ID NO: 1729918 - DNA, 16 bp, Homo sapiens
ccgctggtccctgccc

SEQ ID NO: 1729919 - DNA, 14 bp, Homo sapiens
ccgctgttcaccca

SEQ ID NO: 1729920 - DNA, 15 bp, Homo sapiens
ccgctgttcacccac

SEQ ID NO: 1729921 - DNA, 18 bp, Homo sapiens
ccgctgttcacccacagg

SEQ ID NO: 1729922 - DNA, 21 bp, Homo sapiens
ccgctgttcacccacagggct

SEQ ID NO: 1729923 - DNA, 14 bp, Homo sapiens
ccgcttcacccctg

SEQ ID NO: 1729924 - DNA, 17 bp, Homo sapiens
ccgcttcacccctgcac

SEQ ID NO: 1729925 - DNA, 18 bp, Homo sapiens
ccgcttcacccctgcact

SEQ ID NO: 1729926 - DNA, 15 bp, Homo sapiens
ccgcttccccacaga

SEQ ID NO: 1729927 - DNA, 19 bp, Homo sapiens
ccgcttccccacagaactg

SEQ ID NO: 1729928 - DNA, 12 bp, Homo sapiens
ccgcttcctggc

SEQ ID NO: 1729929 - DNA, 13 bp, Homo sapiens
ccgcttcctggcc

SEQ ID NO: 1729930 - DNA, 23 bp, Homo sapiens
ccgcttgaaaagctagtgtacct

SEQ ID NO: 1729931 - DNA, 16 bp, Homo sapiens
ccgcttgtccagcgcc

SEQ ID NO: 1729932 - DNA, 19 bp, Homo sapiens
ccgcttgtccagcgcctag

SEQ ID NO: 1729933 - DNA, 18 bp, Homo sapiens
tgatttcaggatactctg

SEQ ID NO: 1729934 - DNA, 21 bp, Homo sapiens
tgatttcagtcatagcaagct

SEQ ID NO: 1729935 - DNA, 13 bp, Homo sapiens
tgatttcagtttt

SEQ ID NO: 1729936 - DNA, 18 bp, Homo sapiens
tgatttcagtttttcatt

SEQ ID NO: 1729937 - DNA, 17 bp, Homo sapiens
tgatttcatttcaactg

SEQ ID NO: 1729938 - DNA, 22 bp, Homo sapiens
tgatttcctaaacataattgtg

SEQ ID NO: 1729939 - DNA, 19 bp, Homo sapiens
tgatttctggctgggtcac

SEQ ID NO: 1729940 - DNA, 13 bp, Homo sapiens
tgatttgcctgta

SEQ ID NO: 1729941 - DNA, 18 bp, Homo sapiens
tgatttgtactgaaaaat

SEQ ID NO: 1729942 - DNA, 17 bp, Homo sapiens
tgattttaaaatgtaca

SEQ ID NO: 1729943 - DNA, 20 bp, Homo sapiens
tgattttaaaatgtacatgt

SEQ ID NO: 1729944 - DNA, 13 bp, Homo sapiens
tgattttaaatgt

SEQ ID NO: 1729945 - DNA, 16 bp, Homo sapiens
tgattttagatttctt

SEQ ID NO: 1729946 - DNA, 12 bp, Homo sapiens
tgattttatgat

SEQ ID NO: 1729947 - DNA, 16 bp, Homo sapiens
tgattttattcttgat

SEQ ID NO: 1729948 - DNA, 19 bp, Homo sapiens
tgattttcaagcagcatct

SEQ ID NO: 1729949 - DNA, 17 bp, Homo sapiens
tgattttccatctaaaa

SEQ ID NO: 1729950 - DNA, 12 bp, Homo sapiens
tgattttctcac

SEQ ID NO: 1729951 - DNA, 18 bp, Homo sapiens
tgattttgccccctgagg

SEQ ID NO: 1729952 - DNA, 20 bp, Homo sapiens
tgattttggaaagatgttaa

SEQ ID NO: 1729953 - DNA, 13 bp, Homo sapiens
tgattttggcatg

SEQ ID NO: 1729954 - DNA, 23 bp, Homo sapiens
tgatttttataaatactgcaaat

SEQ ID NO: 1729955 - DNA, 23 bp, Homo sapiens
tgatttttgagcccttgtttcag

SEQ ID NO: 1729956 - DNA, 10 bp, Homo sapiens
tgatttttgt

SEQ ID NO: 1729957 - DNA, 13 bp, Homo sapiens
tgatttttgtctc

SEQ ID NO: 1729958 - DNA, 18 bp, Homo sapiens
tgatttttttaatagtgc

SEQ ID NO: 1729959 - DNA, 23 bp, Homo sapiens
tgattttttttcccatttagaat

SEQ ID NO: 1729960 - DNA, 22 bp, Homo sapiens
tgatttttttttcatacactta

SEQ ID NO: 1729961 - DNA, 15 bp, Homo sapiens
tgatttttttttcca

SEQ ID NO: 1729962 - DNA, 17 bp, Homo sapiens
tgcaaaaaaagcctcca

SEQ ID NO: 1729963 - DNA, 20 bp, Homo sapiens
tgcaaaaaaagcctccaagg

SEQ ID NO: 1729964 - DNA, 22 bp, Homo sapiens
tgcaaaaaaagcctccaagggt

SEQ ID NO: 1729965 - DNA, 16 bp, Homo sapiens
tgcaaaaaatcttaat

SEQ ID NO: 1729966 - DNA, 16 bp, Homo sapiens
tgcaaaaagcttctgt

SEQ ID NO: 1729967 - DNA, 11 bp, Homo sapiens
tgcaaaaataa

SEQ ID NO: 1729968 - DNA, 14 bp, Homo sapiens
tgcaaaaataatca

SEQ ID NO: 1729969 - DNA, 21 bp, Homo sapiens
tgcaaaaatccaaatattgtt

SEQ ID NO: 1729970 - DNA, 12 bp, Homo sapiens
tgcaaaaatgga

SEQ ID NO: 1729971 - DNA, 17 bp, Homo sapiens
tgcaaaatagacatctt

SEQ ID NO: 1729972 - DNA, 12 bp, Homo sapiens
tgcaaaatcact

SEQ ID NO: 1729973 - DNA, 22 bp, Homo sapiens
tgcaaaatctgttatagcttta

SEQ ID NO: 1729974 - DNA, 16 bp, Homo sapiens
tgcaaaattgttttca

SEQ ID NO: 1729975 - DNA, 17 bp, Homo sapiens
tgcaaaattgttttcac

SEQ ID NO: 1729976 - DNA, 17 bp, Homo sapiens
tgcaaacatggagaaat

SEQ ID NO: 1729977 - DNA, 18 bp, Homo sapiens
tgcaaacatggagaaatc

SEQ ID NO: 1729978 - DNA, 20 bp, Homo sapiens
tgcaaacatggagaaatcta

SEQ ID NO: 1729979 - DNA, 12 bp, Homo sapiens
tgcaaagaaaat

SEQ ID NO: 1729980 - DNA, 16 bp, Homo sapiens
tgcaaagaaaatcaga

SEQ ID NO: 1729981 - DNA, 23 bp, Homo sapiens
tgcaaagatctgtcctcagcctt

SEQ ID NO: 1729982 - DNA, 14 bp, Homo sapiens
tgcaaagcaatgaa

SEQ ID NO: 1729983 - DNA, 20 bp, Homo sapiens
tgcaaagcactgacttctaa

SEQ ID NO: 1729984 - DNA, 13 bp, Homo sapiens
tgcaaagccaagg

SEQ ID NO: 1729985 - DNA, 15 bp, Homo sapiens
tgcaaagccaaggca

SEQ ID NO: 1729986 - DNA, 13 bp, Homo sapiens
tgcaaaggagaag

SEQ ID NO: 1729987 - DNA, 20 bp, Homo sapiens
tgcaaaggagaagcacagct

SEQ ID NO: 1729988 - DNA, 14 bp, Homo sapiens
tgcaaagtaaaaaa

SEQ ID NO: 1729989 - DNA, 15 bp, Homo sapiens
tgcaaagtcgccagt

SEQ ID NO: 1729990 - DNA, 23 bp, Homo sapiens
tgcaaagtcgccagtcactgctg

SEQ ID NO: 1729991 - DNA, 21 bp, Homo sapiens
tgcaaagtgttttctcagaac

SEQ ID NO: 1729992 - DNA, 17 bp, Homo sapiens
tgcaaataaggacagca

SEQ ID NO: 1729993 - DNA, 19 bp, Homo sapiens
tgcaaataggcagaatgga

SEQ ID NO: 1729994 - DNA, 15 bp, Homo sapiens
tgcaaatagtttcaa

SEQ ID NO: 1729995 - DNA, 14 bp, Homo sapiens
tgcaaatctgatgg

SEQ ID NO: 1729996 - DNA, 20 bp, Homo sapiens
tgcaaatgagctctgaaatc

SEQ ID NO: 1729997 - DNA, 15 bp, Homo sapiens
tgcaaatgcacattt

SEQ ID NO: 1729998 - DNA, 17 bp, Homo sapiens
tgcaaatggagataaaa

SEQ ID NO: 1729999 - DNA, 19 bp, Homo sapiens
tgcaaatggagataaaagc

SEQ ID NO: 1730000 - DNA, 16 bp, Homo sapiens
tgcaaatgtctaattg

SEQ ID NO: 1730001 - DNA, 24 bp, Homo sapiens
ccgggaccacagctgctggccagg

SEQ ID NO: 1730002 - DNA, 19 bp, Homo sapiens
ccgggacccggcggccctg

SEQ ID NO: 1730003 - DNA, 17 bp, Homo sapiens
ccgggagaagccacctt

SEQ ID NO: 1730004 - DNA, 19 bp, Homo sapiens
ccgggaggaaaaggcccct

SEQ ID NO: 1730005 - DNA, 22 bp, Homo sapiens
ccgggaggtggagcttgcagtg

SEQ ID NO: 1730006 - DNA, 17 bp, Homo sapiens
ccgggataaactgagcc

SEQ ID NO: 1730007 - DNA, 13 bp, Homo sapiens
ccgggccagggct

SEQ ID NO: 1730008 - DNA, 15 bp, Homo sapiens
ccgggccagggctgc

SEQ ID NO: 1730009 - DNA, 16 bp, Homo sapiens
ccgggcccagaggagc

SEQ ID NO: 1730010 - DNA, 14 bp, Homo sapiens
ccgggcccctgggc

SEQ ID NO: 1730011 - DNA, 17 bp, Homo sapiens
ccgggccctctgtagct

SEQ ID NO: 1730012 - DNA, 18 bp, Homo sapiens
ccgggccctctgtagctc

SEQ ID NO: 1730013 - DNA, 17 bp, Homo sapiens
ccgggcctcccaccgca

SEQ ID NO: 1730014 - DNA, 19 bp, Homo sapiens
ccgggcctggagaactaga

SEQ ID NO: 1730015 - DNA, 17 bp, Homo sapiens
ccgggcctgggcctcct

SEQ ID NO: 1730016 - DNA, 14 bp, Homo sapiens
ccgggcctggggct

SEQ ID NO: 1730017 - DNA, 21 bp, Homo sapiens
ccgggcgcggtggcgggcacc

SEQ ID NO: 1730018 - DNA, 16 bp, Homo sapiens
ccgggctctctgctgt

SEQ ID NO: 1730019 - DNA, 21 bp, Homo sapiens
ccgggctgagggcctgctgga

SEQ ID NO: 1730020 - DNA, 17 bp, Homo sapiens
ccgggctgcctgggctg

SEQ ID NO: 1730021 - DNA, 20 bp, Homo sapiens
ccgggctgtagatcaggttt

SEQ ID NO: 1730022 - DNA, 17 bp, Homo sapiens
ccgggcttgggccctgc

SEQ ID NO: 1730023 - DNA, 20 bp, Homo sapiens
ccgggcttgggccctgcaca

SEQ ID NO: 1730024 - DNA, 15 bp, Homo sapiens
ccggggaccctgtga

SEQ ID NO: 1730025 - DNA, 15 bp, Homo sapiens
ccggggagcgcccgc

SEQ ID NO: 1730026 - DNA, 11 bp, Homo sapiens
ccggggaggaa

SEQ ID NO: 1730027 - DNA, 15 bp, Homo sapiens
ccggggatggatctt

SEQ ID NO: 1730028 - DNA, 23 bp, Homo sapiens
ccggggcaaggtctccttactct

SEQ ID NO: 1730029 - DNA, 14 bp, Homo sapiens
ccggggcagggcag

SEQ ID NO: 1730030 - DNA, 23 bp, Homo sapiens
ccggggccttccttttgaggagc

SEQ ID NO: 1730031 - DNA, 20 bp, Homo sapiens
ccggggctggcaagcaggga

SEQ ID NO: 1730032 - DNA, 12 bp, Homo sapiens
ccgggggacaga

SEQ ID NO: 1730033 - DNA, 16 bp, Homo sapiens
ccgggggacagaggtt

SEQ ID NO: 1730034 - DNA, 16 bp, Homo sapiens
ccggggggtctcttct

SEQ ID NO: 1730035 - DNA, 18 bp, Homo sapiens
ccggggtctcctggacct

SEQ ID NO: 1730036 - DNA, 14 bp, Homo sapiens
ccggggtctgtgct

SEQ ID NO: 1730037 - DNA, 17 bp, Homo sapiens
ccggggtctgtgctgtg

SEQ ID NO: 1730038 - DNA, 23 bp, Homo sapiens
ccggggtggggtgcactcgccat

SEQ ID NO: 1730039 - DNA, 20 bp, Homo sapiens
ccggggtgtaacttcctgct

SEQ ID NO: 1730040 - DNA, 23 bp, Homo sapiens
ccggggttccccacacagggcac

SEQ ID NO: 1730041 - DNA, 16 bp, Homo sapiens
ccgggtccccagctcc

SEQ ID NO: 1730042 - DNA, 20 bp, Homo sapiens
ccgggtctggtgctgaggat

SEQ ID NO: 1730043 - DNA, 14 bp, Homo sapiens
ccgggtgggcctgg

SEQ ID NO: 1730044 - DNA, 15 bp, Homo sapiens
ccgggtgggcctggc

SEQ ID NO: 1730045 - DNA, 18 bp, Homo sapiens
ccgggtgggcctggcctg

SEQ ID NO: 1730046 - DNA, 22 bp, Homo sapiens
ccgggttctgcagcggcagagc

SEQ ID NO: 1730047 - DNA, 23 bp, Homo sapiens
ccgggttctgcagcggcagagca

SEQ ID NO: 1730048 - DNA, 17 bp, Homo sapiens
ccgggtttggctgagcc

SEQ ID NO: 1730049 - DNA, 16 bp, Homo sapiens
ccggtaactgtcctgt

SEQ ID NO: 1730050 - DNA, 21 bp, Homo sapiens
ccggtaactgtcctgtcctgc

SEQ ID NO: 1730051 - DNA, 18 bp, Homo sapiens
tgcaaggtggcctctgcc

SEQ ID NO: 1730052 - DNA, 19 bp, Homo sapiens
tgcaaggtggcctctgcct

SEQ ID NO: 1730053 - DNA, 22 bp, Homo sapiens
tgcaaggtggcctctgcctggg

SEQ ID NO: 1730054 - DNA, 19 bp, Homo sapiens
tgcaagtactgctgtaaat

SEQ ID NO: 1730055 - DNA, 21 bp, Homo sapiens
tgcaagtagcacatggtttaa

SEQ ID NO: 1730056 - DNA, 19 bp, Homo sapiens
tgcaagttgaggacttctt

SEQ ID NO: 1730057 - DNA, 16 bp, Homo sapiens
tgcaagtttatcagta

SEQ ID NO: 1730058 - DNA, 14 bp, Homo sapiens
tgcaataaaattta

SEQ ID NO: 1730059 - DNA, 21 bp, Homo sapiens
tgcaataaatctgacccagtg

SEQ ID NO: 1730060 - DNA, 14 bp, Homo sapiens
tgcaataactctgg

SEQ ID NO: 1730061 - DNA, 17 bp, Homo sapiens
tgcaataactctgggag

SEQ ID NO: 1730062 - DNA, 14 bp, Homo sapiens
tgcaatacattttt

SEQ ID NO: 1730063 - DNA, 16 bp, Homo sapiens
tgcaatagaaggtgat

SEQ ID NO: 1730064 - DNA, 18 bp, Homo sapiens
tgcaatagattactgatg

SEQ ID NO: 1730065 - DNA, 21 bp, Homo sapiens
tgcaataggtgagagaatgta

SEQ ID NO: 1730066 - DNA, 16 bp, Homo sapiens
tgcaatataagcataa

SEQ ID NO: 1730067 - DNA, 16 bp, Homo sapiens
tgcaatccatttattt

SEQ ID NO: 1730068 - DNA, 22 bp, Homo sapiens
tgcaatccatttatttcattta

SEQ ID NO: 1730069 - DNA, 19 bp, Homo sapiens
tgcaatcctgtctttctga

SEQ ID NO: 1730070 - DNA, 17 bp, Homo sapiens
tgcaatctactggaaat

SEQ ID NO: 1730071 - DNA, 22 bp, Homo sapiens
tgcaatgaaaggtactatattt

SEQ ID NO: 1730072 - DNA, 21 bp, Homo sapiens
tgcaatgacacagtcttggct

SEQ ID NO: 1730073 - DNA, 16 bp, Homo sapiens
tgcaatgacatcttca

SEQ ID NO: 1730074 - DNA, 15 bp, Homo sapiens
tgcaatgagccatga

SEQ ID NO: 1730075 - DNA, 12 bp, Homo sapiens
tgcaatgccctc

SEQ ID NO: 1730076 - DNA, 15 bp, Homo sapiens
tgcaatgcttgtaga

SEQ ID NO: 1730077 - DNA, 16 bp, Homo sapiens
tgcaatgcttgtagaa

SEQ ID NO: 1730078 - DNA, 17 bp, Homo sapiens
tgcaatgtatagtgtct

SEQ ID NO: 1730079 - DNA, 16 bp, Homo sapiens
tgcaatgtatttagct

SEQ ID NO: 1730080 - DNA, 20 bp, Homo sapiens
tgcaatgtcacaacctctct

SEQ ID NO: 1730081 - DNA, 23 bp, Homo sapiens
tgcaatgtggtgacacctccccc

SEQ ID NO: 1730082 - DNA, 19 bp, Homo sapiens
tgcaattaaacttccaaag

SEQ ID NO: 1730083 - DNA, 23 bp, Homo sapiens
tgcaattaaacttccaaagaaag

SEQ ID NO: 1730084 - DNA, 24 bp, Homo sapiens
tgcaattaaacttccaaagaaagt

SEQ ID NO: 1730085 - DNA, 16 bp, Homo sapiens
tgcaattcaaaagttc

SEQ ID NO: 1730086 - DNA, 18 bp, Homo sapiens
tgcaattcaaaagttcca

SEQ ID NO: 1730087 - DNA, 21 bp, Homo sapiens
tgcaattcaaaagttccaaga

SEQ ID NO: 1730088 - DNA, 13 bp, Homo sapiens
tgcaattcccctc

SEQ ID NO: 1730089 - DNA, 14 bp, Homo sapiens
tgcaattcccctct

SEQ ID NO: 1730090 - DNA, 12 bp, Homo sapiens
tgcaatttcaag

SEQ ID NO: 1730091 - DNA, 14 bp, Homo sapiens
tgcaatttcatatg

SEQ ID NO: 1730092 - DNA, 13 bp, Homo sapiens
tgcaatttgaagt

SEQ ID NO: 1730093 - DNA, 23 bp, Homo sapiens
tgcaatttgattgactgcccatt

SEQ ID NO: 1730094 - DNA, 23 bp, Homo sapiens
tgcacaaacttgtgagcatcaga

SEQ ID NO: 1730095 - DNA, 15 bp, Homo sapiens
tgcacaagaatggat

SEQ ID NO: 1730096 - DNA, 16 bp, Homo sapiens
tgcacaagaatggatc

SEQ ID NO: 1730097 - DNA, 19 bp, Homo sapiens
tgcacaaggaaataaagcg

SEQ ID NO: 1730098 - DNA, 20 bp, Homo sapiens
tgcacaaggaaataaagcgt

SEQ ID NO: 1730099 - DNA, 21 bp, Homo sapiens
tgcacaataaaaatgtttaac

SEQ ID NO: 1730100 - DNA, 21 bp, Homo sapiens
tgcacaattccatgacaatat

SEQ ID NO: 1730101 - DNA, 15 bp, Homo sapiens
tgcacacagaatgct

SEQ ID NO: 1730102 - DNA, 19 bp, Homo sapiens
tgcacacagaatgctcagg

SEQ ID NO: 1730103 - DNA, 20 bp, Homo sapiens
tgcacacagaatgctcaggg

SEQ ID NO: 1730104 - DNA, 13 bp, Homo sapiens
tgcacacaggaca

SEQ ID NO: 1730105 - DNA, 17 bp, Homo sapiens
tgcacacaggacagcgg

SEQ ID NO: 1730106 - DNA, 17 bp, Homo sapiens
tgcacaccttttcccca

SEQ ID NO: 1730107 - DNA, 20 bp, Homo sapiens
tgcacaccttttccccagga

SEQ ID NO: 1730108 - DNA, 18 bp, Homo sapiens
tgcacacggctggtcact

SEQ ID NO: 1730109 - DNA, 18 bp, Homo sapiens
tgcacacgggaaagcctt

SEQ ID NO: 1730110 - DNA, 13 bp, Homo sapiens
tgcacacgggcga

SEQ ID NO: 1730111 - DNA, 23 bp, Homo sapiens
tgcacacgggcgagctttctctc

SEQ ID NO: 1730112 - DNA, 12 bp, Homo sapiens
tgcacacttccc

SEQ ID NO: 1730113 - DNA, 16 bp, Homo sapiens
tgcacacttccccatc

SEQ ID NO: 1730114 - DNA, 21 bp, Homo sapiens
tgcacacttgtgtgtgggctg

SEQ ID NO: 1730115 - DNA, 23 bp, Homo sapiens
ccgtgaagcagtgcctcgaggca

SEQ ID NO: 1730116 - DNA, 13 bp, Homo sapiens
ccgtgaattgctt

SEQ ID NO: 1730117 - DNA, 11 bp, Homo sapiens
ccgtgacctat

SEQ ID NO: 1730118 - DNA, 12 bp, Homo sapiens
ccgtgacctatt

SEQ ID NO: 1730119 - DNA, 20 bp, Homo sapiens
ccgtgacctattcaccctcc

SEQ ID NO: 1730120 - DNA, 19 bp, Homo sapiens
ccgtgagcgccccgccccc

SEQ ID NO: 1730121 - DNA, 16 bp, Homo sapiens
ccgtgaggctgctgcc

SEQ ID NO: 1730122 - DNA, 18 bp, Homo sapiens
ccgtgaggctgctgccat

SEQ ID NO: 1730123 - DNA, 19 bp, Homo sapiens
ccgtgaggctgctgccatc

SEQ ID NO: 1730124 - DNA, 23 bp, Homo sapiens
ccgtgatgtagggtaaggtgcct

SEQ ID NO: 1730125 - DNA, 15 bp, Homo sapiens
ccgtgcagtacaggc

SEQ ID NO: 1730126 - DNA, 16 bp, Homo sapiens
ccgtgcagtacaggca

SEQ ID NO: 1730127 - DNA, 14 bp, Homo sapiens
ccgtgcatggctcc

SEQ ID NO: 1730128 - DNA, 16 bp, Homo sapiens
ccgtgcccaggccctt

SEQ ID NO: 1730129 - DNA, 23 bp, Homo sapiens
ccgtgcccgcaggaactgggctg

SEQ ID NO: 1730130 - DNA, 14 bp, Homo sapiens
ccgtgccgcctgca

SEQ ID NO: 1730131 - DNA, 17 bp, Homo sapiens
ccgtgcctccaccacca

SEQ ID NO: 1730132 - DNA, 23 bp, Homo sapiens
ccgtgcctccaccaccactggcc

SEQ ID NO: 1730133 - DNA, 14 bp, Homo sapiens
ccgtggacaggccc

SEQ ID NO: 1730134 - DNA, 16 bp, Homo sapiens
ccgtggacaggcccag

SEQ ID NO: 1730135 - DNA, 21 bp, Homo sapiens
ccgtggacaggcccagcgcgg

SEQ ID NO: 1730136 - DNA, 16 bp, Homo sapiens
ccgtggagactgagat

SEQ ID NO: 1730137 - DNA, 16 bp, Homo sapiens
ccgtggaggaggaagg

SEQ ID NO: 1730138 - DNA, 23 bp, Homo sapiens
ccgtggaggaggaaggcaagagg

SEQ ID NO: 1730139 - DNA, 12 bp, Homo sapiens
ccgtggatctcc

SEQ ID NO: 1730140 - DNA, 14 bp, Homo sapiens
ccgtggatctcctt

SEQ ID NO: 1730141 - DNA, 14 bp, Homo sapiens
ccgtggatttgtac

SEQ ID NO: 1730142 - DNA, 15 bp, Homo sapiens
ccgtggccctgccct

SEQ ID NO: 1730143 - DNA, 11 bp, Homo sapiens
ccgtggctacc

SEQ ID NO: 1730144 - DNA, 21 bp, Homo sapiens
ccgtggcttcccgctcagccc

SEQ ID NO: 1730145 - DNA, 22 bp, Homo sapiens
ccgtggcttggggattgtacac

SEQ ID NO: 1730146 - DNA, 14 bp, Homo sapiens
ccgtggggcaggga

SEQ ID NO: 1730147 - DNA, 20 bp, Homo sapiens
ccgtggggccgccgcctctt

SEQ ID NO: 1730148 - DNA, 19 bp, Homo sapiens
ccgtggggtgctgccctta

SEQ ID NO: 1730149 - DNA, 15 bp, Homo sapiens
ccgtggtcagagtgc

SEQ ID NO: 1730150 - DNA, 19 bp, Homo sapiens
ccgtggtcagagtgccact

SEQ ID NO: 1730151 - DNA, 16 bp, Homo sapiens
ccgtggtccagctctt

SEQ ID NO: 1730152 - DNA, 20 bp, Homo sapiens
ccgtggtccagctcttggcc

SEQ ID NO: 1730153 - DNA, 21 bp, Homo sapiens
ccgtggtggcaccgagaccaa

SEQ ID NO: 1730154 - DNA, 20 bp, Homo sapiens
ccgtggtgttatttaaagaa

SEQ ID NO: 1730155 - DNA, 13 bp, Homo sapiens
ccgtgtccagcac

SEQ ID NO: 1730156 - DNA, 16 bp, Homo sapiens
ccgtgtccagcacaga

SEQ ID NO: 1730157 - DNA, 19 bp, Homo sapiens
ccgtgtccagcacagaagg

SEQ ID NO: 1730158 - DNA, 23 bp, Homo sapiens
ccgtgtccagcacagaaggaatc

SEQ ID NO: 1730159 - DNA, 18 bp, Homo sapiens
ccgtgtcccaaggagctg

SEQ ID NO: 1730160 - DNA, 20 bp, Homo sapiens
ccgtgtctcagcctctgcca

SEQ ID NO: 1730161 - DNA, 14 bp, Homo sapiens
ccgttactctccaa

SEQ ID NO: 1730162 - DNA, 22 bp, Homo sapiens
ccgttactctccaacctggaca

SEQ ID NO: 1730163 - DNA, 14 bp, Homo sapiens
ccgttagctcctgt

SEQ ID NO: 1730164 - DNA, 18 bp, Homo sapiens
ccgttagctcctgtggcc

SEQ ID NO: 1730165 - DNA, 20 bp, Homo sapiens
ccgttccaccccaagagaac

SEQ ID NO: 1730166 - DNA, 15 bp, Homo sapiens
ccgttccagctgaca

SEQ ID NO: 1730167 - DNA, 14 bp, Homo sapiens
ccgttccccttggc

SEQ ID NO: 1730168 - DNA, 20 bp, Homo sapiens
ccgttccttccgatgacagt

SEQ ID NO: 1730169 - DNA, 14 bp, Homo sapiens
tgcacccctcccca

SEQ ID NO: 1730170 - DNA, 14 bp, Homo sapiens
tgcaccctctatcc

SEQ ID NO: 1730171 - DNA, 22 bp, Homo sapiens
tgcaccctggggcctggacctg

SEQ ID NO: 1730172 - DNA, 17 bp, Homo sapiens
tgcacccttccctcttc

SEQ ID NO: 1730173 - DNA, 23 bp, Homo sapiens
tgcacccttccctcttccctctc

SEQ ID NO: 1730174 - DNA, 22 bp, Homo sapiens
tgcaccgcctgccctcccgcac

SEQ ID NO: 1730175 - DNA, 16 bp, Homo sapiens
tgcacctcaaggtcat

SEQ ID NO: 1730176 - DNA, 18 bp, Homo sapiens
tgcacctccccccactgc

SEQ ID NO: 1730177 - DNA, 19 bp, Homo sapiens
tgcacctctggctagagcc

SEQ ID NO: 1730178 - DNA, 19 bp, Homo sapiens
tgcacctgattagttgaaa

SEQ ID NO: 1730179 - DNA, 13 bp, Homo sapiens
tgcacctgcaggc

SEQ ID NO: 1730180 - DNA, 16 bp, Homo sapiens
tgcacctgcaggctta

SEQ ID NO: 1730181 - DNA, 17 bp, Homo sapiens
tgcacctgccagcctgg

SEQ ID NO: 1730182 - DNA, 19 bp, Homo sapiens
tgcacctgccagcctggct

SEQ ID NO: 1730183 - DNA, 22 bp, Homo sapiens
tgcacctgccagcctggcttct

SEQ ID NO: 1730184 - DNA, 14 bp, Homo sapiens
tgcacctgcctcca

SEQ ID NO: 1730185 - DNA, 15 bp, Homo sapiens
tgcacctgcctccac

SEQ ID NO: 1730186 - DNA, 16 bp, Homo sapiens
tgcacctgcctccacc

SEQ ID NO: 1730187 - DNA, 12 bp, Homo sapiens
tgcacctggcct

SEQ ID NO: 1730188 - DNA, 16 bp, Homo sapiens
tgcacctgtactcagg

SEQ ID NO: 1730189 - DNA, 20 bp, Homo sapiens
tgcacctgtactcaggaggc

SEQ ID NO: 1730190 - DNA, 12 bp, Homo sapiens
tgcacctgtgca

SEQ ID NO: 1730191 - DNA, 16 bp, Homo sapiens
tgcaccttgtaaatgc

SEQ ID NO: 1730192 - DNA, 14 bp, Homo sapiens
tgcaccttgtgtct

SEQ ID NO: 1730193 - DNA, 15 bp, Homo sapiens
tgcaccttgtgtctg

SEQ ID NO: 1730194 - DNA, 21 bp, Homo sapiens
tgcacgggcatgcacacggct

SEQ ID NO: 1730195 - DNA, 17 bp, Homo sapiens
tgcacgtggagagctgg

SEQ ID NO: 1730196 - DNA, 17 bp, Homo sapiens
tgcacgtggcctcttga

SEQ ID NO: 1730197 - DNA, 19 bp, Homo sapiens
tgcacgtggcctcttgagc

SEQ ID NO: 1730198 - DNA, 22 bp, Homo sapiens
tgcacgtggcctcttgagcagt

SEQ ID NO: 1730199 - DNA, 18 bp, Homo sapiens
tgcactaaatcagagaca

SEQ ID NO: 1730200 - DNA, 19 bp, Homo sapiens
tgcactactcctctgcagt

SEQ ID NO: 1730201 - DNA, 23 bp, Homo sapiens
tgcactactcctctgcagtgcct

SEQ ID NO: 1730202 - DNA, 13 bp, Homo sapiens
tgcactagcctgt

SEQ ID NO: 1730203 - DNA, 18 bp, Homo sapiens
tgcactagcctgtgatta

SEQ ID NO: 1730204 - DNA, 13 bp, Homo sapiens
tgcactatttcca

SEQ ID NO: 1730205 - DNA, 16 bp, Homo sapiens
tgcactcaaatcttaa

SEQ ID NO: 1730206 - DNA, 20 bp, Homo sapiens
tgcactcaaatcttaagaaa

SEQ ID NO: 1730207 - DNA, 20 bp, Homo sapiens
tgcactcacccctagccctg

SEQ ID NO: 1730208 - DNA, 21 bp, Homo sapiens
tgcactcacccctagccctgg

SEQ ID NO: 1730209 - DNA, 20 bp, Homo sapiens
tgcactccagcctgggcaac

SEQ ID NO: 1730210 - DNA, 17 bp, Homo sapiens
tgcactccatggccacc

SEQ ID NO: 1730211 - DNA, 18 bp, Homo sapiens
tgcactccatggccaccc

SEQ ID NO: 1730212 - DNA, 19 bp, Homo sapiens
tgcactccatggccacccc

SEQ ID NO: 1730213 - DNA, 17 bp, Homo sapiens
tgcactcccacctgaca

SEQ ID NO: 1730214 - DNA, 15 bp, Homo sapiens
tgcactccctggcct

SEQ ID NO: 1730215 - DNA, 22 bp, Homo sapiens
tgcactccggcctgggtgacag

SEQ ID NO: 1730216 - DNA, 16 bp, Homo sapiens
tgcactcctcagggca

SEQ ID NO: 1730217 - DNA, 19 bp, Homo sapiens
tgcactgaaaacttagcca

SEQ ID NO: 1730218 - DNA, 20 bp, Homo sapiens
tgcactgaaaacttagccag

SEQ ID NO: 1730219 - DNA, 21 bp, Homo sapiens
tgcactgaagccggacagctg

SEQ ID NO: 1730220 - DNA, 20 bp, Homo sapiens
tgcactgacccttccagaca

SEQ ID NO: 1730221 - DNA, 23 bp, Homo sapiens
tgcactgacccttccagacatac

SEQ ID NO: 1730222 - DNA, 17 bp, Homo sapiens
tgcactgagagggcaag

SEQ ID NO: 1730223 - DNA, 12 bp, Homo sapiens
tgcactgagggc

SEQ ID NO: 1730224 - DNA, 15 bp, Homo sapiens
tgcactgagggccac

SEQ ID NO: 1730225 - DNA, 14 bp, Homo sapiens
tgcactgatgttgt

SEQ ID NO: 1730226 - DNA, 18 bp, Homo sapiens
tgcactgctgttcctgct

SEQ ID NO: 1730227 - DNA, 15 bp, Homo sapiens
tgcactggagtccag

SEQ ID NO: 1730228 - DNA, 19 bp, Homo sapiens
tgcactggagtccagtctc

SEQ ID NO: 1730229 - DNA, 16 bp, Homo sapiens
tgcactgtcaagatga

SEQ ID NO: 1730230 - DNA, 17 bp, Homo sapiens
tgcaggaacgagcactg

SEQ ID NO: 1730231 - DNA, 18 bp, Homo sapiens
tgcaggaacgagcactgg

SEQ ID NO: 1730232 - DNA, 21 bp, Homo sapiens
tgcaggaacgagcactggcca

SEQ ID NO: 1730233 - DNA, 12 bp, Homo sapiens
tgcaggacagct

SEQ ID NO: 1730234 - DNA, 18 bp, Homo sapiens
tgcaggacagctcttgat

SEQ ID NO: 1730235 - DNA, 12 bp, Homo sapiens
tgcaggacagga

SEQ ID NO: 1730236 - DNA, 15 bp, Homo sapiens
tgcaggacaggaggc

SEQ ID NO: 1730237 - DNA, 15 bp, Homo sapiens
tgcaggaccttgggc

SEQ ID NO: 1730238 - DNA, 16 bp, Homo sapiens
tgcaggacttctgcct

SEQ ID NO: 1730239 - DNA, 18 bp, Homo sapiens
tgcaggacttgagaagac

SEQ ID NO: 1730240 - DNA, 13 bp, Homo sapiens
tgcaggaggctca

SEQ ID NO: 1730241 - DNA, 13 bp, Homo sapiens
tgcaggaggtgga

SEQ ID NO: 1730242 - DNA, 18 bp, Homo sapiens
tgcaggatggtgtctctt

SEQ ID NO: 1730243 - DNA, 16 bp, Homo sapiens
tgcaggattcccttct

SEQ ID NO: 1730244 - DNA, 21 bp, Homo sapiens
tgcaggattcccttctgggct

SEQ ID NO: 1730245 - DNA, 22 bp, Homo sapiens
tgcaggattcccttctgggctt

SEQ ID NO: 1730246 - DNA, 15 bp, Homo sapiens
tgcaggcagccttga

SEQ ID NO: 1730247 - DNA, 20 bp, Homo sapiens
tgcaggcaggaacaaacagg

SEQ ID NO: 1730248 - DNA, 22 bp, Homo sapiens
tgcaggcccagaggagccaagt

SEQ ID NO: 1730249 - DNA, 10 bp, Homo sapiens
tgcaggcccc

SEQ ID NO: 1730250 - DNA, 15 bp, Homo sapiens
tgcaggccctggcct

SEQ ID NO: 1730251 - DNA, 13 bp, Homo sapiens
tgcaggctctggg

SEQ ID NO: 1730252 - DNA, 15 bp, Homo sapiens
tgcaggctctgggct

SEQ ID NO: 1730253 - DNA, 22 bp, Homo sapiens
tgcaggctctgggctcagggct

SEQ ID NO: 1730254 - DNA, 16 bp, Homo sapiens
tgcagggaagagggca

SEQ ID NO: 1730255 - DNA, 13 bp, Homo sapiens
tgcagggagcact

SEQ ID NO: 1730256 - DNA, 16 bp, Homo sapiens
tgcagggaggggaggc

SEQ ID NO: 1730257 - DNA, 19 bp, Homo sapiens
tgcagggatattgccttat

SEQ ID NO: 1730258 - DNA, 21 bp, Homo sapiens
tgcagggccagacctgcctgc

SEQ ID NO: 1730259 - DNA, 19 bp, Homo sapiens
tgcagggccatggctcagg

SEQ ID NO: 1730260 - DNA, 17 bp, Homo sapiens
tgcagggctcccatggg

SEQ ID NO: 1730261 - DNA, 19 bp, Homo sapiens
tgcagggctcccatgggct

SEQ ID NO: 1730262 - DNA, 17 bp, Homo sapiens
tgcagggctttaaaatt

SEQ ID NO: 1730263 - DNA, 19 bp, Homo sapiens
tgcagggctttaaaattct

SEQ ID NO: 1730264 - DNA, 18 bp, Homo sapiens
tgcaggggtcccccctca

SEQ ID NO: 1730265 - DNA, 22 bp, Homo sapiens
tgcagggtcctcttctgggcct

SEQ ID NO: 1730266 - DNA, 20 bp, Homo sapiens
tgcagggtggtgctgggact

SEQ ID NO: 1730267 - DNA, 12 bp, Homo sapiens
tgcaggtcagcc

SEQ ID NO: 1730268 - DNA, 19 bp, Homo sapiens
tgcaggtggtgggacactg

SEQ ID NO: 1730269 - DNA, 15 bp, Homo sapiens
tgcagtaacttggga

SEQ ID NO: 1730270 - DNA, 11 bp, Homo sapiens
tgcagtacaga

SEQ ID NO: 1730271 - DNA, 19 bp, Homo sapiens
tgcagtacagaattggata

SEQ ID NO: 1730272 - DNA, 13 bp, Homo sapiens
tgcagtacaggca

SEQ ID NO: 1730273 - DNA, 15 bp, Homo sapiens
tgcagtactaaaatt

SEQ ID NO: 1730274 - DNA, 17 bp, Homo sapiens
tgcagtactttgtgcat

SEQ ID NO: 1730275 - DNA, 22 bp, Homo sapiens
tgcagtagagtcatctccatca

SEQ ID NO: 1730276 - DNA, 20 bp, Homo sapiens
tgcagtcaacagttcaaaga

SEQ ID NO: 1730277 - DNA, 13 bp, Homo sapiens
tgcagtcacattg

SEQ ID NO: 1730278 - DNA, 14 bp, Homo sapiens
tgcagtcactggag

SEQ ID NO: 1730279 - DNA, 15 bp, Homo sapiens
tgcagtcactggagg

SEQ ID NO: 1730280 - DNA, 21 bp, Homo sapiens
tgcagtcagtcatgatggcac

SEQ ID NO: 1730281 - DNA, 23 bp, Homo sapiens
tgcagtcatttggtgctctgcta

SEQ ID NO: 1730282 - DNA, 20 bp, Homo sapiens
tgcagtccgcagtctggcct

SEQ ID NO: 1730283 - DNA, 21 bp, Homo sapiens
tgcagtccgcagtctggcctg

SEQ ID NO: 1730284 - DNA, 13 bp, Homo sapiens
tgcagtcctggtg

SEQ ID NO: 1730285 - DNA, 18 bp, Homo sapiens
tgcagtcggcatgccagg

SEQ ID NO: 1730286 - DNA, 19 bp, Homo sapiens
tgcagtcggcatgccagga

SEQ ID NO: 1730287 - DNA, 20 bp, Homo sapiens
ccgttcgtacgcccaggaca

SEQ ID NO: 1730288 - DNA, 16 bp, Homo sapiens
ccgttgcttcccgctg

SEQ ID NO: 1730289 - DNA, 20 bp, Homo sapiens
ccgttggggattggggaaga

SEQ ID NO: 1730290 - DNA, 22 bp, Homo sapiens
ccgttgtctaggagacagagcc

SEQ ID NO: 1730291 - DNA, 23 bp, Homo sapiens
ccgttgtctaggagacagagcca

SEQ ID NO: 1730292 - DNA, 14 bp, Homo sapiens
ccgtttagaaaaaa

SEQ ID NO: 1730293 - DNA, 19 bp, Homo sapiens
ccgtttatgggccttgctt

SEQ ID NO: 1730294 - DNA, 20 bp, Homo sapiens
ccgtttcccggttcaggacc

SEQ ID NO: 1730295 - DNA, 14 bp, Homo sapiens
ccgtttctcctttt

SEQ ID NO: 1730296 - DNA, 22 bp, Homo sapiens
ccgtttgagaagaaaacatcta

SEQ ID NO: 1730297 - DNA, 14 bp, Homo sapiens
ccgttttgtcactt

SEQ ID NO: 1730298 - DNA, 14 bp, Homo sapiens
cctaaaaattttgt

SEQ ID NO: 1730299 - DNA, 23 bp, Homo sapiens
cctaaaacgaatggtctttgctc

SEQ ID NO: 1730300 - DNA, 12 bp, Homo sapiens
cctaaaactggg

SEQ ID NO: 1730301 - DNA, 14 bp, Homo sapiens
cctaaaagtaaaca

SEQ ID NO: 1730302 - DNA, 20 bp, Homo sapiens
cctaaaagttgaaaagccaa

SEQ ID NO: 1730303 - DNA, 23 bp, Homo sapiens
cctaaacagatataaatggctgg

SEQ ID NO: 1730304 - DNA, 16 bp, Homo sapiens
cctaaacataattgtg

SEQ ID NO: 1730305 - DNA, 22 bp, Homo sapiens
cctaaagaaaaatatcttggcc

SEQ ID NO: 1730306 - DNA, 13 bp, Homo sapiens
cctaaagagagta

SEQ ID NO: 1730307 - DNA, 12 bp, Homo sapiens
cctaaagagata

SEQ ID NO: 1730308 - DNA, 16 bp, Homo sapiens
cctaaagattttgatc

SEQ ID NO: 1730309 - DNA, 14 bp, Homo sapiens
cctaaagcagccag

SEQ ID NO: 1730310 - DNA, 13 bp, Homo sapiens
cctaaagggagaa

SEQ ID NO: 1730311 - DNA, 14 bp, Homo sapiens
cctaaagggcaggg

SEQ ID NO: 1730312 - DNA, 18 bp, Homo sapiens
cctaaagggcagggccca

SEQ ID NO: 1730313 - DNA, 18 bp, Homo sapiens
cctaaataaatgagctgt

SEQ ID NO: 1730314 - DNA, 22 bp, Homo sapiens
cctaaataaatgagctgttgga

SEQ ID NO: 1730315 - DNA, 15 bp, Homo sapiens
cctaaatccaaagaa

SEQ ID NO: 1730316 - DNA, 12 bp, Homo sapiens
cctaaatgatgg

SEQ ID NO: 1730317 - DNA, 19 bp, Homo sapiens
cctaaatttaatgctgcct

SEQ ID NO: 1730318 - DNA, 13 bp, Homo sapiens
cctaacaaaagaa

SEQ ID NO: 1730319 - DNA, 22 bp, Homo sapiens
cctaacaccccctagcaaaact

SEQ ID NO: 1730320 - DNA, 19 bp, Homo sapiens
cctaacatagtgtctgctg

SEQ ID NO: 1730321 - DNA, 21 bp, Homo sapiens
cctaacatctgacctggcatc

SEQ ID NO: 1730322 - DNA, 17 bp, Homo sapiens
cctaacattcgatctca

SEQ ID NO: 1730323 - DNA, 18 bp, Homo sapiens
cctaaccccttccagatc

SEQ ID NO: 1730324 - DNA, 13 bp, Homo sapiens
cctaacctttcgc

SEQ ID NO: 1730325 - DNA, 14 bp, Homo sapiens
cctaactgttccct

SEQ ID NO: 1730326 - DNA, 22 bp, Homo sapiens
cctaagagactgcgttctgcaa

SEQ ID NO: 1730327 - DNA, 15 bp, Homo sapiens
cctaagagtggagga

SEQ ID NO: 1730328 - DNA, 16 bp, Homo sapiens
cctaagagtggaggag

SEQ ID NO: 1730329 - DNA, 20 bp, Homo sapiens
cctaagagtgtcactgagct

SEQ ID NO: 1730330 - DNA, 21 bp, Homo sapiens
cctaagatctcggtttgccaa

SEQ ID NO: 1730331 - DNA, 19 bp, Homo sapiens
cctaagatgtgttcttatt

SEQ ID NO: 1730332 - DNA, 16 bp, Homo sapiens
cctaagcccccagggc

SEQ ID NO: 1730333 - DNA, 17 bp, Homo sapiens
cctaagcccccagggcc

SEQ ID NO: 1730334 - DNA, 16 bp, Homo sapiens
cctaaggaaccttcct

SEQ ID NO: 1730335 - DNA, 13 bp, Homo sapiens
cctaaggacacac

SEQ ID NO: 1730336 - DNA, 19 bp, Homo sapiens
cctaagggtcgaaagctct

SEQ ID NO: 1730337 - DNA, 22 bp, Homo sapiens
cctaagggtcgaaagctctaga

SEQ ID NO: 1730338 - DNA, 20 bp, Homo sapiens
cctaaggtccaacaagaatg

SEQ ID NO: 1730339 - DNA, 14 bp, Homo sapiens
cctaagtcaggtaa

SEQ ID NO: 1730340 - DNA, 21 bp, Homo sapiens
cctaagtccttccacctgcca

SEQ ID NO: 1730341 - DNA, 16 bp, Homo sapiens
cctaagtcctttatgt

SEQ ID NO: 1730342 - DNA, 14 bp, Homo sapiens
cctaagtctctgtg

SEQ ID NO: 1730343 - DNA, 15 bp, Homo sapiens
cctaagtctctgtga

SEQ ID NO: 1730344 - DNA, 14 bp, Homo sapiens
cctaagtgcccaaa

SEQ ID NO: 1730345 - DNA, 19 bp, Homo sapiens
tgcatcatatatttaacaa

SEQ ID NO: 1730346 - DNA, 13 bp, Homo sapiens
tgcatccaactcc

SEQ ID NO: 1730347 - DNA, 20 bp, Homo sapiens
tgcatccattgttgtgtctg

SEQ ID NO: 1730348 - DNA, 17 bp, Homo sapiens
tgcatccttcctgggga

SEQ ID NO: 1730349 - DNA, 18 bp, Homo sapiens
tgcatccttgtaatacct

SEQ ID NO: 1730350 - DNA, 15 bp, Homo sapiens
tgcatctagaaagct

SEQ ID NO: 1730351 - DNA, 15 bp, Homo sapiens
tgcatctcagcccac

SEQ ID NO: 1730352 - DNA, 12 bp, Homo sapiens
tgcatctcctcc

SEQ ID NO: 1730353 - DNA, 19 bp, Homo sapiens
tgcatctcctcccgccctt

SEQ ID NO: 1730354 - DNA, 13 bp, Homo sapiens
tgcatctctgtga

SEQ ID NO: 1730355 - DNA, 13 bp, Homo sapiens
tgcatctgggcca

SEQ ID NO: 1730356 - DNA, 18 bp, Homo sapiens
tgcatctgggccagaagt

SEQ ID NO: 1730357 - DNA, 14 bp, Homo sapiens
tgcatcttactgaa

SEQ ID NO: 1730358 - DNA, 17 bp, Homo sapiens
tgcatcttactgaaggt

SEQ ID NO: 1730359 - DNA, 16 bp, Homo sapiens
tgcatctttgttactt

SEQ ID NO: 1730360 - DNA, 10 bp, Homo sapiens
tgcatgaaat

SEQ ID NO: 1730361 - DNA, 18 bp, Homo sapiens
tgcatgaatcagatgtgt

SEQ ID NO: 1730362 - DNA, 24 bp, Homo sapiens
tgcatgagctggcaaccagccagc

SEQ ID NO: 1730363 - DNA, 18 bp, Homo sapiens
tgcatgatgtttgcccaa

SEQ ID NO: 1730364 - DNA, 18 bp, Homo sapiens
tgcatgcatgcaaatgag

SEQ ID NO: 1730365 - DNA, 13 bp, Homo sapiens
tgcatgctctgga

SEQ ID NO: 1730366 - DNA, 16 bp, Homo sapiens
tgcatgctctggaagc

SEQ ID NO: 1730367 - DNA, 22 bp, Homo sapiens
tgcatgctctggaagcctggac

SEQ ID NO: 1730368 - DNA, 13 bp, Homo sapiens
tgcatgctgaaac

SEQ ID NO: 1730369 - DNA, 14 bp, Homo sapiens
tgcatgctgaaaca

SEQ ID NO: 1730370 - DNA, 13 bp, Homo sapiens
tgcatgctgccca

SEQ ID NO: 1730371 - DNA, 15 bp, Homo sapiens
tgcatgctgcccagc

SEQ ID NO: 1730372 - DNA, 13 bp, Homo sapiens
tgcatggagcagg

SEQ ID NO: 1730373 - DNA, 15 bp, Homo sapiens
tgcatggaggactct

SEQ ID NO: 1730374 - DNA, 17 bp, Homo sapiens
tgcatggcactgactga

SEQ ID NO: 1730375 - DNA, 16 bp, Homo sapiens
tgcatggctcctgtct

SEQ ID NO: 1730376 - DNA, 19 bp, Homo sapiens
tgcatggggctggggtcct

SEQ ID NO: 1730377 - DNA, 16 bp, Homo sapiens
tgcatgggtgaaggga

SEQ ID NO: 1730378 - DNA, 17 bp, Homo sapiens
tgcatgggtgaagggag

SEQ ID NO: 1730379 - DNA, 15 bp, Homo sapiens
tgcatggtggccaga

SEQ ID NO: 1730380 - DNA, 21 bp, Homo sapiens
tgcatgtagaggcttgtttac

SEQ ID NO: 1730381 - DNA, 13 bp, Homo sapiens
tgcatgtatgtct

SEQ ID NO: 1730382 - DNA, 15 bp, Homo sapiens
tgcatgtatgtcttg

SEQ ID NO: 1730383 - DNA, 19 bp, Homo sapiens
tgcatgtgagcacatgcgt

SEQ ID NO: 1730384 - DNA, 16 bp, Homo sapiens
tgcatgtgtgtgtctg

SEQ ID NO: 1730385 - DNA, 23 bp, Homo sapiens
tgcattaccagcttaaaacactt

SEQ ID NO: 1730386 - DNA, 21 bp, Homo sapiens
tgcattatatttgtaaattta

SEQ ID NO: 1730387 - DNA, 21 bp, Homo sapiens
tgcattattgacgaactggct

SEQ ID NO: 1730388 - DNA, 21 bp, Homo sapiens
tgcattcacaaggtgactggg

SEQ ID NO: 1730389 - DNA, 18 bp, Homo sapiens
tgcattcatgcaagagtt

SEQ ID NO: 1730390 - DNA, 16 bp, Homo sapiens
tgcattccagaatctt

SEQ ID NO: 1730391 - DNA, 23 bp, Homo sapiens
tgcattccagagttaaaatgttt

SEQ ID NO: 1730392 - DNA, 16 bp, Homo sapiens
tgcattccctgaatct

SEQ ID NO: 1730393 - DNA, 23 bp, Homo sapiens
tgcattccctgaatctgtgcctg

SEQ ID NO: 1730394 - DNA, 23 bp, Homo sapiens
tgcattcgaagaaacccttgctg

SEQ ID NO: 1730395 - DNA, 22 bp, Homo sapiens
tgcattcggtacttacccggag

SEQ ID NO: 1730396 - DNA, 12 bp, Homo sapiens
tgcattctagta

SEQ ID NO: 1730397 - DNA, 16 bp, Homo sapiens
tgcattctgagctgga

SEQ ID NO: 1730398 - DNA, 15 bp, Homo sapiens
tgcattctgcctctc

SEQ ID NO: 1730399 - DNA, 16 bp, Homo sapiens
tgcattctggatttta

SEQ ID NO: 1730400 - DNA, 20 bp, Homo sapiens
tgcattctttggtaattttt

SEQ ID NO: 1730401 - DNA, 15 bp, Homo sapiens
tgcattgaatatatt

SEQ ID NO: 1730402 - DNA, 14 bp, Homo sapiens
tgcattgcctgtaa

SEQ ID NO: 1730403 - DNA, 11 bp, Homo sapiens
tgcattgctgg

SEQ ID NO: 1730404 - DNA, 16 bp, Homo sapiens
tgcattgctggtagag

SEQ ID NO: 1730405 - DNA, 14 bp, Homo sapiens
tgcattgctgtgtg

SEQ ID NO: 1730406 - DNA, 15 bp, Homo sapiens
tgcattgctgtgtga

SEQ ID NO: 1730407 - DNA, 18 bp, Homo sapiens
tgcattggaagaccccac

SEQ ID NO: 1730408 - DNA, 20 bp, Homo sapiens
tgcattggaagaccccaccc

SEQ ID NO: 1730409 - DNA, 14 bp, Homo sapiens
tgcattggcctctg

SEQ ID NO: 1730410 - DNA, 16 bp, Homo sapiens
tgcattggcctggcct

SEQ ID NO: 1730411 - DNA, 17 bp, Homo sapiens
tgcattggcctggcctc

SEQ ID NO: 1730412 - DNA, 18 bp, Homo sapiens
tgcattggcctggcctcc

SEQ ID NO: 1730413 - DNA, 19 bp, Homo sapiens
tgcattggcctggcctcca

SEQ ID NO: 1730414 - DNA, 18 bp, Homo sapiens
tgcattgtctaatgacag

SEQ ID NO: 1730415 - DNA, 17 bp, Homo sapiens
tgcattgtgattggcct

SEQ ID NO: 1730416 - DNA, 15 bp, Homo sapiens
tgcatttaaaacaga

SEQ ID NO: 1730417 - DNA, 20 bp, Homo sapiens
tgcatttaaaacagacactg

SEQ ID NO: 1730418 - DNA, 13 bp, Homo sapiens
tgcatttaaaata

SEQ ID NO: 1730419 - DNA, 20 bp, Homo sapiens
tgcatttaaaataccactgt

SEQ ID NO: 1730420 - DNA, 19 bp, Homo sapiens
tgcatttcacctgtgacaa

SEQ ID NO: 1730421 - DNA, 17 bp, Homo sapiens
tgcatttcagaaagcct

SEQ ID NO: 1730422 - DNA, 13 bp, Homo sapiens
tgcatttcagaat

SEQ ID NO: 1730423 - DNA, 13 bp, Homo sapiens
tgcatttcctgac

SEQ ID NO: 1730424 - DNA, 13 bp, Homo sapiens
tgcatttgaggtc

SEQ ID NO: 1730425 - DNA, 12 bp, Homo sapiens
tgcatttgattt

SEQ ID NO: 1730426 - DNA, 16 bp, Homo sapiens
tgcatttggtcaagat

SEQ ID NO: 1730427 - DNA, 22 bp, Homo sapiens
tgcatttgtggtaatctacacc

SEQ ID NO: 1730428 - DNA, 17 bp, Homo sapiens
tgcattttaattttaac

SEQ ID NO: 1730429 - DNA, 19 bp, Homo sapiens
tgcattttaattttaacca

SEQ ID NO: 1730430 - DNA, 21 bp, Homo sapiens
tgcattttaattttaaccaaa

SEQ ID NO: 1730431 - DNA, 15 bp, Homo sapiens
tgcattttcctcttg

SEQ ID NO: 1730432 - DNA, 18 bp, Homo sapiens
tgcattttgagtgtttat

SEQ ID NO: 1730433 - DNA, 20 bp, Homo sapiens
tgcattttgtttctgtatat

SEQ ID NO: 1730434 - DNA, 14 bp, Homo sapiens
tgcatttttaaact

SEQ ID NO: 1730435 - DNA, 19 bp, Homo sapiens
tgcatttttaaacttgaaa

SEQ ID NO: 1730436 - DNA, 17 bp, Homo sapiens
tgcatttttgtgaaatg

SEQ ID NO: 1730437 - DNA, 19 bp, Homo sapiens
tgccaaaaactaaaattca

SEQ ID NO: 1730438 - DNA, 22 bp, Homo sapiens
tgccaaaaactaaaattcaaca

SEQ ID NO: 1730439 - DNA, 17 bp, Homo sapiens
tgccaaaattcatttct

SEQ ID NO: 1730440 - DNA, 14 bp, Homo sapiens
tgccaaagatcact

SEQ ID NO: 1730441 - DNA, 16 bp, Homo sapiens
tgccaaagccattctc

SEQ ID NO: 1730442 - DNA, 14 bp, Homo sapiens
tgccaaagctttac

SEQ ID NO: 1730443 - DNA, 16 bp, Homo sapiens
tgccaaagctttacta

SEQ ID NO: 1730444 - DNA, 21 bp, Homo sapiens
tgccaaataaatcatcctcat

SEQ ID NO: 1730445 - DNA, 19 bp, Homo sapiens
tgccaaatagccccagact

SEQ ID NO: 1730446 - DNA, 21 bp, Homo sapiens
tgccaaatagccccagactgg

SEQ ID NO: 1730447 - DNA, 24 bp, Homo sapiens
tgccaaattgagataatgatactt

SEQ ID NO: 1730448 - DNA, 22 bp, Homo sapiens
tgccaacagttgtatgtttgct

SEQ ID NO: 1730449 - DNA, 23 bp, Homo sapiens
tgccaacatgaggacagaaggac

SEQ ID NO: 1730450 - DNA, 16 bp, Homo sapiens
tgccaaccctgggcta

SEQ ID NO: 1730451 - DNA, 16 bp, Homo sapiens
tgccaactaagccctc

SEQ ID NO: 1730452 - DNA, 18 bp, Homo sapiens
tgccaactaagccctcga

SEQ ID NO: 1730453 - DNA, 22 bp, Homo sapiens
tgccaagaacagaaaacaagaa

SEQ ID NO: 1730454 - DNA, 15 bp, Homo sapiens
tgccaagacattaat

SEQ ID NO: 1730455 - DNA, 17 bp, Homo sapiens
tgccaagagtgaaggga

SEQ ID NO: 1730456 - DNA, 19 bp, Homo sapiens
tgccaagattctactcttg

SEQ ID NO: 1730457 - DNA, 22 bp, Homo sapiens
tgccaagattctactcttgtca

SEQ ID NO: 1730458 - DNA, 15 bp, Homo sapiens
tgccaagcagtgcac

SEQ ID NO: 1730459 - DNA, 12 bp, Homo sapiens
tgccaagccaga

SEQ ID NO: 1730460 - DNA, 16 bp, Homo sapiens
tgaccatgctcatctg

SEQ ID NO: 1730461 - DNA, 19 bp, Homo sapiens
tgaccatgctcatctgctg

SEQ ID NO: 1730462 - DNA, 12 bp, Homo sapiens
tgaccatgtact

SEQ ID NO: 1730463 - DNA, 22 bp, Homo sapiens
tgaccattctcaccctgtgaaa

SEQ ID NO: 1730464 - DNA, 23 bp, Homo sapiens
tgaccattctcaccctgtgaaac

SEQ ID NO: 1730465 - DNA, 19 bp, Homo sapiens
tgaccattgagtccctgct

SEQ ID NO: 1730466 - DNA, 14 bp, Homo sapiens
tgaccatttataat

SEQ ID NO: 1730467 - DNA, 12 bp, Homo sapiens
tgaccatttttt

SEQ ID NO: 1730468 - DNA, 15 bp, Homo sapiens
tgacccaactgatcc

SEQ ID NO: 1730469 - DNA, 17 bp, Homo sapiens
tgacccaactgatcctg

SEQ ID NO: 1730470 - DNA, 21 bp, Homo sapiens
tgacccaactgatcctgctcc

SEQ ID NO: 1730471 - DNA, 17 bp, Homo sapiens
tgacccaagtggggcct

SEQ ID NO: 1730472 - DNA, 12 bp, Homo sapiens
tgacccaccagt

SEQ ID NO: 1730473 - DNA, 15 bp, Homo sapiens
tgacccaccagtgcc

SEQ ID NO: 1730474 - DNA, 11 bp, Homo sapiens
tgacccacccc

SEQ ID NO: 1730475 - DNA, 12 bp, Homo sapiens
tgacccacccct

SEQ ID NO: 1730476 - DNA, 13 bp, Homo sapiens
tgacccacccctg

SEQ ID NO: 1730477 - DNA, 16 bp, Homo sapiens
tgacccacccctgtgc

SEQ ID NO: 1730478 - DNA, 20 bp, Homo sapiens
tgacccactgatctctacta

SEQ ID NO: 1730479 - DNA, 22 bp, Homo sapiens
tgacccagagccaccaaagtca

SEQ ID NO: 1730480 - DNA, 18 bp, Homo sapiens
tgacccagagtggagtct

SEQ ID NO: 1730481 - DNA, 22 bp, Homo sapiens
tgacccagagtggagtctgagt

SEQ ID NO: 1730482 - DNA, 13 bp, Homo sapiens
tgacccaggccgc

SEQ ID NO: 1730483 - DNA, 14 bp, Homo sapiens
tgacccaggccgca

SEQ ID NO: 1730484 - DNA, 12 bp, Homo sapiens
tgacccaggctg

SEQ ID NO: 1730485 - DNA, 14 bp, Homo sapiens
tgacccatctgtag

SEQ ID NO: 1730486 - DNA, 15 bp, Homo sapiens
tgacccatctgtagt

SEQ ID NO: 1730487 - DNA, 15 bp, Homo sapiens
tgaccccctcccctg

SEQ ID NO: 1730488 - DNA, 22 bp, Homo sapiens
tgaccccgacgccacagcccag

SEQ ID NO: 1730489 - DNA, 17 bp, Homo sapiens
tgaccccgagaagtgct

SEQ ID NO: 1730490 - DNA, 13 bp, Homo sapiens
tgacccctctggt

SEQ ID NO: 1730491 - DNA, 16 bp, Homo sapiens
tgacccggaggaaagg

SEQ ID NO: 1730492 - DNA, 22 bp, Homo sapiens
tgaccctgaaaggaacactggc

SEQ ID NO: 1730493 - DNA, 15 bp, Homo sapiens
tgacccttcagggcc

SEQ ID NO: 1730494 - DNA, 20 bp, Homo sapiens
tgacccttctacatttgagg

SEQ ID NO: 1730495 - DNA, 14 bp, Homo sapiens
tgacccttgtcatc

SEQ ID NO: 1730496 - DNA, 15 bp, Homo sapiens
tgacccttgtcatct

SEQ ID NO: 1730497 - DNA, 18 bp, Homo sapiens
tgaccgactaccccagtc

SEQ ID NO: 1730498 - DNA, 16 bp, Homo sapiens
tgaccggacttttctg

SEQ ID NO: 1730499 - DNA, 19 bp, Homo sapiens
tgacctaaatccattttct

SEQ ID NO: 1730500 - DNA, 17 bp, Homo sapiens
tgacctaaattatttac

SEQ ID NO: 1730501 - DNA, 21 bp, Homo sapiens
tgacctaagtcaggtaatata

SEQ ID NO: 1730502 - DNA, 22 bp, Homo sapiens
tgacctaccccagccaggctcc

SEQ ID NO: 1730503 - DNA, 21 bp, Homo sapiens
tgacctacctcaaagggcagt

SEQ ID NO: 1730504 - DNA, 19 bp, Homo sapiens
tgacctaggcaagtttgtt

SEQ ID NO: 1730505 - DNA, 17 bp, Homo sapiens
tgacctagttttccatg

SEQ ID NO: 1730506 - DNA, 22 bp, Homo sapiens
tgacctagttttccatgcgtgt

SEQ ID NO: 1730507 - DNA, 13 bp, Homo sapiens
tgacctattcacc

SEQ ID NO: 1730508 - DNA, 21 bp, Homo sapiens
tgacctattcaccctccactt

SEQ ID NO: 1730509 - DNA, 20 bp, Homo sapiens
tgacctcaagtgatctgccc

SEQ ID NO: 1730510 - DNA, 19 bp, Homo sapiens
tgacctcacctggtcctcc

SEQ ID NO: 1730511 - DNA, 15 bp, Homo sapiens
tgacctcactgtcct

SEQ ID NO: 1730512 - DNA, 16 bp, Homo sapiens
tgacctcagctgcaca

SEQ ID NO: 1730513 - DNA, 21 bp, Homo sapiens
tgacctcagctgcacattcct

SEQ ID NO: 1730514 - DNA, 19 bp, Homo sapiens
tgacctccgccatccaccc

SEQ ID NO: 1730515 - DNA, 18 bp, Homo sapiens
tgacctccgcccctgccc

SEQ ID NO: 1730516 - DNA, 23 bp, Homo sapiens
tgacctccgcccctgcccccgct

SEQ ID NO: 1730517 - DNA, 20 bp, Homo sapiens
tgacctctctctctgggact

SEQ ID NO: 1730518 - DNA, 18 bp, Homo sapiens
tgacctctgttgtcctcc

SEQ ID NO: 1730519 - DNA, 22 bp, Homo sapiens
tgacctctgttgtcctcccctt

SEQ ID NO: 1730520 - DNA, 17 bp, Homo sapiens
tgacctgagatgtgtga

SEQ ID NO: 1730521 - DNA, 16 bp, Homo sapiens
tgacctgatgtaaaca

SEQ ID NO: 1730522 - DNA, 20 bp, Homo sapiens
tgacctgcaggccaagagca

SEQ ID NO: 1730523 - DNA, 19 bp, Homo sapiens
tgacctgccccgcccagct

SEQ ID NO: 1730524 - DNA, 20 bp, Homo sapiens
tgacctgcctctcacacaca

SEQ ID NO: 1730525 - DNA, 22 bp, Homo sapiens
tgacctgggtatcccctgcctc

SEQ ID NO: 1730526 - DNA, 15 bp, Homo sapiens
tgacctgtcatgccc

SEQ ID NO: 1730527 - DNA, 16 bp, Homo sapiens
tgacctgtcatgcccc

SEQ ID NO: 1730528 - DNA, 19 bp, Homo sapiens
tgacctgtcatgcccccct

SEQ ID NO: 1730529 - DNA, 22 bp, Homo sapiens
tgacctgtgaccagcactgtct

SEQ ID NO: 1730530 - DNA, 15 bp, Homo sapiens
tgacctgtgtcacta

SEQ ID NO: 1730531 - DNA, 17 bp, Homo sapiens
tgaccttggagagacac

SEQ ID NO: 1730532 - DNA, 22 bp, Homo sapiens
tgacctttcatcgtaaagtgct

SEQ ID NO: 1730533 - DNA, 20 bp, Homo sapiens
tgaccttttgacttaaagca

SEQ ID NO: 1730534 - DNA, 12 bp, Homo sapiens
tgacgaactggc

SEQ ID NO: 1730535 - DNA, 13 bp, Homo sapiens
tgacgaactggct

SEQ ID NO: 1730536 - DNA, 14 bp, Homo sapiens
tgacgaactggcta

SEQ ID NO: 1730537 - DNA, 13 bp, Homo sapiens
tgacgaggctcaa

SEQ ID NO: 1730538 - DNA, 14 bp, Homo sapiens
tgacgcccagctcc

SEQ ID NO: 1730539 - DNA, 13 bp, Homo sapiens
tgacgcttccctt

SEQ ID NO: 1730540 - DNA, 16 bp, Homo sapiens
tgacgcttgtgacagt

SEQ ID NO: 1730541 - DNA, 18 bp, Homo sapiens
tgacggaagaacatagaa

SEQ ID NO: 1730542 - DNA, 19 bp, Homo sapiens
tgacggatgattggattat

SEQ ID NO: 1730543 - DNA, 15 bp, Homo sapiens
tgacggcgcccccag

SEQ ID NO: 1730544 - DNA, 19 bp, Homo sapiens
tgacggcgcccccagtgtg

SEQ ID NO: 1730545 - DNA, 17 bp, Homo sapiens
tgacggtaagtgttctc

SEQ ID NO: 1730546 - DNA, 23 bp, Homo sapiens
tgacgtcagtagtttgagaccag

SEQ ID NO: 1730547 - DNA, 14 bp, Homo sapiens
tgacgtctgaagct

SEQ ID NO: 1730548 - DNA, 24 bp, Homo sapiens
tgacgtgaccggacttttctgcaa

SEQ ID NO: 1730549 - DNA, 19 bp, Homo sapiens
tgacgtgcacctgtactca

SEQ ID NO: 1730550 - DNA, 23 bp, Homo sapiens
tgacgtgcactgtgaatcctggc

SEQ ID NO: 1730551 - DNA, 19 bp, Homo sapiens
tgacgtgccttttgcaccc

SEQ ID NO: 1730552 - DNA, 22 bp, Homo sapiens
tgacgtgccttttgcacccctc

SEQ ID NO: 1730553 - DNA, 17 bp, Homo sapiens
tgacgtgtgtggctggg

SEQ ID NO: 1730554 - DNA, 13 bp, Homo sapiens
tgacgtttctggg

SEQ ID NO: 1730555 - DNA, 15 bp, Homo sapiens
tgactaaaaaacaaa

SEQ ID NO: 1730556 - DNA, 12 bp, Homo sapiens
tgactaaacttt

SEQ ID NO: 1730557 - DNA, 19 bp, Homo sapiens
tgactaaactttttttctg

SEQ ID NO: 1730558 - DNA, 14 bp, Homo sapiens
tgactaaagctatg

SEQ ID NO: 1730559 - DNA, 18 bp, Homo sapiens
tgactaaattcgtgattt

SEQ ID NO: 1730560 - DNA, 21 bp, Homo sapiens
tgactaacaggccaaagagtc

SEQ ID NO: 1730561 - DNA, 15 bp, Homo sapiens
tgactaattttacat

SEQ ID NO: 1730562 - DNA, 13 bp, Homo sapiens
tgactacattttg

SEQ ID NO: 1730563 - DNA, 17 bp, Homo sapiens
tgactacattttgaggt

SEQ ID NO: 1730564 - DNA, 17 bp, Homo sapiens
tgactagaggcagggag

SEQ ID NO: 1730565 - DNA, 16 bp, Homo sapiens
ccctggggctgagtct

SEQ ID NO: 1730566 - DNA, 20 bp, Homo sapiens
ccctggggctgatctcaggg

SEQ ID NO: 1730567 - DNA, 15 bp, Homo sapiens
ccctggggcttctcc

SEQ ID NO: 1730568 - DNA, 18 bp, Homo sapiens
ccctggggcttctcctga

SEQ ID NO: 1730569 - DNA, 19 bp, Homo sapiens
ccctggggcttctcctgac

SEQ ID NO: 1730570 - DNA, 17 bp, Homo sapiens
ccctgggggaagccctg

SEQ ID NO: 1730571 - DNA, 20 bp, Homo sapiens
ccctgggggaagccctggat

SEQ ID NO: 1730572 - DNA, 23 bp, Homo sapiens
ccctggggtggcgtctgcctagg

SEQ ID NO: 1730573 - DNA, 20 bp, Homo sapiens
ccctggggtgggatctgagc

SEQ ID NO: 1730574 - DNA, 13 bp, Homo sapiens
ccctgggtgccat

SEQ ID NO: 1730575 - DNA, 16 bp, Homo sapiens
ccctgggtgggtggtg

SEQ ID NO: 1730576 - DNA, 19 bp, Homo sapiens
ccctgggttaacaaatgag

SEQ ID NO: 1730577 - DNA, 23 bp, Homo sapiens
ccctgggttcttccacagcacaa

SEQ ID NO: 1730578 - DNA, 23 bp, Homo sapiens
ccctggtaataagtactgtgtac

SEQ ID NO: 1730579 - DNA, 14 bp, Homo sapiens
tgactcacccaagc

SEQ ID NO: 1730580 - DNA, 18 bp, Homo sapiens
tgactcacttatcccaag

SEQ ID NO: 1730581 - DNA, 14 bp, Homo sapiens
tgactcatccccac

SEQ ID NO: 1730582 - DNA, 18 bp, Homo sapiens
tgactcatccccacagct

SEQ ID NO: 1730583 - DNA, 20 bp, Homo sapiens
tgactcatggcagctgtttc

SEQ ID NO: 1730584 - DNA, 23 bp, Homo sapiens
tgactcatggcagctgtttctca

SEQ ID NO: 1730585 - DNA, 15 bp, Homo sapiens
tgactccagagtctg

SEQ ID NO: 1730586 - DNA, 17 bp, Homo sapiens
tgactcctgctggtacc

SEQ ID NO: 1730587 - DNA, 19 bp, Homo sapiens
tgactcctgttgccatgga

SEQ ID NO: 1730588 - DNA, 16 bp, Homo sapiens
tgactcgggggtgggg

SEQ ID NO: 1730589 - DNA, 18 bp, Homo sapiens
tgactcgggggtggggaa

SEQ ID NO: 1730590 - DNA, 15 bp, Homo sapiens
tgactcggtttctcc

SEQ ID NO: 1730591 - DNA, 18 bp, Homo sapiens
tgactcggtttctccaaa

SEQ ID NO: 1730592 - DNA, 15 bp, Homo sapiens
tgactcgttacctgc

SEQ ID NO: 1730593 - DNA, 16 bp, Homo sapiens
tgactcgttacctgcc

SEQ ID NO: 1730594 - DNA, 17 bp, Homo sapiens
tgactcgttacctgccg

SEQ ID NO: 1730595 - DNA, 17 bp, Homo sapiens
tgactctagcaaggctc

SEQ ID NO: 1730596 - DNA, 21 bp, Homo sapiens
tgactctataagcaaattgct

SEQ ID NO: 1730597 - DNA, 16 bp, Homo sapiens
tgactctcacactgaa

SEQ ID NO: 1730598 - DNA, 16 bp, Homo sapiens
tgactctcacctgtac

SEQ ID NO: 1730599 - DNA, 11 bp, Homo sapiens
tgactctgaaa

SEQ ID NO: 1730600 - DNA, 15 bp, Homo sapiens
tgactctgaaatctg

SEQ ID NO: 1730601 - DNA, 22 bp, Homo sapiens
tgactgaaaaaaaaaaagaaga

SEQ ID NO: 1730602 - DNA, 22 bp, Homo sapiens
tgactgaacattagttgcacta

SEQ ID NO: 1730603 - DNA, 14 bp, Homo sapiens
tgactgaggcctgc

SEQ ID NO: 1730604 - DNA, 23 bp, Homo sapiens
tgactgatagcttacactgagga

SEQ ID NO: 1730605 - DNA, 22 bp, Homo sapiens
tgactgcaccagcgcccccaga

SEQ ID NO: 1730606 - DNA, 21 bp, Homo sapiens
tgactgccaagccagattctc

SEQ ID NO: 1730607 - DNA, 18 bp, Homo sapiens
tgactggaagttgtggat

SEQ ID NO: 1730608 - DNA, 12 bp, Homo sapiens
tgactggcaggt

SEQ ID NO: 1730609 - DNA, 21 bp, Homo sapiens
tgactggcaggtgcagatggg

SEQ ID NO: 1730610 - DNA, 24 bp, Homo sapiens
tgactggcaggtgcagatgggctg

SEQ ID NO: 1730611 - DNA, 20 bp, Homo sapiens
tgactggccaaacccttgct

SEQ ID NO: 1730612 - DNA, 19 bp, Homo sapiens
tgactggctgtctgcctgt

SEQ ID NO: 1730613 - DNA, 17 bp, Homo sapiens
tgactgggtgagaccca

SEQ ID NO: 1730614 - DNA, 15 bp, Homo sapiens
tgactggtgctgcag

SEQ ID NO: 1730615 - DNA, 15 bp, Homo sapiens
tgactgtatctgtgt

SEQ ID NO: 1730616 - DNA, 17 bp, Homo sapiens
tgactgtatctgtgtag

SEQ ID NO: 1730617 - DNA, 16 bp, Homo sapiens
tgactgtatggcactc

SEQ ID NO: 1730618 - DNA, 13 bp, Homo sapiens
tgactgtcactgt

SEQ ID NO: 1730619 - DNA, 17 bp, Homo sapiens
tgactgtcactgttcct

SEQ ID NO: 1730620 - DNA, 16 bp, Homo sapiens
tgactgtccaggagct

SEQ ID NO: 1730621 - DNA, 14 bp, Homo sapiens
tgactgtctttcct

SEQ ID NO: 1730622 - DNA, 13 bp, Homo sapiens
tgactgtgattta

SEQ ID NO: 1730623 - DNA, 21 bp, Homo sapiens
tgactgtgtaactttctctta

SEQ ID NO: 1730624 - DNA, 17 bp, Homo sapiens
tgactgtttatttaagg

SEQ ID NO: 1730625 - DNA, 16 bp, Homo sapiens
tgacttaactgcattt

SEQ ID NO: 1730626 - DNA, 21 bp, Homo sapiens
tgacttaactttaacttttga

SEQ ID NO: 1730627 - DNA, 21 bp, Homo sapiens
tgacttagaggcaacaggatt

SEQ ID NO: 1730628 - DNA, 20 bp, Homo sapiens
tgacttagcgtcaagacatt

SEQ ID NO: 1730629 - DNA, 21 bp, Homo sapiens
tgacttagcgtcaagacattt

SEQ ID NO: 1730630 - DNA, 23 bp, Homo sapiens
tgacttagcgtcaagacatttgc

SEQ ID NO: 1730631 - DNA, 13 bp, Homo sapiens
tgacttatttctg

SEQ ID NO: 1730632 - DNA, 14 bp, Homo sapiens
tgacttatttctgc

SEQ ID NO: 1730633 - DNA, 17 bp, Homo sapiens
tgacttcaatgatagta

SEQ ID NO: 1730634 - DNA, 17 bp, Homo sapiens
tgacttcactgtatata

SEQ ID NO: 1730635 - DNA, 21 bp, Homo sapiens
tgacttcatgctatatatctt

SEQ ID NO: 1730636 - DNA, 15 bp, Homo sapiens
tgacttctaagtaaa

SEQ ID NO: 1730637 - DNA, 18 bp, Homo sapiens
tgacttctcccctgccct

SEQ ID NO: 1730638 - DNA, 13 bp, Homo sapiens
tgacttctgagat

SEQ ID NO: 1730639 - DNA, 22 bp, Homo sapiens
tgacttgaaaagaaagaaacca

SEQ ID NO: 1730640 - DNA, 18 bp, Homo sapiens
tgacttgcgcttaatcca

SEQ ID NO: 1730641 - DNA, 19 bp, Homo sapiens
tgacttgctgtccaggcag

SEQ ID NO: 1730642 - DNA, 15 bp, Homo sapiens
tgacttgctgtgtga

SEQ ID NO: 1730643 - DNA, 12 bp, Homo sapiens
tgacttgcttta

SEQ ID NO: 1730644 - DNA, 23 bp, Homo sapiens
tgacttgtacaaacagtatttct

SEQ ID NO: 1730645 - DNA, 18 bp, Homo sapiens
tgacttgtttgtcttcca

SEQ ID NO: 1730646 - DNA, 14 bp, Homo sapiens
tgactttacaggag

SEQ ID NO: 1730647 - DNA, 22 bp, Homo sapiens
tgactttacgcccatctcagga

SEQ ID NO: 1730648 - DNA, 23 bp, Homo sapiens
tgactttatgttgtatgattcca

SEQ ID NO: 1730649 - DNA, 13 bp, Homo sapiens
tgactttgcttgc

SEQ ID NO: 1730650 - DNA, 17 bp, Homo sapiens
tgacttttataaagcat

SEQ ID NO: 1730651 - DNA, 18 bp, Homo sapiens
tgacttttataaagcatg

SEQ ID NO: 1730652 - DNA, 23 bp, Homo sapiens
tgacttttcaagtatttaagcct

SEQ ID NO: 1730653 - DNA, 16 bp, Homo sapiens
tgacttttgctttaat

SEQ ID NO: 1730654 - DNA, 17 bp, Homo sapiens
tgacttttgttaaattc

SEQ ID NO: 1730655 - DNA, 14 bp, Homo sapiens
tgactttttataaa

SEQ ID NO: 1730656 - DNA, 22 bp, Homo sapiens
tgactttttctgagcttttcat

SEQ ID NO: 1730657 - DNA, 17 bp, Homo sapiens
tgactttttttgtatgt

SEQ ID NO: 1730658 - DNA, 20 bp, Homo sapiens
tgagaaaagttcaatactct

SEQ ID NO: 1730659 - DNA, 20 bp, Homo sapiens
tgagaaacagctcagccagt

SEQ ID NO: 1730660 - DNA, 18 bp, Homo sapiens
tgagaaacttaaatgtta

SEQ ID NO: 1730661 - DNA, 18 bp, Homo sapiens
tgagaaagaataggggct

SEQ ID NO: 1730662 - DNA, 17 bp, Homo sapiens
tgagaaagactattcaa

SEQ ID NO: 1730663 - DNA, 18 bp, Homo sapiens
tgagaaagactattcaaa

SEQ ID NO: 1730664 - DNA, 16 bp, Homo sapiens
tgagaaaggacagagc

SEQ ID NO: 1730665 - DNA, 20 bp, Homo sapiens
tgagaaaggacagagccagc

SEQ ID NO: 1730666 - DNA, 12 bp, Homo sapiens
tgagaaatgcat

SEQ ID NO: 1730667 - DNA, 20 bp, Homo sapiens
tgagaacaagtcacagctgc

SEQ ID NO: 1730668 - DNA, 21 bp, Homo sapiens
tgagaacaagtcacagctgca

SEQ ID NO: 1730669 - DNA, 19 bp, Homo sapiens
tgagaacacgttgccaggg

SEQ ID NO: 1730670 - DNA, 18 bp, Homo sapiens
tgagaacagataaagatt

SEQ ID NO: 1730671 - DNA, 17 bp, Homo sapiens
tgagaaccttttcaaac

SEQ ID NO: 1730672 - DNA, 23 bp, Homo sapiens
tgagaactctctccctggtctct

SEQ ID NO: 1730673 - DNA, 17 bp, Homo sapiens
tgagaactgcttctaag

SEQ ID NO: 1730674 - DNA, 14 bp, Homo sapiens
tgagaagaaaaatg

SEQ ID NO: 1730675 - DNA, 20 bp, Homo sapiens
tgagaagaaaaatggaaaaa

SEQ ID NO: 1730676 - DNA, 14 bp, Homo sapiens
tgagaagaaaacat

SEQ ID NO: 1730677 - DNA, 17 bp, Homo sapiens
tgagaagaaaacatcta

SEQ ID NO: 1730678 - DNA, 19 bp, Homo sapiens
tgagaagagcttgcacagc

SEQ ID NO: 1730679 - DNA, 12 bp, Homo sapiens
cccttcagggcc

SEQ ID NO: 1730680 - DNA, 19 bp, Homo sapiens
cccttcagggccagaagga

SEQ ID NO: 1730681 - DNA, 21 bp, Homo sapiens
cccttcagtaccctctcagct

SEQ ID NO: 1730682 - DNA, 13 bp, Homo sapiens
cccttcagtctgc

SEQ ID NO: 1730683 - DNA, 15 bp, Homo sapiens
cccttcagtctgctc

SEQ ID NO: 1730684 - DNA, 19 bp, Homo sapiens
cccttcagtctgctccacc

SEQ ID NO: 1730685 - DNA, 20 bp, Homo sapiens
cccttcagtctgctccacca

SEQ ID NO: 1730686 - DNA, 13 bp, Homo sapiens
cccttcagtgccc

SEQ ID NO: 1730687 - DNA, 19 bp, Homo sapiens
cccttcagtgctacatttt

SEQ ID NO: 1730688 - DNA, 15 bp, Homo sapiens
cccttcatctccagg

SEQ ID NO: 1730689 - DNA, 18 bp, Homo sapiens
cccttcatctccagggag

SEQ ID NO: 1730690 - DNA, 17 bp, Homo sapiens
cccttcatcttcctgtg

SEQ ID NO: 1730691 - DNA, 20 bp, Homo sapiens
cccttcatcttcctgtgtcc

SEQ ID NO: 1730692 - DNA, 12 bp, Homo sapiens
cccttccaaaga

SEQ ID NO: 1730693 - DNA, 18 bp, Homo sapiens
cccttccacctcctagag

SEQ ID NO: 1730694 - DNA, 13 bp, Homo sapiens
cccttccagacat

SEQ ID NO: 1730695 - DNA, 13 bp, Homo sapiens
cccttccagatca

SEQ ID NO: 1730696 - DNA, 14 bp, Homo sapiens
cccttccaggtggg

SEQ ID NO: 1730697 - DNA, 16 bp, Homo sapiens
cccttccaggtgggtg

SEQ ID NO: 1730698 - DNA, 19 bp, Homo sapiens
tgagaatataccttattta

SEQ ID NO: 1730699 - DNA, 16 bp, Homo sapiens
tgagaatcacggtggt

SEQ ID NO: 1730700 - DNA, 17 bp, Homo sapiens
tgagaatcagatcattt

SEQ ID NO: 1730701 - DNA, 15 bp, Homo sapiens
tgagaatcctctcct

SEQ ID NO: 1730702 - DNA, 21 bp, Homo sapiens
tgagaatcctctcctttctta

SEQ ID NO: 1730703 - DNA, 18 bp, Homo sapiens
tgagaatctatatttaac

SEQ ID NO: 1730704 - DNA, 20 bp, Homo sapiens
tgagaatgctagcaggctgt

SEQ ID NO: 1730705 - DNA, 16 bp, Homo sapiens
tgagaattaagtttta

SEQ ID NO: 1730706 - DNA, 20 bp, Homo sapiens
tgagaattttatattctaag

SEQ ID NO: 1730707 - DNA, 13 bp, Homo sapiens
tgagacaagccct

SEQ ID NO: 1730708 - DNA, 20 bp, Homo sapiens
tgagacaagccctggcaaca

SEQ ID NO: 1730709 - DNA, 13 bp, Homo sapiens
tgagacactgaag

SEQ ID NO: 1730710 - DNA, 18 bp, Homo sapiens
tgagacagccacttggtt

SEQ ID NO: 1730711 - DNA, 12 bp, Homo sapiens
tgagacatccag

SEQ ID NO: 1730712 - DNA, 13 bp, Homo sapiens
tgagacatccagc

SEQ ID NO: 1730713 - DNA, 18 bp, Homo sapiens
tgagaccaggctgggcat

SEQ ID NO: 1730714 - DNA, 23 bp, Homo sapiens
tgagaccagttgggagcactgga

SEQ ID NO: 1730715 - DNA, 18 bp, Homo sapiens
tgagacccccaagcttcc

SEQ ID NO: 1730716 - DNA, 15 bp, Homo sapiens
tgagaccctactgaa

SEQ ID NO: 1730717 - DNA, 12 bp, Homo sapiens
tgagaccctgtc

SEQ ID NO: 1730718 - DNA, 11 bp, Homo sapiens
tgagacctcaa

SEQ ID NO: 1730719 - DNA, 13 bp, Homo sapiens
tgagacctcagcc

SEQ ID NO: 1730720 - DNA, 17 bp, Homo sapiens
tgagacctcagccatga

SEQ ID NO: 1730721 - DNA, 19 bp, Homo sapiens
tgagacctcagccatgagg

SEQ ID NO: 1730722 - DNA, 20 bp, Homo sapiens
tgagacctcgccggccttgt

SEQ ID NO: 1730723 - DNA, 19 bp, Homo sapiens
tgagactaaattcaatcac

SEQ ID NO: 1730724 - DNA, 21 bp, Homo sapiens
tgagactcaaaggtgatgtaa

SEQ ID NO: 1730725 - DNA, 15 bp, Homo sapiens
tgagactcagtgcag

SEQ ID NO: 1730726 - DNA, 17 bp, Homo sapiens
tgagactcgagaacttt

SEQ ID NO: 1730727 - DNA, 15 bp, Homo sapiens
tgagacttaaaacat

SEQ ID NO: 1730728 - DNA, 17 bp, Homo sapiens
tgagacttaaaacatgg

SEQ ID NO: 1730729 - DNA, 12 bp, Homo sapiens
tgagacttccaa

SEQ ID NO: 1730730 - DNA, 23 bp, Homo sapiens
tgagagaaagagagaagccagcc

SEQ ID NO: 1730731 - DNA, 16 bp, Homo sapiens
tgagagaatggagaca

SEQ ID NO: 1730732 - DNA, 19 bp, Homo sapiens
tgagagaattgtatcattt

SEQ ID NO: 1730733 - DNA, 20 bp, Homo sapiens
tgagagacccaaggaggaaa

SEQ ID NO: 1730734 - DNA, 17 bp, Homo sapiens
tgagagacctctgccta

SEQ ID NO: 1730735 - DNA, 15 bp, Homo sapiens
tgagagacctgtgtg

SEQ ID NO: 1730736 - DNA, 16 bp, Homo sapiens
tgagagacctgtgtga

SEQ ID NO: 1730737 - DNA, 21 bp, Homo sapiens
tgagagacctgtgtgaactat

SEQ ID NO: 1730738 - DNA, 14 bp, Homo sapiens
tgagagactgccat

SEQ ID NO: 1730739 - DNA, 22 bp, Homo sapiens
tgagagactgccatacataata

SEQ ID NO: 1730740 - DNA, 19 bp, Homo sapiens
tgagagagaatagagctgc

SEQ ID NO: 1730741 - DNA, 20 bp, Homo sapiens
tgagagagaatagagctgcc

SEQ ID NO: 1730742 - DNA, 21 bp, Homo sapiens
tgagagagaatagagctgcca

SEQ ID NO: 1730743 - DNA, 19 bp, Homo sapiens
tgagagccagatgcctccc

SEQ ID NO: 1730744 - DNA, 14 bp, Homo sapiens
tgagagccagcagc

SEQ ID NO: 1730745 - DNA, 19 bp, Homo sapiens
tgagagccctgctgtggga

SEQ ID NO: 1730746 - DNA, 15 bp, Homo sapiens
tgagagcgacacaga

SEQ ID NO: 1730747 - DNA, 16 bp, Homo sapiens
tgagagctcaggcagc

SEQ ID NO: 1730748 - DNA, 14 bp, Homo sapiens
tgagaggcaggcat

SEQ ID NO: 1730749 - DNA, 21 bp, Homo sapiens
tgagaggcctggagcccacaa

SEQ ID NO: 1730750 - DNA, 11 bp, Homo sapiens
tgagagggcaa

SEQ ID NO: 1730751 - DNA, 16 bp, Homo sapiens
tgagagtcaaagctga

SEQ ID NO: 1730752 - DNA, 16 bp, Homo sapiens
tgagagtcagctctct

SEQ ID NO: 1730753 - DNA, 22 bp, Homo sapiens
tgagagtcagctctctgccctg

SEQ ID NO: 1730754 - DNA, 17 bp, Homo sapiens
tgagagtctagattctc

SEQ ID NO: 1730755 - DNA, 16 bp, Homo sapiens
tgagagttccttctca

SEQ ID NO: 1730756 - DNA, 14 bp, Homo sapiens
tgagagttggctca

SEQ ID NO: 1730757 - DNA, 19 bp, Homo sapiens
tgagagttggctcaggcag

SEQ ID NO: 1730758 - DNA, 20 bp, Homo sapiens
tgagagttggctcaggcaga

SEQ ID NO: 1730759 - DNA, 14 bp, Homo sapiens
tgagataaggtttt

SEQ ID NO: 1730760 - DNA, 17 bp, Homo sapiens
tgagataatatctgtga

SEQ ID NO: 1730761 - DNA, 18 bp, Homo sapiens
tgagataatatctgtgag

SEQ ID NO: 1730762 - DNA, 17 bp, Homo sapiens
tgagataatgatactta

SEQ ID NO: 1730763 - DNA, 16 bp, Homo sapiens
tgagatacgtctgtga

SEQ ID NO: 1730764 - DNA, 20 bp, Homo sapiens
tgagatcagcattcaaaata

SEQ ID NO: 1730765 - DNA, 22 bp, Homo sapiens
tgagatccttcacaggcagtgc

SEQ ID NO: 1730766 - DNA, 20 bp, Homo sapiens
tgagatcgtgctactgcact

SEQ ID NO: 1730767 - DNA, 23 bp, Homo sapiens
tgagatcgtgctactgcactcca

SEQ ID NO: 1730768 - DNA, 23 bp, Homo sapiens
tgagatctaaaaataactgtaat

SEQ ID NO: 1730769 - DNA, 20 bp, Homo sapiens
tgagatctaagcctttccat

SEQ ID NO: 1730770 - DNA, 14 bp, Homo sapiens
tgagatctgcacag

SEQ ID NO: 1730771 - DNA, 16 bp, Homo sapiens
tgagatctggggaggc

SEQ ID NO: 1730772 - DNA, 22 bp, Homo sapiens
tgagatgagccccacgtggagc

SEQ ID NO: 1730773 - DNA, 22 bp, Homo sapiens
tgagatgcgttgttacaggaag

SEQ ID NO: 1730774 - DNA, 13 bp, Homo sapiens
tgagatgctggtt

SEQ ID NO: 1730775 - DNA, 21 bp, Homo sapiens
tgagatggaaaagtgtccttc

SEQ ID NO: 1730776 - DNA, 14 bp, Homo sapiens
tgagatgggaaagc

SEQ ID NO: 1730777 - DNA, 17 bp, Homo sapiens
tgagatggtatgaaata

SEQ ID NO: 1730778 - DNA, 19 bp, Homo sapiens
tgagatggttaaaaaggcc

SEQ ID NO: 1730779 - DNA, 22 bp, Homo sapiens
tgagatggttaaaaaggccaaa

SEQ ID NO: 1730780 - DNA, 22 bp, Homo sapiens
tgagatgtgctttgctgcacaa

SEQ ID NO: 1730781 - DNA, 22 bp, Homo sapiens
tgagattctcaaaggagcgagc

SEQ ID NO: 1730782 - DNA, 13 bp, Homo sapiens
tgagattctttaa

SEQ ID NO: 1730783 - DNA, 15 bp, Homo sapiens
tgagattctttaagg

SEQ ID NO: 1730784 - DNA, 16 bp, Homo sapiens
tgagattctttaagga

SEQ ID NO: 1730785 - DNA, 20 bp, Homo sapiens
tgagattctttaaggagata

SEQ ID NO: 1730786 - DNA, 17 bp, Homo sapiens
tgagattggcatggctt

SEQ ID NO: 1730787 - DNA, 18 bp, Homo sapiens
tgagattgtgtttgttca

SEQ ID NO: 1730788 - DNA, 19 bp, Homo sapiens
tgagatttcatctgctctc

SEQ ID NO: 1730789 - DNA, 21 bp, Homo sapiens
tgagatttcatctgctctcct

SEQ ID NO: 1730790 - DNA, 15 bp, Homo sapiens
tgagatttgccagca

SEQ ID NO: 1730791 - DNA, 20 bp, Homo sapiens
tgagatttgccagcacaggg

SEQ ID NO: 1730792 - DNA, 19 bp, Homo sapiens
tgagattttcctccatttt

SEQ ID NO: 1730793 - DNA, 19 bp, Homo sapiens
tgagcaagactctttcaaa

SEQ ID NO: 1730794 - DNA, 16 bp, Homo sapiens
tgagcttgagctcccc

SEQ ID NO: 1730795 - DNA, 24 bp, Homo sapiens
tgagcttgagctcccctggagcca

SEQ ID NO: 1730796 - DNA, 21 bp, Homo sapiens
tgagctttccatgttgctgcc

SEQ ID NO: 1730797 - DNA, 22 bp, Homo sapiens
tgagctttccatgttgctgcca

SEQ ID NO: 1730798 - DNA, 20 bp, Homo sapiens
tgagctttgaagtaggtggc

SEQ ID NO: 1730799 - DNA, 14 bp, Homo sapiens
tgagctttgctgct

SEQ ID NO: 1730800 - DNA, 16 bp, Homo sapiens
tgagctttgctgctac

SEQ ID NO: 1730801 - DNA, 23 bp, Homo sapiens
tgagctttggggacagttggcag

SEQ ID NO: 1730802 - DNA, 17 bp, Homo sapiens
tgagcttttcatggaag

SEQ ID NO: 1730803 - DNA, 20 bp, Homo sapiens
tgaggaaaaaatggtataaa

SEQ ID NO: 1730804 - DNA, 22 bp, Homo sapiens
tgaggaaaaaatggtataaaag

SEQ ID NO: 1730805 - DNA, 15 bp, Homo sapiens
tgaggaaaattctta

SEQ ID NO: 1730806 - DNA, 11 bp, Homo sapiens
tgaggaaatgt

SEQ ID NO: 1730807 - DNA, 12 bp, Homo sapiens
tgaggaaatgtg

SEQ ID NO: 1730808 - DNA, 16 bp, Homo sapiens
tgaggaaatttgcagc

SEQ ID NO: 1730809 - DNA, 19 bp, Homo sapiens
tgaggaatagttgagcccc

SEQ ID NO: 1730810 - DNA, 13 bp, Homo sapiens
tgaggaattttct

SEQ ID NO: 1730811 - DNA, 10 bp, Homo sapiens
tgaggacaga

SEQ ID NO: 1730812 - DNA, 19 bp, Homo sapiens
tgaggacagagcttgaagc

SEQ ID NO: 1730813 - DNA, 21 bp, Homo sapiens
tgaggactcatatatttaagc

SEQ ID NO: 1730814 - DNA, 13 bp, Homo sapiens
tgaggagacagaa

SEQ ID NO: 1730815 - DNA, 16 bp, Homo sapiens
tgaggagacagaaagc

SEQ ID NO: 1730816 - DNA, 21 bp, Homo sapiens
cccttcccaatcagcactgaa

SEQ ID NO: 1730817 - DNA, 13 bp, Homo sapiens
cccttcccagacc

SEQ ID NO: 1730818 - DNA, 22 bp, Homo sapiens
cccttcccctcccccactcctc

SEQ ID NO: 1730819 - DNA, 15 bp, Homo sapiens
cccttcccctccctg

SEQ ID NO: 1730820 - DNA, 17 bp, Homo sapiens
cccttcccctccctggc

SEQ ID NO: 1730821 - DNA, 19 bp, Homo sapiens
cccttcccctccctggctc

SEQ ID NO: 1730822 - DNA, 14 bp, Homo sapiens
cccttcctccccac

SEQ ID NO: 1730823 - DNA, 19 bp, Homo sapiens
cccttcctccccacactcc

SEQ ID NO: 1730824 - DNA, 13 bp, Homo sapiens
cccttcctcccgg

SEQ ID NO: 1730825 - DNA, 13 bp, Homo sapiens
cccttcctcctga

SEQ ID NO: 1730826 - DNA, 13 bp, Homo sapiens
cccttcctctcca

SEQ ID NO: 1730827 - DNA, 16 bp, Homo sapiens
cccttcctctctcctt

SEQ ID NO: 1730828 - DNA, 16 bp, Homo sapiens
cccttcctcttcctgc

SEQ ID NO: 1730829 - DNA, 17 bp, Homo sapiens
cccttcctcttcctgcc

SEQ ID NO: 1730830 - DNA, 21 bp, Homo sapiens
cccttcctcttcctgcccttg

SEQ ID NO: 1730831 - DNA, 20 bp, Homo sapiens
cccttcctcttgtctgattt

SEQ ID NO: 1730832 - DNA, 19 bp, Homo sapiens
cccttcctggaaacagcat

SEQ ID NO: 1730833 - DNA, 21 bp, Homo sapiens
cccttcctggcctcactggct

SEQ ID NO: 1730834 - DNA, 24 bp, Homo sapiens
cccttcctggcctcactggctggg

SEQ ID NO: 1730835 - DNA, 11 bp, Homo sapiens
cccttcctgtg

SEQ ID NO: 1730836 - DNA, 18 bp, Homo sapiens
cccttccttttccctgct

SEQ ID NO: 1730837 - DNA, 19 bp, Homo sapiens
cccttccttttccctgctt

SEQ ID NO: 1730838 - DNA, 16 bp, Homo sapiens
cccttcgagtccagga

SEQ ID NO: 1730839 - DNA, 22 bp, Homo sapiens
cccttcgtggttatagccctgc

SEQ ID NO: 1730840 - DNA, 15 bp, Homo sapiens
cccttctacaaggac

SEQ ID NO: 1730841 - DNA, 14 bp, Homo sapiens
cccttctccccagc

SEQ ID NO: 1730842 - DNA, 17 bp, Homo sapiens
cccttctccccagccag

SEQ ID NO: 1730843 - DNA, 14 bp, Homo sapiens
cccttctcccctgc

SEQ ID NO: 1730844 - DNA, 16 bp, Homo sapiens
cccttctcccctgcac

SEQ ID NO: 1730845 - DNA, 18 bp, Homo sapiens
cccttctcctttccttcc

SEQ ID NO: 1730846 - DNA, 22 bp, Homo sapiens
cccttctcctttccttcccagg

SEQ ID NO: 1730847 - DNA, 15 bp, Homo sapiens
cccttctctcatctc

SEQ ID NO: 1730848 - DNA, 12 bp, Homo sapiens
cccttctctctc

SEQ ID NO: 1730849 - DNA, 15 bp, Homo sapiens
cccttctgactgttt

SEQ ID NO: 1730850 - DNA, 19 bp, Homo sapiens
cccttctggccggtgctgg

SEQ ID NO: 1730851 - DNA, 19 bp, Homo sapiens
cccttctgggcttcattct

SEQ ID NO: 1730852 - DNA, 22 bp, Homo sapiens
cccttgagaaaccttattgtac

SEQ ID NO: 1730853 - DNA, 13 bp, Homo sapiens
cccttgagacctc

SEQ ID NO: 1730854 - DNA, 15 bp, Homo sapiens
cccttgagacctcag

SEQ ID NO: 1730855 - DNA, 21 bp, Homo sapiens
cccttgatcagccccaccctg

SEQ ID NO: 1730856 - DNA, 23 bp, Homo sapiens
cccttgatggggaatccgtgtgt

SEQ ID NO: 1730857 - DNA, 21 bp, Homo sapiens
cccttgcagttcagcaccacc

SEQ ID NO: 1730858 - DNA, 23 bp, Homo sapiens
cccttgcagttcagcaccaccct

SEQ ID NO: 1730859 - DNA, 12 bp, Homo sapiens
cccttgcccagg

SEQ ID NO: 1730860 - DNA, 15 bp, Homo sapiens
cccttgcccagggct

SEQ ID NO: 1730861 - DNA, 19 bp, Homo sapiens
cccttgcccagggctcagc

SEQ ID NO: 1730862 - DNA, 20 bp, Homo sapiens
cccttgcccagggctcagcc

SEQ ID NO: 1730863 - DNA, 23 bp, Homo sapiens
cccttgcccagggctcagcctgg

SEQ ID NO: 1730864 - DNA, 15 bp, Homo sapiens
cccttgcccccatcc

SEQ ID NO: 1730865 - DNA, 18 bp, Homo sapiens
cccttgcccccatccctc

SEQ ID NO: 1730866 - DNA, 12 bp, Homo sapiens
cccttgcctccc

SEQ ID NO: 1730867 - DNA, 11 bp, Homo sapiens
cccttgcctct

SEQ ID NO: 1730868 - DNA, 13 bp, Homo sapiens
cccttgcctctgc

SEQ ID NO: 1730869 - DNA, 16 bp, Homo sapiens
cccttgcctctgccct

SEQ ID NO: 1730870 - DNA, 21 bp, Homo sapiens
cccttgcctttcgaggcctga

SEQ ID NO: 1730871 - DNA, 23 bp, Homo sapiens
cccttgctggccccagccctgct

SEQ ID NO: 1730872 - DNA, 24 bp, Homo sapiens
cccttgctggccccagccctgctg

SEQ ID NO: 1730873 - DNA, 14 bp, Homo sapiens
cccttgctgtatgc

SEQ ID NO: 1730874 - DNA, 21 bp, Homo sapiens
cccttgctgtatgctgatcat

SEQ ID NO: 1730875 - DNA, 18 bp, Homo sapiens
cccttgcttgcctgcagg

SEQ ID NO: 1730876 - DNA, 18 bp, Homo sapiens
cccttgctttcctgggcc

SEQ ID NO: 1730877 - DNA, 19 bp, Homo sapiens
cccttgctttgttttaata

SEQ ID NO: 1730878 - DNA, 13 bp, Homo sapiens
cccttggaaacct

SEQ ID NO: 1730879 - DNA, 17 bp, Homo sapiens
cccttggaaacctgccc

SEQ ID NO: 1730880 - DNA, 19 bp, Homo sapiens
cccttggaaacctgccctg

SEQ ID NO: 1730881 - DNA, 22 bp, Homo sapiens
cccttggaaacctgccctgcct

SEQ ID NO: 1730882 - DNA, 23 bp, Homo sapiens
cccttggaaacctgccctgcctg

SEQ ID NO: 1730883 - DNA, 19 bp, Homo sapiens
cccttggaaatgtctgctg

SEQ ID NO: 1730884 - DNA, 22 bp, Homo sapiens
cccttggaggagagagaccccg

SEQ ID NO: 1730885 - DNA, 13 bp, Homo sapiens
cccttggcctcag

SEQ ID NO: 1730886 - DNA, 15 bp, Homo sapiens
cccttggctcaatcc

SEQ ID NO: 1730887 - DNA, 13 bp, Homo sapiens
cccttggctgcag

SEQ ID NO: 1730888 - DNA, 14 bp, Homo sapiens
cccttggctgggac

SEQ ID NO: 1730889 - DNA, 18 bp, Homo sapiens
cccttggcttcctccgtc

SEQ ID NO: 1730890 - DNA, 19 bp, Homo sapiens
cccttggcttcctccgtcc

SEQ ID NO: 1730891 - DNA, 16 bp, Homo sapiens
cccttggcttctgtga

SEQ ID NO: 1730892 - DNA, 15 bp, Homo sapiens
cccttgggcatccac

SEQ ID NO: 1730893 - DNA, 16 bp, Homo sapiens
cccttgggccagaagt

SEQ ID NO: 1730894 - DNA, 21 bp, Homo sapiens
cccttgggccagaagtaccag

SEQ ID NO: 1730895 - DNA, 18 bp, Homo sapiens
cccttgggcggctgagag

SEQ ID NO: 1730896 - DNA, 15 bp, Homo sapiens
cccttggggcctggc

SEQ ID NO: 1730897 - DNA, 16 bp, Homo sapiens
cccttggggcctggct

SEQ ID NO: 1730898 - DNA, 18 bp, Homo sapiens
cccttggggcctggcttg

SEQ ID NO: 1730899 - DNA, 19 bp, Homo sapiens
cccttggtcccaagcctga

SEQ ID NO: 1730900 - DNA, 17 bp, Homo sapiens
cccttggtcttccatgg

SEQ ID NO: 1730901 - DNA, 23 bp, Homo sapiens
cccttgtacctatggctgcctgc

SEQ ID NO: 1730902 - DNA, 14 bp, Homo sapiens
cccttgtcctgcca

SEQ ID NO: 1730903 - DNA, 17 bp, Homo sapiens
cccttgtcctgccagct

SEQ ID NO: 1730904 - DNA, 19 bp, Homo sapiens
cccttgtcctgccagctgc

SEQ ID NO: 1730905 - DNA, 17 bp, Homo sapiens
cccttgtgagagcccat

SEQ ID NO: 1730906 - DNA, 17 bp, Homo sapiens
ccctttactcagcccag

SEQ ID NO: 1730907 - DNA, 19 bp, Homo sapiens
ccctttactcagcccagct

SEQ ID NO: 1730908 - DNA, 17 bp, Homo sapiens
ccctttcagatgtcttc

SEQ ID NO: 1730909 - DNA, 14 bp, Homo sapiens
tgagggtctgggat

SEQ ID NO: 1730910 - DNA, 13 bp, Homo sapiens
tgagggtgactgt

SEQ ID NO: 1730911 - DNA, 20 bp, Homo sapiens
tgagggtgcccttttccagc

SEQ ID NO: 1730912 - DNA, 17 bp, Homo sapiens
tgagggtttgagagccc

SEQ ID NO: 1730913 - DNA, 18 bp, Homo sapiens
tgagggtttgagagcccg

SEQ ID NO: 1730914 - DNA, 18 bp, Homo sapiens
tgaggtactggtcccttc

SEQ ID NO: 1730915 - DNA, 15 bp, Homo sapiens
tgaggtataaagaca

SEQ ID NO: 1730916 - DNA, 17 bp, Homo sapiens
tgaggtcaccaggggag

SEQ ID NO: 1730917 - DNA, 21 bp, Homo sapiens
tgaggtcaccaggggaggagc

SEQ ID NO: 1730918 - DNA, 18 bp, Homo sapiens
tgaggtgaaatgggagat

SEQ ID NO: 1730919 - DNA, 16 bp, Homo sapiens
tgaggtgatgggtgca

SEQ ID NO: 1730920 - DNA, 21 bp, Homo sapiens
tgaggtgcagagtgcccagaa

SEQ ID NO: 1730921 - DNA, 16 bp, Homo sapiens
tgaggtgctatgttct

SEQ ID NO: 1730922 - DNA, 16 bp, Homo sapiens
tgaggtggaagccctc

SEQ ID NO: 1730923 - DNA, 20 bp, Homo sapiens
tgaggtggaagccctccttc

SEQ ID NO: 1730924 - DNA, 13 bp, Homo sapiens
tgaggtgggaggt

SEQ ID NO: 1730925 - DNA, 15 bp, Homo sapiens
tgaggtgggcccagg

SEQ ID NO: 1730926 - DNA, 17 bp, Homo sapiens
tgaggtgggctggggct

SEQ ID NO: 1730927 - DNA, 14 bp, Homo sapiens
tgaggtgtgggggc

SEQ ID NO: 1730928 - DNA, 12 bp, Homo sapiens
tgaggttaggag

SEQ ID NO: 1730929 - DNA, 15 bp, Homo sapiens
tgaggttcctctgcc

SEQ ID NO: 1730930 - DNA, 16 bp, Homo sapiens
tgaggttcctctgcct

SEQ ID NO: 1730931 - DNA, 17 bp, Homo sapiens
tgaggttcctctgcctg

SEQ ID NO: 1730932 - DNA, 18 bp, Homo sapiens
tgaggttcctctgcctgc

SEQ ID NO: 1730933 - DNA, 15 bp, Homo sapiens
tgaggttgctttgtt

SEQ ID NO: 1730934 - DNA, 20 bp, Homo sapiens
tgaggttttgtaaaactgtt

SEQ ID NO: 1730935 - DNA, 16 bp, Homo sapiens
tgaggtttttaaatat

SEQ ID NO: 1730936 - DNA, 16 bp, Homo sapiens
tgagtaacatttgctg

SEQ ID NO: 1730937 - DNA, 17 bp, Homo sapiens
tgagtaacatttgctgt

SEQ ID NO: 1730938 - DNA, 19 bp, Homo sapiens
tgagtaacatttgctgttt

SEQ ID NO: 1730939 - DNA, 13 bp, Homo sapiens
tgagtaagagctg

SEQ ID NO: 1730940 - DNA, 21 bp, Homo sapiens
tgagtaatcaatacagacaag

SEQ ID NO: 1730941 - DNA, 17 bp, Homo sapiens
tgagtaatggtgtagaa

SEQ ID NO: 1730942 - DNA, 20 bp, Homo sapiens
tgagtaatgtgactaaagga

SEQ ID NO: 1730943 - DNA, 18 bp, Homo sapiens
tgagtacagatactgtga

SEQ ID NO: 1730944 - DNA, 15 bp, Homo sapiens
tgagtacctgcaaaa

SEQ ID NO: 1730945 - DNA, 15 bp, Homo sapiens
tgagtactgtactat

SEQ ID NO: 1730946 - DNA, 22 bp, Homo sapiens
tgagtagctctgcctttgctct

SEQ ID NO: 1730947 - DNA, 19 bp, Homo sapiens
tgagtattgtttaaaatgt

SEQ ID NO: 1730948 - DNA, 16 bp, Homo sapiens
tgagtatttttaaaaa

SEQ ID NO: 1730949 - DNA, 12 bp, Homo sapiens
tgagtcaaatcc

SEQ ID NO: 1730950 - DNA, 19 bp, Homo sapiens
tgagtcaaatccagtggtg

SEQ ID NO: 1730951 - DNA, 22 bp, Homo sapiens
tgagtcaaatccagtggtgggt

SEQ ID NO: 1730952 - DNA, 15 bp, Homo sapiens
tgagtcaactggagc

SEQ ID NO: 1730953 - DNA, 16 bp, Homo sapiens
tgagtcaactggagca

SEQ ID NO: 1730954 - DNA, 22 bp, Homo sapiens
tgagtcaccctacctgtgcctg

SEQ ID NO: 1730955 - DNA, 13 bp, Homo sapiens
tgagtcacctgct

SEQ ID NO: 1730956 - DNA, 14 bp, Homo sapiens
tgagtcacctgctc

SEQ ID NO: 1730957 - DNA, 17 bp, Homo sapiens
tgagtcacctgctccag

SEQ ID NO: 1730958 - DNA, 19 bp, Homo sapiens
tgagtcacctgctccagaa

SEQ ID NO: 1730959 - DNA, 16 bp, Homo sapiens
tgagtcactgagcatc

SEQ ID NO: 1730960 - DNA, 21 bp, Homo sapiens
tgagtcagatgggtctgatat

SEQ ID NO: 1730961 - DNA, 13 bp, Homo sapiens
tgagtcagcacct

SEQ ID NO: 1730962 - DNA, 17 bp, Homo sapiens
tgagtcagtgcatttca

SEQ ID NO: 1730963 - DNA, 13 bp, Homo sapiens
tgagtcagtgctc

SEQ ID NO: 1730964 - DNA, 15 bp, Homo sapiens
tgagtcatctgttag

SEQ ID NO: 1730965 - DNA, 22 bp, Homo sapiens
tgagtcatgatctccctgccgc

SEQ ID NO: 1730966 - DNA, 14 bp, Homo sapiens
tgagtccagagctt

SEQ ID NO: 1730967 - DNA, 15 bp, Homo sapiens
tgagtccagagcttg

SEQ ID NO: 1730968 - DNA, 19 bp, Homo sapiens
tgagtccagagcttgtgct

SEQ ID NO: 1730969 - DNA, 17 bp, Homo sapiens
tgagtccattctcccag

SEQ ID NO: 1730970 - DNA, 19 bp, Homo sapiens
tgagtccattctcccaggt

SEQ ID NO: 1730971 - DNA, 20 bp, Homo sapiens
tgagtccattctcccaggta

SEQ ID NO: 1730972 - DNA, 21 bp, Homo sapiens
tgagtcctggtttcctggcag

SEQ ID NO: 1730973 - DNA, 19 bp, Homo sapiens
tgagtcctgtctctgcctg

SEQ ID NO: 1730974 - DNA, 14 bp, Homo sapiens
tgagtcctttgcta

SEQ ID NO: 1730975 - DNA, 19 bp, Homo sapiens
tgagtcggccccacatggg

SEQ ID NO: 1730976 - DNA, 23 bp, Homo sapiens
tgagtcggccccacatgggaacc

SEQ ID NO: 1730977 - DNA, 17 bp, Homo sapiens
tgagtcgtacagaaagc

SEQ ID NO: 1730978 - DNA, 16 bp, Homo sapiens
tgagtctcaagggtgg

SEQ ID NO: 1730979 - DNA, 14 bp, Homo sapiens
tgagtctccagggc

SEQ ID NO: 1730980 - DNA, 17 bp, Homo sapiens
tgagtctcctctctgag

SEQ ID NO: 1730981 - DNA, 18 bp, Homo sapiens
tgagtctcctctctgaga

SEQ ID NO: 1730982 - DNA, 21 bp, Homo sapiens
tgagtctcctctctgagactg

SEQ ID NO: 1730983 - DNA, 14 bp, Homo sapiens
tgagtctcttcaga

SEQ ID NO: 1730984 - DNA, 14 bp, Homo sapiens
tgagtctgggcagc

SEQ ID NO: 1730985 - DNA, 16 bp, Homo sapiens
tgagtcttggcggcag

SEQ ID NO: 1730986 - DNA, 15 bp, Homo sapiens
tgagtcttggttcta

SEQ ID NO: 1730987 - DNA, 16 bp, Homo sapiens
tgagtctttggttcta

SEQ ID NO: 1730988 - DNA, 17 bp, Homo sapiens
tgagtctttggttctaa

SEQ ID NO: 1730989 - DNA, 13 bp, Homo sapiens
tgagtgagaatat

SEQ ID NO: 1730990 - DNA, 18 bp, Homo sapiens
tgagtgagccacagacca

SEQ ID NO: 1730991 - DNA, 14 bp, Homo sapiens
tgagtgatcactgg

SEQ ID NO: 1730992 - DNA, 18 bp, Homo sapiens
tgagtgatcactggtatt

SEQ ID NO: 1730993 - DNA, 20 bp, Homo sapiens
tgagtgatcctccaacttca

SEQ ID NO: 1730994 - DNA, 22 bp, Homo sapiens
tgagtgattgacacacagcact

SEQ ID NO: 1730995 - DNA, 13 bp, Homo sapiens
tgagtgcagaccc

SEQ ID NO: 1730996 - DNA, 16 bp, Homo sapiens
tgagtgccaatttctt

SEQ ID NO: 1730997 - DNA, 17 bp, Homo sapiens
tgagtggaatgcaggga

SEQ ID NO: 1730998 - DNA, 15 bp, Homo sapiens
tgagtggataatcag

SEQ ID NO: 1730999 - DNA, 14 bp, Homo sapiens
tgagtggcagcagc

SEQ ID NO: 1731000 - DNA, 13 bp, Homo sapiens
tgagtggcagcca

SEQ ID NO: 1731001 - DNA, 15 bp, Homo sapiens
tgagtggcagccatg

SEQ ID NO: 1731002 - DNA, 18 bp, Homo sapiens
tgagtggcagccatgcct

SEQ ID NO: 1731003 - DNA, 21 bp, Homo sapiens
tgagtggcaggggacaggagt

SEQ ID NO: 1731004 - DNA, 23 bp, Homo sapiens
tgagtggccccacctgtgtcccc

SEQ ID NO: 1731005 - DNA, 12 bp, Homo sapiens
tgagtggcctgc

SEQ ID NO: 1731006 - DNA, 13 bp, Homo sapiens
tgagtgggaagcc

SEQ ID NO: 1731007 - DNA, 14 bp, Homo sapiens
tgagtgggaagccc

SEQ ID NO: 1731008 - DNA, 15 bp, Homo sapiens
tgagtgggctgggcc

SEQ ID NO: 1731009 - DNA, 15 bp, Homo sapiens
tgagtggtgtgactc

SEQ ID NO: 1731010 - DNA, 18 bp, Homo sapiens
tgagtgtatgagtagcca

SEQ ID NO: 1731011 - DNA, 22 bp, Homo sapiens
tgagtgtattttttaaaattga

SEQ ID NO: 1731012 - DNA, 12 bp, Homo sapiens
tgagtgtcccaa

SEQ ID NO: 1731013 - DNA, 24 bp, Homo sapiens
tgagtgttcctttttaaatgtgaa

SEQ ID NO: 1731014 - DNA, 22 bp, Homo sapiens
tgagtgtttttactacagttgt

SEQ ID NO: 1731015 - DNA, 13 bp, Homo sapiens
tgagttaactgtg

SEQ ID NO: 1731016 - DNA, 15 bp, Homo sapiens
tgagttaactgtgaa

SEQ ID NO: 1731017 - DNA, 15 bp, Homo sapiens
tgagttacttcctat

SEQ ID NO: 1731018 - DNA, 21 bp, Homo sapiens
tgagttatcatgaattttaaa

SEQ ID NO: 1731019 - DNA, 18 bp, Homo sapiens
tgagttcataaatttatg

SEQ ID NO: 1731020 - DNA, 17 bp, Homo sapiens
tgagttccagaaagtaa

SEQ ID NO: 1731021 - DNA, 18 bp, Homo sapiens
tgagttccagaaagtaaa

SEQ ID NO: 1731022 - DNA, 20 bp, Homo sapiens
tgagttctacataagtaatt

SEQ ID NO: 1731023 - DNA, 17 bp, Homo sapiens
tgagttcttgtgtcctg

SEQ ID NO: 1731024 - DNA, 21 bp, Homo sapiens
tgcgccattgcactccagcct

SEQ ID NO: 1731025 - DNA, 23 bp, Homo sapiens
tgcgcccagggctgggaggaagg

SEQ ID NO: 1731026 - DNA, 17 bp, Homo sapiens
tgcgcccttgtgccctg

SEQ ID NO: 1731027 - DNA, 21 bp, Homo sapiens
tgcgcctcggtatctggcttc

SEQ ID NO: 1731028 - DNA, 22 bp, Homo sapiens
tgcgcctcggtatctggcttcc

SEQ ID NO: 1731029 - DNA, 19 bp, Homo sapiens
tgcgcctgtgatgctgggc

SEQ ID NO: 1731030 - DNA, 21 bp, Homo sapiens
tgcgcgcatgtaatcccagct

SEQ ID NO: 1731031 - DNA, 23 bp, Homo sapiens
tgcgcgctgtgggcaattgttac

SEQ ID NO: 1731032 - DNA, 15 bp, Homo sapiens
tgcgcgtgtgggtct

SEQ ID NO: 1731033 - DNA, 17 bp, Homo sapiens
tgcgctcacctcagagc

SEQ ID NO: 1731034 - DNA, 15 bp, Homo sapiens
tgcgctcacctgcag

SEQ ID NO: 1731035 - DNA, 14 bp, Homo sapiens
tgcgctcagggcca

SEQ ID NO: 1731036 - DNA, 11 bp, Homo sapiens
tgcgctgcctg

SEQ ID NO: 1731037 - DNA, 12 bp, Homo sapiens
tgcgctgcctgg

SEQ ID NO: 1731038 - DNA, 16 bp, Homo sapiens
tgcgctgcctggccag

SEQ ID NO: 1731039 - DNA, 20 bp, Homo sapiens
tgcgctgcctggccaggccc

SEQ ID NO: 1731040 - DNA, 21 bp, Homo sapiens
tgcgctggttccgccaggcgc

SEQ ID NO: 1731041 - DNA, 19 bp, Homo sapiens
tgcggaggagctgcctgct

SEQ ID NO: 1731042 - DNA, 15 bp, Homo sapiens
tgcggagtgaagagg

SEQ ID NO: 1731043 - DNA, 21 bp, Homo sapiens
tgcggagtgaagaggggcagc

SEQ ID NO: 1731044 - DNA, 15 bp, Homo sapiens
tgcggatcctgctgg

SEQ ID NO: 1731045 - DNA, 16 bp, Homo sapiens
tgcggatcctgctggg

SEQ ID NO: 1731046 - DNA, 19 bp, Homo sapiens
tgcggcccactttcctgag

SEQ ID NO: 1731047 - DNA, 22 bp, Homo sapiens
tgcggcccactttcctgagctg

SEQ ID NO: 1731048 - DNA, 19 bp, Homo sapiens
tgcggccgcattccctgag

SEQ ID NO: 1731049 - DNA, 17 bp, Homo sapiens
tgcgggagctctgtatg

SEQ ID NO: 1731050 - DNA, 16 bp, Homo sapiens
tgcgggcacaataaat

SEQ ID NO: 1731051 - DNA, 17 bp, Homo sapiens
tgcgggcctggccctca

SEQ ID NO: 1731052 - DNA, 19 bp, Homo sapiens
tgcgggcctggccctcact

SEQ ID NO: 1731053 - DNA, 23 bp, Homo sapiens
tgcgggcgcgggcagccacccaa

SEQ ID NO: 1731054 - DNA, 19 bp, Homo sapiens
tgcggttcttacagcacat

SEQ ID NO: 1731055 - DNA, 13 bp, Homo sapiens
tgcgtagaggcta

SEQ ID NO: 1731056 - DNA, 17 bp, Homo sapiens
tgcgtagaggctacagg

SEQ ID NO: 1731057 - DNA, 16 bp, Homo sapiens
tgcgtatatgtgcgtc

SEQ ID NO: 1731058 - DNA, 21 bp, Homo sapiens
tgcgtcccagctgaaggcagt

SEQ ID NO: 1731059 - DNA, 15 bp, Homo sapiens
tgcgtccccactccc

SEQ ID NO: 1731060 - DNA, 19 bp, Homo sapiens
tgcgtcctgcagaggacca

SEQ ID NO: 1731061 - DNA, 15 bp, Homo sapiens
tgcgtctccagtcat

SEQ ID NO: 1731062 - DNA, 17 bp, Homo sapiens
tgcgtctccagtcatct

SEQ ID NO: 1731063 - DNA, 20 bp, Homo sapiens
tgcgtctccagtcatctgta

SEQ ID NO: 1731064 - DNA, 22 bp, Homo sapiens
tgcgtcttggtgtaatttgaag

SEQ ID NO: 1731065 - DNA, 14 bp, Homo sapiens
tgcgtcttttttct

SEQ ID NO: 1731066 - DNA, 18 bp, Homo sapiens
tgcgtgccgcctgctcct

SEQ ID NO: 1731067 - DNA, 17 bp, Homo sapiens
tgcgtgcgagcacacac

SEQ ID NO: 1731068 - DNA, 13 bp, Homo sapiens
tgcgtgcgtgtgc

SEQ ID NO: 1731069 - DNA, 16 bp, Homo sapiens
tgcgtgcgtgtgcgtg

SEQ ID NO: 1731070 - DNA, 20 bp, Homo sapiens
tgcgtggcgcaggtgccatg

SEQ ID NO: 1731071 - DNA, 21 bp, Homo sapiens
tgcgtggtatacatgtgtaca

SEQ ID NO: 1731072 - DNA, 16 bp, Homo sapiens
tgcgtgtctctgccat

SEQ ID NO: 1731073 - DNA, 17 bp, Homo sapiens
tgcgtgtctctgccatg

SEQ ID NO: 1731074 - DNA, 12 bp, Homo sapiens
tgcgtgtgtata

SEQ ID NO: 1731075 - DNA, 13 bp, Homo sapiens
tgcgtgtgtatat

SEQ ID NO: 1731076 - DNA, 18 bp, Homo sapiens
tgcgtgtgtgtgtgtttg

SEQ ID NO: 1731077 - DNA, 22 bp, Homo sapiens
tgcgtgtgtttgtatgtctgtg

SEQ ID NO: 1731078 - DNA, 13 bp, Homo sapiens
tgcgttcaaagag

SEQ ID NO: 1731079 - DNA, 16 bp, Homo sapiens
tgcgttctgcaagcat

SEQ ID NO: 1731080 - DNA, 15 bp, Homo sapiens
tgcgttggagccact

SEQ ID NO: 1731081 - DNA, 17 bp, Homo sapiens
tgcgtttggtttacttg

SEQ ID NO: 1731082 - DNA, 13 bp, Homo sapiens
tgcgtttttacag

SEQ ID NO: 1731083 - DNA, 22 bp, Homo sapiens
tgctaaacatggcttaatctta

SEQ ID NO: 1731084 - DNA, 21 bp, Homo sapiens
tgctaaaccttagtactgagt

SEQ ID NO: 1731085 - DNA, 17 bp, Homo sapiens
tgctaaagcactttgca

SEQ ID NO: 1731086 - DNA, 19 bp, Homo sapiens
tgctaaagccaaccagcct

SEQ ID NO: 1731087 - DNA, 13 bp, Homo sapiens
tgctaaataaaca

SEQ ID NO: 1731088 - DNA, 20 bp, Homo sapiens
tgctaaatggtcgcccagga

SEQ ID NO: 1731089 - DNA, 12 bp, Homo sapiens
tgctaaatttca

SEQ ID NO: 1731090 - DNA, 14 bp, Homo sapiens
tgctaactgggtta

SEQ ID NO: 1731091 - DNA, 17 bp, Homo sapiens
tgctaactgggttaaat

SEQ ID NO: 1731092 - DNA, 12 bp, Homo sapiens
tgctaactggtt

SEQ ID NO: 1731093 - DNA, 15 bp, Homo sapiens
tgctaactggttaaa

SEQ ID NO: 1731094 - DNA, 14 bp, Homo sapiens
tgctaagaaaccag

SEQ ID NO: 1731095 - DNA, 12 bp, Homo sapiens
tgctaagaaatg

SEQ ID NO: 1731096 - DNA, 18 bp, Homo sapiens
tgctaagaagctaaagtc

SEQ ID NO: 1731097 - DNA, 12 bp, Homo sapiens
tgctaagtattt

SEQ ID NO: 1731098 - DNA, 17 bp, Homo sapiens
tgctaagtatttcccag

SEQ ID NO: 1731099 - DNA, 18 bp, Homo sapiens
tgctaagtatttcccagc

SEQ ID NO: 1731100 - DNA, 13 bp, Homo sapiens
tgctaagttctcc

SEQ ID NO: 1731101 - DNA, 18 bp, Homo sapiens
tgctaagttctcccaaca

SEQ ID NO: 1731102 - DNA, 23 bp, Homo sapiens
tgctaatcagggaggtcattttg

SEQ ID NO: 1731103 - DNA, 22 bp, Homo sapiens
tgctaatcatgtgggtgagcca

SEQ ID NO: 1731104 - DNA, 13 bp, Homo sapiens
tgctaatcttctt

SEQ ID NO: 1731105 - DNA, 13 bp, Homo sapiens
tgctaatgtaatc

SEQ ID NO: 1731106 - DNA, 14 bp, Homo sapiens
tgctaatgtaatca

SEQ ID NO: 1731107 - DNA, 15 bp, Homo sapiens
tgctaatgtaatcat

SEQ ID NO: 1731108 - DNA, 21 bp, Homo sapiens
tgctaatgtaatcatttatct

SEQ ID NO: 1731109 - DNA, 13 bp, Homo sapiens
tgctaatgtataa

SEQ ID NO: 1731110 - DNA, 12 bp, Homo sapiens
tgctaattcttt

SEQ ID NO: 1731111 - DNA, 14 bp, Homo sapiens
tgctaattctttgc

SEQ ID NO: 1731112 - DNA, 20 bp, Homo sapiens
tgctaattctttgcaaaaat

SEQ ID NO: 1731113 - DNA, 15 bp, Homo sapiens
tgctacaaaaacaca

SEQ ID NO: 1731114 - DNA, 22 bp, Homo sapiens
tgctacaaatttatgcatttca

SEQ ID NO: 1731115 - DNA, 14 bp, Homo sapiens
tgctacaattttaa

SEQ ID NO: 1731116 - DNA, 20 bp, Homo sapiens
tgctacagatgatagaggat

SEQ ID NO: 1731117 - DNA, 15 bp, Homo sapiens
tgctacatcagactc

SEQ ID NO: 1731118 - DNA, 21 bp, Homo sapiens
tgctacattataatgtacaga

SEQ ID NO: 1731119 - DNA, 14 bp, Homo sapiens
tgctaccacagact

SEQ ID NO: 1731120 - DNA, 18 bp, Homo sapiens
tgctaccaggatgctaaa

SEQ ID NO: 1731121 - DNA, 14 bp, Homo sapiens
tgctacctctgaga

SEQ ID NO: 1731122 - DNA, 15 bp, Homo sapiens
tgctacctctgagaa

SEQ ID NO: 1731123 - DNA, 18 bp, Homo sapiens
tgctacctctgagaagac

SEQ ID NO: 1731124 - DNA, 18 bp, Homo sapiens
tgctacctttcaaagctt

SEQ ID NO: 1731125 - DNA, 16 bp, Homo sapiens
tgctacgattccactg

SEQ ID NO: 1731126 - DNA, 18 bp, Homo sapiens
tgctactaagttcacatt

SEQ ID NO: 1731127 - DNA, 12 bp, Homo sapiens
tgctactccatg

SEQ ID NO: 1731128 - DNA, 13 bp, Homo sapiens
tgctactccatgc

SEQ ID NO: 1731129 - DNA, 18 bp, Homo sapiens
tgctactccatgcagggg

SEQ ID NO: 1731130 - DNA, 20 bp, Homo sapiens
tgctactgcactccagcctg

SEQ ID NO: 1731131 - DNA, 13 bp, Homo sapiens
tgctactgttgta

SEQ ID NO: 1731132 - DNA, 23 bp, Homo sapiens
tgctactgttgtaagaattctga

SEQ ID NO: 1731133 - DNA, 14 bp, Homo sapiens
tgctacttccccag

SEQ ID NO: 1731134 - DNA, 21 bp, Homo sapiens
tgctagaacaatgggaggctg

SEQ ID NO: 1731135 - DNA, 13 bp, Homo sapiens
tgctagaatactt

SEQ ID NO: 1731136 - DNA, 20 bp, Homo sapiens
tgctagactcctcaggagag

SEQ ID NO: 1731137 - DNA, 14 bp, Homo sapiens
tgctagagcaaccc

SEQ ID NO: 1731138 - DNA, 22 bp, Homo sapiens
tgctagagcaacccctgtaccc

SEQ ID NO: 1731139 - DNA, 19 bp, Homo sapiens
tgctagatgtgcaaatgca

SEQ ID NO: 1731140 - DNA, 20 bp, Homo sapiens
tgctagatgtgcaaatgcaa

SEQ ID NO: 1731141 - DNA, 12 bp, Homo sapiens
cctccctccttc

SEQ ID NO: 1731142 - DNA, 22 bp, Homo sapiens
cctccctctcagaggcctgctg

SEQ ID NO: 1731143 - DNA, 13 bp, Homo sapiens
cctccctctccat

SEQ ID NO: 1731144 - DNA, 13 bp, Homo sapiens
cctccctctctca

SEQ ID NO: 1731145 - DNA, 18 bp, Homo sapiens
cctccctctctcttctgc

SEQ ID NO: 1731146 - DNA, 20 bp, Homo sapiens
cctccctctctcttctgctc

SEQ ID NO: 1731147 - DNA, 19 bp, Homo sapiens
cctccctctgacctgcagg

SEQ ID NO: 1731148 - DNA, 20 bp, Homo sapiens
cctccctgaaaatgtttttc

SEQ ID NO: 1731149 - DNA, 22 bp, Homo sapiens
cctccctgcccctcccttcaac

SEQ ID NO: 1731150 - DNA, 11 bp, Homo sapiens
cctccctgctt

SEQ ID NO: 1731151 - DNA, 22 bp, Homo sapiens
cctccctgcttgcacacttccc

SEQ ID NO: 1731152 - DNA, 20 bp, Homo sapiens
cctccctggagcctccactg

SEQ ID NO: 1731153 - DNA, 13 bp, Homo sapiens
cctccctggcaga

SEQ ID NO: 1731154 - DNA, 12 bp, Homo sapiens
cctccctggctc

SEQ ID NO: 1731155 - DNA, 14 bp, Homo sapiens
cctccctggctgcc

SEQ ID NO: 1731156 - DNA, 16 bp, Homo sapiens
cctccctggctgccct

SEQ ID NO: 1731157 - DNA, 18 bp, Homo sapiens
cctccctggctgccctgg

SEQ ID NO: 1731158 - DNA, 22 bp, Homo sapiens
cctccctggctgtgagcagcct

SEQ ID NO: 1731159 - DNA, 18 bp, Homo sapiens
cctccctggggaccagga

SEQ ID NO: 1731160 - DNA, 23 bp, Homo sapiens
cctccctggggaccaggagctag

SEQ ID NO: 1731161 - DNA, 12 bp, Homo sapiens
cctccctgggtt

SEQ ID NO: 1731162 - DNA, 21 bp, Homo sapiens
cctccctgtcactcagctgag

SEQ ID NO: 1731163 - DNA, 15 bp, Homo sapiens
cctccctgtcccagg

SEQ ID NO: 1731164 - DNA, 14 bp, Homo sapiens
cctccctgtctcca

SEQ ID NO: 1731165 - DNA, 21 bp, Homo sapiens
cctccctgtctccagctgcct

SEQ ID NO: 1731166 - DNA, 18 bp, Homo sapiens
cctccctgttccccagag

SEQ ID NO: 1731167 - DNA, 19 bp, Homo sapiens
cctccctgttccccagaga

SEQ ID NO: 1731168 - DNA, 21 bp, Homo sapiens
cctccctgttgaagctctggt

SEQ ID NO: 1731169 - DNA, 12 bp, Homo sapiens
cctcccttccca

SEQ ID NO: 1731170 - DNA, 13 bp, Homo sapiens
cctcccttcccag

SEQ ID NO: 1731171 - DNA, 17 bp, Homo sapiens
cctcccttccttttccc

SEQ ID NO: 1731172 - DNA, 21 bp, Homo sapiens
cctcccttccttttccctgct

SEQ ID NO: 1731173 - DNA, 12 bp, Homo sapiens
cctccctttctc

SEQ ID NO: 1731174 - DNA, 15 bp, Homo sapiens
cctccctttctcccc

SEQ ID NO: 1731175 - DNA, 16 bp, Homo sapiens
cctccgaccctcatgg

SEQ ID NO: 1731176 - DNA, 22 bp, Homo sapiens
cctccgaccctcatggccccca

SEQ ID NO: 1731177 - DNA, 19 bp, Homo sapiens
cctccgaggctccccgcct

SEQ ID NO: 1731178 - DNA, 16 bp, Homo sapiens
cctccgatgctgaggc

SEQ ID NO: 1731179 - DNA, 15 bp, Homo sapiens
cctccgcagtgtctc

SEQ ID NO: 1731180 - DNA, 17 bp, Homo sapiens
cctccgcagtgtctcca

SEQ ID NO: 1731181 - DNA, 13 bp, Homo sapiens
cctccgcccctgc

SEQ ID NO: 1731182 - DNA, 14 bp, Homo sapiens
cctccgccctgcca

SEQ ID NO: 1731183 - DNA, 18 bp, Homo sapiens
cctccgccctgccactca

SEQ ID NO: 1731184 - DNA, 13 bp, Homo sapiens
cctccgcctcccg

SEQ ID NO: 1731185 - DNA, 15 bp, Homo sapiens
cctccgcctgggatc

SEQ ID NO: 1731186 - DNA, 14 bp, Homo sapiens
cctccgctgggctt

SEQ ID NO: 1731187 - DNA, 21 bp, Homo sapiens
cctccgtagggtctttcttgg

SEQ ID NO: 1731188 - DNA, 23 bp, Homo sapiens
cctccgtagggtctttcttggga

SEQ ID NO: 1731189 - DNA, 13 bp, Homo sapiens
cctccgtccaccc

SEQ ID NO: 1731190 - DNA, 15 bp, Homo sapiens
cctccgtccacccag

SEQ ID NO: 1731191 - DNA, 18 bp, Homo sapiens
cctccgtccacccaggct

SEQ ID NO: 1731192 - DNA, 19 bp, Homo sapiens
cctccgtccacccaggctg

SEQ ID NO: 1731193 - DNA, 20 bp, Homo sapiens
cctccgtccacccaggctgc

SEQ ID NO: 1731194 - DNA, 16 bp, Homo sapiens
cctccgtgatccatcc

SEQ ID NO: 1731195 - DNA, 17 bp, Homo sapiens
cctccgtgatccatcca

SEQ ID NO: 1731196 - DNA, 18 bp, Homo sapiens
cctccgtgatccatccat

SEQ ID NO: 1731197 - DNA, 23 bp, Homo sapiens
cctccgtgatccatccatctcca

SEQ ID NO: 1731198 - DNA, 19 bp, Homo sapiens
cctcctagaggtgggcagc

SEQ ID NO: 1731199 - DNA, 21 bp, Homo sapiens
cctcctagaggtgggcagctg

SEQ ID NO: 1731200 - DNA, 19 bp, Homo sapiens
cctcctatctccctggctc

SEQ ID NO: 1731201 - DNA, 19 bp, Homo sapiens
cctcctattctataaaact

SEQ ID NO: 1731202 - DNA, 13 bp, Homo sapiens
cctcctcaccccc

SEQ ID NO: 1731203 - DNA, 13 bp, Homo sapiens
cctcctcacctca

SEQ ID NO: 1731204 - DNA, 16 bp, Homo sapiens
cctcctcacctcatgc

SEQ ID NO: 1731205 - DNA, 19 bp, Homo sapiens
cctcctcacctcatgccca

SEQ ID NO: 1731206 - DNA, 20 bp, Homo sapiens
cctcctcagcgagaggcagc

SEQ ID NO: 1731207 - DNA, 14 bp, Homo sapiens
cctcctccacagtg

SEQ ID NO: 1731208 - DNA, 17 bp, Homo sapiens
cctcctccacagtgctg

SEQ ID NO: 1731209 - DNA, 18 bp, Homo sapiens
cctcctccacagtgctgc

SEQ ID NO: 1731210 - DNA, 16 bp, Homo sapiens
cctcctccacccaccc

SEQ ID NO: 1731211 - DNA, 17 bp, Homo sapiens
cctcctccacccacccc

SEQ ID NO: 1731212 - DNA, 15 bp, Homo sapiens
cctcctccactcact

SEQ ID NO: 1731213 - DNA, 22 bp, Homo sapiens
cctcctccactcactccagccc

SEQ ID NO: 1731214 - DNA, 18 bp, Homo sapiens
cctcctccagcccctgtc

SEQ ID NO: 1731215 - DNA, 15 bp, Homo sapiens
cctcctccaggcctg

SEQ ID NO: 1731216 - DNA, 12 bp, Homo sapiens
cctcctccaggg

SEQ ID NO: 1731217 - DNA, 19 bp, Homo sapiens
cctcctcccacccggctgc

SEQ ID NO: 1731218 - DNA, 14 bp, Homo sapiens
cctcctcccatctc

SEQ ID NO: 1731219 - DNA, 20 bp, Homo sapiens
cctcctcccatctccttccc

SEQ ID NO: 1731220 - DNA, 13 bp, Homo sapiens
cctcctccccact

SEQ ID NO: 1731221 - DNA, 16 bp, Homo sapiens
cctcctccccagctct

SEQ ID NO: 1731222 - DNA, 13 bp, Homo sapiens
cctcctcccccag

SEQ ID NO: 1731223 - DNA, 23 bp, Homo sapiens
cctcctccccgctccgtctctgt

SEQ ID NO: 1731224 - DNA, 19 bp, Homo sapiens
cctcctcgaacccactccg

SEQ ID NO: 1731225 - DNA, 13 bp, Homo sapiens
cctcctcggaaga

SEQ ID NO: 1731226 - DNA, 16 bp, Homo sapiens
cctcctcgggcacaga

SEQ ID NO: 1731227 - DNA, 14 bp, Homo sapiens
cctcctcgggccga

SEQ ID NO: 1731228 - DNA, 18 bp, Homo sapiens
cctcctcgggccgaggcc

SEQ ID NO: 1731229 - DNA, 14 bp, Homo sapiens
cctcctctcccatc

SEQ ID NO: 1731230 - DNA, 13 bp, Homo sapiens
cctcctctgccac

SEQ ID NO: 1731231 - DNA, 15 bp, Homo sapiens
cctcctctgccacct

SEQ ID NO: 1731232 - DNA, 21 bp, Homo sapiens
cctcctctggacggcaggctc

SEQ ID NO: 1731233 - DNA, 12 bp, Homo sapiens
cctcctctgtcc

SEQ ID NO: 1731234 - DNA, 15 bp, Homo sapiens
cctcctctgtccagg

SEQ ID NO: 1731235 - DNA, 16 bp, Homo sapiens
cctcctctgtccaggg

SEQ ID NO: 1731236 - DNA, 22 bp, Homo sapiens
cctcctcttcccttagcctctc

SEQ ID NO: 1731237 - DNA, 14 bp, Homo sapiens
cctcctcttctgac

SEQ ID NO: 1731238 - DNA, 22 bp, Homo sapiens
cctcctgaaccgcacagctcag

SEQ ID NO: 1731239 - DNA, 23 bp, Homo sapiens
cctcctgagctcggggggctctg

SEQ ID NO: 1731240 - DNA, 16 bp, Homo sapiens
cctcctgatggccaag

SEQ ID NO: 1731241 - DNA, 19 bp, Homo sapiens
cctcctgcagaccacgccc

SEQ ID NO: 1731242 - DNA, 12 bp, Homo sapiens
cctcctgcaggc

SEQ ID NO: 1731243 - DNA, 15 bp, Homo sapiens
cctcctgcaggctgg

SEQ ID NO: 1731244 - DNA, 21 bp, Homo sapiens
cctcctgcaggctggctgttg

SEQ ID NO: 1731245 - DNA, 12 bp, Homo sapiens
cctcctgccacc

SEQ ID NO: 1731246 - DNA, 18 bp, Homo sapiens
cctcctgccaccccttcc

SEQ ID NO: 1731247 - DNA, 13 bp, Homo sapiens
tgctcccagcagc

SEQ ID NO: 1731248 - DNA, 14 bp, Homo sapiens
tgctcccagcagcc

SEQ ID NO: 1731249 - DNA, 15 bp, Homo sapiens
tgctcccagcagccc

SEQ ID NO: 1731250 - DNA, 23 bp, Homo sapiens
tgctcccagtgggagcttcccgg

SEQ ID NO: 1731251 - DNA, 17 bp, Homo sapiens
tgctcccattcctccct

SEQ ID NO: 1731252 - DNA, 18 bp, Homo sapiens
tgctcccattcctccctc

SEQ ID NO: 1731253 - DNA, 11 bp, Homo sapiens
tgctccccaca

SEQ ID NO: 1731254 - DNA, 23 bp, Homo sapiens
tgctccccacagcgtccctggcg

SEQ ID NO: 1731255 - DNA, 18 bp, Homo sapiens
tgctccccaggccacccc

SEQ ID NO: 1731256 - DNA, 19 bp, Homo sapiens
tgctcccctgccacactga

SEQ ID NO: 1731257 - DNA, 24 bp, Homo sapiens
tgctcccctgccacactgatggct

SEQ ID NO: 1731258 - DNA, 23 bp, Homo sapiens
tgctcccggcaagcgcttctgct

SEQ ID NO: 1731259 - DNA, 13 bp, Homo sapiens
tgctccctcccct

SEQ ID NO: 1731260 - DNA, 22 bp, Homo sapiens
cctcctgggaaggagggagctg

SEQ ID NO: 1731261 - DNA, 17 bp, Homo sapiens
cctcctgtgctatttgt

SEQ ID NO: 1731262 - DNA, 22 bp, Homo sapiens
cctcctgtgctatttgtacaaa

SEQ ID NO: 1731263 - DNA, 19 bp, Homo sapiens
cctcctgttctgcccacga

SEQ ID NO: 1731264 - DNA, 22 bp, Homo sapiens
cctccttagccctgtctgctag

SEQ ID NO: 1731265 - DNA, 12 bp, Homo sapiens
cctccttcagac

SEQ ID NO: 1731266 - DNA, 17 bp, Homo sapiens
cctccttcccatgcctg

SEQ ID NO: 1731267 - DNA, 20 bp, Homo sapiens
cctccttccttgaccagcag

SEQ ID NO: 1731268 - DNA, 20 bp, Homo sapiens
cctccttccttgctgtccta

SEQ ID NO: 1731269 - DNA, 12 bp, Homo sapiens
cctccttctccc

SEQ ID NO: 1731270 - DNA, 17 bp, Homo sapiens
cctccttgcccagacta

SEQ ID NO: 1731271 - DNA, 17 bp, Homo sapiens
cctccttgtccaggtct

SEQ ID NO: 1731272 - DNA, 18 bp, Homo sapiens
cctccttgtgccttcttt

SEQ ID NO: 1731273 - DNA, 12 bp, Homo sapiens
cctcctttccct

SEQ ID NO: 1731274 - DNA, 14 bp, Homo sapiens
cctcctttccctta

SEQ ID NO: 1731275 - DNA, 18 bp, Homo sapiens
cctcctttcccttattgc

SEQ ID NO: 1731276 - DNA, 15 bp, Homo sapiens
cctcgaaccaaggca

SEQ ID NO: 1731277 - DNA, 16 bp, Homo sapiens
cctcgagcagatgatg

SEQ ID NO: 1731278 - DNA, 13 bp, Homo sapiens
cctcgaggcaccg

SEQ ID NO: 1731279 - DNA, 22 bp, Homo sapiens
cctcgaggcaccggcgctgcag

SEQ ID NO: 1731280 - DNA, 23 bp, Homo sapiens
cctcgaggcaccggcgctgcagg

SEQ ID NO: 1731281 - DNA, 17 bp, Homo sapiens
cctcgcacaggccctag

SEQ ID NO: 1731282 - DNA, 18 bp, Homo sapiens
cctcgcacaggccctagc

SEQ ID NO: 1731283 - DNA, 17 bp, Homo sapiens
cctcgcccttcagccca

SEQ ID NO: 1731284 - DNA, 16 bp, Homo sapiens
cctcgctgctgctact

SEQ ID NO: 1731285 - DNA, 17 bp, Homo sapiens
cctcgctgctgctacta

SEQ ID NO: 1731286 - DNA, 21 bp, Homo sapiens
cctcgctgctgctactacccg

SEQ ID NO: 1731287 - DNA, 13 bp, Homo sapiens
cctcgctgcttct

SEQ ID NO: 1731288 - DNA, 15 bp, Homo sapiens
cctcggaagagcccg

SEQ ID NO: 1731289 - DNA, 16 bp, Homo sapiens
cctcggaagagcccgt

SEQ ID NO: 1731290 - DNA, 16 bp, Homo sapiens
cctcggactccatggc

SEQ ID NO: 1731291 - DNA, 14 bp, Homo sapiens
cctcggagagcagc

SEQ ID NO: 1731292 - DNA, 15 bp, Homo sapiens
cctcggagagcagca

SEQ ID NO: 1731293 - DNA, 17 bp, Homo sapiens
cctcggagagcagcagc

SEQ ID NO: 1731294 - DNA, 18 bp, Homo sapiens
cctcggagagcagcagca

SEQ ID NO: 1731295 - DNA, 19 bp, Homo sapiens
cctcggagagcagcagcac

SEQ ID NO: 1731296 - DNA, 17 bp, Homo sapiens
cctcggatcaccgagag

SEQ ID NO: 1731297 - DNA, 22 bp, Homo sapiens
cctcggcctccgaggctccccg

SEQ ID NO: 1731298 - DNA, 16 bp, Homo sapiens
cctcgggaagcagcca

SEQ ID NO: 1731299 - DNA, 17 bp, Homo sapiens
cctcgggaagcagccag

SEQ ID NO: 1731300 - DNA, 19 bp, Homo sapiens
cctcgggccgaggcccagc

SEQ ID NO: 1731301 - DNA, 13 bp, Homo sapiens
cctcgggcctgct

SEQ ID NO: 1731302 - DNA, 22 bp, Homo sapiens
cctcgggcgagtcactgcctct

SEQ ID NO: 1731303 - DNA, 18 bp, Homo sapiens
cctcggggacaccagagc

SEQ ID NO: 1731304 - DNA, 13 bp, Homo sapiens
cctcgggggcctg

SEQ ID NO: 1731305 - DNA, 18 bp, Homo sapiens
cctcggtatctggcttcc

SEQ ID NO: 1731306 - DNA, 13 bp, Homo sapiens
cctcggtgggcca

SEQ ID NO: 1731307 - DNA, 22 bp, Homo sapiens
cctcgtcaagagcatgcacatg

SEQ ID NO: 1731308 - DNA, 14 bp, Homo sapiens
cctcgtccacaggg

SEQ ID NO: 1731309 - DNA, 17 bp, Homo sapiens
cctcgtccacaggggca

SEQ ID NO: 1731310 - DNA, 21 bp, Homo sapiens
cctcgtccacaggggcaggcc

SEQ ID NO: 1731311 - DNA, 22 bp, Homo sapiens
cctcgtccacaggggcaggcct

SEQ ID NO: 1731312 - DNA, 16 bp, Homo sapiens
cctcgtccgtctgtct

SEQ ID NO: 1731313 - DNA, 18 bp, Homo sapiens
cctcgtcctgtcccagag

SEQ ID NO: 1731314 - DNA, 17 bp, Homo sapiens
cctcgtctccctggtgc

SEQ ID NO: 1731315 - DNA, 20 bp, Homo sapiens
cctcgtctccctggtgcctc

SEQ ID NO: 1731316 - DNA, 22 bp, Homo sapiens
cctcgtctccctggtgcctctg

SEQ ID NO: 1731317 - DNA, 15 bp, Homo sapiens
cctcgtgaggggcaa

SEQ ID NO: 1731318 - DNA, 13 bp, Homo sapiens
cctcgtgccagca

SEQ ID NO: 1731319 - DNA, 13 bp, Homo sapiens
cctcgtggccagc

SEQ ID NO: 1731320 - DNA, 22 bp, Homo sapiens
cctcgtggccttccccagcctc

SEQ ID NO: 1731321 - DNA, 23 bp, Homo sapiens
cctcgtggccttccccagcctct

SEQ ID NO: 1731322 - DNA, 15 bp, Homo sapiens
cctcgttctctgggt

SEQ ID NO: 1731323 - DNA, 15 bp, Homo sapiens
cctcgttggaagagg

SEQ ID NO: 1731324 - DNA, 17 bp, Homo sapiens
cctctaaagcagaggca

SEQ ID NO: 1731325 - DNA, 18 bp, Homo sapiens
cctctaaagcagaggcaa

SEQ ID NO: 1731326 - DNA, 15 bp, Homo sapiens
cctctaactcactgc

SEQ ID NO: 1731327 - DNA, 18 bp, Homo sapiens
cctctaataaacactgtt

SEQ ID NO: 1731328 - DNA, 15 bp, Homo sapiens
cctctaatgagactg

SEQ ID NO: 1731329 - DNA, 23 bp, Homo sapiens
cctctactcttacagagccttga

SEQ ID NO: 1731330 - DNA, 20 bp, Homo sapiens
cctctacttaatgagatagt

SEQ ID NO: 1731331 - DNA, 19 bp, Homo sapiens
cctctactttgattctgat

SEQ ID NO: 1731332 - DNA, 17 bp, Homo sapiens
cctctagaaatttttca

SEQ ID NO: 1731333 - DNA, 18 bp, Homo sapiens
cctctagaagccaaggga

SEQ ID NO: 1731334 - DNA, 19 bp, Homo sapiens
cctctagaattttaagcct

SEQ ID NO: 1731335 - DNA, 14 bp, Homo sapiens
cctctagcaggcct

SEQ ID NO: 1731336 - DNA, 19 bp, Homo sapiens
cctctagtccccaaggcct

SEQ ID NO: 1731337 - DNA, 22 bp, Homo sapiens
cctctagtccccaaggcctctc

SEQ ID NO: 1731338 - DNA, 14 bp, Homo sapiens
cctctagtgccctc

SEQ ID NO: 1731339 - DNA, 19 bp, Homo sapiens
cctctatactttgttctgt

SEQ ID NO: 1731340 - DNA, 23 bp, Homo sapiens
cctctatactttgttctgttgtc

SEQ ID NO: 1731341 - DNA, 17 bp, Homo sapiens
cctctatttatgtttgc

SEQ ID NO: 1731342 - DNA, 19 bp, Homo sapiens
cctctatttattagccaac

SEQ ID NO: 1731343 - DNA, 14 bp, Homo sapiens
cctctcacacacat

SEQ ID NO: 1731344 - DNA, 16 bp, Homo sapiens
cctctcacctctccct

SEQ ID NO: 1731345 - DNA, 14 bp, Homo sapiens
cctctcagaacata

SEQ ID NO: 1731346 - DNA, 20 bp, Homo sapiens
cctctcagaacatactgatt

SEQ ID NO: 1731347 - DNA, 16 bp, Homo sapiens
cctctcagaactcctg

SEQ ID NO: 1731348 - DNA, 17 bp, Homo sapiens
cctctcagaactcctgt

SEQ ID NO: 1731349 - DNA, 17 bp, Homo sapiens
cctctcagaggcctgct

SEQ ID NO: 1731350 - DNA, 19 bp, Homo sapiens
cctctcagaggcctgctgc

SEQ ID NO: 1731351 - DNA, 17 bp, Homo sapiens
cctctcagagtgacagt

SEQ ID NO: 1731352 - DNA, 14 bp, Homo sapiens
cctctcagcatagc

SEQ ID NO: 1731353 - DNA, 19 bp, Homo sapiens
cctctcagcatagcctgcc

SEQ ID NO: 1731354 - DNA, 20 bp, Homo sapiens
cctctcagcatagcctgcct

SEQ ID NO: 1731355 - DNA, 22 bp, Homo sapiens
cctctcagcatagcctgcctga

SEQ ID NO: 1731356 - DNA, 13 bp, Homo sapiens
cctctcagctcca

SEQ ID NO: 1731357 - DNA, 16 bp, Homo sapiens
cctctcagctccaggt

SEQ ID NO: 1731358 - DNA, 21 bp, Homo sapiens
cctctcagctgctgggacgat

SEQ ID NO: 1731359 - DNA, 13 bp, Homo sapiens
cctctcaggtggg

SEQ ID NO: 1731360 - DNA, 14 bp, Homo sapiens
cctctcagtgcctt

SEQ ID NO: 1731361 - DNA, 21 bp, Homo sapiens
cctctcagtgccttctctcag

SEQ ID NO: 1731362 - DNA, 16 bp, Homo sapiens
tgctgaacgcagaaga

SEQ ID NO: 1731363 - DNA, 20 bp, Homo sapiens
tgctgaacgcagaagaaagg

SEQ ID NO: 1731364 - DNA, 17 bp, Homo sapiens
tgctgaactcagcacat

SEQ ID NO: 1731365 - DNA, 19 bp, Homo sapiens
tgctgaactcagcacattc

SEQ ID NO: 1731366 - DNA, 11 bp, Homo sapiens
tgctgaactcc

SEQ ID NO: 1731367 - DNA, 11 bp, Homo sapiens
tgctgaagctg

SEQ ID NO: 1731368 - DNA, 15 bp, Homo sapiens
tgctgaagttctgag

SEQ ID NO: 1731369 - DNA, 15 bp, Homo sapiens
tgctgaatgccccct

SEQ ID NO: 1731370 - DNA, 20 bp, Homo sapiens
tgctgaatgccccctgctta

SEQ ID NO: 1731371 - DNA, 17 bp, Homo sapiens
tgctgaatttcaggcat

SEQ ID NO: 1731372 - DNA, 14 bp, Homo sapiens
tgctgaatttctaa

SEQ ID NO: 1731373 - DNA, 21 bp, Homo sapiens
tgctgacaaaaatattttcct

SEQ ID NO: 1731374 - DNA, 19 bp, Homo sapiens
tgctgacaacttagctcag

SEQ ID NO: 1731375 - DNA, 21 bp, Homo sapiens
tgctgaccaaatggccagttt

SEQ ID NO: 1731376 - DNA, 18 bp, Homo sapiens
tgctgaccaattgtgctg

SEQ ID NO: 1731377 - DNA, 20 bp, Homo sapiens
tgctgacgggacccacatgc

SEQ ID NO: 1731378 - DNA, 23 bp, Homo sapiens
cctctcccacccggccacagctg

SEQ ID NO: 1731379 - DNA, 24 bp, Homo sapiens
cctctcccacccggccacagctgc

SEQ ID NO: 1731380 - DNA, 16 bp, Homo sapiens
cctctcccaggcccga

SEQ ID NO: 1731381 - DNA, 13 bp, Homo sapiens
cctctcccatccc

SEQ ID NO: 1731382 - DNA, 16 bp, Homo sapiens
cctctcccatccccct

SEQ ID NO: 1731383 - DNA, 17 bp, Homo sapiens
cctctcccatccccctg

SEQ ID NO: 1731384 - DNA, 20 bp, Homo sapiens
cctctcccatccccctgccc

SEQ ID NO: 1731385 - DNA, 17 bp, Homo sapiens
cctctcccgcaccaggc

SEQ ID NO: 1731386 - DNA, 14 bp, Homo sapiens
cctctcccggctgc

SEQ ID NO: 1731387 - DNA, 16 bp, Homo sapiens
cctctcccggctgcct

SEQ ID NO: 1731388 - DNA, 18 bp, Homo sapiens
cctctcccggctgcctgc

SEQ ID NO: 1731389 - DNA, 22 bp, Homo sapiens
cctctcccggctgcctgccgcc

SEQ ID NO: 1731390 - DNA, 22 bp, Homo sapiens
cctctcccgtcagggcccaagt

SEQ ID NO: 1731391 - DNA, 10 bp, Homo sapiens
cctctccctc

SEQ ID NO: 1731392 - DNA, 16 bp, Homo sapiens
cctctccgactctgca

SEQ ID NO: 1731393 - DNA, 20 bp, Homo sapiens
cctctcctatgtggcagctg

SEQ ID NO: 1731394 - DNA, 21 bp, Homo sapiens
cctctcctatgtggcagctgg

SEQ ID NO: 1731395 - DNA, 16 bp, Homo sapiens
cctctcctgacccctg

SEQ ID NO: 1731396 - DNA, 12 bp, Homo sapiens
cctctcctgcct

SEQ ID NO: 1731397 - DNA, 16 bp, Homo sapiens
cctctcctgcctactc

SEQ ID NO: 1731398 - DNA, 20 bp, Homo sapiens
cctctcctgcttcctctttt

SEQ ID NO: 1731399 - DNA, 23 bp, Homo sapiens
cctctccttcatgacagcctcca

SEQ ID NO: 1731400 - DNA, 22 bp, Homo sapiens
cctctccttgggctcctggctg

SEQ ID NO: 1731401 - DNA, 22 bp, Homo sapiens
cctctcgacggcacgcacttgc

SEQ ID NO: 1731402 - DNA, 14 bp, Homo sapiens
cctctcgcggccct

SEQ ID NO: 1731403 - DNA, 14 bp, Homo sapiens
cctctcgctcccct

SEQ ID NO: 1731404 - DNA, 17 bp, Homo sapiens
cctctcgctcccctctg

SEQ ID NO: 1731405 - DNA, 15 bp, Homo sapiens
cctctcggccaggca

SEQ ID NO: 1731406 - DNA, 22 bp, Homo sapiens
cctctcggtgctccatctccgc

SEQ ID NO: 1731407 - DNA, 14 bp, Homo sapiens
cctctctcatgaga

SEQ ID NO: 1731408 - DNA, 15 bp, Homo sapiens
cctctctcccctctg

SEQ ID NO: 1731409 - DNA, 15 bp, Homo sapiens
cctctctccttggcc

SEQ ID NO: 1731410 - DNA, 18 bp, Homo sapiens
cctctctccttggccaca

SEQ ID NO: 1731411 - DNA, 21 bp, Homo sapiens
cctctctccttggccacagac

SEQ ID NO: 1731412 - DNA, 14 bp, Homo sapiens
cctctctcctttgc

SEQ ID NO: 1731413 - DNA, 15 bp, Homo sapiens
cctctctctcttcta

SEQ ID NO: 1731414 - DNA, 11 bp, Homo sapiens
cctctctctgg

SEQ ID NO: 1731415 - DNA, 13 bp, Homo sapiens
cctctctctgggc

SEQ ID NO: 1731416 - DNA, 17 bp, Homo sapiens
cctctctctgtggggct

SEQ ID NO: 1731417 - DNA, 16 bp, Homo sapiens
cctctctcttcccagc

SEQ ID NO: 1731418 - DNA, 22 bp, Homo sapiens
cctctctcttctgctccaccct

SEQ ID NO: 1731419 - DNA, 18 bp, Homo sapiens
cctctctctttcctccac

SEQ ID NO: 1731420 - DNA, 13 bp, Homo sapiens
cctctctgagtca

SEQ ID NO: 1731421 - DNA, 21 bp, Homo sapiens
cctctctgatcttgtgctcag

SEQ ID NO: 1731422 - DNA, 23 bp, Homo sapiens
cctctctgatcttgtgctcagca

SEQ ID NO: 1731423 - DNA, 23 bp, Homo sapiens
cctctctgcagacttcccagcta

SEQ ID NO: 1731424 - DNA, 13 bp, Homo sapiens
cctctctgctcct

SEQ ID NO: 1731425 - DNA, 17 bp, Homo sapiens
cctctctggcctcccac

SEQ ID NO: 1731426 - DNA, 12 bp, Homo sapiens
cctctctgtccc

SEQ ID NO: 1731427 - DNA, 12 bp, Homo sapiens
cctctcttcccc

SEQ ID NO: 1731428 - DNA, 16 bp, Homo sapiens
cctctcttccccttcc

SEQ ID NO: 1731429 - DNA, 17 bp, Homo sapiens
cctctcttccccttccc

SEQ ID NO: 1731430 - DNA, 19 bp, Homo sapiens
cctctcttgattaagggct

SEQ ID NO: 1731431 - DNA, 14 bp, Homo sapiens
cctctcttgcaccc

SEQ ID NO: 1731432 - DNA, 19 bp, Homo sapiens
cctctcttggcaattcctc

SEQ ID NO: 1731433 - DNA, 21 bp, Homo sapiens
cctctcttggtttccttcctt

SEQ ID NO: 1731434 - DNA, 12 bp, Homo sapiens
cctctctttctc

SEQ ID NO: 1731435 - DNA, 14 bp, Homo sapiens
cctctctttctctg

SEQ ID NO: 1731436 - DNA, 18 bp, Homo sapiens
cctctgaaaagtgtgtat

SEQ ID NO: 1731437 - DNA, 17 bp, Homo sapiens
cctctgaaaatattttt

SEQ ID NO: 1731438 - DNA, 23 bp, Homo sapiens
cctctgaaaatatttttttctag

SEQ ID NO: 1731439 - DNA, 22 bp, Homo sapiens
cctctgaatttacttccttgca

SEQ ID NO: 1731440 - DNA, 18 bp, Homo sapiens
cctctgacagtccacagg

SEQ ID NO: 1731441 - DNA, 20 bp, Homo sapiens
cctctgaccaacaggctgtt

SEQ ID NO: 1731442 - DNA, 20 bp, Homo sapiens
cctctgacctgcaggccaag

SEQ ID NO: 1731443 - DNA, 20 bp, Homo sapiens
cctctgagaagctctgaaga

SEQ ID NO: 1731444 - DNA, 16 bp, Homo sapiens
cctctgagcagcctct

SEQ ID NO: 1731445 - DNA, 14 bp, Homo sapiens
cctctgaggacaga

SEQ ID NO: 1731446 - DNA, 21 bp, Homo sapiens
cctctgaggacagaggccggg

SEQ ID NO: 1731447 - DNA, 18 bp, Homo sapiens
cctctgatatgggactga

SEQ ID NO: 1731448 - DNA, 17 bp, Homo sapiens
cctctgatcacattctt

SEQ ID NO: 1731449 - DNA, 19 bp, Homo sapiens
cctctgcacaccctccaga

SEQ ID NO: 1731450 - DNA, 21 bp, Homo sapiens
cctctgcactactgacatgtg

SEQ ID NO: 1731451 - DNA, 14 bp, Homo sapiens
cctctgcagaatcc

SEQ ID NO: 1731452 - DNA, 13 bp, Homo sapiens
cctctgcagctga

SEQ ID NO: 1731453 - DNA, 22 bp, Homo sapiens
cctctgcagctgacctctgttg

SEQ ID NO: 1731454 - DNA, 16 bp, Homo sapiens
cctctgcagtctcatt

SEQ ID NO: 1731455 - DNA, 18 bp, Homo sapiens
cctctgcagtctcatttc

SEQ ID NO: 1731456 - DNA, 11 bp, Homo sapiens
cctctgccacc

SEQ ID NO: 1731457 - DNA, 16 bp, Homo sapiens
cctctgccaggcctgt

SEQ ID NO: 1731458 - DNA, 18 bp, Homo sapiens
cctctgcccagcttgggc

SEQ ID NO: 1731459 - DNA, 23 bp, Homo sapiens
cctctgcccagcttgggcccagc

SEQ ID NO: 1731460 - DNA, 16 bp, Homo sapiens
cctctgccccaagcag

SEQ ID NO: 1731461 - DNA, 21 bp, Homo sapiens
cctctgccccaagcagccagc

SEQ ID NO: 1731462 - DNA, 14 bp, Homo sapiens
cctctgccctggat

SEQ ID NO: 1731463 - DNA, 14 bp, Homo sapiens
cctctgcctcaatg

SEQ ID NO: 1731464 - DNA, 17 bp, Homo sapiens
cctctgcctctagtccc

SEQ ID NO: 1731465 - DNA, 15 bp, Homo sapiens
cctctgcctgcactc

SEQ ID NO: 1731466 - DNA, 16 bp, Homo sapiens
cctctgcctgcactcc

SEQ ID NO: 1731467 - DNA, 12 bp, Homo sapiens
cctctgcctgcc

SEQ ID NO: 1731468 - DNA, 16 bp, Homo sapiens
cctctgcctgccccgc

SEQ ID NO: 1731469 - DNA, 12 bp, Homo sapiens
cctctgcctggg

SEQ ID NO: 1731470 - DNA, 14 bp, Homo sapiens
cctctgcctggggc

SEQ ID NO: 1731471 - DNA, 23 bp, Homo sapiens
cctctgcctttgcaccacgggac

SEQ ID NO: 1731472 - DNA, 19 bp, Homo sapiens
cctctgcgtctatcctgtg

SEQ ID NO: 1731473 - DNA, 14 bp, Homo sapiens
cctctgctccagca

SEQ ID NO: 1731474 - DNA, 15 bp, Homo sapiens
cctctgctccagcaa

SEQ ID NO: 1731475 - DNA, 16 bp, Homo sapiens
cctctgctccagcaac

SEQ ID NO: 1731476 - DNA, 11 bp, Homo sapiens
cctctgctccc

SEQ ID NO: 1731477 - DNA, 15 bp, Homo sapiens
tgctgctgccttcac

SEQ ID NO: 1731478 - DNA, 13 bp, Homo sapiens
tgctgctggccaa

SEQ ID NO: 1731479 - DNA, 14 bp, Homo sapiens
tgctgctggggaag

SEQ ID NO: 1731480 - DNA, 19 bp, Homo sapiens
tgctgctggggaagacagt

SEQ ID NO: 1731481 - DNA, 20 bp, Homo sapiens
tgctgctggggaagacagtg

SEQ ID NO: 1731482 - DNA, 21 bp, Homo sapiens
tgctgctggggaagacagtgg

SEQ ID NO: 1731483 - DNA, 18 bp, Homo sapiens
tgctgctgtaactgctga

SEQ ID NO: 1731484 - DNA, 19 bp, Homo sapiens
tgctgctgtaactgctgag

SEQ ID NO: 1731485 - DNA, 20 bp, Homo sapiens
tgctgctgtaactgctgagc

SEQ ID NO: 1731486 - DNA, 21 bp, Homo sapiens
tgctgctgtaactgctgagcc

SEQ ID NO: 1731487 - DNA, 16 bp, Homo sapiens
tgctgcttctcttggg

SEQ ID NO: 1731488 - DNA, 15 bp, Homo sapiens
tgctggaaataaaac

SEQ ID NO: 1731489 - DNA, 14 bp, Homo sapiens
tgctggaagcccag

SEQ ID NO: 1731490 - DNA, 14 bp, Homo sapiens
tgctggaaggggca

SEQ ID NO: 1731491 - DNA, 20 bp, Homo sapiens
tgctggaaggggcagcagga

SEQ ID NO: 1731492 - DNA, 11 bp, Homo sapiens
tgctggaagtc

SEQ ID NO: 1731493 - DNA, 19 bp, Homo sapiens
tgctggaagtctccatgaa

SEQ ID NO: 1731494 - DNA, 21 bp, Homo sapiens
tgctggaattccacagggacc

SEQ ID NO: 1731495 - DNA, 23 bp, Homo sapiens
tgctggacatgagatggagaggc

SEQ ID NO: 1731496 - DNA, 15 bp, Homo sapiens
tgctggactgtcata

SEQ ID NO: 1731497 - DNA, 19 bp, Homo sapiens
tgctggactgtcatagaaa

SEQ ID NO: 1731498 - DNA, 17 bp, Homo sapiens
tgctggactgtggaggg

SEQ ID NO: 1731499 - DNA, 13 bp, Homo sapiens
cctgaacaagaat

SEQ ID NO: 1731500 - DNA, 20 bp, Homo sapiens
cctgaacatccttccttccc

SEQ ID NO: 1731501 - DNA, 21 bp, Homo sapiens
cctgaacatccttccttccca

SEQ ID NO: 1731502 - DNA, 21 bp, Homo sapiens
cctgaaccccagaggcagagg

SEQ ID NO: 1731503 - DNA, 16 bp, Homo sapiens
cctgaacccctggcca

SEQ ID NO: 1731504 - DNA, 20 bp, Homo sapiens
cctgaacccctggccagctc

SEQ ID NO: 1731505 - DNA, 17 bp, Homo sapiens
cctgaaccttgagcaaa

SEQ ID NO: 1731506 - DNA, 16 bp, Homo sapiens
cctgaacgttttcttc

SEQ ID NO: 1731507 - DNA, 17 bp, Homo sapiens
cctgaacgttttcttct

SEQ ID NO: 1731508 - DNA, 18 bp, Homo sapiens
cctgaacgttttcttctt

SEQ ID NO: 1731509 - DNA, 20 bp, Homo sapiens
cctgaacgttttcttctttc

SEQ ID NO: 1731510 - DNA, 14 bp, Homo sapiens
cctgaactatttat

SEQ ID NO: 1731511 - DNA, 13 bp, Homo sapiens
cctgaactgagga

SEQ ID NO: 1731512 - DNA, 14 bp, Homo sapiens
cctgaactgaggag

SEQ ID NO: 1731513 - DNA, 14 bp, Homo sapiens
cctgaactgaggcc

SEQ ID NO: 1731514 - DNA, 16 bp, Homo sapiens
cctgaactgaggcctt

SEQ ID NO: 1731515 - DNA, 14 bp, Homo sapiens
cctgaagaacagta

SEQ ID NO: 1731516 - DNA, 13 bp, Homo sapiens
cctgaagaaccag

SEQ ID NO: 1731517 - DNA, 18 bp, Homo sapiens
cctgaagaattaagatac

SEQ ID NO: 1731518 - DNA, 19 bp, Homo sapiens
cctgaagagaagggcaggg

SEQ ID NO: 1731519 - DNA, 21 bp, Homo sapiens
cctgaagaggcgggccagcca

SEQ ID NO: 1731520 - DNA, 23 bp, Homo sapiens
cctgaagaggcgggccagccagg

SEQ ID NO: 1731521 - DNA, 18 bp, Homo sapiens
cctgaagcctggattcca

SEQ ID NO: 1731522 - DNA, 15 bp, Homo sapiens
cctgaagctgctgga

SEQ ID NO: 1731523 - DNA, 21 bp, Homo sapiens
cctgaaggaacattccttagt

SEQ ID NO: 1731524 - DNA, 15 bp, Homo sapiens
cctgaagggaactag

SEQ ID NO: 1731525 - DNA, 17 bp, Homo sapiens
cctgaatcatgagcctg

SEQ ID NO: 1731526 - DNA, 21 bp, Homo sapiens
cctgaatccaaactaatccat

SEQ ID NO: 1731527 - DNA, 13 bp, Homo sapiens
cctgacaatggca

SEQ ID NO: 1731528 - DNA, 15 bp, Homo sapiens
cctgacacaccaggc

SEQ ID NO: 1731529 - DNA, 20 bp, Homo sapiens
cctgacacactaaccaagct

SEQ ID NO: 1731530 - DNA, 23 bp, Homo sapiens
cctgacacagtgctcgaccttga

SEQ ID NO: 1731531 - DNA, 13 bp, Homo sapiens
cctgacaccccct

SEQ ID NO: 1731532 - DNA, 16 bp, Homo sapiens
cctgacaccccctccc

SEQ ID NO: 1731533 - DNA, 14 bp, Homo sapiens
cctgacactttaat

SEQ ID NO: 1731534 - DNA, 15 bp, Homo sapiens
cctgacactttaatt

SEQ ID NO: 1731535 - DNA, 14 bp, Homo sapiens
cctgacagaaggtg

SEQ ID NO: 1731536 - DNA, 17 bp, Homo sapiens
cctgacatggacccact

SEQ ID NO: 1731537 - DNA, 18 bp, Homo sapiens
cctgaccaccctcccctc

SEQ ID NO: 1731538 - DNA, 20 bp, Homo sapiens
cctgaccagctgctccgagg

SEQ ID NO: 1731539 - DNA, 14 bp, Homo sapiens
cctgacccaggccg

SEQ ID NO: 1731540 - DNA, 15 bp, Homo sapiens
cctgacccaggccgc

SEQ ID NO: 1731541 - DNA, 16 bp, Homo sapiens
cctgacccaggccgca

SEQ ID NO: 1731542 - DNA, 18 bp, Homo sapiens
cctgacccaggccgcagc

SEQ ID NO: 1731543 - DNA, 21 bp, Homo sapiens
cctgacccaggccgcagctct

SEQ ID NO: 1731544 - DNA, 17 bp, Homo sapiens
cctgaccccattcctga

SEQ ID NO: 1731545 - DNA, 18 bp, Homo sapiens
cctgaccccattcctgat

SEQ ID NO: 1731546 - DNA, 16 bp, Homo sapiens
cctgacccctgctcag

SEQ ID NO: 1731547 - DNA, 18 bp, Homo sapiens
cctgacctaccccagcca

SEQ ID NO: 1731548 - DNA, 21 bp, Homo sapiens
cctgacctaccccagccaggc

SEQ ID NO: 1731549 - DNA, 23 bp, Homo sapiens
cctgacctaccccagccaggctc

SEQ ID NO: 1731550 - DNA, 16 bp, Homo sapiens
cctgacctcactgtga

SEQ ID NO: 1731551 - DNA, 16 bp, Homo sapiens
cctgacctccctctaa

SEQ ID NO: 1731552 - DNA, 19 bp, Homo sapiens
cctgaccttagcgttctgg

SEQ ID NO: 1731553 - DNA, 20 bp, Homo sapiens
cctgaccttagcgttctgga

SEQ ID NO: 1731554 - DNA, 21 bp, Homo sapiens
cctgaccttagcgttctggac

SEQ ID NO: 1731555 - DNA, 17 bp, Homo sapiens
cctgactcaattatttg

SEQ ID NO: 1731556 - DNA, 15 bp, Homo sapiens
cctgactctctgtga

SEQ ID NO: 1731557 - DNA, 21 bp, Homo sapiens
cctgactgcccgctcctcggg

SEQ ID NO: 1731558 - DNA, 13 bp, Homo sapiens
cctgacttctgga

SEQ ID NO: 1731559 - DNA, 15 bp, Homo sapiens
cctgacttctggaga

SEQ ID NO: 1731560 - DNA, 23 bp, Homo sapiens
cctgacttgagtgttccttttta

SEQ ID NO: 1731561 - DNA, 18 bp, Homo sapiens
cctgagaaacccaccagc

SEQ ID NO: 1731562 - DNA, 22 bp, Homo sapiens
cctgagaaacccaccagcctaa

SEQ ID NO: 1731563 - DNA, 19 bp, Homo sapiens
cctgagaaggcgaggagag

SEQ ID NO: 1731564 - DNA, 12 bp, Homo sapiens
cctgagaatgag

SEQ ID NO: 1731565 - DNA, 22 bp, Homo sapiens
cctgagaccagttgggagcact

SEQ ID NO: 1731566 - DNA, 19 bp, Homo sapiens
cctgagaccctactgaagt

SEQ ID NO: 1731567 - DNA, 16 bp, Homo sapiens
cctgagacctccactc

SEQ ID NO: 1731568 - DNA, 14 bp, Homo sapiens
cctgagagcatctc

SEQ ID NO: 1731569 - DNA, 19 bp, Homo sapiens
cctgagagcatctcaggag

SEQ ID NO: 1731570 - DNA, 18 bp, Homo sapiens
cctgagaggcaggcatag

SEQ ID NO: 1731571 - DNA, 20 bp, Homo sapiens
cctgagaggggaagcggccc

SEQ ID NO: 1731572 - DNA, 14 bp, Homo sapiens
cctgagatgtgtga

SEQ ID NO: 1731573 - DNA, 15 bp, Homo sapiens
cctgagattctttaa

SEQ ID NO: 1731574 - DNA, 16 bp, Homo sapiens
cctgagattctttaag

SEQ ID NO: 1731575 - DNA, 18 bp, Homo sapiens
cctgagattctttaagga

SEQ ID NO: 1731576 - DNA, 20 bp, Homo sapiens
cctgagattctttaaggaga

SEQ ID NO: 1731577 - DNA, 23 bp, Homo sapiens
cctgagattctttaaggagatag

SEQ ID NO: 1731578 - DNA, 23 bp, Homo sapiens
cctgagatttcatctgctctcct

SEQ ID NO: 1731579 - DNA, 20 bp, Homo sapiens
cctgagcaatgtctgtgcta

SEQ ID NO: 1731580 - DNA, 23 bp, Homo sapiens
cctgagcagaatactggtctcag

SEQ ID NO: 1731581 - DNA, 20 bp, Homo sapiens
cctgagcagggtccacagct

SEQ ID NO: 1731582 - DNA, 13 bp, Homo sapiens
cctgagccaggga

SEQ ID NO: 1731583 - DNA, 21 bp, Homo sapiens
cctgagccagggaacagcccc

SEQ ID NO: 1731584 - DNA, 16 bp, Homo sapiens
cctgagcccaggagct

SEQ ID NO: 1731585 - DNA, 20 bp, Homo sapiens
cctgagccccctgcacccac

SEQ ID NO: 1731586 - DNA, 21 bp, Homo sapiens
cctgagcctcaaccttctggg

SEQ ID NO: 1731587 - DNA, 23 bp, Homo sapiens
cctgagcgctcctgccgcagagc

SEQ ID NO: 1731588 - DNA, 22 bp, Homo sapiens
cctgagcgctgtggactgtcct

SEQ ID NO: 1731589 - DNA, 23 bp, Homo sapiens
cctgagctcggggggctctgcct

SEQ ID NO: 1731590 - DNA, 15 bp, Homo sapiens
cctgagctcggtgga

SEQ ID NO: 1731591 - DNA, 20 bp, Homo sapiens
tgaatgtccccattctataa

SEQ ID NO: 1731592 - DNA, 17 bp, Homo sapiens
tgaatgtgctggtgaac

SEQ ID NO: 1731593 - DNA, 19 bp, Homo sapiens
tagaagattgttggtgaat

SEQ ID NO: 1731594 - DNA, 21 bp, Homo sapiens
tagaagccaagtaaagtgctt

SEQ ID NO: 1731595 - DNA, 12 bp, Homo sapiens
tagaagcctgca

SEQ ID NO: 1731596 - DNA, 23 bp, Homo sapiens
tagaaggaaaaaagttccttcct

SEQ ID NO: 1731597 - DNA, 21 bp, Homo sapiens
tagaaggcgtccatgtttatt

SEQ ID NO: 1731598 - DNA, 18 bp, Homo sapiens
tagaaggcttctctccac

SEQ ID NO: 1731599 - DNA, 22 bp, Homo sapiens
tagaagggccagtcctgcctgg

SEQ ID NO: 1731600 - DNA, 19 bp, Homo sapiens
tagaaggttgacacagttg

SEQ ID NO: 1731601 - DNA, 15 bp, Homo sapiens
tagaagtaggaggaa

SEQ ID NO: 1731602 - DNA, 14 bp, Homo sapiens
tagaagtctggaaa

SEQ ID NO: 1731603 - DNA, 16 bp, Homo sapiens
tagaagtctggaaaaa

SEQ ID NO: 1731604 - DNA, 17 bp, Homo sapiens
tagaagtcttagatgta

SEQ ID NO: 1731605 - DNA, 19 bp, Homo sapiens
tagaagtcttagatgtata

SEQ ID NO: 1731606 - DNA, 18 bp, Homo sapiens
tagaagtgagtttgtaaa

SEQ ID NO: 1731607 - DNA, 16 bp, Homo sapiens
tagaagtggaccagga

SEQ ID NO: 1731608 - DNA, 20 bp, Homo sapiens
tagaagtggaccaggacagg

SEQ ID NO: 1731609 - DNA, 19 bp, Homo sapiens
tagaagtgggccaggacag

SEQ ID NO: 1731610 - DNA, 19 bp, Homo sapiens
tagaagtggtttgtagact

SEQ ID NO: 1731611 - DNA, 19 bp, Homo sapiens
tagaagtgttgtaaaagat

SEQ ID NO: 1731612 - DNA, 15 bp, Homo sapiens
tagaagttactgaat

SEQ ID NO: 1731613 - DNA, 13 bp, Homo sapiens
tagaataaaagct

SEQ ID NO: 1731614 - DNA, 21 bp, Homo sapiens
tagaataaaagctataaagta

SEQ ID NO: 1731615 - DNA, 19 bp, Homo sapiens
tagaataaaggcagttttc

SEQ ID NO: 1731616 - DNA, 16 bp, Homo sapiens
tagaataaggaggagg

SEQ ID NO: 1731617 - DNA, 12 bp, Homo sapiens
tagaataattct

SEQ ID NO: 1731618 - DNA, 13 bp, Homo sapiens
tagaataattctt

SEQ ID NO: 1731619 - DNA, 20 bp, Homo sapiens
tagaataattcttttctgag

SEQ ID NO: 1731620 - DNA, 18 bp, Homo sapiens
tagaatactttttaaaag

SEQ ID NO: 1731621 - DNA, 15 bp, Homo sapiens
tagaatataattatc

SEQ ID NO: 1731622 - DNA, 20 bp, Homo sapiens
tagaatatttattacctctg

SEQ ID NO: 1731623 - DNA, 15 bp, Homo sapiens
tagaatcaaatactc

SEQ ID NO: 1731624 - DNA, 20 bp, Homo sapiens
tagaatctcttcatgcttga

SEQ ID NO: 1731625 - DNA, 18 bp, Homo sapiens
tagaatctgcaattcaaa

SEQ ID NO: 1731626 - DNA, 22 bp, Homo sapiens
tagaatgaatttatctttacca

SEQ ID NO: 1731627 - DNA, 19 bp, Homo sapiens
tagaatgatgttttaaaaa

SEQ ID NO: 1731628 - DNA, 21 bp, Homo sapiens
tagaatgatttcatgctatct

SEQ ID NO: 1731629 - DNA, 17 bp, Homo sapiens
tagaatgtcagatttct

SEQ ID NO: 1731630 - DNA, 21 bp, Homo sapiens
tagaatgtcagatttctggtt

SEQ ID NO: 1731631 - DNA, 12 bp, Homo sapiens
tagaatgtggat

SEQ ID NO: 1731632 - DNA, 21 bp, Homo sapiens
tagaattaccattaattacat

SEQ ID NO: 1731633 - DNA, 22 bp, Homo sapiens
tagaattataactgtaaagatg

SEQ ID NO: 1731634 - DNA, 16 bp, Homo sapiens
tagaattatctaattt

SEQ ID NO: 1731635 - DNA, 19 bp, Homo sapiens
tagaattatctaatttata

SEQ ID NO: 1731636 - DNA, 21 bp, Homo sapiens
tagaattatctaatttataaa

SEQ ID NO: 1731637 - DNA, 23 bp, Homo sapiens
tagaattatctaatttataaaaa

SEQ ID NO: 1731638 - DNA, 16 bp, Homo sapiens
tagaattatttaaaca

SEQ ID NO: 1731639 - DNA, 19 bp, Homo sapiens
tagaattcagaaaattgtt

SEQ ID NO: 1731640 - DNA, 22 bp, Homo sapiens
tagaattctagtgctgctgaag

SEQ ID NO: 1731641 - DNA, 14 bp, Homo sapiens
tagaattcttttat

SEQ ID NO: 1731642 - DNA, 16 bp, Homo sapiens
tagaattgcagtcatt

SEQ ID NO: 1731643 - DNA, 22 bp, Homo sapiens
tagaatttattcaattcctctg

SEQ ID NO: 1731644 - DNA, 16 bp, Homo sapiens
tagacaaaaagtatat

SEQ ID NO: 1731645 - DNA, 14 bp, Homo sapiens
tagacaaagtacat

SEQ ID NO: 1731646 - DNA, 20 bp, Homo sapiens
tagacaaatagaaaatggtc

SEQ ID NO: 1731647 - DNA, 23 bp, Homo sapiens
tagacaaatgctacattaatgtt

SEQ ID NO: 1731648 - DNA, 20 bp, Homo sapiens
tagacaacctgaaatttatt

SEQ ID NO: 1731649 - DNA, 16 bp, Homo sapiens
tagacaacctttctgt

SEQ ID NO: 1731650 - DNA, 14 bp, Homo sapiens
tagacaactagatt

SEQ ID NO: 1731651 - DNA, 14 bp, Homo sapiens
tagacaagatattg

SEQ ID NO: 1731652 - DNA, 19 bp, Homo sapiens
tagacaagatattgtacat

SEQ ID NO: 1731653 - DNA, 21 bp, Homo sapiens
tagacaagatattgtacataa

SEQ ID NO: 1731654 - DNA, 16 bp, Homo sapiens
tagacacaatttcatt

SEQ ID NO: 1731655 - DNA, 20 bp, Homo sapiens
tagacaccaaagttctaata

SEQ ID NO: 1731656 - DNA, 16 bp, Homo sapiens
tagacaccaaggaggc

SEQ ID NO: 1731657 - DNA, 21 bp, Homo sapiens
tagacagaaaccaagccatta

SEQ ID NO: 1731658 - DNA, 18 bp, Homo sapiens
tagacagagttgcttaat

SEQ ID NO: 1731659 - DNA, 21 bp, Homo sapiens
tagacagagttgcttaatgaa

SEQ ID NO: 1731660 - DNA, 13 bp, Homo sapiens
tagacagatattt

SEQ ID NO: 1731661 - DNA, 19 bp, Homo sapiens
tagacagcttttctcaact

SEQ ID NO: 1731662 - DNA, 16 bp, Homo sapiens
tagacaggtcctgatt

SEQ ID NO: 1731663 - DNA, 19 bp, Homo sapiens
tagacagtaaaatactatt

SEQ ID NO: 1731664 - DNA, 20 bp, Homo sapiens
tagacatcaatcctggtaac

SEQ ID NO: 1731665 - DNA, 23 bp, Homo sapiens
tagacatggaggttctaaggcct

SEQ ID NO: 1731666 - DNA, 14 bp, Homo sapiens
tagacattcagact

SEQ ID NO: 1731667 - DNA, 22 bp, Homo sapiens
tagacattcagactaaaaatac

SEQ ID NO: 1731668 - DNA, 14 bp, Homo sapiens
tagaccaaaataaa

SEQ ID NO: 1731669 - DNA, 12 bp, Homo sapiens
tagaccaaagca

SEQ ID NO: 1731670 - DNA, 18 bp, Homo sapiens
tagaccaagcttgtccaa

SEQ ID NO: 1731671 - DNA, 23 bp, Homo sapiens
tagacccaggtggagggcacagc

SEQ ID NO: 1731672 - DNA, 16 bp, Homo sapiens
tagacccgccaggtca

SEQ ID NO: 1731673 - DNA, 19 bp, Homo sapiens
tagaccctctttcttgttt

SEQ ID NO: 1731674 - DNA, 12 bp, Homo sapiens
tagaccctgggt

SEQ ID NO: 1731675 - DNA, 13 bp, Homo sapiens
tagacctcagcct

SEQ ID NO: 1731676 - DNA, 22 bp, Homo sapiens
tagacctcagcctgtgctgccc

SEQ ID NO: 1731677 - DNA, 21 bp, Homo sapiens
tagacctctggttaatttata

SEQ ID NO: 1731678 - DNA, 17 bp, Homo sapiens
tagaccttgttacttct

SEQ ID NO: 1731679 - DNA, 16 bp, Homo sapiens
tagacgccttccaggt

SEQ ID NO: 1731680 - DNA, 15 bp, Homo sapiens
tagacgggttgaaag

SEQ ID NO: 1731681 - DNA, 16 bp, Homo sapiens
tagacgggttgaaaga

SEQ ID NO: 1731682 - DNA, 20 bp, Homo sapiens
tagacgggttgaaagacatc

SEQ ID NO: 1731683 - DNA, 21 bp, Homo sapiens
tagactaagaataagaagcat

SEQ ID NO: 1731684 - DNA, 17 bp, Homo sapiens
tagactagtcctatgga

SEQ ID NO: 1731685 - DNA, 22 bp, Homo sapiens
tagactattccttttctgtata

SEQ ID NO: 1731686 - DNA, 13 bp, Homo sapiens
tagactatttctt

SEQ ID NO: 1731687 - DNA, 18 bp, Homo sapiens
tagactcctcaggagaga

SEQ ID NO: 1731688 - DNA, 16 bp, Homo sapiens
tagactctagtattta

SEQ ID NO: 1731689 - DNA, 13 bp, Homo sapiens
tagactgaattta

SEQ ID NO: 1731690 - DNA, 19 bp, Homo sapiens
tagactgaggtataaagac

SEQ ID NO: 1731691 - DNA, 20 bp, Homo sapiens
tagacttatagtcctcctgg

SEQ ID NO: 1731692 - DNA, 19 bp, Homo sapiens
tagacttcccactgttctg

SEQ ID NO: 1731693 - DNA, 22 bp, Homo sapiens
tagacttcccactgttctgaaa

SEQ ID NO: 1731694 - DNA, 13 bp, Homo sapiens
tagacttccccat

SEQ ID NO: 1731695 - DNA, 17 bp, Homo sapiens
tagacttccccatcccg

SEQ ID NO: 1731696 - DNA, 17 bp, Homo sapiens
tagacttctggttgtat

SEQ ID NO: 1731697 - DNA, 22 bp, Homo sapiens
tagacttgggatggggagggag

SEQ ID NO: 1731698 - DNA, 18 bp, Homo sapiens
tagacttgtgctgatcgt

SEQ ID NO: 1731699 - DNA, 13 bp, Homo sapiens
tagagaagcaagt

SEQ ID NO: 1731700 - DNA, 13 bp, Homo sapiens
tagagaaggaccc

SEQ ID NO: 1731701 - DNA, 16 bp, Homo sapiens
tagagaatgtgtttca

SEQ ID NO: 1731702 - DNA, 11 bp, Homo sapiens
tagagacacat

SEQ ID NO: 1731703 - DNA, 19 bp, Homo sapiens
tagagacaggacagaatgt

SEQ ID NO: 1731704 - DNA, 14 bp, Homo sapiens
tagagagaacaggt

SEQ ID NO: 1731705 - DNA, 21 bp, Homo sapiens
taaagccttctggatccatgg

SEQ ID NO: 1731706 - DNA, 18 bp, Homo sapiens
taaagcctttgtatcttt

SEQ ID NO: 1731707 - DNA, 15 bp, Homo sapiens
taaagctaaaataac

SEQ ID NO: 1731708 - DNA, 16 bp, Homo sapiens
taaagctaaattttgt

SEQ ID NO: 1731709 - DNA, 15 bp, Homo sapiens
taaagctaaggacct

SEQ ID NO: 1731710 - DNA, 14 bp, Homo sapiens
taaagctatgttac

SEQ ID NO: 1731711 - DNA, 20 bp, Homo sapiens
taaagctcaaatgaaatgta

SEQ ID NO: 1731712 - DNA, 20 bp, Homo sapiens
taaagctcataaactgccaa

SEQ ID NO: 1731713 - DNA, 13 bp, Homo sapiens
taaagctggaaca

SEQ ID NO: 1731714 - DNA, 22 bp, Homo sapiens
taaagctggaacatttgatatt

SEQ ID NO: 1731715 - DNA, 14 bp, Homo sapiens
taaagctgttattc

SEQ ID NO: 1731716 - DNA, 13 bp, Homo sapiens
taaagcttaaatt

SEQ ID NO: 1731717 - DNA, 20 bp, Homo sapiens
taaagcttatttttctgtga

SEQ ID NO: 1731718 - DNA, 22 bp, Homo sapiens
taaagcttccctctcagctgct

SEQ ID NO: 1731719 - DNA, 19 bp, Homo sapiens
taaagcttgcaacaaaatt

SEQ ID NO: 1731720 - DNA, 17 bp, Homo sapiens
taaagcttgtggcccct

SEQ ID NO: 1731721 - DNA, 15 bp, Homo sapiens
taaagcttttggaag

SEQ ID NO: 1731722 - DNA, 17 bp, Homo sapiens
taaaggagaaggcatga

SEQ ID NO: 1731723 - DNA, 13 bp, Homo sapiens
taaaggcagctgc

SEQ ID NO: 1731724 - DNA, 14 bp, Homo sapiens
taaaggcagctgcc

SEQ ID NO: 1731725 - DNA, 16 bp, Homo sapiens
taaaggcagctgcctc

SEQ ID NO: 1731726 - DNA, 18 bp, Homo sapiens
taaaggcagctgcctctg

SEQ ID NO: 1731727 - DNA, 20 bp, Homo sapiens
taaaggctatacttgtcttg

SEQ ID NO: 1731728 - DNA, 17 bp, Homo sapiens
taaagggaagaaaacac

SEQ ID NO: 1731729 - DNA, 13 bp, Homo sapiens
taaagggcagggc

SEQ ID NO: 1731730 - DNA, 21 bp, Homo sapiens
taaaggtacgattatacttga

SEQ ID NO: 1731731 - DNA, 20 bp, Homo sapiens
taaaggtccacaggtctaga

SEQ ID NO: 1731732 - DNA, 22 bp, Homo sapiens
taaaggtgacatcggaaaaata

SEQ ID NO: 1731733 - DNA, 20 bp, Homo sapiens
taaaggtggtgaggcaataa

SEQ ID NO: 1731734 - DNA, 21 bp, Homo sapiens
taaaggtggtgaggcaataaa

SEQ ID NO: 1731735 - DNA, 22 bp, Homo sapiens
taaaggttacaagcctgcacaa

SEQ ID NO: 1731736 - DNA, 13 bp, Homo sapiens
taaagtacaaatg

SEQ ID NO: 1731737 - DNA, 21 bp, Homo sapiens
taaagtacaaatgaagaaagt

SEQ ID NO: 1731738 - DNA, 22 bp, Homo sapiens
taaagtacaaatgaagaaagtc

SEQ ID NO: 1731739 - DNA, 14 bp, Homo sapiens
taaagtacctgtag

SEQ ID NO: 1731740 - DNA, 15 bp, Homo sapiens
taaagtacctgtagt

SEQ ID NO: 1731741 - DNA, 21 bp, Homo sapiens
taaagtagtaaaagaagaaat

SEQ ID NO: 1731742 - DNA, 15 bp, Homo sapiens
taaagtataatgttt

SEQ ID NO: 1731743 - DNA, 19 bp, Homo sapiens
taaagtatatatagaatct

SEQ ID NO: 1731744 - DNA, 19 bp, Homo sapiens
taaagtatgaatctatgcc

SEQ ID NO: 1731745 - DNA, 21 bp, Homo sapiens
taaagtatgcattattaaatt

SEQ ID NO: 1731746 - DNA, 21 bp, Homo sapiens
taaagtatgtattatttacat

SEQ ID NO: 1731747 - DNA, 22 bp, Homo sapiens
taaagtattcaacaatttcaat

SEQ ID NO: 1731748 - DNA, 18 bp, Homo sapiens
taaagtcacttccagtgt

SEQ ID NO: 1731749 - DNA, 15 bp, Homo sapiens
taaagtcagaagttt

SEQ ID NO: 1731750 - DNA, 18 bp, Homo sapiens
taaagtcaggtccaattt

SEQ ID NO: 1731751 - DNA, 23 bp, Homo sapiens
taaagtcatggtcattgcaggaa

SEQ ID NO: 1731752 - DNA, 17 bp, Homo sapiens
taaagtctaagcaagat

SEQ ID NO: 1731753 - DNA, 14 bp, Homo sapiens
taaagtctattttt

SEQ ID NO: 1731754 - DNA, 13 bp, Homo sapiens
taaagtgatgttt

SEQ ID NO: 1731755 - DNA, 12 bp, Homo sapiens
tgccacttccca

SEQ ID NO: 1731756 - DNA, 18 bp, Homo sapiens
tgccacttcccagaggca

SEQ ID NO: 1731757 - DNA, 21 bp, Homo sapiens
tgccacttcttaaaggcctgg

SEQ ID NO: 1731758 - DNA, 22 bp, Homo sapiens
tgccacttcttaaaggcctgga

SEQ ID NO: 1731759 - DNA, 23 bp, Homo sapiens
tgccacttcttaaaggcctggaa

SEQ ID NO: 1731760 - DNA, 22 bp, Homo sapiens
tgccactttacccacctagaac

SEQ ID NO: 1731761 - DNA, 23 bp, Homo sapiens
tgccactttggcttctcctgtga

SEQ ID NO: 1731762 - DNA, 19 bp, Homo sapiens
tgccagaagagaattcagt

SEQ ID NO: 1731763 - DNA, 17 bp, Homo sapiens
tgccagaattttaggaa

SEQ ID NO: 1731764 - DNA, 13 bp, Homo sapiens
tgccagacatgtg

SEQ ID NO: 1731765 - DNA, 21 bp, Homo sapiens
tgccagacattgctctcagtg

SEQ ID NO: 1731766 - DNA, 14 bp, Homo sapiens
tgccagacttaaat

SEQ ID NO: 1731767 - DNA, 11 bp, Homo sapiens
tgccagagagg

SEQ ID NO: 1731768 - DNA, 18 bp, Homo sapiens
tgccagagaggtggggat

SEQ ID NO: 1731769 - DNA, 14 bp, Homo sapiens
tgccagagatccaa

SEQ ID NO: 1731770 - DNA, 13 bp, Homo sapiens
tgccagagcagga

SEQ ID NO: 1731771 - DNA, 16 bp, Homo sapiens
tgccagagcaggagcc

SEQ ID NO: 1731772 - DNA, 17 bp, Homo sapiens
tgccagagccaacctgg

SEQ ID NO: 1731773 - DNA, 20 bp, Homo sapiens
tgccagagccaacctggact

SEQ ID NO: 1731774 - DNA, 21 bp, Homo sapiens
tgccagagccaacctggactt

SEQ ID NO: 1731775 - DNA, 22 bp, Homo sapiens
tgccagagccaacctggacttc

SEQ ID NO: 1731776 - DNA, 23 bp, Homo sapiens
tgccagagggccagcaggctcct

SEQ ID NO: 1731777 - DNA, 16 bp, Homo sapiens
tgccagaggtgggcag

SEQ ID NO: 1731778 - DNA, 19 bp, Homo sapiens
tgccagaggtgggcaggtg

SEQ ID NO: 1731779 - DNA, 16 bp, Homo sapiens
tgccagatataactgt

SEQ ID NO: 1731780 - DNA, 23 bp, Homo sapiens
tgccagatataactgtcttgttt

SEQ ID NO: 1731781 - DNA, 22 bp, Homo sapiens
tgccagcacagagcgtccttcc

SEQ ID NO: 1731782 - DNA, 15 bp, Homo sapiens
tgccagcacaggggc

SEQ ID NO: 1731783 - DNA, 18 bp, Homo sapiens
tgccagcagcagcaggtg

SEQ ID NO: 1731784 - DNA, 22 bp, Homo sapiens
tgccagcaggggggctgtgcca

SEQ ID NO: 1731785 - DNA, 19 bp, Homo sapiens
tgccagcatggttgcagat

SEQ ID NO: 1731786 - DNA, 20 bp, Homo sapiens
tgccagccagaagcctctgc

SEQ ID NO: 1731787 - DNA, 22 bp, Homo sapiens
tgccagccagaagcctctgcct

SEQ ID NO: 1731788 - DNA, 11 bp, Homo sapiens
tgccagccagc

SEQ ID NO: 1731789 - DNA, 17 bp, Homo sapiens
tgccagccagcagccag

SEQ ID NO: 1731790 - DNA, 22 bp, Homo sapiens
tgccagccagcagccagctctc

SEQ ID NO: 1731791 - DNA, 19 bp, Homo sapiens
tgccagccccctaaaagca

SEQ ID NO: 1731792 - DNA, 21 bp, Homo sapiens
tgccagccccctaaaagcact

SEQ ID NO: 1731793 - DNA, 19 bp, Homo sapiens
tgccagccgtgatgctcag

SEQ ID NO: 1731794 - DNA, 12 bp, Homo sapiens
tgccagcctggc

SEQ ID NO: 1731795 - DNA, 20 bp, Homo sapiens
tgccagcctggcttctggag

SEQ ID NO: 1731796 - DNA, 22 bp, Homo sapiens
tgccagcctggcttctggagcc

SEQ ID NO: 1731797 - DNA, 18 bp, Homo sapiens
tgccagccttcctctgca

SEQ ID NO: 1731798 - DNA, 23 bp, Homo sapiens
tgccagccttcctctgcagctga

SEQ ID NO: 1731799 - DNA, 21 bp, Homo sapiens
tgccagcgccaaaacaagcca

SEQ ID NO: 1731800 - DNA, 17 bp, Homo sapiens
tgccagctcagtcccat

SEQ ID NO: 1731801 - DNA, 17 bp, Homo sapiens
tgataagttcatacatt

SEQ ID NO: 1731802 - DNA, 19 bp, Homo sapiens
tgataagttcatacattgt

SEQ ID NO: 1731803 - DNA, 23 bp, Homo sapiens
tgataagttcctttccttttctt

SEQ ID NO: 1731804 - DNA, 23 bp, Homo sapiens
tgataatattagtgattctgatt

SEQ ID NO: 1731805 - DNA, 20 bp, Homo sapiens
tgataatattgtttccctcg

SEQ ID NO: 1731806 - DNA, 17 bp, Homo sapiens
tgatacaagattagaag

SEQ ID NO: 1731807 - DNA, 15 bp, Homo sapiens
tgatacactgtatct

SEQ ID NO: 1731808 - DNA, 20 bp, Homo sapiens
tgatacactgtatctaaaaa

SEQ ID NO: 1731809 - DNA, 21 bp, Homo sapiens
tgatacatgagccagtgatta

SEQ ID NO: 1731810 - DNA, 22 bp, Homo sapiens
tgataccacctttactgtgctt

SEQ ID NO: 1731811 - DNA, 21 bp, Homo sapiens
tgatacccatagcttccatga

SEQ ID NO: 1731812 - DNA, 17 bp, Homo sapiens
tgatactagcatactta

SEQ ID NO: 1731813 - DNA, 14 bp, Homo sapiens
tgatactgcttttc

SEQ ID NO: 1731814 - DNA, 18 bp, Homo sapiens
tgatacttcaggtgcttt

SEQ ID NO: 1731815 - DNA, 23 bp, Homo sapiens
tgatacttcaggtgcttttgatg

SEQ ID NO: 1731816 - DNA, 12 bp, Homo sapiens
tgatacttccaa

SEQ ID NO: 1731817 - DNA, 15 bp, Homo sapiens
tgatacttttaagag

SEQ ID NO: 1731818 - DNA, 15 bp, Homo sapiens
tgatagcatatgaca

SEQ ID NO: 1731819 - DNA, 19 bp, Homo sapiens
tgatagcatggggcccctg

SEQ ID NO: 1731820 - DNA, 20 bp, Homo sapiens
tgatagcatggggcccctgg

SEQ ID NO: 1731821 - DNA, 16 bp, Homo sapiens
tgatagcttacactga

SEQ ID NO: 1731822 - DNA, 17 bp, Homo sapiens
tgatagcttacactgag

SEQ ID NO: 1731823 - DNA, 20 bp, Homo sapiens
tgatagcttacactgaggac

SEQ ID NO: 1731824 - DNA, 11 bp, Homo sapiens
tgatagcttta

SEQ ID NO: 1731825 - DNA, 13 bp, Homo sapiens
tgatagctttatt

SEQ ID NO: 1731826 - DNA, 21 bp, Homo sapiens
tgataggaagcgtctggcaga

SEQ ID NO: 1731827 - DNA, 19 bp, Homo sapiens
tgatagggtaaggggaggc

SEQ ID NO: 1731828 - DNA, 16 bp, Homo sapiens
tgatagtcttttgctt

SEQ ID NO: 1731829 - DNA, 18 bp, Homo sapiens
tgatataatttccatagt

SEQ ID NO: 1731830 - DNA, 21 bp, Homo sapiens
tgatatagtcagctgcctttt

SEQ ID NO: 1731831 - DNA, 15 bp, Homo sapiens
tgatatattttacaa

SEQ ID NO: 1731832 - DNA, 20 bp, Homo sapiens
tgatatcacctctcttcagc

SEQ ID NO: 1731833 - DNA, 16 bp, Homo sapiens
tgatatcccccagcct

SEQ ID NO: 1731834 - DNA, 16 bp, Homo sapiens
tgatatctataaaata

SEQ ID NO: 1731835 - DNA, 17 bp, Homo sapiens
tgatatctataaaatag

SEQ ID NO: 1731836 - DNA, 15 bp, Homo sapiens
tgatatgatttaaaa

SEQ ID NO: 1731837 - DNA, 18 bp, Homo sapiens
tgatatgcatatttgttt

SEQ ID NO: 1731838 - DNA, 19 bp, Homo sapiens
tgatatgcatatttgttta

SEQ ID NO: 1731839 - DNA, 21 bp, Homo sapiens
tgatattaatcaaaattgtct

SEQ ID NO: 1731840 - DNA, 22 bp, Homo sapiens
tgatattacatttatttatcca

SEQ ID NO: 1731841 - DNA, 19 bp, Homo sapiens
tgatattatattaaacata

SEQ ID NO: 1731842 - DNA, 14 bp, Homo sapiens
tgatattatttctt

SEQ ID NO: 1731843 - DNA, 19 bp, Homo sapiens
tgatattatttcttctctt

SEQ ID NO: 1731844 - DNA, 24 bp, Homo sapiens
tgatattatttcttctcttatcct

SEQ ID NO: 1731845 - DNA, 16 bp, Homo sapiens
tgatattccatgaatg

SEQ ID NO: 1731846 - DNA, 18 bp, Homo sapiens
tgatattctgttgcttta

SEQ ID NO: 1731847 - DNA, 16 bp, Homo sapiens
tgatatttatagaaca

SEQ ID NO: 1731848 - DNA, 15 bp, Homo sapiens
tgatatttcagaaat

SEQ ID NO: 1731849 - DNA, 19 bp, Homo sapiens
tgatatttgtatttattct

SEQ ID NO: 1731850 - DNA, 17 bp, Homo sapiens
tgatattttctgtgcct

SEQ ID NO: 1731851 - DNA, 13 bp, Homo sapiens
tgatatttttcca

SEQ ID NO: 1731852 - DNA, 19 bp, Homo sapiens
tgatcaaaatcaattaaaa

SEQ ID NO: 1731853 - DNA, 15 bp, Homo sapiens
tgatcaaattcattt

SEQ ID NO: 1731854 - DNA, 17 bp, Homo sapiens
tgatcaaattcattttt

SEQ ID NO: 1731855 - DNA, 23 bp, Homo sapiens
tgatcaaattcatttttttcact

SEQ ID NO: 1731856 - DNA, 14 bp, Homo sapiens
tgatcaagagtccg

SEQ ID NO: 1731857 - DNA, 13 bp, Homo sapiens
tgatcaataaaat

SEQ ID NO: 1731858 - DNA, 16 bp, Homo sapiens
tgatcaattaaatgta

SEQ ID NO: 1731859 - DNA, 16 bp, Homo sapiens
tgatcaattttgactt

SEQ ID NO: 1731860 - DNA, 14 bp, Homo sapiens
tgatcacacagtgt

SEQ ID NO: 1731861 - DNA, 21 bp, Homo sapiens
tgatcactgtgaaccaacccc

SEQ ID NO: 1731862 - DNA, 19 bp, Homo sapiens
tgatcagccttatgtggaa

SEQ ID NO: 1731863 - DNA, 16 bp, Homo sapiens
tgatcagctgtttgtc

SEQ ID NO: 1731864 - DNA, 18 bp, Homo sapiens
tgatcagctgtttgtcat

SEQ ID NO: 1731865 - DNA, 19 bp, Homo sapiens
tgatcaggcttcctggtga

SEQ ID NO: 1731866 - DNA, 22 bp, Homo sapiens
tgatcaggcttcctggtgagaa

SEQ ID NO: 1731867 - DNA, 17 bp, Homo sapiens
tgatcagtagtttgcat

SEQ ID NO: 1731868 - DNA, 18 bp, Homo sapiens
tgatcagtgttgttgctc

SEQ ID NO: 1731869 - DNA, 16 bp, Homo sapiens
tgatcatcgccagagg

SEQ ID NO: 1731870 - DNA, 20 bp, Homo sapiens
tgatcatcgccagaggtgct

SEQ ID NO: 1731871 - DNA, 17 bp, Homo sapiens
tgatcatgtacttttta

SEQ ID NO: 1731872 - DNA, 18 bp, Homo sapiens
tgatcattttccccccac

SEQ ID NO: 1731873 - DNA, 21 bp, Homo sapiens
tgatcattttccccccactct

SEQ ID NO: 1731874 - DNA, 22 bp, Homo sapiens
tgatcattttccccccactctc

SEQ ID NO: 1731875 - DNA, 12 bp, Homo sapiens
tgatccacactt

SEQ ID NO: 1731876 - DNA, 20 bp, Homo sapiens
tgatccaccggcctcggcct

SEQ ID NO: 1731877 - DNA, 15 bp, Homo sapiens
tgatccagaacagtg

SEQ ID NO: 1731878 - DNA, 15 bp, Homo sapiens
tgatccagagcacag

SEQ ID NO: 1731879 - DNA, 19 bp, Homo sapiens
tgatccagcctttccaagt

SEQ ID NO: 1731880 - DNA, 23 bp, Homo sapiens
tgatccataaagacaatcactgc

SEQ ID NO: 1731881 - DNA, 14 bp, Homo sapiens
tgatccatccatct

SEQ ID NO: 1731882 - DNA, 16 bp, Homo sapiens
tgatccatccatctcc

SEQ ID NO: 1731883 - DNA, 18 bp, Homo sapiens
tgacaccgtccctcagtg

SEQ ID NO: 1731884 - DNA, 13 bp, Homo sapiens
tgacacctaccat

SEQ ID NO: 1731885 - DNA, 17 bp, Homo sapiens
tgacacctaccatgctg

SEQ ID NO: 1731886 - DNA, 22 bp, Homo sapiens
tgacacctccatttctctccag

SEQ ID NO: 1731887 - DNA, 16 bp, Homo sapiens
tgacacctgtcttgaa

SEQ ID NO: 1731888 - DNA, 17 bp, Homo sapiens
tgacacgcgctctccac

SEQ ID NO: 1731889 - DNA, 19 bp, Homo sapiens
tgacactaccttatcaggc

SEQ ID NO: 1731890 - DNA, 20 bp, Homo sapiens
tgacactaccttatcaggca

SEQ ID NO: 1731891 - DNA, 15 bp, Homo sapiens
tgacactagaaaact

SEQ ID NO: 1731892 - DNA, 18 bp, Homo sapiens
tgacactagcccaatgaa

SEQ ID NO: 1731893 - DNA, 22 bp, Homo sapiens
tgacactatatctgtatataaa

SEQ ID NO: 1731894 - DNA, 10 bp, Homo sapiens
tgacactgaa

SEQ ID NO: 1731895 - DNA, 18 bp, Homo sapiens
tgacactgaaagttttgt

SEQ ID NO: 1731896 - DNA, 15 bp, Homo sapiens
tgacactgctctaac

SEQ ID NO: 1731897 - DNA, 19 bp, Homo sapiens
tgacactgctctaacagcc

SEQ ID NO: 1731898 - DNA, 21 bp, Homo sapiens
tgacactgctctaacagccct

SEQ ID NO: 1731899 - DNA, 14 bp, Homo sapiens
tgacacttccagtc

SEQ ID NO: 1731900 - DNA, 22 bp, Homo sapiens
tgacactttaattaccaacctg

SEQ ID NO: 1731901 - DNA, 17 bp, Homo sapiens
tgacagaaggtgccact

SEQ ID NO: 1731902 - DNA, 20 bp, Homo sapiens
tgacagaaggtgccacttta

SEQ ID NO: 1731903 - DNA, 18 bp, Homo sapiens
tgacagaatatgtttcaa

SEQ ID NO: 1731904 - DNA, 14 bp, Homo sapiens
tgacagacaggctc

SEQ ID NO: 1731905 - DNA, 15 bp, Homo sapiens
tgacagacaggctct

SEQ ID NO: 1731906 - DNA, 19 bp, Homo sapiens
tgacagacaggctcttagc

SEQ ID NO: 1731907 - DNA, 15 bp, Homo sapiens
tgacagagacccaga

SEQ ID NO: 1731908 - DNA, 22 bp, Homo sapiens
tgacagagtgagaccctgtctc

SEQ ID NO: 1731909 - DNA, 15 bp, Homo sapiens
tgacagataaatcct

SEQ ID NO: 1731910 - DNA, 17 bp, Homo sapiens
tgacagcaaaatgttga

SEQ ID NO: 1731911 - DNA, 11 bp, Homo sapiens
tgacagccaga

SEQ ID NO: 1731912 - DNA, 12 bp, Homo sapiens
tgacagccagag

SEQ ID NO: 1731913 - DNA, 15 bp, Homo sapiens
tgacagccagagcct

SEQ ID NO: 1731914 - DNA, 18 bp, Homo sapiens
tgacagctcttctaagga

SEQ ID NO: 1731915 - DNA, 13 bp, Homo sapiens
tgacagcttggaa

SEQ ID NO: 1731916 - DNA, 23 bp, Homo sapiens
tgacagctttctgggatgtcaca

SEQ ID NO: 1731917 - DNA, 13 bp, Homo sapiens
tgacaggaacctt

SEQ ID NO: 1731918 - DNA, 16 bp, Homo sapiens
tgacaggtaatgaagc

SEQ ID NO: 1731919 - DNA, 17 bp, Homo sapiens
tgacaggtaatgaagct

SEQ ID NO: 1731920 - DNA, 12 bp, Homo sapiens
tgacagtatatt

SEQ ID NO: 1731921 - DNA, 22 bp, Homo sapiens
tgacagtattatacgctggcaa

SEQ ID NO: 1731922 - DNA, 24 bp, Homo sapiens
tgacagtcataaatactgtcaaac

SEQ ID NO: 1731923 - DNA, 13 bp, Homo sapiens
tgacagtgaaata

SEQ ID NO: 1731924 - DNA, 14 bp, Homo sapiens
tgacagtgcctctt

SEQ ID NO: 1731925 - DNA, 17 bp, Homo sapiens
tgacagtgcctcttcca

SEQ ID NO: 1731926 - DNA, 12 bp, Homo sapiens
tgacagtgcctt

SEQ ID NO: 1731927 - DNA, 16 bp, Homo sapiens
tgacagtgccttctct

SEQ ID NO: 1731928 - DNA, 11 bp, Homo sapiens
tgacagtggct

SEQ ID NO: 1731929 - DNA, 17 bp, Homo sapiens
tgacagtggctgacaag

SEQ ID NO: 1731930 - DNA, 14 bp, Homo sapiens
tgacagtgtatggg

SEQ ID NO: 1731931 - DNA, 16 bp, Homo sapiens
tgacagtttccaaatt

SEQ ID NO: 1731932 - DNA, 22 bp, Homo sapiens
tgacataaaatttacatttaat

SEQ ID NO: 1731933 - DNA, 17 bp, Homo sapiens
tgacataacactataaa

SEQ ID NO: 1731934 - DNA, 13 bp, Homo sapiens
tgacatacatatt

SEQ ID NO: 1731935 - DNA, 15 bp, Homo sapiens
tgacatagcctcatg

SEQ ID NO: 1731936 - DNA, 13 bp, Homo sapiens
tgacatcacttgt

SEQ ID NO: 1731937 - DNA, 18 bp, Homo sapiens
tgacatcacttgtacaaa

SEQ ID NO: 1731938 - DNA, 13 bp, Homo sapiens
tgacatcccttcc

SEQ ID NO: 1731939 - DNA, 18 bp, Homo sapiens
tgacatcccttcctggaa

SEQ ID NO: 1731940 - DNA, 15 bp, Homo sapiens
tgacatcctagaggt

SEQ ID NO: 1731941 - DNA, 16 bp, Homo sapiens
tgacatcttcaaagct

SEQ ID NO: 1731942 - DNA, 12 bp, Homo sapiens
tgacatgaaaaa

SEQ ID NO: 1731943 - DNA, 14 bp, Homo sapiens
tgacatgaaatgaa

SEQ ID NO: 1731944 - DNA, 17 bp, Homo sapiens
tgacatgcactgaccct

SEQ ID NO: 1731945 - DNA, 15 bp, Homo sapiens
tgacatgctcacaca

SEQ ID NO: 1731946 - DNA, 18 bp, Homo sapiens
tgacatgggtattttata

SEQ ID NO: 1731947 - DNA, 14 bp, Homo sapiens
tgacatgggtgggg

SEQ ID NO: 1731948 - DNA, 16 bp, Homo sapiens
tgacatggtgcctgag

SEQ ID NO: 1731949 - DNA, 17 bp, Homo sapiens
tgacatggtgcctgaga

SEQ ID NO: 1731950 - DNA, 18 bp, Homo sapiens
tgacatggtgcctgagag

SEQ ID NO: 1731951 - DNA, 20 bp, Homo sapiens
tgacatgtaagaaaatgtta

SEQ ID NO: 1731952 - DNA, 15 bp, Homo sapiens
tgacattcaaggcat

SEQ ID NO: 1731953 - DNA, 15 bp, Homo sapiens
tgacattcggggtga

SEQ ID NO: 1731954 - DNA, 11 bp, Homo sapiens
tgacattgtct

SEQ ID NO: 1731955 - DNA, 12 bp, Homo sapiens
tgacattgtctc

SEQ ID NO: 1731956 - DNA, 14 bp, Homo sapiens
tgacattgtctcct

SEQ ID NO: 1731957 - DNA, 12 bp, Homo sapiens
tgacatttaaat

SEQ ID NO: 1731958 - DNA, 15 bp, Homo sapiens
tgacatttagaactt

SEQ ID NO: 1731959 - DNA, 16 bp, Homo sapiens
tgacatttagaacttt

SEQ ID NO: 1731960 - DNA, 13 bp, Homo sapiens
tgacatttcttct

SEQ ID NO: 1731961 - DNA, 22 bp, Homo sapiens
tgacatttcttctagtgatgat

SEQ ID NO: 1731962 - DNA, 12 bp, Homo sapiens
tgacatttcttt

SEQ ID NO: 1731963 - DNA, 15 bp, Homo sapiens
tgacatttggagagg

SEQ ID NO: 1731964 - DNA, 12 bp, Homo sapiens
tgacattttatt

SEQ ID NO: 1731965 - DNA, 22 bp, Homo sapiens
tgaccaaaattttaagtaggaa

SEQ ID NO: 1731966 - DNA, 13 bp, Homo sapiens
tgaccaaaccagc

SEQ ID NO: 1731967 - DNA, 16 bp, Homo sapiens
tgaccaaagactgcag

SEQ ID NO: 1731968 - DNA, 17 bp, Homo sapiens
tgaccaaagactgcaga

SEQ ID NO: 1731969 - DNA, 18 bp, Homo sapiens
tgaccaaagactgcagaa

SEQ ID NO: 1731970 - DNA, 19 bp, Homo sapiens
tgaccaacagaaacctttt

SEQ ID NO: 1731971 - DNA, 16 bp, Homo sapiens
tgaccaacatggagaa

SEQ ID NO: 1731972 - DNA, 17 bp, Homo sapiens
tgaccaacatggagaaa

SEQ ID NO: 1731973 - DNA, 20 bp, Homo sapiens
tgaccaacatggagaaaccc

SEQ ID NO: 1731974 - DNA, 15 bp, Homo sapiens
tgaccaagaactgca

SEQ ID NO: 1731975 - DNA, 16 bp, Homo sapiens
tgaccaagaactgcat

SEQ ID NO: 1731976 - DNA, 19 bp, Homo sapiens
tgaccaagaactgcatgga

SEQ ID NO: 1731977 - DNA, 10 bp, Homo sapiens
tgaccaagac

SEQ ID NO: 1731978 - DNA, 22 bp, Homo sapiens
tgaccaagacaggttcaggtag

SEQ ID NO: 1731979 - DNA, 16 bp, Homo sapiens
tgaccaagttataaat

SEQ ID NO: 1731980 - DNA, 16 bp, Homo sapiens
tgaccaatacatttgt

SEQ ID NO: 1731981 - DNA, 18 bp, Homo sapiens
tgaccaatacatttgtat

SEQ ID NO: 1731982 - DNA, 18 bp, Homo sapiens
tgaccaattgtgctgcca

SEQ ID NO: 1731983 - DNA, 15 bp, Homo sapiens
tgaccacagcccgct

SEQ ID NO: 1731984 - DNA, 21 bp, Homo sapiens
tgaccacagcccgctctctgg

SEQ ID NO: 1731985 - DNA, 12 bp, Homo sapiens
tgaccaccctcc

SEQ ID NO: 1731986 - DNA, 16 bp, Homo sapiens
tgaccactcttggcta

SEQ ID NO: 1731987 - DNA, 21 bp, Homo sapiens
tgaccactcttggctattgaa

SEQ ID NO: 1731988 - DNA, 17 bp, Homo sapiens
tgaccactgaattcact

SEQ ID NO: 1731989 - DNA, 19 bp, Homo sapiens
tgaccactgaattcactcc

SEQ ID NO: 1731990 - DNA, 21 bp, Homo sapiens
tgaccactgaattcactccag

SEQ ID NO: 1731991 - DNA, 12 bp, Homo sapiens
tgaccagagaat

SEQ ID NO: 1731992 - DNA, 22 bp, Homo sapiens
tgaccagatctttctcttccct

SEQ ID NO: 1731993 - DNA, 18 bp, Homo sapiens
tgaccagcagatcccagc

SEQ ID NO: 1731994 - DNA, 21 bp, Homo sapiens
tgaccagcggctgctcaagcc

SEQ ID NO: 1731995 - DNA, 13 bp, Homo sapiens
tgaccagctctct

SEQ ID NO: 1731996 - DNA, 16 bp, Homo sapiens
tgaccaggatcccaag

SEQ ID NO: 1731997 - DNA, 16 bp, Homo sapiens
tgaccagggatgctgg

SEQ ID NO: 1731998 - DNA, 19 bp, Homo sapiens
tgaccagggatgctgggct

SEQ ID NO: 1731999 - DNA, 16 bp, Homo sapiens
tgaccatactgaggga

SEQ ID NO: 1732000 - DNA, 14 bp, Homo sapiens
tgaccatcatttca

SEQ ID NO: 1732001 - DNA, 11 bp, Homo sapiens
tgaactgaagg

SEQ ID NO: 1732002 - DNA, 23 bp, Homo sapiens
tgaactgaggagatgaccaggga

SEQ ID NO: 1732003 - DNA, 14 bp, Homo sapiens
tgaactgcaaagct

SEQ ID NO: 1732004 - DNA, 12 bp, Homo sapiens
tgaactggaaga

SEQ ID NO: 1732005 - DNA, 16 bp, Homo sapiens
tgaactggaagaaagc

SEQ ID NO: 1732006 - DNA, 17 bp, Homo sapiens
tgaactggaagaaagca

SEQ ID NO: 1732007 - DNA, 11 bp, Homo sapiens
tgaactggctt

SEQ ID NO: 1732008 - DNA, 16 bp, Homo sapiens
tgaactggcttgtaca

SEQ ID NO: 1732009 - DNA, 17 bp, Homo sapiens
tgaactggcttgtacat

SEQ ID NO: 1732010 - DNA, 18 bp, Homo sapiens
tgaactggcttgtacatt

SEQ ID NO: 1732011 - DNA, 19 bp, Homo sapiens
tgaactggcttgtacattt

SEQ ID NO: 1732012 - DNA, 20 bp, Homo sapiens
tgaactggcttgtacatttt

SEQ ID NO: 1732013 - DNA, 13 bp, Homo sapiens
tgaactgttacaa

SEQ ID NO: 1732014 - DNA, 22 bp, Homo sapiens
tgaactgttacaacttgtattt

SEQ ID NO: 1732015 - DNA, 17 bp, Homo sapiens
tgaactgttagaatgta

SEQ ID NO: 1732016 - DNA, 18 bp, Homo sapiens
tgaacttaaatgcccccc

SEQ ID NO: 1732017 - DNA, 18 bp, Homo sapiens
tgaacttaataactgtgt

SEQ ID NO: 1732018 - DNA, 16 bp, Homo sapiens
tgaacttacacttgga

SEQ ID NO: 1732019 - DNA, 23 bp, Homo sapiens
tgaacttacatactaggtgcctt

SEQ ID NO: 1732020 - DNA, 21 bp, Homo sapiens
tgaacttatttacacatagtt

SEQ ID NO: 1732021 - DNA, 17 bp, Homo sapiens
tgaacttgcattgtgat

SEQ ID NO: 1732022 - DNA, 13 bp, Homo sapiens
tgaactttttgta

SEQ ID NO: 1732023 - DNA, 12 bp, Homo sapiens
tgaagaaaatac

SEQ ID NO: 1732024 - DNA, 18 bp, Homo sapiens
tgaagaaaatacttaaat

SEQ ID NO: 1732025 - DNA, 24 bp, Homo sapiens
tgaagaaaatacttaaatgttatg

SEQ ID NO: 1732026 - DNA, 22 bp, Homo sapiens
tgaagaaagtcaaaaaattatt

SEQ ID NO: 1732027 - DNA, 19 bp, Homo sapiens
tgaagaaccagtcccccca

SEQ ID NO: 1732028 - DNA, 20 bp, Homo sapiens
tgaagaaccagtccccccac

SEQ ID NO: 1732029 - DNA, 21 bp, Homo sapiens
tgaagaaccctgcagggccct

SEQ ID NO: 1732030 - DNA, 15 bp, Homo sapiens
tgaagaagatgagcc

SEQ ID NO: 1732031 - DNA, 16 bp, Homo sapiens
tgaagaagggggtggg

SEQ ID NO: 1732032 - DNA, 19 bp, Homo sapiens
tgaagaagggggtgggggg

SEQ ID NO: 1732033 - DNA, 21 bp, Homo sapiens
tgaagaagggggtggggggag

SEQ ID NO: 1732034 - DNA, 21 bp, Homo sapiens
tgaagaagtcactgaacaaaa

SEQ ID NO: 1732035 - DNA, 23 bp, Homo sapiens
tgaagaagtcactgaacaaaacc

SEQ ID NO: 1732036 - DNA, 14 bp, Homo sapiens
tgaagaatacatca

SEQ ID NO: 1732037 - DNA, 11 bp, Homo sapiens
tgaagaattaa

SEQ ID NO: 1732038 - DNA, 14 bp, Homo sapiens
tgaagaattaagat

SEQ ID NO: 1732039 - DNA, 13 bp, Homo sapiens
tgaagaattgaaa

SEQ ID NO: 1732040 - DNA, 23 bp, Homo sapiens
tgaagacaatttgatacataata

SEQ ID NO: 1732041 - DNA, 16 bp, Homo sapiens
tgaagacacagcctcc

SEQ ID NO: 1732042 - DNA, 21 bp, Homo sapiens
tgaagacagagcaaagcgccc

SEQ ID NO: 1732043 - DNA, 20 bp, Homo sapiens
tgaagacattttttgctata

SEQ ID NO: 1732044 - DNA, 22 bp, Homo sapiens
tgaagacctttattcacccctg

SEQ ID NO: 1732045 - DNA, 15 bp, Homo sapiens
tgaagacttcttggg

SEQ ID NO: 1732046 - DNA, 23 bp, Homo sapiens
tgaagagaaccgagcaaagatca

SEQ ID NO: 1732047 - DNA, 22 bp, Homo sapiens
tgaagagaagggcagggctgag

SEQ ID NO: 1732048 - DNA, 17 bp, Homo sapiens
tgaagagaatgtattct

SEQ ID NO: 1732049 - DNA, 23 bp, Homo sapiens
tgaagagacagagacaagtaatt

SEQ ID NO: 1732050 - DNA, 21 bp, Homo sapiens
tgaagagatttcaacaagaat

SEQ ID NO: 1732051 - DNA, 22 bp, Homo sapiens
tgaagagccggtggtgcccgtg

SEQ ID NO: 1732052 - DNA, 13 bp, Homo sapiens
tgaagagcttgtg

SEQ ID NO: 1732053 - DNA, 13 bp, Homo sapiens
tgaagaggaaggg

SEQ ID NO: 1732054 - DNA, 23 bp, Homo sapiens
tgaagaggaggggaagaggcctg

SEQ ID NO: 1732055 - DNA, 22 bp, Homo sapiens
tgaagagggctctgatctaaca

SEQ ID NO: 1732056 - DNA, 17 bp, Homo sapiens
tgaagaggggcagccct

SEQ ID NO: 1732057 - DNA, 19 bp, Homo sapiens
tgaagaggggcagcccttg

SEQ ID NO: 1732058 - DNA, 12 bp, Homo sapiens
tgaagaggtctg

SEQ ID NO: 1732059 - DNA, 19 bp, Homo sapiens
tgaagaggtctgattggct

SEQ ID NO: 1732060 - DNA, 20 bp, Homo sapiens
tgaagaggtctgattggctg

SEQ ID NO: 1732061 - DNA, 22 bp, Homo sapiens
tgaagaggtctgattggctgct

SEQ ID NO: 1732062 - DNA, 15 bp, Homo sapiens
tgaagagtatccttc

SEQ ID NO: 1732063 - DNA, 19 bp, Homo sapiens
tgaagagtatccttccttc

SEQ ID NO: 1732064 - DNA, 19 bp, Homo sapiens
tgaagattctcctgtgcta

SEQ ID NO: 1732065 - DNA, 11 bp, Homo sapiens
tgaagattctt

SEQ ID NO: 1732066 - DNA, 22 bp, Homo sapiens
tgaagattcttaaaaattgaat

SEQ ID NO: 1732067 - DNA, 20 bp, Homo sapiens
tgaagatttcagaggctgca

SEQ ID NO: 1732068 - DNA, 15 bp, Homo sapiens
tgaagcaaatcagaa

SEQ ID NO: 1732069 - DNA, 21 bp, Homo sapiens
tgaagcaattagtctgaaact

SEQ ID NO: 1732070 - DNA, 19 bp, Homo sapiens
tgaagcacatacggcagac

SEQ ID NO: 1732071 - DNA, 12 bp, Homo sapiens
tgaagcagcact

SEQ ID NO: 1732072 - DNA, 15 bp, Homo sapiens
tgaagcagcactgtg

SEQ ID NO: 1732073 - DNA, 17 bp, Homo sapiens
tgaagcagctttaaaca

SEQ ID NO: 1732074 - DNA, 19 bp, Homo sapiens
tgaagcagctttaaacaaa

SEQ ID NO: 1732075 - DNA, 17 bp, Homo sapiens
tgaagcagtcttgctct

SEQ ID NO: 1732076 - DNA, 17 bp, Homo sapiens
tgaagcagttcagaagg

SEQ ID NO: 1732077 - DNA, 17 bp, Homo sapiens
tgaagcatagataatat

SEQ ID NO: 1732078 - DNA, 22 bp, Homo sapiens
tgaagcatagataatattgttt

SEQ ID NO: 1732079 - DNA, 12 bp, Homo sapiens
tgaagcatgctt

SEQ ID NO: 1732080 - DNA, 20 bp, Homo sapiens
tgaagcatttcaaagccctg

SEQ ID NO: 1732081 - DNA, 14 bp, Homo sapiens
tgaagccaaagaaa

SEQ ID NO: 1732082 - DNA, 19 bp, Homo sapiens
tgaagccactgaagctggg

SEQ ID NO: 1732083 - DNA, 20 bp, Homo sapiens
tgaagccactgaagctggga

SEQ ID NO: 1732084 - DNA, 16 bp, Homo sapiens
tgaagcccaagaagtt

SEQ ID NO: 1732085 - DNA, 16 bp, Homo sapiens
tgaagcccaagtgaaa

SEQ ID NO: 1732086 - DNA, 15 bp, Homo sapiens
tgaagccctcccagg

SEQ ID NO: 1732087 - DNA, 15 bp, Homo sapiens
tgaagccgactctgg

SEQ ID NO: 1732088 - DNA, 19 bp, Homo sapiens
tgaagccgactctggccct

SEQ ID NO: 1732089 - DNA, 22 bp, Homo sapiens
tgaagcctccacaccagctgct

SEQ ID NO: 1732090 - DNA, 19 bp, Homo sapiens
tgaagcgtttttctttttc

SEQ ID NO: 1732091 - DNA, 17 bp, Homo sapiens
tgaagctaaaaggaaaa

SEQ ID NO: 1732092 - DNA, 18 bp, Homo sapiens
tgaagctaaaaggaaaag

SEQ ID NO: 1732093 - DNA, 17 bp, Homo sapiens
tgaagctgctgcagccc

SEQ ID NO: 1732094 - DNA, 13 bp, Homo sapiens
tgaagctgctgga

SEQ ID NO: 1732095 - DNA, 19 bp, Homo sapiens
tgaagctgctggagcccgc

SEQ ID NO: 1732096 - DNA, 14 bp, Homo sapiens
tgaagctggagcag

SEQ ID NO: 1732097 - DNA, 23 bp, Homo sapiens
tgaagctgttgctatttgtattt

SEQ ID NO: 1732098 - DNA, 12 bp, Homo sapiens
tgaaggaaacag

SEQ ID NO: 1732099 - DNA, 12 bp, Homo sapiens
tgaaggaagagg

SEQ ID NO: 1732100 - DNA, 21 bp, Homo sapiens
tgaaggaagttggtctttgtc

SEQ ID NO: 1732101 - DNA, 16 bp, Homo sapiens
tgaaggataagagaaa

SEQ ID NO: 1732102 - DNA, 21 bp, Homo sapiens
tgaaggcaaaaactgtactgt

SEQ ID NO: 1732103 - DNA, 22 bp, Homo sapiens
tgaaggcaaaaactgtactgtg

SEQ ID NO: 1732104 - DNA, 23 bp, Homo sapiens
tgaaggcaaaaactgtactgtgt

SEQ ID NO: 1732105 - DNA, 18 bp, Homo sapiens
tgaaggcagtctgaaccc

SEQ ID NO: 1732106 - DNA, 19 bp, Homo sapiens
tgaaggcagtctgaaccct

SEQ ID NO: 1732107 - DNA, 23 bp, Homo sapiens
ccctgagacaaatggaggcctgt

SEQ ID NO: 1732108 - DNA, 10 bp, Homo sapiens
ccctgagact

SEQ ID NO: 1732109 - DNA, 22 bp, Homo sapiens
ccctgagagagaatagagctgc

SEQ ID NO: 1732110 - DNA, 16 bp, Homo sapiens
ccctgagcaatgtctg

SEQ ID NO: 1732111 - DNA, 20 bp, Homo sapiens
ccctgagcaatgtctgtgct

SEQ ID NO: 1732112 - DNA, 20 bp, Homo sapiens
ccctgagcagggtccacagc

SEQ ID NO: 1732113 - DNA, 16 bp, Homo sapiens
ccctgagcatcctggt

SEQ ID NO: 1732114 - DNA, 23 bp, Homo sapiens
ccctgagcccagagaagctggaa

SEQ ID NO: 1732115 - DNA, 18 bp, Homo sapiens
ctgtttgcatttgataca

SEQ ID NO: 1732116 - DNA, 13 bp, Homo sapiens
ctgtttgctgtgc

SEQ ID NO: 1732117 - DNA, 15 bp, Homo sapiens
ctgtttgctgttgct

SEQ ID NO: 1732118 - DNA, 11 bp, Homo sapiens
ctgtttggaaa

SEQ ID NO: 1732119 - DNA, 16 bp, Homo sapiens
ctgtttggcacttgta

SEQ ID NO: 1732120 - DNA, 18 bp, Homo sapiens
tctcccaggccaggctcc

SEQ ID NO: 1732121 - DNA, 15 bp, Homo sapiens
tctcccaggccccct

SEQ ID NO: 1732122 - DNA, 19 bp, Homo sapiens
tctcccaggtaccagctgc

SEQ ID NO: 1732123 - DNA, 15 bp, Homo sapiens
tctcccagtcattta

SEQ ID NO: 1732124 - DNA, 12 bp, Homo sapiens
tctcccatcccc

SEQ ID NO: 1732125 - DNA, 19 bp, Homo sapiens
tctcccatccccctgccct

SEQ ID NO: 1732126 - DNA, 20 bp, Homo sapiens
tctcccatccccctgccctc

SEQ ID NO: 1732127 - DNA, 14 bp, Homo sapiens
tctcccatttcagg

SEQ ID NO: 1732128 - DNA, 16 bp, Homo sapiens
tctcccatttcaggaa

SEQ ID NO: 1732129 - DNA, 22 bp, Homo sapiens
tctcccatttcaggaatttaaa

SEQ ID NO: 1732130 - DNA, 22 bp, Homo sapiens
tctccccacactaacctgggtt

SEQ ID NO: 1732131 - DNA, 20 bp, Homo sapiens
tctccccacgagggctggct

SEQ ID NO: 1732132 - DNA, 15 bp, Homo sapiens
tctccccagcccaga

SEQ ID NO: 1732133 - DNA, 18 bp, Homo sapiens
tctccccagcccagagac

SEQ ID NO: 1732134 - DNA, 14 bp, Homo sapiens
tctccccaggcctc

SEQ ID NO: 1732135 - DNA, 15 bp, Homo sapiens
tctccccaggtccag

SEQ ID NO: 1732136 - DNA, 10 bp, Homo sapiens
tctccccagt

SEQ ID NO: 1732137 - DNA, 20 bp, Homo sapiens
tctccccagtgcctgccact

SEQ ID NO: 1732138 - DNA, 23 bp, Homo sapiens
tctccccagtgcctgccactctc

SEQ ID NO: 1732139 - DNA, 12 bp, Homo sapiens
tctccccagtgt

SEQ ID NO: 1732140 - DNA, 21 bp, Homo sapiens
tctccccctatttattgactt

SEQ ID NO: 1732141 - DNA, 20 bp, Homo sapiens
tctccccctgggctctgccc

SEQ ID NO: 1732142 - DNA, 20 bp, Homo sapiens
tctccccgaggctgccccag

SEQ ID NO: 1732143 - DNA, 18 bp, Homo sapiens
tctccccggcaggcctga

SEQ ID NO: 1732144 - DNA, 23 bp, Homo sapiens
tctcccctagctcaccaggcctg

SEQ ID NO: 1732145 - DNA, 13 bp, Homo sapiens
tctcccctcctgc

SEQ ID NO: 1732146 - DNA, 16 bp, Homo sapiens
tctcccctgcactgta

SEQ ID NO: 1732147 - DNA, 21 bp, Homo sapiens
tctcccctgcactgtaaaatg

SEQ ID NO: 1732148 - DNA, 14 bp, Homo sapiens
tctcccctgccccc

SEQ ID NO: 1732149 - DNA, 20 bp, Homo sapiens
tctcccctgcccccaggact

SEQ ID NO: 1732150 - DNA, 20 bp, Homo sapiens
tgctactgattgtttcattg

SEQ ID NO: 1732151 - DNA, 15 bp, Homo sapiens
tgctactgctgctgc

SEQ ID NO: 1732152 - DNA, 20 bp, Homo sapiens
tgctactgttgtaagaattc

SEQ ID NO: 1732153 - DNA, 19 bp, Homo sapiens
tgctacttcactgtcatct

SEQ ID NO: 1732154 - DNA, 23 bp, Homo sapiens
tgctacttcactgtcatcttcaa

SEQ ID NO: 1732155 - DNA, 22 bp, Homo sapiens
tgctacttccccagctctcagt

SEQ ID NO: 1732156 - DNA, 16 bp, Homo sapiens
tgctagaatacttttt

SEQ ID NO: 1732157 - DNA, 14 bp, Homo sapiens
tgctagacagccag

SEQ ID NO: 1732158 - DNA, 15 bp, Homo sapiens
tgctagactcctcag

SEQ ID NO: 1732159 - DNA, 19 bp, Homo sapiens
tgctagactctagacaaga

SEQ ID NO: 1732160 - DNA, 18 bp, Homo sapiens
tgctagagacgctgatcc

SEQ ID NO: 1732161 - DNA, 17 bp, Homo sapiens
tgctagaggttgcagca

SEQ ID NO: 1732162 - DNA, 13 bp, Homo sapiens
tgctagataaaag

SEQ ID NO: 1732163 - DNA, 14 bp, Homo sapiens
tgctagataaaagc

SEQ ID NO: 1732164 - DNA, 17 bp, Homo sapiens
tgctagattttaattta

SEQ ID NO: 1732165 - DNA, 20 bp, Homo sapiens
tgctagattttaatttattt

SEQ ID NO: 1732166 - DNA, 22 bp, Homo sapiens
tgctagattttaatttatttgt

SEQ ID NO: 1732167 - DNA, 23 bp, Homo sapiens
tgctagattttaatttatttgtt

SEQ ID NO: 1732168 - DNA, 20 bp, Homo sapiens
tgctagcacttggagccaag

SEQ ID NO: 1732169 - DNA, 14 bp, Homo sapiens
tgctagcaggctgt

SEQ ID NO: 1732170 - DNA, 22 bp, Homo sapiens
tgctagcagtaaaagatgaagt

SEQ ID NO: 1732171 - DNA, 19 bp, Homo sapiens
tgctagcatgggtattttt

SEQ ID NO: 1732172 - DNA, 19 bp, Homo sapiens
tgctagccctggggtggcg

SEQ ID NO: 1732173 - DNA, 21 bp, Homo sapiens
tgctagctatatatttaggaa

SEQ ID NO: 1732174 - DNA, 12 bp, Homo sapiens
tgctaggaagag

SEQ ID NO: 1732175 - DNA, 19 bp, Homo sapiens
tgctaggagccccagcttc

SEQ ID NO: 1732176 - DNA, 23 bp, Homo sapiens
tgctaggagccccagcttcctgt

SEQ ID NO: 1732177 - DNA, 16 bp, Homo sapiens
tgctaggttaattcca

SEQ ID NO: 1732178 - DNA, 19 bp, Homo sapiens
tgctagtatcttgggtgta

SEQ ID NO: 1732179 - DNA, 22 bp, Homo sapiens
tgctagtctgccctatggattt

SEQ ID NO: 1732180 - DNA, 21 bp, Homo sapiens
tgctagtgaaatggctggggc

SEQ ID NO: 1732181 - DNA, 20 bp, Homo sapiens
tgctagtgtggtctgtaata

SEQ ID NO: 1732182 - DNA, 16 bp, Homo sapiens
tgctagttctgctgcc

SEQ ID NO: 1732183 - DNA, 17 bp, Homo sapiens
tgctagttctgctgccc

SEQ ID NO: 1732184 - DNA, 19 bp, Homo sapiens
tgctagttctgctgccctc

SEQ ID NO: 1732185 - DNA, 17 bp, Homo sapiens
tgctagttggagtgctt

SEQ ID NO: 1732186 - DNA, 16 bp, Homo sapiens
tgctataaatgccaga

SEQ ID NO: 1732187 - DNA, 19 bp, Homo sapiens
tgctataaatgccagagcc

SEQ ID NO: 1732188 - DNA, 20 bp, Homo sapiens
tgctataaatgccagagcca

SEQ ID NO: 1732189 - DNA, 21 bp, Homo sapiens
tgctataaatgccagagccaa

SEQ ID NO: 1732190 - DNA, 22 bp, Homo sapiens
tgctataaatgccagagccaac

SEQ ID NO: 1732191 - DNA, 13 bp, Homo sapiens
tgctataatctgt

SEQ ID NO: 1732192 - DNA, 17 bp, Homo sapiens
tgctataatctgttttt

SEQ ID NO: 1732193 - DNA, 13 bp, Homo sapiens
tgctatactgcat

SEQ ID NO: 1732194 - DNA, 21 bp, Homo sapiens
tgctatagcctaagcggctgt

SEQ ID NO: 1732195 - DNA, 19 bp, Homo sapiens
tgctatcaacaataaaatt

SEQ ID NO: 1732196 - DNA, 19 bp, Homo sapiens
tgctatccccatctccctg

SEQ ID NO: 1732197 - DNA, 20 bp, Homo sapiens
tgctatccccatctccctgc

SEQ ID NO: 1732198 - DNA, 22 bp, Homo sapiens
tgctatccccatctccctgcct

SEQ ID NO: 1732199 - DNA, 18 bp, Homo sapiens
tgctatcgccctcctttc

SEQ ID NO: 1732200 - DNA, 23 bp, Homo sapiens
tgctatctggaggccttccagct

SEQ ID NO: 1732201 - DNA, 23 bp, Homo sapiens
tgcctgggggcttttgccactcc

SEQ ID NO: 1732202 - DNA, 22 bp, Homo sapiens
tgcctgggtggggctgctcctc

SEQ ID NO: 1732203 - DNA, 13 bp, Homo sapiens
tgcctggtatttt

SEQ ID NO: 1732204 - DNA, 20 bp, Homo sapiens
tgcctggtcagaaggccagc

SEQ ID NO: 1732205 - DNA, 19 bp, Homo sapiens
tgcctggtcctccctccca

SEQ ID NO: 1732206 - DNA, 19 bp, Homo sapiens
tgcctggtctgtctggatc

SEQ ID NO: 1732207 - DNA, 20 bp, Homo sapiens
tgcctggtgcattgctgtgt

SEQ ID NO: 1732208 - DNA, 13 bp, Homo sapiens
tgcctgtaaacat

SEQ ID NO: 1732209 - DNA, 22 bp, Homo sapiens
tgcctgtagagacaatacagta

SEQ ID NO: 1732210 - DNA, 16 bp, Homo sapiens
tgcctgtagctttcct

SEQ ID NO: 1732211 - DNA, 20 bp, Homo sapiens
tgcctgtagctttcctggtc

SEQ ID NO: 1732212 - DNA, 16 bp, Homo sapiens
tgcctgtagtctcagc

SEQ ID NO: 1732213 - DNA, 14 bp, Homo sapiens
tgcctgtatttcca

SEQ ID NO: 1732214 - DNA, 20 bp, Homo sapiens
tgcctgtatttgagagactg

SEQ ID NO: 1732215 - DNA, 19 bp, Homo sapiens
tgcctgtcccacccccacc

SEQ ID NO: 1732216 - DNA, 12 bp, Homo sapiens
tgcctgtctctg

SEQ ID NO: 1732217 - DNA, 14 bp, Homo sapiens
tgcctgtctctgtt

SEQ ID NO: 1732218 - DNA, 21 bp, Homo sapiens
tgcctgtctgtctctccatct

SEQ ID NO: 1732219 - DNA, 15 bp, Homo sapiens
tgcctgtgagccagt

SEQ ID NO: 1732220 - DNA, 12 bp, Homo sapiens
tgcctgtgccaa

SEQ ID NO: 1732221 - DNA, 14 bp, Homo sapiens
tgcctgtgccaata

SEQ ID NO: 1732222 - DNA, 16 bp, Homo sapiens
tgcctgtgccaataaa

SEQ ID NO: 1732223 - DNA, 16 bp, Homo sapiens
tgcctgtgccacccac

SEQ ID NO: 1732224 - DNA, 14 bp, Homo sapiens
tgcctgtgctcctg

SEQ ID NO: 1732225 - DNA, 16 bp, Homo sapiens
tgcctgtgctcctgcc

SEQ ID NO: 1732226 - DNA, 21 bp, Homo sapiens
tgcctgtggcgccgtctccag

SEQ ID NO: 1732227 - DNA, 22 bp, Homo sapiens
tgcctgtggcgccgtctccagg

SEQ ID NO: 1732228 - DNA, 23 bp, Homo sapiens
tgcctgtggcgccgtctccaggg

SEQ ID NO: 1732229 - DNA, 15 bp, Homo sapiens
tgcctgtgtccatgc

SEQ ID NO: 1732230 - DNA, 22 bp, Homo sapiens
tgcctgtgtccatgcgctcagg

SEQ ID NO: 1732231 - DNA, 12 bp, Homo sapiens
tgcctgtgtgcg

SEQ ID NO: 1732232 - DNA, 13 bp, Homo sapiens
tgcctgttctgct

SEQ ID NO: 1732233 - DNA, 15 bp, Homo sapiens
tgcctgttggctgct

SEQ ID NO: 1732234 - DNA, 17 bp, Homo sapiens
tgcctgttggctgctgc

SEQ ID NO: 1732235 - DNA, 16 bp, Homo sapiens
tgcctgtttcccaggc

SEQ ID NO: 1732236 - DNA, 16 bp, Homo sapiens
tgcctgtttctgattt

SEQ ID NO: 1732237 - DNA, 20 bp, Homo sapiens
tgccttaaaaccaaagaggg

SEQ ID NO: 1732238 - DNA, 21 bp, Homo sapiens
tgccttaagcagaacaaatgt

SEQ ID NO: 1732239 - DNA, 23 bp, Homo sapiens
tgccttaataaatatgtaatata

SEQ ID NO: 1732240 - DNA, 17 bp, Homo sapiens
tgccttacatcttttct

SEQ ID NO: 1732241 - DNA, 20 bp, Homo sapiens
tgccttacctcctgcccagg

SEQ ID NO: 1732242 - DNA, 21 bp, Homo sapiens
tgccttacctcctgcccagga

SEQ ID NO: 1732243 - DNA, 15 bp, Homo sapiens
tgccttagtctcagt

SEQ ID NO: 1732244 - DNA, 14 bp, Homo sapiens
tgccttatcttgca

SEQ ID NO: 1732245 - DNA, 12 bp, Homo sapiens
tgccttatttgt

SEQ ID NO: 1732246 - DNA, 14 bp, Homo sapiens
tgccttatttgtct

SEQ ID NO: 1732247 - DNA, 15 bp, Homo sapiens
tgccttatttgtctg

SEQ ID NO: 1732248 - DNA, 20 bp, Homo sapiens
tgccttcaaggactgtttca

SEQ ID NO: 1732249 - DNA, 15 bp, Homo sapiens
tgccttcacatttgg

SEQ ID NO: 1732250 - DNA, 13 bp, Homo sapiens
tgccttcagctct

SEQ ID NO: 1732251 - DNA, 17 bp, Homo sapiens
tgccttcagctctacag

SEQ ID NO: 1732252 - DNA, 18 bp, Homo sapiens
tgccttcagctctacagc

SEQ ID NO: 1732253 - DNA, 17 bp, Homo sapiens
tgccttcaggcttctgt

SEQ ID NO: 1732254 - DNA, 17 bp, Homo sapiens
tgccttcattacctttt

SEQ ID NO: 1732255 - DNA, 18 bp, Homo sapiens
tgccttccagcaccctgc

SEQ ID NO: 1732256 - DNA, 16 bp, Homo sapiens
tgccttccctagcttt

SEQ ID NO: 1732257 - DNA, 11 bp, Homo sapiens
tgccttccctt

SEQ ID NO: 1732258 - DNA, 20 bp, Homo sapiens
tgccttcgcttcttgcctct

SEQ ID NO: 1732259 - DNA, 22 bp, Homo sapiens
tgccttcgcttcttgcctctgt

SEQ ID NO: 1732260 - DNA, 23 bp, Homo sapiens
tgccttcgcttcttgcctctgtg

SEQ ID NO: 1732261 - DNA, 20 bp, Homo sapiens
tgccttcgttaactgtgtat

SEQ ID NO: 1732262 - DNA, 15 bp, Homo sapiens
tgctccagattctga

SEQ ID NO: 1732263 - DNA, 23 bp, Homo sapiens
tgctccagcaacacagcctgggc

SEQ ID NO: 1732264 - DNA, 19 bp, Homo sapiens
tgctccagcaactgccctt

SEQ ID NO: 1732265 - DNA, 13 bp, Homo sapiens
tgctccagcagca

SEQ ID NO: 1732266 - DNA, 15 bp, Homo sapiens
tgctccagcagcaca

SEQ ID NO: 1732267 - DNA, 18 bp, Homo sapiens
tgctccagcagcacacct

SEQ ID NO: 1732268 - DNA, 23 bp, Homo sapiens
tgctccagcagcacacctcagcc

SEQ ID NO: 1732269 - DNA, 16 bp, Homo sapiens
tgctccagggtcaggc

SEQ ID NO: 1732270 - DNA, 16 bp, Homo sapiens
tgctccagggtcttgg

SEQ ID NO: 1732271 - DNA, 15 bp, Homo sapiens
tgctccatatttgat

SEQ ID NO: 1732272 - DNA, 21 bp, Homo sapiens
tgctcccagtgggagcttccc

SEQ ID NO: 1732273 - DNA, 20 bp, Homo sapiens
tgctcccattcctccctccg

SEQ ID NO: 1732274 - DNA, 14 bp, Homo sapiens
tgctccccacagcg

SEQ ID NO: 1732275 - DNA, 21 bp, Homo sapiens
tgctccccacagcgtccctgg

SEQ ID NO: 1732276 - DNA, 22 bp, Homo sapiens
tgctccccacagcgtccctggc

SEQ ID NO: 1732277 - DNA, 15 bp, Homo sapiens
tgctccccaggccac

SEQ ID NO: 1732278 - DNA, 14 bp, Homo sapiens
tgctcccccacccc

SEQ ID NO: 1732279 - DNA, 16 bp, Homo sapiens
tgctcccccaccccct

SEQ ID NO: 1732280 - DNA, 21 bp, Homo sapiens
tgctcccccaccccctcccca

SEQ ID NO: 1732281 - DNA, 13 bp, Homo sapiens
tgctcccctaacc

SEQ ID NO: 1732282 - DNA, 23 bp, Homo sapiens
tgctcccctgccacactgatggc

SEQ ID NO: 1732283 - DNA, 16 bp, Homo sapiens
tgctccctaacctttc

SEQ ID NO: 1732284 - DNA, 15 bp, Homo sapiens
tgctccctcccctgc

SEQ ID NO: 1732285 - DNA, 17 bp, Homo sapiens
tgctccctcccctgccc

SEQ ID NO: 1732286 - DNA, 14 bp, Homo sapiens
tgctccctctgtca

SEQ ID NO: 1732287 - DNA, 15 bp, Homo sapiens
tgctccgctcccacc

SEQ ID NO: 1732288 - DNA, 16 bp, Homo sapiens
tgctccgctcccaccg

SEQ ID NO: 1732289 - DNA, 18 bp, Homo sapiens
tgctccgctcccaccgcc

SEQ ID NO: 1732290 - DNA, 14 bp, Homo sapiens
tgctccgtgcctcc

SEQ ID NO: 1732291 - DNA, 17 bp, Homo sapiens
tgctccgtgcctccacc

SEQ ID NO: 1732292 - DNA, 18 bp, Homo sapiens
tgctccgtgcctccacca

SEQ ID NO: 1732293 - DNA, 13 bp, Homo sapiens
tgctccgtggact

SEQ ID NO: 1732294 - DNA, 19 bp, Homo sapiens
tgctccgtggactgcagtc

SEQ ID NO: 1732295 - DNA, 18 bp, Homo sapiens
tgctcctagtttgacctc

SEQ ID NO: 1732296 - DNA, 14 bp, Homo sapiens
tgctcctcacctgt

SEQ ID NO: 1732297 - DNA, 16 bp, Homo sapiens
tgctcctcacctgtct

SEQ ID NO: 1732298 - DNA, 17 bp, Homo sapiens
tgctcctcactggagga

SEQ ID NO: 1732299 - DNA, 21 bp, Homo sapiens
tgctcctccagggccacgtgc

SEQ ID NO: 1732300 - DNA, 15 bp, Homo sapiens
tgctcctccctgccc

SEQ ID NO: 1732301 - DNA, 13 bp, Homo sapiens
tgctcctccctgg

SEQ ID NO: 1732302 - DNA, 14 bp, Homo sapiens
tgctcctccctggc

SEQ ID NO: 1732303 - DNA, 17 bp, Homo sapiens
tgctcctccctggctgc

SEQ ID NO: 1732304 - DNA, 20 bp, Homo sapiens
tgctcctccctggctgccct

SEQ ID NO: 1732305 - DNA, 23 bp, Homo sapiens
tgctcctccctggctgccctggc

SEQ ID NO: 1732306 - DNA, 20 bp, Homo sapiens
tgctcctccgtgtggactgt

SEQ ID NO: 1732307 - DNA, 19 bp, Homo sapiens
tgctcctccttggtgcctg

SEQ ID NO: 1732308 - DNA, 17 bp, Homo sapiens
tgctcctctctttgtgg

SEQ ID NO: 1732309 - DNA, 20 bp, Homo sapiens
tgctcctcttgattcctggt

SEQ ID NO: 1732310 - DNA, 14 bp, Homo sapiens
tgctcctgcccagg

SEQ ID NO: 1732311 - DNA, 15 bp, Homo sapiens
tgctcctgcccagga

SEQ ID NO: 1732312 - DNA, 16 bp, Homo sapiens
tgctcctgcccaggag

SEQ ID NO: 1732313 - DNA, 23 bp, Homo sapiens
tgctcctgcttttctgtcctggg

SEQ ID NO: 1732314 - DNA, 19 bp, Homo sapiens
tgctcctgtggcaggaggc

SEQ ID NO: 1732315 - DNA, 14 bp, Homo sapiens
tgctcctttaccct

SEQ ID NO: 1732316 - DNA, 16 bp, Homo sapiens
tgctcctttaccctct

SEQ ID NO: 1732317 - DNA, 16 bp, Homo sapiens
tgctcgcccagacacc

SEQ ID NO: 1732318 - DNA, 12 bp, Homo sapiens
tgctctaaaata

SEQ ID NO: 1732319 - DNA, 15 bp, Homo sapiens
tgctctaaaatattt

SEQ ID NO: 1732320 - DNA, 19 bp, Homo sapiens
tgctctaacacctgcctag

SEQ ID NO: 1732321 - DNA, 15 bp, Homo sapiens
tgctctaacagccct

SEQ ID NO: 1732322 - DNA, 21 bp, Homo sapiens
tgctctaatgatcaaaacatg

SEQ ID NO: 1732323 - DNA, 20 bp, Homo sapiens
tgctctacaatgacacacaa

SEQ ID NO: 1732324 - DNA, 19 bp, Homo sapiens
tgctctagccaggagtctg

SEQ ID NO: 1732325 - DNA, 13 bp, Homo sapiens
tgctctagctggc

SEQ ID NO: 1732326 - DNA, 14 bp, Homo sapiens
tgctctagctggca

SEQ ID NO: 1732327 - DNA, 15 bp, Homo sapiens
tgctctagctggcag

SEQ ID NO: 1732328 - DNA, 17 bp, Homo sapiens
tgctctagctggcagga

SEQ ID NO: 1732329 - DNA, 18 bp, Homo sapiens
tgctctagctggcaggac

SEQ ID NO: 1732330 - DNA, 19 bp, Homo sapiens
tgctctagctggcaggaca

SEQ ID NO: 1732331 - DNA, 15 bp, Homo sapiens
tgctctaggaagaca

SEQ ID NO: 1732332 - DNA, 21 bp, Homo sapiens
tgctctaggctgccccgggtc

SEQ ID NO: 1732333 - DNA, 20 bp, Homo sapiens
tgctctagggaatctggatt

SEQ ID NO: 1732334 - DNA, 21 bp, Homo sapiens
tgctctagggaatctggatta

SEQ ID NO: 1732335 - DNA, 21 bp, Homo sapiens
tgctctattaagattggaaat

SEQ ID NO: 1732336 - DNA, 22 bp, Homo sapiens
tgctctattaagattggaaatg

SEQ ID NO: 1732337 - DNA, 21 bp, Homo sapiens
tgctctattgtagcatttctt

SEQ ID NO: 1732338 - DNA, 15 bp, Homo sapiens
tgctctcagcctccc

SEQ ID NO: 1732339 - DNA, 16 bp, Homo sapiens
tgctctcagcctccca

SEQ ID NO: 1732340 - DNA, 17 bp, Homo sapiens
tgctctcagcctcccac

SEQ ID NO: 1732341 - DNA, 16 bp, Homo sapiens
tgctctcagctggcag

SEQ ID NO: 1732342 - DNA, 18 bp, Homo sapiens
tgctctccccggcaggcc

SEQ ID NO: 1732343 - DNA, 19 bp, Homo sapiens
tgctctccccggcaggcct

SEQ ID NO: 1732344 - DNA, 21 bp, Homo sapiens
tgctctccccggcaggcctga

SEQ ID NO: 1732345 - DNA, 22 bp, Homo sapiens
tgctctccccggcaggcctgag

SEQ ID NO: 1732346 - DNA, 21 bp, Homo sapiens
tgctctccggcgcagacaggc

SEQ ID NO: 1732347 - DNA, 14 bp, Homo sapiens
tgctctcctcatct

SEQ ID NO: 1732348 - DNA, 22 bp, Homo sapiens
tgctctcgcacctttccaaagt

SEQ ID NO: 1732349 - DNA, 14 bp, Homo sapiens
tgctctctctgagg

SEQ ID NO: 1732350 - DNA, 11 bp, Homo sapiens
tgctctctgag

SEQ ID NO: 1732351 - DNA, 14 bp, Homo sapiens
tgctctctgcagcc

SEQ ID NO: 1732352 - DNA, 17 bp, Homo sapiens
tgctctctgcagccagc

SEQ ID NO: 1732353 - DNA, 12 bp, Homo sapiens
tgctctcttcag

SEQ ID NO: 1732354 - DNA, 13 bp, Homo sapiens
tgctctcttcagg

SEQ ID NO: 1732355 - DNA, 15 bp, Homo sapiens
tgctctctttctgtc

SEQ ID NO: 1732356 - DNA, 18 bp, Homo sapiens
tgctctgacgtagaaaga

SEQ ID NO: 1732357 - DNA, 20 bp, Homo sapiens
tgctctgagaattgttgaga

SEQ ID NO: 1732358 - DNA, 17 bp, Homo sapiens
tgctctgaggcctcact

SEQ ID NO: 1732359 - DNA, 16 bp, Homo sapiens
tgctctgccatcttca

SEQ ID NO: 1732360 - DNA, 12 bp, Homo sapiens
tgctctgcccct

SEQ ID NO: 1732361 - DNA, 16 bp, Homo sapiens
tgctctggaagagagg

SEQ ID NO: 1732362 - DNA, 12 bp, Homo sapiens
tgctctggagca

SEQ ID NO: 1732363 - DNA, 17 bp, Homo sapiens
tgctctggagcagccaa

SEQ ID NO: 1732364 - DNA, 12 bp, Homo sapiens
tgctctggcacc

SEQ ID NO: 1732365 - DNA, 24 bp, Homo sapiens
tgctctggcggcttcctgtccact

SEQ ID NO: 1732366 - DNA, 22 bp, Homo sapiens
tgctctgtcttctttgcccaca

SEQ ID NO: 1732367 - DNA, 12 bp, Homo sapiens
tgctcttagctg

SEQ ID NO: 1732368 - DNA, 21 bp, Homo sapiens
tgctcttagtgcccgcctagg

SEQ ID NO: 1732369 - DNA, 18 bp, Homo sapiens
tgctcttcaaaataaaac

SEQ ID NO: 1732370 - DNA, 16 bp, Homo sapiens
tgctcttctttctgag

SEQ ID NO: 1732371 - DNA, 16 bp, Homo sapiens
tgctcttgaaatattc

SEQ ID NO: 1732372 - DNA, 16 bp, Homo sapiens
tgctcttgcagttgct

SEQ ID NO: 1732373 - DNA, 12 bp, Homo sapiens
tgctcttggaaa

SEQ ID NO: 1732374 - DNA, 18 bp, Homo sapiens
tgctcttggctgacccct

SEQ ID NO: 1732375 - DNA, 18 bp, Homo sapiens
tgctcttgtttttattaa

SEQ ID NO: 1732376 - DNA, 20 bp, Homo sapiens
tgctctttcatagtataact

SEQ ID NO: 1732377 - DNA, 14 bp, Homo sapiens
tgctctttcccagg

SEQ ID NO: 1732378 - DNA, 16 bp, Homo sapiens
tgctctttcccaggac

SEQ ID NO: 1732379 - DNA, 20 bp, Homo sapiens
tgagctctccaggccaggtg

SEQ ID NO: 1732380 - DNA, 21 bp, Homo sapiens
tgagctctccaggccaggtgg

SEQ ID NO: 1732381 - DNA, 12 bp, Homo sapiens
tgagctctctgt

SEQ ID NO: 1732382 - DNA, 21 bp, Homo sapiens
tgagctctggttatttttctc

SEQ ID NO: 1732383 - DNA, 13 bp, Homo sapiens
tgagctcttccct

SEQ ID NO: 1732384 - DNA, 20 bp, Homo sapiens
tgagctcttcccttattcct

SEQ ID NO: 1732385 - DNA, 17 bp, Homo sapiens
tgagctgaaatgctgca

SEQ ID NO: 1732386 - DNA, 18 bp, Homo sapiens
tgagctgaaatgctgcat

SEQ ID NO: 1732387 - DNA, 20 bp, Homo sapiens
tgagctgaaatgctgcattt

SEQ ID NO: 1732388 - DNA, 19 bp, Homo sapiens
tgagctgagatcgtgccgt

SEQ ID NO: 1732389 - DNA, 16 bp, Homo sapiens
tgagctgatctgcgga

SEQ ID NO: 1732390 - DNA, 11 bp, Homo sapiens
tgagctgcctt

SEQ ID NO: 1732391 - DNA, 12 bp, Homo sapiens
tgagctgccttc

SEQ ID NO: 1732392 - DNA, 16 bp, Homo sapiens
tgagctgccttcccta

SEQ ID NO: 1732393 - DNA, 19 bp, Homo sapiens
tgagctgccttccctagct

SEQ ID NO: 1732394 - DNA, 21 bp, Homo sapiens
tgagctgctcattacagttct

SEQ ID NO: 1732395 - DNA, 17 bp, Homo sapiens
tgcctatatctgagaga

SEQ ID NO: 1732396 - DNA, 20 bp, Homo sapiens
tgcctatcacctcttatgca

SEQ ID NO: 1732397 - DNA, 21 bp, Homo sapiens
tgcctattatctgtcagctgc

SEQ ID NO: 1732398 - DNA, 14 bp, Homo sapiens
tgcctatttgtgtg

SEQ ID NO: 1732399 - DNA, 22 bp, Homo sapiens
tgcctcaatgtgaatcagaccc

SEQ ID NO: 1732400 - DNA, 20 bp, Homo sapiens
tgcctcagactccgccctcc

SEQ ID NO: 1732401 - DNA, 21 bp, Homo sapiens
tgcctcagactccgccctcct

SEQ ID NO: 1732402 - DNA, 14 bp, Homo sapiens
tgcctcagagacca

SEQ ID NO: 1732403 - DNA, 16 bp, Homo sapiens
tgcctcagcctcctga

SEQ ID NO: 1732404 - DNA, 18 bp, Homo sapiens
tgcctcaggaggcaggac

SEQ ID NO: 1732405 - DNA, 21 bp, Homo sapiens
tgcctcaggaggcaggacctt

SEQ ID NO: 1732406 - DNA, 12 bp, Homo sapiens
tgcctcagtttt

SEQ ID NO: 1732407 - DNA, 16 bp, Homo sapiens
tgcctcagttttcctt

SEQ ID NO: 1732408 - DNA, 18 bp, Homo sapiens
tgcctcagttttccttct

SEQ ID NO: 1732409 - DNA, 21 bp, Homo sapiens
tgcctcagttttccttctgtt

SEQ ID NO: 1732410 - DNA, 22 bp, Homo sapiens
tgcctcatagcatagccagcat

SEQ ID NO: 1732411 - DNA, 20 bp, Homo sapiens
tgcctcatctataacatgca

SEQ ID NO: 1732412 - DNA, 21 bp, Homo sapiens
tgcctccaccaccactggcca

SEQ ID NO: 1732413 - DNA, 14 bp, Homo sapiens
tgcctccaccagca

SEQ ID NO: 1732414 - DNA, 20 bp, Homo sapiens
tgcctccaccgagccagctt

SEQ ID NO: 1732415 - DNA, 22 bp, Homo sapiens
tgcctccaccgagccagcttgg

SEQ ID NO: 1732416 - DNA, 13 bp, Homo sapiens
tgcctccaccgct

SEQ ID NO: 1732417 - DNA, 15 bp, Homo sapiens
tgcctccagggctgg

SEQ ID NO: 1732418 - DNA, 21 bp, Homo sapiens
tgcctccagggctggactgag

SEQ ID NO: 1732419 - DNA, 15 bp, Homo sapiens
tgcctccaggtgcag

SEQ ID NO: 1732420 - DNA, 16 bp, Homo sapiens
tgcctccaggtgcaga

SEQ ID NO: 1732421 - DNA, 19 bp, Homo sapiens
tgcctccatggcagcagcc

SEQ ID NO: 1732422 - DNA, 20 bp, Homo sapiens
tgcctccatggcagcagcca

SEQ ID NO: 1732423 - DNA, 19 bp, Homo sapiens
tgcctcccaaggtcctctc

SEQ ID NO: 1732424 - DNA, 17 bp, Homo sapiens
tgcctcccacttcactg

SEQ ID NO: 1732425 - DNA, 14 bp, Homo sapiens
tgcctcccaggcaa

SEQ ID NO: 1732426 - DNA, 17 bp, Homo sapiens
tgcctccccatttccca

SEQ ID NO: 1732427 - DNA, 14 bp, Homo sapiens
tgcctccccccaga

SEQ ID NO: 1732428 - DNA, 16 bp, Homo sapiens
tgcctccccccagacc

SEQ ID NO: 1732429 - DNA, 22 bp, Homo sapiens
tgcctccccccagaccccgccc

SEQ ID NO: 1732430 - DNA, 14 bp, Homo sapiens
tgcctccctagctt

SEQ ID NO: 1732431 - DNA, 18 bp, Homo sapiens
tgcctccctccccagtgc

SEQ ID NO: 1732432 - DNA, 14 bp, Homo sapiens
tgcctccctctcca

SEQ ID NO: 1732433 - DNA, 19 bp, Homo sapiens
tgcctcccttgtggcagca

SEQ ID NO: 1732434 - DNA, 16 bp, Homo sapiens
tgcctccgggcaggca

SEQ ID NO: 1732435 - DNA, 20 bp, Homo sapiens
tgcctcctgccaccccttcc

SEQ ID NO: 1732436 - DNA, 12 bp, Homo sapiens
tgcctcctggct

SEQ ID NO: 1732437 - DNA, 14 bp, Homo sapiens
tgcctcctggctca

SEQ ID NO: 1732438 - DNA, 21 bp, Homo sapiens
tgcctcctggctcaggcccag

SEQ ID NO: 1732439 - DNA, 23 bp, Homo sapiens
tgcctcgaggcaccggcgctgca

SEQ ID NO: 1732440 - DNA, 14 bp, Homo sapiens
tgcctcggactcca

SEQ ID NO: 1732441 - DNA, 20 bp, Homo sapiens
tgcctctactttgattctga

SEQ ID NO: 1732442 - DNA, 23 bp, Homo sapiens
tgcctctagtccccaaggcctct

SEQ ID NO: 1732443 - DNA, 18 bp, Homo sapiens
tgcctctccctggccctc

SEQ ID NO: 1732444 - DNA, 11 bp, Homo sapiens
tgcctctcctc

SEQ ID NO: 1732445 - DNA, 12 bp, Homo sapiens
tgcctctctagg

SEQ ID NO: 1732446 - DNA, 20 bp, Homo sapiens
tgcctctgatatgggactga

SEQ ID NO: 1732447 - DNA, 15 bp, Homo sapiens
tgcctctgcagtctc

SEQ ID NO: 1732448 - DNA, 17 bp, Homo sapiens
tgcctctgcctcccaaa

SEQ ID NO: 1732449 - DNA, 11 bp, Homo sapiens
tgcctctgtgc

SEQ ID NO: 1732450 - DNA, 20 bp, Homo sapiens
tgcctctgtgcacagtggct

SEQ ID NO: 1732451 - DNA, 14 bp, Homo sapiens
tgcctctgtgctgt

SEQ ID NO: 1732452 - DNA, 17 bp, Homo sapiens
tgcctctgtgctgtgtg

SEQ ID NO: 1732453 - DNA, 21 bp, Homo sapiens
tgcctctgtgctgtgtgtgac

SEQ ID NO: 1732454 - DNA, 23 bp, Homo sapiens
tgcctcttccagtcttcctgaca

SEQ ID NO: 1732455 - DNA, 18 bp, Homo sapiens
tgcctcttccagtgaaca

SEQ ID NO: 1732456 - DNA, 11 bp, Homo sapiens
tgcctcttctt

SEQ ID NO: 1732457 - DNA, 12 bp, Homo sapiens
tgcctctttccc

SEQ ID NO: 1732458 - DNA, 18 bp, Homo sapiens
tgcctctttcctgttgtt

SEQ ID NO: 1732459 - DNA, 20 bp, Homo sapiens
tgccgcctgcactcctcagg

SEQ ID NO: 1732460 - DNA, 14 bp, Homo sapiens
tgccgcctgctcct

SEQ ID NO: 1732461 - DNA, 20 bp, Homo sapiens
tgccgcctgctcctcactgg

SEQ ID NO: 1732462 - DNA, 20 bp, Homo sapiens
tgccgcgggcggccaggcaa

SEQ ID NO: 1732463 - DNA, 17 bp, Homo sapiens
tgccgcgtccctgcccc

SEQ ID NO: 1732464 - DNA, 17 bp, Homo sapiens
tgccgctacctccctcc

SEQ ID NO: 1732465 - DNA, 14 bp, Homo sapiens
tgccgctctctctg

SEQ ID NO: 1732466 - DNA, 16 bp, Homo sapiens
tgccgctctctctgag

SEQ ID NO: 1732467 - DNA, 12 bp, Homo sapiens
tgccgctgtctc

SEQ ID NO: 1732468 - DNA, 15 bp, Homo sapiens
tgccgctgtctctga

SEQ ID NO: 1732469 - DNA, 18 bp, Homo sapiens
tgccggatacaaactggt

SEQ ID NO: 1732470 - DNA, 19 bp, Homo sapiens
tgccggcggcagccccact

SEQ ID NO: 1732471 - DNA, 22 bp, Homo sapiens
tgccggcggcagccccacttca

SEQ ID NO: 1732472 - DNA, 16 bp, Homo sapiens
tgccggctctgggcct

SEQ ID NO: 1732473 - DNA, 22 bp, Homo sapiens
tgccgggctgagggcctgctgg

SEQ ID NO: 1732474 - DNA, 13 bp, Homo sapiens
tgccggggacaga

SEQ ID NO: 1732475 - DNA, 16 bp, Homo sapiens
tgccggtgagaataag

SEQ ID NO: 1732476 - DNA, 14 bp, Homo sapiens
tgccgtaatttaac

SEQ ID NO: 1732477 - DNA, 20 bp, Homo sapiens
tgccgtggattgcacgtggc

SEQ ID NO: 1732478 - DNA, 15 bp, Homo sapiens
tgccgtggcttgggg

SEQ ID NO: 1732479 - DNA, 23 bp, Homo sapiens
tgccgtggggccgccgcctcttt

SEQ ID NO: 1732480 - DNA, 20 bp, Homo sapiens
tgccgtgtgccctcgggcga

SEQ ID NO: 1732481 - DNA, 20 bp, Homo sapiens
tgcctaaaacccagttgctg

SEQ ID NO: 1732482 - DNA, 18 bp, Homo sapiens
tgcctaaatccaaagaaa

SEQ ID NO: 1732483 - DNA, 18 bp, Homo sapiens
tgcctaaatcccaagaaa

SEQ ID NO: 1732484 - DNA, 20 bp, Homo sapiens
tgcctaaatttaatgctgcc

SEQ ID NO: 1732485 - DNA, 13 bp, Homo sapiens
tgcctaagccctc

SEQ ID NO: 1732486 - DNA, 15 bp, Homo sapiens
tgcctaagtggctgc

SEQ ID NO: 1732487 - DNA, 17 bp, Homo sapiens
tgcctaagtggctgctg

SEQ ID NO: 1732488 - DNA, 18 bp, Homo sapiens
tgcctaataaacatcctt

SEQ ID NO: 1732489 - DNA, 21 bp, Homo sapiens
tgcctaataaacatccttcaa

SEQ ID NO: 1732490 - DNA, 15 bp, Homo sapiens
tgcctaattttctat

SEQ ID NO: 1732491 - DNA, 17 bp, Homo sapiens
tgcctacaataaaaaga

SEQ ID NO: 1732492 - DNA, 18 bp, Homo sapiens
tgcctacacacacagcct

SEQ ID NO: 1732493 - DNA, 17 bp, Homo sapiens
tgcctacagaacttcag

SEQ ID NO: 1732494 - DNA, 20 bp, Homo sapiens
tgcctacctaatgaggactt

SEQ ID NO: 1732495 - DNA, 22 bp, Homo sapiens
tgcctacggagggtgggctctg

SEQ ID NO: 1732496 - DNA, 16 bp, Homo sapiens
tgcctagactgttact

SEQ ID NO: 1732497 - DNA, 22 bp, Homo sapiens
tgcctagattaggtagactttg

SEQ ID NO: 1732498 - DNA, 12 bp, Homo sapiens
tgcctaggagct

SEQ ID NO: 1732499 - DNA, 14 bp, Homo sapiens
tgcctaggagctgg

SEQ ID NO: 1732500 - DNA, 17 bp, Homo sapiens
tgcctaggagctggctg

SEQ ID NO: 1732501 - DNA, 18 bp, Homo sapiens
tgcctaggaggctggcca

SEQ ID NO: 1732502 - DNA, 22 bp, Homo sapiens
tgcctaggccaaatgcacaagc

SEQ ID NO: 1732503 - DNA, 17 bp, Homo sapiens
tgagtcttggttctaaa

SEQ ID NO: 1732504 - DNA, 18 bp, Homo sapiens
tgagtcttggttctaaag

SEQ ID NO: 1732505 - DNA, 20 bp, Homo sapiens
tgagtcttggttctaaaggt

SEQ ID NO: 1732506 - DNA, 19 bp, Homo sapiens
tgagtctttgaagatagtt

SEQ ID NO: 1732507 - DNA, 20 bp, Homo sapiens
tgagtgaaaatttttacatt

SEQ ID NO: 1732508 - DNA, 23 bp, Homo sapiens
tgagtgacacaagcactttaatg

SEQ ID NO: 1732509 - DNA, 17 bp, Homo sapiens
tgagtgacagctttctg

SEQ ID NO: 1732510 - DNA, 18 bp, Homo sapiens
tgcagttcagcaccaccc

SEQ ID NO: 1732511 - DNA, 20 bp, Homo sapiens
tgcagttcatccgcactgta

SEQ ID NO: 1732512 - DNA, 20 bp, Homo sapiens
tgcagttctagtttgcattc

SEQ ID NO: 1732513 - DNA, 17 bp, Homo sapiens
tgcagttgataagagga

SEQ ID NO: 1732514 - DNA, 18 bp, Homo sapiens
tgcagttgtgatttctgt

SEQ ID NO: 1732515 - DNA, 12 bp, Homo sapiens
tgcagtttcctg

SEQ ID NO: 1732516 - DNA, 13 bp, Homo sapiens
tgcagtttcctgg

SEQ ID NO: 1732517 - DNA, 15 bp, Homo sapiens
tgcagtttcttttca

SEQ ID NO: 1732518 - DNA, 17 bp, Homo sapiens
tgcagtttcttttcaca

SEQ ID NO: 1732519 - DNA, 14 bp, Homo sapiens
tgcagtttggccct

SEQ ID NO: 1732520 - DNA, 14 bp, Homo sapiens
tgcagttttaagaa

SEQ ID NO: 1732521 - DNA, 12 bp, Homo sapiens
tgcagttttcct

SEQ ID NO: 1732522 - DNA, 21 bp, Homo sapiens
tgcagttttggtttgatgtaa

SEQ ID NO: 1732523 - DNA, 15 bp, Homo sapiens
tgcagtttttcagag

SEQ ID NO: 1732524 - DNA, 14 bp, Homo sapiens
tgcagtttttcagg

SEQ ID NO: 1732525 - DNA, 16 bp, Homo sapiens
tgcagtttttcccaag

SEQ ID NO: 1732526 - DNA, 17 bp, Homo sapiens
tgcataaagtcagtgcc

SEQ ID NO: 1732527 - DNA, 16 bp, Homo sapiens
tgcataagctgaacta

SEQ ID NO: 1732528 - DNA, 23 bp, Homo sapiens
tgcataataagctaaagaggctg

SEQ ID NO: 1732529 - DNA, 15 bp, Homo sapiens
tgcataatttatggt

SEQ ID NO: 1732530 - DNA, 20 bp, Homo sapiens
tgcatactcaaggtgagaat

SEQ ID NO: 1732531 - DNA, 18 bp, Homo sapiens
tgcatactttgacaagga

SEQ ID NO: 1732532 - DNA, 19 bp, Homo sapiens
tgcatactttgacaaggaa

SEQ ID NO: 1732533 - DNA, 20 bp, Homo sapiens
tgcatactttgacaaggaaa

SEQ ID NO: 1732534 - DNA, 21 bp, Homo sapiens
tgcatactttgacaaggaaaa

SEQ ID NO: 1732535 - DNA, 20 bp, Homo sapiens
tgcatactttgtattttgat

SEQ ID NO: 1732536 - DNA, 22 bp, Homo sapiens
tgcatactttttaaatgtaaag

SEQ ID NO: 1732537 - DNA, 20 bp, Homo sapiens
tgcatagattccctgagcag

SEQ ID NO: 1732538 - DNA, 15 bp, Homo sapiens
tgcatagcagtatat

SEQ ID NO: 1732539 - DNA, 16 bp, Homo sapiens
tgcatagcagtatatg

SEQ ID NO: 1732540 - DNA, 14 bp, Homo sapiens
tgcatagcgtcctg

SEQ ID NO: 1732541 - DNA, 19 bp, Homo sapiens
tgcataggctcttaagcag

SEQ ID NO: 1732542 - DNA, 20 bp, Homo sapiens
tgcatagtaccaatcatttt

SEQ ID NO: 1732543 - DNA, 14 bp, Homo sapiens
tgcatagtattcca

SEQ ID NO: 1732544 - DNA, 18 bp, Homo sapiens
tgcatagttgtagacaaa

SEQ ID NO: 1732545 - DNA, 18 bp, Homo sapiens
tgcatatcacccttccct

SEQ ID NO: 1732546 - DNA, 13 bp, Homo sapiens
tgcatatcctgag

SEQ ID NO: 1732547 - DNA, 16 bp, Homo sapiens
tgcatatcctgagcca

SEQ ID NO: 1732548 - DNA, 18 bp, Homo sapiens
tgcatatcctgagccatc

SEQ ID NO: 1732549 - DNA, 13 bp, Homo sapiens
tgcatatgtttcg

SEQ ID NO: 1732550 - DNA, 15 bp, Homo sapiens
tgcatattaaataat

SEQ ID NO: 1732551 - DNA, 15 bp, Homo sapiens
tgcatattgtattac

SEQ ID NO: 1732552 - DNA, 15 bp, Homo sapiens
tgcatatttatccaa

SEQ ID NO: 1732553 - DNA, 22 bp, Homo sapiens
tgcatatttatccaaaatgtgt

SEQ ID NO: 1732554 - DNA, 18 bp, Homo sapiens
tgcatatttattgcattg

SEQ ID NO: 1732555 - DNA, 13 bp, Homo sapiens
tgcatatttgcca

SEQ ID NO: 1732556 - DNA, 20 bp, Homo sapiens
tgcatattttgagaaactgc

SEQ ID NO: 1732557 - DNA, 22 bp, Homo sapiens
tgcatcaatttttcttatttca

SEQ ID NO: 1732558 - DNA, 21 bp, Homo sapiens
tgcatcactgtatcattttct

SEQ ID NO: 1732559 - DNA, 19 bp, Homo sapiens
tgcatcagaaagctttatt

SEQ ID NO: 1732560 - DNA, 22 bp, Homo sapiens
tgcatcagctgctgaaacaaca

SEQ ID NO: 1732561 - DNA, 13 bp, Homo sapiens
tgcatcaggtcct

SEQ ID NO: 1732562 - DNA, 18 bp, Homo sapiens
tgcatccattcctcaggg

SEQ ID NO: 1732563 - DNA, 20 bp, Homo sapiens
tgcatccattcctcagggac

SEQ ID NO: 1732564 - DNA, 23 bp, Homo sapiens
tgcatcccaaaccacgcctcttg

SEQ ID NO: 1732565 - DNA, 22 bp, Homo sapiens
tgcatcccgatacctcagccct

SEQ ID NO: 1732566 - DNA, 13 bp, Homo sapiens
tgcatccctgaga

SEQ ID NO: 1732567 - DNA, 19 bp, Homo sapiens
tgcatccgtagttccctga

SEQ ID NO: 1732568 - DNA, 14 bp, Homo sapiens
tgcatcctccaaga

SEQ ID NO: 1732569 - DNA, 14 bp, Homo sapiens
tgcatccttcctgg

SEQ ID NO: 1732570 - DNA, 15 bp, Homo sapiens
tgcatccttcctggg

SEQ ID NO: 1732571 - DNA, 16 bp, Homo sapiens
tgcatccttcctgggg

SEQ ID NO: 1732572 - DNA, 16 bp, Homo sapiens
tgcatccttgtaatac

SEQ ID NO: 1732573 - DNA, 14 bp, Homo sapiens
tgcatctcaaaatt

SEQ ID NO: 1732574 - DNA, 19 bp, Homo sapiens
tgcatctcaaaattattct

SEQ ID NO: 1732575 - DNA, 13 bp, Homo sapiens
tgcatctcagccc

SEQ ID NO: 1732576 - DNA, 14 bp, Homo sapiens
tgcatctcagccca

SEQ ID NO: 1732577 - DNA, 13 bp, Homo sapiens
tgcatctcctccc

SEQ ID NO: 1732578 - DNA, 22 bp, Homo sapiens
tgcatctgaaataggaaacaag

SEQ ID NO: 1732579 - DNA, 18 bp, Homo sapiens
tgcatcttactgaaggta

SEQ ID NO: 1732580 - DNA, 14 bp, Homo sapiens
tgcatctttgcctc

SEQ ID NO: 1732581 - DNA, 20 bp, Homo sapiens
tgcatgaaaaatcatgggcc

SEQ ID NO: 1732582 - DNA, 11 bp, Homo sapiens
tgcatgaaaat

SEQ ID NO: 1732583 - DNA, 21 bp, Homo sapiens
tgcatgaaattgtatctcagt

SEQ ID NO: 1732584 - DNA, 19 bp, Homo sapiens
tgcatgaatatcatacaaa

SEQ ID NO: 1732585 - DNA, 20 bp, Homo sapiens
tgcatgaattactgtatata

SEQ ID NO: 1732586 - DNA, 21 bp, Homo sapiens
tgcatgacaaaccttatggaa

SEQ ID NO: 1732587 - DNA, 16 bp, Homo sapiens
tgcatgaccaaagtga

SEQ ID NO: 1732588 - DNA, 18 bp, Homo sapiens
tgcatgaccaaagtgata

SEQ ID NO: 1732589 - DNA, 22 bp, Homo sapiens
tgcatgagctggcaaccagcca

SEQ ID NO: 1732590 - DNA, 15 bp, Homo sapiens
tgcatgattgcagaa

SEQ ID NO: 1732591 - DNA, 15 bp, Homo sapiens
tgcatgcaaatgagc

SEQ ID NO: 1732592 - DNA, 21 bp, Homo sapiens
tgcatgccaaggggttaatga

SEQ ID NO: 1732593 - DNA, 15 bp, Homo sapiens
tgcatgctagcatgg

SEQ ID NO: 1732594 - DNA, 18 bp, Homo sapiens
tgcatgctctctgcagcc

SEQ ID NO: 1732595 - DNA, 19 bp, Homo sapiens
tgcatgctctctgcagcca

SEQ ID NO: 1732596 - DNA, 15 bp, Homo sapiens
tgcatgctctggaag

SEQ ID NO: 1732597 - DNA, 17 bp, Homo sapiens
tgcatgctctggaagcc

SEQ ID NO: 1732598 - DNA, 15 bp, Homo sapiens
tgcatggacctaaca

SEQ ID NO: 1732599 - DNA, 18 bp, Homo sapiens
tgcatggacctaacattc

SEQ ID NO: 1732600 - DNA, 16 bp, Homo sapiens
tgcatggattcagcat

SEQ ID NO: 1732601 - DNA, 23 bp, Homo sapiens
tgcatggcctctaagagtgcccg

SEQ ID NO: 1732602 - DNA, 18 bp, Homo sapiens
tgcatggctccagaaatg

SEQ ID NO: 1732603 - DNA, 18 bp, Homo sapiens
tgccaccaggccacctcc

SEQ ID NO: 1732604 - DNA, 12 bp, Homo sapiens
tgccacccacca

SEQ ID NO: 1732605 - DNA, 22 bp, Homo sapiens
tgccacccccagttcctatgac

SEQ ID NO: 1732606 - DNA, 17 bp, Homo sapiens
tgccacccccttccctg

SEQ ID NO: 1732607 - DNA, 20 bp, Homo sapiens
tgccacccccttccctggga

SEQ ID NO: 1732608 - DNA, 21 bp, Homo sapiens
tgccacccccttccctgggag

SEQ ID NO: 1732609 - DNA, 13 bp, Homo sapiens
tgccaccctacct

SEQ ID NO: 1732610 - DNA, 14 bp, Homo sapiens
tgccaccctagcca

SEQ ID NO: 1732611 - DNA, 21 bp, Homo sapiens
tgccaccggaggtcactccac

SEQ ID NO: 1732612 - DNA, 15 bp, Homo sapiens
tgccaccggcctgtg

SEQ ID NO: 1732613 - DNA, 13 bp, Homo sapiens
tgccacctcccct

SEQ ID NO: 1732614 - DNA, 17 bp, Homo sapiens
tgccacctcccctatcc

SEQ ID NO: 1732615 - DNA, 18 bp, Homo sapiens
tgccacctcccctatcca

SEQ ID NO: 1732616 - DNA, 21 bp, Homo sapiens
tgccacctcccctatccaccc

SEQ ID NO: 1732617 - DNA, 23 bp, Homo sapiens
tgccacctgttaaaatgtacact

SEQ ID NO: 1732618 - DNA, 19 bp, Homo sapiens
tgccacgccccgtgtctgg

SEQ ID NO: 1732619 - DNA, 20 bp, Homo sapiens
tgccacgccccgtgtctgga

SEQ ID NO: 1732620 - DNA, 16 bp, Homo sapiens
tgccacgcctggaagg

SEQ ID NO: 1732621 - DNA, 20 bp, Homo sapiens
tgccacgggtgagagagcag

SEQ ID NO: 1732622 - DNA, 22 bp, Homo sapiens
tgccacgttggagaagcccgtg

SEQ ID NO: 1732623 - DNA, 13 bp, Homo sapiens
tgccactcactag

SEQ ID NO: 1732624 - DNA, 15 bp, Homo sapiens
tgccactcactaggc

SEQ ID NO: 1732625 - DNA, 17 bp, Homo sapiens
tgccactcactaggccc

SEQ ID NO: 1732626 - DNA, 19 bp, Homo sapiens
tgccactcactaggccccc

SEQ ID NO: 1732627 - DNA, 13 bp, Homo sapiens
tgccactccctga

SEQ ID NO: 1732628 - DNA, 16 bp, Homo sapiens
tgccactccctgagct

SEQ ID NO: 1732629 - DNA, 17 bp, Homo sapiens
tgccactccctgagctt

SEQ ID NO: 1732630 - DNA, 18 bp, Homo sapiens
tgccaggttgcagctgct

SEQ ID NO: 1732631 - DNA, 14 bp, Homo sapiens
tgccagtaaaaaaa

SEQ ID NO: 1732632 - DNA, 18 bp, Homo sapiens
tgccagtaacgcgtcttc

SEQ ID NO: 1732633 - DNA, 21 bp, Homo sapiens
tgccagtaacgcgtcttcctg

SEQ ID NO: 1732634 - DNA, 18 bp, Homo sapiens
tgccagtatgttccaaac

SEQ ID NO: 1732635 - DNA, 17 bp, Homo sapiens
tgccagtgaagacttct

SEQ ID NO: 1732636 - DNA, 14 bp, Homo sapiens
tgccagtgcactcc

SEQ ID NO: 1732637 - DNA, 14 bp, Homo sapiens
tgccagtgcagcca

SEQ ID NO: 1732638 - DNA, 11 bp, Homo sapiens
tgccagtgcct

SEQ ID NO: 1732639 - DNA, 15 bp, Homo sapiens
tgccagtgctcaagg

SEQ ID NO: 1732640 - DNA, 17 bp, Homo sapiens
tgccagttatggctata

SEQ ID NO: 1732641 - DNA, 15 bp, Homo sapiens
tgccagttctctgtg

SEQ ID NO: 1732642 - DNA, 18 bp, Homo sapiens
tgccataatcagaacaca

SEQ ID NO: 1732643 - DNA, 13 bp, Homo sapiens
tgccataattcta

SEQ ID NO: 1732644 - DNA, 18 bp, Homo sapiens
tgccatactttgtctgaa

SEQ ID NO: 1732645 - DNA, 17 bp, Homo sapiens
tgccatagtcacatggc

SEQ ID NO: 1732646 - DNA, 18 bp, Homo sapiens
tgccatagtcacatggcc

SEQ ID NO: 1732647 - DNA, 20 bp, Homo sapiens
tgccatagtcttaactggtc

SEQ ID NO: 1732648 - DNA, 23 bp, Homo sapiens
tgccatcaccacggctcactgca

SEQ ID NO: 1732649 - DNA, 13 bp, Homo sapiens
tgccatcactggt

SEQ ID NO: 1732650 - DNA, 21 bp, Homo sapiens
tgccatcctaaaagccacccc

SEQ ID NO: 1732651 - DNA, 18 bp, Homo sapiens
tgccatctagccagcccc

SEQ ID NO: 1732652 - DNA, 12 bp, Homo sapiens
tgccatctgtag

SEQ ID NO: 1732653 - DNA, 16 bp, Homo sapiens
tgccatctgttttcaa

SEQ ID NO: 1732654 - DNA, 12 bp, Homo sapiens
tgccatcttcag

SEQ ID NO: 1732655 - DNA, 14 bp, Homo sapiens
tgccatcttcccag

SEQ ID NO: 1732656 - DNA, 13 bp, Homo sapiens
tgccatgcaggaa

SEQ ID NO: 1732657 - DNA, 21 bp, Homo sapiens
tgccatgcaggaagaggccca

SEQ ID NO: 1732658 - DNA, 18 bp, Homo sapiens
tgccatgccactgccagg

SEQ ID NO: 1732659 - DNA, 20 bp, Homo sapiens
tgccatgccactgccaggca

SEQ ID NO: 1732660 - DNA, 21 bp, Homo sapiens
tgccatgccactgccaggcac

SEQ ID NO: 1732661 - DNA, 16 bp, Homo sapiens
tgccatgcctgctccc

SEQ ID NO: 1732662 - DNA, 14 bp, Homo sapiens
tgccatgctgggcc

SEQ ID NO: 1732663 - DNA, 19 bp, Homo sapiens
tgccatgctgggccactgg

SEQ ID NO: 1732664 - DNA, 14 bp, Homo sapiens
tgccatggatctga

SEQ ID NO: 1732665 - DNA, 24 bp, Homo sapiens
tgccatggatctgatctgtaccat

SEQ ID NO: 1732666 - DNA, 23 bp, Homo sapiens
tgccatgtaaggttgtgcagggt

SEQ ID NO: 1732667 - DNA, 18 bp, Homo sapiens
tgccatgtcagcgctctg

SEQ ID NO: 1732668 - DNA, 14 bp, Homo sapiens
tgccatgtggcaga

SEQ ID NO: 1732669 - DNA, 21 bp, Homo sapiens
tgccatgttttgccaccccct

SEQ ID NO: 1732670 - DNA, 14 bp, Homo sapiens
tgccattacccagt

SEQ ID NO: 1732671 - DNA, 14 bp, Homo sapiens
tgccattcccagcg

SEQ ID NO: 1732672 - DNA, 21 bp, Homo sapiens
tgccattctcttgcattgtga

SEQ ID NO: 1732673 - DNA, 13 bp, Homo sapiens
tgccattctgcct

SEQ ID NO: 1732674 - DNA, 14 bp, Homo sapiens
tgccattctgcctc

SEQ ID NO: 1732675 - DNA, 13 bp, Homo sapiens
tgccattcttctg

SEQ ID NO: 1732676 - DNA, 18 bp, Homo sapiens
tgccattcttctggtgct

SEQ ID NO: 1732677 - DNA, 21 bp, Homo sapiens
tgccattcttctggtgctact

SEQ ID NO: 1732678 - DNA, 17 bp, Homo sapiens
tgccattgggaccctcc

SEQ ID NO: 1732679 - DNA, 17 bp, Homo sapiens
tgccatttaaaaagttg

SEQ ID NO: 1732680 - DNA, 14 bp, Homo sapiens
tgccatttatttat

SEQ ID NO: 1732681 - DNA, 18 bp, Homo sapiens
tgccatttcagtggcttc

SEQ ID NO: 1732682 - DNA, 14 bp, Homo sapiens
tgccatttcccttc

SEQ ID NO: 1732683 - DNA, 17 bp, Homo sapiens
tgccatttctgaactgt

SEQ ID NO: 1732684 - DNA, 21 bp, Homo sapiens
tgccatttctgaactgttaca

SEQ ID NO: 1732685 - DNA, 22 bp, Homo sapiens
tgccatttctgaactgttacaa

SEQ ID NO: 1732686 - DNA, 16 bp, Homo sapiens
tgccatttgcaccctc

SEQ ID NO: 1732687 - DNA, 17 bp, Homo sapiens
tgccatttgcaccctcc

SEQ ID NO: 1732688 - DNA, 19 bp, Homo sapiens
tgccattttaaaaatagaa

SEQ ID NO: 1732689 - DNA, 15 bp, Homo sapiens
tgccatttttcaaaa

SEQ ID NO: 1732690 - DNA, 19 bp, Homo sapiens
tgcccaaaaatatggttga

SEQ ID NO: 1732691 - DNA, 22 bp, Homo sapiens
tgcccaacccttccctcacctt

SEQ ID NO: 1732692 - DNA, 22 bp, Homo sapiens
tgcccaagaatagatgctgact

SEQ ID NO: 1732693 - DNA, 20 bp, Homo sapiens
tgcccaagccagaggctggg

SEQ ID NO: 1732694 - DNA, 23 bp, Homo sapiens
tgcccaagccagaggctgggttc

SEQ ID NO: 1732695 - DNA, 16 bp, Homo sapiens
tgcccaagccctgaga

SEQ ID NO: 1732696 - DNA, 18 bp, Homo sapiens
tgcccaagccctgagagt

SEQ ID NO: 1732697 - DNA, 13 bp, Homo sapiens
tgcccaaggccac

SEQ ID NO: 1732698 - DNA, 20 bp, Homo sapiens
tgcccaatgagactctaggg

SEQ ID NO: 1732699 - DNA, 21 bp, Homo sapiens
tgcccaatgagactctagggt

SEQ ID NO: 1732700 - DNA, 22 bp, Homo sapiens
tgcccaatgctttgggaggcca

SEQ ID NO: 1732701 - DNA, 16 bp, Homo sapiens
tgcccacacactttcc

SEQ ID NO: 1732702 - DNA, 17 bp, Homo sapiens
tgcccacacactttcca

SEQ ID NO: 1732703 - DNA, 22 bp, Homo sapiens
tgcccacacactttccatctct

SEQ ID NO: 1732704 - DNA, 16 bp, Homo sapiens
tgcccacatcccaggc

SEQ ID NO: 1732705 - DNA, 22 bp, Homo sapiens
tgcccacatttgggctcagggt

SEQ ID NO: 1732706 - DNA, 17 bp, Homo sapiens
tgcccaccaacatccca

SEQ ID NO: 1732707 - DNA, 13 bp, Homo sapiens
tgcccaccccctg

SEQ ID NO: 1732708 - DNA, 18 bp, Homo sapiens
tgcccaccccctgccctg

SEQ ID NO: 1732709 - DNA, 18 bp, Homo sapiens
tgcccacccctcactccc

SEQ ID NO: 1732710 - DNA, 21 bp, Homo sapiens
tgcccacccctcactccccag

SEQ ID NO: 1732711 - DNA, 22 bp, Homo sapiens
tgcccacccctcactccccagg

SEQ ID NO: 1732712 - DNA, 18 bp, Homo sapiens
tgcccacccgtcttcaat

SEQ ID NO: 1732713 - DNA, 15 bp, Homo sapiens
tgcccacctgctctt

SEQ ID NO: 1732714 - DNA, 16 bp, Homo sapiens
tgcccacgatcccctc

SEQ ID NO: 1732715 - DNA, 19 bp, Homo sapiens
tgcccacgatcccctcccc

SEQ ID NO: 1732716 - DNA, 23 bp, Homo sapiens
tgcccacgatcccctcccccaag

SEQ ID NO: 1732717 - DNA, 23 bp, Homo sapiens
tgcccacttagccgtccatggca

SEQ ID NO: 1732718 - DNA, 13 bp, Homo sapiens
tgcccagacacat

SEQ ID NO: 1732719 - DNA, 18 bp, Homo sapiens
tgcccagacccctctggc

SEQ ID NO: 1732720 - DNA, 17 bp, Homo sapiens
tgcccagagatgcctcc

SEQ ID NO: 1732721 - DNA, 20 bp, Homo sapiens
tgcccagagggcccaggcag

SEQ ID NO: 1732722 - DNA, 23 bp, Homo sapiens
tgcccagagggcccaggcaggcc

SEQ ID NO: 1732723 - DNA, 16 bp, Homo sapiens
tgcccagcacctggag

SEQ ID NO: 1732724 - DNA, 20 bp, Homo sapiens
tgcccagcaggcccagcatg

SEQ ID NO: 1732725 - DNA, 17 bp, Homo sapiens
tgcccagcccctgcccc

SEQ ID NO: 1732726 - DNA, 19 bp, Homo sapiens
tgcccagcccctgccccta

SEQ ID NO: 1732727 - DNA, 20 bp, Homo sapiens
tgcccagcccggaccttggc

SEQ ID NO: 1732728 - DNA, 23 bp, Homo sapiens
tgcccagctaatttttgtatttt

SEQ ID NO: 1732729 - DNA, 15 bp, Homo sapiens
tgcccagctctctga

SEQ ID NO: 1732730 - DNA, 18 bp, Homo sapiens
tgcccagctctctgacgc

SEQ ID NO: 1732731 - DNA, 21 bp, Homo sapiens
tgcccagctctctgacgcttg

SEQ ID NO: 1732732 - DNA, 18 bp, Homo sapiens
tgcccaggagagccagcc

SEQ ID NO: 1732733 - DNA, 13 bp, Homo sapiens
tgcccaggccctt

SEQ ID NO: 1732734 - DNA, 17 bp, Homo sapiens
tgcccaggcccttggct

SEQ ID NO: 1732735 - DNA, 19 bp, Homo sapiens
tgcccaggcccttggctgc

SEQ ID NO: 1732736 - DNA, 20 bp, Homo sapiens
tgcccagggctcagcctggt

SEQ ID NO: 1732737 - DNA, 15 bp, Homo sapiens
tgcccaggggtgccc

SEQ ID NO: 1732738 - DNA, 18 bp, Homo sapiens
tgcccaggggtgccccct

SEQ ID NO: 1732739 - DNA, 15 bp, Homo sapiens
tgcccgctcagccca

SEQ ID NO: 1732740 - DNA, 14 bp, Homo sapiens
tgcccgctcccaac

SEQ ID NO: 1732741 - DNA, 16 bp, Homo sapiens
tgcccgctcccaaccc

SEQ ID NO: 1732742 - DNA, 21 bp, Homo sapiens
tgcccgctcccaacccccctc

SEQ ID NO: 1732743 - DNA, 16 bp, Homo sapiens
tgcccgctcctcggga

SEQ ID NO: 1732744 - DNA, 23 bp, Homo sapiens
tgcccggagattggacggcctga

SEQ ID NO: 1732745 - DNA, 16 bp, Homo sapiens
tgcccggattctggga

SEQ ID NO: 1732746 - DNA, 18 bp, Homo sapiens
tgcccggattctgggagg

SEQ ID NO: 1732747 - DNA, 17 bp, Homo sapiens
tgcccggcgccgggcac

SEQ ID NO: 1732748 - DNA, 23 bp, Homo sapiens
tgcccggggtggggtgcactcgc

SEQ ID NO: 1732749 - DNA, 20 bp, Homo sapiens
tgcccgtaatcccagctact

SEQ ID NO: 1732750 - DNA, 13 bp, Homo sapiens
tgcccgtcttcag

SEQ ID NO: 1732751 - DNA, 18 bp, Homo sapiens
tgcccgtcttcagcctag

SEQ ID NO: 1732752 - DNA, 15 bp, Homo sapiens
tgcccgtgcccgcag

SEQ ID NO: 1732753 - DNA, 23 bp, Homo sapiens
tgcccgtgtgtgtgtatgtgtgt

SEQ ID NO: 1732754 - DNA, 14 bp, Homo sapiens
tgcccgttcttgaa

SEQ ID NO: 1732755 - DNA, 17 bp, Homo sapiens
tgcccgttcttgaaatg

SEQ ID NO: 1732756 - DNA, 21 bp, Homo sapiens
tgcccgttgtctaggagacag

SEQ ID NO: 1732757 - DNA, 17 bp, Homo sapiens
tgccctaacctgacaga

SEQ ID NO: 1732758 - DNA, 15 bp, Homo sapiens
tgccctaagccccca

SEQ ID NO: 1732759 - DNA, 17 bp, Homo sapiens
tgccctaagcccccagg

SEQ ID NO: 1732760 - DNA, 13 bp, Homo sapiens
tgccctaagggac

SEQ ID NO: 1732761 - DNA, 16 bp, Homo sapiens
tgccctagctgacccc

SEQ ID NO: 1732762 - DNA, 16 bp, Homo sapiens
tgccctatgggcctgc

SEQ ID NO: 1732763 - DNA, 19 bp, Homo sapiens
tgccctcaccaccacacta

SEQ ID NO: 1732764 - DNA, 17 bp, Homo sapiens
tgccctcactccctctg

SEQ ID NO: 1732765 - DNA, 18 bp, Homo sapiens
tgccctcactccctctgc

SEQ ID NO: 1732766 - DNA, 22 bp, Homo sapiens
tgccctcatacccatgcacagt

SEQ ID NO: 1732767 - DNA, 21 bp, Homo sapiens
tgccctcatggcccctctgac

SEQ ID NO: 1732768 - DNA, 18 bp, Homo sapiens
tgccctcattttatgtca

SEQ ID NO: 1732769 - DNA, 13 bp, Homo sapiens
tgccctccaaaga

SEQ ID NO: 1732770 - DNA, 21 bp, Homo sapiens
tgccctccacagccgcagcct

SEQ ID NO: 1732771 - DNA, 20 bp, Homo sapiens
tgccctcccaagtcccaccc

SEQ ID NO: 1732772 - DNA, 14 bp, Homo sapiens
tgccctcccacagc

SEQ ID NO: 1732773 - DNA, 19 bp, Homo sapiens
tgccctcccacagcctcct

SEQ ID NO: 1732774 - DNA, 20 bp, Homo sapiens
tgccctcccacagcctcctt

SEQ ID NO: 1732775 - DNA, 16 bp, Homo sapiens
tgccctcccctgctcc

SEQ ID NO: 1732776 - DNA, 17 bp, Homo sapiens
tgccctccccttcccct

SEQ ID NO: 1732777 - DNA, 21 bp, Homo sapiens
tgccctcccgcaccttcctcc

SEQ ID NO: 1732778 - DNA, 16 bp, Homo sapiens
tgccctccctccttcc

SEQ ID NO: 1732779 - DNA, 14 bp, Homo sapiens
tggcctgggtctcc

SEQ ID NO: 1732780 - DNA, 19 bp, Homo sapiens
tggcctggtccctggtcct

SEQ ID NO: 1732781 - DNA, 14 bp, Homo sapiens
tggcctgtctcatc

SEQ ID NO: 1732782 - DNA, 20 bp, Homo sapiens
tggcctgtctcatccccagg

SEQ ID NO: 1732783 - DNA, 17 bp, Homo sapiens
tggcctgtgctgggcca

SEQ ID NO: 1732784 - DNA, 22 bp, Homo sapiens
tggcctgtgctgggccagtggc

SEQ ID NO: 1732785 - DNA, 13 bp, Homo sapiens
tggcctgtggcac

SEQ ID NO: 1732786 - DNA, 17 bp, Homo sapiens
tggcctgtggcacagcc

SEQ ID NO: 1732787 - DNA, 18 bp, Homo sapiens
tggcctgtggcacagccc

SEQ ID NO: 1732788 - DNA, 19 bp, Homo sapiens
tggcctgtggcacagccct

SEQ ID NO: 1732789 - DNA, 14 bp, Homo sapiens
tggcctgtgtccag

SEQ ID NO: 1732790 - DNA, 15 bp, Homo sapiens
tggcctgtgtccagc

SEQ ID NO: 1732791 - DNA, 16 bp, Homo sapiens
tggcctgtgtccagca

SEQ ID NO: 1732792 - DNA, 20 bp, Homo sapiens
tggcctgtgtccagcagctg

SEQ ID NO: 1732793 - DNA, 14 bp, Homo sapiens
tggcctgtgtccca

SEQ ID NO: 1732794 - DNA, 20 bp, Homo sapiens
tggcctgtgtcccatgaccc

SEQ ID NO: 1732795 - DNA, 16 bp, Homo sapiens
tggcctgttccctaga

SEQ ID NO: 1732796 - DNA, 19 bp, Homo sapiens
tggcctgttccctagagag

SEQ ID NO: 1732797 - DNA, 16 bp, Homo sapiens
tggcctgtttgatgta

SEQ ID NO: 1732798 - DNA, 20 bp, Homo sapiens
tggcctgtttgatgtatgtg

SEQ ID NO: 1732799 - DNA, 18 bp, Homo sapiens
tggccttccccagcctct

SEQ ID NO: 1732800 - DNA, 21 bp, Homo sapiens
tggccttccccttttgcctgg

SEQ ID NO: 1732801 - DNA, 18 bp, Homo sapiens
tggccttgaaaccacctt

SEQ ID NO: 1732802 - DNA, 22 bp, Homo sapiens
tggccttgcccgccagcctcag

SEQ ID NO: 1732803 - DNA, 23 bp, Homo sapiens
tggccttgtaagacccttattgc

SEQ ID NO: 1732804 - DNA, 18 bp, Homo sapiens
tggcctttgcttatgaat

SEQ ID NO: 1732805 - DNA, 19 bp, Homo sapiens
tggcctttttcatttatct

SEQ ID NO: 1732806 - DNA, 20 bp, Homo sapiens
tggcctttttcatttatcta

SEQ ID NO: 1732807 - DNA, 16 bp, Homo sapiens
tggcgcaatctcggct

SEQ ID NO: 1732808 - DNA, 18 bp, Homo sapiens
tggcgcaatctcggctca

SEQ ID NO: 1732809 - DNA, 16 bp, Homo sapiens
tggcgcagccaaggcc

SEQ ID NO: 1732810 - DNA, 19 bp, Homo sapiens
tggcgcaggtgccatgcct

SEQ ID NO: 1732811 - DNA, 14 bp, Homo sapiens
tggcgcaggtgggc

SEQ ID NO: 1732812 - DNA, 21 bp, Homo sapiens
tggcgcaggtgggctggactt

SEQ ID NO: 1732813 - DNA, 21 bp, Homo sapiens
tggcggcacgtccttgggcgt

SEQ ID NO: 1732814 - DNA, 14 bp, Homo sapiens
tggcggcagcagcc

SEQ ID NO: 1732815 - DNA, 15 bp, Homo sapiens
tggcggcagcagcca

SEQ ID NO: 1732816 - DNA, 23 bp, Homo sapiens
tggcggcagcagccatcatagga

SEQ ID NO: 1732817 - DNA, 23 bp, Homo sapiens
tggcggcccttctgactgtttat

SEQ ID NO: 1732818 - DNA, 17 bp, Homo sapiens
tggcggtggaccaaagg

SEQ ID NO: 1732819 - DNA, 19 bp, Homo sapiens
tggcgtctgcctaggagct

SEQ ID NO: 1732820 - DNA, 20 bp, Homo sapiens
tggcgtctgcctaggagctg

SEQ ID NO: 1732821 - DNA, 18 bp, Homo sapiens
tggcgtgggagccagcct

SEQ ID NO: 1732822 - DNA, 18 bp, Homo sapiens
tggcgtgtccctctcgga

SEQ ID NO: 1732823 - DNA, 19 bp, Homo sapiens
tggcgttctcaagaatcta

SEQ ID NO: 1732824 - DNA, 15 bp, Homo sapiens
tggctaataaactgt

SEQ ID NO: 1732825 - DNA, 18 bp, Homo sapiens
tggctaataaactgtatt

SEQ ID NO: 1732826 - DNA, 20 bp, Homo sapiens
tggctacatcccagcctgtg

SEQ ID NO: 1732827 - DNA, 22 bp, Homo sapiens
tggctacatcccagcctgtggt

SEQ ID NO: 1732828 - DNA, 23 bp, Homo sapiens
tggctacgcctcttctgtccctg

SEQ ID NO: 1732829 - DNA, 17 bp, Homo sapiens
tggctacgttttggttc

SEQ ID NO: 1732830 - DNA, 12 bp, Homo sapiens
tggctactgtct

SEQ ID NO: 1732831 - DNA, 16 bp, Homo sapiens
tggctacttcccttcc

SEQ ID NO: 1732832 - DNA, 22 bp, Homo sapiens
tggctactttggtttctgtctg

SEQ ID NO: 1732833 - DNA, 23 bp, Homo sapiens
tggctactttggtttctgtctgt

SEQ ID NO: 1732834 - DNA, 19 bp, Homo sapiens
tggctagaggccagcccca

SEQ ID NO: 1732835 - DNA, 18 bp, Homo sapiens
tggctagagtcctcactc

SEQ ID NO: 1732836 - DNA, 21 bp, Homo sapiens
tggctagagtcctcactccca

SEQ ID NO: 1732837 - DNA, 16 bp, Homo sapiens
tggctagcctttcttg

SEQ ID NO: 1732838 - DNA, 17 bp, Homo sapiens
tggctataagtgctcaa

SEQ ID NO: 1732839 - DNA, 18 bp, Homo sapiens
tggctatacctggggact

SEQ ID NO: 1732840 - DNA, 18 bp, Homo sapiens
tggctattgaagatgctg

SEQ ID NO: 1732841 - DNA, 21 bp, Homo sapiens
tggctattgaagatgctgcct

SEQ ID NO: 1732842 - DNA, 13 bp, Homo sapiens
tggctatttctgt

SEQ ID NO: 1732843 - DNA, 21 bp, Homo sapiens
tggctatttctgtgtccagtt

SEQ ID NO: 1732844 - DNA, 12 bp, Homo sapiens
tggctcacaagg

SEQ ID NO: 1732845 - DNA, 20 bp, Homo sapiens
tggctcacaaggcccaggag

SEQ ID NO: 1732846 - DNA, 22 bp, Homo sapiens
tggctcactgcagcctccgcct

SEQ ID NO: 1732847 - DNA, 14 bp, Homo sapiens
tggctcagctcggg

SEQ ID NO: 1732848 - DNA, 14 bp, Homo sapiens
tggctcaggcaagc

SEQ ID NO: 1732849 - DNA, 19 bp, Homo sapiens
tggctcaggcaagcccctc

SEQ ID NO: 1732850 - DNA, 21 bp, Homo sapiens
tggctcaggcaagcccctcag

SEQ ID NO: 1732851 - DNA, 12 bp, Homo sapiens
tggctcaggcag

SEQ ID NO: 1732852 - DNA, 13 bp, Homo sapiens
tggctcaggcaga

SEQ ID NO: 1732853 - DNA, 14 bp, Homo sapiens
tggctcccacaggc

SEQ ID NO: 1732854 - DNA, 18 bp, Homo sapiens
tggctcccattcactctt

SEQ ID NO: 1732855 - DNA, 14 bp, Homo sapiens
tggctccccaaagg

SEQ ID NO: 1732856 - DNA, 15 bp, Homo sapiens
tggctccccaaaggg

SEQ ID NO: 1732857 - DNA, 20 bp, Homo sapiens
tggctccctcctccaggcct

SEQ ID NO: 1732858 - DNA, 17 bp, Homo sapiens
tggctccctgggcagtg

SEQ ID NO: 1732859 - DNA, 14 bp, Homo sapiens
tggctccggcctct

SEQ ID NO: 1732860 - DNA, 14 bp, Homo sapiens
tggctcctcccggt

SEQ ID NO: 1732861 - DNA, 18 bp, Homo sapiens
tggctcctcccggtgccc

SEQ ID NO: 1732862 - DNA, 19 bp, Homo sapiens
tggctcctcccggtgccca

SEQ ID NO: 1732863 - DNA, 12 bp, Homo sapiens
tggctcctccta

SEQ ID NO: 1732864 - DNA, 14 bp, Homo sapiens
tggctcctcctagg

SEQ ID NO: 1732865 - DNA, 14 bp, Homo sapiens
tggctcctgagggg

SEQ ID NO: 1732866 - DNA, 14 bp, Homo sapiens
tggctcctgggccg

SEQ ID NO: 1732867 - DNA, 19 bp, Homo sapiens
tggctccttcccatcgctg

SEQ ID NO: 1732868 - DNA, 17 bp, Homo sapiens
tggctcggacccacccc

SEQ ID NO: 1732869 - DNA, 20 bp, Homo sapiens
tggctcggacccaccccaac

SEQ ID NO: 1732870 - DNA, 22 bp, Homo sapiens
tggctctaccctgtctgtccct

SEQ ID NO: 1732871 - DNA, 14 bp, Homo sapiens
tggctctcagagga

SEQ ID NO: 1732872 - DNA, 19 bp, Homo sapiens
tggctctgagcgcctccat

SEQ ID NO: 1732873 - DNA, 22 bp, Homo sapiens
tggctctgaggtgcctgtccca

SEQ ID NO: 1732874 - DNA, 16 bp, Homo sapiens
tggctctgccccctcc

SEQ ID NO: 1732875 - DNA, 14 bp, Homo sapiens
tggctgaagaatga

SEQ ID NO: 1732876 - DNA, 16 bp, Homo sapiens
tggctgacccagtccc

SEQ ID NO: 1732877 - DNA, 19 bp, Homo sapiens
tggctgacccagtccctgg

SEQ ID NO: 1732878 - DNA, 13 bp, Homo sapiens
tggctgagacctg

SEQ ID NO: 1732879 - DNA, 17 bp, Homo sapiens
tggctgagatagcagag

SEQ ID NO: 1732880 - DNA, 18 bp, Homo sapiens
tggctgagatagcagagg

SEQ ID NO: 1732881 - DNA, 19 bp, Homo sapiens
tggctgagatatgaacata

SEQ ID NO: 1732882 - DNA, 15 bp, Homo sapiens
tggctgagcccctgg

SEQ ID NO: 1732883 - DNA, 16 bp, Homo sapiens
tggctgagcccctggg

SEQ ID NO: 1732884 - DNA, 16 bp, Homo sapiens
tggctgagcctggctg

SEQ ID NO: 1732885 - DNA, 19 bp, Homo sapiens
tggctgagcctggctggca

SEQ ID NO: 1732886 - DNA, 17 bp, Homo sapiens
tggctgaggttcctctg

SEQ ID NO: 1732887 - DNA, 22 bp, Homo sapiens
tggctgaggttcctctgcctgc

SEQ ID NO: 1732888 - DNA, 24 bp, Homo sapiens
tggctgaggttcctctgcctgccc

SEQ ID NO: 1732889 - DNA, 22 bp, Homo sapiens
tggctgagtggaatgcagggaa

SEQ ID NO: 1732890 - DNA, 16 bp, Homo sapiens
tggctgatctatgcct

SEQ ID NO: 1732891 - DNA, 21 bp, Homo sapiens
tggctgatgatccagaacagt

SEQ ID NO: 1732892 - DNA, 23 bp, Homo sapiens
tggctgcaaataaggacagcagc

SEQ ID NO: 1732893 - DNA, 13 bp, Homo sapiens
tggctgcactctt

SEQ ID NO: 1732894 - DNA, 10 bp, Homo sapiens
tggctgcagg

SEQ ID NO: 1732895 - DNA, 19 bp, Homo sapiens
tggctgcaggaagaaactt

SEQ ID NO: 1732896 - DNA, 11 bp, Homo sapiens
tggctgcaggt

SEQ ID NO: 1732897 - DNA, 14 bp, Homo sapiens
tggctgcaggtgtt

SEQ ID NO: 1732898 - DNA, 22 bp, Homo sapiens
tggctgcaggtgttctgctgat

SEQ ID NO: 1732899 - DNA, 20 bp, Homo sapiens
tggctgcccagacccctctg

SEQ ID NO: 1732900 - DNA, 13 bp, Homo sapiens
tggctgccccggc

SEQ ID NO: 1732901 - DNA, 18 bp, Homo sapiens
tggctgccccggcctcct

SEQ ID NO: 1732902 - DNA, 13 bp, Homo sapiens
tggctgccctggc

SEQ ID NO: 1732903 - DNA, 17 bp, Homo sapiens
tggctgccttctttcca

SEQ ID NO: 1732904 - DNA, 17 bp, Homo sapiens
tggctgctagattttaa

SEQ ID NO: 1732905 - DNA, 13 bp, Homo sapiens
tggctgctagcac

SEQ ID NO: 1732906 - DNA, 14 bp, Homo sapiens
tggctgctagcact

SEQ ID NO: 1732907 - DNA, 21 bp, Homo sapiens
tggctgctccccacccgcctc

SEQ ID NO: 1732908 - DNA, 14 bp, Homo sapiens
tggctgctgactga

SEQ ID NO: 1732909 - DNA, 15 bp, Homo sapiens
tggctgctgccccca

SEQ ID NO: 1732910 - DNA, 14 bp, Homo sapiens
tggctgctgcctgc

SEQ ID NO: 1732911 - DNA, 19 bp, Homo sapiens
tggctgctgcggctgtggg

SEQ ID NO: 1732912 - DNA, 13 bp, Homo sapiens
tggagctgactgt

SEQ ID NO: 1732913 - DNA, 18 bp, Homo sapiens
tggagctgagatgagccc

SEQ ID NO: 1732914 - DNA, 20 bp, Homo sapiens
tggagctgagatgagcccca

SEQ ID NO: 1732915 - DNA, 20 bp, Homo sapiens
tggagctgccgtgcctgtgt

SEQ ID NO: 1732916 - DNA, 14 bp, Homo sapiens
tggagctttctgta

SEQ ID NO: 1732917 - DNA, 15 bp, Homo sapiens
tggagctttctgtat

SEQ ID NO: 1732918 - DNA, 16 bp, Homo sapiens
tggagctttggaatat

SEQ ID NO: 1732919 - DNA, 20 bp, Homo sapiens
tggagcttttaaaaatgttt

SEQ ID NO: 1732920 - DNA, 16 bp, Homo sapiens
tggagctttttcaaaa

SEQ ID NO: 1732921 - DNA, 16 bp, Homo sapiens
tggaggaaaaaggtca

SEQ ID NO: 1732922 - DNA, 21 bp, Homo sapiens
tggaggaaaaccaagccgtgg

SEQ ID NO: 1732923 - DNA, 23 bp, Homo sapiens
tggaggaaaaccaagccgtggct

SEQ ID NO: 1732924 - DNA, 19 bp, Homo sapiens
tggaggaacacttgatgga

SEQ ID NO: 1732925 - DNA, 20 bp, Homo sapiens
tggaggaagagccacctgca

SEQ ID NO: 1732926 - DNA, 23 bp, Homo sapiens
tggaggaagagccacctgcaaga

SEQ ID NO: 1732927 - DNA, 11 bp, Homo sapiens
tggaggagaga

SEQ ID NO: 1732928 - DNA, 13 bp, Homo sapiens
tggaggagagaga

SEQ ID NO: 1732929 - DNA, 16 bp, Homo sapiens
tggaggagcagcttcc

SEQ ID NO: 1732930 - DNA, 20 bp, Homo sapiens
tggaggagcagcttccttct

SEQ ID NO: 1732931 - DNA, 17 bp, Homo sapiens
tggaggagctggcctgt

SEQ ID NO: 1732932 - DNA, 22 bp, Homo sapiens
tggaggagcttgggggatgact

SEQ ID NO: 1732933 - DNA, 21 bp, Homo sapiens
tggaggaggaaggcaagaggg

SEQ ID NO: 1732934 - DNA, 14 bp, Homo sapiens
tggaggaggaggag

SEQ ID NO: 1732935 - DNA, 21 bp, Homo sapiens
tggaggaggaggaggagcctt

SEQ ID NO: 1732936 - DNA, 21 bp, Homo sapiens
tggaggaggagggaggcgctg

SEQ ID NO: 1732937 - DNA, 19 bp, Homo sapiens
tggaggattctttccccag

SEQ ID NO: 1732938 - DNA, 18 bp, Homo sapiens
tggaggcacgcaccactg

SEQ ID NO: 1732939 - DNA, 16 bp, Homo sapiens
tggaggcagatgtggg

SEQ ID NO: 1732940 - DNA, 17 bp, Homo sapiens
tggaggcagccagggct

SEQ ID NO: 1732941 - DNA, 14 bp, Homo sapiens
tggaggcagggcct

SEQ ID NO: 1732942 - DNA, 21 bp, Homo sapiens
tggaggcaggggacaagggag

SEQ ID NO: 1732943 - DNA, 13 bp, Homo sapiens
tggaggcattgtt

SEQ ID NO: 1732944 - DNA, 23 bp, Homo sapiens
tggaggccaccgggacagacctg

SEQ ID NO: 1732945 - DNA, 21 bp, Homo sapiens
tggaggccatcgggctcccag

SEQ ID NO: 1732946 - DNA, 12 bp, Homo sapiens
tggaggcccagt

SEQ ID NO: 1732947 - DNA, 18 bp, Homo sapiens
tggaggccccaaccctgt

SEQ ID NO: 1732948 - DNA, 17 bp, Homo sapiens
tggaggcccctgggctc

SEQ ID NO: 1732949 - DNA, 19 bp, Homo sapiens
tggaggccgaggaccacca

SEQ ID NO: 1732950 - DNA, 24 bp, Homo sapiens
tggaggcctcaggtgctgtccatg

SEQ ID NO: 1732951 - DNA, 15 bp, Homo sapiens
tggaggcctgatgct

SEQ ID NO: 1732952 - DNA, 19 bp, Homo sapiens
tggaggccttccagctgct

SEQ ID NO: 1732953 - DNA, 20 bp, Homo sapiens
tggaggccttccagctgctg

SEQ ID NO: 1732954 - DNA, 17 bp, Homo sapiens
tggaggcgggcttggaa

SEQ ID NO: 1732955 - DNA, 14 bp, Homo sapiens
tggaggctgcagcg

SEQ ID NO: 1732956 - DNA, 14 bp, Homo sapiens
tggaggctgctgtg

SEQ ID NO: 1732957 - DNA, 20 bp, Homo sapiens
tggaggcttcctgcgtcctc

SEQ ID NO: 1732958 - DNA, 17 bp, Homo sapiens
tggaggcttttcactgc

SEQ ID NO: 1732959 - DNA, 20 bp, Homo sapiens
tggagggaaacaccaaactc

SEQ ID NO: 1732960 - DNA, 20 bp, Homo sapiens
tggagggaagggagaaagta

SEQ ID NO: 1732961 - DNA, 13 bp, Homo sapiens
tggagggaggctg

SEQ ID NO: 1732962 - DNA, 22 bp, Homo sapiens
tggagggcaacattccacagct

SEQ ID NO: 1732963 - DNA, 19 bp, Homo sapiens
tggaggggtggtcctgact

SEQ ID NO: 1732964 - DNA, 14 bp, Homo sapiens
tggaggggtgtggc

SEQ ID NO: 1732965 - DNA, 21 bp, Homo sapiens
tggagggtgggttggggaggg

SEQ ID NO: 1732966 - DNA, 13 bp, Homo sapiens
tggagggttgcca

SEQ ID NO: 1732967 - DNA, 17 bp, Homo sapiens
tggaggtctccaggggc

SEQ ID NO: 1732968 - DNA, 16 bp, Homo sapiens
tggaggtctggctgag

SEQ ID NO: 1732969 - DNA, 17 bp, Homo sapiens
tggaggtctggctgagc

SEQ ID NO: 1732970 - DNA, 14 bp, Homo sapiens
tggaggtggggaag

SEQ ID NO: 1732971 - DNA, 17 bp, Homo sapiens
tggaggtggggaaggct

SEQ ID NO: 1732972 - DNA, 15 bp, Homo sapiens
tggaggtggggttgg

SEQ ID NO: 1732973 - DNA, 14 bp, Homo sapiens
tggaggtgtgggcc

SEQ ID NO: 1732974 - DNA, 16 bp, Homo sapiens
tggaggttaaggcata

SEQ ID NO: 1732975 - DNA, 17 bp, Homo sapiens
tggaggttgaagccaag

SEQ ID NO: 1732976 - DNA, 18 bp, Homo sapiens
tggaggttgaagccaagt

SEQ ID NO: 1732977 - DNA, 18 bp, Homo sapiens
tggagtactatatttaca

SEQ ID NO: 1732978 - DNA, 13 bp, Homo sapiens
tggagtagaatgt

SEQ ID NO: 1732979 - DNA, 14 bp, Homo sapiens
tggagtatatgtca

SEQ ID NO: 1732980 - DNA, 23 bp, Homo sapiens
tggagtcacatcagtgaggaggg

SEQ ID NO: 1732981 - DNA, 14 bp, Homo sapiens
tggagtcaggcttc

SEQ ID NO: 1732982 - DNA, 22 bp, Homo sapiens
tggagtcagtaggtccaagggc

SEQ ID NO: 1732983 - DNA, 22 bp, Homo sapiens
tggagtcatggtccggtgtcct

SEQ ID NO: 1732984 - DNA, 17 bp, Homo sapiens
tggagtcccaggggcag

SEQ ID NO: 1732985 - DNA, 18 bp, Homo sapiens
tggagtcccaggggcagc

SEQ ID NO: 1732986 - DNA, 16 bp, Homo sapiens
tggagtctgagtctga

SEQ ID NO: 1732987 - DNA, 21 bp, Homo sapiens
tggagtctgagtctgagtcct

SEQ ID NO: 1732988 - DNA, 19 bp, Homo sapiens
tggagtgaggcttccaggc

SEQ ID NO: 1732989 - DNA, 20 bp, Homo sapiens
tggagtgaggcttccaggct

SEQ ID NO: 1732990 - DNA, 22 bp, Homo sapiens
tggagtgaggcttccaggctct

SEQ ID NO: 1732991 - DNA, 23 bp, Homo sapiens
tggagtgagtcacctgctccaga

SEQ ID NO: 1732992 - DNA, 17 bp, Homo sapiens
tggagtgcagggaggag

SEQ ID NO: 1732993 - DNA, 12 bp, Homo sapiens
tggagtgcgctc

SEQ ID NO: 1732994 - DNA, 17 bp, Homo sapiens
tggagtggaggcattgt

SEQ ID NO: 1732995 - DNA, 19 bp, Homo sapiens
tggagtggaggcattgttt

SEQ ID NO: 1732996 - DNA, 14 bp, Homo sapiens
tggagtgtatgact

SEQ ID NO: 1732997 - DNA, 19 bp, Homo sapiens
tggagtgtcggatcctgtg

SEQ ID NO: 1732998 - DNA, 18 bp, Homo sapiens
tggagttacattaatgtt

SEQ ID NO: 1732999 - DNA, 17 bp, Homo sapiens
tggagttcaccttggaa

SEQ ID NO: 1733000 - DNA, 16 bp, Homo sapiens
tggagttcctgctccg

SEQ ID NO: 1733001 - DNA, 13 bp, Homo sapiens
tggagttccttat

SEQ ID NO: 1733002 - DNA, 19 bp, Homo sapiens
tggagttcttagctatcct

SEQ ID NO: 1733003 - DNA, 14 bp, Homo sapiens
tggagttcttgtgc

SEQ ID NO: 1733004 - DNA, 22 bp, Homo sapiens
tggagttgaaagagttaagaat

SEQ ID NO: 1733005 - DNA, 19 bp, Homo sapiens
tggagttgatctggaaccc

SEQ ID NO: 1733006 - DNA, 14 bp, Homo sapiens
tggagtttctaagg

SEQ ID NO: 1733007 - DNA, 17 bp, Homo sapiens
tggagtttctaaggtcc

SEQ ID NO: 1733008 - DNA, 14 bp, Homo sapiens
tggagtttgtattt

SEQ ID NO: 1733009 - DNA, 15 bp, Homo sapiens
tggataaactgagcc

SEQ ID NO: 1733010 - DNA, 15 bp, Homo sapiens
tggataactagccag

SEQ ID NO: 1733011 - DNA, 18 bp, Homo sapiens
tggataatgctgttgcct

SEQ ID NO: 1733012 - DNA, 15 bp, Homo sapiens
tggatagacttggga

SEQ ID NO: 1733013 - DNA, 15 bp, Homo sapiens
tggatataaaatgtg

SEQ ID NO: 1733014 - DNA, 22 bp, Homo sapiens
tggatatatttgaaatagtata

SEQ ID NO: 1733015 - DNA, 15 bp, Homo sapiens
tggatatgacccaca

SEQ ID NO: 1733016 - DNA, 19 bp, Homo sapiens
tggatatgacccacactgc

SEQ ID NO: 1733017 - DNA, 19 bp, Homo sapiens
tggatatgttgttaaacac

SEQ ID NO: 1733018 - DNA, 17 bp, Homo sapiens
tggatattattagaaat

SEQ ID NO: 1733019 - DNA, 13 bp, Homo sapiens
tggatatttcaat

SEQ ID NO: 1733020 - DNA, 22 bp, Homo sapiens
tggatatttcaatcttttaaat

SEQ ID NO: 1733021 - DNA, 11 bp, Homo sapiens
tggatatttgt

SEQ ID NO: 1733022 - DNA, 13 bp, Homo sapiens
tggatatttgtat

SEQ ID NO: 1733023 - DNA, 15 bp, Homo sapiens
tggatcacaaagtgg

SEQ ID NO: 1733024 - DNA, 16 bp, Homo sapiens
tggatcacaagatgga

SEQ ID NO: 1733025 - DNA, 21 bp, Homo sapiens
tggatcacacctcagtgggaa

SEQ ID NO: 1733026 - DNA, 23 bp, Homo sapiens
tggatcacagaggcttcttcaga

SEQ ID NO: 1733027 - DNA, 23 bp, Homo sapiens
tggatcacctgaggtcaggagtt

SEQ ID NO: 1733028 - DNA, 14 bp, Homo sapiens
tggatccagcactg

SEQ ID NO: 1733029 - DNA, 23 bp, Homo sapiens
tggatccatggggggagaagtga

SEQ ID NO: 1733030 - DNA, 19 bp, Homo sapiens
tggatccctgcccttctca

SEQ ID NO: 1733031 - DNA, 20 bp, Homo sapiens
tggatccctgcccttctcaa

SEQ ID NO: 1733032 - DNA, 14 bp, Homo sapiens
tggatcctgggctg

SEQ ID NO: 1733033 - DNA, 19 bp, Homo sapiens
tggatcctgggctgggtgg

SEQ ID NO: 1733034 - DNA, 17 bp, Homo sapiens
tggatcctgtgtggaga

SEQ ID NO: 1733035 - DNA, 23 bp, Homo sapiens
tggatcgagtgtagctgtgaaat

SEQ ID NO: 1733036 - DNA, 19 bp, Homo sapiens
tggatcgctaagctggctc

SEQ ID NO: 1733037 - DNA, 14 bp, Homo sapiens
tggatctagaaggg

SEQ ID NO: 1733038 - DNA, 16 bp, Homo sapiens
tggatctatattttca

SEQ ID NO: 1733039 - DNA, 20 bp, Homo sapiens
tggatctatcacctgtcatc

SEQ ID NO: 1733040 - DNA, 21 bp, Homo sapiens
tggatctatcacctgtcatca

SEQ ID NO: 1733041 - DNA, 18 bp, Homo sapiens
tggatctatttcatgttt

SEQ ID NO: 1733042 - DNA, 15 bp, Homo sapiens
tggatctccttccct

SEQ ID NO: 1733043 - DNA, 21 bp, Homo sapiens
tggatctccttcccttctctt

SEQ ID NO: 1733044 - DNA, 19 bp, Homo sapiens
tggatctgatctgtaccat

SEQ ID NO: 1733045 - DNA, 23 bp, Homo sapiens
tggatctgggaccctttccttcc

SEQ ID NO: 1733046 - DNA, 12 bp, Homo sapiens
tggatcttttct

SEQ ID NO: 1733047 - DNA, 14 bp, Homo sapiens
tggatgaaaaaagc

SEQ ID NO: 1733048 - DNA, 13 bp, Homo sapiens
tggatgaaggcaa

SEQ ID NO: 1733049 - DNA, 19 bp, Homo sapiens
tggatgacagggcagagca

SEQ ID NO: 1733050 - DNA, 14 bp, Homo sapiens
tggatgatgtttcg

SEQ ID NO: 1733051 - DNA, 17 bp, Homo sapiens
tggatgatttcatcttc

SEQ ID NO: 1733052 - DNA, 15 bp, Homo sapiens
tggatgcccagagga

SEQ ID NO: 1733053 - DNA, 17 bp, Homo sapiens
tggatgctccagggcag

SEQ ID NO: 1733054 - DNA, 12 bp, Homo sapiens
tggatggcaccc

SEQ ID NO: 1733055 - DNA, 14 bp, Homo sapiens
tggatggcaccctg

SEQ ID NO: 1733056 - DNA, 17 bp, Homo sapiens
tggatggcaccctggaa

SEQ ID NO: 1733057 - DNA, 17 bp, Homo sapiens
tggatggccccagcaca

SEQ ID NO: 1733058 - DNA, 21 bp, Homo sapiens
tggatggccccagcacagctt

SEQ ID NO: 1733059 - DNA, 18 bp, Homo sapiens
tggatgggcattgggctg

SEQ ID NO: 1733060 - DNA, 19 bp, Homo sapiens
tggatgggcattgggctga

SEQ ID NO: 1733061 - DNA, 23 bp, Homo sapiens
tggatgggcattgggctgacacc

SEQ ID NO: 1733062 - DNA, 23 bp, Homo sapiens
tggatgggggaactcagatccag

SEQ ID NO: 1733063 - DNA, 18 bp, Homo sapiens
tggatgggggtgcaggca

SEQ ID NO: 1733064 - DNA, 20 bp, Homo sapiens
tggatgggggtgcaggcagc

SEQ ID NO: 1733065 - DNA, 17 bp, Homo sapiens
tggatgggtggatggcc

SEQ ID NO: 1733066 - DNA, 18 bp, Homo sapiens
tggatggtcattgcagtt

SEQ ID NO: 1733067 - DNA, 12 bp, Homo sapiens
tggatggtttgt

SEQ ID NO: 1733068 - DNA, 15 bp, Homo sapiens
tggatgtaaatcctg

SEQ ID NO: 1733069 - DNA, 17 bp, Homo sapiens
tggatgttatgaacagc

SEQ ID NO: 1733070 - DNA, 18 bp, Homo sapiens
tggatgttatgaacagct

SEQ ID NO: 1733071 - DNA, 21 bp, Homo sapiens
tggatgttatgaacagctgtg

SEQ ID NO: 1733072 - DNA, 15 bp, Homo sapiens
tggatgttgtgtgta

SEQ ID NO: 1733073 - DNA, 21 bp, Homo sapiens
tggattataaaaaatgtaaca

SEQ ID NO: 1733074 - DNA, 22 bp, Homo sapiens
tggattataaaaaatgtaacat

SEQ ID NO: 1733075 - DNA, 13 bp, Homo sapiens
tggattattcatt

SEQ ID NO: 1733076 - DNA, 14 bp, Homo sapiens
tggattattcattt

SEQ ID NO: 1733077 - DNA, 16 bp, Homo sapiens
tggattattcatttaa

SEQ ID NO: 1733078 - DNA, 18 bp, Homo sapiens
tggattattcatttaaaa

SEQ ID NO: 1733079 - DNA, 22 bp, Homo sapiens
tggattattctttctccttttt

SEQ ID NO: 1733080 - DNA, 14 bp, Homo sapiens
tggattcattgtct

SEQ ID NO: 1733081 - DNA, 16 bp, Homo sapiens
tggattcattgtctct

SEQ ID NO: 1733082 - DNA, 13 bp, Homo sapiens
tggattcatttcc

SEQ ID NO: 1733083 - DNA, 19 bp, Homo sapiens
tggattcatttcctgccct

SEQ ID NO: 1733084 - DNA, 20 bp, Homo sapiens
tggattcatttcctgccctt

SEQ ID NO: 1733085 - DNA, 15 bp, Homo sapiens
tggattctaaataca

SEQ ID NO: 1733086 - DNA, 22 bp, Homo sapiens
tggattctcttagctactgtat

SEQ ID NO: 1733087 - DNA, 13 bp, Homo sapiens
tggattctggatg

SEQ ID NO: 1733088 - DNA, 17 bp, Homo sapiens
tggattcttatgtagca

SEQ ID NO: 1733089 - DNA, 20 bp, Homo sapiens
tggattggaatgcagaggtc

SEQ ID NO: 1733090 - DNA, 15 bp, Homo sapiens
tggatttcctaatac

SEQ ID NO: 1733091 - DNA, 20 bp, Homo sapiens
tggatttccttctaacatgt

SEQ ID NO: 1733092 - DNA, 19 bp, Homo sapiens
tggatttgaagtttgccaa

SEQ ID NO: 1733093 - DNA, 24 bp, Homo sapiens
tggatttgatgagttaactgtgaa

SEQ ID NO: 1733094 - DNA, 17 bp, Homo sapiens
tggatttgattcatttt

SEQ ID NO: 1733095 - DNA, 21 bp, Homo sapiens
tggatttggagagaaatattt

SEQ ID NO: 1733096 - DNA, 14 bp, Homo sapiens
tggatttgtacttg

SEQ ID NO: 1733097 - DNA, 15 bp, Homo sapiens
tggatttgtttaaaa

SEQ ID NO: 1733098 - DNA, 17 bp, Homo sapiens
tggatttgtttaaaagg

SEQ ID NO: 1733099 - DNA, 21 bp, Homo sapiens
tggattttctttctatgtaga

SEQ ID NO: 1733100 - DNA, 15 bp, Homo sapiens
tggatttttaaatta

SEQ ID NO: 1733101 - DNA, 15 bp, Homo sapiens
tggatttttctttaa

SEQ ID NO: 1733102 - DNA, 15 bp, Homo sapiens
tggatttttttttct

SEQ ID NO: 1733103 - DNA, 18 bp, Homo sapiens
tggcaaaaaggagccttt

SEQ ID NO: 1733104 - DNA, 22 bp, Homo sapiens
tggcaaaaaggagccttttgct

SEQ ID NO: 1733105 - DNA, 20 bp, Homo sapiens
tggcaaaacactatgtatag

SEQ ID NO: 1733106 - DNA, 17 bp, Homo sapiens
tggcaaaccctcccaga

SEQ ID NO: 1733107 - DNA, 17 bp, Homo sapiens
tggcaaaggaaggtgga

SEQ ID NO: 1733108 - DNA, 22 bp, Homo sapiens
tggcaaagggagcagaactgaa

SEQ ID NO: 1733109 - DNA, 18 bp, Homo sapiens
tggcaaattttaaaacat

SEQ ID NO: 1733110 - DNA, 16 bp, Homo sapiens
tggcaacagatctgga

SEQ ID NO: 1733111 - DNA, 16 bp, Homo sapiens
tggcaacattcattgc

SEQ ID NO: 1733112 - DNA, 15 bp, Homo sapiens
tggcaaccagccagc

SEQ ID NO: 1733113 - DNA, 16 bp, Homo sapiens
tggcaaccagccagcg

SEQ ID NO: 1733114 - DNA, 21 bp, Homo sapiens
tggcaagcagggaaagctcca

SEQ ID NO: 1733115 - DNA, 23 bp, Homo sapiens
tggcaagcagggaaagctccacg

SEQ ID NO: 1733116 - DNA, 13 bp, Homo sapiens
tggcaaggacttt

SEQ ID NO: 1733117 - DNA, 16 bp, Homo sapiens
tggcaatataatcttt

SEQ ID NO: 1733118 - DNA, 13 bp, Homo sapiens
tggcaatatagaa

SEQ ID NO: 1733119 - DNA, 19 bp, Homo sapiens
tggcaatattctgtaacta

SEQ ID NO: 1733120 - DNA, 19 bp, Homo sapiens
tggcaatgctaattcaatg

SEQ ID NO: 1733121 - DNA, 20 bp, Homo sapiens
tggcaatgggatttgggcta

SEQ ID NO: 1733122 - DNA, 16 bp, Homo sapiens
tggcaattaagtggtc

SEQ ID NO: 1733123 - DNA, 23 bp, Homo sapiens
tggcaattcctcttcattgtcta

SEQ ID NO: 1733124 - DNA, 16 bp, Homo sapiens
tggcaattgtccccag

SEQ ID NO: 1733125 - DNA, 14 bp, Homo sapiens
tggcaattgtctat

SEQ ID NO: 1733126 - DNA, 15 bp, Homo sapiens
tggcaatttcctggc

SEQ ID NO: 1733127 - DNA, 22 bp, Homo sapiens
tggcaatttcctggccctccac

SEQ ID NO: 1733128 - DNA, 14 bp, Homo sapiens
tggcaattttgtaa

SEQ ID NO: 1733129 - DNA, 13 bp, Homo sapiens
tggcacacagcag

SEQ ID NO: 1733130 - DNA, 13 bp, Homo sapiens
tggcacactccct

SEQ ID NO: 1733131 - DNA, 20 bp, Homo sapiens
tggcacactccctctccttg

SEQ ID NO: 1733132 - DNA, 22 bp, Homo sapiens
tggcacagacttctggaaggct

SEQ ID NO: 1733133 - DNA, 22 bp, Homo sapiens
tggcacagccctgagtgtccca

SEQ ID NO: 1733134 - DNA, 16 bp, Homo sapiens
tggcacagggcagtgg

SEQ ID NO: 1733135 - DNA, 20 bp, Homo sapiens
tggcacagttttctgagaaa

SEQ ID NO: 1733136 - DNA, 13 bp, Homo sapiens
tggcaccactctc

SEQ ID NO: 1733137 - DNA, 18 bp, Homo sapiens
tggcaccactgcactcca

SEQ ID NO: 1733138 - DNA, 17 bp, Homo sapiens
tggcaccagacacccag

SEQ ID NO: 1733139 - DNA, 23 bp, Homo sapiens
tggcaccagacacccaggactta

SEQ ID NO: 1733140 - DNA, 12 bp, Homo sapiens
tggcaccagccc

SEQ ID NO: 1733141 - DNA, 15 bp, Homo sapiens
tggcaccagccccct

SEQ ID NO: 1733142 - DNA, 19 bp, Homo sapiens
tggcaccagccccctggat

SEQ ID NO: 1733143 - DNA, 16 bp, Homo sapiens
tgctgaggccagggct

SEQ ID NO: 1733144 - DNA, 15 bp, Homo sapiens
tgctgaggcccagtg

SEQ ID NO: 1733145 - DNA, 16 bp, Homo sapiens
tgctgaggcccagtgc

SEQ ID NO: 1733146 - DNA, 18 bp, Homo sapiens
tgctgaggcccagtgcat

SEQ ID NO: 1733147 - DNA, 17 bp, Homo sapiens
tgctgaggcctccagct

SEQ ID NO: 1733148 - DNA, 14 bp, Homo sapiens
tgctgaggcctggg

SEQ ID NO: 1733149 - DNA, 16 bp, Homo sapiens
tgctgaggcctgggcc

SEQ ID NO: 1733150 - DNA, 17 bp, Homo sapiens
tgctgaggcctgggccg

SEQ ID NO: 1733151 - DNA, 14 bp, Homo sapiens
tgctgagggaccag

SEQ ID NO: 1733152 - DNA, 16 bp, Homo sapiens
tgctgagggaccagcc

SEQ ID NO: 1733153 - DNA, 20 bp, Homo sapiens
tgctgagggaccagccaaga

SEQ ID NO: 1733154 - DNA, 12 bp, Homo sapiens
tgctgagggtgt

SEQ ID NO: 1733155 - DNA, 22 bp, Homo sapiens
tgctgagggtgtttcttcctgc

SEQ ID NO: 1733156 - DNA, 21 bp, Homo sapiens
tgctgagtatgttaagctctt

SEQ ID NO: 1733157 - DNA, 16 bp, Homo sapiens
tgctgagtgacagctt

SEQ ID NO: 1733158 - DNA, 15 bp, Homo sapiens
tgctgagttggcctg

SEQ ID NO: 1733159 - DNA, 18 bp, Homo sapiens
tgctgatccctgctctct

SEQ ID NO: 1733160 - DNA, 19 bp, Homo sapiens
tgctgatcttttaaaatca

SEQ ID NO: 1733161 - DNA, 20 bp, Homo sapiens
tgctgatcttttaaaatcat

SEQ ID NO: 1733162 - DNA, 21 bp, Homo sapiens
tgctgatgaactcttaatcaa

SEQ ID NO: 1733163 - DNA, 14 bp, Homo sapiens
tgctgatggcccct

SEQ ID NO: 1733164 - DNA, 22 bp, Homo sapiens
tgctgatggcccctccagcaca

SEQ ID NO: 1733165 - DNA, 14 bp, Homo sapiens
tgctgatgtcaaag

SEQ ID NO: 1733166 - DNA, 12 bp, Homo sapiens
tgctgattattt

SEQ ID NO: 1733167 - DNA, 14 bp, Homo sapiens
tgctgattcttgta

SEQ ID NO: 1733168 - DNA, 20 bp, Homo sapiens
tgctgattcttgtaaatctt

SEQ ID NO: 1733169 - DNA, 19 bp, Homo sapiens
tgctgatttcccctcttcc

SEQ ID NO: 1733170 - DNA, 22 bp, Homo sapiens
tgctgcaaggtggcctctgcct

SEQ ID NO: 1733171 - DNA, 23 bp, Homo sapiens
tgctgcaaggtggcctctgcctg

SEQ ID NO: 1733172 - DNA, 16 bp, Homo sapiens
tgctgcacaggccctg

SEQ ID NO: 1733173 - DNA, 17 bp, Homo sapiens
tgctgcacaggccctgg

SEQ ID NO: 1733174 - DNA, 17 bp, Homo sapiens
tgctgcaccccatgtgg

SEQ ID NO: 1733175 - DNA, 21 bp, Homo sapiens
tgctgcaccctgcgcctccag

SEQ ID NO: 1733176 - DNA, 17 bp, Homo sapiens
tgctgcaccttgtaaat

SEQ ID NO: 1733177 - DNA, 17 bp, Homo sapiens
tgctgcacttcctgttt

SEQ ID NO: 1733178 - DNA, 12 bp, Homo sapiens
tgctgcagagat

SEQ ID NO: 1733179 - DNA, 13 bp, Homo sapiens
tgctgcagagatc

SEQ ID NO: 1733180 - DNA, 23 bp, Homo sapiens
tgctgcagcaccgaggggccttt

SEQ ID NO: 1733181 - DNA, 17 bp, Homo sapiens
tgctgcagccctgccag

SEQ ID NO: 1733182 - DNA, 20 bp, Homo sapiens
tgctgcagcttctaactggt

SEQ ID NO: 1733183 - DNA, 16 bp, Homo sapiens
tgctgcagggctttaa

SEQ ID NO: 1733184 - DNA, 15 bp, Homo sapiens
tgctgcatagctcta

SEQ ID NO: 1733185 - DNA, 16 bp, Homo sapiens
tgctgcatatttgtgc

SEQ ID NO: 1733186 - DNA, 12 bp, Homo sapiens
tgctgcatccct

SEQ ID NO: 1733187 - DNA, 19 bp, Homo sapiens
tgctgcatccctgtgtcca

SEQ ID NO: 1733188 - DNA, 23 bp, Homo sapiens
tgctgcattttaattttaaccaa

SEQ ID NO: 1733189 - DNA, 19 bp, Homo sapiens
tgctgccaaggtggaggga

SEQ ID NO: 1733190 - DNA, 23 bp, Homo sapiens
tgctgccaaggtggagggaagga

SEQ ID NO: 1733191 - DNA, 22 bp, Homo sapiens
tgctgccaccacttttggattt

SEQ ID NO: 1733192 - DNA, 14 bp, Homo sapiens
tgctgccacttttt

SEQ ID NO: 1733193 - DNA, 13 bp, Homo sapiens
tgctgccaggcac

SEQ ID NO: 1733194 - DNA, 13 bp, Homo sapiens
tgctgccatgcca

SEQ ID NO: 1733195 - DNA, 15 bp, Homo sapiens
tgctgccatgccact

SEQ ID NO: 1733196 - DNA, 16 bp, Homo sapiens
tgctgccatgccactg

SEQ ID NO: 1733197 - DNA, 18 bp, Homo sapiens
tgctgccatgccactgcc

SEQ ID NO: 1733198 - DNA, 23 bp, Homo sapiens
tgctgccatgccactgccaggca

SEQ ID NO: 1733199 - DNA, 12 bp, Homo sapiens
tgctgcccaggc

SEQ ID NO: 1733200 - DNA, 23 bp, Homo sapiens
tgctgcccatgagcaagcctagg

SEQ ID NO: 1733201 - DNA, 21 bp, Homo sapiens
tgctgccccgcttccccacag

SEQ ID NO: 1733202 - DNA, 23 bp, Homo sapiens
tgctgccccgcttccccacagaa

SEQ ID NO: 1733203 - DNA, 14 bp, Homo sapiens
tgctgcccctgcag

SEQ ID NO: 1733204 - DNA, 12 bp, Homo sapiens
tgctgccctccc

SEQ ID NO: 1733205 - DNA, 17 bp, Homo sapiens
tgctgccctcccacagc

SEQ ID NO: 1733206 - DNA, 14 bp, Homo sapiens
tgctgccctcttaa

SEQ ID NO: 1733207 - DNA, 16 bp, Homo sapiens
tgctgccctcttaaga

SEQ ID NO: 1733208 - DNA, 18 bp, Homo sapiens
tgctgccctgatgcgtct

SEQ ID NO: 1733209 - DNA, 16 bp, Homo sapiens
tgctgccggctctggg

SEQ ID NO: 1733210 - DNA, 15 bp, Homo sapiens
tgctgcctccctggg

SEQ ID NO: 1733211 - DNA, 16 bp, Homo sapiens
tgctgcctgcctgtct

SEQ ID NO: 1733212 - DNA, 23 bp, Homo sapiens
tgctgcgcgtgtgggtctctggg

SEQ ID NO: 1733213 - DNA, 19 bp, Homo sapiens
tgctgcggaggagctgcct

SEQ ID NO: 1733214 - DNA, 15 bp, Homo sapiens
tgctgcggctgtggg

SEQ ID NO: 1733215 - DNA, 14 bp, Homo sapiens
tgctgcgtccccac

SEQ ID NO: 1733216 - DNA, 23 bp, Homo sapiens
tgcttgggaatgaaattaacaca

SEQ ID NO: 1733217 - DNA, 15 bp, Homo sapiens
tgcttggggctattt

SEQ ID NO: 1733218 - DNA, 17 bp, Homo sapiens
tgcttggggctatttgt

SEQ ID NO: 1733219 - DNA, 13 bp, Homo sapiens
tgcttggtctgtt

SEQ ID NO: 1733220 - DNA, 22 bp, Homo sapiens
tgcttggtggggctcgtggcct

SEQ ID NO: 1733221 - DNA, 18 bp, Homo sapiens
tgcttggttggctggcag

SEQ ID NO: 1733222 - DNA, 17 bp, Homo sapiens
tgcttgtcctgctctct

SEQ ID NO: 1733223 - DNA, 18 bp, Homo sapiens
tgcttgtcctgctctctt

SEQ ID NO: 1733224 - DNA, 20 bp, Homo sapiens
tgcttgtcctgctctcttca

SEQ ID NO: 1733225 - DNA, 22 bp, Homo sapiens
tgcttgtcttctggtactttct

SEQ ID NO: 1733226 - DNA, 16 bp, Homo sapiens
tgcttgtgaaaatgtg

SEQ ID NO: 1733227 - DNA, 20 bp, Homo sapiens
tgcttgtgaaaatgtgttct

SEQ ID NO: 1733228 - DNA, 16 bp, Homo sapiens
tgcttgtgacattaaa

SEQ ID NO: 1733229 - DNA, 12 bp, Homo sapiens
tgcttgtgggcc

SEQ ID NO: 1733230 - DNA, 22 bp, Homo sapiens
tgcttgttgggattcctgaccc

SEQ ID NO: 1733231 - DNA, 19 bp, Homo sapiens
tgcttgtttactaagcatg

SEQ ID NO: 1733232 - DNA, 13 bp, Homo sapiens
tgcttgtttatga

SEQ ID NO: 1733233 - DNA, 21 bp, Homo sapiens
tgctttaaagtacctgtagtg

SEQ ID NO: 1733234 - DNA, 20 bp, Homo sapiens
tgctttaatgagaatagaaa

SEQ ID NO: 1733235 - DNA, 18 bp, Homo sapiens
tgctttattaatgttttc

SEQ ID NO: 1733236 - DNA, 20 bp, Homo sapiens
tgctttattaatgttttcaa

SEQ ID NO: 1733237 - DNA, 19 bp, Homo sapiens
tgctttcaattacaaagca

SEQ ID NO: 1733238 - DNA, 19 bp, Homo sapiens
tgctttcatcttggtcaca

SEQ ID NO: 1733239 - DNA, 18 bp, Homo sapiens
tgctttccagcctgggca

SEQ ID NO: 1733240 - DNA, 15 bp, Homo sapiens
tgctttccctgagga

SEQ ID NO: 1733241 - DNA, 18 bp, Homo sapiens
tgctttccctgaggaatg

SEQ ID NO: 1733242 - DNA, 17 bp, Homo sapiens
tgctttcctgcatctct

SEQ ID NO: 1733243 - DNA, 20 bp, Homo sapiens
tgctttcctttctttactat

SEQ ID NO: 1733244 - DNA, 21 bp, Homo sapiens
tgctttcggagctcctgtcca

SEQ ID NO: 1733245 - DNA, 17 bp, Homo sapiens
tggaaataaactgtgca

SEQ ID NO: 1733246 - DNA, 23 bp, Homo sapiens
tggaaataaatgtatcatagaaa

SEQ ID NO: 1733247 - DNA, 16 bp, Homo sapiens
tggaaatacagttatt

SEQ ID NO: 1733248 - DNA, 15 bp, Homo sapiens
tggaaatattaagaa

SEQ ID NO: 1733249 - DNA, 14 bp, Homo sapiens
tggaaatcatacca

SEQ ID NO: 1733250 - DNA, 16 bp, Homo sapiens
tggaaatgtagcactt

SEQ ID NO: 1733251 - DNA, 17 bp, Homo sapiens
tggaaatgtagcactta

SEQ ID NO: 1733252 - DNA, 12 bp, Homo sapiens
tggaaatgtctg

SEQ ID NO: 1733253 - DNA, 17 bp, Homo sapiens
tggaaatgtctgctggt

SEQ ID NO: 1733254 - DNA, 19 bp, Homo sapiens
tggaaattcctgtactgtg

SEQ ID NO: 1733255 - DNA, 23 bp, Homo sapiens
tggaaatttgttataatgaatga

SEQ ID NO: 1733256 - DNA, 20 bp, Homo sapiens
tggaacaacttgtagcagct

SEQ ID NO: 1733257 - DNA, 16 bp, Homo sapiens
tggaacaagacagcct

SEQ ID NO: 1733258 - DNA, 16 bp, Homo sapiens
tggaacagaatgtttt

SEQ ID NO: 1733259 - DNA, 21 bp, Homo sapiens
tggaacagaatgttttactgt

SEQ ID NO: 1733260 - DNA, 19 bp, Homo sapiens
tggaacagtgctactgaaa

SEQ ID NO: 1733261 - DNA, 20 bp, Homo sapiens
tggaacataaaatacaatgt

SEQ ID NO: 1733262 - DNA, 15 bp, Homo sapiens
tggaacataaagttg

SEQ ID NO: 1733263 - DNA, 19 bp, Homo sapiens
tggaacatggactttcttg

SEQ ID NO: 1733264 - DNA, 21 bp, Homo sapiens
tggaacatggctagcctttct

SEQ ID NO: 1733265 - DNA, 17 bp, Homo sapiens
tggaacattggaatgtt

SEQ ID NO: 1733266 - DNA, 15 bp, Homo sapiens
tggaacccagactca

SEQ ID NO: 1733267 - DNA, 20 bp, Homo sapiens
tggaaccgtgtccagcacag

SEQ ID NO: 1733268 - DNA, 21 bp, Homo sapiens
tggaaccgtgtccagcacaga

SEQ ID NO: 1733269 - DNA, 15 bp, Homo sapiens
tggaacctcagcctg

SEQ ID NO: 1733270 - DNA, 23 bp, Homo sapiens
tgaggccttgtgtgtcaggccct

SEQ ID NO: 1733271 - DNA, 22 bp, Homo sapiens
tgaggcggcagctggggccgga

SEQ ID NO: 1733272 - DNA, 22 bp, Homo sapiens
tgaggctgcagcaggtgctggg

SEQ ID NO: 1733273 - DNA, 13 bp, Homo sapiens
tgaggctgcagcg

SEQ ID NO: 1733274 - DNA, 13 bp, Homo sapiens
tgaggctgctgcc

SEQ ID NO: 1733275 - DNA, 19 bp, Homo sapiens
tgaggctgggggagagccg

SEQ ID NO: 1733276 - DNA, 23 bp, Homo sapiens
tgaggctggttttgatggctggg

SEQ ID NO: 1733277 - DNA, 18 bp, Homo sapiens
tgaggctgtcctgtacat

SEQ ID NO: 1733278 - DNA, 14 bp, Homo sapiens
tgaggcttaaacaa

SEQ ID NO: 1733279 - DNA, 13 bp, Homo sapiens
tgaggcttccagg

SEQ ID NO: 1733280 - DNA, 15 bp, Homo sapiens
tgaggcttccaggct

SEQ ID NO: 1733281 - DNA, 16 bp, Homo sapiens
tgaggcttccaggctc

SEQ ID NO: 1733282 - DNA, 17 bp, Homo sapiens
tgaggcttccaggctct

SEQ ID NO: 1733283 - DNA, 22 bp, Homo sapiens
tgaggcttccaggctcttcctg

SEQ ID NO: 1733284 - DNA, 20 bp, Homo sapiens
tgaggcttttcccaccagct

SEQ ID NO: 1733285 - DNA, 22 bp, Homo sapiens
tgaggcttttcccaccagctcc

SEQ ID NO: 1733286 - DNA, 23 bp, Homo sapiens
tgaggcttttcccaccagctccc

SEQ ID NO: 1733287 - DNA, 16 bp, Homo sapiens
tgagggaaatctgtaa

SEQ ID NO: 1733288 - DNA, 21 bp, Homo sapiens
tgagggaccgagcccagcaga

SEQ ID NO: 1733289 - DNA, 15 bp, Homo sapiens
tgagggaccttggag

SEQ ID NO: 1733290 - DNA, 22 bp, Homo sapiens
tgagggagaatcctcccttccc

SEQ ID NO: 1733291 - DNA, 14 bp, Homo sapiens
tgagggagcttagc

SEQ ID NO: 1733292 - DNA, 23 bp, Homo sapiens
tgagggaggaggccacctctcca

SEQ ID NO: 1733293 - DNA, 19 bp, Homo sapiens
tgagggagggggcgctcag

SEQ ID NO: 1733294 - DNA, 18 bp, Homo sapiens
tgagggcagactggggca

SEQ ID NO: 1733295 - DNA, 17 bp, Homo sapiens
tgagggcagtgcccttt

SEQ ID NO: 1733296 - DNA, 15 bp, Homo sapiens
tgagggcctgctgga

SEQ ID NO: 1733297 - DNA, 22 bp, Homo sapiens
tgagggcctgctggaggcctca

SEQ ID NO: 1733298 - DNA, 16 bp, Homo sapiens
tgaggggagaggagac

SEQ ID NO: 1733299 - DNA, 21 bp, Homo sapiens
tgaggggaggatcactggagc

SEQ ID NO: 1733300 - DNA, 22 bp, Homo sapiens
tgaggggaggatcactggagcc

SEQ ID NO: 1733301 - DNA, 17 bp, Homo sapiens
tgaggggccctggccag

SEQ ID NO: 1733302 - DNA, 17 bp, Homo sapiens
tgaggggcttcctgggt

SEQ ID NO: 1733303 - DNA, 13 bp, Homo sapiens
tgaggggctttct

SEQ ID NO: 1733304 - DNA, 18 bp, Homo sapiens
tgagggggagctgaaagg

SEQ ID NO: 1733305 - DNA, 12 bp, Homo sapiens
tgagggggtggt

SEQ ID NO: 1733306 - DNA, 22 bp, Homo sapiens
tgagggggtggttattggactc

SEQ ID NO: 1733307 - DNA, 15 bp, Homo sapiens
tgaggggtctcggat

SEQ ID NO: 1733308 - DNA, 15 bp, Homo sapiens
tgagggtctgggatc

SEQ ID NO: 1733309 - DNA, 21 bp, Homo sapiens
tgagggtgcttgttccctctc

SEQ ID NO: 1733310 - DNA, 14 bp, Homo sapiens
tgagggtgtttctt

SEQ ID NO: 1733311 - DNA, 20 bp, Homo sapiens
tgaggtcaagtaagaagaca

SEQ ID NO: 1733312 - DNA, 13 bp, Homo sapiens
tgaggtcccaggc

SEQ ID NO: 1733313 - DNA, 15 bp, Homo sapiens
tgaggtcccaggcag

SEQ ID NO: 1733314 - DNA, 17 bp, Homo sapiens
tgaggtcccaggcagag

SEQ ID NO: 1733315 - DNA, 13 bp, Homo sapiens
tgaggtccttatg

SEQ ID NO: 1733316 - DNA, 17 bp, Homo sapiens
tgaggtctcttgaggga

SEQ ID NO: 1733317 - DNA, 18 bp, Homo sapiens
tgaggtctcttgagggag

SEQ ID NO: 1733318 - DNA, 20 bp, Homo sapiens
tgaggtgcagagtgcccaga

SEQ ID NO: 1733319 - DNA, 23 bp, Homo sapiens
tgaggtgcgctcacctcagagca

SEQ ID NO: 1733320 - DNA, 16 bp, Homo sapiens
tgaggtggctgtagat

SEQ ID NO: 1733321 - DNA, 18 bp, Homo sapiens
tgaggtgggaggtggaag

SEQ ID NO: 1733322 - DNA, 20 bp, Homo sapiens
tgaggtgggcagatcacgag

SEQ ID NO: 1733323 - DNA, 13 bp, Homo sapiens
tgaggtgggccca

SEQ ID NO: 1733324 - DNA, 20 bp, Homo sapiens
tgaggtgggcccaggaccag

SEQ ID NO: 1733325 - DNA, 23 bp, Homo sapiens
tgaggtgggctggggctgctccc

SEQ ID NO: 1733326 - DNA, 21 bp, Homo sapiens
tgaggtgtgggggctgcagca

SEQ ID NO: 1733327 - DNA, 15 bp, Homo sapiens
tgaggttaagtttct

SEQ ID NO: 1733328 - DNA, 18 bp, Homo sapiens
tgaggttcccgacaccag

SEQ ID NO: 1733329 - DNA, 20 bp, Homo sapiens
tgaggttcctctgcctgccc

SEQ ID NO: 1733330 - DNA, 15 bp, Homo sapiens
tgaggttggatttgc

SEQ ID NO: 1733331 - DNA, 15 bp, Homo sapiens
tgaggtttggaagag

SEQ ID NO: 1733332 - DNA, 23 bp, Homo sapiens
tgagtaaaaaggtggtatgtaat

SEQ ID NO: 1733333 - DNA, 20 bp, Homo sapiens
tgagtaaaacacatattcaa

SEQ ID NO: 1733334 - DNA, 18 bp, Homo sapiens
tgagtaacatttgctgtt

SEQ ID NO: 1733335 - DNA, 16 bp, Homo sapiens
tgagtaagagctggtg

SEQ ID NO: 1733336 - DNA, 18 bp, Homo sapiens
tgagtaagagctggtgtc

SEQ ID NO: 1733337 - DNA, 17 bp, Homo sapiens
tgagtaatcaatacaga

SEQ ID NO: 1733338 - DNA, 13 bp, Homo sapiens
tgagtacagatac

SEQ ID NO: 1733339 - DNA, 14 bp, Homo sapiens
tgagtacagatact

SEQ ID NO: 1733340 - DNA, 16 bp, Homo sapiens
tgagtacagtgaggag

SEQ ID NO: 1733341 - DNA, 18 bp, Homo sapiens
tgagtacagtgaggaggg

SEQ ID NO: 1733342 - DNA, 19 bp, Homo sapiens
tgagtacagtgaggagggt

SEQ ID NO: 1733343 - DNA, 19 bp, Homo sapiens
tgagtacctgcaaaaatga

SEQ ID NO: 1733344 - DNA, 20 bp, Homo sapiens
tgagtacctgcaaaaatgag

SEQ ID NO: 1733345 - DNA, 21 bp, Homo sapiens
tgagtacctgcaaaaatgagt

SEQ ID NO: 1733346 - DNA, 24 bp, Homo sapiens
tgagtacggatgggaaactattgt

SEQ ID NO: 1733347 - DNA, 14 bp, Homo sapiens
tgagtagagttgat

SEQ ID NO: 1733348 - DNA, 19 bp, Homo sapiens
tgagtagatccatttccat

SEQ ID NO: 1733349 - DNA, 15 bp, Homo sapiens
tgagtagatgggact

SEQ ID NO: 1733350 - DNA, 14 bp, Homo sapiens
tgagtagctctgcc

SEQ ID NO: 1733351 - DNA, 13 bp, Homo sapiens
tgagtagctggga

SEQ ID NO: 1733352 - DNA, 14 bp, Homo sapiens
tgagtataatcaat

SEQ ID NO: 1733353 - DNA, 22 bp, Homo sapiens
tgagtatgcttgggccctgcat

SEQ ID NO: 1733354 - DNA, 18 bp, Homo sapiens
tgagtattccatgagctg

SEQ ID NO: 1733355 - DNA, 23 bp, Homo sapiens
tgagtattgtttaaaatgtaatt

SEQ ID NO: 1733356 - DNA, 13 bp, Homo sapiens
tgagtcaaatcca

SEQ ID NO: 1733357 - DNA, 14 bp, Homo sapiens
tgagtcaaatccag

SEQ ID NO: 1733358 - DNA, 15 bp, Homo sapiens
tgagtcaaatccagt

SEQ ID NO: 1733359 - DNA, 17 bp, Homo sapiens
tgagtcaaatccagtgg

SEQ ID NO: 1733360 - DNA, 13 bp, Homo sapiens
tgagtcacctcct

SEQ ID NO: 1733361 - DNA, 15 bp, Homo sapiens
tgagtcacctgctcc

SEQ ID NO: 1733362 - DNA, 13 bp, Homo sapiens
tgagtcagaatgt

SEQ ID NO: 1733363 - DNA, 14 bp, Homo sapiens
tgagtcagcacctt

SEQ ID NO: 1733364 - DNA, 20 bp, Homo sapiens
tgagtcagcaccttggccca

SEQ ID NO: 1733365 - DNA, 16 bp, Homo sapiens
tgagtcagtgctctca

SEQ ID NO: 1733366 - DNA, 20 bp, Homo sapiens
tgagtcatctgttagggcct

SEQ ID NO: 1733367 - DNA, 21 bp, Homo sapiens
tgagtcatctgttagggcctt

SEQ ID NO: 1733368 - DNA, 21 bp, Homo sapiens
tgagtcatgatctccctgccg

SEQ ID NO: 1733369 - DNA, 12 bp, Homo sapiens
tgagtccagagc

SEQ ID NO: 1733370 - DNA, 22 bp, Homo sapiens
tgagtccattctcccaggtacc

SEQ ID NO: 1733371 - DNA, 23 bp, Homo sapiens
tgagtcccagagcccgcttttgt

SEQ ID NO: 1733372 - DNA, 15 bp, Homo sapiens
tgagtccttgaaaat

SEQ ID NO: 1733373 - DNA, 18 bp, Homo sapiens
tgagtccttgaaaatatt

SEQ ID NO: 1733374 - DNA, 18 bp, Homo sapiens
tgagtccttgatttcaaa

SEQ ID NO: 1733375 - DNA, 19 bp, Homo sapiens
tgagtcgtacagaaagctg

SEQ ID NO: 1733376 - DNA, 14 bp, Homo sapiens
tgagtctatgttca

SEQ ID NO: 1733377 - DNA, 15 bp, Homo sapiens
tgagtctatgttcaa

SEQ ID NO: 1733378 - DNA, 20 bp, Homo sapiens
tgagtctatgttcaaagact

SEQ ID NO: 1733379 - DNA, 20 bp, Homo sapiens
tgagtctcaagggtggcagg

SEQ ID NO: 1733380 - DNA, 15 bp, Homo sapiens
tgagtctcctctctg

SEQ ID NO: 1733381 - DNA, 15 bp, Homo sapiens
tgagtctgagtcctg

SEQ ID NO: 1733382 - DNA, 21 bp, Homo sapiens
tgagtctgggcagctgtccct

SEQ ID NO: 1733383 - DNA, 15 bp, Homo sapiens
tgagtctgttgtgtg

SEQ ID NO: 1733384 - DNA, 18 bp, Homo sapiens
tgagtcttggcggcagca

SEQ ID NO: 1733385 - DNA, 23 bp, Homo sapiens
tgagtcttggcggcagcagccat

SEQ ID NO: 1733386 - DNA, 17 bp, Homo sapiens
tgaaataggaaacaagt

SEQ ID NO: 1733387 - DNA, 18 bp, Homo sapiens
tgaaataggaaacaagtg

SEQ ID NO: 1733388 - DNA, 18 bp, Homo sapiens
tgaaatagtctgtgtgaa

SEQ ID NO: 1733389 - DNA, 19 bp, Homo sapiens
tgaaatagttcaaagccaa

SEQ ID NO: 1733390 - DNA, 17 bp, Homo sapiens
tgaaatcaactcagtgg

SEQ ID NO: 1733391 - DNA, 22 bp, Homo sapiens
tgaaatcaatgcaagagtgatt

SEQ ID NO: 1733392 - DNA, 15 bp, Homo sapiens
tgaaatccataaact

SEQ ID NO: 1733393 - DNA, 19 bp, Homo sapiens
tgaaatccgtgaagtcaca

SEQ ID NO: 1733394 - DNA, 21 bp, Homo sapiens
tgaaatcctggaaaattctat

SEQ ID NO: 1733395 - DNA, 16 bp, Homo sapiens
tgaaatctcagaattc

SEQ ID NO: 1733396 - DNA, 19 bp, Homo sapiens
tgaaatctcagaattcctt

SEQ ID NO: 1733397 - DNA, 13 bp, Homo sapiens
tgaaatgaaaaca

SEQ ID NO: 1733398 - DNA, 20 bp, Homo sapiens
tgaaatgaaaacatgtaata

SEQ ID NO: 1733399 - DNA, 17 bp, Homo sapiens
tgaaatgaaaattttaa

SEQ ID NO: 1733400 - DNA, 21 bp, Homo sapiens
tgaaatgaaacaaataatcac

SEQ ID NO: 1733401 - DNA, 12 bp, Homo sapiens
tgaaatgaaagg

SEQ ID NO: 1733402 - DNA, 16 bp, Homo sapiens
tgaaatgaaagggaaa

SEQ ID NO: 1733403 - DNA, 16 bp, Homo sapiens
tgaaatgaccaagaca

SEQ ID NO: 1733404 - DNA, 19 bp, Homo sapiens
tgaaatgagtaaaaactag

SEQ ID NO: 1733405 - DNA, 20 bp, Homo sapiens
tgaaatgcatcaggtccttt

SEQ ID NO: 1733406 - DNA, 15 bp, Homo sapiens
tgaaatgctgaaaat

SEQ ID NO: 1733407 - DNA, 15 bp, Homo sapiens
tgaaatgctgcattt

SEQ ID NO: 1733408 - DNA, 16 bp, Homo sapiens
tgaaatggaggtcctt

SEQ ID NO: 1733409 - DNA, 15 bp, Homo sapiens
tgaaatggctggggc

SEQ ID NO: 1733410 - DNA, 21 bp, Homo sapiens
tgaaatggctggggccgctgg

SEQ ID NO: 1733411 - DNA, 23 bp, Homo sapiens
tgaaatggggattattatagcaa

SEQ ID NO: 1733412 - DNA, 21 bp, Homo sapiens
tgaaatgttagtcattgttat

SEQ ID NO: 1733413 - DNA, 20 bp, Homo sapiens
tgaaatgtttggattctctt

SEQ ID NO: 1733414 - DNA, 21 bp, Homo sapiens
tgaaatgtttggattctctta

SEQ ID NO: 1733415 - DNA, 13 bp, Homo sapiens
tgaaattaacaca

SEQ ID NO: 1733416 - DNA, 19 bp, Homo sapiens
tgaaattaacacaaaggaa

SEQ ID NO: 1733417 - DNA, 21 bp, Homo sapiens
tgaaattaacacaaaggaagt

SEQ ID NO: 1733418 - DNA, 13 bp, Homo sapiens
tgaaattaagcat

SEQ ID NO: 1733419 - DNA, 24 bp, Homo sapiens
tgaaattaagcattttgaaacaaa

SEQ ID NO: 1733420 - DNA, 20 bp, Homo sapiens
tgaaattacgggtacctgaa

SEQ ID NO: 1733421 - DNA, 19 bp, Homo sapiens
tgaaattacttatcatcca

SEQ ID NO: 1733422 - DNA, 23 bp, Homo sapiens
tgaaattatgtatgtttacatat

SEQ ID NO: 1733423 - DNA, 21 bp, Homo sapiens
tgaaattcagagcaagttcct

SEQ ID NO: 1733424 - DNA, 23 bp, Homo sapiens
tgaaattcagagcaagttcctga

SEQ ID NO: 1733425 - DNA, 19 bp, Homo sapiens
tgaaattccaaagtctcta

SEQ ID NO: 1733426 - DNA, 23 bp, Homo sapiens
tgaaattctattgaaaacagtgt

SEQ ID NO: 1733427 - DNA, 14 bp, Homo sapiens
tgaaattctcctgg

SEQ ID NO: 1733428 - DNA, 15 bp, Homo sapiens
tgaaattctcctgga

SEQ ID NO: 1733429 - DNA, 16 bp, Homo sapiens
tgaaattcttgaagtt

SEQ ID NO: 1733430 - DNA, 22 bp, Homo sapiens
tgaaattgataatgctttcaca

SEQ ID NO: 1733431 - DNA, 18 bp, Homo sapiens
tgaaatttattcacatat

SEQ ID NO: 1733432 - DNA, 13 bp, Homo sapiens
tgaaatttctcat

SEQ ID NO: 1733433 - DNA, 12 bp, Homo sapiens
tgaaatttggaa

SEQ ID NO: 1733434 - DNA, 20 bp, Homo sapiens
tgaaattttaacctatgata

SEQ ID NO: 1733435 - DNA, 14 bp, Homo sapiens
tgaaattttagaaa

SEQ ID NO: 1733436 - DNA, 16 bp, Homo sapiens
tgaaattttagaaata

SEQ ID NO: 1733437 - DNA, 15 bp, Homo sapiens
tgaaatttttattaa

SEQ ID NO: 1733438 - DNA, 20 bp, Homo sapiens
tgaacaaaaatgtttccact

SEQ ID NO: 1733439 - DNA, 21 bp, Homo sapiens
tgaacaaaaatgtttccactg

SEQ ID NO: 1733440 - DNA, 14 bp, Homo sapiens
tgaacaaaataaat

SEQ ID NO: 1733441 - DNA, 18 bp, Homo sapiens
tgaacaaagctcaaagta

SEQ ID NO: 1733442 - DNA, 18 bp, Homo sapiens
tgaacaaattctttagta

SEQ ID NO: 1733443 - DNA, 23 bp, Homo sapiens
tgaacaaattctttagtactcaa

SEQ ID NO: 1733444 - DNA, 11 bp, Homo sapiens
tgaacaagaat

SEQ ID NO: 1733445 - DNA, 12 bp, Homo sapiens
tgaacaagaatt

SEQ ID NO: 1733446 - DNA, 12 bp, Homo sapiens
tgaacaaggtaa

SEQ ID NO: 1733447 - DNA, 20 bp, Homo sapiens
tgaacaagttgtttcattga

SEQ ID NO: 1733448 - DNA, 18 bp, Homo sapiens
tgaacacaattgatactt

SEQ ID NO: 1733449 - DNA, 18 bp, Homo sapiens
tgaacacactgtgtcctg

SEQ ID NO: 1733450 - DNA, 23 bp, Homo sapiens
tgaacacactgtgtcctggtgct

SEQ ID NO: 1733451 - DNA, 17 bp, Homo sapiens
tgagaagagcttgcaca

SEQ ID NO: 1733452 - DNA, 18 bp, Homo sapiens
tgagaagagcttgcacag

SEQ ID NO: 1733453 - DNA, 22 bp, Homo sapiens
tgagaagagcttgcacagccaa

SEQ ID NO: 1733454 - DNA, 17 bp, Homo sapiens
tgagaagagggcctgtg

SEQ ID NO: 1733455 - DNA, 17 bp, Homo sapiens
tgagaagccaagcgctc

SEQ ID NO: 1733456 - DNA, 19 bp, Homo sapiens
tgagaagccttcagctcca

SEQ ID NO: 1733457 - DNA, 12 bp, Homo sapiens
tgagaagctctg

SEQ ID NO: 1733458 - DNA, 14 bp, Homo sapiens
tgagaagctgaggc

SEQ ID NO: 1733459 - DNA, 21 bp, Homo sapiens
tgagaaggcagtagttttcaa

SEQ ID NO: 1733460 - DNA, 19 bp, Homo sapiens
tgagaaggccctgtgccct

SEQ ID NO: 1733461 - DNA, 11 bp, Homo sapiens
tgagaaggtta

SEQ ID NO: 1733462 - DNA, 15 bp, Homo sapiens
tgagaaggttactga

SEQ ID NO: 1733463 - DNA, 15 bp, Homo sapiens
tgagaaggtttattg

SEQ ID NO: 1733464 - DNA, 18 bp, Homo sapiens
tgagaagtgaatgctggg

SEQ ID NO: 1733465 - DNA, 19 bp, Homo sapiens
tgagaagtgaatgctggga

SEQ ID NO: 1733466 - DNA, 22 bp, Homo sapiens
tgagaagtgaatgctgggactc

SEQ ID NO: 1733467 - DNA, 24 bp, Homo sapiens
tgagaatagaaacgtaaactatga

SEQ ID NO: 1733468 - DNA, 16 bp, Homo sapiens
tgagaatataccttat

SEQ ID NO: 1733469 - DNA, 22 bp, Homo sapiens
tgagaatcacggtggtaaagaa

SEQ ID NO: 1733470 - DNA, 20 bp, Homo sapiens
tgagaatcagatcatttcaa

SEQ ID NO: 1733471 - DNA, 22 bp, Homo sapiens
tgagaatcctctcctttcttat

SEQ ID NO: 1733472 - DNA, 17 bp, Homo sapiens
tgagaatgagtgggaat

SEQ ID NO: 1733473 - DNA, 15 bp, Homo sapiens
tgagaatgtaagaac

SEQ ID NO: 1733474 - DNA, 12 bp, Homo sapiens
tgagaatgtgat

SEQ ID NO: 1733475 - DNA, 23 bp, Homo sapiens
tgactcctgctggtacctgccct

SEQ ID NO: 1733476 - DNA, 14 bp, Homo sapiens
tgactcctgggtgg

SEQ ID NO: 1733477 - DNA, 14 bp, Homo sapiens
tgactcggtttctc

SEQ ID NO: 1733478 - DNA, 14 bp, Homo sapiens
tgactctaaatgca

SEQ ID NO: 1733479 - DNA, 15 bp, Homo sapiens
tgactctataagcaa

SEQ ID NO: 1733480 - DNA, 15 bp, Homo sapiens
tgactctcacctgta

SEQ ID NO: 1733481 - DNA, 12 bp, Homo sapiens
tgactctctcca

SEQ ID NO: 1733482 - DNA, 15 bp, Homo sapiens
tgactctctgtgacc

SEQ ID NO: 1733483 - DNA, 15 bp, Homo sapiens
tgactcttactcctt

SEQ ID NO: 1733484 - DNA, 14 bp, Homo sapiens
tgactgaactggga

SEQ ID NO: 1733485 - DNA, 20 bp, Homo sapiens
tgactgaagaagatgagcct

SEQ ID NO: 1733486 - DNA, 13 bp, Homo sapiens
tgactgaagcaca

SEQ ID NO: 1733487 - DNA, 14 bp, Homo sapiens
tgactgaaggaaaa

SEQ ID NO: 1733488 - DNA, 15 bp, Homo sapiens
tgactgaaggaaaag

SEQ ID NO: 1733489 - DNA, 19 bp, Homo sapiens
tgactgaaggggcacacca

SEQ ID NO: 1733490 - DNA, 14 bp, Homo sapiens
tgactgaatgctgt

SEQ ID NO: 1733491 - DNA, 16 bp, Homo sapiens
tgactgagataagaaa

SEQ ID NO: 1733492 - DNA, 13 bp, Homo sapiens
tgactgaggcctg

SEQ ID NO: 1733493 - DNA, 20 bp, Homo sapiens
tgactgatagcttacactga

SEQ ID NO: 1733494 - DNA, 15 bp, Homo sapiens
tgactgatgattttc

SEQ ID NO: 1733495 - DNA, 18 bp, Homo sapiens
tgactgatgattttcctt

SEQ ID NO: 1733496 - DNA, 12 bp, Homo sapiens
tgactgcagccc

SEQ ID NO: 1733497 - DNA, 13 bp, Homo sapiens
tgactgcagcccc

SEQ ID NO: 1733498 - DNA, 14 bp, Homo sapiens
tgactgccaagcca

SEQ ID NO: 1733499 - DNA, 15 bp, Homo sapiens
tgactgccaagccag

SEQ ID NO: 1733500 - DNA, 20 bp, Homo sapiens
tgactgccaagccagattct

SEQ ID NO: 1733501 - DNA, 20 bp, Homo sapiens
tgactgccccaactcctgga

SEQ ID NO: 1733502 - DNA, 22 bp, Homo sapiens
tgactgccccttctatgctgct

SEQ ID NO: 1733503 - DNA, 20 bp, Homo sapiens
tgactgcccgctcctcggga

SEQ ID NO: 1733504 - DNA, 17 bp, Homo sapiens
tgacccagtgcccccac

SEQ ID NO: 1733505 - DNA, 22 bp, Homo sapiens
tgaccccaaacaccttccagct

SEQ ID NO: 1733506 - DNA, 22 bp, Homo sapiens
tgaccccgagaagtgctcttgg

SEQ ID NO: 1733507 - DNA, 23 bp, Homo sapiens
tgaccccggtggcggccccagca

SEQ ID NO: 1733508 - DNA, 13 bp, Homo sapiens
tgacccctgctca

SEQ ID NO: 1733509 - DNA, 15 bp, Homo sapiens
tgaccccttccctgt

SEQ ID NO: 1733510 - DNA, 18 bp, Homo sapiens
tgaccctagctctttcct

SEQ ID NO: 1733511 - DNA, 21 bp, Homo sapiens
tgaccctgaaaggaacactgg

SEQ ID NO: 1733512 - DNA, 15 bp, Homo sapiens
tgaccctgaagtgag

SEQ ID NO: 1733513 - DNA, 23 bp, Homo sapiens
tgaccctgcgaaggggccctggt

SEQ ID NO: 1733514 - DNA, 13 bp, Homo sapiens
tgaccctgggcaa

SEQ ID NO: 1733515 - DNA, 16 bp, Homo sapiens
tgaccctgggcctgga

SEQ ID NO: 1733516 - DNA, 17 bp, Homo sapiens
tgaccctgggcctggag

SEQ ID NO: 1733517 - DNA, 18 bp, Homo sapiens
tgaccctgggcctggagg

SEQ ID NO: 1733518 - DNA, 23 bp, Homo sapiens
tgaccctggtgggctgttcagct

SEQ ID NO: 1733519 - DNA, 17 bp, Homo sapiens
tgacccttcagggccag

SEQ ID NO: 1733520 - DNA, 21 bp, Homo sapiens
tgacccttccagacatacgaa

SEQ ID NO: 1733521 - DNA, 21 bp, Homo sapiens
tgacccttcccaatcagcact

SEQ ID NO: 1733522 - DNA, 22 bp, Homo sapiens
tgacccttcccaatcagcactg

SEQ ID NO: 1733523 - DNA, 23 bp, Homo sapiens
tgacccttcccaatcagcactga

SEQ ID NO: 1733524 - DNA, 15 bp, Homo sapiens
tgacccttgaaccaa

SEQ ID NO: 1733525 - DNA, 23 bp, Homo sapiens
tgacccttgagcttaaacagaag

SEQ ID NO: 1733526 - DNA, 21 bp, Homo sapiens
tgacccttgtcatctctctgc

SEQ ID NO: 1733527 - DNA, 13 bp, Homo sapiens
tgacccttttcat

SEQ ID NO: 1733528 - DNA, 20 bp, Homo sapiens
tgaccgactaccccagtccc

SEQ ID NO: 1733529 - DNA, 16 bp, Homo sapiens
tgaccgagagaacctc

SEQ ID NO: 1733530 - DNA, 14 bp, Homo sapiens
tgaccgagccctgg

SEQ ID NO: 1733531 - DNA, 17 bp, Homo sapiens
tgaccgagccctggaga

SEQ ID NO: 1733532 - DNA, 18 bp, Homo sapiens
tgaccgagccctggagag

SEQ ID NO: 1733533 - DNA, 19 bp, Homo sapiens
tgaccggacttttctgcaa

SEQ ID NO: 1733534 - DNA, 19 bp, Homo sapiens
tgaccgggacttcaaagcc

SEQ ID NO: 1733535 - DNA, 20 bp, Homo sapiens
tgacctaaatccattttcta

SEQ ID NO: 1733536 - DNA, 20 bp, Homo sapiens
tgaatatctgccccagtagt

SEQ ID NO: 1733537 - DNA, 13 bp, Homo sapiens
tgaatattactct

SEQ ID NO: 1733538 - DNA, 14 bp, Homo sapiens
tgaatattctagaa

SEQ ID NO: 1733539 - DNA, 15 bp, Homo sapiens
tgaatattctagaac

SEQ ID NO: 1733540 - DNA, 19 bp, Homo sapiens
tgaatattgatgttaacaa

SEQ ID NO: 1733541 - DNA, 19 bp, Homo sapiens
tgaatatttatatttcact

SEQ ID NO: 1733542 - DNA, 15 bp, Homo sapiens
tgaatatttttgtat

SEQ ID NO: 1733543 - DNA, 17 bp, Homo sapiens
tgaatatttttgtattt

SEQ ID NO: 1733544 - DNA, 21 bp, Homo sapiens
tgaatatttttgtattttaca

SEQ ID NO: 1733545 - DNA, 22 bp, Homo sapiens
tgaatatttttgtattttacat

SEQ ID NO: 1733546 - DNA, 18 bp, Homo sapiens
tgaatcaagcaatatgga

SEQ ID NO: 1733547 - DNA, 16 bp, Homo sapiens
tgaatcaatcctgggc

SEQ ID NO: 1733548 - DNA, 16 bp, Homo sapiens
tgaatcactgtgctca

SEQ ID NO: 1733549 - DNA, 19 bp, Homo sapiens
tgaatcactgtgctcagcc

SEQ ID NO: 1733550 - DNA, 21 bp, Homo sapiens
tgaatcactgtgctcagccac

SEQ ID NO: 1733551 - DNA, 18 bp, Homo sapiens
tgaatcagaccctacccc

SEQ ID NO: 1733552 - DNA, 21 bp, Homo sapiens
tgaatcagaccctaccccacc

SEQ ID NO: 1733553 - DNA, 17 bp, Homo sapiens
tgaatcagccagtctca

SEQ ID NO: 1733554 - DNA, 14 bp, Homo sapiens
tgaatcatgagcct

SEQ ID NO: 1733555 - DNA, 15 bp, Homo sapiens
tgaatccaaactaat

SEQ ID NO: 1733556 - DNA, 16 bp, Homo sapiens
tgaatccaaactaatc

SEQ ID NO: 1733557 - DNA, 20 bp, Homo sapiens
tgaatccaaatctgtcctct

SEQ ID NO: 1733558 - DNA, 21 bp, Homo sapiens
tgaatccaaatctgtcctctg

SEQ ID NO: 1733559 - DNA, 23 bp, Homo sapiens
tgaatccaaatctgtcctctgta

SEQ ID NO: 1733560 - DNA, 19 bp, Homo sapiens
tgaatccaacgtgtaacca

SEQ ID NO: 1733561 - DNA, 20 bp, Homo sapiens
tgaatccaggaggcagtgga

SEQ ID NO: 1733562 - DNA, 14 bp, Homo sapiens
tgaatccatgcttg

SEQ ID NO: 1733563 - DNA, 15 bp, Homo sapiens
tgaatccctgggagc

SEQ ID NO: 1733564 - DNA, 22 bp, Homo sapiens
tgaatcctaagggctggtctct

SEQ ID NO: 1733565 - DNA, 20 bp, Homo sapiens
tgaatcctctattaattact

SEQ ID NO: 1733566 - DNA, 16 bp, Homo sapiens
tgaatccttttaatct

SEQ ID NO: 1733567 - DNA, 14 bp, Homo sapiens
tgaatctacatttg

SEQ ID NO: 1733568 - DNA, 22 bp, Homo sapiens
tgaatctataagtagtaaatca

SEQ ID NO: 1733569 - DNA, 12 bp, Homo sapiens
tgaatctatgcc

SEQ ID NO: 1733570 - DNA, 22 bp, Homo sapiens
tgaatctattatactgtattaa

SEQ ID NO: 1733571 - DNA, 12 bp, Homo sapiens
tgaatctcaaag

SEQ ID NO: 1733572 - DNA, 18 bp, Homo sapiens
tgaatctgcgagtagatg

SEQ ID NO: 1733573 - DNA, 14 bp, Homo sapiens
tgaatctgtgcctg

SEQ ID NO: 1733574 - DNA, 18 bp, Homo sapiens
tgaatgaataactaagat

SEQ ID NO: 1733575 - DNA, 17 bp, Homo sapiens
tgaatgactaagaggaa

SEQ ID NO: 1733576 - DNA, 17 bp, Homo sapiens
tgaatgaggtcccaggc

SEQ ID NO: 1733577 - DNA, 21 bp, Homo sapiens
tgaatgagtctgttgtgtgtc

SEQ ID NO: 1733578 - DNA, 18 bp, Homo sapiens
tgaatgatctctctgaat

SEQ ID NO: 1733579 - DNA, 17 bp, Homo sapiens
tgaatgatttttcattg

SEQ ID NO: 1733580 - DNA, 19 bp, Homo sapiens
tgaatgcacactagcctct

SEQ ID NO: 1733581 - DNA, 15 bp, Homo sapiens
tgaatgccaaagcca

SEQ ID NO: 1733582 - DNA, 20 bp, Homo sapiens
tgaatgccatttagaatcta

SEQ ID NO: 1733583 - DNA, 23 bp, Homo sapiens
tgaatgcccacaggcaaatgcat

SEQ ID NO: 1733584 - DNA, 17 bp, Homo sapiens
tgaatgccggggacaga

SEQ ID NO: 1733585 - DNA, 12 bp, Homo sapiens
tgaatgctgcca

SEQ ID NO: 1733586 - DNA, 13 bp, Homo sapiens
tgaatgctgccag

SEQ ID NO: 1733587 - DNA, 13 bp, Homo sapiens
tgaatgctgggac

SEQ ID NO: 1733588 - DNA, 15 bp, Homo sapiens
tgacaaggaaaatct

SEQ ID NO: 1733589 - DNA, 16 bp, Homo sapiens
tgacaaggaaaatcta

SEQ ID NO: 1733590 - DNA, 21 bp, Homo sapiens
tgacaagggctgacctgcctc

SEQ ID NO: 1733591 - DNA, 20 bp, Homo sapiens
tgacaagtcattttaacttt

SEQ ID NO: 1733592 - DNA, 16 bp, Homo sapiens
tgacaagtgaagaaca

SEQ ID NO: 1733593 - DNA, 10 bp, Homo sapiens
tgacaataaa

SEQ ID NO: 1733594 - DNA, 12 bp, Homo sapiens
tgacaatgaagg

SEQ ID NO: 1733595 - DNA, 14 bp, Homo sapiens
tgacaattgggagc

SEQ ID NO: 1733596 - DNA, 18 bp, Homo sapiens
tgacaattttgtacaaat

SEQ ID NO: 1733597 - DNA, 22 bp, Homo sapiens
tgacaattttgtacaaatttgt

SEQ ID NO: 1733598 - DNA, 14 bp, Homo sapiens
tgacaattttgtct

SEQ ID NO: 1733599 - DNA, 19 bp, Homo sapiens
tgacacaaagcttctaaag

SEQ ID NO: 1733600 - DNA, 13 bp, Homo sapiens
tgacacacagcac

SEQ ID NO: 1733601 - DNA, 16 bp, Homo sapiens
tgacacacagcactct

SEQ ID NO: 1733602 - DNA, 16 bp, Homo sapiens
tgacacaccaggcgct

SEQ ID NO: 1733603 - DNA, 22 bp, Homo sapiens
tgacacagacattttgtgtgag

SEQ ID NO: 1733604 - DNA, 22 bp, Homo sapiens
tgacacagcagcttcaccagag

SEQ ID NO: 1733605 - DNA, 22 bp, Homo sapiens
tgacacagtcttggctcactgc

SEQ ID NO: 1733606 - DNA, 16 bp, Homo sapiens
tgacacataaatctgt

SEQ ID NO: 1733607 - DNA, 18 bp, Homo sapiens
tgacacataaatctgtct

SEQ ID NO: 1733608 - DNA, 15 bp, Homo sapiens
tgacacatatgaaca

SEQ ID NO: 1733609 - DNA, 21 bp, Homo sapiens
tgacacatatgcaccttgtgt

SEQ ID NO: 1733610 - DNA, 17 bp, Homo sapiens
tgacacatcgttttggg

SEQ ID NO: 1733611 - DNA, 17 bp, Homo sapiens
tgacacattaatgataa

SEQ ID NO: 1733612 - DNA, 16 bp, Homo sapiens
tgacaccagcctttct

SEQ ID NO: 1733613 - DNA, 23 bp, Homo sapiens
tgacaccagcctttctcccaggc

SEQ ID NO: 1733614 - DNA, 20 bp, Homo sapiens
tgacacccatgccagagagg

SEQ ID NO: 1733615 - DNA, 16 bp, Homo sapiens
tgacaccccctccccg

SEQ ID NO: 1733616 - DNA, 15 bp, Homo sapiens
tgacaccctggcctg

SEQ ID NO: 1733617 - DNA, 17 bp, Homo sapiens
tgacaccctggtcctga

SEQ ID NO: 1733618 - DNA, 17 bp, Homo sapiens
tgacaccgtccctcagt

SEQ ID NO: 1733619 - DNA, 19 bp, Homo sapiens
tgacaccgtccctcagtga

SEQ ID NO: 1733620 - DNA, 20 bp, Homo sapiens
tgacacctaccatgctgctt

SEQ ID NO: 1733621 - DNA, 15 bp, Homo sapiens
tgacacctccccctt

SEQ ID NO: 1733622 - DNA, 18 bp, Homo sapiens
tgacacctggtgcgggcc

SEQ ID NO: 1733623 - DNA, 20 bp, Homo sapiens
tgacacctggtgcgggcctg

SEQ ID NO: 1733624 - DNA, 17 bp, Homo sapiens
tgacacctgtcttgaat

SEQ ID NO: 1733625 - DNA, 19 bp, Homo sapiens
tgacacctgtcttgaataa

SEQ ID NO: 1733626 - DNA, 19 bp, Homo sapiens
tgacacgcagcctgctctg

SEQ ID NO: 1733627 - DNA, 22 bp, Homo sapiens
tgacacgcgctctccaccaccc

SEQ ID NO: 1733628 - DNA, 22 bp, Homo sapiens
tgacactagcccaatgaaatga

SEQ ID NO: 1733629 - DNA, 20 bp, Homo sapiens
tgacactgaaagttttgtaa

SEQ ID NO: 1733630 - DNA, 22 bp, Homo sapiens
tgacactgaaagttttgtaaaa

SEQ ID NO: 1733631 - DNA, 22 bp, Homo sapiens
tgacactgaacttaataactgt

SEQ ID NO: 1733632 - DNA, 21 bp, Homo sapiens
tgacactgatgagtttcactg

SEQ ID NO: 1733633 - DNA, 22 bp, Homo sapiens
tgacactgctctaacagccctc

SEQ ID NO: 1733634 - DNA, 13 bp, Homo sapiens
tgacactggacca

SEQ ID NO: 1733635 - DNA, 14 bp, Homo sapiens
tgacagaaaatatg

SEQ ID NO: 1733636 - DNA, 19 bp, Homo sapiens
tgacagaaaatatgtatta

SEQ ID NO: 1733637 - DNA, 20 bp, Homo sapiens
tgacagaaaatatgtattaa

SEQ ID NO: 1733638 - DNA, 23 bp, Homo sapiens
tgacagaaaatatgtattaacac

SEQ ID NO: 1733639 - DNA, 15 bp, Homo sapiens
tgacagaaggtgcca

SEQ ID NO: 1733640 - DNA, 16 bp, Homo sapiens
tgacagaatatgtttc

SEQ ID NO: 1733641 - DNA, 17 bp, Homo sapiens
tgacagaccacatcttt

SEQ ID NO: 1733642 - DNA, 16 bp, Homo sapiens
tgacagactatttgct

SEQ ID NO: 1733643 - DNA, 19 bp, Homo sapiens
tgacagactatttgctaat

SEQ ID NO: 1733644 - DNA, 18 bp, Homo sapiens
tgacagagacccagatct

SEQ ID NO: 1733645 - DNA, 19 bp, Homo sapiens
tgacagagacccagatctc

SEQ ID NO: 1733646 - DNA, 21 bp, Homo sapiens
tgacagagcaagactctgtct

SEQ ID NO: 1733647 - DNA, 23 bp, Homo sapiens
tgacagagcagctaactccgaga

SEQ ID NO: 1733648 - DNA, 12 bp, Homo sapiens
tgacagagccag

SEQ ID NO: 1733649 - DNA, 20 bp, Homo sapiens
tgacagagcccagcatccct

SEQ ID NO: 1733650 - DNA, 22 bp, Homo sapiens
tgacagataaatccttaacatt

SEQ ID NO: 1733651 - DNA, 19 bp, Homo sapiens
tgacagatgttgaatgccc

SEQ ID NO: 1733652 - DNA, 18 bp, Homo sapiens
tgacagattgacagggac

SEQ ID NO: 1733653 - DNA, 16 bp, Homo sapiens
tgacagatttctgtaa

SEQ ID NO: 1733654 - DNA, 22 bp, Homo sapiens
tgacagcaaaatgttgaagaaa

SEQ ID NO: 1733655 - DNA, 15 bp, Homo sapiens
tctttcccatgtatt

SEQ ID NO: 1733656 - DNA, 12 bp, Homo sapiens
tctttccccaga

SEQ ID NO: 1733657 - DNA, 14 bp, Homo sapiens
tctttccccagagg

SEQ ID NO: 1733658 - DNA, 20 bp, Homo sapiens
tctttccccagaggctccca

SEQ ID NO: 1733659 - DNA, 14 bp, Homo sapiens
tctttcccctttct

SEQ ID NO: 1733660 - DNA, 12 bp, Homo sapiens
tctttccctgcg

SEQ ID NO: 1733661 - DNA, 14 bp, Homo sapiens
tctttccctgcgag

SEQ ID NO: 1733662 - DNA, 13 bp, Homo sapiens
tctttccctggac

SEQ ID NO: 1733663 - DNA, 17 bp, Homo sapiens
tctttccctggacaggc

SEQ ID NO: 1733664 - DNA, 13 bp, Homo sapiens
tctttccggccaa

SEQ ID NO: 1733665 - DNA, 16 bp, Homo sapiens
tctttcctcaatatag

SEQ ID NO: 1733666 - DNA, 14 bp, Homo sapiens
tctttcctccaccc

SEQ ID NO: 1733667 - DNA, 15 bp, Homo sapiens
tctttcctccaccca

SEQ ID NO: 1733668 - DNA, 15 bp, Homo sapiens
tctttcctctttctg

SEQ ID NO: 1733669 - DNA, 15 bp, Homo sapiens
tctttccttcccaat

SEQ ID NO: 1733670 - DNA, 10 bp, Homo sapiens
tctttccttg

SEQ ID NO: 1733671 - DNA, 18 bp, Homo sapiens
tctttctaactttcttta

SEQ ID NO: 1733672 - DNA, 16 bp, Homo sapiens
tctttctagagccagc

SEQ ID NO: 1733673 - DNA, 23 bp, Homo sapiens
tctttctattgttaaacaaatga

SEQ ID NO: 1733674 - DNA, 19 bp, Homo sapiens
tctttctctgacactgtgt

SEQ ID NO: 1733675 - DNA, 12 bp, Homo sapiens
tctttctctgcc

SEQ ID NO: 1733676 - DNA, 17 bp, Homo sapiens
tctttctctgccagtga

SEQ ID NO: 1733677 - DNA, 12 bp, Homo sapiens
tctttctcttcc

SEQ ID NO: 1733678 - DNA, 18 bp, Homo sapiens
tctttctgagcacacttt

SEQ ID NO: 1733679 - DNA, 21 bp, Homo sapiens
tctttctgagcacactttagt

SEQ ID NO: 1733680 - DNA, 16 bp, Homo sapiens
tctttctgatgtcaaa

SEQ ID NO: 1733681 - DNA, 12 bp, Homo sapiens
tctttctgcctt

SEQ ID NO: 1733682 - DNA, 13 bp, Homo sapiens
tctttctgggagc

SEQ ID NO: 1733683 - DNA, 20 bp, Homo sapiens
tctttctgtcttgttaatgc

SEQ ID NO: 1733684 - DNA, 14 bp, Homo sapiens
tctttcttcctctt

SEQ ID NO: 1733685 - DNA, 22 bp, Homo sapiens
tctttcttcttcaaacctttgt

SEQ ID NO: 1733686 - DNA, 20 bp, Homo sapiens
tctttcttgctggctctgag

SEQ ID NO: 1733687 - DNA, 13 bp, Homo sapiens
tctttcttgtttg

SEQ ID NO: 1733688 - DNA, 23 bp, Homo sapiens
tctttcttgtttgtcagcatctg

SEQ ID NO: 1733689 - DNA, 11 bp, Homo sapiens
tctttgaaata

SEQ ID NO: 1733690 - DNA, 15 bp, Homo sapiens
tctttgaaataaaaa

SEQ ID NO: 1733691 - DNA, 21 bp, Homo sapiens
tctttgacaattgggagctgc

SEQ ID NO: 1733692 - DNA, 19 bp, Homo sapiens
tctttgaccagatctttct

SEQ ID NO: 1733693 - DNA, 23 bp, Homo sapiens
tctttgactgaaaaaaaaaaaga

SEQ ID NO: 1733694 - DNA, 23 bp, Homo sapiens
tctttgagaactgcttctaagat

SEQ ID NO: 1733695 - DNA, 16 bp, Homo sapiens
tcttatctcagatatt

SEQ ID NO: 1733696 - DNA, 17 bp, Homo sapiens
tcttatctgttcagtgt

SEQ ID NO: 1733697 - DNA, 16 bp, Homo sapiens
tcttatgtgacattaa

SEQ ID NO: 1733698 - DNA, 15 bp, Homo sapiens
tcttatgttgaatat

SEQ ID NO: 1733699 - DNA, 20 bp, Homo sapiens
tcttattaatcatacaaact

SEQ ID NO: 1733700 - DNA, 21 bp, Homo sapiens
tcttattcccaaactacagaa

SEQ ID NO: 1733701 - DNA, 18 bp, Homo sapiens
tcttattccgagcattcc

SEQ ID NO: 1733702 - DNA, 13 bp, Homo sapiens
tcttattctaata

SEQ ID NO: 1733703 - DNA, 17 bp, Homo sapiens
tcttattgcaaggcagt

SEQ ID NO: 1733704 - DNA, 17 bp, Homo sapiens
tcttattgcgctgctac

SEQ ID NO: 1733705 - DNA, 19 bp, Homo sapiens
tcttattttctcaatctcc

SEQ ID NO: 1733706 - DNA, 14 bp, Homo sapiens
tcttattttgtggg

SEQ ID NO: 1733707 - DNA, 16 bp, Homo sapiens
tcttcaaaaagcagag

SEQ ID NO: 1733708 - DNA, 14 bp, Homo sapiens
tcttcaaactttca

SEQ ID NO: 1733709 - DNA, 15 bp, Homo sapiens
tcttcaaactttcac

SEQ ID NO: 1733710 - DNA, 18 bp, Homo sapiens
tcttcaaactttcacttt

SEQ ID NO: 1733711 - DNA, 16 bp, Homo sapiens
tcttcaaattagaaga

SEQ ID NO: 1733712 - DNA, 17 bp, Homo sapiens
tcttcaaccaaggccac

SEQ ID NO: 1733713 - DNA, 14 bp, Homo sapiens
tcttcaactcctgg

SEQ ID NO: 1733714 - DNA, 19 bp, Homo sapiens
tcttcaagggaagaaacac

SEQ ID NO: 1733715 - DNA, 14 bp, Homo sapiens
tcttcaatctctgt

SEQ ID NO: 1733716 - DNA, 24 bp, Homo sapiens
tcttcacactggtttgccaggcca

SEQ ID NO: 1733717 - DNA, 12 bp, Homo sapiens
tcttcacctcag

SEQ ID NO: 1733718 - DNA, 20 bp, Homo sapiens
tcttcactgcaattttgtgt

SEQ ID NO: 1733719 - DNA, 21 bp, Homo sapiens
tcttcactgtggccacagccc

SEQ ID NO: 1733720 - DNA, 17 bp, Homo sapiens
tcttcacttcaagctgt

SEQ ID NO: 1733721 - DNA, 16 bp, Homo sapiens
tcttcagacccagaga

SEQ ID NO: 1733722 - DNA, 14 bp, Homo sapiens
tcttcagagaaatc

SEQ ID NO: 1733723 - DNA, 14 bp, Homo sapiens
tgaaaagtgtgtat

SEQ ID NO: 1733724 - DNA, 18 bp, Homo sapiens
tgaaaagtgtgtatatat

SEQ ID NO: 1733725 - DNA, 16 bp, Homo sapiens
tgaaaagtgttctgtg

SEQ ID NO: 1733726 - DNA, 18 bp, Homo sapiens
tgaaaagtgttctgtgcg

SEQ ID NO: 1733727 - DNA, 19 bp, Homo sapiens
tgaaaagtgttctgtgcgt

SEQ ID NO: 1733728 - DNA, 23 bp, Homo sapiens
tgaaaagttcagggaccgtccag

SEQ ID NO: 1733729 - DNA, 15 bp, Homo sapiens
tgaaaagttggaagg

SEQ ID NO: 1733730 - DNA, 15 bp, Homo sapiens
tgaaaataaaaagag

SEQ ID NO: 1733731 - DNA, 16 bp, Homo sapiens
tgaaaataaaaagaga

SEQ ID NO: 1733732 - DNA, 20 bp, Homo sapiens
tgaaaataaaaagatcactt

SEQ ID NO: 1733733 - DNA, 15 bp, Homo sapiens
tgaaaataaaacaca

SEQ ID NO: 1733734 - DNA, 16 bp, Homo sapiens
tgaaaataactgaatt

SEQ ID NO: 1733735 - DNA, 21 bp, Homo sapiens
tgaaaataactgaatttggag

SEQ ID NO: 1733736 - DNA, 19 bp, Homo sapiens
tgaaaatacaacttaaata

SEQ ID NO: 1733737 - DNA, 19 bp, Homo sapiens
tgaaaatacttttgcattt

SEQ ID NO: 1733738 - DNA, 13 bp, Homo sapiens
tgaaaatagtgta

SEQ ID NO: 1733739 - DNA, 22 bp, Homo sapiens
tgaaaatatagacattctcaca

SEQ ID NO: 1733740 - DNA, 23 bp, Homo sapiens
tgaaaatatctgctcaaaacttt

SEQ ID NO: 1733741 - DNA, 21 bp, Homo sapiens
tgaaaatatttttttctagct

SEQ ID NO: 1733742 - DNA, 21 bp, Homo sapiens
tgaaaatcatgaaaagaggaa

SEQ ID NO: 1733743 - DNA, 21 bp, Homo sapiens
tgaaaatgaatatctattaat

SEQ ID NO: 1733744 - DNA, 23 bp, Homo sapiens
tgaaaatgaatatctattaatat

SEQ ID NO: 1733745 - DNA, 19 bp, Homo sapiens
tgaaaatgagcatcagaga

SEQ ID NO: 1733746 - DNA, 19 bp, Homo sapiens
tgaaaatgattcctggaca

SEQ ID NO: 1733747 - DNA, 16 bp, Homo sapiens
tgaaaatgggctcaac

SEQ ID NO: 1733748 - DNA, 13 bp, Homo sapiens
tgaaaatggtttt

SEQ ID NO: 1733749 - DNA, 21 bp, Homo sapiens
tgaaaatgtcagaaaccagtt

SEQ ID NO: 1733750 - DNA, 20 bp, Homo sapiens
tgaaaatgtgctatactgca

SEQ ID NO: 1733751 - DNA, 13 bp, Homo sapiens
tgaaaatgttttt

SEQ ID NO: 1733752 - DNA, 13 bp, Homo sapiens
tgaaaattatgca

SEQ ID NO: 1733753 - DNA, 17 bp, Homo sapiens
tgaaaattatgcaaaag

SEQ ID NO: 1733754 - DNA, 19 bp, Homo sapiens
tgaaaattatgcaaaagca

SEQ ID NO: 1733755 - DNA, 19 bp, Homo sapiens
tgaaaattattttgttcat

SEQ ID NO: 1733756 - DNA, 22 bp, Homo sapiens
tgaaaattattttgttcataca

SEQ ID NO: 1733757 - DNA, 18 bp, Homo sapiens
tgaaaattccagaaagga

SEQ ID NO: 1733758 - DNA, 22 bp, Homo sapiens
tgaaaattctaacccaagacat

SEQ ID NO: 1733759 - DNA, 18 bp, Homo sapiens
tgaaaattgcctttctgt

SEQ ID NO: 1733760 - DNA, 22 bp, Homo sapiens
tgaaaattgcctttctgtgttt

SEQ ID NO: 1733761 - DNA, 23 bp, Homo sapiens
tgaaaattgcctttctgtgttta

SEQ ID NO: 1733762 - DNA, 17 bp, Homo sapiens
tgaaacaaagtactctt

SEQ ID NO: 1733763 - DNA, 14 bp, Homo sapiens
tgaaacaactcctt

SEQ ID NO: 1733764 - DNA, 20 bp, Homo sapiens
tgaaacaactccttttactg

SEQ ID NO: 1733765 - DNA, 17 bp, Homo sapiens
tgaaacaagaagccaca

SEQ ID NO: 1733766 - DNA, 13 bp, Homo sapiens
tgaaacacacgag

SEQ ID NO: 1733767 - DNA, 18 bp, Homo sapiens
tgaaacagttgctgtgaa

SEQ ID NO: 1733768 - DNA, 22 bp, Homo sapiens
tgaaacatgcacattttgtaca

SEQ ID NO: 1733769 - DNA, 23 bp, Homo sapiens
tgaaacattcacacagggctctt

SEQ ID NO: 1733770 - DNA, 18 bp, Homo sapiens
tgaaacattccgaagagg

SEQ ID NO: 1733771 - DNA, 15 bp, Homo sapiens
tgaaacattttttct

SEQ ID NO: 1733772 - DNA, 19 bp, Homo sapiens
tgaaacattttttcttctg

SEQ ID NO: 1733773 - DNA, 16 bp, Homo sapiens
tgaaacccccatctct

SEQ ID NO: 1733774 - DNA, 20 bp, Homo sapiens
tgaaacctacacactgtcat

SEQ ID NO: 1733775 - DNA, 15 bp, Homo sapiens
tgaaacctctgcctt

SEQ ID NO: 1733776 - DNA, 19 bp, Homo sapiens
tgaaacctgttaaaacaac

SEQ ID NO: 1733777 - DNA, 18 bp, Homo sapiens
tgaaacctttagggcagc

SEQ ID NO: 1733778 - DNA, 21 bp, Homo sapiens
tgaaacctttagggcagcttg

SEQ ID NO: 1733779 - DNA, 16 bp, Homo sapiens
tgaaacgtcccacact

SEQ ID NO: 1733780 - DNA, 18 bp, Homo sapiens
tgaaactcatagacactg

SEQ ID NO: 1733781 - DNA, 19 bp, Homo sapiens
tgaaactcctgattttgta

SEQ ID NO: 1733782 - DNA, 23 bp, Homo sapiens
tgaaactcgcgagtgtaactttc

SEQ ID NO: 1733783 - DNA, 20 bp, Homo sapiens
tgaaactgaaggtcaataaa

SEQ ID NO: 1733784 - DNA, 14 bp, Homo sapiens
tgaaactgagtata

SEQ ID NO: 1733785 - DNA, 18 bp, Homo sapiens
tgaaactggcactgaatt

SEQ ID NO: 1733786 - DNA, 22 bp, Homo sapiens
tgaaactttgagatctaaaaat

SEQ ID NO: 1733787 - DNA, 15 bp, Homo sapiens
tgaaactttgggaaa

SEQ ID NO: 1733788 - DNA, 23 bp, Homo sapiens
tgaaactttgggaaaacatgtta

SEQ ID NO: 1733789 - DNA, 17 bp, Homo sapiens
tgaaagaaaattgagtt

SEQ ID NO: 1733790 - DNA, 22 bp, Homo sapiens
tgaaagaaaattgagttgcact

SEQ ID NO: 1733791 - DNA, 14 bp, Homo sapiens
tctgccaggcctgt

SEQ ID NO: 1733792 - DNA, 13 bp, Homo sapiens
tctgccagggagc

SEQ ID NO: 1733793 - DNA, 20 bp, Homo sapiens
tctgtgtgtttatgtgtgtg

SEQ ID NO: 1733794 - DNA, 14 bp, Homo sapiens
tctgtgttcatttt

SEQ ID NO: 1733795 - DNA, 12 bp, Homo sapiens
tctgtgtttatt

SEQ ID NO: 1733796 - DNA, 15 bp, Homo sapiens
tctgttacaaaagaa

SEQ ID NO: 1733797 - DNA, 23 bp, Homo sapiens
tctgttacccagggctctgcagc

SEQ ID NO: 1733798 - DNA, 21 bp, Homo sapiens
tctgttactccattactgtga

SEQ ID NO: 1733799 - DNA, 21 bp, Homo sapiens
tctgttataggtcctttagaa

SEQ ID NO: 1733800 - DNA, 12 bp, Homo sapiens
tctgttatgcac

SEQ ID NO: 1733801 - DNA, 17 bp, Homo sapiens
tctgttatgctgtgaca

SEQ ID NO: 1733802 - DNA, 15 bp, Homo sapiens
tctgttatgggcttt

SEQ ID NO: 1733803 - DNA, 20 bp, Homo sapiens
tctgttcaaagctgcctgtc

SEQ ID NO: 1733804 - DNA, 21 bp, Homo sapiens
tctgttcacagtctctggaaa

SEQ ID NO: 1733805 - DNA, 19 bp, Homo sapiens
tctgttcacttttcctccc

SEQ ID NO: 1733806 - DNA, 14 bp, Homo sapiens
tctgttcagcgttt

SEQ ID NO: 1733807 - DNA, 20 bp, Homo sapiens
tctgttcagcgttttgcaag

SEQ ID NO: 1733808 - DNA, 13 bp, Homo sapiens
tctgttcagtgat

SEQ ID NO: 1733809 - DNA, 13 bp, Homo sapiens
tctgttccaacct

SEQ ID NO: 1733810 - DNA, 24 bp, Homo sapiens
tctgttccaacctcctgctctggg

SEQ ID NO: 1733811 - DNA, 16 bp, Homo sapiens
tctgttccattttaac

SEQ ID NO: 1733812 - DNA, 16 bp, Homo sapiens
tctgttctgctcccag

SEQ ID NO: 1733813 - DNA, 22 bp, Homo sapiens
tctgttctgctcccagatgcct

SEQ ID NO: 1733814 - DNA, 13 bp, Homo sapiens
tctgttctgttga

SEQ ID NO: 1733815 - DNA, 16 bp, Homo sapiens
tctgttctgtttcaag

SEQ ID NO: 1733816 - DNA, 18 bp, Homo sapiens
tctgttgatcccacttca

SEQ ID NO: 1733817 - DNA, 16 bp, Homo sapiens
tccctctcgctcccct

SEQ ID NO: 1733818 - DNA, 17 bp, Homo sapiens
tccctctcgctcccctc

SEQ ID NO: 1733819 - DNA, 20 bp, Homo sapiens
tccctctctcatgagaagcc

SEQ ID NO: 1733820 - DNA, 17 bp, Homo sapiens
tccctctctcccatttc

SEQ ID NO: 1733821 - DNA, 18 bp, Homo sapiens
tccctctctcttctgctc

SEQ ID NO: 1733822 - DNA, 13 bp, Homo sapiens
tccctctctggtt

SEQ ID NO: 1733823 - DNA, 16 bp, Homo sapiens
tccctctcttggctat

SEQ ID NO: 1733824 - DNA, 13 bp, Homo sapiens
tccctctgacctg

SEQ ID NO: 1733825 - DNA, 17 bp, Homo sapiens
tccctctgacctgcagg

SEQ ID NO: 1733826 - DNA, 18 bp, Homo sapiens
tccctctgacctgcaggc

SEQ ID NO: 1733827 - DNA, 16 bp, Homo sapiens
tccctctgcagaatcc

SEQ ID NO: 1733828 - DNA, 20 bp, Homo sapiens
tccctctgcagaatcccttt

SEQ ID NO: 1733829 - DNA, 13 bp, Homo sapiens
tccctctgcccca

SEQ ID NO: 1733830 - DNA, 20 bp, Homo sapiens
tccctctgccccaagcagcc

SEQ ID NO: 1733831 - DNA, 21 bp, Homo sapiens
tccctctgccccaagcagcca

SEQ ID NO: 1733832 - DNA, 22 bp, Homo sapiens
tccctctgccccaagcagccag

SEQ ID NO: 1733833 - DNA, 21 bp, Homo sapiens
tccctctgcctgaaccttcca

SEQ ID NO: 1733834 - DNA, 19 bp, Homo sapiens
tccctctggccctgccttc

SEQ ID NO: 1733835 - DNA, 15 bp, Homo sapiens
tccctctgggcctgt

SEQ ID NO: 1733836 - DNA, 17 bp, Homo sapiens
tccctctgggcctgttc

SEQ ID NO: 1733837 - DNA, 13 bp, Homo sapiens
tccctctgtttct

SEQ ID NO: 1733838 - DNA, 14 bp, Homo sapiens
tccctctgtttctc

SEQ ID NO: 1733839 - DNA, 15 bp, Homo sapiens
tccctcttccctctc

SEQ ID NO: 1733840 - DNA, 13 bp, Homo sapiens
tccctcttgtaag

SEQ ID NO: 1733841 - DNA, 15 bp, Homo sapiens
tccctgaaaacccag

SEQ ID NO: 1733842 - DNA, 15 bp, Homo sapiens
tccctgaaccatccc

SEQ ID NO: 1733843 - DNA, 19 bp, Homo sapiens
tccctgaacccctggccag

SEQ ID NO: 1733844 - DNA, 18 bp, Homo sapiens
tccctgaacgttttcttc

SEQ ID NO: 1733845 - DNA, 20 bp, Homo sapiens
tccctgaacgttttcttctt

SEQ ID NO: 1733846 - DNA, 14 bp, Homo sapiens
tccctgacccgtct

SEQ ID NO: 1733847 - DNA, 16 bp, Homo sapiens
tccctgacctccctct

SEQ ID NO: 1733848 - DNA, 15 bp, Homo sapiens
tccctgaggactgat

SEQ ID NO: 1733849 - DNA, 15 bp, Homo sapiens
tccctgagtcaccag

SEQ ID NO: 1733850 - DNA, 15 bp, Homo sapiens
tccctgatcccaccc

SEQ ID NO: 1733851 - DNA, 16 bp, Homo sapiens
tccctgatcccacccc

SEQ ID NO: 1733852 - DNA, 17 bp, Homo sapiens
tccctgatcccaccccc

SEQ ID NO: 1733853 - DNA, 15 bp, Homo sapiens
tccctgatcccagac

SEQ ID NO: 1733854 - DNA, 20 bp, Homo sapiens
tccctgcaaccaattgaaaa

SEQ ID NO: 1733855 - DNA, 15 bp, Homo sapiens
tccctgcacagcctc

SEQ ID NO: 1733856 - DNA, 16 bp, Homo sapiens
tccctgcacagcctct

SEQ ID NO: 1733857 - DNA, 17 bp, Homo sapiens
tccctgcacagcctcta

SEQ ID NO: 1733858 - DNA, 23 bp, Homo sapiens
tccctgcagatgccaccctagcc

SEQ ID NO: 1733859 - DNA, 21 bp, Homo sapiens
tccctgccacactcagtcccc

SEQ ID NO: 1733860 - DNA, 14 bp, Homo sapiens
tccctgcccctccc

SEQ ID NO: 1733861 - DNA, 18 bp, Homo sapiens
tccctgcccctcccttca

SEQ ID NO: 1733862 - DNA, 18 bp, Homo sapiens
tccctgccgaacacacat

SEQ ID NO: 1733863 - DNA, 22 bp, Homo sapiens
tccctgccttgctgacaataaa

SEQ ID NO: 1733864 - DNA, 22 bp, Homo sapiens
tccctgcggcctccacacctga

SEQ ID NO: 1733865 - DNA, 11 bp, Homo sapiens
tccctgctgaa

SEQ ID NO: 1733866 - DNA, 12 bp, Homo sapiens
tccctgcttcca

SEQ ID NO: 1733867 - DNA, 18 bp, Homo sapiens
tccctgcttccaggaaac

SEQ ID NO: 1733868 - DNA, 21 bp, Homo sapiens
tccctgcttgcacacttcccc

SEQ ID NO: 1733869 - DNA, 13 bp, Homo sapiens
tccctgctttgca

SEQ ID NO: 1733870 - DNA, 18 bp, Homo sapiens
tccctgctttgcatcttt

SEQ ID NO: 1733871 - DNA, 20 bp, Homo sapiens
tccctggaagctctccgagc

SEQ ID NO: 1733872 - DNA, 19 bp, Homo sapiens
tccctggaagctggaagac

SEQ ID NO: 1733873 - DNA, 11 bp, Homo sapiens
tccctggacac

SEQ ID NO: 1733874 - DNA, 12 bp, Homo sapiens
tccctggacaca

SEQ ID NO: 1733875 - DNA, 19 bp, Homo sapiens
tccctggacaggcagcctc

SEQ ID NO: 1733876 - DNA, 23 bp, Homo sapiens
tccctggacaggcagcctccttt

SEQ ID NO: 1733877 - DNA, 16 bp, Homo sapiens
tccctggagcaggagc

SEQ ID NO: 1733878 - DNA, 19 bp, Homo sapiens
tccctggagcaggagcccc

SEQ ID NO: 1733879 - DNA, 21 bp, Homo sapiens
tccctggagcctccactgcct

SEQ ID NO: 1733880 - DNA, 19 bp, Homo sapiens
tccctggagctgtccttca

SEQ ID NO: 1733881 - DNA, 19 bp, Homo sapiens
tccctggaggcacgcacca

SEQ ID NO: 1733882 - DNA, 21 bp, Homo sapiens
tccctggaggcacgcaccact

SEQ ID NO: 1733883 - DNA, 17 bp, Homo sapiens
tccctggagtcagggtg

SEQ ID NO: 1733884 - DNA, 21 bp, Homo sapiens
tccctggatgtgtggggcatg

SEQ ID NO: 1733885 - DNA, 22 bp, Homo sapiens
tccctggctacttcccttcctc

SEQ ID NO: 1733886 - DNA, 18 bp, Homo sapiens
tccctggctctcagaagg

SEQ ID NO: 1733887 - DNA, 19 bp, Homo sapiens
tccctggctgccctggccc

SEQ ID NO: 1733888 - DNA, 11 bp, Homo sapiens
tccctggcttg

SEQ ID NO: 1733889 - DNA, 19 bp, Homo sapiens
tccctggcttgtaactcca

SEQ ID NO: 1733890 - DNA, 19 bp, Homo sapiens
tccctgggaggaaatttga

SEQ ID NO: 1733891 - DNA, 16 bp, Homo sapiens
tccctgggagggaggt

SEQ ID NO: 1733892 - DNA, 13 bp, Homo sapiens
tccctgggcctca

SEQ ID NO: 1733893 - DNA, 15 bp, Homo sapiens
tccctgggctgtgct

SEQ ID NO: 1733894 - DNA, 20 bp, Homo sapiens
tccctgggctgtgctacctg

SEQ ID NO: 1733895 - DNA, 18 bp, Homo sapiens
tccctggggaccaggagc

SEQ ID NO: 1733896 - DNA, 20 bp, Homo sapiens
tccctggggaccaggagcta

SEQ ID NO: 1733897 - DNA, 20 bp, Homo sapiens
tccctgggggaagccctgga

SEQ ID NO: 1733898 - DNA, 19 bp, Homo sapiens
tccctgggggccccaggat

SEQ ID NO: 1733899 - DNA, 22 bp, Homo sapiens
tccctgggggccttgggtgagt

SEQ ID NO: 1733900 - DNA, 16 bp, Homo sapiens
tccctggtgcctctgt

SEQ ID NO: 1733901 - DNA, 22 bp, Homo sapiens
tccctgtaaattgcagaattca

SEQ ID NO: 1733902 - DNA, 14 bp, Homo sapiens
tccctgtagctctg

SEQ ID NO: 1733903 - DNA, 17 bp, Homo sapiens
tccctgtagctctgcct

SEQ ID NO: 1733904 - DNA, 18 bp, Homo sapiens
tccctgtagctctgcctc

SEQ ID NO: 1733905 - DNA, 19 bp, Homo sapiens
tccctgtagggtccaacca

SEQ ID NO: 1733906 - DNA, 14 bp, Homo sapiens
tccctgtcaccaag

SEQ ID NO: 1733907 - DNA, 15 bp, Homo sapiens
tccctgtcaccaagc

SEQ ID NO: 1733908 - DNA, 15 bp, Homo sapiens
tccctgtcacgctca

SEQ ID NO: 1733909 - DNA, 15 bp, Homo sapiens
tccctgtcagaggct

SEQ ID NO: 1733910 - DNA, 15 bp, Homo sapiens
tccctgtcccagttg

SEQ ID NO: 1733911 - DNA, 14 bp, Homo sapiens
tccctgtccctcta

SEQ ID NO: 1733912 - DNA, 23 bp, Homo sapiens
tccctgtcccttcgagtccagga

SEQ ID NO: 1733913 - DNA, 18 bp, Homo sapiens
tccctgtcgcgtctcatt

SEQ ID NO: 1733914 - DNA, 23 bp, Homo sapiens
tccctgtctccagctgcctgggc

SEQ ID NO: 1733915 - DNA, 13 bp, Homo sapiens
tccctgtctgtgt

SEQ ID NO: 1733916 - DNA, 23 bp, Homo sapiens
tccctgtctgtgtcccagccacg

SEQ ID NO: 1733917 - DNA, 18 bp, Homo sapiens
tccctgtgatggccaggc

SEQ ID NO: 1733918 - DNA, 20 bp, Homo sapiens
tccctgtggggcaggagtgc

SEQ ID NO: 1733919 - DNA, 21 bp, Homo sapiens
tccctgttatttttctgccct

SEQ ID NO: 1733920 - DNA, 23 bp, Homo sapiens
tccctgttatttttctgccctgg

SEQ ID NO: 1733921 - DNA, 16 bp, Homo sapiens
tccctgttccccagag

SEQ ID NO: 1733922 - DNA, 18 bp, Homo sapiens
tccctgttggtcggtggg

SEQ ID NO: 1733923 - DNA, 14 bp, Homo sapiens
tccctgttttagtt

SEQ ID NO: 1733924 - DNA, 21 bp, Homo sapiens
tctctgcaatttgtttaaaga

SEQ ID NO: 1733925 - DNA, 22 bp, Homo sapiens
tctctgcaatttgtttaaagaa

SEQ ID NO: 1733926 - DNA, 20 bp, Homo sapiens
tctctgcacccagtgaacac

SEQ ID NO: 1733927 - DNA, 15 bp, Homo sapiens
tctctgcagccagcc

SEQ ID NO: 1733928 - DNA, 18 bp, Homo sapiens
tctctgcagccagcccag

SEQ ID NO: 1733929 - DNA, 12 bp, Homo sapiens
tctctgcagctg

SEQ ID NO: 1733930 - DNA, 18 bp, Homo sapiens
tctctgcatctactccca

SEQ ID NO: 1733931 - DNA, 13 bp, Homo sapiens
tctctgccaagat

SEQ ID NO: 1733932 - DNA, 21 bp, Homo sapiens
tctctgccagtgacagacagg

SEQ ID NO: 1733933 - DNA, 14 bp, Homo sapiens
tctctgcccagccg

SEQ ID NO: 1733934 - DNA, 18 bp, Homo sapiens
tctctgcccagccgggca

SEQ ID NO: 1733935 - DNA, 14 bp, Homo sapiens
tctctgccctgtgt

SEQ ID NO: 1733936 - DNA, 11 bp, Homo sapiens
tctctgcctgt

SEQ ID NO: 1733937 - DNA, 13 bp, Homo sapiens
tctctgcgctgag

SEQ ID NO: 1733938 - DNA, 12 bp, Homo sapiens
tctctgctccac

SEQ ID NO: 1733939 - DNA, 20 bp, Homo sapiens
tctctgctctagccaggagt

SEQ ID NO: 1733940 - DNA, 14 bp, Homo sapiens
tctctgctggcagg

SEQ ID NO: 1733941 - DNA, 12 bp, Homo sapiens
tctctgctggcc

SEQ ID NO: 1733942 - DNA, 18 bp, Homo sapiens
tctctgcttacccttcac

SEQ ID NO: 1733943 - DNA, 14 bp, Homo sapiens
tctctgctttaaag

SEQ ID NO: 1733944 - DNA, 19 bp, Homo sapiens
tctctggaagcccctgggc

SEQ ID NO: 1733945 - DNA, 20 bp, Homo sapiens
tctctggaagcccctgggcc

SEQ ID NO: 1733946 - DNA, 21 bp, Homo sapiens
tctctggaaggccccttccct

SEQ ID NO: 1733947 - DNA, 17 bp, Homo sapiens
tctctggctcaggtgtg

SEQ ID NO: 1733948 - DNA, 22 bp, Homo sapiens
tctctggctgtaaggctctaga

SEQ ID NO: 1733949 - DNA, 13 bp, Homo sapiens
tctctggcttctc

SEQ ID NO: 1733950 - DNA, 23 bp, Homo sapiens
tctctgggactctcctcctcccc

SEQ ID NO: 1733951 - DNA, 14 bp, Homo sapiens
tctctgggagaaaa

SEQ ID NO: 1733952 - DNA, 17 bp, Homo sapiens
tctctgggagaaaatca

SEQ ID NO: 1733953 - DNA, 19 bp, Homo sapiens
tctctgggagaaaatcatc

SEQ ID NO: 1733954 - DNA, 12 bp, Homo sapiens
tctctgggctgc

SEQ ID NO: 1733955 - DNA, 18 bp, Homo sapiens
tctctgggctgtcagctt

SEQ ID NO: 1733956 - DNA, 16 bp, Homo sapiens
tctctgggtcagaacc

SEQ ID NO: 1733957 - DNA, 18 bp, Homo sapiens
tctctgggtcagaaccag

SEQ ID NO: 1733958 - DNA, 19 bp, Homo sapiens
tctctgggtctgattttct

SEQ ID NO: 1733959 - DNA, 21 bp, Homo sapiens
tctctgtacttttcattctct

SEQ ID NO: 1733960 - DNA, 15 bp, Homo sapiens
tctctgtcccttgct

SEQ ID NO: 1733961 - DNA, 17 bp, Homo sapiens
tctctgtcccttgctgt

SEQ ID NO: 1733962 - DNA, 18 bp, Homo sapiens
tctctgtcccttgctgta

SEQ ID NO: 1733963 - DNA, 11 bp, Homo sapiens
tctctgtcctc

SEQ ID NO: 1733964 - DNA, 19 bp, Homo sapiens
tctctgtgagaaggtttat

SEQ ID NO: 1733965 - DNA, 13 bp, Homo sapiens
tctctgtgctctg

SEQ ID NO: 1733966 - DNA, 20 bp, Homo sapiens
tctctgtggaagcaaggctg

SEQ ID NO: 1733967 - DNA, 20 bp, Homo sapiens
tctctgtgtctaagattcta

SEQ ID NO: 1733968 - DNA, 21 bp, Homo sapiens
tctctgtgtctaagattctag

SEQ ID NO: 1733969 - DNA, 21 bp, Homo sapiens
tctctgttcagatgtgcattt

SEQ ID NO: 1733970 - DNA, 20 bp, Homo sapiens
tctctgttctgtttggcact

SEQ ID NO: 1733971 - DNA, 13 bp, Homo sapiens
tctcttacctgtt

SEQ ID NO: 1733972 - DNA, 12 bp, Homo sapiens
tctcttagaaaa

SEQ ID NO: 1733973 - DNA, 13 bp, Homo sapiens
tctcttagaaata

SEQ ID NO: 1733974 - DNA, 20 bp, Homo sapiens
tctcttagctactgtatgca

SEQ ID NO: 1733975 - DNA, 21 bp, Homo sapiens
tctcttatagaatatttatta

SEQ ID NO: 1733976 - DNA, 18 bp, Homo sapiens
tctcttatcctctctctc

SEQ ID NO: 1733977 - DNA, 17 bp, Homo sapiens
tctcttcactaccctga

SEQ ID NO: 1733978 - DNA, 21 bp, Homo sapiens
tctcttcactaccctgattct

SEQ ID NO: 1733979 - DNA, 22 bp, Homo sapiens
tctcttcactaccctgattctt

SEQ ID NO: 1733980 - DNA, 13 bp, Homo sapiens
tctcttcactccc

SEQ ID NO: 1733981 - DNA, 16 bp, Homo sapiens
tctcttcaggttctta

SEQ ID NO: 1733982 - DNA, 9 bp, Homo sapiens
tctcttcat

SEQ ID NO: 1733983 - DNA, 19 bp, Homo sapiens
tctcttcatgcttgacata

SEQ ID NO: 1733984 - DNA, 19 bp, Homo sapiens
tctcttcattattctctgc

SEQ ID NO: 1733985 - DNA, 16 bp, Homo sapiens
tctcttccccttcctg

SEQ ID NO: 1733986 - DNA, 12 bp, Homo sapiens
tctcttccctga

SEQ ID NO: 1733987 - DNA, 20 bp, Homo sapiens
tctcttcccttcccagacca

SEQ ID NO: 1733988 - DNA, 15 bp, Homo sapiens
tctcttctccactgg

SEQ ID NO: 1733989 - DNA, 14 bp, Homo sapiens
tctcttctctcttc

SEQ ID NO: 1733990 - DNA, 16 bp, Homo sapiens
tctcttctgctccacc

SEQ ID NO: 1733991 - DNA, 17 bp, Homo sapiens
tctcttctgggcgtctg

SEQ ID NO: 1733992 - DNA, 19 bp, Homo sapiens
tctcttctgggcgtctgag

SEQ ID NO: 1733993 - DNA, 14 bp, Homo sapiens
tctcttcttgctat

SEQ ID NO: 1733994 - DNA, 13 bp, Homo sapiens
tctcttctttaaa

SEQ ID NO: 1733995 - DNA, 12 bp, Homo sapiens
tctcttgaaacc

SEQ ID NO: 1733996 - DNA, 23 bp, Homo sapiens
tctcttgaataaagtattctagt

SEQ ID NO: 1733997 - DNA, 15 bp, Homo sapiens
tctcttgagtttgtc

SEQ ID NO: 1733998 - DNA, 15 bp, Homo sapiens
tctcttgcacccgcc

SEQ ID NO: 1733999 - DNA, 17 bp, Homo sapiens
tctcttgcacccgcctc

SEQ ID NO: 1734000 - DNA, 22 bp, Homo sapiens
tctcttgcacccgcctctcccg

SEQ ID NO: 1734001 - DNA, 22 bp, Homo sapiens
tctcttgtataagatcctagat

SEQ ID NO: 1734002 - DNA, 20 bp, Homo sapiens
tctcttgtcctcttctgctc

SEQ ID NO: 1734003 - DNA, 19 bp, Homo sapiens
tctctttaaaaggaaagaa

SEQ ID NO: 1734004 - DNA, 14 bp, Homo sapiens
tctctttaaactat

SEQ ID NO: 1734005 - DNA, 17 bp, Homo sapiens
tctctttatacagctgt

SEQ ID NO: 1734006 - DNA, 15 bp, Homo sapiens
tctctttcctccacc

SEQ ID NO: 1734007 - DNA, 22 bp, Homo sapiens
tctctttccttgagctgttgtg

SEQ ID NO: 1734008 - DNA, 10 bp, Homo sapiens
tctctttctc

SEQ ID NO: 1734009 - DNA, 14 bp, Homo sapiens
tctctttctctcct

SEQ ID NO: 1734010 - DNA, 18 bp, Homo sapiens
tctctttgataacaaaaa

SEQ ID NO: 1734011 - DNA, 17 bp, Homo sapiens
tctctttgttctaaaga

SEQ ID NO: 1734012 - DNA, 20 bp, Homo sapiens
tctcttttatatttgtagga

SEQ ID NO: 1734013 - DNA, 14 bp, Homo sapiens
tctcttttcaagaa

SEQ ID NO: 1734014 - DNA, 22 bp, Homo sapiens
tctcttttccactccattgtcg

SEQ ID NO: 1734015 - DNA, 22 bp, Homo sapiens
tctcttttcccctttcctgtcc

SEQ ID NO: 1734016 - DNA, 14 bp, Homo sapiens
tctcttttgaaagt

SEQ ID NO: 1734017 - DNA, 22 bp, Homo sapiens
tctcttttgaatccatgcttgg

SEQ ID NO: 1734018 - DNA, 15 bp, Homo sapiens
tctcttttgctttct

SEQ ID NO: 1734019 - DNA, 18 bp, Homo sapiens
tctcttttgctttctgtt

SEQ ID NO: 1734020 - DNA, 14 bp, Homo sapiens
tctctttttgtttg

SEQ ID NO: 1734021 - DNA, 15 bp, Homo sapiens
tctgaaaagtgtgta

SEQ ID NO: 1734022 - DNA, 14 bp, Homo sapiens
tctgaaaatatttt

SEQ ID NO: 1734023 - DNA, 23 bp, Homo sapiens
tctgaaaatgtatgtgtaagtat

SEQ ID NO: 1734024 - DNA, 22 bp, Homo sapiens
tctgaaaattccagaaaggata

SEQ ID NO: 1734025 - DNA, 17 bp, Homo sapiens
tctgaaacacacgagca

SEQ ID NO: 1734026 - DNA, 18 bp, Homo sapiens
tctgaaagagtctttctt

SEQ ID NO: 1734027 - DNA, 23 bp, Homo sapiens
tctgaaataaaatgccatagttt

SEQ ID NO: 1734028 - DNA, 18 bp, Homo sapiens
tctgaaataggaaacaag

SEQ ID NO: 1734029 - DNA, 16 bp, Homo sapiens
tctgaaccccctttcc

SEQ ID NO: 1734030 - DNA, 22 bp, Homo sapiens
tctgaacccttgtgcttggtgg

SEQ ID NO: 1734031 - DNA, 14 bp, Homo sapiens
tctgaactcaaact

SEQ ID NO: 1734032 - DNA, 17 bp, Homo sapiens
tctgaactccatacagc

SEQ ID NO: 1734033 - DNA, 15 bp, Homo sapiens
tctgaactctgacag

SEQ ID NO: 1734034 - DNA, 13 bp, Homo sapiens
tctgaactgttac

SEQ ID NO: 1734035 - DNA, 18 bp, Homo sapiens
tctgaactgttacaactt

SEQ ID NO: 1734036 - DNA, 17 bp, Homo sapiens
tctgaacttgccttaaa

SEQ ID NO: 1734037 - DNA, 22 bp, Homo sapiens
tctgaagagtgggtttcacaag

SEQ ID NO: 1734038 - DNA, 19 bp, Homo sapiens
tctgaagatcagaacattc

SEQ ID NO: 1734039 - DNA, 15 bp, Homo sapiens
tcctcttccatgctg

SEQ ID NO: 1734040 - DNA, 14 bp, Homo sapiens
tcctcttcctgccc

SEQ ID NO: 1734041 - DNA, 19 bp, Homo sapiens
tcctcttcgtggttgtgtt

SEQ ID NO: 1734042 - DNA, 18 bp, Homo sapiens
tcctcttctgctcttttc

SEQ ID NO: 1734043 - DNA, 14 bp, Homo sapiens
tcctcttgctcaaa

SEQ ID NO: 1734044 - DNA, 14 bp, Homo sapiens
tcctcttggagctg

SEQ ID NO: 1734045 - DNA, 20 bp, Homo sapiens
tcctcttggccatccttctg

SEQ ID NO: 1734046 - DNA, 16 bp, Homo sapiens
tcctcttggtgggtgt

SEQ ID NO: 1734047 - DNA, 22 bp, Homo sapiens
tcctcttggtgggtgtggccag

SEQ ID NO: 1734048 - DNA, 13 bp, Homo sapiens
tcctcttgtccta

SEQ ID NO: 1734049 - DNA, 18 bp, Homo sapiens
tcctcttgtcctggccct

SEQ ID NO: 1734050 - DNA, 20 bp, Homo sapiens
tcctcttgtcctggcccttc

SEQ ID NO: 1734051 - DNA, 21 bp, Homo sapiens
tcctcttgtcctggcccttca

SEQ ID NO: 1734052 - DNA, 23 bp, Homo sapiens
tcctcttgtcctggcccttcagt

SEQ ID NO: 1734053 - DNA, 14 bp, Homo sapiens
tcctctttctgctc

SEQ ID NO: 1734054 - DNA, 21 bp, Homo sapiens
tcctcttttatcttggactga

SEQ ID NO: 1734055 - DNA, 18 bp, Homo sapiens
tcctgaaagaaacagtta

SEQ ID NO: 1734056 - DNA, 14 bp, Homo sapiens
tcctgaaatttcag

SEQ ID NO: 1734057 - DNA, 16 bp, Homo sapiens
tcctgaaccgcacagc

SEQ ID NO: 1734058 - DNA, 20 bp, Homo sapiens
tcctgaaccgcacagctcag

SEQ ID NO: 1734059 - DNA, 21 bp, Homo sapiens
tcctgaaccgcacagctcagg

SEQ ID NO: 1734060 - DNA, 19 bp, Homo sapiens
tcctgaactcttctgcaaa

SEQ ID NO: 1734061 - DNA, 13 bp, Homo sapiens
tcctgaagaatta

SEQ ID NO: 1734062 - DNA, 14 bp, Homo sapiens
tcctgaagaattaa

SEQ ID NO: 1734063 - DNA, 19 bp, Homo sapiens
tcctgaagaggcgggccag

SEQ ID NO: 1734064 - DNA, 20 bp, Homo sapiens
tcctgaagaggcgggccagc

SEQ ID NO: 1734065 - DNA, 21 bp, Homo sapiens
tcctgaagaggcgggccagcc

SEQ ID NO: 1734066 - DNA, 22 bp, Homo sapiens
tcctgaagaggcgggccagcca

SEQ ID NO: 1734067 - DNA, 14 bp, Homo sapiens
tcctgaagctgctg

SEQ ID NO: 1734068 - DNA, 14 bp, Homo sapiens
tcctgaagggaact

SEQ ID NO: 1734069 - DNA, 13 bp, Homo sapiens
tcctgaatatttt

SEQ ID NO: 1734070 - DNA, 16 bp, Homo sapiens
tcctgaatattttttg

SEQ ID NO: 1734071 - DNA, 15 bp, Homo sapiens
tcctgaattctattt

SEQ ID NO: 1734072 - DNA, 16 bp, Homo sapiens
tcctgacagaaggtgc

SEQ ID NO: 1734073 - DNA, 13 bp, Homo sapiens
tcctgacatttgt

SEQ ID NO: 1734074 - DNA, 16 bp, Homo sapiens
tcctgaccaccctccc

SEQ ID NO: 1734075 - DNA, 11 bp, Homo sapiens
tcctgaccagc

SEQ ID NO: 1734076 - DNA, 21 bp, Homo sapiens
tcctgaccataatcctagccc

SEQ ID NO: 1734077 - DNA, 13 bp, Homo sapiens
tcctgacccaggc

SEQ ID NO: 1734078 - DNA, 14 bp, Homo sapiens
tcctgacccaggcc

SEQ ID NO: 1734079 - DNA, 15 bp, Homo sapiens
tcctgacccaggccg

SEQ ID NO: 1734080 - DNA, 17 bp, Homo sapiens
tcctgacccaggccgca

SEQ ID NO: 1734081 - DNA, 19 bp, Homo sapiens
tcctgacccaggccgcagc

SEQ ID NO: 1734082 - DNA, 14 bp, Homo sapiens
tcctgacccagtcc

SEQ ID NO: 1734083 - DNA, 16 bp, Homo sapiens
tcctgacccctgcctg

SEQ ID NO: 1734084 - DNA, 20 bp, Homo sapiens
tcctgacctccgccatccac

SEQ ID NO: 1734085 - DNA, 20 bp, Homo sapiens
tcctgacctgtctcaccatg

SEQ ID NO: 1734086 - DNA, 21 bp, Homo sapiens
tcctgacggcgcccccagtgt

SEQ ID NO: 1734087 - DNA, 22 bp, Homo sapiens
tcctgacggcgcccccagtgtg

SEQ ID NO: 1734088 - DNA, 20 bp, Homo sapiens
tcctgactctcacctgtact

SEQ ID NO: 1734089 - DNA, 14 bp, Homo sapiens
tcctgactggtgct

SEQ ID NO: 1734090 - DNA, 15 bp, Homo sapiens
tcctgagaaagctca

SEQ ID NO: 1734091 - DNA, 13 bp, Homo sapiens
tcctgagaagcat

SEQ ID NO: 1734092 - DNA, 17 bp, Homo sapiens
tcctgagaaggcgagga

SEQ ID NO: 1734093 - DNA, 20 bp, Homo sapiens
tcctgagagacctgccctct

SEQ ID NO: 1734094 - DNA, 21 bp, Homo sapiens
tcctgagagacctgccctctc

SEQ ID NO: 1734095 - DNA, 15 bp, Homo sapiens
tcctgagccccctgc

SEQ ID NO: 1734096 - DNA, 18 bp, Homo sapiens
tcctgagctgtcgctgcc

SEQ ID NO: 1734097 - DNA, 21 bp, Homo sapiens
tcctgagctgtcgctgcctcc

SEQ ID NO: 1734098 - DNA, 18 bp, Homo sapiens
tcctgaggagccctgagg

SEQ ID NO: 1734099 - DNA, 17 bp, Homo sapiens
tcctgagggttttctca

SEQ ID NO: 1734100 - DNA, 20 bp, Homo sapiens
tcctgagtagatgggactac

SEQ ID NO: 1734101 - DNA, 15 bp, Homo sapiens
tcctgagtggtgcca

SEQ ID NO: 1734102 - DNA, 17 bp, Homo sapiens
tcctgagtgtggacttg

SEQ ID NO: 1734103 - DNA, 18 bp, Homo sapiens
tcctgataaagcacagct

SEQ ID NO: 1734104 - DNA, 17 bp, Homo sapiens
tcctgataataattgat

SEQ ID NO: 1734105 - DNA, 18 bp, Homo sapiens
tcctgatagtcacctgct

SEQ ID NO: 1734106 - DNA, 23 bp, Homo sapiens
tcctgatatgatttaaaacatgt

SEQ ID NO: 1734107 - DNA, 17 bp, Homo sapiens
tcctgatgatgattctt

SEQ ID NO: 1734108 - DNA, 15 bp, Homo sapiens
tcctgatgcccctga

SEQ ID NO: 1734109 - DNA, 14 bp, Homo sapiens
tcctgatggccaag

SEQ ID NO: 1734110 - DNA, 14 bp, Homo sapiens
tcctgattcctctc

SEQ ID NO: 1734111 - DNA, 23 bp, Homo sapiens
tcctgatttctagaacccgtgac

SEQ ID NO: 1734112 - DNA, 15 bp, Homo sapiens
tcctgatttctctga

SEQ ID NO: 1734113 - DNA, 18 bp, Homo sapiens
tcctgatttctctgaaca

SEQ ID NO: 1734114 - DNA, 13 bp, Homo sapiens
tcctgattttgta

SEQ ID NO: 1734115 - DNA, 17 bp, Homo sapiens
tcctgcaattctacagt

SEQ ID NO: 1734116 - DNA, 23 bp, Homo sapiens
tcctgcacacagaatgctcaggg

SEQ ID NO: 1734117 - DNA, 19 bp, Homo sapiens
tcctgcagcaaacactcca

SEQ ID NO: 1734118 - DNA, 20 bp, Homo sapiens
tcctgcagcaaacactccac

SEQ ID NO: 1734119 - DNA, 18 bp, Homo sapiens
tcctgcagcctcctcctg

SEQ ID NO: 1734120 - DNA, 17 bp, Homo sapiens
tcctgcaggaacgagca

SEQ ID NO: 1734121 - DNA, 22 bp, Homo sapiens
tcctgcagggccagacctgcct

SEQ ID NO: 1734122 - DNA, 19 bp, Homo sapiens
tcctgcagggcttctcctc

SEQ ID NO: 1734123 - DNA, 16 bp, Homo sapiens
tcctgcatctctgtga

SEQ ID NO: 1734124 - DNA, 11 bp, Homo sapiens
tcctgccaaaa

SEQ ID NO: 1734125 - DNA, 12 bp, Homo sapiens
tcctgccacccc

SEQ ID NO: 1734126 - DNA, 16 bp, Homo sapiens
tcctgccaccccttcc

SEQ ID NO: 1734127 - DNA, 14 bp, Homo sapiens
tctatttgtacaat

SEQ ID NO: 1734128 - DNA, 15 bp, Homo sapiens
tctattttaaaataa

SEQ ID NO: 1734129 - DNA, 17 bp, Homo sapiens
tctattttaattactgc

SEQ ID NO: 1734130 - DNA, 16 bp, Homo sapiens
tctattttactgtctt

SEQ ID NO: 1734131 - DNA, 15 bp, Homo sapiens
tctcaaaacaaaaca

SEQ ID NO: 1734132 - DNA, 24 bp, Homo sapiens
tctcaaaacaatattactttgtct

SEQ ID NO: 1734133 - DNA, 14 bp, Homo sapiens
tctcaaaagaggtt

SEQ ID NO: 1734134 - DNA, 17 bp, Homo sapiens
tctcaaaagaggttact

SEQ ID NO: 1734135 - DNA, 20 bp, Homo sapiens
tctcaaaagaggttacttta

SEQ ID NO: 1734136 - DNA, 23 bp, Homo sapiens
tctcaaacacagttacacttgtg

SEQ ID NO: 1734137 - DNA, 20 bp, Homo sapiens
tctcaaaccaagcaaaggaa

SEQ ID NO: 1734138 - DNA, 17 bp, Homo sapiens
tctcaaagagattcgaa

SEQ ID NO: 1734139 - DNA, 14 bp, Homo sapiens
tctcaaaggagaaa

SEQ ID NO: 1734140 - DNA, 15 bp, Homo sapiens
tctcaaaggccctca

SEQ ID NO: 1734141 - DNA, 20 bp, Homo sapiens
tctcaaaggtaattctgaac

SEQ ID NO: 1734142 - DNA, 20 bp, Homo sapiens
tctcaaataggctattaaaa

SEQ ID NO: 1734143 - DNA, 23 bp, Homo sapiens
tctcaaatccctctccaactgcc

SEQ ID NO: 1734144 - DNA, 18 bp, Homo sapiens
tctcaacatgtctcctac

SEQ ID NO: 1734145 - DNA, 23 bp, Homo sapiens
tctcaagaaagccctcattttta

SEQ ID NO: 1734146 - DNA, 19 bp, Homo sapiens
tctcaagaatctagaagat

SEQ ID NO: 1734147 - DNA, 22 bp, Homo sapiens
tctcaagaatctagaagatgtg

SEQ ID NO: 1734148 - DNA, 18 bp, Homo sapiens
tctcaagacctgagtatt

SEQ ID NO: 1734149 - DNA, 12 bp, Homo sapiens
tctcaagacttt

SEQ ID NO: 1734150 - DNA, 23 bp, Homo sapiens
tctcaagaggcagagttctgtga

SEQ ID NO: 1734151 - DNA, 17 bp, Homo sapiens
tctcaagatattcaggt

SEQ ID NO: 1734152 - DNA, 21 bp, Homo sapiens
tctcaagatgggggcagggct

SEQ ID NO: 1734153 - DNA, 22 bp, Homo sapiens
tctcaagatgggggcagggctg

SEQ ID NO: 1734154 - DNA, 15 bp, Homo sapiens
tctcaagtagctggg

SEQ ID NO: 1734155 - DNA, 18 bp, Homo sapiens
tctcaagtatatgtcatt

SEQ ID NO: 1734156 - DNA, 22 bp, Homo sapiens
tctcaagtgatgagacagtgaa

SEQ ID NO: 1734157 - DNA, 12 bp, Homo sapiens
tctcaagttcta

SEQ ID NO: 1734158 - DNA, 14 bp, Homo sapiens
tctcaagttctaag

SEQ ID NO: 1734159 - DNA, 16 bp, Homo sapiens
tctcaagttctaagat

SEQ ID NO: 1734160 - DNA, 18 bp, Homo sapiens
tctcaagttctaagattc

SEQ ID NO: 1734161 - DNA, 20 bp, Homo sapiens
tctcaagttctaagattcta

SEQ ID NO: 1734162 - DNA, 22 bp, Homo sapiens
tctcaagttctaagattctaat

SEQ ID NO: 1734163 - DNA, 13 bp, Homo sapiens
tctcaatcagtgc

SEQ ID NO: 1734164 - DNA, 15 bp, Homo sapiens
tctcaatcagtgcag

SEQ ID NO: 1734165 - DNA, 21 bp, Homo sapiens
tctcaatgaaccataaattca

SEQ ID NO: 1734166 - DNA, 12 bp, Homo sapiens
tctcacaaacat

SEQ ID NO: 1734167 - DNA, 12 bp, Homo sapiens
tctcacacacat

SEQ ID NO: 1734168 - DNA, 23 bp, Homo sapiens
tctcacacccaccgtccgccctg

SEQ ID NO: 1734169 - DNA, 17 bp, Homo sapiens
tctcacactgaatcagc

SEQ ID NO: 1734170 - DNA, 18 bp, Homo sapiens
tctcacagagaagctcct

SEQ ID NO: 1734171 - DNA, 19 bp, Homo sapiens
tctcacagtgggagccagg

SEQ ID NO: 1734172 - DNA, 22 bp, Homo sapiens
tctcacagtgggagccagggct

SEQ ID NO: 1734173 - DNA, 23 bp, Homo sapiens
tctcacagtgggagccagggctg

SEQ ID NO: 1734174 - DNA, 22 bp, Homo sapiens
tctcacccatgcaagcagagga

SEQ ID NO: 1734175 - DNA, 20 bp, Homo sapiens
tctcacccattatctggaat

SEQ ID NO: 1734176 - DNA, 13 bp, Homo sapiens
tctcaccccagga

SEQ ID NO: 1734177 - DNA, 14 bp, Homo sapiens
tctcaccccaggat

SEQ ID NO: 1734178 - DNA, 19 bp, Homo sapiens
tctcaccccatcccacacc

SEQ ID NO: 1734179 - DNA, 14 bp, Homo sapiens
tctcaccctgtgaa

SEQ ID NO: 1734180 - DNA, 21 bp, Homo sapiens
tctcaccggctctcacctggc

SEQ ID NO: 1734181 - DNA, 12 bp, Homo sapiens
tctcacctcagc

SEQ ID NO: 1734182 - DNA, 14 bp, Homo sapiens
tctcacctggccct

SEQ ID NO: 1734183 - DNA, 19 bp, Homo sapiens
tctcacctggccctgcttc

SEQ ID NO: 1734184 - DNA, 23 bp, Homo sapiens
tctcactaaagcatgaaatgtga

SEQ ID NO: 1734185 - DNA, 17 bp, Homo sapiens
tctcactatatatattt

SEQ ID NO: 1734186 - DNA, 24 bp, Homo sapiens
tctcactcaccactaccagccagc

SEQ ID NO: 1734187 - DNA, 18 bp, Homo sapiens
tctcactccaccacccaa

SEQ ID NO: 1734188 - DNA, 17 bp, Homo sapiens
tctcactcctacctggt

SEQ ID NO: 1734189 - DNA, 14 bp, Homo sapiens
tctcactgaactcc

SEQ ID NO: 1734190 - DNA, 18 bp, Homo sapiens
tctcactgaactccaccg

SEQ ID NO: 1734191 - DNA, 18 bp, Homo sapiens
tctcactgcttgaactag

SEQ ID NO: 1734192 - DNA, 15 bp, Homo sapiens
tctcactgctttgca

SEQ ID NO: 1734193 - DNA, 15 bp, Homo sapiens
tctcactgtttgttt

SEQ ID NO: 1734194 - DNA, 19 bp, Homo sapiens
tctcactgtttgtttttat

SEQ ID NO: 1734195 - DNA, 13 bp, Homo sapiens
tctcacttgtttc

SEQ ID NO: 1734196 - DNA, 16 bp, Homo sapiens
tctcagaacatactga

SEQ ID NO: 1734197 - DNA, 12 bp, Homo sapiens
tctcagaagcac

SEQ ID NO: 1734198 - DNA, 16 bp, Homo sapiens
tctcagaagcacagaa

SEQ ID NO: 1734199 - DNA, 21 bp, Homo sapiens
tctcagaatcccttaacagtt

SEQ ID NO: 1734200 - DNA, 17 bp, Homo sapiens
tctcagaatctcaaata

SEQ ID NO: 1734201 - DNA, 16 bp, Homo sapiens
tctcagactgcatgta

SEQ ID NO: 1734202 - DNA, 11 bp, Homo sapiens
tctcagagaca

SEQ ID NO: 1734203 - DNA, 14 bp, Homo sapiens
tctcagagacaggt

SEQ ID NO: 1734204 - DNA, 20 bp, Homo sapiens
tctcagagacaggtggccta

SEQ ID NO: 1734205 - DNA, 14 bp, Homo sapiens
tctcagttgtttgc

SEQ ID NO: 1734206 - DNA, 13 bp, Homo sapiens
tctcagtttcact

SEQ ID NO: 1734207 - DNA, 15 bp, Homo sapiens
tctcagttttcataa

SEQ ID NO: 1734208 - DNA, 15 bp, Homo sapiens
tctcataatgctttg

SEQ ID NO: 1734209 - DNA, 15 bp, Homo sapiens
tctcataattttgca

SEQ ID NO: 1734210 - DNA, 17 bp, Homo sapiens
tctcataattttgcaaa

SEQ ID NO: 1734211 - DNA, 19 bp, Homo sapiens
tctcatacctctgaccaac

SEQ ID NO: 1734212 - DNA, 18 bp, Homo sapiens
tctcatactgtctgggat

SEQ ID NO: 1734213 - DNA, 16 bp, Homo sapiens
tctcataggaaaagta

SEQ ID NO: 1734214 - DNA, 21 bp, Homo sapiens
tctcataggaaaagtacattt

SEQ ID NO: 1734215 - DNA, 14 bp, Homo sapiens
tctcataggagact

SEQ ID NO: 1734216 - DNA, 16 bp, Homo sapiens
tctcataggttaaaaa

SEQ ID NO: 1734217 - DNA, 17 bp, Homo sapiens
tctcatcaactgaatga

SEQ ID NO: 1734218 - DNA, 15 bp, Homo sapiens
tctcatcagtgtcct

SEQ ID NO: 1734219 - DNA, 14 bp, Homo sapiens
tctcatccccaggg

SEQ ID NO: 1734220 - DNA, 21 bp, Homo sapiens
tctcatcctccagtaccttgc

SEQ ID NO: 1734221 - DNA, 16 bp, Homo sapiens
tctcatccttttggat

SEQ ID NO: 1734222 - DNA, 19 bp, Homo sapiens
tctcatcgccagacaactg

SEQ ID NO: 1734223 - DNA, 20 bp, Homo sapiens
tctcatctagtacctttgga

SEQ ID NO: 1734224 - DNA, 20 bp, Homo sapiens
tctcatgaagctaataaaat

SEQ ID NO: 1734225 - DNA, 22 bp, Homo sapiens
tctcatgaggggagaggagacg

SEQ ID NO: 1734226 - DNA, 14 bp, Homo sapiens
tctcatgcctcagc

SEQ ID NO: 1734227 - DNA, 23 bp, Homo sapiens
tctcatggaccagtggctggtct

SEQ ID NO: 1734228 - DNA, 12 bp, Homo sapiens
tctcattaaagt

SEQ ID NO: 1734229 - DNA, 10 bp, Homo sapiens
tctcattccc

SEQ ID NO: 1734230 - DNA, 20 bp, Homo sapiens
tctcattccgttgtctgtgg

SEQ ID NO: 1734231 - DNA, 21 bp, Homo sapiens
tctcattcgcctttgtcttgt

SEQ ID NO: 1734232 - DNA, 16 bp, Homo sapiens
tctcattctttgaaca

SEQ ID NO: 1734233 - DNA, 20 bp, Homo sapiens
tctcattctttgaacatgaa

SEQ ID NO: 1734234 - DNA, 18 bp, Homo sapiens
tctcatttagaacttgca

SEQ ID NO: 1734235 - DNA, 19 bp, Homo sapiens
tctcatttcacccctccct

SEQ ID NO: 1734236 - DNA, 20 bp, Homo sapiens
tctcatttggggaggggggt

SEQ ID NO: 1734237 - DNA, 20 bp, Homo sapiens
tctcattttgtccatgtccc

SEQ ID NO: 1734238 - DNA, 16 bp, Homo sapiens
tctccaaactgattaa

SEQ ID NO: 1734239 - DNA, 19 bp, Homo sapiens
tctccaaaggggctgctgg

SEQ ID NO: 1734240 - DNA, 20 bp, Homo sapiens
tctccaaatattattcaagt

SEQ ID NO: 1734241 - DNA, 19 bp, Homo sapiens
tctccaacatcacagccca

SEQ ID NO: 1734242 - DNA, 21 bp, Homo sapiens
tctccaacatcacagcccagc

SEQ ID NO: 1734243 - DNA, 20 bp, Homo sapiens
tctccaaccactgtgccact

SEQ ID NO: 1734244 - DNA, 19 bp, Homo sapiens
tctccaaccccccagcact

SEQ ID NO: 1734245 - DNA, 21 bp, Homo sapiens
tctccaactgcctaaggccct

SEQ ID NO: 1734246 - DNA, 17 bp, Homo sapiens
tctccaagaatggaagc

SEQ ID NO: 1734247 - DNA, 20 bp, Homo sapiens
tctccaagaatggaagcctg

SEQ ID NO: 1734248 - DNA, 20 bp, Homo sapiens
tctccaagggcttctgcacc

SEQ ID NO: 1734249 - DNA, 14 bp, Homo sapiens
tctccaagtgccag

SEQ ID NO: 1734250 - DNA, 22 bp, Homo sapiens
tctccacagtgttgtgcccctt

SEQ ID NO: 1734251 - DNA, 18 bp, Homo sapiens
tctccacctcagccttgg

SEQ ID NO: 1734252 - DNA, 20 bp, Homo sapiens
tctccacctcccccaaaccc

SEQ ID NO: 1734253 - DNA, 22 bp, Homo sapiens
tctccactaaatgagctcctgc

SEQ ID NO: 1734254 - DNA, 19 bp, Homo sapiens
tctccactgctctcagcct

SEQ ID NO: 1734255 - DNA, 19 bp, Homo sapiens
tctccactgtgcacaccca

SEQ ID NO: 1734256 - DNA, 19 bp, Homo sapiens
tctccagatgtttccagac

SEQ ID NO: 1734257 - DNA, 14 bp, Homo sapiens
tctccagcccacgt

SEQ ID NO: 1734258 - DNA, 16 bp, Homo sapiens
tctccagcggccctgt

SEQ ID NO: 1734259 - DNA, 20 bp, Homo sapiens
tctccagcggccctgtcatc

SEQ ID NO: 1734260 - DNA, 12 bp, Homo sapiens
tctccagctgac

SEQ ID NO: 1734261 - DNA, 14 bp, Homo sapiens
tctccagctgacta

SEQ ID NO: 1734262 - DNA, 15 bp, Homo sapiens
tctccagctgactaa

SEQ ID NO: 1734263 - DNA, 15 bp, Homo sapiens
tctccagcttcagct

SEQ ID NO: 1734264 - DNA, 22 bp, Homo sapiens
tctccaggaaggtagcccagca

SEQ ID NO: 1734265 - DNA, 13 bp, Homo sapiens
tctccaggccagg

SEQ ID NO: 1734266 - DNA, 16 bp, Homo sapiens
tctccaggccaggtgg

SEQ ID NO: 1734267 - DNA, 19 bp, Homo sapiens
tctccagggccccccaact

SEQ ID NO: 1734268 - DNA, 20 bp, Homo sapiens
tctccaggggcctgcagaag

SEQ ID NO: 1734269 - DNA, 23 bp, Homo sapiens
tctccaggggcctgcagaaggaa

SEQ ID NO: 1734270 - DNA, 18 bp, Homo sapiens
tctccaggtcagcctgga

SEQ ID NO: 1734271 - DNA, 19 bp, Homo sapiens
tctccaggtcagcctggaa

SEQ ID NO: 1734272 - DNA, 20 bp, Homo sapiens
tctccagttgggactcagga

SEQ ID NO: 1734273 - DNA, 21 bp, Homo sapiens
tctccagttgggactcaggat

SEQ ID NO: 1734274 - DNA, 20 bp, Homo sapiens
tctccatcaccctcttcctg

SEQ ID NO: 1734275 - DNA, 13 bp, Homo sapiens
tctccatcagctg

SEQ ID NO: 1734276 - DNA, 15 bp, Homo sapiens
tctccatgaagagct

SEQ ID NO: 1734277 - DNA, 13 bp, Homo sapiens
tctccatgctgca

SEQ ID NO: 1734278 - DNA, 16 bp, Homo sapiens
tctccatgtttgatgt

SEQ ID NO: 1734279 - DNA, 22 bp, Homo sapiens
tctccattagaaaattttgtaa

SEQ ID NO: 1734280 - DNA, 23 bp, Homo sapiens
tctccattagaaaattttgtaaa

SEQ ID NO: 1734281 - DNA, 22 bp, Homo sapiens
tctcccaactcttgcacagtca

SEQ ID NO: 1734282 - DNA, 14 bp, Homo sapiens
tctcccaagaaacc

SEQ ID NO: 1734283 - DNA, 22 bp, Homo sapiens
tctcccaccccctccccaaagc

SEQ ID NO: 1734284 - DNA, 20 bp, Homo sapiens
tctcccacccggccacagct

SEQ ID NO: 1734285 - DNA, 23 bp, Homo sapiens
tctcccacccggccacagctgct

SEQ ID NO: 1734286 - DNA, 18 bp, Homo sapiens
tctcccagcttcaaatgc

SEQ ID NO: 1734287 - DNA, 21 bp, Homo sapiens
tcccttccagatggtcatcca

SEQ ID NO: 1734288 - DNA, 17 bp, Homo sapiens
tcccttcccagaccagg

SEQ ID NO: 1734289 - DNA, 19 bp, Homo sapiens
tcccttcccagaccaggaa

SEQ ID NO: 1734290 - DNA, 12 bp, Homo sapiens
tcccttcccctc

SEQ ID NO: 1734291 - DNA, 21 bp, Homo sapiens
tcccttcccctccctggctcc

SEQ ID NO: 1734292 - DNA, 22 bp, Homo sapiens
tcccttcctcttcctgcccttg

SEQ ID NO: 1734293 - DNA, 13 bp, Homo sapiens
tcccttcctggaa

SEQ ID NO: 1734294 - DNA, 19 bp, Homo sapiens
tcccttcctggaaacagca

SEQ ID NO: 1734295 - DNA, 21 bp, Homo sapiens
tcccttcctggaaacagcatg

SEQ ID NO: 1734296 - DNA, 23 bp, Homo sapiens
tcccttcctggaaacagcatgaa

SEQ ID NO: 1734297 - DNA, 14 bp, Homo sapiens
tcccttcctggcct

SEQ ID NO: 1734298 - DNA, 17 bp, Homo sapiens
tcccttccttttccctg

SEQ ID NO: 1734299 - DNA, 17 bp, Homo sapiens
tcccttcgagtccagga

SEQ ID NO: 1734300 - DNA, 18 bp, Homo sapiens
tcccttctccccagccag

SEQ ID NO: 1734301 - DNA, 23 bp, Homo sapiens
tcccttctccccagccagaggtg

SEQ ID NO: 1734302 - DNA, 19 bp, Homo sapiens
tcccttctcctttctaagc

SEQ ID NO: 1734303 - DNA, 14 bp, Homo sapiens
tcccttgccctccc

SEQ ID NO: 1734304 - DNA, 20 bp, Homo sapiens
tcccttgccctccctttctc

SEQ ID NO: 1734305 - DNA, 12 bp, Homo sapiens
tcccttgcctca

SEQ ID NO: 1734306 - DNA, 14 bp, Homo sapiens
tcccttgcctctgc

SEQ ID NO: 1734307 - DNA, 21 bp, Homo sapiens
tcccttgcctttcgaggcctg

SEQ ID NO: 1734308 - DNA, 19 bp, Homo sapiens
tcccttgctggccccagcc

SEQ ID NO: 1734309 - DNA, 20 bp, Homo sapiens
tcccttgcttgcctgcaggg

SEQ ID NO: 1734310 - DNA, 18 bp, Homo sapiens
tcccttggaaacctgccc

SEQ ID NO: 1734311 - DNA, 19 bp, Homo sapiens
tcccttggaaacctgccct

SEQ ID NO: 1734312 - DNA, 16 bp, Homo sapiens
tcccttggcccagaga

SEQ ID NO: 1734313 - DNA, 12 bp, Homo sapiens
tcccttggcctc

SEQ ID NO: 1734314 - DNA, 14 bp, Homo sapiens
tcccttggcctcag

SEQ ID NO: 1734315 - DNA, 22 bp, Homo sapiens
tcccttgtgtcaagacatttct

SEQ ID NO: 1734316 - DNA, 13 bp, Homo sapiens
tcccttgtgtgtg

SEQ ID NO: 1734317 - DNA, 17 bp, Homo sapiens
tccctttagctgtgtta

SEQ ID NO: 1734318 - DNA, 17 bp, Homo sapiens
tccctttcatttgctat

SEQ ID NO: 1734319 - DNA, 16 bp, Homo sapiens
tccctttccaacctca

SEQ ID NO: 1734320 - DNA, 14 bp, Homo sapiens
tccctttctcccct

SEQ ID NO: 1734321 - DNA, 16 bp, Homo sapiens
tccctttctcccctgc

SEQ ID NO: 1734322 - DNA, 17 bp, Homo sapiens
tccctttctcccctgcc

SEQ ID NO: 1734323 - DNA, 14 bp, Homo sapiens
tccctttctctctc

SEQ ID NO: 1734324 - DNA, 17 bp, Homo sapiens
tccctttctcttcttcc

SEQ ID NO: 1734325 - DNA, 19 bp, Homo sapiens
tccctttctgcttgtgtta

SEQ ID NO: 1734326 - DNA, 18 bp, Homo sapiens
tccctttgcacctgagac

SEQ ID NO: 1734327 - DNA, 17 bp, Homo sapiens
tccctttgcccagaaag

SEQ ID NO: 1734328 - DNA, 13 bp, Homo sapiens
tcccttttacata

SEQ ID NO: 1734329 - DNA, 18 bp, Homo sapiens
tccctttttctccacact

SEQ ID NO: 1734330 - DNA, 19 bp, Homo sapiens
tccctttttttacatttca

SEQ ID NO: 1734331 - DNA, 21 bp, Homo sapiens
tccgaagtatgagggaaaatg

SEQ ID NO: 1734332 - DNA, 17 bp, Homo sapiens
tccgacatcccagacca

SEQ ID NO: 1734333 - DNA, 20 bp, Homo sapiens
tccgacatcccagaccagcc

SEQ ID NO: 1734334 - DNA, 20 bp, Homo sapiens
tccgaccactaattgccaag

SEQ ID NO: 1734335 - DNA, 15 bp, Homo sapiens
tccgaccctcatggc

SEQ ID NO: 1734336 - DNA, 17 bp, Homo sapiens
tccgaccctcatggccc

SEQ ID NO: 1734337 - DNA, 20 bp, Homo sapiens
tccgaccctcatggccccca

SEQ ID NO: 1734338 - DNA, 15 bp, Homo sapiens
tccgactgctttgga

SEQ ID NO: 1734339 - DNA, 14 bp, Homo sapiens
tccgagagggagag

SEQ ID NO: 1734340 - DNA, 20 bp, Homo sapiens
tccgagcattccagtaactt

SEQ ID NO: 1734341 - DNA, 13 bp, Homo sapiens
tccgaggcagggt

SEQ ID NO: 1734342 - DNA, 21 bp, Homo sapiens
tccgaggctccccgcctccac

SEQ ID NO: 1734343 - DNA, 23 bp, Homo sapiens
tccgagtgtgatttgaattctgt

SEQ ID NO: 1734344 - DNA, 15 bp, Homo sapiens
tccgatcaacattta

SEQ ID NO: 1734345 - DNA, 18 bp, Homo sapiens
tccgatcaacatttatga

SEQ ID NO: 1734346 - DNA, 12 bp, Homo sapiens
tccgattaattt

SEQ ID NO: 1734347 - DNA, 23 bp, Homo sapiens
tccgcaatgtggagcagcagcca

SEQ ID NO: 1734348 - DNA, 15 bp, Homo sapiens
tccgcaccagctgct

SEQ ID NO: 1734349 - DNA, 23 bp, Homo sapiens
tccgcaccagctgctctgcccct

SEQ ID NO: 1734350 - DNA, 16 bp, Homo sapiens
tccgcaggtgctggtc

SEQ ID NO: 1734351 - DNA, 11 bp, Homo sapiens
tccgccactca

SEQ ID NO: 1734352 - DNA, 15 bp, Homo sapiens
tccgccactcagcca

SEQ ID NO: 1734353 - DNA, 16 bp, Homo sapiens
tccgccagcctcctct

SEQ ID NO: 1734354 - DNA, 17 bp, Homo sapiens
tccgccagcctcctctg

SEQ ID NO: 1734355 - DNA, 15 bp, Homo sapiens
tccgccaggcgctgc

SEQ ID NO: 1734356 - DNA, 18 bp, Homo sapiens
tccgcccccgccccacag

SEQ ID NO: 1734357 - DNA, 15 bp, Homo sapiens
tccgccctcctcggg

SEQ ID NO: 1734358 - DNA, 16 bp, Homo sapiens
tccgccctcctcgggc

SEQ ID NO: 1734359 - DNA, 13 bp, Homo sapiens
tccgccctgccac

SEQ ID NO: 1734360 - DNA, 15 bp, Homo sapiens
tccgccctgccactc

SEQ ID NO: 1734361 - DNA, 12 bp, Homo sapiens
tccgccctgctc

SEQ ID NO: 1734362 - DNA, 14 bp, Homo sapiens
tccgccctgctcct

SEQ ID NO: 1734363 - DNA, 15 bp, Homo sapiens
tccgccctgctcctc

SEQ ID NO: 1734364 - DNA, 22 bp, Homo sapiens
tccgccctgctcctccctggct

SEQ ID NO: 1734365 - DNA, 14 bp, Homo sapiens
tccgcctcctgtgt

SEQ ID NO: 1734366 - DNA, 19 bp, Homo sapiens
tccgcgccgatgccaccgg

SEQ ID NO: 1734367 - DNA, 23 bp, Homo sapiens
tccgcgggtcccggccgcgccgc

SEQ ID NO: 1734368 - DNA, 14 bp, Homo sapiens
tccgcgtgtgcctg

SEQ ID NO: 1734369 - DNA, 19 bp, Homo sapiens
tccgcgtgtgcctgtgtgc

SEQ ID NO: 1734370 - DNA, 13 bp, Homo sapiens
tccgctgccacca

SEQ ID NO: 1734371 - DNA, 22 bp, Homo sapiens
tccgctgccaccacgtctgcca

SEQ ID NO: 1734372 - DNA, 23 bp, Homo sapiens
tccgctgccaccacgtctgccag

SEQ ID NO: 1734373 - DNA, 16 bp, Homo sapiens
tccgctgccagccttg

SEQ ID NO: 1734374 - DNA, 20 bp, Homo sapiens
tccgctgcgggcccagctga

SEQ ID NO: 1734375 - DNA, 21 bp, Homo sapiens
tccgctttgaaagaagcaaga

SEQ ID NO: 1734376 - DNA, 14 bp, Homo sapiens
tccggactggcaga

SEQ ID NO: 1734377 - DNA, 15 bp, Homo sapiens
tccggagtagctggg

SEQ ID NO: 1734378 - DNA, 13 bp, Homo sapiens
tccggatttctaa

SEQ ID NO: 1734379 - DNA, 20 bp, Homo sapiens
tccggatttctaacagtcct

SEQ ID NO: 1734380 - DNA, 21 bp, Homo sapiens
tccggccaaggtgccaccacc

SEQ ID NO: 1734381 - DNA, 22 bp, Homo sapiens
tccggcgcagacaggcggggcc

SEQ ID NO: 1734382 - DNA, 18 bp, Homo sapiens
tccggcgtcttgcccagc

SEQ ID NO: 1734383 - DNA, 23 bp, Homo sapiens
tccgggaccattgacctcagctg

SEQ ID NO: 1734384 - DNA, 23 bp, Homo sapiens
tccgggctgggggggctgcctcc

SEQ ID NO: 1734385 - DNA, 15 bp, Homo sapiens
tccggggtctgtgct

SEQ ID NO: 1734386 - DNA, 18 bp, Homo sapiens
tccggggtctgtgctgtg

SEQ ID NO: 1734387 - DNA, 16 bp, Homo sapiens
tccgggtctcgcagcc

SEQ ID NO: 1734388 - DNA, 17 bp, Homo sapiens
tccggtgtgcctgcagc

SEQ ID NO: 1734389 - DNA, 19 bp, Homo sapiens
tccggtgtgcctgcagccc

SEQ ID NO: 1734390 - DNA, 16 bp, Homo sapiens
tccggtttactttaac

SEQ ID NO: 1734391 - DNA, 17 bp, Homo sapiens
tccgtagggtctttctt

SEQ ID NO: 1734392 - DNA, 15 bp, Homo sapiens
tccgtagttccctga

SEQ ID NO: 1734393 - DNA, 12 bp, Homo sapiens
tccgtagtttgt

SEQ ID NO: 1734394 - DNA, 17 bp, Homo sapiens
tccgtagtttgttttct

SEQ ID NO: 1734395 - DNA, 16 bp, Homo sapiens
tccgtatttaaagttg

SEQ ID NO: 1734396 - DNA, 17 bp, Homo sapiens
tccgtcattgctgctgc

SEQ ID NO: 1734397 - DNA, 14 bp, Homo sapiens
tccgtccacccagg

SEQ ID NO: 1734398 - DNA, 18 bp, Homo sapiens
tccgtccacccaggctgc

SEQ ID NO: 1734399 - DNA, 20 bp, Homo sapiens
tccgtccacccaggctgcac

SEQ ID NO: 1734400 - DNA, 21 bp, Homo sapiens
tccgtccacccttccatcagc

SEQ ID NO: 1734401 - DNA, 20 bp, Homo sapiens
tccgtctctcttgcttgagg

SEQ ID NO: 1734402 - DNA, 16 bp, Homo sapiens
tccgtctctgtcctcg

SEQ ID NO: 1734403 - DNA, 12 bp, Homo sapiens
tccgtctgtctc

SEQ ID NO: 1734404 - DNA, 19 bp, Homo sapiens
tccgtgaagggatttctta

SEQ ID NO: 1734405 - DNA, 22 bp, Homo sapiens
tccgtgaagtcacattccacat

SEQ ID NO: 1734406 - DNA, 23 bp, Homo sapiens
tccgtgatccatccatctccagg

SEQ ID NO: 1734407 - DNA, 14 bp, Homo sapiens
tccgtgcttaacca

SEQ ID NO: 1734408 - DNA, 16 bp, Homo sapiens
tccgtgggacggtgcc

SEQ ID NO: 1734409 - DNA, 21 bp, Homo sapiens
tccgtggtcagagtgccactg

SEQ ID NO: 1734410 - DNA, 16 bp, Homo sapiens
tccgtgtgtcccagat

SEQ ID NO: 1734411 - DNA, 17 bp, Homo sapiens
tccgtgtgtcccagatg

SEQ ID NO: 1734412 - DNA, 15 bp, Homo sapiens
tccgttagctcctgt

SEQ ID NO: 1734413 - DNA, 12 bp, Homo sapiens
tccgttaggaat

SEQ ID NO: 1734414 - DNA, 16 bp, Homo sapiens
tccgtttatgggcctt

SEQ ID NO: 1734415 - DNA, 18 bp, Homo sapiens
tccgtttatgggccttgc

SEQ ID NO: 1734416 - DNA, 15 bp, Homo sapiens
tccgtttttttttct

SEQ ID NO: 1734417 - DNA, 16 bp, Homo sapiens
tcctaaaaatctgtgg

SEQ ID NO: 1734418 - DNA, 18 bp, Homo sapiens
tcctaaaaatctgtggca

SEQ ID NO: 1734419 - DNA, 13 bp, Homo sapiens
tcctaaaactggg

SEQ ID NO: 1734420 - DNA, 21 bp, Homo sapiens
tcctaaaactgggattaagaa

SEQ ID NO: 1734421 - DNA, 23 bp, Homo sapiens
tcctaaaactgggattaagaaac

SEQ ID NO: 1734422 - DNA, 11 bp, Homo sapiens
tcctaaacata

SEQ ID NO: 1734423 - DNA, 18 bp, Homo sapiens
tcctaaagagagtatttt

SEQ ID NO: 1734424 - DNA, 12 bp, Homo sapiens
tcctaacaaaag

SEQ ID NO: 1734425 - DNA, 15 bp, Homo sapiens
tcctaacaaaagaac

SEQ ID NO: 1734426 - DNA, 16 bp, Homo sapiens
tcctaacacagcatgt

SEQ ID NO: 1734427 - DNA, 15 bp, Homo sapiens
tcctaacctgtcaga

SEQ ID NO: 1734428 - DNA, 13 bp, Homo sapiens
tcctaagaaagag

SEQ ID NO: 1734429 - DNA, 17 bp, Homo sapiens
tcctaagagtggaggag

SEQ ID NO: 1734430 - DNA, 20 bp, Homo sapiens
tcctaagatgtgttcttatt

SEQ ID NO: 1734431 - DNA, 16 bp, Homo sapiens
tcctaagctattcagt

SEQ ID NO: 1734432 - DNA, 18 bp, Homo sapiens
tcctaagggtcgaaagct

SEQ ID NO: 1734433 - DNA, 20 bp, Homo sapiens
tcctaagggtcgaaagctct

SEQ ID NO: 1734434 - DNA, 21 bp, Homo sapiens
tcctaagggtcgaaagctcta

SEQ ID NO: 1734435 - DNA, 17 bp, Homo sapiens
tcctaatagcttttcct

SEQ ID NO: 1734436 - DNA, 19 bp, Homo sapiens
tcctaatggctatttttga

SEQ ID NO: 1734437 - DNA, 23 bp, Homo sapiens
tcctaattcacacaaagactcct

SEQ ID NO: 1734438 - DNA, 23 bp, Homo sapiens
tcctaattttaaataatttctac

SEQ ID NO: 1734439 - DNA, 15 bp, Homo sapiens
tcctacaaagatgtt

SEQ ID NO: 1734440 - DNA, 18 bp, Homo sapiens
tcctacaacttaatggaa

SEQ ID NO: 1734441 - DNA, 17 bp, Homo sapiens
tcctacaagatttagaa

SEQ ID NO: 1734442 - DNA, 21 bp, Homo sapiens
tcctacaagatttagaaaaaa

SEQ ID NO: 1734443 - DNA, 15 bp, Homo sapiens
tcctacccaaccact

SEQ ID NO: 1734444 - DNA, 16 bp, Homo sapiens
tcctacccaaccactc

SEQ ID NO: 1734445 - DNA, 14 bp, Homo sapiens
tcctacctattatc

SEQ ID NO: 1734446 - DNA, 12 bp, Homo sapiens
tcctacctcagc

SEQ ID NO: 1734447 - DNA, 14 bp, Homo sapiens
tcctacctcagcct

SEQ ID NO: 1734448 - DNA, 16 bp, Homo sapiens
tcctacctcagcctag

SEQ ID NO: 1734449 - DNA, 17 bp, Homo sapiens
tcctacctcagcctaga

SEQ ID NO: 1734450 - DNA, 13 bp, Homo sapiens
tcctacctccctg

SEQ ID NO: 1734451 - DNA, 22 bp, Homo sapiens
tcctacctgtctgctgccagca

SEQ ID NO: 1734452 - DNA, 16 bp, Homo sapiens
tcctactgtcctcaga

SEQ ID NO: 1734453 - DNA, 18 bp, Homo sapiens
tcctacttctgactttac

SEQ ID NO: 1734454 - DNA, 20 bp, Homo sapiens
tcctagaagttactgaatgc

SEQ ID NO: 1734455 - DNA, 15 bp, Homo sapiens
tcctagacccgtgac

SEQ ID NO: 1734456 - DNA, 23 bp, Homo sapiens
tcctagaggtgggcagctgggcc

SEQ ID NO: 1734457 - DNA, 14 bp, Homo sapiens
tcctagatcctaag

SEQ ID NO: 1734458 - DNA, 18 bp, Homo sapiens
tcctagatctgcaggctg

SEQ ID NO: 1734459 - DNA, 19 bp, Homo sapiens
tcctagcatcagtagattt

SEQ ID NO: 1734460 - DNA, 13 bp, Homo sapiens
tcctagccactca

SEQ ID NO: 1734461 - DNA, 20 bp, Homo sapiens
tcctagctcctcctcctggg

SEQ ID NO: 1734462 - DNA, 17 bp, Homo sapiens
tcctaggaaaccagctc

SEQ ID NO: 1734463 - DNA, 21 bp, Homo sapiens
tcctaggaaaccagctcgtgg

SEQ ID NO: 1734464 - DNA, 20 bp, Homo sapiens
tcctaggcattgcaggacct

SEQ ID NO: 1734465 - DNA, 13 bp, Homo sapiens
tcctaggccacac

SEQ ID NO: 1734466 - DNA, 14 bp, Homo sapiens
tcctaggggtgcgc

SEQ ID NO: 1734467 - DNA, 13 bp, Homo sapiens
tcctagtaagaag

SEQ ID NO: 1734468 - DNA, 14 bp, Homo sapiens
tcctagtaagaaga

SEQ ID NO: 1734469 - DNA, 15 bp, Homo sapiens
tcctagtcttcacaa

SEQ ID NO: 1734470 - DNA, 16 bp, Homo sapiens
tcctagtcttcacaac

SEQ ID NO: 1734471 - DNA, 14 bp, Homo sapiens
tcctagtgaaagag

SEQ ID NO: 1734472 - DNA, 23 bp, Homo sapiens
tcctagtttgacctcacagtgac

SEQ ID NO: 1734473 - DNA, 13 bp, Homo sapiens
tcctatactggtt

SEQ ID NO: 1734474 - DNA, 20 bp, Homo sapiens
tcctatagctacatgttctt

SEQ ID NO: 1734475 - DNA, 18 bp, Homo sapiens
tcctatatagtttattga

SEQ ID NO: 1734476 - DNA, 20 bp, Homo sapiens
tcctatatatttctattatt

SEQ ID NO: 1734477 - DNA, 18 bp, Homo sapiens
tcctatatcctgtgactg

SEQ ID NO: 1734478 - DNA, 21 bp, Homo sapiens
tcctatattgttttcagtgta

SEQ ID NO: 1734479 - DNA, 20 bp, Homo sapiens
tcctatccccaggccaggtc

SEQ ID NO: 1734480 - DNA, 13 bp, Homo sapiens
tcctatccttata

SEQ ID NO: 1734481 - DNA, 23 bp, Homo sapiens
tcctatctccagcggccctgtca

SEQ ID NO: 1734482 - DNA, 14 bp, Homo sapiens
tcctatctccctgg

SEQ ID NO: 1734483 - DNA, 20 bp, Homo sapiens
tcctatctccctggctcact

SEQ ID NO: 1734484 - DNA, 16 bp, Homo sapiens
tcctatggacaactta

SEQ ID NO: 1734485 - DNA, 18 bp, Homo sapiens
tcctatgtcaatttgtat

SEQ ID NO: 1734486 - DNA, 17 bp, Homo sapiens
tcctatgtggcagctgg

SEQ ID NO: 1734487 - DNA, 20 bp, Homo sapiens
tcctattaaaacacagcttt

SEQ ID NO: 1734488 - DNA, 15 bp, Homo sapiens
tcctcaaagaaagtg

SEQ ID NO: 1734489 - DNA, 14 bp, Homo sapiens
tcctcaacactatt

SEQ ID NO: 1734490 - DNA, 19 bp, Homo sapiens
tcctcaagcaataattgtt

SEQ ID NO: 1734491 - DNA, 13 bp, Homo sapiens
tcctcacaagcct

SEQ ID NO: 1734492 - DNA, 20 bp, Homo sapiens
tcctcacaagcctcttctga

SEQ ID NO: 1734493 - DNA, 17 bp, Homo sapiens
tcctcacacccctgtcc

SEQ ID NO: 1734494 - DNA, 16 bp, Homo sapiens
tcctcacccctgtagg

SEQ ID NO: 1734495 - DNA, 21 bp, Homo sapiens
tcctcacctcatgcccacccc

SEQ ID NO: 1734496 - DNA, 23 bp, Homo sapiens
tcctcacgtgcaggacagctctt

SEQ ID NO: 1734497 - DNA, 20 bp, Homo sapiens
tcctcactggaggagcagct

SEQ ID NO: 1734498 - DNA, 23 bp, Homo sapiens
tcctcactggaggagcagcttcc

SEQ ID NO: 1734499 - DNA, 14 bp, Homo sapiens
tcctcactgggtgg

SEQ ID NO: 1734500 - DNA, 22 bp, Homo sapiens
tcctcactgggtggggtgagga

SEQ ID NO: 1734501 - DNA, 19 bp, Homo sapiens
tcctcacttctgtctcctg

SEQ ID NO: 1734502 - DNA, 19 bp, Homo sapiens
tcctcacttggctgtctga

SEQ ID NO: 1734503 - DNA, 16 bp, Homo sapiens
tcctcagaggacagtt

SEQ ID NO: 1734504 - DNA, 18 bp, Homo sapiens
tcctcagcgagaggcagc

SEQ ID NO: 1734505 - DNA, 12 bp, Homo sapiens
tcctcagctgcc

SEQ ID NO: 1734506 - DNA, 24 bp, Homo sapiens
tcctcagggacagagacacctgca

SEQ ID NO: 1734507 - DNA, 17 bp, Homo sapiens
tcctcaggggtggagaa

SEQ ID NO: 1734508 - DNA, 13 bp, Homo sapiens
tcctcagggtggg

SEQ ID NO: 1734509 - DNA, 22 bp, Homo sapiens
tcctcagtaacatttctgttct

SEQ ID NO: 1734510 - DNA, 15 bp, Homo sapiens
tcctcatccacccca

SEQ ID NO: 1734511 - DNA, 23 bp, Homo sapiens
tcctcatcccctcgtcctgtccc

SEQ ID NO: 1734512 - DNA, 22 bp, Homo sapiens
tcctcatcccgtgttctccttt

SEQ ID NO: 1734513 - DNA, 14 bp, Homo sapiens
tcctcatccctgac

SEQ ID NO: 1734514 - DNA, 15 bp, Homo sapiens
tcctcatgaatgtaa

SEQ ID NO: 1734515 - DNA, 20 bp, Homo sapiens
tcctcatgaatgtaaatttg

SEQ ID NO: 1734516 - DNA, 14 bp, Homo sapiens
tcctcatgtaacat

SEQ ID NO: 1734517 - DNA, 15 bp, Homo sapiens
tcctcatgtaacatt

SEQ ID NO: 1734518 - DNA, 19 bp, Homo sapiens
tcctcatgtaacattggtg

SEQ ID NO: 1734519 - DNA, 20 bp, Homo sapiens
tcctcatgtaacattggtga

SEQ ID NO: 1734520 - DNA, 16 bp, Homo sapiens
tcctcattgcctcctg

SEQ ID NO: 1734521 - DNA, 20 bp, Homo sapiens
tcctcattgcctcctgttct

SEQ ID NO: 1734522 - DNA, 16 bp, Homo sapiens
tcctcatttcccctcc

SEQ ID NO: 1734523 - DNA, 13 bp, Homo sapiens
tcctccaacagct

SEQ ID NO: 1734524 - DNA, 15 bp, Homo sapiens
tcctccacagcccca

SEQ ID NO: 1734525 - DNA, 15 bp, Homo sapiens
tcctccaccatgcac

SEQ ID NO: 1734526 - DNA, 17 bp, Homo sapiens
tcctccactcactccag

SEQ ID NO: 1734527 - DNA, 16 bp, Homo sapiens
tcctccactctccccc

SEQ ID NO: 1734528 - DNA, 19 bp, Homo sapiens
tcctccactctcccccacc

SEQ ID NO: 1734529 - DNA, 19 bp, Homo sapiens
tcctccagaagcctctggc

SEQ ID NO: 1734530 - DNA, 15 bp, Homo sapiens
tcctccagcccctgt

SEQ ID NO: 1734531 - DNA, 18 bp, Homo sapiens
tcctccagcccctgtccc

SEQ ID NO: 1734532 - DNA, 19 bp, Homo sapiens
tcctccaggcctgcctccc

SEQ ID NO: 1734533 - DNA, 23 bp, Homo sapiens
tcctccaggtcggagtgcctgga

SEQ ID NO: 1734534 - DNA, 21 bp, Homo sapiens
tcctccatctttctacagaga

SEQ ID NO: 1734535 - DNA, 13 bp, Homo sapiens
tcctccatggtgg

SEQ ID NO: 1734536 - DNA, 21 bp, Homo sapiens
tcctcccaatttcagactccc

SEQ ID NO: 1734537 - DNA, 21 bp, Homo sapiens
tcctcccacccggctgcagag

SEQ ID NO: 1734538 - DNA, 20 bp, Homo sapiens
tcctcccaccttggcctccc

SEQ ID NO: 1734539 - DNA, 22 bp, Homo sapiens
tcctcccaggaggtgcttgagg

SEQ ID NO: 1734540 - DNA, 14 bp, Homo sapiens
tcctcccagtgcct

SEQ ID NO: 1734541 - DNA, 17 bp, Homo sapiens
tcctcccatctccttcc

SEQ ID NO: 1734542 - DNA, 13 bp, Homo sapiens
tcctccccagctc

SEQ ID NO: 1734543 - DNA, 18 bp, Homo sapiens
tcctcccccggctgggcc

SEQ ID NO: 1734544 - DNA, 14 bp, Homo sapiens
tcctccccctgcaa

SEQ ID NO: 1734545 - DNA, 23 bp, Homo sapiens
tcctccccctgccagtgccttac

SEQ ID NO: 1734546 - DNA, 18 bp, Homo sapiens
tcctcccctccctcagag

SEQ ID NO: 1734547 - DNA, 16 bp, Homo sapiens
tcctccccttcctctt

SEQ ID NO: 1734548 - DNA, 14 bp, Homo sapiens
tcctccccttgggc

SEQ ID NO: 1734549 - DNA, 20 bp, Homo sapiens
tcctcccgagctcctcttcc

SEQ ID NO: 1734550 - DNA, 14 bp, Homo sapiens
tcctcccgccccgc

SEQ ID NO: 1734551 - DNA, 19 bp, Homo sapiens
tcctcccgccccgcccctc

SEQ ID NO: 1734552 - DNA, 14 bp, Homo sapiens
tcctcccgggccct

SEQ ID NO: 1734553 - DNA, 16 bp, Homo sapiens
tcctcccgggccctcc

SEQ ID NO: 1734554 - DNA, 17 bp, Homo sapiens
tcctcccgggccctccc

SEQ ID NO: 1734555 - DNA, 14 bp, Homo sapiens
tcctccctcccaag

SEQ ID NO: 1734556 - DNA, 13 bp, Homo sapiens
tcctccctgcccc

SEQ ID NO: 1734557 - DNA, 20 bp, Homo sapiens
tcctccctgcctcagtggct

SEQ ID NO: 1734558 - DNA, 12 bp, Homo sapiens
tcctccctggct

SEQ ID NO: 1734559 - DNA, 18 bp, Homo sapiens
tcctccctggctgccctg

SEQ ID NO: 1734560 - DNA, 13 bp, Homo sapiens
tcctcccttcctt

SEQ ID NO: 1734561 - DNA, 19 bp, Homo sapiens
tcctcccttccttttccct

SEQ ID NO: 1734562 - DNA, 15 bp, Homo sapiens
tcctccgtagggtct

SEQ ID NO: 1734563 - DNA, 14 bp, Homo sapiens
tcctccgtccaccc

SEQ ID NO: 1734564 - DNA, 15 bp, Homo sapiens
tcctccgtccaccca

SEQ ID NO: 1734565 - DNA, 17 bp, Homo sapiens
tcctccgtccacccagg

SEQ ID NO: 1734566 - DNA, 18 bp, Homo sapiens
tcctccgtccacccaggc

SEQ ID NO: 1734567 - DNA, 19 bp, Homo sapiens
tcctccgtccacccaggct

SEQ ID NO: 1734568 - DNA, 20 bp, Homo sapiens
tcctccgtccacccaggctg

SEQ ID NO: 1734569 - DNA, 14 bp, Homo sapiens
tcctcctacttaca

SEQ ID NO: 1734570 - DNA, 16 bp, Homo sapiens
tcctcctcacctcatg

SEQ ID NO: 1734571 - DNA, 18 bp, Homo sapiens
tcctcctccacagtgctg

SEQ ID NO: 1734572 - DNA, 20 bp, Homo sapiens
tcctcctccacagtgctgct

SEQ ID NO: 1734573 - DNA, 14 bp, Homo sapiens
tcctcctcccaccc

SEQ ID NO: 1734574 - DNA, 17 bp, Homo sapiens
tcctcctcccagtgcct

SEQ ID NO: 1734575 - DNA, 20 bp, Homo sapiens
tcctcctcccagtgccttct

SEQ ID NO: 1734576 - DNA, 13 bp, Homo sapiens
tcctcctccccag

SEQ ID NO: 1734577 - DNA, 13 bp, Homo sapiens
tcctcctcccctc

SEQ ID NO: 1734578 - DNA, 16 bp, Homo sapiens
tcctcctgtattcctg

SEQ ID NO: 1734579 - DNA, 12 bp, Homo sapiens
tcctcctgtgct

SEQ ID NO: 1734580 - DNA, 13 bp, Homo sapiens
tcctcctgtgcta

SEQ ID NO: 1734581 - DNA, 14 bp, Homo sapiens
tcctcctgtgctat

SEQ ID NO: 1734582 - DNA, 18 bp, Homo sapiens
tcctcctgtgctatttgt

SEQ ID NO: 1734583 - DNA, 22 bp, Homo sapiens
tcctccttttcttcaccctccc

SEQ ID NO: 1734584 - DNA, 17 bp, Homo sapiens
tcctcgaacccactccg

SEQ ID NO: 1734585 - DNA, 20 bp, Homo sapiens
tcctcgaagccatgtgctgc

SEQ ID NO: 1734586 - DNA, 13 bp, Homo sapiens
tcctcgcctgaca

SEQ ID NO: 1734587 - DNA, 24 bp, Homo sapiens
tcctcgcctgacaaccactggtct

SEQ ID NO: 1734588 - DNA, 16 bp, Homo sapiens
tcctcggatcaccgag

SEQ ID NO: 1734589 - DNA, 15 bp, Homo sapiens
tcctcggccccctcc

SEQ ID NO: 1734590 - DNA, 15 bp, Homo sapiens
tcctcgggccgaggc

SEQ ID NO: 1734591 - DNA, 18 bp, Homo sapiens
tcctcggtgggccagagc

SEQ ID NO: 1734592 - DNA, 21 bp, Homo sapiens
tcctctaaagcagaggcaaca

SEQ ID NO: 1734593 - DNA, 18 bp, Homo sapiens
tcctctaactcactgcct

SEQ ID NO: 1734594 - DNA, 14 bp, Homo sapiens
tcctctactcttac

SEQ ID NO: 1734595 - DNA, 18 bp, Homo sapiens
tcctctagaagccaaggg

SEQ ID NO: 1734596 - DNA, 19 bp, Homo sapiens
tcctctagaagccaaggga

SEQ ID NO: 1734597 - DNA, 22 bp, Homo sapiens
tcctctagcccactccctgcct

SEQ ID NO: 1734598 - DNA, 21 bp, Homo sapiens
tcctctagtaagatgcactga

SEQ ID NO: 1734599 - DNA, 15 bp, Homo sapiens
tcctctatactttgt

SEQ ID NO: 1734600 - DNA, 23 bp, Homo sapiens
tcctctatactttgttctgttgt

SEQ ID NO: 1734601 - DNA, 18 bp, Homo sapiens
tcctctcacctctccctc

SEQ ID NO: 1734602 - DNA, 13 bp, Homo sapiens
tcctctccactgc

SEQ ID NO: 1734603 - DNA, 15 bp, Homo sapiens
tcctctccactgcct

SEQ ID NO: 1734604 - DNA, 15 bp, Homo sapiens
tcctctccccagccc

SEQ ID NO: 1734605 - DNA, 23 bp, Homo sapiens
tcctctccccagcccagagacat

SEQ ID NO: 1734606 - DNA, 14 bp, Homo sapiens
tcctctccctgcca

SEQ ID NO: 1734607 - DNA, 22 bp, Homo sapiens
tcctctccttgggctcctggct

SEQ ID NO: 1734608 - DNA, 23 bp, Homo sapiens
tcctctccttgggctcctggctg

SEQ ID NO: 1734609 - DNA, 19 bp, Homo sapiens
tcctctcgcggccctcagt

SEQ ID NO: 1734610 - DNA, 18 bp, Homo sapiens
tcctctctaagtgggcat

SEQ ID NO: 1734611 - DNA, 14 bp, Homo sapiens
tcctctctccagat

SEQ ID NO: 1734612 - DNA, 14 bp, Homo sapiens
tcctctctctcttc

SEQ ID NO: 1734613 - DNA, 22 bp, Homo sapiens
tcctctctctcttcctctttct

SEQ ID NO: 1734614 - DNA, 12 bp, Homo sapiens
tcctctctctgt

SEQ ID NO: 1734615 - DNA, 19 bp, Homo sapiens
tcctctctgagtcaaatcc

SEQ ID NO: 1734616 - DNA, 14 bp, Homo sapiens
tcctctcttggcaa

SEQ ID NO: 1734617 - DNA, 22 bp, Homo sapiens
tcctctgagcagcctctgccag

SEQ ID NO: 1734618 - DNA, 16 bp, Homo sapiens
tcctctgcagctgacc

SEQ ID NO: 1734619 - DNA, 17 bp, Homo sapiens
tcctctgcagctgacct

SEQ ID NO: 1734620 - DNA, 18 bp, Homo sapiens
tcctctgcagtgccttgg

SEQ ID NO: 1734621 - DNA, 11 bp, Homo sapiens
tcctctgcctg

SEQ ID NO: 1734622 - DNA, 14 bp, Homo sapiens
tcctctgcctgccc

SEQ ID NO: 1734623 - DNA, 12 bp, Homo sapiens
tcctctgctcca

SEQ ID NO: 1734624 - DNA, 15 bp, Homo sapiens
tcctctggacggcag

SEQ ID NO: 1734625 - DNA, 18 bp, Homo sapiens
tcctctggacggcaggct

SEQ ID NO: 1734626 - DNA, 20 bp, Homo sapiens
tcctctggacggcaggctca

SEQ ID NO: 1734627 - DNA, 24 bp, Homo sapiens
tcctctggacggcaggctcactgc

SEQ ID NO: 1734628 - DNA, 23 bp, Homo sapiens
tcctctggctggctaactggaag

SEQ ID NO: 1734629 - DNA, 20 bp, Homo sapiens
tcctctgggtttctaagcag

SEQ ID NO: 1734630 - DNA, 14 bp, Homo sapiens
tcctctgtccaggg

SEQ ID NO: 1734631 - DNA, 16 bp, Homo sapiens
tcctctgtccagggcc

SEQ ID NO: 1734632 - DNA, 23 bp, Homo sapiens
tcctctgttcaaagctgcctgtc

SEQ ID NO: 1734633 - DNA, 12 bp, Homo sapiens
tcctctgttcac

SEQ ID NO: 1734634 - DNA, 19 bp, Homo sapiens
tcctcttaccgtagcctcc

SEQ ID NO: 1734635 - DNA, 20 bp, Homo sapiens
tcctcttaccgtagcctccg

SEQ ID NO: 1734636 - DNA, 21 bp, Homo sapiens
tcctcttagcctctggatcta

SEQ ID NO: 1734637 - DNA, 14 bp, Homo sapiens
tccccttctcccct

SEQ ID NO: 1734638 - DNA, 18 bp, Homo sapiens
tccccttctcccctgcac

SEQ ID NO: 1734639 - DNA, 16 bp, Homo sapiens
tccccttctctcatct

SEQ ID NO: 1734640 - DNA, 13 bp, Homo sapiens
tccccttctctgt

SEQ ID NO: 1734641 - DNA, 16 bp, Homo sapiens
tccccttctgaatcag

SEQ ID NO: 1734642 - DNA, 22 bp, Homo sapiens
tccccttctgtgtttctggagt

SEQ ID NO: 1734643 - DNA, 15 bp, Homo sapiens
tccccttgcccaggg

SEQ ID NO: 1734644 - DNA, 14 bp, Homo sapiens
tccccttgggcggc

SEQ ID NO: 1734645 - DNA, 18 bp, Homo sapiens
tcccctttactcagccca

SEQ ID NO: 1734646 - DNA, 19 bp, Homo sapiens
tcccctttactcagcccag

SEQ ID NO: 1734647 - DNA, 21 bp, Homo sapiens
tcccctttactcagcccagct

SEQ ID NO: 1734648 - DNA, 21 bp, Homo sapiens
tccccttttcttttctaccct

SEQ ID NO: 1734649 - DNA, 22 bp, Homo sapiens
tccccttttcttttctacccta

SEQ ID NO: 1734650 - DNA, 24 bp, Homo sapiens
tccccttttgcctggctgtggagg

SEQ ID NO: 1734651 - DNA, 19 bp, Homo sapiens
tcccgaagccatcacttct

SEQ ID NO: 1734652 - DNA, 17 bp, Homo sapiens
tcccgacaccagaagct

SEQ ID NO: 1734653 - DNA, 15 bp, Homo sapiens
tcccgatgagggaag

SEQ ID NO: 1734654 - DNA, 21 bp, Homo sapiens
tcccgcacatggtgtgggggg

SEQ ID NO: 1734655 - DNA, 17 bp, Homo sapiens
tcccgcaccttcctcct

SEQ ID NO: 1734656 - DNA, 15 bp, Homo sapiens
tcccgccccgcccct

SEQ ID NO: 1734657 - DNA, 16 bp, Homo sapiens
tcccgccgcccgaccc

SEQ ID NO: 1734658 - DNA, 18 bp, Homo sapiens
tcccgcctccctctcaga

SEQ ID NO: 1734659 - DNA, 21 bp, Homo sapiens
tcccgcctcttcttcttcaga

SEQ ID NO: 1734660 - DNA, 18 bp, Homo sapiens
tcccgcggtgctgactga

SEQ ID NO: 1734661 - DNA, 21 bp, Homo sapiens
tcccgcggtgctgactgaggc

SEQ ID NO: 1734662 - DNA, 15 bp, Homo sapiens
tcccgcgttcaagac

SEQ ID NO: 1734663 - DNA, 14 bp, Homo sapiens
tcccgctcagccct

SEQ ID NO: 1734664 - DNA, 20 bp, Homo sapiens
tcccgctcagccctccctgc

SEQ ID NO: 1734665 - DNA, 9 bp, Homo sapiens
tcccgctcc

SEQ ID NO: 1734666 - DNA, 13 bp, Homo sapiens
tcccgctcccagg

SEQ ID NO: 1734667 - DNA, 14 bp, Homo sapiens
tcccgctccccacc

SEQ ID NO: 1734668 - DNA, 15 bp, Homo sapiens
tcccgctgctgtgct

SEQ ID NO: 1734669 - DNA, 16 bp, Homo sapiens
tcccgctgctgtgctc

SEQ ID NO: 1734670 - DNA, 16 bp, Homo sapiens
tcccgcttcctggcct

SEQ ID NO: 1734671 - DNA, 18 bp, Homo sapiens
tcccgcttcctggcctcc

SEQ ID NO: 1734672 - DNA, 17 bp, Homo sapiens
tcccggagcacagccct

SEQ ID NO: 1734673 - DNA, 18 bp, Homo sapiens
tcccggaggttgggtggg

SEQ ID NO: 1734674 - DNA, 22 bp, Homo sapiens
tcccggcaagcgcttctgctga

SEQ ID NO: 1734675 - DNA, 16 bp, Homo sapiens
tcccggccagctctgg

SEQ ID NO: 1734676 - DNA, 13 bp, Homo sapiens
tcccggccgcgcc

SEQ ID NO: 1734677 - DNA, 18 bp, Homo sapiens
tcccggccggccctggct

SEQ ID NO: 1734678 - DNA, 13 bp, Homo sapiens
tcccggcctcttc

SEQ ID NO: 1734679 - DNA, 16 bp, Homo sapiens
tcccggctgcctgccg

SEQ ID NO: 1734680 - DNA, 21 bp, Homo sapiens
tcccgggcccgttgaggatga

SEQ ID NO: 1734681 - DNA, 18 bp, Homo sapiens
tcccgggccctcccttgg

SEQ ID NO: 1734682 - DNA, 16 bp, Homo sapiens
tcccggggcagggcag

SEQ ID NO: 1734683 - DNA, 21 bp, Homo sapiens
tcccggggcagggcagccgtc

SEQ ID NO: 1734684 - DNA, 16 bp, Homo sapiens
tcccggggccagcact

SEQ ID NO: 1734685 - DNA, 16 bp, Homo sapiens
tcccgtatcacagtgt

SEQ ID NO: 1734686 - DNA, 21 bp, Homo sapiens
tcccgtatcacagtgttttta

SEQ ID NO: 1734687 - DNA, 23 bp, Homo sapiens
tcccgtcagggcccaagtccctg

SEQ ID NO: 1734688 - DNA, 13 bp, Homo sapiens
tcccgtctcagaa

SEQ ID NO: 1734689 - DNA, 15 bp, Homo sapiens
tcccgtgttctcctt

SEQ ID NO: 1734690 - DNA, 22 bp, Homo sapiens
tccctaagcatgtgtcccagga

SEQ ID NO: 1734691 - DNA, 19 bp, Homo sapiens
tccctaattctcttcgctg

SEQ ID NO: 1734692 - DNA, 23 bp, Homo sapiens
tccctaattctcttcgctgtgat

SEQ ID NO: 1734693 - DNA, 19 bp, Homo sapiens
tccctaccctaaccaagtt

SEQ ID NO: 1734694 - DNA, 17 bp, Homo sapiens
tccctactcccctgggc

SEQ ID NO: 1734695 - DNA, 18 bp, Homo sapiens
tccctactcccctgggca

SEQ ID NO: 1734696 - DNA, 14 bp, Homo sapiens
tccctacttccaag

SEQ ID NO: 1734697 - DNA, 13 bp, Homo sapiens
tccctagagagaa

SEQ ID NO: 1734698 - DNA, 18 bp, Homo sapiens
tccctagagagaataaat

SEQ ID NO: 1734699 - DNA, 15 bp, Homo sapiens
tccctagcagtgaac

SEQ ID NO: 1734700 - DNA, 20 bp, Homo sapiens
tccctagccagcacttgtat

SEQ ID NO: 1734701 - DNA, 22 bp, Homo sapiens
tccctagctttagaccctgggt

SEQ ID NO: 1734702 - DNA, 17 bp, Homo sapiens
tccctagttagcatcca

SEQ ID NO: 1734703 - DNA, 22 bp, Homo sapiens
tccctagttagcatccaggctg

SEQ ID NO: 1734704 - DNA, 23 bp, Homo sapiens
tccctcaactgagggccagggac

SEQ ID NO: 1734705 - DNA, 14 bp, Homo sapiens
tccctcacccatcc

SEQ ID NO: 1734706 - DNA, 22 bp, Homo sapiens
tccctcaccttggcaccagaca

SEQ ID NO: 1734707 - DNA, 20 bp, Homo sapiens
tccctcactccacagagtga

SEQ ID NO: 1734708 - DNA, 16 bp, Homo sapiens
tccctcagagacacca

SEQ ID NO: 1734709 - DNA, 13 bp, Homo sapiens
tccctccaccagc

SEQ ID NO: 1734710 - DNA, 13 bp, Homo sapiens
tccctccacccca

SEQ ID NO: 1734711 - DNA, 15 bp, Homo sapiens
tccctccactccatc

SEQ ID NO: 1734712 - DNA, 17 bp, Homo sapiens
tccctccactccatccc

SEQ ID NO: 1734713 - DNA, 18 bp, Homo sapiens
tccctccaggcccatctc

SEQ ID NO: 1734714 - DNA, 19 bp, Homo sapiens
tccctccaggcccatctca

SEQ ID NO: 1734715 - DNA, 23 bp, Homo sapiens
tccctccagtattgccccctctc

SEQ ID NO: 1734716 - DNA, 17 bp, Homo sapiens
tccctccatcccagaca

SEQ ID NO: 1734717 - DNA, 13 bp, Homo sapiens
tccctccatcccc

SEQ ID NO: 1734718 - DNA, 18 bp, Homo sapiens
tccctccattcatccttc

SEQ ID NO: 1734719 - DNA, 12 bp, Homo sapiens
tccctcccaagg

SEQ ID NO: 1734720 - DNA, 22 bp, Homo sapiens
tccctcccagaggagccaccag

SEQ ID NO: 1734721 - DNA, 14 bp, Homo sapiens
tccctcccccagca

SEQ ID NO: 1734722 - DNA, 16 bp, Homo sapiens
tccctcccccagcaga

SEQ ID NO: 1734723 - DNA, 16 bp, Homo sapiens
tccctcccccccatgc

SEQ ID NO: 1734724 - DNA, 12 bp, Homo sapiens
tccctccccctt

SEQ ID NO: 1734725 - DNA, 13 bp, Homo sapiens
tccctcccctctc

SEQ ID NO: 1734726 - DNA, 16 bp, Homo sapiens
tccctcccctctcaga

SEQ ID NO: 1734727 - DNA, 17 bp, Homo sapiens
tccctcccctgccctgg

SEQ ID NO: 1734728 - DNA, 15 bp, Homo sapiens
tccctccccttctct

SEQ ID NO: 1734729 - DNA, 15 bp, Homo sapiens
tccctccgccttctc

SEQ ID NO: 1734730 - DNA, 21 bp, Homo sapiens
tccctcctccaggcctgcctc

SEQ ID NO: 1734731 - DNA, 15 bp, Homo sapiens
tccctcctgcaggct

SEQ ID NO: 1734732 - DNA, 20 bp, Homo sapiens
tccctcgccgtccctcccag

SEQ ID NO: 1734733 - DNA, 19 bp, Homo sapiens
tccctcgctgcacaaatac

SEQ ID NO: 1734734 - DNA, 22 bp, Homo sapiens
tccctcgctgcacaaatactcc

SEQ ID NO: 1734735 - DNA, 19 bp, Homo sapiens
tccctcgggaagcagccag

SEQ ID NO: 1734736 - DNA, 21 bp, Homo sapiens
tccctcgtagttggcaggagc

SEQ ID NO: 1734737 - DNA, 22 bp, Homo sapiens
tccctcgtagttggcaggagct

SEQ ID NO: 1734738 - DNA, 19 bp, Homo sapiens
tccctcgtccacaggggca

SEQ ID NO: 1734739 - DNA, 15 bp, Homo sapiens
tccctcgtccgtctg

SEQ ID NO: 1734740 - DNA, 19 bp, Homo sapiens
tccctcgtccgtctgtctc

SEQ ID NO: 1734741 - DNA, 22 bp, Homo sapiens
tccctcgtcttcagctgcattt

SEQ ID NO: 1734742 - DNA, 17 bp, Homo sapiens
tccctctaatgagactg

SEQ ID NO: 1734743 - DNA, 19 bp, Homo sapiens
tccctctatttatgtttgc

SEQ ID NO: 1734744 - DNA, 15 bp, Homo sapiens
tccctctcagaggcc

SEQ ID NO: 1734745 - DNA, 19 bp, Homo sapiens
tccctctcagaggcctgct

SEQ ID NO: 1734746 - DNA, 16 bp, Homo sapiens
tccctctcaggatcca

SEQ ID NO: 1734747 - DNA, 19 bp, Homo sapiens
tccctctcagtgccttctc

SEQ ID NO: 1734748 - DNA, 19 bp, Homo sapiens
tcccccgacactgctgcac

SEQ ID NO: 1734749 - DNA, 16 bp, Homo sapiens
tcccccgactgcctgt

SEQ ID NO: 1734750 - DNA, 20 bp, Homo sapiens
tcccccgcagtccccagccc

SEQ ID NO: 1734751 - DNA, 21 bp, Homo sapiens
tcccccgcagtccccagccct

SEQ ID NO: 1734752 - DNA, 22 bp, Homo sapiens
tcccccgcagtccccagccctt

SEQ ID NO: 1734753 - DNA, 14 bp, Homo sapiens
tcccccgccgcgcc

SEQ ID NO: 1734754 - DNA, 16 bp, Homo sapiens
tcccccggggcaaggt

SEQ ID NO: 1734755 - DNA, 23 bp, Homo sapiens
tcccagctctccctctggccctg

SEQ ID NO: 1734756 - DNA, 18 bp, Homo sapiens
tcccagcttggttccagg

SEQ ID NO: 1734757 - DNA, 16 bp, Homo sapiens
tcccaggaccctgaag

SEQ ID NO: 1734758 - DNA, 19 bp, Homo sapiens
tcccaggaccctgaagggg

SEQ ID NO: 1734759 - DNA, 10 bp, Homo sapiens
tcccaggacg

SEQ ID NO: 1734760 - DNA, 13 bp, Homo sapiens
tcccaggagaaag

SEQ ID NO: 1734761 - DNA, 22 bp, Homo sapiens
tcccaggagacagttcaagaaa

SEQ ID NO: 1734762 - DNA, 15 bp, Homo sapiens
tcccaggagacctga

SEQ ID NO: 1734763 - DNA, 17 bp, Homo sapiens
tcccaggaggtgcttga

SEQ ID NO: 1734764 - DNA, 20 bp, Homo sapiens
tcccaggccaacagtagcca

SEQ ID NO: 1734765 - DNA, 15 bp, Homo sapiens
tcccaggccaggctc

SEQ ID NO: 1734766 - DNA, 17 bp, Homo sapiens
tcccaggccccctgcat

SEQ ID NO: 1734767 - DNA, 19 bp, Homo sapiens
tcccaggccccctgcatct

SEQ ID NO: 1734768 - DNA, 20 bp, Homo sapiens
tcccaggccccctgcatcta

SEQ ID NO: 1734769 - DNA, 20 bp, Homo sapiens
tcccaggccgcaccatttct

SEQ ID NO: 1734770 - DNA, 23 bp, Homo sapiens
tcccaggccgcaccatttctgtc

SEQ ID NO: 1734771 - DNA, 17 bp, Homo sapiens
tcccagggccagggccc

SEQ ID NO: 1734772 - DNA, 20 bp, Homo sapiens
tcccagggccagggccctgc

SEQ ID NO: 1734773 - DNA, 17 bp, Homo sapiens
tcccaggggagccagct

SEQ ID NO: 1734774 - DNA, 21 bp, Homo sapiens
tcccaggggagccagctgctt

SEQ ID NO: 1734775 - DNA, 23 bp, Homo sapiens
tcccaggggagccagctgcttga

SEQ ID NO: 1734776 - DNA, 21 bp, Homo sapiens
tcccaggggtctccctggctc

SEQ ID NO: 1734777 - DNA, 15 bp, Homo sapiens
tcccaggtcgggcag

SEQ ID NO: 1734778 - DNA, 15 bp, Homo sapiens
tcccaggtgttaaca

SEQ ID NO: 1734779 - DNA, 23 bp, Homo sapiens
tcccaggtgttaacattccaaga

SEQ ID NO: 1734780 - DNA, 20 bp, Homo sapiens
tcccaggttgacaccattct

SEQ ID NO: 1734781 - DNA, 14 bp, Homo sapiens
tcccagtattttta

SEQ ID NO: 1734782 - DNA, 14 bp, Homo sapiens
tcccagtcactcct

SEQ ID NO: 1734783 - DNA, 14 bp, Homo sapiens
tcccagtcatttaa

SEQ ID NO: 1734784 - DNA, 16 bp, Homo sapiens
tcccagtccctcgccg

SEQ ID NO: 1734785 - DNA, 18 bp, Homo sapiens
tcccagtgaatccctggg

SEQ ID NO: 1734786 - DNA, 12 bp, Homo sapiens
tcccagtgcctt

SEQ ID NO: 1734787 - DNA, 20 bp, Homo sapiens
tcccagtgggaggggcaggc

SEQ ID NO: 1734788 - DNA, 19 bp, Homo sapiens
tcccagtgtgagaccccaa

SEQ ID NO: 1734789 - DNA, 14 bp, Homo sapiens
tcccagttaaagat

SEQ ID NO: 1734790 - DNA, 15 bp, Homo sapiens
tcccagttaaagatt

SEQ ID NO: 1734791 - DNA, 20 bp, Homo sapiens
tcccagttcaggagtcccaa

SEQ ID NO: 1734792 - DNA, 22 bp, Homo sapiens
tcccatcactggagcaccaggc

SEQ ID NO: 1734793 - DNA, 14 bp, Homo sapiens
tcccatcagggaag

SEQ ID NO: 1734794 - DNA, 12 bp, Homo sapiens
tcccatccaggc

SEQ ID NO: 1734795 - DNA, 14 bp, Homo sapiens
tcccatccaggcag

SEQ ID NO: 1734796 - DNA, 17 bp, Homo sapiens
tcccatccccctgccct

SEQ ID NO: 1734797 - DNA, 18 bp, Homo sapiens
tcccatccccctgccctc

SEQ ID NO: 1734798 - DNA, 14 bp, Homo sapiens
tcccatcctggggc

SEQ ID NO: 1734799 - DNA, 15 bp, Homo sapiens
tcccatcctggggca

SEQ ID NO: 1734800 - DNA, 15 bp, Homo sapiens
tcccatctccttccc

SEQ ID NO: 1734801 - DNA, 18 bp, Homo sapiens
tcccatctggctttttct

SEQ ID NO: 1734802 - DNA, 17 bp, Homo sapiens
tcccatctgggagtccc

SEQ ID NO: 1734803 - DNA, 19 bp, Homo sapiens
tcccatgaacacactgtgt

SEQ ID NO: 1734804 - DNA, 14 bp, Homo sapiens
tcccatgacccacc

SEQ ID NO: 1734805 - DNA, 17 bp, Homo sapiens
tcccatgacccacccct

SEQ ID NO: 1734806 - DNA, 21 bp, Homo sapiens
tcccatgacccacccctgtgc

SEQ ID NO: 1734807 - DNA, 19 bp, Homo sapiens
tcccatgcctgtctctgtt

SEQ ID NO: 1734808 - DNA, 19 bp, Homo sapiens
tcccatggctgaagctgga

SEQ ID NO: 1734809 - DNA, 21 bp, Homo sapiens
tcccatggctgaagctggagc

SEQ ID NO: 1734810 - DNA, 24 bp, Homo sapiens
tcccatggctgaagctggagcagc

SEQ ID NO: 1734811 - DNA, 13 bp, Homo sapiens
tcccatgtatttg

SEQ ID NO: 1734812 - DNA, 20 bp, Homo sapiens
tcccatgtcacctcagctga

SEQ ID NO: 1734813 - DNA, 18 bp, Homo sapiens
tcccatgtcccaccctcc

SEQ ID NO: 1734814 - DNA, 17 bp, Homo sapiens
tcccattcctgaagaac

SEQ ID NO: 1734815 - DNA, 14 bp, Homo sapiens
tcccattctagatc

SEQ ID NO: 1734816 - DNA, 17 bp, Homo sapiens
tcccattctagatcctg

SEQ ID NO: 1734817 - DNA, 14 bp, Homo sapiens
tcccattctgcccc

SEQ ID NO: 1734818 - DNA, 15 bp, Homo sapiens
tcccattgccctggt

SEQ ID NO: 1734819 - DNA, 16 bp, Homo sapiens
tcccattgtggctcct

SEQ ID NO: 1734820 - DNA, 15 bp, Homo sapiens
tcccatttagaatgg

SEQ ID NO: 1734821 - DNA, 14 bp, Homo sapiens
tcccatttcaggaa

SEQ ID NO: 1734822 - DNA, 13 bp, Homo sapiens
tcccatttccttg

SEQ ID NO: 1734823 - DNA, 18 bp, Homo sapiens
tcccatttccttggaggc

SEQ ID NO: 1734824 - DNA, 21 bp, Homo sapiens
tcccatttccttggaggccac

SEQ ID NO: 1734825 - DNA, 23 bp, Homo sapiens
tcccatttctacctaagtcagct

SEQ ID NO: 1734826 - DNA, 15 bp, Homo sapiens
tcccatttcttccca

SEQ ID NO: 1734827 - DNA, 15 bp, Homo sapiens
tcccatttgtaattt

SEQ ID NO: 1734828 - DNA, 16 bp, Homo sapiens
tcccatttgtgccaga

SEQ ID NO: 1734829 - DNA, 14 bp, Homo sapiens
tcccattttattaa

SEQ ID NO: 1734830 - DNA, 22 bp, Homo sapiens
tcccattttgcaaaatttccag

SEQ ID NO: 1734831 - DNA, 15 bp, Homo sapiens
tccccaaagccactg

SEQ ID NO: 1734832 - DNA, 22 bp, Homo sapiens
tccccaaagccactggaaggag

SEQ ID NO: 1734833 - DNA, 18 bp, Homo sapiens
tccccaaatcaatacact

SEQ ID NO: 1734834 - DNA, 22 bp, Homo sapiens
tccccaaccgtgtctgtctggc

SEQ ID NO: 1734835 - DNA, 23 bp, Homo sapiens
tcccaaggttggagcccagggca

SEQ ID NO: 1734836 - DNA, 21 bp, Homo sapiens
tcccaagtaactgggattaca

SEQ ID NO: 1734837 - DNA, 20 bp, Homo sapiens
tcccaagtaccctgagatac

SEQ ID NO: 1734838 - DNA, 23 bp, Homo sapiens
tcccaagtatgccttaagcagaa

SEQ ID NO: 1734839 - DNA, 16 bp, Homo sapiens
tcccaataaaagtgac

SEQ ID NO: 1734840 - DNA, 22 bp, Homo sapiens
tcccaatagcaacgtagcttct

SEQ ID NO: 1734841 - DNA, 16 bp, Homo sapiens
tcccaatagctctact

SEQ ID NO: 1734842 - DNA, 22 bp, Homo sapiens
tcccaatagctctactgccctc

SEQ ID NO: 1734843 - DNA, 17 bp, Homo sapiens
tcccaataggcagactg

SEQ ID NO: 1734844 - DNA, 19 bp, Homo sapiens
tcccaatcagcactgaaaa

SEQ ID NO: 1734845 - DNA, 14 bp, Homo sapiens
tcccaatcagcttt

SEQ ID NO: 1734846 - DNA, 16 bp, Homo sapiens
tcccaatcagcttttg

SEQ ID NO: 1734847 - DNA, 20 bp, Homo sapiens
tcccaattaggaagtgtaac

SEQ ID NO: 1734848 - DNA, 13 bp, Homo sapiens
tcccacaaaatat

SEQ ID NO: 1734849 - DNA, 13 bp, Homo sapiens
tcccacaccctgg

SEQ ID NO: 1734850 - DNA, 13 bp, Homo sapiens
tcccacactttga

SEQ ID NO: 1734851 - DNA, 15 bp, Homo sapiens
tcccacactttgaag

SEQ ID NO: 1734852 - DNA, 19 bp, Homo sapiens
tcccacactttgaagcaaa

SEQ ID NO: 1734853 - DNA, 17 bp, Homo sapiens
tcccacagcctccttct

SEQ ID NO: 1734854 - DNA, 12 bp, Homo sapiens
tcccacaggagg

SEQ ID NO: 1734855 - DNA, 16 bp, Homo sapiens
tcccacaggagggcca

SEQ ID NO: 1734856 - DNA, 11 bp, Homo sapiens
tcccacagtgg

SEQ ID NO: 1734857 - DNA, 23 bp, Homo sapiens
tcccacatccaactccagcaact

SEQ ID NO: 1734858 - DNA, 13 bp, Homo sapiens
tcccacatctttc

SEQ ID NO: 1734859 - DNA, 14 bp, Homo sapiens
tcccacatgaggcc

SEQ ID NO: 1734860 - DNA, 19 bp, Homo sapiens
tcccaccaaccctcagagc

SEQ ID NO: 1734861 - DNA, 17 bp, Homo sapiens
tcccaccaactctgcac

SEQ ID NO: 1734862 - DNA, 19 bp, Homo sapiens
tcccaccaactctgcactc

SEQ ID NO: 1734863 - DNA, 23 bp, Homo sapiens
tcccaccaactctgcactccatg

SEQ ID NO: 1734864 - DNA, 16 bp, Homo sapiens
tcccaccagagccggg

SEQ ID NO: 1734865 - DNA, 22 bp, Homo sapiens
tcccaccaggctgctcagggct

SEQ ID NO: 1734866 - DNA, 19 bp, Homo sapiens
tcccaccattcctgccttt

SEQ ID NO: 1734867 - DNA, 22 bp, Homo sapiens
tcccacccacacagctgcccta

SEQ ID NO: 1734868 - DNA, 18 bp, Homo sapiens
tcccacccacagccatag

SEQ ID NO: 1734869 - DNA, 19 bp, Homo sapiens
tcccacccacagccataga

SEQ ID NO: 1734870 - DNA, 22 bp, Homo sapiens
tcccacccacatgtgacacata

SEQ ID NO: 1734871 - DNA, 15 bp, Homo sapiens
tcccacccacccgcc

SEQ ID NO: 1734872 - DNA, 23 bp, Homo sapiens
tcccacccacccgccgcctccca

SEQ ID NO: 1734873 - DNA, 16 bp, Homo sapiens
tcccaccccaccccct

SEQ ID NO: 1734874 - DNA, 18 bp, Homo sapiens
tcccaccccacccccttc

SEQ ID NO: 1734875 - DNA, 15 bp, Homo sapiens
tcccaccccactcca

SEQ ID NO: 1734876 - DNA, 16 bp, Homo sapiens
tcccaccccactccag

SEQ ID NO: 1734877 - DNA, 19 bp, Homo sapiens
tcccaccccactccagccc

SEQ ID NO: 1734878 - DNA, 18 bp, Homo sapiens
tcccacccccacccccag

SEQ ID NO: 1734879 - DNA, 16 bp, Homo sapiens
tcccacccccgaccct

SEQ ID NO: 1734880 - DNA, 18 bp, Homo sapiens
tcccacccccgaccctgc

SEQ ID NO: 1734881 - DNA, 21 bp, Homo sapiens
tcccacccccgaccctgccct

SEQ ID NO: 1734882 - DNA, 14 bp, Homo sapiens
tcccaccccctcct

SEQ ID NO: 1734883 - DNA, 17 bp, Homo sapiens
tcccacccccttctctg

SEQ ID NO: 1734884 - DNA, 19 bp, Homo sapiens
tcccaccccggcctccact

SEQ ID NO: 1734885 - DNA, 15 bp, Homo sapiens
tcccacccgatgctg

SEQ ID NO: 1734886 - DNA, 23 bp, Homo sapiens
tcccacccggccacagctgctgg

SEQ ID NO: 1734887 - DNA, 18 bp, Homo sapiens
tcccaccgcagcgtcccc

SEQ ID NO: 1734888 - DNA, 16 bp, Homo sapiens
tcccaccgcccccacc

SEQ ID NO: 1734889 - DNA, 19 bp, Homo sapiens
tcccacctagtgccccaga

SEQ ID NO: 1734890 - DNA, 19 bp, Homo sapiens
tcccacctcagcctcctga

SEQ ID NO: 1734891 - DNA, 16 bp, Homo sapiens
tcccacctcccttccc

SEQ ID NO: 1734892 - DNA, 23 bp, Homo sapiens
tcccacctctccttttgaggctt

SEQ ID NO: 1734893 - DNA, 20 bp, Homo sapiens
tcccacctttcgggccatgt

SEQ ID NO: 1734894 - DNA, 21 bp, Homo sapiens
tcccactcaccagccctagct

SEQ ID NO: 1734895 - DNA, 11 bp, Homo sapiens
tcccactcccg

SEQ ID NO: 1734896 - DNA, 23 bp, Homo sapiens
tcccactcccggcctaggcacct

SEQ ID NO: 1734897 - DNA, 13 bp, Homo sapiens
tcccactcctgct

SEQ ID NO: 1734898 - DNA, 12 bp, Homo sapiens
tcccactctttg

SEQ ID NO: 1734899 - DNA, 14 bp, Homo sapiens
tcccacttcactgt

SEQ ID NO: 1734900 - DNA, 16 bp, Homo sapiens
tcccacttcccaccct

SEQ ID NO: 1734901 - DNA, 22 bp, Homo sapiens
tcccacttgcaacttctttctg

SEQ ID NO: 1734902 - DNA, 16 bp, Homo sapiens
tcccagaatctctgag

SEQ ID NO: 1734903 - DNA, 21 bp, Homo sapiens
tcccagaccagccaagggtcc

SEQ ID NO: 1734904 - DNA, 20 bp, Homo sapiens
tcccagagacaggaaaatcc

SEQ ID NO: 1734905 - DNA, 21 bp, Homo sapiens
tcccagagcaggaggcccctg

SEQ ID NO: 1734906 - DNA, 17 bp, Homo sapiens
tccaccattcacatttg

SEQ ID NO: 1734907 - DNA, 12 bp, Homo sapiens
tccacccaccag

SEQ ID NO: 1734908 - DNA, 13 bp, Homo sapiens
tccacccagccca

SEQ ID NO: 1734909 - DNA, 19 bp, Homo sapiens
tccacccaggctgcactgc

SEQ ID NO: 1734910 - DNA, 21 bp, Homo sapiens
tccacccaggctgcactgcag

SEQ ID NO: 1734911 - DNA, 18 bp, Homo sapiens
tccaccccaagagaactc

SEQ ID NO: 1734912 - DNA, 21 bp, Homo sapiens
tccaccccccacgtctgtcct

SEQ ID NO: 1734913 - DNA, 20 bp, Homo sapiens
tccacccgggggagcccagt

SEQ ID NO: 1734914 - DNA, 12 bp, Homo sapiens
tccaccctgcat

SEQ ID NO: 1734915 - DNA, 20 bp, Homo sapiens
tccaccctgccaagactcct

SEQ ID NO: 1734916 - DNA, 18 bp, Homo sapiens
tccaccctgtcccccagc

SEQ ID NO: 1734917 - DNA, 21 bp, Homo sapiens
tccaccctgtcccccagctct

SEQ ID NO: 1734918 - DNA, 13 bp, Homo sapiens
tccacccttccat

SEQ ID NO: 1734919 - DNA, 14 bp, Homo sapiens
tccacccttggcct

SEQ ID NO: 1734920 - DNA, 15 bp, Homo sapiens
tccacccttggcctg

SEQ ID NO: 1734921 - DNA, 17 bp, Homo sapiens
tccacccttggcctgtc

SEQ ID NO: 1734922 - DNA, 17 bp, Homo sapiens
tccaccgagccagcttg

SEQ ID NO: 1734923 - DNA, 17 bp, Homo sapiens
tccaccggcctcggcct

SEQ ID NO: 1734924 - DNA, 23 bp, Homo sapiens
tccaccgtctttcttttatactg

SEQ ID NO: 1734925 - DNA, 12 bp, Homo sapiens
tccacctcagcc

SEQ ID NO: 1734926 - DNA, 17 bp, Homo sapiens
tccacctcagccttgga

SEQ ID NO: 1734927 - DNA, 18 bp, Homo sapiens
tccacctcatcactggac

SEQ ID NO: 1734928 - DNA, 14 bp, Homo sapiens
tccacctcccccaa

SEQ ID NO: 1734929 - DNA, 22 bp, Homo sapiens
tccacctcccccaaaccctgct

SEQ ID NO: 1734930 - DNA, 13 bp, Homo sapiens
tccacctctggtg

SEQ ID NO: 1734931 - DNA, 16 bp, Homo sapiens
tccacctctggtggct

SEQ ID NO: 1734932 - DNA, 22 bp, Homo sapiens
tccacctctggtggctcctcct

SEQ ID NO: 1734933 - DNA, 24 bp, Homo sapiens
tccacctctggtggctcctcctag

SEQ ID NO: 1734934 - DNA, 23 bp, Homo sapiens
tccacctgccacaaaccaccagg

SEQ ID NO: 1734935 - DNA, 22 bp, Homo sapiens
tccacctggagagtacatttgc

SEQ ID NO: 1734936 - DNA, 13 bp, Homo sapiens
tccacctggcccc

SEQ ID NO: 1734937 - DNA, 13 bp, Homo sapiens
tccacctgtctca

SEQ ID NO: 1734938 - DNA, 17 bp, Homo sapiens
tccacctgtcttggcct

SEQ ID NO: 1734939 - DNA, 15 bp, Homo sapiens
tccacctgtgccctc

SEQ ID NO: 1734940 - DNA, 15 bp, Homo sapiens
tccaccttagtactt

SEQ ID NO: 1734941 - DNA, 12 bp, Homo sapiens
tccaccttccca

SEQ ID NO: 1734942 - DNA, 22 bp, Homo sapiens
tccaccttcccttctacaagga

SEQ ID NO: 1734943 - DNA, 13 bp, Homo sapiens
tccaccttgctct

SEQ ID NO: 1734944 - DNA, 19 bp, Homo sapiens
tccacgcacatgcgacccc

SEQ ID NO: 1734945 - DNA, 14 bp, Homo sapiens
tccacgcagcaccc

SEQ ID NO: 1734946 - DNA, 23 bp, Homo sapiens
tccacggcctgcccagtcgaccc

SEQ ID NO: 1734947 - DNA, 13 bp, Homo sapiens
tccacggtgcgtg

SEQ ID NO: 1734948 - DNA, 18 bp, Homo sapiens
tccacgtccccctggggc

SEQ ID NO: 1734949 - DNA, 20 bp, Homo sapiens
tccacgtgtccgtccaccct

SEQ ID NO: 1734950 - DNA, 19 bp, Homo sapiens
tccactaaatgagctcctg

SEQ ID NO: 1734951 - DNA, 20 bp, Homo sapiens
tccactaaatgagctcctgc

SEQ ID NO: 1734952 - DNA, 17 bp, Homo sapiens
tccactacacctggctg

SEQ ID NO: 1734953 - DNA, 13 bp, Homo sapiens
tccactactgcta

SEQ ID NO: 1734954 - DNA, 13 bp, Homo sapiens
tccactcactcca

SEQ ID NO: 1734955 - DNA, 18 bp, Homo sapiens
tccactcactccagccca

SEQ ID NO: 1734956 - DNA, 21 bp, Homo sapiens
tccactcactccagcccaaca

SEQ ID NO: 1734957 - DNA, 13 bp, Homo sapiens
tccactccactgc

SEQ ID NO: 1734958 - DNA, 15 bp, Homo sapiens
tccactccattgtcg

SEQ ID NO: 1734959 - DNA, 17 bp, Homo sapiens
tccactcccagcagctc

SEQ ID NO: 1734960 - DNA, 16 bp, Homo sapiens
tccactcccccacctg

SEQ ID NO: 1734961 - DNA, 9 bp, Homo sapiens
tcagtgccc

SEQ ID NO: 1734962 - DNA, 16 bp, Homo sapiens
tcagtgcccaactgtt

SEQ ID NO: 1734963 - DNA, 18 bp, Homo sapiens
tcagtgccttcctctctc

SEQ ID NO: 1734964 - DNA, 15 bp, Homo sapiens
tcagtgccttctctc

SEQ ID NO: 1734965 - DNA, 21 bp, Homo sapiens
tcagtgccttctctcagctcc

SEQ ID NO: 1734966 - DNA, 18 bp, Homo sapiens
tcagtgctataaatgcca

SEQ ID NO: 1734967 - DNA, 20 bp, Homo sapiens
tcagtgctataaatgccaga

SEQ ID NO: 1734968 - DNA, 22 bp, Homo sapiens
tcagtgctataaatgccagagc

SEQ ID NO: 1734969 - DNA, 20 bp, Homo sapiens
tcagtgctctcagctggcag

SEQ ID NO: 1734970 - DNA, 14 bp, Homo sapiens
tcagtgctgtggcc

SEQ ID NO: 1734971 - DNA, 17 bp, Homo sapiens
tcagtgctgtggcctgg

SEQ ID NO: 1734972 - DNA, 15 bp, Homo sapiens
tcagtggatcacaca

SEQ ID NO: 1734973 - DNA, 15 bp, Homo sapiens
tcagtggctctgggt

SEQ ID NO: 1734974 - DNA, 13 bp, Homo sapiens
tcagtgggagaaa

SEQ ID NO: 1734975 - DNA, 14 bp, Homo sapiens
tcagtgggagaaaa

SEQ ID NO: 1734976 - DNA, 20 bp, Homo sapiens
tcagtggggctggcatcaag

SEQ ID NO: 1734977 - DNA, 16 bp, Homo sapiens
tcagtgtaatgtgact

SEQ ID NO: 1734978 - DNA, 20 bp, Homo sapiens
tcagtgtacatggaataaca

SEQ ID NO: 1734979 - DNA, 15 bp, Homo sapiens
tcagtgtccagcttc

SEQ ID NO: 1734980 - DNA, 16 bp, Homo sapiens
tcagtgtccagcttcc

SEQ ID NO: 1734981 - DNA, 19 bp, Homo sapiens
tcagtgtccagcttccaaa

SEQ ID NO: 1734982 - DNA, 20 bp, Homo sapiens
tcagtgtccagcttccaaag

SEQ ID NO: 1734983 - DNA, 19 bp, Homo sapiens
tcagtgtcctcttgctcaa

SEQ ID NO: 1734984 - DNA, 19 bp, Homo sapiens
tcagtgtctccccgtgtcc

SEQ ID NO: 1734985 - DNA, 12 bp, Homo sapiens
tcagtgtctgaa

SEQ ID NO: 1734986 - DNA, 17 bp, Homo sapiens
tcagtgtgagtcagaat

SEQ ID NO: 1734987 - DNA, 19 bp, Homo sapiens
tcagtgtgtctaaatttga

SEQ ID NO: 1734988 - DNA, 15 bp, Homo sapiens
tcagtgttaaaaaat

SEQ ID NO: 1734989 - DNA, 17 bp, Homo sapiens
tcagtgttacctgtgtg

SEQ ID NO: 1734990 - DNA, 13 bp, Homo sapiens
tcagtgttttcat

SEQ ID NO: 1734991 - DNA, 14 bp, Homo sapiens
tcagttaattctta

SEQ ID NO: 1734992 - DNA, 17 bp, Homo sapiens
tcagttaccaaacatta

SEQ ID NO: 1734993 - DNA, 20 bp, Homo sapiens
tcagttactaagaagaaaat

SEQ ID NO: 1734994 - DNA, 15 bp, Homo sapiens
tcagttactcagccc

SEQ ID NO: 1734995 - DNA, 16 bp, Homo sapiens
tcagttactcagccct

SEQ ID NO: 1734996 - DNA, 18 bp, Homo sapiens
tcagttactcagccctgg

SEQ ID NO: 1734997 - DNA, 19 bp, Homo sapiens
tcagttactcagccctggg

SEQ ID NO: 1734998 - DNA, 16 bp, Homo sapiens
tcagttactctgaagg

SEQ ID NO: 1734999 - DNA, 17 bp, Homo sapiens
tcagttactctgaaggg

SEQ ID NO: 1735000 - DNA, 14 bp, Homo sapiens
tcagttcagcttta

SEQ ID NO: 1735001 - DNA, 20 bp, Homo sapiens
tcagttccaggcctgatctt

SEQ ID NO: 1735002 - DNA, 13 bp, Homo sapiens
tcagttcccagct

SEQ ID NO: 1735003 - DNA, 19 bp, Homo sapiens
tcagttcccagctcccccc

SEQ ID NO: 1735004 - DNA, 20 bp, Homo sapiens
tcagttcccccagtacctcc

SEQ ID NO: 1735005 - DNA, 15 bp, Homo sapiens
tcagttcccggagca

SEQ ID NO: 1735006 - DNA, 20 bp, Homo sapiens
tcagttcccggagcacagcc

SEQ ID NO: 1735007 - DNA, 22 bp, Homo sapiens
tcagttcccggagcacagccct

SEQ ID NO: 1735008 - DNA, 17 bp, Homo sapiens
tcagttcccttggcctc

SEQ ID NO: 1735009 - DNA, 18 bp, Homo sapiens
tcagttctctcccttcct

SEQ ID NO: 1735010 - DNA, 23 bp, Homo sapiens
tcagttgagagggtgcagtccag

SEQ ID NO: 1735011 - DNA, 16 bp, Homo sapiens
tcagttgcaataatac

SEQ ID NO: 1735012 - DNA, 17 bp, Homo sapiens
tcagttgcaataatact

SEQ ID NO: 1735013 - DNA, 12 bp, Homo sapiens
tcagttgtaata

SEQ ID NO: 1735014 - DNA, 20 bp, Homo sapiens
tcagttgtccttaaatttgt

SEQ ID NO: 1735015 - DNA, 21 bp, Homo sapiens
tcagttgtccttaaatttgta

SEQ ID NO: 1735016 - DNA, 15 bp, Homo sapiens
tcagttgtgactaac

SEQ ID NO: 1735017 - DNA, 18 bp, Homo sapiens
tcagttgtgttttttaag

SEQ ID NO: 1735018 - DNA, 19 bp, Homo sapiens
tcagttgtttgcttcttgc

SEQ ID NO: 1735019 - DNA, 19 bp, Homo sapiens
tcagttgtttgtttttgct

SEQ ID NO: 1735020 - DNA, 16 bp, Homo sapiens
tcagtttatttccact

SEQ ID NO: 1735021 - DNA, 18 bp, Homo sapiens
tcagtttcacagaaaata

SEQ ID NO: 1735022 - DNA, 19 bp, Homo sapiens
tcagtttcacatatttgta

SEQ ID NO: 1735023 - DNA, 18 bp, Homo sapiens
tcagtttccgaatctctt

SEQ ID NO: 1735024 - DNA, 20 bp, Homo sapiens
tcagtttgaaaatattttgt

SEQ ID NO: 1735025 - DNA, 21 bp, Homo sapiens
tcagtttgaaaatattttgtt

SEQ ID NO: 1735026 - DNA, 15 bp, Homo sapiens
tcagtttgttggaaa

SEQ ID NO: 1735027 - DNA, 13 bp, Homo sapiens
tcagttttaacta

SEQ ID NO: 1735028 - DNA, 14 bp, Homo sapiens
tcagtttttcattt

SEQ ID NO: 1735029 - DNA, 16 bp, Homo sapiens
tcagtttttcatttgt

SEQ ID NO: 1735030 - DNA, 20 bp, Homo sapiens
tcagtttttcatttgttttg

SEQ ID NO: 1735031 - DNA, 23 bp, Homo sapiens
tcagtttttcatttgttttgctt

SEQ ID NO: 1735032 - DNA, 20 bp, Homo sapiens
tcagttttttgttttacaat

SEQ ID NO: 1735033 - DNA, 20 bp, Homo sapiens
tcataaaaacaagtcatttt

SEQ ID NO: 1735034 - DNA, 22 bp, Homo sapiens
tcataaaaagcctgcaatttca

SEQ ID NO: 1735035 - DNA, 22 bp, Homo sapiens
tcataaaaataaaatctgtaaa

SEQ ID NO: 1735036 - DNA, 17 bp, Homo sapiens
tcataaaactgtgacta

SEQ ID NO: 1735037 - DNA, 12 bp, Homo sapiens
tcataaaataaa

SEQ ID NO: 1735038 - DNA, 13 bp, Homo sapiens
tcataaatactgt

SEQ ID NO: 1735039 - DNA, 20 bp, Homo sapiens
tcataacggttaagaaagca

SEQ ID NO: 1735040 - DNA, 21 bp, Homo sapiens
tcataactagattaagatctg

SEQ ID NO: 1735041 - DNA, 18 bp, Homo sapiens
tcataagcattactttat

SEQ ID NO: 1735042 - DNA, 16 bp, Homo sapiens
tcataagtatttggaa

SEQ ID NO: 1735043 - DNA, 18 bp, Homo sapiens
tcataataaactacacaa

SEQ ID NO: 1735044 - DNA, 19 bp, Homo sapiens
tcataatgaattataacag

SEQ ID NO: 1735045 - DNA, 19 bp, Homo sapiens
tcataattacattcctaac

SEQ ID NO: 1735046 - DNA, 14 bp, Homo sapiens
tcataattttgcaa

SEQ ID NO: 1735047 - DNA, 15 bp, Homo sapiens
tcatacattgtacga

SEQ ID NO: 1735048 - DNA, 17 bp, Homo sapiens
tcataccagttgttcat

SEQ ID NO: 1735049 - DNA, 18 bp, Homo sapiens
tcatacccatgcacagta

SEQ ID NO: 1735050 - DNA, 14 bp, Homo sapiens
tcatttattttgac

SEQ ID NO: 1735051 - DNA, 21 bp, Homo sapiens
tcatttattttttgtttgttt

SEQ ID NO: 1735052 - DNA, 16 bp, Homo sapiens
tcatttcacccctccc

SEQ ID NO: 1735053 - DNA, 23 bp, Homo sapiens
tcatttcacccctccctttctcc

SEQ ID NO: 1735054 - DNA, 12 bp, Homo sapiens
tcatttcacctg

SEQ ID NO: 1735055 - DNA, 13 bp, Homo sapiens
tcatttcagaagt

SEQ ID NO: 1735056 - DNA, 15 bp, Homo sapiens
tcatttcagagccct

SEQ ID NO: 1735057 - DNA, 23 bp, Homo sapiens
tcatttcccctcccaatcctctc

SEQ ID NO: 1735058 - DNA, 17 bp, Homo sapiens
tcatttccctatcttct

SEQ ID NO: 1735059 - DNA, 21 bp, Homo sapiens
tcatttcctttgttgtctaca

SEQ ID NO: 1735060 - DNA, 16 bp, Homo sapiens
tcatttgaacaactag

SEQ ID NO: 1735061 - DNA, 22 bp, Homo sapiens
tcatttggaggaaaaaaagcat

SEQ ID NO: 1735062 - DNA, 15 bp, Homo sapiens
tcatttggtctgcca

SEQ ID NO: 1735063 - DNA, 18 bp, Homo sapiens
tcatttggtgttcctgga

SEQ ID NO: 1735064 - DNA, 18 bp, Homo sapiens
tcatttgtattgcttatt

SEQ ID NO: 1735065 - DNA, 16 bp, Homo sapiens
tcatttgtcctgttct

SEQ ID NO: 1735066 - DNA, 15 bp, Homo sapiens
tcatttgttggaatg

SEQ ID NO: 1735067 - DNA, 12 bp, Homo sapiens
tcatttgtttaa

SEQ ID NO: 1735068 - DNA, 16 bp, Homo sapiens
tcattttagtgactgt

SEQ ID NO: 1735069 - DNA, 17 bp, Homo sapiens
tcattttagtgactgta

SEQ ID NO: 1735070 - DNA, 22 bp, Homo sapiens
tcattttcaagactgaattcca

SEQ ID NO: 1735071 - DNA, 19 bp, Homo sapiens
tcattttccccccactctc

SEQ ID NO: 1735072 - DNA, 12 bp, Homo sapiens
tcattttcctgt

SEQ ID NO: 1735073 - DNA, 15 bp, Homo sapiens
tcattttcctgttca

SEQ ID NO: 1735074 - DNA, 13 bp, Homo sapiens
tcattttctggtt

SEQ ID NO: 1735075 - DNA, 18 bp, Homo sapiens
tcattttgagtattttta

SEQ ID NO: 1735076 - DNA, 12 bp, Homo sapiens
tcattttgcact

SEQ ID NO: 1735077 - DNA, 20 bp, Homo sapiens
tcattttgtaacaaatgaac

SEQ ID NO: 1735078 - DNA, 20 bp, Homo sapiens
tcattttgtccatgtccccc

SEQ ID NO: 1735079 - DNA, 19 bp, Homo sapiens
tcattttgtgttgaagagc

SEQ ID NO: 1735080 - DNA, 11 bp, Homo sapiens
tcatttttaat

SEQ ID NO: 1735081 - DNA, 16 bp, Homo sapiens
tcatttttaatcatga

SEQ ID NO: 1735082 - DNA, 13 bp, Homo sapiens
tcatttttaatgt

SEQ ID NO: 1735083 - DNA, 15 bp, Homo sapiens
tcatttttcattaga

SEQ ID NO: 1735084 - DNA, 21 bp, Homo sapiens
tcattttttatatatatgcat

SEQ ID NO: 1735085 - DNA, 12 bp, Homo sapiens
tcattttttccc

SEQ ID NO: 1735086 - DNA, 13 bp, Homo sapiens
tcattttttcctg

SEQ ID NO: 1735087 - DNA, 17 bp, Homo sapiens
tcattttttcctgtttg

SEQ ID NO: 1735088 - DNA, 13 bp, Homo sapiens
tcatttttttcca

SEQ ID NO: 1735089 - DNA, 17 bp, Homo sapiens
tcatttttttctctctg

SEQ ID NO: 1735090 - DNA, 17 bp, Homo sapiens
tcatttttttttcaatc

SEQ ID NO: 1735091 - DNA, 17 bp, Homo sapiens
tccaaaaaaaggaaaaa

SEQ ID NO: 1735092 - DNA, 19 bp, Homo sapiens
tccaaaaagctcctggggc

SEQ ID NO: 1735093 - DNA, 20 bp, Homo sapiens
tccaaaacatttctggacag

SEQ ID NO: 1735094 - DNA, 17 bp, Homo sapiens
tccaaaacctgcttcct

SEQ ID NO: 1735095 - DNA, 22 bp, Homo sapiens
tccaaaacctgcttccttcagt

SEQ ID NO: 1735096 - DNA, 12 bp, Homo sapiens
tccaaaactgcc

SEQ ID NO: 1735097 - DNA, 15 bp, Homo sapiens
tccaaaacttctctt

SEQ ID NO: 1735098 - DNA, 16 bp, Homo sapiens
tccaaaacttctcttg

SEQ ID NO: 1735099 - DNA, 18 bp, Homo sapiens
tccaaaagaagcccccag

SEQ ID NO: 1735100 - DNA, 16 bp, Homo sapiens
tccaaaagattgctga

SEQ ID NO: 1735101 - DNA, 13 bp, Homo sapiens
tccaaaagctttt

SEQ ID NO: 1735102 - DNA, 16 bp, Homo sapiens
tccaaaagctttttat

SEQ ID NO: 1735103 - DNA, 15 bp, Homo sapiens
tccaaaataatttta

SEQ ID NO: 1735104 - DNA, 19 bp, Homo sapiens
tccaaaataattttaagaa

SEQ ID NO: 1735105 - DNA, 22 bp, Homo sapiens
tccaaaatgttggtcattttat

SEQ ID NO: 1735106 - DNA, 15 bp, Homo sapiens
tccaaacatccaaaa

SEQ ID NO: 1735107 - DNA, 22 bp, Homo sapiens
tccaaacatggtttattggtga

SEQ ID NO: 1735108 - DNA, 20 bp, Homo sapiens
tccaaacctccagcctccct

SEQ ID NO: 1735109 - DNA, 12 bp, Homo sapiens
tccaaacctgtc

SEQ ID NO: 1735110 - DNA, 19 bp, Homo sapiens
tccaaactgattaaatatt

SEQ ID NO: 1735111 - DNA, 20 bp, Homo sapiens
tccaaactgcctaagccctc

SEQ ID NO: 1735112 - DNA, 22 bp, Homo sapiens
tccaaagaaacactaagctctc

SEQ ID NO: 1735113 - DNA, 17 bp, Homo sapiens
tccaaagaaatgtaagg

SEQ ID NO: 1735114 - DNA, 14 bp, Homo sapiens
tccaaagactccct

SEQ ID NO: 1735115 - DNA, 23 bp, Homo sapiens
tccaaagagagttaaaagcagca

SEQ ID NO: 1735116 - DNA, 13 bp, Homo sapiens
tccaaagaggctg

SEQ ID NO: 1735117 - DNA, 16 bp, Homo sapiens
tccaaagaggctgccc

SEQ ID NO: 1735118 - DNA, 19 bp, Homo sapiens
tccaaagcacattgaaaga

SEQ ID NO: 1735119 - DNA, 20 bp, Homo sapiens
tccaaagcttattttgtaag

SEQ ID NO: 1735120 - DNA, 23 bp, Homo sapiens
tccaaaggaagtctaggagctgg

SEQ ID NO: 1735121 - DNA, 15 bp, Homo sapiens
tccaaaggaggctgg

SEQ ID NO: 1735122 - DNA, 19 bp, Homo sapiens
tccaaaggaggctggcagg

SEQ ID NO: 1735123 - DNA, 19 bp, Homo sapiens
tccaaagtcagatctggtc

SEQ ID NO: 1735124 - DNA, 14 bp, Homo sapiens
tccaaagtctctaa

SEQ ID NO: 1735125 - DNA, 18 bp, Homo sapiens
tccaaagtggagctggga

SEQ ID NO: 1735126 - DNA, 19 bp, Homo sapiens
tccaaatatgttaagggct

SEQ ID NO: 1735127 - DNA, 22 bp, Homo sapiens
tccaaatattattcaagtgcct

SEQ ID NO: 1735128 - DNA, 15 bp, Homo sapiens
tccaaatcctggaag

SEQ ID NO: 1735129 - DNA, 21 bp, Homo sapiens
tccaaatcctggaaggacaca

SEQ ID NO: 1735130 - DNA, 18 bp, Homo sapiens
tccaaatctgtcctctgt

SEQ ID NO: 1735131 - DNA, 23 bp, Homo sapiens
tccaaatctgtcctctgtagtat

SEQ ID NO: 1735132 - DNA, 17 bp, Homo sapiens
tccaaatgtgtcagaat

SEQ ID NO: 1735133 - DNA, 17 bp, Homo sapiens
tccaaattaaaacaaat

SEQ ID NO: 1735134 - DNA, 18 bp, Homo sapiens
tccaaattaaaacaaata

SEQ ID NO: 1735135 - DNA, 19 bp, Homo sapiens
tccaaattaaaacaaatat

SEQ ID NO: 1735136 - DNA, 13 bp, Homo sapiens
tccaaattcacaa

SEQ ID NO: 1735137 - DNA, 12 bp, Homo sapiens
tccaacaataaa

SEQ ID NO: 1735138 - DNA, 11 bp, Homo sapiens
tccaaccactg

SEQ ID NO: 1735139 - DNA, 16 bp, Homo sapiens
tccaaccactgtgcca

SEQ ID NO: 1735140 - DNA, 23 bp, Homo sapiens
tccaaccactgtgccactgactt

SEQ ID NO: 1735141 - DNA, 14 bp, Homo sapiens
tccaaccagacctg

SEQ ID NO: 1735142 - DNA, 16 bp, Homo sapiens
tccaaccagacctgga

SEQ ID NO: 1735143 - DNA, 17 bp, Homo sapiens
tccaaccccccagcact

SEQ ID NO: 1735144 - DNA, 18 bp, Homo sapiens
tccaaccccccagcactg

SEQ ID NO: 1735145 - DNA, 23 bp, Homo sapiens
tccaaccccccagcactgaggaa

SEQ ID NO: 1735146 - DNA, 22 bp, Homo sapiens
tccaacccccgccacctcaggg

SEQ ID NO: 1735147 - DNA, 22 bp, Homo sapiens
tccaacccgtctggcccaccag

SEQ ID NO: 1735148 - DNA, 23 bp, Homo sapiens
tccaacccgtctggcccaccagg

SEQ ID NO: 1735149 - DNA, 20 bp, Homo sapiens
tccaacctaacccctttcct

SEQ ID NO: 1735150 - DNA, 14 bp, Homo sapiens
tccaacctcctgct

SEQ ID NO: 1735151 - DNA, 21 bp, Homo sapiens
tccaacctggggggcagtggt

SEQ ID NO: 1735152 - DNA, 16 bp, Homo sapiens
tccaacgcccctgtgg

SEQ ID NO: 1735153 - DNA, 20 bp, Homo sapiens
tccaacgcccctgtggccaa

SEQ ID NO: 1735154 - DNA, 21 bp, Homo sapiens
tccaacgcccctgtggccaac

SEQ ID NO: 1735155 - DNA, 14 bp, Homo sapiens
tccaacgccgcctt

SEQ ID NO: 1735156 - DNA, 23 bp, Homo sapiens
tccaacgccgccttggccttgca

SEQ ID NO: 1735157 - DNA, 14 bp, Homo sapiens
tccaacgtggccca

SEQ ID NO: 1735158 - DNA, 19 bp, Homo sapiens
tccaactaatgccttactc

SEQ ID NO: 1735159 - DNA, 20 bp, Homo sapiens
tccaactcctttcagccaca

SEQ ID NO: 1735160 - DNA, 21 bp, Homo sapiens
tccaactggattataaataaa

SEQ ID NO: 1735161 - DNA, 19 bp, Homo sapiens
tccaactgggcatttcaat

SEQ ID NO: 1735162 - DNA, 18 bp, Homo sapiens
tccaacttatgtttttaa

SEQ ID NO: 1735163 - DNA, 20 bp, Homo sapiens
tccaactttatcatggaatt

SEQ ID NO: 1735164 - DNA, 22 bp, Homo sapiens
tccaagaatccacatttctaaa

SEQ ID NO: 1735165 - DNA, 13 bp, Homo sapiens
tccaagactctag

SEQ ID NO: 1735166 - DNA, 15 bp, Homo sapiens
tccaagactctagag

SEQ ID NO: 1735167 - DNA, 14 bp, Homo sapiens
tccaagaggctgta

SEQ ID NO: 1735168 - DNA, 15 bp, Homo sapiens
tccaagagtctaaag

SEQ ID NO: 1735169 - DNA, 13 bp, Homo sapiens
tccaagattccgg

SEQ ID NO: 1735170 - DNA, 14 bp, Homo sapiens
tccaagattctaga

SEQ ID NO: 1735171 - DNA, 15 bp, Homo sapiens
tccaagattctagat

SEQ ID NO: 1735172 - DNA, 20 bp, Homo sapiens
tccaagcatcaccctgggag

SEQ ID NO: 1735173 - DNA, 12 bp, Homo sapiens
tccaagccagag

SEQ ID NO: 1735174 - DNA, 15 bp, Homo sapiens
tccaagccccatctt

SEQ ID NO: 1735175 - DNA, 16 bp, Homo sapiens
tccaagcctccacagc

SEQ ID NO: 1735176 - DNA, 17 bp, Homo sapiens
tccaagcctccacagcg

SEQ ID NO: 1735177 - DNA, 13 bp, Homo sapiens
tccaagcctgcct

SEQ ID NO: 1735178 - DNA, 14 bp, Homo sapiens
tccaagcctgcctc

SEQ ID NO: 1735179 - DNA, 17 bp, Homo sapiens
tccaagcctgcctccca

SEQ ID NO: 1735180 - DNA, 23 bp, Homo sapiens
tccaagcgaggtcaacagagaag

SEQ ID NO: 1735181 - DNA, 16 bp, Homo sapiens
tccaaggagaaacaga

SEQ ID NO: 1735182 - DNA, 19 bp, Homo sapiens
tccaaggagaaacagagac

SEQ ID NO: 1735183 - DNA, 22 bp, Homo sapiens
tccaaggagaaacagagacagg

SEQ ID NO: 1735184 - DNA, 18 bp, Homo sapiens
tccaaggagaccaagtcc

SEQ ID NO: 1735185 - DNA, 20 bp, Homo sapiens
tccaaggaggggctgtaaaa

SEQ ID NO: 1735186 - DNA, 12 bp, Homo sapiens
tccaaggccctg

SEQ ID NO: 1735187 - DNA, 18 bp, Homo sapiens
tccaagggacagcccacg

SEQ ID NO: 1735188 - DNA, 23 bp, Homo sapiens
tccaagggagggtgcagccctct

SEQ ID NO: 1735189 - DNA, 23 bp, Homo sapiens
tccaagggccgtgcccttgccct

SEQ ID NO: 1735190 - DNA, 16 bp, Homo sapiens
tccaagggcttctgca

SEQ ID NO: 1735191 - DNA, 23 bp, Homo sapiens
tccaagggcttctgcaccctcca

SEQ ID NO: 1735192 - DNA, 14 bp, Homo sapiens
tccaagggtttcga

SEQ ID NO: 1735193 - DNA, 22 bp, Homo sapiens
tccaagggtttcgactggtcca

SEQ ID NO: 1735194 - DNA, 17 bp, Homo sapiens
tccaagtaccaatgctg

SEQ ID NO: 1735195 - DNA, 20 bp, Homo sapiens
tccaagtaccaatgctgttg

SEQ ID NO: 1735196 - DNA, 20 bp, Homo sapiens
tccaagtcactagaagtcct

SEQ ID NO: 1735197 - DNA, 19 bp, Homo sapiens
tccaagtctttgctattgt

SEQ ID NO: 1735198 - DNA, 20 bp, Homo sapiens
tccaagtgaacactagccag

SEQ ID NO: 1735199 - DNA, 22 bp, Homo sapiens
tccaagtggtgggaatcagatc

SEQ ID NO: 1735200 - DNA, 20 bp, Homo sapiens
tccaagttccccatccctgt

SEQ ID NO: 1735201 - DNA, 14 bp, Homo sapiens
tccaatatgtgatt

SEQ ID NO: 1735202 - DNA, 16 bp, Homo sapiens
tccaatatgtgatttt

SEQ ID NO: 1735203 - DNA, 16 bp, Homo sapiens
tccaatattttgcctt

SEQ ID NO: 1735204 - DNA, 17 bp, Homo sapiens
tccaatattttgccttt

SEQ ID NO: 1735205 - DNA, 18 bp, Homo sapiens
tccaatcccaccaaccct

SEQ ID NO: 1735206 - DNA, 15 bp, Homo sapiens
tccaatgcattggcc

SEQ ID NO: 1735207 - DNA, 19 bp, Homo sapiens
tccaatggggccagcactg

SEQ ID NO: 1735208 - DNA, 17 bp, Homo sapiens
tccaattctaaatccga

SEQ ID NO: 1735209 - DNA, 23 bp, Homo sapiens
tccaattctaaatccgacttgaa

SEQ ID NO: 1735210 - DNA, 13 bp, Homo sapiens
tccaattgatgta

SEQ ID NO: 1735211 - DNA, 16 bp, Homo sapiens
tccaattgatgtatat

SEQ ID NO: 1735212 - DNA, 18 bp, Homo sapiens
tccaatttacatactctg

SEQ ID NO: 1735213 - DNA, 19 bp, Homo sapiens
tccacaagattcccagaga

SEQ ID NO: 1735214 - DNA, 18 bp, Homo sapiens
tccacaaggaataaatga

SEQ ID NO: 1735215 - DNA, 21 bp, Homo sapiens
tcagagtttgtgtgtatttgt

SEQ ID NO: 1735216 - DNA, 23 bp, Homo sapiens
tcagagtttgtgtgtatttgtat

SEQ ID NO: 1735217 - DNA, 15 bp, Homo sapiens
tcagatataagagaa

SEQ ID NO: 1735218 - DNA, 21 bp, Homo sapiens
tcagatatcttggacaaatca

SEQ ID NO: 1735219 - DNA, 15 bp, Homo sapiens
tcagatatttcttat

SEQ ID NO: 1735220 - DNA, 13 bp, Homo sapiens
tcagatatttgca

SEQ ID NO: 1735221 - DNA, 13 bp, Homo sapiens
tcagatcagtgct

SEQ ID NO: 1735222 - DNA, 20 bp, Homo sapiens
tcagatcattatcagcctgt

SEQ ID NO: 1735223 - DNA, 16 bp, Homo sapiens
tcagatcctgttactt

SEQ ID NO: 1735224 - DNA, 19 bp, Homo sapiens
tcagatccttgtttcaaac

SEQ ID NO: 1735225 - DNA, 17 bp, Homo sapiens
tcaaatatgcaaagcac

SEQ ID NO: 1735226 - DNA, 14 bp, Homo sapiens
tcaaatatttcttg

SEQ ID NO: 1735227 - DNA, 17 bp, Homo sapiens
tcaaatcagtgatctat

SEQ ID NO: 1735228 - DNA, 18 bp, Homo sapiens
tcaaatcagtgatctatg

SEQ ID NO: 1735229 - DNA, 21 bp, Homo sapiens
tcaaatcagtgatctatgttt

SEQ ID NO: 1735230 - DNA, 14 bp, Homo sapiens
tcaaatcatcatta

SEQ ID NO: 1735231 - DNA, 16 bp, Homo sapiens
tcaaatccagtggtgg

SEQ ID NO: 1735232 - DNA, 19 bp, Homo sapiens
tcaaatccagtggtgggta

SEQ ID NO: 1735233 - DNA, 20 bp, Homo sapiens
tcaaatccagtggtgggtaa

SEQ ID NO: 1735234 - DNA, 16 bp, Homo sapiens
tcaaatccctctccaa

SEQ ID NO: 1735235 - DNA, 13 bp, Homo sapiens
tcaaatcctcacc

SEQ ID NO: 1735236 - DNA, 20 bp, Homo sapiens
tcaaatctaccactgtatga

SEQ ID NO: 1735237 - DNA, 13 bp, Homo sapiens
tcaaatctctgtt

SEQ ID NO: 1735238 - DNA, 17 bp, Homo sapiens
tcaaatctctgttactc

SEQ ID NO: 1735239 - DNA, 22 bp, Homo sapiens
tcaaatctgcttcatccaatgt

SEQ ID NO: 1735240 - DNA, 19 bp, Homo sapiens
tcaaatctgtaatcagcaa

SEQ ID NO: 1735241 - DNA, 14 bp, Homo sapiens
tcaaatcttaagaa

SEQ ID NO: 1735242 - DNA, 17 bp, Homo sapiens
tcaaatcttaagaaata

SEQ ID NO: 1735243 - DNA, 23 bp, Homo sapiens
tcaaatgaaatgtatgcattcac

SEQ ID NO: 1735244 - DNA, 20 bp, Homo sapiens
tcaaatggggccagatccag

SEQ ID NO: 1735245 - DNA, 15 bp, Homo sapiens
tcaaatgttctaagt

SEQ ID NO: 1735246 - DNA, 16 bp, Homo sapiens
tcaaatgtttccttaa

SEQ ID NO: 1735247 - DNA, 23 bp, Homo sapiens
tcaaatgtttccttaaacatgaa

SEQ ID NO: 1735248 - DNA, 23 bp, Homo sapiens
tcaaattaatctttctttacctg

SEQ ID NO: 1735249 - DNA, 17 bp, Homo sapiens
tcaaattagaagacatt

SEQ ID NO: 1735250 - DNA, 22 bp, Homo sapiens
tcaaattgtgcagtactttgtg

SEQ ID NO: 1735251 - DNA, 12 bp, Homo sapiens
tcaaatttgtac

SEQ ID NO: 1735252 - DNA, 22 bp, Homo sapiens
tcaaatttgtacaggactgtaa

SEQ ID NO: 1735253 - DNA, 20 bp, Homo sapiens
tcaacaagaatattgtatgt

SEQ ID NO: 1735254 - DNA, 20 bp, Homo sapiens
tcaacaagatttccttgtgc

SEQ ID NO: 1735255 - DNA, 18 bp, Homo sapiens
tcaacaataaaatttttt

SEQ ID NO: 1735256 - DNA, 19 bp, Homo sapiens
tcaacaatggttgaatgaa

SEQ ID NO: 1735257 - DNA, 23 bp, Homo sapiens
tcaacacttaagggttttagaaa

SEQ ID NO: 1735258 - DNA, 16 bp, Homo sapiens
tcaacacttattttct

SEQ ID NO: 1735259 - DNA, 20 bp, Homo sapiens
tcaacagaacatatgttgca

SEQ ID NO: 1735260 - DNA, 14 bp, Homo sapiens
tcaacagacaatta

SEQ ID NO: 1735261 - DNA, 17 bp, Homo sapiens
tcaacagagaaggcagg

SEQ ID NO: 1735262 - DNA, 16 bp, Homo sapiens
tcaacagagactgaat

SEQ ID NO: 1735263 - DNA, 19 bp, Homo sapiens
tcaacagagaggaccaaca

SEQ ID NO: 1735264 - DNA, 15 bp, Homo sapiens
tcaaggctgtgcagg

SEQ ID NO: 1735265 - DNA, 20 bp, Homo sapiens
tcaagggaaaaccccgtctc

SEQ ID NO: 1735266 - DNA, 13 bp, Homo sapiens
tcaagggaagaaa

SEQ ID NO: 1735267 - DNA, 21 bp, Homo sapiens
tcaagggaatgtaactgctga

SEQ ID NO: 1735268 - DNA, 16 bp, Homo sapiens
tcaagggagacaccag

SEQ ID NO: 1735269 - DNA, 14 bp, Homo sapiens
tcaagggctgtagg

SEQ ID NO: 1735270 - DNA, 16 bp, Homo sapiens
tcaagggtggcaggtc

SEQ ID NO: 1735271 - DNA, 22 bp, Homo sapiens
tcaagggtggcaggtcactgtc

SEQ ID NO: 1735272 - DNA, 18 bp, Homo sapiens
tcaaggtcatcaaacatt

SEQ ID NO: 1735273 - DNA, 11 bp, Homo sapiens
tcaaggtgaag

SEQ ID NO: 1735274 - DNA, 18 bp, Homo sapiens
tcaaggtgagaattaagt

SEQ ID NO: 1735275 - DNA, 18 bp, Homo sapiens
tcaaggttactgggagtg

SEQ ID NO: 1735276 - DNA, 19 bp, Homo sapiens
tcaaggttactgggagtgt

SEQ ID NO: 1735277 - DNA, 23 bp, Homo sapiens
tcaaggttactgggagtgtgggc

SEQ ID NO: 1735278 - DNA, 18 bp, Homo sapiens
tcaaggttttaaaacagt

SEQ ID NO: 1735279 - DNA, 16 bp, Homo sapiens
tcaagtaagaagacat

SEQ ID NO: 1735280 - DNA, 19 bp, Homo sapiens
tcaagtaatccacctgcct

SEQ ID NO: 1735281 - DNA, 15 bp, Homo sapiens
tcaagtaattgtgaa

SEQ ID NO: 1735282 - DNA, 16 bp, Homo sapiens
tcaagtaattgtgaaa

SEQ ID NO: 1735283 - DNA, 22 bp, Homo sapiens
tcaagtaccaccaagggatctg

SEQ ID NO: 1735284 - DNA, 17 bp, Homo sapiens
tcaagtagactactgtt

SEQ ID NO: 1735285 - DNA, 18 bp, Homo sapiens
tcaagtagctgggactac

SEQ ID NO: 1735286 - DNA, 16 bp, Homo sapiens
tcaagtatcttctatt

SEQ ID NO: 1735287 - DNA, 16 bp, Homo sapiens
tcaagtatttaagcct

SEQ ID NO: 1735288 - DNA, 22 bp, Homo sapiens
tcaagtatttaagcctaaagat

SEQ ID NO: 1735289 - DNA, 14 bp, Homo sapiens
tcaagtccatctga

SEQ ID NO: 1735290 - DNA, 16 bp, Homo sapiens
tcaagtctctgctggc

SEQ ID NO: 1735291 - DNA, 19 bp, Homo sapiens
tcaagtctctgctggccca

SEQ ID NO: 1735292 - DNA, 20 bp, Homo sapiens
tcaagtgatctgcccacctc

SEQ ID NO: 1735293 - DNA, 19 bp, Homo sapiens
tcaagtgcatgctctctgc

SEQ ID NO: 1735294 - DNA, 18 bp, Homo sapiens
tcaagtgcctagactgtt

SEQ ID NO: 1735295 - DNA, 22 bp, Homo sapiens
tcaagtgcctcttgttgcagag

SEQ ID NO: 1735296 - DNA, 23 bp, Homo sapiens
tcaagttattcaaatttgtacag

SEQ ID NO: 1735297 - DNA, 16 bp, Homo sapiens
tcaagttcccaactga

SEQ ID NO: 1735298 - DNA, 15 bp, Homo sapiens
tcaagttctaagatt

SEQ ID NO: 1735299 - DNA, 18 bp, Homo sapiens
tcaagttctaagattcta

SEQ ID NO: 1735300 - DNA, 22 bp, Homo sapiens
tcaagttctggacctgggcatg

SEQ ID NO: 1735301 - DNA, 17 bp, Homo sapiens
tcaagttggacttgttt

SEQ ID NO: 1735302 - DNA, 18 bp, Homo sapiens
tcaagttgttgactgtga

SEQ ID NO: 1735303 - DNA, 21 bp, Homo sapiens
tcaagttttgggggtgggctg

SEQ ID NO: 1735304 - DNA, 21 bp, Homo sapiens
tcaagttttgggtatgtttaa

SEQ ID NO: 1735305 - DNA, 22 bp, Homo sapiens
tcaataaaaaaaagaaatgaaa

SEQ ID NO: 1735306 - DNA, 16 bp, Homo sapiens
tcaataaacaacagct

SEQ ID NO: 1735307 - DNA, 14 bp, Homo sapiens
tcaataaacagctt

SEQ ID NO: 1735308 - DNA, 12 bp, Homo sapiens
tcaataaactta

SEQ ID NO: 1735309 - DNA, 18 bp, Homo sapiens
tcaataacactgtatttt

SEQ ID NO: 1735310 - DNA, 14 bp, Homo sapiens
tcaatacactagtt

SEQ ID NO: 1735311 - DNA, 20 bp, Homo sapiens
tcaataccgctcagtatttt

SEQ ID NO: 1735312 - DNA, 15 bp, Homo sapiens
tcaatacttttgtgt

SEQ ID NO: 1735313 - DNA, 16 bp, Homo sapiens
tcaatagatctccagc

SEQ ID NO: 1735314 - DNA, 13 bp, Homo sapiens
tcaatagttgaat

SEQ ID NO: 1735315 - DNA, 15 bp, Homo sapiens
tcaatataagaagca

SEQ ID NO: 1735316 - DNA, 20 bp, Homo sapiens
tcaatataagaagcaatctt

SEQ ID NO: 1735317 - DNA, 18 bp, Homo sapiens
tcaatatccctcttgtaa

SEQ ID NO: 1735318 - DNA, 19 bp, Homo sapiens
tcaatatccctcttgtaag

SEQ ID NO: 1735319 - DNA, 13 bp, Homo sapiens
tcaatatctaata

SEQ ID NO: 1735320 - DNA, 14 bp, Homo sapiens
tcaatatgaatcta

SEQ ID NO: 1735321 - DNA, 17 bp, Homo sapiens
tcaatatgaatctataa

SEQ ID NO: 1735322 - DNA, 14 bp, Homo sapiens
tcaatattaaatac

SEQ ID NO: 1735323 - DNA, 19 bp, Homo sapiens
tcaatattaaatacagaca

SEQ ID NO: 1735324 - DNA, 22 bp, Homo sapiens
tcaatattaaatacagacacta

SEQ ID NO: 1735325 - DNA, 14 bp, Homo sapiens
tcaatattcctgaa

SEQ ID NO: 1735326 - DNA, 17 bp, Homo sapiens
tcaatattcctgaatga

SEQ ID NO: 1735327 - DNA, 10 bp, Homo sapiens
tcaatattta

SEQ ID NO: 1735328 - DNA, 16 bp, Homo sapiens
tcaatatttagaaaat

SEQ ID NO: 1735329 - DNA, 21 bp, Homo sapiens
tcaatatttagaaaattttgt

SEQ ID NO: 1735330 - DNA, 22 bp, Homo sapiens
tcaatatttagaaaattttgta

SEQ ID NO: 1735331 - DNA, 20 bp, Homo sapiens
tcaatatttattattttcac

SEQ ID NO: 1735332 - DNA, 14 bp, Homo sapiens
tcaatcaactttac

SEQ ID NO: 1735333 - DNA, 15 bp, Homo sapiens
tcaatcagtataatt

SEQ ID NO: 1735334 - DNA, 14 bp, Homo sapiens
tcaatcagtgcagt

SEQ ID NO: 1735335 - DNA, 13 bp, Homo sapiens
tcaatcatgccct

SEQ ID NO: 1735336 - DNA, 16 bp, Homo sapiens
tcaatcatttattcat

SEQ ID NO: 1735337 - DNA, 15 bp, Homo sapiens
tcaatcccctcattc

SEQ ID NO: 1735338 - DNA, 22 bp, Homo sapiens
tcaatcccctcattcaggaaaa

SEQ ID NO: 1735339 - DNA, 22 bp, Homo sapiens
tcaatcctaatttctcctccct

SEQ ID NO: 1735340 - DNA, 20 bp, Homo sapiens
tcaatctcccgctgctgctg

SEQ ID NO: 1735341 - DNA, 21 bp, Homo sapiens
tcaatctcctctctctttcct

SEQ ID NO: 1735342 - DNA, 12 bp, Homo sapiens
tcaatctctgtt

SEQ ID NO: 1735343 - DNA, 13 bp, Homo sapiens
tcaatctgtaaac

SEQ ID NO: 1735344 - DNA, 14 bp, Homo sapiens
tcaatctgtaaact

SEQ ID NO: 1735345 - DNA, 13 bp, Homo sapiens
tcaatcttgttac

SEQ ID NO: 1735346 - DNA, 14 bp, Homo sapiens
tcagatctgaacac

SEQ ID NO: 1735347 - DNA, 14 bp, Homo sapiens
tcagatctgaggtt

SEQ ID NO: 1735348 - DNA, 16 bp, Homo sapiens
tcagatgccacttcta

SEQ ID NO: 1735349 - DNA, 14 bp, Homo sapiens
tcagatgcccagag

SEQ ID NO: 1735350 - DNA, 22 bp, Homo sapiens
tcagatgcccagagggcccagg

SEQ ID NO: 1735351 - DNA, 16 bp, Homo sapiens
tcagatgctccaagat

SEQ ID NO: 1735352 - DNA, 18 bp, Homo sapiens
tcagatgctccaagattc

SEQ ID NO: 1735353 - DNA, 14 bp, Homo sapiens
tcagatgcttctgg

SEQ ID NO: 1735354 - DNA, 20 bp, Homo sapiens
tcagatggaaaattcatttt

SEQ ID NO: 1735355 - DNA, 18 bp, Homo sapiens
tcagatggaagagataaa

SEQ ID NO: 1735356 - DNA, 23 bp, Homo sapiens
tcagatgggtctgatattaatca

SEQ ID NO: 1735357 - DNA, 15 bp, Homo sapiens
tcagatgtcttctgc

SEQ ID NO: 1735358 - DNA, 16 bp, Homo sapiens
tcagatgtcttctgcc

SEQ ID NO: 1735359 - DNA, 17 bp, Homo sapiens
tcagatgtcttctgcct

SEQ ID NO: 1735360 - DNA, 16 bp, Homo sapiens
tcagatgtgcaataat

SEQ ID NO: 1735361 - DNA, 12 bp, Homo sapiens
tcagatgtgcat

SEQ ID NO: 1735362 - DNA, 17 bp, Homo sapiens
tcagatgtgtgttctca

SEQ ID NO: 1735363 - DNA, 14 bp, Homo sapiens
tcagattcccagag

SEQ ID NO: 1735364 - DNA, 18 bp, Homo sapiens
tcagatttaagccttaca

SEQ ID NO: 1735365 - DNA, 21 bp, Homo sapiens
tcagatttgaactcttcaatc

SEQ ID NO: 1735366 - DNA, 22 bp, Homo sapiens
tcagatttgccttattggcagc

SEQ ID NO: 1735367 - DNA, 22 bp, Homo sapiens
tcagcaaaccatttttaaagta

SEQ ID NO: 1735368 - DNA, 18 bp, Homo sapiens
tcagcaacaagactgcca

SEQ ID NO: 1735369 - DNA, 20 bp, Homo sapiens
tcagcaacaagactgccagg

SEQ ID NO: 1735370 - DNA, 19 bp, Homo sapiens
tcagcaactgaggtaacct

SEQ ID NO: 1735371 - DNA, 12 bp, Homo sapiens
tcagcaagactt

SEQ ID NO: 1735372 - DNA, 20 bp, Homo sapiens
tcagcaagaggaggacagaa

SEQ ID NO: 1735373 - DNA, 22 bp, Homo sapiens
tcagcaagtgcccagtggagcc

SEQ ID NO: 1735374 - DNA, 19 bp, Homo sapiens
tcagcaagttagaactagc

SEQ ID NO: 1735375 - DNA, 21 bp, Homo sapiens
tcagcaagttagaactagcca

SEQ ID NO: 1735376 - DNA, 18 bp, Homo sapiens
tcagcaatttcagaacca

SEQ ID NO: 1735377 - DNA, 23 bp, Homo sapiens
tcagcacaatctgtaaattttta

SEQ ID NO: 1735378 - DNA, 14 bp, Homo sapiens
tcagcaccacccta

SEQ ID NO: 1735379 - DNA, 23 bp, Homo sapiens
tcagcaccaccctagtcccttcc

SEQ ID NO: 1735380 - DNA, 13 bp, Homo sapiens
tcagcaccccagt

SEQ ID NO: 1735381 - DNA, 16 bp, Homo sapiens
tcagcaccctgggtgc

SEQ ID NO: 1735382 - DNA, 13 bp, Homo sapiens
tcagcaccttggc

SEQ ID NO: 1735383 - DNA, 21 bp, Homo sapiens
tcagcaccttggcccaggagc

SEQ ID NO: 1735384 - DNA, 22 bp, Homo sapiens
tcagcaccttggcccaggagct

SEQ ID NO: 1735385 - DNA, 12 bp, Homo sapiens
tcagcactgaaa

SEQ ID NO: 1735386 - DNA, 17 bp, Homo sapiens
tcagcactgatttcaca

SEQ ID NO: 1735387 - DNA, 20 bp, Homo sapiens
tcagcactgatttcacaaca

SEQ ID NO: 1735388 - DNA, 13 bp, Homo sapiens
tcagcactgtccc

SEQ ID NO: 1735389 - DNA, 19 bp, Homo sapiens
tcagcagaacctgcacaca

SEQ ID NO: 1735390 - DNA, 22 bp, Homo sapiens
tcagcagagttattgaatctta

SEQ ID NO: 1735391 - DNA, 14 bp, Homo sapiens
tcagcagccagtct

SEQ ID NO: 1735392 - DNA, 18 bp, Homo sapiens
tcagcagccctcctcacc

SEQ ID NO: 1735393 - DNA, 20 bp, Homo sapiens
tcagcaggcccttcccattc

SEQ ID NO: 1735394 - DNA, 16 bp, Homo sapiens
tcagcatagcctgcct

SEQ ID NO: 1735395 - DNA, 20 bp, Homo sapiens
tcagcatagcctgcctgatc

SEQ ID NO: 1735396 - DNA, 17 bp, Homo sapiens
tcagcatctgaccatct

SEQ ID NO: 1735397 - DNA, 23 bp, Homo sapiens
tcagcatgaagaattttttctca

SEQ ID NO: 1735398 - DNA, 19 bp, Homo sapiens
tcagcatgtctattcagct

SEQ ID NO: 1735399 - DNA, 23 bp, Homo sapiens
tcagcattcaaaatagttctatt

SEQ ID NO: 1735400 - DNA, 19 bp, Homo sapiens
tcagcatttcttttctggc

SEQ ID NO: 1735401 - DNA, 22 bp, Homo sapiens
tcagccaaatgtaattgaataa

SEQ ID NO: 1735402 - DNA, 22 bp, Homo sapiens
tcagccaaatttcctgtttgaa

SEQ ID NO: 1735403 - DNA, 22 bp, Homo sapiens
tcagccaaggttttataaggct

SEQ ID NO: 1735404 - DNA, 23 bp, Homo sapiens
tcagccaaggttttataaggctg

SEQ ID NO: 1735405 - DNA, 14 bp, Homo sapiens
tcagccacactggg

SEQ ID NO: 1735406 - DNA, 13 bp, Homo sapiens
tcagccacagcct

SEQ ID NO: 1735407 - DNA, 19 bp, Homo sapiens
tcagccaccctgaggcctc

SEQ ID NO: 1735408 - DNA, 16 bp, Homo sapiens
tcagccaccctgagtt

SEQ ID NO: 1735409 - DNA, 17 bp, Homo sapiens
tcagccaccctgagttg

SEQ ID NO: 1735410 - DNA, 23 bp, Homo sapiens
tcagccaggaccataccgggtct

SEQ ID NO: 1735411 - DNA, 12 bp, Homo sapiens
tcagccaggagc

SEQ ID NO: 1735412 - DNA, 13 bp, Homo sapiens
tcagccaggagct

SEQ ID NO: 1735413 - DNA, 19 bp, Homo sapiens
tcagccaggagctgggcag

SEQ ID NO: 1735414 - DNA, 23 bp, Homo sapiens
tcagccatgaggagttgctgttt

SEQ ID NO: 1735415 - DNA, 11 bp, Homo sapiens
tcagccatgtt

SEQ ID NO: 1735416 - DNA, 16 bp, Homo sapiens
tcagccatttccccct

SEQ ID NO: 1735417 - DNA, 18 bp, Homo sapiens
tcagccatttccccctcc

SEQ ID NO: 1735418 - DNA, 23 bp, Homo sapiens
tcagccatttccccctcctcaga

SEQ ID NO: 1735419 - DNA, 17 bp, Homo sapiens
tcagccatttttaatga

SEQ ID NO: 1735420 - DNA, 16 bp, Homo sapiens
tcagcccaccaccctg

SEQ ID NO: 1735421 - DNA, 12 bp, Homo sapiens
tcagcccagcac

SEQ ID NO: 1735422 - DNA, 14 bp, Homo sapiens
tcagcccagcacct

SEQ ID NO: 1735423 - DNA, 15 bp, Homo sapiens
tcagcccagcacctg

SEQ ID NO: 1735424 - DNA, 11 bp, Homo sapiens
tcagcccagct

SEQ ID NO: 1735425 - DNA, 15 bp, Homo sapiens
tcagcccagctggcc

SEQ ID NO: 1735426 - DNA, 21 bp, Homo sapiens
tcagcccaggcttttgctaga

SEQ ID NO: 1735427 - DNA, 23 bp, Homo sapiens
tcagcccctcaaagggagagaaa

SEQ ID NO: 1735428 - DNA, 14 bp, Homo sapiens
tcagcccctcctct

SEQ ID NO: 1735429 - DNA, 18 bp, Homo sapiens
tcagcccctcctctgcca

SEQ ID NO: 1735430 - DNA, 19 bp, Homo sapiens
tcagcccctcctctgccac

SEQ ID NO: 1735431 - DNA, 23 bp, Homo sapiens
tcagcccctcctctgccacctcc

SEQ ID NO: 1735432 - DNA, 18 bp, Homo sapiens
tcagcccgtttcagaagg

SEQ ID NO: 1735433 - DNA, 22 bp, Homo sapiens
tcagccctagaggcgagccagg

SEQ ID NO: 1735434 - DNA, 15 bp, Homo sapiens
tcagccctccctgcc

SEQ ID NO: 1735435 - DNA, 17 bp, Homo sapiens
tcagccctccctgcccc

SEQ ID NO: 1735436 - DNA, 12 bp, Homo sapiens
tcagccctggcc

SEQ ID NO: 1735437 - DNA, 13 bp, Homo sapiens
tcagccctggccc

SEQ ID NO: 1735438 - DNA, 17 bp, Homo sapiens
tcagccctggccctgcc

SEQ ID NO: 1735439 - DNA, 19 bp, Homo sapiens
tcagccctggccctgccca

SEQ ID NO: 1735440 - DNA, 18 bp, Homo sapiens
tcagccctgggccccacc

SEQ ID NO: 1735441 - DNA, 19 bp, Homo sapiens
tcagccctgggccccacca

SEQ ID NO: 1735442 - DNA, 18 bp, Homo sapiens
tcagccgagccgggcctg

SEQ ID NO: 1735443 - DNA, 21 bp, Homo sapiens
tcagcctactccgctcactga

SEQ ID NO: 1735444 - DNA, 20 bp, Homo sapiens
tcagcctagccgacctcagc

SEQ ID NO: 1735445 - DNA, 22 bp, Homo sapiens
tcagcctagccgacctcagcct

SEQ ID NO: 1735446 - DNA, 23 bp, Homo sapiens
tcagcctagccgacctcagcctt

SEQ ID NO: 1735447 - DNA, 18 bp, Homo sapiens
tcagcctcattcagcatg

SEQ ID NO: 1735448 - DNA, 13 bp, Homo sapiens
tcaggccagggct

SEQ ID NO: 1735449 - DNA, 17 bp, Homo sapiens
tcaggccaggtgcagtg

SEQ ID NO: 1735450 - DNA, 18 bp, Homo sapiens
tcaggccaggtgcagtgg

SEQ ID NO: 1735451 - DNA, 12 bp, Homo sapiens
tcaggcccaggc

SEQ ID NO: 1735452 - DNA, 16 bp, Homo sapiens
tcaggccccgggcttc

SEQ ID NO: 1735453 - DNA, 17 bp, Homo sapiens
tcaggcccgtcggagct

SEQ ID NO: 1735454 - DNA, 18 bp, Homo sapiens
tcaggcccgtcggagctg

SEQ ID NO: 1735455 - DNA, 19 bp, Homo sapiens
tcaggcccgtcggagctgc

SEQ ID NO: 1735456 - DNA, 22 bp, Homo sapiens
tcaggcccgtcggagctgcctg

SEQ ID NO: 1735457 - DNA, 15 bp, Homo sapiens
tcaggccctctgcct

SEQ ID NO: 1735458 - DNA, 19 bp, Homo sapiens
tcaggccctctgcctgcac

SEQ ID NO: 1735459 - DNA, 18 bp, Homo sapiens
tcaggcctataaccccag

SEQ ID NO: 1735460 - DNA, 17 bp, Homo sapiens
tcaggcctccctctctc

SEQ ID NO: 1735461 - DNA, 18 bp, Homo sapiens
tcaggcggggtgctgtgg

SEQ ID NO: 1735462 - DNA, 19 bp, Homo sapiens
tcaggcggggtgctgtggt

SEQ ID NO: 1735463 - DNA, 16 bp, Homo sapiens
tcaggctaagaccctg

SEQ ID NO: 1735464 - DNA, 21 bp, Homo sapiens
tcaggctactcattcagtccc

SEQ ID NO: 1735465 - DNA, 18 bp, Homo sapiens
tagataaattactataaa

SEQ ID NO: 1735466 - DNA, 23 bp, Homo sapiens
tagataacaagacctcagtgcct

SEQ ID NO: 1735467 - DNA, 20 bp, Homo sapiens
tagataataactgtcttctg

SEQ ID NO: 1735468 - DNA, 21 bp, Homo sapiens
tagataataactgtcttctgg

SEQ ID NO: 1735469 - DNA, 15 bp, Homo sapiens
tagataatattgttt

SEQ ID NO: 1735470 - DNA, 14 bp, Homo sapiens
tagataattatcca

SEQ ID NO: 1735471 - DNA, 19 bp, Homo sapiens
tagatacactaaaaatctg

SEQ ID NO: 1735472 - DNA, 23 bp, Homo sapiens
tagatacgaaatcagtttctcaa

SEQ ID NO: 1735473 - DNA, 19 bp, Homo sapiens
tagatagttaaaagactgc

SEQ ID NO: 1735474 - DNA, 22 bp, Homo sapiens
tagatagttaaaagactgcagc

SEQ ID NO: 1735475 - DNA, 16 bp, Homo sapiens
tagatatagagtcatt

SEQ ID NO: 1735476 - DNA, 19 bp, Homo sapiens
tagatatatgctctgcatg

SEQ ID NO: 1735477 - DNA, 16 bp, Homo sapiens
tagatatgtatatata

SEQ ID NO: 1735478 - DNA, 16 bp, Homo sapiens
tagatattttatatgt

SEQ ID NO: 1735479 - DNA, 13 bp, Homo sapiens
tagatatttttca

SEQ ID NO: 1735480 - DNA, 15 bp, Homo sapiens
tagatatttttcata

SEQ ID NO: 1735481 - DNA, 20 bp, Homo sapiens
tagatcaaatagttgcatag

SEQ ID NO: 1735482 - DNA, 19 bp, Homo sapiens
tagatcaaggagcccagaa

SEQ ID NO: 1735483 - DNA, 15 bp, Homo sapiens
tagatcaataaatgt

SEQ ID NO: 1735484 - DNA, 15 bp, Homo sapiens
tagatcataaggctt

SEQ ID NO: 1735485 - DNA, 21 bp, Homo sapiens
tagatcataaggcttcaaaat

SEQ ID NO: 1735486 - DNA, 17 bp, Homo sapiens
tagatcatatttaaaga

SEQ ID NO: 1735487 - DNA, 16 bp, Homo sapiens
tagatccacacacaga

SEQ ID NO: 1735488 - DNA, 18 bp, Homo sapiens
tagatccacacacagagg

SEQ ID NO: 1735489 - DNA, 18 bp, Homo sapiens
tagatccatttccattgc

SEQ ID NO: 1735490 - DNA, 21 bp, Homo sapiens
tagatccatttccattgctta

SEQ ID NO: 1735491 - DNA, 21 bp, Homo sapiens
tagatcccatgtcacctcagc

SEQ ID NO: 1735492 - DNA, 15 bp, Homo sapiens
tagatcgcttgagcc

SEQ ID NO: 1735493 - DNA, 17 bp, Homo sapiens
tagatcgcttgagccca

SEQ ID NO: 1735494 - DNA, 19 bp, Homo sapiens
tagatcgcttgagcccagg

SEQ ID NO: 1735495 - DNA, 12 bp, Homo sapiens
tagatctccagc

SEQ ID NO: 1735496 - DNA, 14 bp, Homo sapiens
tagatctgcaggct

SEQ ID NO: 1735497 - DNA, 12 bp, Homo sapiens
tagatcttctga

SEQ ID NO: 1735498 - DNA, 19 bp, Homo sapiens
tagatctttgtaaatgcat

SEQ ID NO: 1735499 - DNA, 15 bp, Homo sapiens
tagatgaactcaact

SEQ ID NO: 1735500 - DNA, 21 bp, Homo sapiens
tagatgattaaataagattct

SEQ ID NO: 1735501 - DNA, 19 bp, Homo sapiens
tagatgattttttgaaagt

SEQ ID NO: 1735502 - DNA, 14 bp, Homo sapiens
tagatgctgaggcc

SEQ ID NO: 1735503 - DNA, 20 bp, Homo sapiens
tagatgctgatgatttgttt

SEQ ID NO: 1735504 - DNA, 14 bp, Homo sapiens
tagatgctggccca

SEQ ID NO: 1735505 - DNA, 18 bp, Homo sapiens
tagatgctggcccagggc

SEQ ID NO: 1735506 - DNA, 21 bp, Homo sapiens
tagatgctggcccagggccca

SEQ ID NO: 1735507 - DNA, 16 bp, Homo sapiens
tagatggaatggaaaa

SEQ ID NO: 1735508 - DNA, 17 bp, Homo sapiens
tagatggaatggaaaag

SEQ ID NO: 1735509 - DNA, 17 bp, Homo sapiens
tagatggaccccagcat

SEQ ID NO: 1735510 - DNA, 15 bp, Homo sapiens
tagatggcgatgtgt

SEQ ID NO: 1735511 - DNA, 16 bp, Homo sapiens
tagatggcgatgtgtt

SEQ ID NO: 1735512 - DNA, 15 bp, Homo sapiens
tagatgggcattttt

SEQ ID NO: 1735513 - DNA, 17 bp, Homo sapiens
tagatgtagtatttttt

SEQ ID NO: 1735514 - DNA, 15 bp, Homo sapiens
tagatgtatttttga

SEQ ID NO: 1735515 - DNA, 21 bp, Homo sapiens
tagatgtccctttcttggcca

SEQ ID NO: 1735516 - DNA, 13 bp, Homo sapiens
tagatgtctcaaa

SEQ ID NO: 1735517 - DNA, 14 bp, Homo sapiens
tagatgttcttttc

SEQ ID NO: 1735518 - DNA, 17 bp, Homo sapiens
tagatgttcttttctat

SEQ ID NO: 1735519 - DNA, 20 bp, Homo sapiens
tagatgttcttttctattta

SEQ ID NO: 1735520 - DNA, 14 bp, Homo sapiens
tagatgttgccatg

SEQ ID NO: 1735521 - DNA, 15 bp, Homo sapiens
tagatgttgccatgt

SEQ ID NO: 1735522 - DNA, 13 bp, Homo sapiens
tagatgtttcaca

SEQ ID NO: 1735523 - DNA, 17 bp, Homo sapiens
tagattaatggcactga

SEQ ID NO: 1735524 - DNA, 21 bp, Homo sapiens
tagattaccccctcattgttt

SEQ ID NO: 1735525 - DNA, 15 bp, Homo sapiens
tagattattataaac

SEQ ID NO: 1735526 - DNA, 13 bp, Homo sapiens
tagattcaaaggt

SEQ ID NO: 1735527 - DNA, 15 bp, Homo sapiens
tagattcaaaggttc

SEQ ID NO: 1735528 - DNA, 13 bp, Homo sapiens
tagattcataaat

SEQ ID NO: 1735529 - DNA, 17 bp, Homo sapiens
tagattctaaagattct

SEQ ID NO: 1735530 - DNA, 20 bp, Homo sapiens
tagattctctgtgtctaaga

SEQ ID NO: 1735531 - DNA, 21 bp, Homo sapiens
tagattctctgtgtctaagat

SEQ ID NO: 1735532 - DNA, 18 bp, Homo sapiens
tagattgaaaacttttct

SEQ ID NO: 1735533 - DNA, 21 bp, Homo sapiens
tagattgaaaacttttctcag

SEQ ID NO: 1735534 - DNA, 23 bp, Homo sapiens
tagattgaaaacttttctcagat

SEQ ID NO: 1735535 - DNA, 16 bp, Homo sapiens
tagattgattgtattg

SEQ ID NO: 1735536 - DNA, 16 bp, Homo sapiens
tagattgcaaagcaat

SEQ ID NO: 1735537 - DNA, 15 bp, Homo sapiens
tagatttagctattt

SEQ ID NO: 1735538 - DNA, 16 bp, Homo sapiens
tagatttagctattta

SEQ ID NO: 1735539 - DNA, 17 bp, Homo sapiens
tagatttagctatttat

SEQ ID NO: 1735540 - DNA, 13 bp, Homo sapiens
tagatttctttga

SEQ ID NO: 1735541 - DNA, 16 bp, Homo sapiens
tagatttggcatctcc

SEQ ID NO: 1735542 - DNA, 18 bp, Homo sapiens
tagatttggcatctcctg

SEQ ID NO: 1735543 - DNA, 23 bp, Homo sapiens
tagatttgtgcaaacatggagaa

SEQ ID NO: 1735544 - DNA, 21 bp, Homo sapiens
tagattttctggttctaacat

SEQ ID NO: 1735545 - DNA, 21 bp, Homo sapiens
tagcaaagattaaatgtgtca

SEQ ID NO: 1735546 - DNA, 21 bp, Homo sapiens
tagcaaagcgggttataatga

SEQ ID NO: 1735547 - DNA, 13 bp, Homo sapiens
tagcaacttttgt

SEQ ID NO: 1735548 - DNA, 16 bp, Homo sapiens
tagcaagaagattcta

SEQ ID NO: 1735549 - DNA, 17 bp, Homo sapiens
tagcaagacacatccct

SEQ ID NO: 1735550 - DNA, 18 bp, Homo sapiens
tagcaagacacatcccta

SEQ ID NO: 1735551 - DNA, 13 bp, Homo sapiens
tagcaaggctcat

SEQ ID NO: 1735552 - DNA, 20 bp, Homo sapiens
tagcaagggacaattgtatc

SEQ ID NO: 1735553 - DNA, 18 bp, Homo sapiens
tagcaagttacagtgatg

SEQ ID NO: 1735554 - DNA, 14 bp, Homo sapiens
tagcaatctcttca

SEQ ID NO: 1735555 - DNA, 14 bp, Homo sapiens
tagcaatgtgcctt

SEQ ID NO: 1735556 - DNA, 21 bp, Homo sapiens
tagcaattttctttgtttctt

SEQ ID NO: 1735557 - DNA, 14 bp, Homo sapiens
tagcactcttgttt

SEQ ID NO: 1735558 - DNA, 16 bp, Homo sapiens
tagcacttacgtaaaa

SEQ ID NO: 1735559 - DNA, 17 bp, Homo sapiens
tagcacttatgttactg

SEQ ID NO: 1735560 - DNA, 15 bp, Homo sapiens
tagcagaaagaagag

SEQ ID NO: 1735561 - DNA, 15 bp, Homo sapiens
tagcagacagtgttt

SEQ ID NO: 1735562 - DNA, 19 bp, Homo sapiens
tagcagacgtatattgtat

SEQ ID NO: 1735563 - DNA, 16 bp, Homo sapiens
tagcagagagccaaat

SEQ ID NO: 1735564 - DNA, 23 bp, Homo sapiens
tagaaatatctgaaaatgtatgt

SEQ ID NO: 1735565 - DNA, 15 bp, Homo sapiens
tagaaatatctttct

SEQ ID NO: 1735566 - DNA, 15 bp, Homo sapiens
tagaaatattttaaa

SEQ ID NO: 1735567 - DNA, 19 bp, Homo sapiens
tagaaatgatgatgtggaa

SEQ ID NO: 1735568 - DNA, 16 bp, Homo sapiens
tagaaatggaaatttt

SEQ ID NO: 1735569 - DNA, 14 bp, Homo sapiens
tagaaatgtatcct

SEQ ID NO: 1735570 - DNA, 12 bp, Homo sapiens
tagaaatgtgaa

SEQ ID NO: 1735571 - DNA, 20 bp, Homo sapiens
tagaaatgtgaagaggtctg

SEQ ID NO: 1735572 - DNA, 16 bp, Homo sapiens
tagaaattacctgtgg

SEQ ID NO: 1735573 - DNA, 18 bp, Homo sapiens
tagaaattacctgtggat

SEQ ID NO: 1735574 - DNA, 16 bp, Homo sapiens
tagaaattagatttgt

SEQ ID NO: 1735575 - DNA, 18 bp, Homo sapiens
tagaaattagctgtgtga

SEQ ID NO: 1735576 - DNA, 13 bp, Homo sapiens
tagaaattttgta

SEQ ID NO: 1735577 - DNA, 12 bp, Homo sapiens
tagaacaaaaaa

SEQ ID NO: 1735578 - DNA, 20 bp, Homo sapiens
tagaacaaaggacagagtat

SEQ ID NO: 1735579 - DNA, 20 bp, Homo sapiens
tagaacacaagggatataaa

SEQ ID NO: 1735580 - DNA, 15 bp, Homo sapiens
tagaacacaggcaaa

SEQ ID NO: 1735581 - DNA, 15 bp, Homo sapiens
tagaacactaattca

SEQ ID NO: 1735582 - DNA, 16 bp, Homo sapiens
tagaacactaattcat

SEQ ID NO: 1735583 - DNA, 20 bp, Homo sapiens
tagaacactaattcataatc

SEQ ID NO: 1735584 - DNA, 23 bp, Homo sapiens
tagaacaggttcttaaaaaggaa

SEQ ID NO: 1735585 - DNA, 18 bp, Homo sapiens
tagaacataaagcaaata

SEQ ID NO: 1735586 - DNA, 22 bp, Homo sapiens
tagaacataaagcaaatagaca

SEQ ID NO: 1735587 - DNA, 19 bp, Homo sapiens
tagaacatgcacatttata

SEQ ID NO: 1735588 - DNA, 15 bp, Homo sapiens
tagaaccaagcttca

SEQ ID NO: 1735589 - DNA, 16 bp, Homo sapiens
tagaaccaagcttcag

SEQ ID NO: 1735590 - DNA, 15 bp, Homo sapiens
tagaaccactatgaa

SEQ ID NO: 1735591 - DNA, 16 bp, Homo sapiens
tagaaccactatgaag

SEQ ID NO: 1735592 - DNA, 15 bp, Homo sapiens
tagaacctaactttt

SEQ ID NO: 1735593 - DNA, 22 bp, Homo sapiens
tagaacgtgcatccttgtaata

SEQ ID NO: 1735594 - DNA, 16 bp, Homo sapiens
tagaactatgctaatt

SEQ ID NO: 1735595 - DNA, 17 bp, Homo sapiens
tagaactcactctgggc

SEQ ID NO: 1735596 - DNA, 19 bp, Homo sapiens
tagaactcactctgggctg

SEQ ID NO: 1735597 - DNA, 20 bp, Homo sapiens
tagaactcactctgggctgt

SEQ ID NO: 1735598 - DNA, 14 bp, Homo sapiens
tagaactcagcagt

SEQ ID NO: 1735599 - DNA, 16 bp, Homo sapiens
tagaactccaggccct

SEQ ID NO: 1735600 - DNA, 21 bp, Homo sapiens
tagaactgtcccacaaaatat

SEQ ID NO: 1735601 - DNA, 19 bp, Homo sapiens
tagaactgttcatttccac

SEQ ID NO: 1735602 - DNA, 21 bp, Homo sapiens
tagaactgttcatttccacca

SEQ ID NO: 1735603 - DNA, 21 bp, Homo sapiens
tagaacttgcagctgatgttg

SEQ ID NO: 1735604 - DNA, 12 bp, Homo sapiens
tagaagaaaagc

SEQ ID NO: 1735605 - DNA, 20 bp, Homo sapiens
tagaagaaccaaatacctca

SEQ ID NO: 1735606 - DNA, 11 bp, Homo sapiens
tagaagaagag

SEQ ID NO: 1735607 - DNA, 17 bp, Homo sapiens
tagaagaagaggaagaa

SEQ ID NO: 1735608 - DNA, 14 bp, Homo sapiens
tagaagaagtgtgt

SEQ ID NO: 1735609 - DNA, 14 bp, Homo sapiens
tagaagatgtgtaa

SEQ ID NO: 1735610 - DNA, 21 bp, Homo sapiens
tagaagcactacaccttgcct

SEQ ID NO: 1735611 - DNA, 22 bp, Homo sapiens
tagaagcactacaccttgcctt

SEQ ID NO: 1735612 - DNA, 19 bp, Homo sapiens
tagaagccaagggaaaggg

SEQ ID NO: 1735613 - DNA, 16 bp, Homo sapiens
tagaagcccattcatt

SEQ ID NO: 1735614 - DNA, 15 bp, Homo sapiens
tagaaggaatttgta

SEQ ID NO: 1735615 - DNA, 14 bp, Homo sapiens
tagaaggcttctct

SEQ ID NO: 1735616 - DNA, 19 bp, Homo sapiens
tagaagggccagtcctgcc

SEQ ID NO: 1735617 - DNA, 22 bp, Homo sapiens
tagaagtctccctgcacagcct

SEQ ID NO: 1735618 - DNA, 15 bp, Homo sapiens
tagaagtctggaaaa

SEQ ID NO: 1735619 - DNA, 20 bp, Homo sapiens
tagaagtgagcaaaaaagag

SEQ ID NO: 1735620 - DNA, 20 bp, Homo sapiens
tagaagtgagtttgtaaata

SEQ ID NO: 1735621 - DNA, 17 bp, Homo sapiens
tagaagtgttgtaaaag

SEQ ID NO: 1735622 - DNA, 18 bp, Homo sapiens
tagaagttgtttgtcatc

SEQ ID NO: 1735623 - DNA, 16 bp, Homo sapiens
tagaagtttggctgct

SEQ ID NO: 1735624 - DNA, 21 bp, Homo sapiens
tagaagtttggctgctgtcat

SEQ ID NO: 1735625 - DNA, 21 bp, Homo sapiens
tagaataaaggcagttttcta

SEQ ID NO: 1735626 - DNA, 22 bp, Homo sapiens
tagaataaaggcagttttctaa

SEQ ID NO: 1735627 - DNA, 23 bp, Homo sapiens
tagaataaggaggaggagggaga

SEQ ID NO: 1735628 - DNA, 15 bp, Homo sapiens
tagaataggcagggg

SEQ ID NO: 1735629 - DNA, 21 bp, Homo sapiens
tagaatagggggatataatac

SEQ ID NO: 1735630 - DNA, 17 bp, Homo sapiens
tagaatatcctatactg

SEQ ID NO: 1735631 - DNA, 19 bp, Homo sapiens
tacatctgcaatatgaatt

SEQ ID NO: 1735632 - DNA, 14 bp, Homo sapiens
tacatctttcacat

SEQ ID NO: 1735633 - DNA, 13 bp, Homo sapiens
tacatcttttcta

SEQ ID NO: 1735634 - DNA, 15 bp, Homo sapiens
tacatcttttctaat

SEQ ID NO: 1735635 - DNA, 17 bp, Homo sapiens
tacatcttttttcacaa

SEQ ID NO: 1735636 - DNA, 13 bp, Homo sapiens
tacatgaaacaga

SEQ ID NO: 1735637 - DNA, 14 bp, Homo sapiens
tacatgaaacagaa

SEQ ID NO: 1735638 - DNA, 13 bp, Homo sapiens
tacatgcacacac

SEQ ID NO: 1735639 - DNA, 14 bp, Homo sapiens
tacatgccagtgac

SEQ ID NO: 1735640 - DNA, 16 bp, Homo sapiens
tacatgctactaaatt

SEQ ID NO: 1735641 - DNA, 17 bp, Homo sapiens
tacatgctactaaattt

SEQ ID NO: 1735642 - DNA, 14 bp, Homo sapiens
tacatgctggggtc

SEQ ID NO: 1735643 - DNA, 14 bp, Homo sapiens
tacatggaataaca

SEQ ID NO: 1735644 - DNA, 19 bp, Homo sapiens
tacatggaataacatgtaa

SEQ ID NO: 1735645 - DNA, 22 bp, Homo sapiens
tacatggaataacatgtaatta

SEQ ID NO: 1735646 - DNA, 19 bp, Homo sapiens
tacatggcagagtttgtgt

SEQ ID NO: 1735647 - DNA, 22 bp, Homo sapiens
tacatggcagagtttgtgtgtt

SEQ ID NO: 1735648 - DNA, 20 bp, Homo sapiens
tacatggcagtgttttagtt

SEQ ID NO: 1735649 - DNA, 19 bp, Homo sapiens
tacatgggccagtttatat

SEQ ID NO: 1735650 - DNA, 15 bp, Homo sapiens
tacatgggtgaatta

SEQ ID NO: 1735651 - DNA, 19 bp, Homo sapiens
tacatgggtgaattatgtt

SEQ ID NO: 1735652 - DNA, 13 bp, Homo sapiens
tacatgtaatttg

SEQ ID NO: 1735653 - DNA, 15 bp, Homo sapiens
tacatgtacatagta

SEQ ID NO: 1735654 - DNA, 23 bp, Homo sapiens
tacatgtattaaattacatttgt

SEQ ID NO: 1735655 - DNA, 12 bp, Homo sapiens
tacatgtattat

SEQ ID NO: 1735656 - DNA, 22 bp, Homo sapiens
tacatgtattatttcattatgt

SEQ ID NO: 1735657 - DNA, 16 bp, Homo sapiens
tacatgtgatacattt

SEQ ID NO: 1735658 - DNA, 20 bp, Homo sapiens
tacatgtgcacattgtgcag

SEQ ID NO: 1735659 - DNA, 17 bp, Homo sapiens
tacatgtgtacatatat

SEQ ID NO: 1735660 - DNA, 18 bp, Homo sapiens
tacatgtgtacatatatg

SEQ ID NO: 1735661 - DNA, 18 bp, Homo sapiens
tacatgtgtagcctgtgc

SEQ ID NO: 1735662 - DNA, 15 bp, Homo sapiens
tacatgttctttgta

SEQ ID NO: 1735663 - DNA, 15 bp, Homo sapiens
tacatgtttatgtaa

SEQ ID NO: 1735664 - DNA, 22 bp, Homo sapiens
tacattaatgtcctcttgctgt

SEQ ID NO: 1735665 - DNA, 18 bp, Homo sapiens
tactacagctatatttga

SEQ ID NO: 1735666 - DNA, 16 bp, Homo sapiens
tactaccacaaggaaa

SEQ ID NO: 1735667 - DNA, 13 bp, Homo sapiens
tactacctagaag

SEQ ID NO: 1735668 - DNA, 13 bp, Homo sapiens
tactactcctgta

SEQ ID NO: 1735669 - DNA, 21 bp, Homo sapiens
tactactgaaacagatttcat

SEQ ID NO: 1735670 - DNA, 17 bp, Homo sapiens
tactactgagggaaata

SEQ ID NO: 1735671 - DNA, 18 bp, Homo sapiens
tactactggtgatgccta

SEQ ID NO: 1735672 - DNA, 14 bp, Homo sapiens
tactactttaagtg

SEQ ID NO: 1735673 - DNA, 22 bp, Homo sapiens
tactactttgttaggattttca

SEQ ID NO: 1735674 - DNA, 16 bp, Homo sapiens
tactagagttggcatg

SEQ ID NO: 1735675 - DNA, 19 bp, Homo sapiens
tactagatgtctttaggca

SEQ ID NO: 1735676 - DNA, 16 bp, Homo sapiens
tactagatttgggaga

SEQ ID NO: 1735677 - DNA, 23 bp, Homo sapiens
tactagatttgggagaagggcag

SEQ ID NO: 1735678 - DNA, 14 bp, Homo sapiens
tactagcatactta

SEQ ID NO: 1735679 - DNA, 22 bp, Homo sapiens
tactaggatacagaaatgcaaa

SEQ ID NO: 1735680 - DNA, 19 bp, Homo sapiens
tactagggagccatttgag

SEQ ID NO: 1735681 - DNA, 16 bp, Homo sapiens
tactagtgttctgttt

SEQ ID NO: 1735682 - DNA, 22 bp, Homo sapiens
tactagttcagacactttggaa

SEQ ID NO: 1735683 - DNA, 13 bp, Homo sapiens
tactataaagaga

SEQ ID NO: 1735684 - DNA, 22 bp, Homo sapiens
tactataagtagttggtttgta

SEQ ID NO: 1735685 - DNA, 14 bp, Homo sapiens
tactatatttacaa

SEQ ID NO: 1735686 - DNA, 14 bp, Homo sapiens
tactatatttatgg

SEQ ID NO: 1735687 - DNA, 13 bp, Homo sapiens
tactatatttgct

SEQ ID NO: 1735688 - DNA, 14 bp, Homo sapiens
tactatatttgcta

SEQ ID NO: 1735689 - DNA, 17 bp, Homo sapiens
tactatcacacatgaat

SEQ ID NO: 1735690 - DNA, 17 bp, Homo sapiens
tactatccatttcttca

SEQ ID NO: 1735691 - DNA, 17 bp, Homo sapiens
tactatctgttgaaaag

SEQ ID NO: 1735692 - DNA, 17 bp, Homo sapiens
tactatcttatctcaga

SEQ ID NO: 1735693 - DNA, 16 bp, Homo sapiens
tactatgatctcagga

SEQ ID NO: 1735694 - DNA, 17 bp, Homo sapiens
tactatggtaacacttt

SEQ ID NO: 1735695 - DNA, 18 bp, Homo sapiens
tactatggtgtgttgtat

SEQ ID NO: 1735696 - DNA, 14 bp, Homo sapiens
tactatgtatcaat

SEQ ID NO: 1735697 - DNA, 15 bp, Homo sapiens
tactattaagcaaga

SEQ ID NO: 1735698 - DNA, 22 bp, Homo sapiens
tactattaagcagtaaaaactg

SEQ ID NO: 1735699 - DNA, 13 bp, Homo sapiens
tactattattgtt

SEQ ID NO: 1735700 - DNA, 19 bp, Homo sapiens
tactattcaggtaacacta

SEQ ID NO: 1735701 - DNA, 11 bp, Homo sapiens
tactatttaaa

SEQ ID NO: 1735702 - DNA, 21 bp, Homo sapiens
tactatttaaagcctcctcat

SEQ ID NO: 1735703 - DNA, 12 bp, Homo sapiens
tactatttaact

SEQ ID NO: 1735704 - DNA, 14 bp, Homo sapiens
tactatttaactga

SEQ ID NO: 1735705 - DNA, 19 bp, Homo sapiens
tactatttaactgactatt

SEQ ID NO: 1735706 - DNA, 18 bp, Homo sapiens
tactatttaagatgtgaa

SEQ ID NO: 1735707 - DNA, 21 bp, Homo sapiens
tactatttaagatgtgaaaat

SEQ ID NO: 1735708 - DNA, 15 bp, Homo sapiens
tactcaagaggctga

SEQ ID NO: 1735709 - DNA, 14 bp, Homo sapiens
tactcaatggattt

SEQ ID NO: 1735710 - DNA, 17 bp, Homo sapiens
tactcagaagcctgagg

SEQ ID NO: 1735711 - DNA, 21 bp, Homo sapiens
tactcagagcagagcaaatga

SEQ ID NO: 1735712 - DNA, 20 bp, Homo sapiens
tactcagcagccctcctcac

SEQ ID NO: 1735713 - DNA, 23 bp, Homo sapiens
tactcagcagccctcctcacccc

SEQ ID NO: 1735714 - DNA, 13 bp, Homo sapiens
tactcagcccagc

SEQ ID NO: 1735715 - DNA, 18 bp, Homo sapiens
tactcagcccagctggcc

SEQ ID NO: 1735716 - DNA, 13 bp, Homo sapiens
tactgacttggat

SEQ ID NO: 1735717 - DNA, 20 bp, Homo sapiens
tactgactttgcttgctttg

SEQ ID NO: 1735718 - DNA, 23 bp, Homo sapiens
tactgagccttgtaattctaaat

SEQ ID NO: 1735719 - DNA, 23 bp, Homo sapiens
tactgagggaccaactgggccca

SEQ ID NO: 1735720 - DNA, 16 bp, Homo sapiens
tactgagttacattgt

SEQ ID NO: 1735721 - DNA, 19 bp, Homo sapiens
tactgataaacctaatatt

SEQ ID NO: 1735722 - DNA, 16 bp, Homo sapiens
tactgataaagaaaga

SEQ ID NO: 1735723 - DNA, 15 bp, Homo sapiens
tactgatgaaatctg

SEQ ID NO: 1735724 - DNA, 23 bp, Homo sapiens
tactgatgttcctagtgaaagag

SEQ ID NO: 1735725 - DNA, 18 bp, Homo sapiens
tactgatgttcctttgga

SEQ ID NO: 1735726 - DNA, 18 bp, Homo sapiens
tactgatttcagtaagtc

SEQ ID NO: 1735727 - DNA, 16 bp, Homo sapiens
tactgcaaagtcgcca

SEQ ID NO: 1735728 - DNA, 20 bp, Homo sapiens
tactgcaaagtcgccagtca

SEQ ID NO: 1735729 - DNA, 21 bp, Homo sapiens
tactgcacagtggcacaaaaa

SEQ ID NO: 1735730 - DNA, 17 bp, Homo sapiens
tactgcactccagcctg

SEQ ID NO: 1735731 - DNA, 13 bp, Homo sapiens
tactgcactttcc

SEQ ID NO: 1735732 - DNA, 17 bp, Homo sapiens
tactgcatatgaaagga

SEQ ID NO: 1735733 - DNA, 18 bp, Homo sapiens
tactgcattctctcccat

SEQ ID NO: 1735734 - DNA, 11 bp, Homo sapiens
tactgccaaag

SEQ ID NO: 1735735 - DNA, 19 bp, Homo sapiens
tactgccatgtactagttt

SEQ ID NO: 1735736 - DNA, 13 bp, Homo sapiens
tactgccttgaaa

SEQ ID NO: 1735737 - DNA, 16 bp, Homo sapiens
tactgcgactttctgc

SEQ ID NO: 1735738 - DNA, 21 bp, Homo sapiens
tactgctaagtatttcccagc

SEQ ID NO: 1735739 - DNA, 14 bp, Homo sapiens
tactgctcctgtgg

SEQ ID NO: 1735740 - DNA, 18 bp, Homo sapiens
tactgctcctgtggcagg

SEQ ID NO: 1735741 - DNA, 19 bp, Homo sapiens
tactgctctttattgcaga

SEQ ID NO: 1735742 - DNA, 22 bp, Homo sapiens
tactgctgattcttgtaaatct

SEQ ID NO: 1735743 - DNA, 14 bp, Homo sapiens
tactggaaatgtag

SEQ ID NO: 1735744 - DNA, 17 bp, Homo sapiens
tactggaagttttgcat

SEQ ID NO: 1735745 - DNA, 12 bp, Homo sapiens
tactggcagctc

SEQ ID NO: 1735746 - DNA, 14 bp, Homo sapiens
tactggcagctcct

SEQ ID NO: 1735747 - DNA, 13 bp, Homo sapiens
tactggcctgtaa

SEQ ID NO: 1735748 - DNA, 23 bp, Homo sapiens
tactggcctgtaatctaccagtg

SEQ ID NO: 1735749 - DNA, 18 bp, Homo sapiens
tactggcctttttcattt

SEQ ID NO: 1735750 - DNA, 12 bp, Homo sapiens
tactgggagtgt

SEQ ID NO: 1735751 - DNA, 17 bp, Homo sapiens
tactggtaattgtacaa

SEQ ID NO: 1735752 - DNA, 22 bp, Homo sapiens
tactggtgatgcctaattatga

SEQ ID NO: 1735753 - DNA, 18 bp, Homo sapiens
tactgtaaatgccttgct

SEQ ID NO: 1735754 - DNA, 23 bp, Homo sapiens
tactgtaaatgccttgcttgtat

SEQ ID NO: 1735755 - DNA, 18 bp, Homo sapiens
tactgtaactgtcagtgt

SEQ ID NO: 1735756 - DNA, 13 bp, Homo sapiens
tactgtactatcc

SEQ ID NO: 1735757 - DNA, 17 bp, Homo sapiens
tactgtagctgatgaaa

SEQ ID NO: 1735758 - DNA, 14 bp, Homo sapiens
tactgtatatgtat

SEQ ID NO: 1735759 - DNA, 18 bp, Homo sapiens
tactgtcaaaataatttt

SEQ ID NO: 1735760 - DNA, 19 bp, Homo sapiens
tactgtcaaaataatttta

SEQ ID NO: 1735761 - DNA, 16 bp, Homo sapiens
tactgtcaataaacag

SEQ ID NO: 1735762 - DNA, 23 bp, Homo sapiens
tactgtcagctcccctcggagaa

SEQ ID NO: 1735763 - DNA, 21 bp, Homo sapiens
tactgtccctctcagtgcctt

SEQ ID NO: 1735764 - DNA, 16 bp, Homo sapiens
tactgtctaagcagtt

SEQ ID NO: 1735765 - DNA, 22 bp, Homo sapiens
tactgtctaagcagttttgtaa

SEQ ID NO: 1735766 - DNA, 17 bp, Homo sapiens
tactgtctattaatatt

SEQ ID NO: 1735767 - DNA, 18 bp, Homo sapiens
tactgtctattaatattc

SEQ ID NO: 1735768 - DNA, 13 bp, Homo sapiens
tactgtctgggat

SEQ ID NO: 1735769 - DNA, 15 bp, Homo sapiens
tactgtgaaactggc

SEQ ID NO: 1735770 - DNA, 13 bp, Homo sapiens
tactgtgatttct

SEQ ID NO: 1735771 - DNA, 22 bp, Homo sapiens
tactgtgtacagaattctgcta

SEQ ID NO: 1735772 - DNA, 13 bp, Homo sapiens
tacttctgtgttc

SEQ ID NO: 1735773 - DNA, 15 bp, Homo sapiens
tacttctgtgttcat

SEQ ID NO: 1735774 - DNA, 15 bp, Homo sapiens
tacttcttattgcaa

SEQ ID NO: 1735775 - DNA, 18 bp, Homo sapiens
tacttcttatttttctta

SEQ ID NO: 1735776 - DNA, 16 bp, Homo sapiens
tacttctttagcattt

SEQ ID NO: 1735777 - DNA, 20 bp, Homo sapiens
tacttcttttttcaaaagaa

SEQ ID NO: 1735778 - DNA, 24 bp, Homo sapiens
tacttgaagaaacagagtggcctc

SEQ ID NO: 1735779 - DNA, 11 bp, Homo sapiens
tacttgaaggg

SEQ ID NO: 1735780 - DNA, 15 bp, Homo sapiens
tacttgaagggccag

SEQ ID NO: 1735781 - DNA, 20 bp, Homo sapiens
tacttgaagggccagagcca

SEQ ID NO: 1735782 - DNA, 23 bp, Homo sapiens
tacttgaagtctaaaagcagaaa

SEQ ID NO: 1735783 - DNA, 15 bp, Homo sapiens
tacttgataatatta

SEQ ID NO: 1735784 - DNA, 16 bp, Homo sapiens
tacttgcactcttcta

SEQ ID NO: 1735785 - DNA, 19 bp, Homo sapiens
tacttgctccttttgctct

SEQ ID NO: 1735786 - DNA, 15 bp, Homo sapiens
tacttgcttcagtgg

SEQ ID NO: 1735787 - DNA, 23 bp, Homo sapiens
tacttggctgcttcctgtgacag

SEQ ID NO: 1735788 - DNA, 21 bp, Homo sapiens
tacttgggagacctgtaatca

SEQ ID NO: 1735789 - DNA, 23 bp, Homo sapiens
tacttgggagacctgtaatcata

SEQ ID NO: 1735790 - DNA, 12 bp, Homo sapiens
tacttgggaggc

SEQ ID NO: 1735791 - DNA, 18 bp, Homo sapiens
tacttgggaggctgaggc

SEQ ID NO: 1735792 - DNA, 22 bp, Homo sapiens
tacttgggaggctgaggcagga

SEQ ID NO: 1735793 - DNA, 13 bp, Homo sapiens
tacttggtttgtg

SEQ ID NO: 1735794 - DNA, 20 bp, Homo sapiens
tacttggtttgtgttcttct

SEQ ID NO: 1735795 - DNA, 16 bp, Homo sapiens
tacttgtctgaggcct

SEQ ID NO: 1735796 - DNA, 18 bp, Homo sapiens
tacttgtctgtcaaatgt

SEQ ID NO: 1735797 - DNA, 15 bp, Homo sapiens
tacttgtgacaagaa

SEQ ID NO: 1735798 - DNA, 16 bp, Homo sapiens
tacttgtttctctgtt

SEQ ID NO: 1735799 - DNA, 13 bp, Homo sapiens
tacttgtttgcta

SEQ ID NO: 1735800 - DNA, 16 bp, Homo sapiens
tacttgtttgctatga

SEQ ID NO: 1735801 - DNA, 19 bp, Homo sapiens
tacttgtttttgtaaagaa

SEQ ID NO: 1735802 - DNA, 13 bp, Homo sapiens
tactttaaaaagg

SEQ ID NO: 1735803 - DNA, 15 bp, Homo sapiens
tactttaaaaaggaa

SEQ ID NO: 1735804 - DNA, 16 bp, Homo sapiens
tactttaaaaaggaaa

SEQ ID NO: 1735805 - DNA, 17 bp, Homo sapiens
tactttaaatgttctgt

SEQ ID NO: 1735806 - DNA, 21 bp, Homo sapiens
tactttaacttagttttgcat

SEQ ID NO: 1735807 - DNA, 22 bp, Homo sapiens
tactttaagttaaatatgtaga

SEQ ID NO: 1735808 - DNA, 23 bp, Homo sapiens
tactttacaaaccattacctgta

SEQ ID NO: 1735809 - DNA, 22 bp, Homo sapiens
tactttaggtttgttcccttga

SEQ ID NO: 1735810 - DNA, 23 bp, Homo sapiens
tactttataactaacatgtcctg

SEQ ID NO: 1735811 - DNA, 12 bp, Homo sapiens
tactttattctt

SEQ ID NO: 1735812 - DNA, 21 bp, Homo sapiens
tactttattgtacagactgtt

SEQ ID NO: 1735813 - DNA, 20 bp, Homo sapiens
tactttcagaatattttcaa

SEQ ID NO: 1735814 - DNA, 23 bp, Homo sapiens
tactttcagaatattttcaaaat

SEQ ID NO: 1735815 - DNA, 15 bp, Homo sapiens
tactttctgttaaaa

SEQ ID NO: 1735816 - DNA, 17 bp, Homo sapiens
tactttctgttaaaatg

SEQ ID NO: 1735817 - DNA, 15 bp, Homo sapiens
tactttgacaaggaa

SEQ ID NO: 1735818 - DNA, 21 bp, Homo sapiens
tactttgattctgataatgct

SEQ ID NO: 1735819 - DNA, 22 bp, Homo sapiens
tactttgcaatccaaataaaga

SEQ ID NO: 1735820 - DNA, 13 bp, Homo sapiens
tactttgccattt

SEQ ID NO: 1735821 - DNA, 20 bp, Homo sapiens
tactttgccatttttctata

SEQ ID NO: 1735822 - DNA, 20 bp, Homo sapiens
tactttgcccctttcagtat

SEQ ID NO: 1735823 - DNA, 12 bp, Homo sapiens
tactttgcttga

SEQ ID NO: 1735824 - DNA, 17 bp, Homo sapiens
tactttggaattcttag

SEQ ID NO: 1735825 - DNA, 23 bp, Homo sapiens
tactttgtaaataggatttttag

SEQ ID NO: 1735826 - DNA, 21 bp, Homo sapiens
tactttgtattttgattattt

SEQ ID NO: 1735827 - DNA, 14 bp, Homo sapiens
tactttgtctgaaa

SEQ ID NO: 1735828 - DNA, 15 bp, Homo sapiens
tactttgttctgttg

SEQ ID NO: 1735829 - DNA, 14 bp, Homo sapiens
tacttttaaactgt

SEQ ID NO: 1735830 - DNA, 21 bp, Homo sapiens
tacttttaaactgtgtacata

SEQ ID NO: 1735831 - DNA, 19 bp, Homo sapiens
tacttttaactaataaaat

SEQ ID NO: 1735832 - DNA, 17 bp, Homo sapiens
tacttttaccactattt

SEQ ID NO: 1735833 - DNA, 13 bp, Homo sapiens
gctctttcagaga

SEQ ID NO: 1735834 - DNA, 12 bp, Homo sapiens
gctctttccaaa

SEQ ID NO: 1735835 - DNA, 13 bp, Homo sapiens
gctctttccaaat

SEQ ID NO: 1735836 - DNA, 13 bp, Homo sapiens
gctctttcccagg

SEQ ID NO: 1735837 - DNA, 16 bp, Homo sapiens
gctctttcccaggacg

SEQ ID NO: 1735838 - DNA, 13 bp, Homo sapiens
gctctttctgggc

SEQ ID NO: 1735839 - DNA, 21 bp, Homo sapiens
gctctttgaaatagtctgtgt

SEQ ID NO: 1735840 - DNA, 21 bp, Homo sapiens
gctcttttcctggtgctcttt

SEQ ID NO: 1735841 - DNA, 19 bp, Homo sapiens
gctgaaaaatcacatcctg

SEQ ID NO: 1735842 - DNA, 22 bp, Homo sapiens
gctgaaaagggcactcccaacc

SEQ ID NO: 1735843 - DNA, 14 bp, Homo sapiens
gctgaaaatgcaaa

SEQ ID NO: 1735844 - DNA, 16 bp, Homo sapiens
gctgaaatgctgcatt

SEQ ID NO: 1735845 - DNA, 17 bp, Homo sapiens
gctgaaattctcctgga

SEQ ID NO: 1735846 - DNA, 18 bp, Homo sapiens
gctgaaattctcctggag

SEQ ID NO: 1735847 - DNA, 17 bp, Homo sapiens
gctgaaattgaaaagtt

SEQ ID NO: 1735848 - DNA, 19 bp, Homo sapiens
gctgaaattgaaaagttat

SEQ ID NO: 1735849 - DNA, 15 bp, Homo sapiens
gctgaaatttggaaa

SEQ ID NO: 1735850 - DNA, 13 bp, Homo sapiens
gctgaacagtgga

SEQ ID NO: 1735851 - DNA, 17 bp, Homo sapiens
gctgaaccctgtgctgg

SEQ ID NO: 1735852 - DNA, 16 bp, Homo sapiens
gctgaactcttcagaa

SEQ ID NO: 1735853 - DNA, 18 bp, Homo sapiens
gctgaactgacaatgaag

SEQ ID NO: 1735854 - DNA, 23 bp, Homo sapiens
gctgaactgtgcatcaaccagga

SEQ ID NO: 1735855 - DNA, 13 bp, Homo sapiens
gctgaagaatgaa

SEQ ID NO: 1735856 - DNA, 18 bp, Homo sapiens
gctgaagaatgaagacca

SEQ ID NO: 1735857 - DNA, 14 bp, Homo sapiens
gctgaagagaggga

SEQ ID NO: 1735858 - DNA, 17 bp, Homo sapiens
gctgaagagagggacag

SEQ ID NO: 1735859 - DNA, 18 bp, Homo sapiens
gctgaagagagggacagg

SEQ ID NO: 1735860 - DNA, 21 bp, Homo sapiens
gctgaagattaggcacacaga

SEQ ID NO: 1735861 - DNA, 15 bp, Homo sapiens
gctgaagctgctgca

SEQ ID NO: 1735862 - DNA, 17 bp, Homo sapiens
gctgaagctgctgcagc

SEQ ID NO: 1735863 - DNA, 12 bp, Homo sapiens
gctgaaggcagt

SEQ ID NO: 1735864 - DNA, 15 bp, Homo sapiens
gctgaagttctgagc

SEQ ID NO: 1735865 - DNA, 17 bp, Homo sapiens
gctgaatggttttcaaa

SEQ ID NO: 1735866 - DNA, 18 bp, Homo sapiens
gctgaattcatctatttc

SEQ ID NO: 1735867 - DNA, 19 bp, Homo sapiens
gctgacaaccattaaagtc

SEQ ID NO: 1735868 - DNA, 20 bp, Homo sapiens
gctgacaacttagctcaggt

SEQ ID NO: 1735869 - DNA, 12 bp, Homo sapiens
gctgacaataaa

SEQ ID NO: 1735870 - DNA, 17 bp, Homo sapiens
gctgacacctaccatgc

SEQ ID NO: 1735871 - DNA, 18 bp, Homo sapiens
gctgacacctaccatgct

SEQ ID NO: 1735872 - DNA, 19 bp, Homo sapiens
gctgacagtttgtggcatc

SEQ ID NO: 1735873 - DNA, 23 bp, Homo sapiens
gctgacatcttgaatccttccat

SEQ ID NO: 1735874 - DNA, 14 bp, Homo sapiens
gctgacatgctcac

SEQ ID NO: 1735875 - DNA, 15 bp, Homo sapiens
gctgaccaattgtgc

SEQ ID NO: 1735876 - DNA, 21 bp, Homo sapiens
gctgaccaattgtgctgccat

SEQ ID NO: 1735877 - DNA, 17 bp, Homo sapiens
gctgaccatgcgtcagg

SEQ ID NO: 1735878 - DNA, 20 bp, Homo sapiens
gctgaccatgcgtcaggggc

SEQ ID NO: 1735879 - DNA, 21 bp, Homo sapiens
gctgaccatgctcatctgctg

SEQ ID NO: 1735880 - DNA, 17 bp, Homo sapiens
gctgacccagtccctgg

SEQ ID NO: 1735881 - DNA, 21 bp, Homo sapiens
gctgaccccgagaagtgctct

SEQ ID NO: 1735882 - DNA, 15 bp, Homo sapiens
gctgacccctctggt

SEQ ID NO: 1735883 - DNA, 16 bp, Homo sapiens
gctgacctcacctggt

SEQ ID NO: 1735884 - DNA, 19 bp, Homo sapiens
gctgacctcacctggtcct

SEQ ID NO: 1735885 - DNA, 18 bp, Homo sapiens
gctgacctcccagtgacc

SEQ ID NO: 1735886 - DNA, 15 bp, Homo sapiens
gctgacctgcctctc

SEQ ID NO: 1735887 - DNA, 22 bp, Homo sapiens
gctgacctgcctctcacacaca

SEQ ID NO: 1735888 - DNA, 19 bp, Homo sapiens
gctgacgggacccacatgc

SEQ ID NO: 1735889 - DNA, 23 bp, Homo sapiens
gctgactagaagggccagtcctg

SEQ ID NO: 1735890 - DNA, 23 bp, Homo sapiens
gctgactatttgacccccacaac

SEQ ID NO: 1735891 - DNA, 15 bp, Homo sapiens
gctgactgaacatta

SEQ ID NO: 1735892 - DNA, 15 bp, Homo sapiens
gctgactgaggcctg

SEQ ID NO: 1735893 - DNA, 21 bp, Homo sapiens
gctgactgaggcctgcttccc

SEQ ID NO: 1735894 - DNA, 19 bp, Homo sapiens
gctgactgtactcctccca

SEQ ID NO: 1735895 - DNA, 14 bp, Homo sapiens
gctgacttggcact

SEQ ID NO: 1735896 - DNA, 17 bp, Homo sapiens
gctgacttggcacttaa

SEQ ID NO: 1735897 - DNA, 16 bp, Homo sapiens
gctgagaaggaacagg

SEQ ID NO: 1735898 - DNA, 13 bp, Homo sapiens
gctgagaaggcag

SEQ ID NO: 1735899 - DNA, 20 bp, Homo sapiens
gctgagagacccaaggagga

SEQ ID NO: 1735900 - DNA, 22 bp, Homo sapiens
gctgagcacttagcaggcaccg

SEQ ID NO: 1735901 - DNA, 15 bp, Homo sapiens
gctgagcatggggcg

SEQ ID NO: 1735902 - DNA, 23 bp, Homo sapiens
gctgagccatgaggagcgtggac

SEQ ID NO: 1735903 - DNA, 15 bp, Homo sapiens
gctgagcccctgggg

SEQ ID NO: 1735904 - DNA, 17 bp, Homo sapiens
gctgagcccctggggaa

SEQ ID NO: 1735905 - DNA, 15 bp, Homo sapiens
gctgagccctggcag

SEQ ID NO: 1735906 - DNA, 16 bp, Homo sapiens
gctgagccctggcagg

SEQ ID NO: 1735907 - DNA, 12 bp, Homo sapiens
gctgagcctgag

SEQ ID NO: 1735908 - DNA, 14 bp, Homo sapiens
gctgagcctgaggc

SEQ ID NO: 1735909 - DNA, 12 bp, Homo sapiens
gctgagcctgca

SEQ ID NO: 1735910 - DNA, 15 bp, Homo sapiens
gctgagcctgcaggg

SEQ ID NO: 1735911 - DNA, 16 bp, Homo sapiens
gctgagcctgcaggga

SEQ ID NO: 1735912 - DNA, 19 bp, Homo sapiens
gctgagcctgcagggaagc

SEQ ID NO: 1735913 - DNA, 11 bp, Homo sapiens
gctgagctgga

SEQ ID NO: 1735914 - DNA, 19 bp, Homo sapiens
gctgagcttgagctcccct

SEQ ID NO: 1735915 - DNA, 15 bp, Homo sapiens
gctgaggacgagacc

SEQ ID NO: 1735916 - DNA, 19 bp, Homo sapiens
gctgaggacgagaccccca

SEQ ID NO: 1735917 - DNA, 21 bp, Homo sapiens
gctgaggacgagacccccatc

SEQ ID NO: 1735918 - DNA, 23 bp, Homo sapiens
gctgaggacgagacccccatcca

SEQ ID NO: 1735919 - DNA, 18 bp, Homo sapiens
gctgaggaggcacctaca

SEQ ID NO: 1735920 - DNA, 16 bp, Homo sapiens
gctgaggagtgaggaa

SEQ ID NO: 1735921 - DNA, 18 bp, Homo sapiens
gctgaggatttcaagcct

SEQ ID NO: 1735922 - DNA, 13 bp, Homo sapiens
gctgaggcagaag

SEQ ID NO: 1735923 - DNA, 15 bp, Homo sapiens
gctgaggcagaagaa

SEQ ID NO: 1735924 - DNA, 16 bp, Homo sapiens
gctgaggcagaagaat

SEQ ID NO: 1735925 - DNA, 13 bp, Homo sapiens
gctgaggcaggag

SEQ ID NO: 1735926 - DNA, 19 bp, Homo sapiens
gctgaggccacccactgac

SEQ ID NO: 1735927 - DNA, 19 bp, Homo sapiens
gctgaggcccagcccctcc

SEQ ID NO: 1735928 - DNA, 17 bp, Homo sapiens
gctgaggcccagtgcat

SEQ ID NO: 1735929 - DNA, 19 bp, Homo sapiens
gctgaggcccagtgcatat

SEQ ID NO: 1735930 - DNA, 16 bp, Homo sapiens
gctgaggcccctaggt

SEQ ID NO: 1735931 - DNA, 14 bp, Homo sapiens
gctgaggcctgggc

SEQ ID NO: 1735932 - DNA, 20 bp, Homo sapiens
gctgaggcctgggccgctgc

SEQ ID NO: 1735933 - DNA, 20 bp, Homo sapiens
taatttacttgttttggatg

SEQ ID NO: 1735934 - DNA, 21 bp, Homo sapiens
taatttagagataggaaactg

SEQ ID NO: 1735935 - DNA, 15 bp, Homo sapiens
taatttagatgaatt

SEQ ID NO: 1735936 - DNA, 12 bp, Homo sapiens
taatttataaag

SEQ ID NO: 1735937 - DNA, 23 bp, Homo sapiens
taatttatcttgtctctgggctt

SEQ ID NO: 1735938 - DNA, 14 bp, Homo sapiens
taatttatgagttt

SEQ ID NO: 1735939 - DNA, 11 bp, Homo sapiens
taatttatgca

SEQ ID NO: 1735940 - DNA, 19 bp, Homo sapiens
taatttattgtctgtctac

SEQ ID NO: 1735941 - DNA, 14 bp, Homo sapiens
taatttatttgttt

SEQ ID NO: 1735942 - DNA, 16 bp, Homo sapiens
taatttatttgtttcc

SEQ ID NO: 1735943 - DNA, 19 bp, Homo sapiens
taatttcaaaaatataact

SEQ ID NO: 1735944 - DNA, 12 bp, Homo sapiens
taatttcaaaat

SEQ ID NO: 1735945 - DNA, 19 bp, Homo sapiens
taatttcaaaatacatttg

SEQ ID NO: 1735946 - DNA, 16 bp, Homo sapiens
taatttcagtgtaaag

SEQ ID NO: 1735947 - DNA, 22 bp, Homo sapiens
taatttcatactatttagattt

SEQ ID NO: 1735948 - DNA, 14 bp, Homo sapiens
taatttcatttaaa

SEQ ID NO: 1735949 - DNA, 17 bp, Homo sapiens
taatttcctttttgaca

SEQ ID NO: 1735950 - DNA, 19 bp, Homo sapiens
taatttcctttttgacact

SEQ ID NO: 1735951 - DNA, 21 bp, Homo sapiens
taatttcctttttgacactga

SEQ ID NO: 1735952 - DNA, 18 bp, Homo sapiens
taatttcgccttaaactc

SEQ ID NO: 1735953 - DNA, 20 bp, Homo sapiens
taatttctagaaacaaacat

SEQ ID NO: 1735954 - DNA, 16 bp, Homo sapiens
taatttcttctttaga

SEQ ID NO: 1735955 - DNA, 16 bp, Homo sapiens
taatttcttttttcct

SEQ ID NO: 1735956 - DNA, 17 bp, Homo sapiens
taatttcttttttcctc

SEQ ID NO: 1735957 - DNA, 13 bp, Homo sapiens
taatttgaagatt

SEQ ID NO: 1735958 - DNA, 16 bp, Homo sapiens
taatttgatgaaagct

SEQ ID NO: 1735959 - DNA, 20 bp, Homo sapiens
taatttgatgaaagctgatt

SEQ ID NO: 1735960 - DNA, 13 bp, Homo sapiens
taatttgcacagt

SEQ ID NO: 1735961 - DNA, 12 bp, Homo sapiens
taatttgtacaa

SEQ ID NO: 1735962 - DNA, 19 bp, Homo sapiens
taatttgtacaatggttta

SEQ ID NO: 1735963 - DNA, 17 bp, Homo sapiens
taatttgttttggatat

SEQ ID NO: 1735964 - DNA, 14 bp, Homo sapiens
taattttaaacaaa

SEQ ID NO: 1735965 - DNA, 12 bp, Homo sapiens
taattttaatat

SEQ ID NO: 1735966 - DNA, 16 bp, Homo sapiens
taattttaatgctgtt

SEQ ID NO: 1735967 - DNA, 22 bp, Homo sapiens
taattttacatgtttataaatc

SEQ ID NO: 1735968 - DNA, 19 bp, Homo sapiens
taattttccagtataaaac

SEQ ID NO: 1735969 - DNA, 21 bp, Homo sapiens
taattttccagtataaaacaa

SEQ ID NO: 1735970 - DNA, 20 bp, Homo sapiens
taattttctgtggatcattt

SEQ ID NO: 1735971 - DNA, 14 bp, Homo sapiens
taattttcttcatg

SEQ ID NO: 1735972 - DNA, 23 bp, Homo sapiens
taattttcttcatgcaatgacat

SEQ ID NO: 1735973 - DNA, 15 bp, Homo sapiens
taattttgaataaat

SEQ ID NO: 1735974 - DNA, 21 bp, Homo sapiens
taattttgatatacattgtgt

SEQ ID NO: 1735975 - DNA, 12 bp, Homo sapiens
taattttgcaaa

SEQ ID NO: 1735976 - DNA, 14 bp, Homo sapiens
taattttgccttta

SEQ ID NO: 1735977 - DNA, 15 bp, Homo sapiens
taattttgcctttaa

SEQ ID NO: 1735978 - DNA, 12 bp, Homo sapiens
taattttgctaa

SEQ ID NO: 1735979 - DNA, 16 bp, Homo sapiens
taattttggaataatt

SEQ ID NO: 1735980 - DNA, 14 bp, Homo sapiens
taattttgtgcatt

SEQ ID NO: 1735981 - DNA, 20 bp, Homo sapiens
taattttgtgcattctttgg

SEQ ID NO: 1735982 - DNA, 22 bp, Homo sapiens
taattttgtgcattctttggta

SEQ ID NO: 1735983 - DNA, 13 bp, Homo sapiens
taatttttaaatg

SEQ ID NO: 1735984 - DNA, 18 bp, Homo sapiens
taatttttacctaatctc

SEQ ID NO: 1735985 - DNA, 13 bp, Homo sapiens
taatttttattta

SEQ ID NO: 1735986 - DNA, 16 bp, Homo sapiens
taatttttgctctaga

SEQ ID NO: 1735987 - DNA, 23 bp, Homo sapiens
taatttttggagaaatgtcataa

SEQ ID NO: 1735988 - DNA, 15 bp, Homo sapiens
taatttttgtacatt

SEQ ID NO: 1735989 - DNA, 16 bp, Homo sapiens
taatttttgtacatta

SEQ ID NO: 1735990 - DNA, 21 bp, Homo sapiens
taatttttgtacattacacta

SEQ ID NO: 1735991 - DNA, 22 bp, Homo sapiens
taatttttgtgtttttaataaa

SEQ ID NO: 1735992 - DNA, 20 bp, Homo sapiens
taattttttgtacttttagt

SEQ ID NO: 1735993 - DNA, 13 bp, Homo sapiens
taatttttttcct

SEQ ID NO: 1735994 - DNA, 13 bp, Homo sapiens
taattttttttaa

SEQ ID NO: 1735995 - DNA, 20 bp, Homo sapiens
taattttttttaaaatagaa

SEQ ID NO: 1735996 - DNA, 14 bp, Homo sapiens
tacaaaaacacagc

SEQ ID NO: 1735997 - DNA, 15 bp, Homo sapiens
tacaaaaacacagca

SEQ ID NO: 1735998 - DNA, 17 bp, Homo sapiens
tacaaaaacacagcaag

SEQ ID NO: 1735999 - DNA, 21 bp, Homo sapiens
tacaaaaaccaaaaagttaaa

SEQ ID NO: 1736000 - DNA, 16 bp, Homo sapiens
tacaaaaagcaaaaat

SEQ ID NO: 1736001 - DNA, 12 bp, Homo sapiens
tacaaaatattt

SEQ ID NO: 1736002 - DNA, 13 bp, Homo sapiens
tacaaaatattta

SEQ ID NO: 1736003 - DNA, 14 bp, Homo sapiens
tacaaaattaagca

SEQ ID NO: 1736004 - DNA, 16 bp, Homo sapiens
tacaaacagtatttct

SEQ ID NO: 1736005 - DNA, 23 bp, Homo sapiens
tacaaactcatcctcttttaatg

SEQ ID NO: 1736006 - DNA, 21 bp, Homo sapiens
tacaaagaggtgtacaggtac

SEQ ID NO: 1736007 - DNA, 21 bp, Homo sapiens
tacaaagggaaagcctctggc

SEQ ID NO: 1736008 - DNA, 14 bp, Homo sapiens
tacaaagtgtacca

SEQ ID NO: 1736009 - DNA, 15 bp, Homo sapiens
tacaaataaacctga

SEQ ID NO: 1736010 - DNA, 16 bp, Homo sapiens
tacaaataaacctgag

SEQ ID NO: 1736011 - DNA, 15 bp, Homo sapiens
tacaaatcagaactt

SEQ ID NO: 1736012 - DNA, 19 bp, Homo sapiens
tacaaatcagaagtcatct

SEQ ID NO: 1736013 - DNA, 22 bp, Homo sapiens
tacaaatcagaagtcatcttgc

SEQ ID NO: 1736014 - DNA, 21 bp, Homo sapiens
tacaaatgaagaaagtcaaaa

SEQ ID NO: 1736015 - DNA, 13 bp, Homo sapiens
tacaaatggattt

SEQ ID NO: 1736016 - DNA, 22 bp, Homo sapiens
tacaaattataatgtattcata

SEQ ID NO: 1736017 - DNA, 12 bp, Homo sapiens
tacaaatttatg

SEQ ID NO: 1736018 - DNA, 15 bp, Homo sapiens
tacaaatttatgcat

SEQ ID NO: 1736019 - DNA, 18 bp, Homo sapiens
tacaaatttatgcatttc

SEQ ID NO: 1736020 - DNA, 21 bp, Homo sapiens
tacaaatttatgcatttcatt

SEQ ID NO: 1736021 - DNA, 16 bp, Homo sapiens
tacaaatttggcctta

SEQ ID NO: 1736022 - DNA, 18 bp, Homo sapiens
tacaaatttggccttaag

SEQ ID NO: 1736023 - DNA, 22 bp, Homo sapiens
tacaaatttggccttaagaact

SEQ ID NO: 1736024 - DNA, 16 bp, Homo sapiens
tacaaatttgttattt

SEQ ID NO: 1736025 - DNA, 19 bp, Homo sapiens
tacaacaccaaaaaatatc

SEQ ID NO: 1736026 - DNA, 14 bp, Homo sapiens
tacaacatttatgt

SEQ ID NO: 1736027 - DNA, 17 bp, Homo sapiens
tacaaccaagctctctg

SEQ ID NO: 1736028 - DNA, 19 bp, Homo sapiens
tacaaccaagctctctgca

SEQ ID NO: 1736029 - DNA, 16 bp, Homo sapiens
tacaaccctaccctgg

SEQ ID NO: 1736030 - DNA, 15 bp, Homo sapiens
tacaacggaggcctg

SEQ ID NO: 1736031 - DNA, 20 bp, Homo sapiens
tacaactaacgcaaccaagt

SEQ ID NO: 1736032 - DNA, 17 bp, Homo sapiens
tacaactagatcaagga

SEQ ID NO: 1736033 - DNA, 14 bp, Homo sapiens
tacaactgtattta

SEQ ID NO: 1736034 - DNA, 18 bp, Homo sapiens
tacaactgtatttattaa

SEQ ID NO: 1736035 - DNA, 15 bp, Homo sapiens
tacaacttaatggaa

SEQ ID NO: 1736036 - DNA, 18 bp, Homo sapiens
tacaacttgtatttccaa

SEQ ID NO: 1736037 - DNA, 15 bp, Homo sapiens
tacaagaaaatgtat

SEQ ID NO: 1736038 - DNA, 18 bp, Homo sapiens
tacaagaaaatgtatcca

SEQ ID NO: 1736039 - DNA, 21 bp, Homo sapiens
tacaagattagaagctgaaaa

SEQ ID NO: 1736040 - DNA, 20 bp, Homo sapiens
tacaagattgaaaatcttgt

SEQ ID NO: 1736041 - DNA, 17 bp, Homo sapiens
tacaagatttagaaaaa

SEQ ID NO: 1736042 - DNA, 18 bp, Homo sapiens
tacaagccagctggagaa

SEQ ID NO: 1736043 - DNA, 15 bp, Homo sapiens
tacaaggcaagcatt

SEQ ID NO: 1736044 - DNA, 16 bp, Homo sapiens
tacaaggtaattgttt

SEQ ID NO: 1736045 - DNA, 17 bp, Homo sapiens
tacaaggtataataaaa

SEQ ID NO: 1736046 - DNA, 22 bp, Homo sapiens
tacaaggtggggattgcccctg

SEQ ID NO: 1736047 - DNA, 21 bp, Homo sapiens
tacaagtaaatagtttgaatt

SEQ ID NO: 1736048 - DNA, 18 bp, Homo sapiens
tacaagtcagctccagct

SEQ ID NO: 1736049 - DNA, 21 bp, Homo sapiens
tacaagtggtaatttttgtac

SEQ ID NO: 1736050 - DNA, 14 bp, Homo sapiens
tacagaaaaatctt

SEQ ID NO: 1736051 - DNA, 20 bp, Homo sapiens
tacagaaatactgctctgaa

SEQ ID NO: 1736052 - DNA, 22 bp, Homo sapiens
tacagaataatggagaacaagt

SEQ ID NO: 1736053 - DNA, 18 bp, Homo sapiens
tacagaatcttgttttga

SEQ ID NO: 1736054 - DNA, 17 bp, Homo sapiens
tacagaatttgaattat

SEQ ID NO: 1736055 - DNA, 18 bp, Homo sapiens
tacagacactaagttata

SEQ ID NO: 1736056 - DNA, 18 bp, Homo sapiens
tacagacattcaatgaat

SEQ ID NO: 1736057 - DNA, 20 bp, Homo sapiens
tacagactccatctcttctg

SEQ ID NO: 1736058 - DNA, 13 bp, Homo sapiens
tacagactctgat

SEQ ID NO: 1736059 - DNA, 19 bp, Homo sapiens
tacagactgttttactgtt

SEQ ID NO: 1736060 - DNA, 15 bp, Homo sapiens
tacagagaaagaaat

SEQ ID NO: 1736061 - DNA, 15 bp, Homo sapiens
tacagagaagtgaat

SEQ ID NO: 1736062 - DNA, 13 bp, Homo sapiens
tacagagctgtgg

SEQ ID NO: 1736063 - DNA, 11 bp, Homo sapiens
tacagaggaga

SEQ ID NO: 1736064 - DNA, 12 bp, Homo sapiens
tacagaggagat

SEQ ID NO: 1736065 - DNA, 23 bp, Homo sapiens
tacagaggatgccttttctgtga

SEQ ID NO: 1736066 - DNA, 20 bp, Homo sapiens
tacagataagtgttcttcag

SEQ ID NO: 1736067 - DNA, 15 bp, Homo sapiens
tacagataattcatt

SEQ ID NO: 1736068 - DNA, 20 bp, Homo sapiens
tacagataattcatttgtat

SEQ ID NO: 1736069 - DNA, 15 bp, Homo sapiens
tacagatactgtgag

SEQ ID NO: 1736070 - DNA, 17 bp, Homo sapiens
tacagatactgtgagct

SEQ ID NO: 1736071 - DNA, 13 bp, Homo sapiens
tacagatcaagaa

SEQ ID NO: 1736072 - DNA, 18 bp, Homo sapiens
tacagatgaatgtattta

SEQ ID NO: 1736073 - DNA, 13 bp, Homo sapiens
tacagcaacagga

SEQ ID NO: 1736074 - DNA, 23 bp, Homo sapiens
tacagcaacaggaatctcagaga

SEQ ID NO: 1736075 - DNA, 17 bp, Homo sapiens
tacagcacatcacctct

SEQ ID NO: 1736076 - DNA, 19 bp, Homo sapiens
tacagcactactctgtgcc

SEQ ID NO: 1736077 - DNA, 16 bp, Homo sapiens
tacagcattacaaatt

SEQ ID NO: 1736078 - DNA, 15 bp, Homo sapiens
tacagcattgtcttt

SEQ ID NO: 1736079 - DNA, 20 bp, Homo sapiens
tagcagctttgtctctgtca

SEQ ID NO: 1736080 - DNA, 17 bp, Homo sapiens
tagcaggtaccactgat

SEQ ID NO: 1736081 - DNA, 14 bp, Homo sapiens
tagcagttgctcac

SEQ ID NO: 1736082 - DNA, 20 bp, Homo sapiens
tagcagttgctcacatgtct

SEQ ID NO: 1736083 - DNA, 15 bp, Homo sapiens
tagcatacatttata

SEQ ID NO: 1736084 - DNA, 21 bp, Homo sapiens
tagcatacatttataatgttt

SEQ ID NO: 1736085 - DNA, 18 bp, Homo sapiens
tagcatacttaaaatatc

SEQ ID NO: 1736086 - DNA, 12 bp, Homo sapiens
tagcatatcaat

SEQ ID NO: 1736087 - DNA, 22 bp, Homo sapiens
tagcatatgacaaatgtttcta

SEQ ID NO: 1736088 - DNA, 19 bp, Homo sapiens
tagcatattcatggttgtt

SEQ ID NO: 1736089 - DNA, 22 bp, Homo sapiens
tagcatctcaggagatttcatg

SEQ ID NO: 1736090 - DNA, 19 bp, Homo sapiens
tagcatgcgcgctgtgggc

SEQ ID NO: 1736091 - DNA, 20 bp, Homo sapiens
tagcatgcgcgctgtgggca

SEQ ID NO: 1736092 - DNA, 17 bp, Homo sapiens
tagcatgcttcctttct

SEQ ID NO: 1736093 - DNA, 18 bp, Homo sapiens
tagcatgcttcctttctc

SEQ ID NO: 1736094 - DNA, 22 bp, Homo sapiens
tagcatggcatatttttcacat

SEQ ID NO: 1736095 - DNA, 15 bp, Homo sapiens
tagcatggggcccct

SEQ ID NO: 1736096 - DNA, 20 bp, Homo sapiens
tagcatgtactctgttgagt

SEQ ID NO: 1736097 - DNA, 14 bp, Homo sapiens
tagcattacctaat

SEQ ID NO: 1736098 - DNA, 22 bp, Homo sapiens
tagcattacctaatttttttcc

SEQ ID NO: 1736099 - DNA, 17 bp, Homo sapiens
tagcattgtttttgtca

SEQ ID NO: 1736100 - DNA, 16 bp, Homo sapiens
tagcatttcttgatgt

SEQ ID NO: 1736101 - DNA, 17 bp, Homo sapiens
tagcatttgttttagca

SEQ ID NO: 1736102 - DNA, 19 bp, Homo sapiens
tagcatttttatgcagaca

SEQ ID NO: 1736103 - DNA, 22 bp, Homo sapiens
tagcatttttatgcagacagtc

SEQ ID NO: 1736104 - DNA, 22 bp, Homo sapiens
tagccaaaaaggcaaataatgg

SEQ ID NO: 1736105 - DNA, 19 bp, Homo sapiens
tagccaactgtttccctgc

SEQ ID NO: 1736106 - DNA, 20 bp, Homo sapiens
tagccaaggtgggctgagcc

SEQ ID NO: 1736107 - DNA, 23 bp, Homo sapiens
tagccaaggtgggctgagccctg

SEQ ID NO: 1736108 - DNA, 16 bp, Homo sapiens
tagccacctcccaccc

SEQ ID NO: 1736109 - DNA, 21 bp, Homo sapiens
tagccacctcccaccccactc

SEQ ID NO: 1736110 - DNA, 14 bp, Homo sapiens
tagccactcaggag

SEQ ID NO: 1736111 - DNA, 19 bp, Homo sapiens
tagccactggtttctcaga

SEQ ID NO: 1736112 - DNA, 16 bp, Homo sapiens
tagccagacactctgc

SEQ ID NO: 1736113 - DNA, 17 bp, Homo sapiens
tagccagagaggagcac

SEQ ID NO: 1736114 - DNA, 24 bp, Homo sapiens
tagccagagcccttcactgccatg

SEQ ID NO: 1736115 - DNA, 17 bp, Homo sapiens
tagccagagggtgggag

SEQ ID NO: 1736116 - DNA, 20 bp, Homo sapiens
tagccagagggtgggagcct

SEQ ID NO: 1736117 - DNA, 22 bp, Homo sapiens
tagccagggtgtggccctgcca

SEQ ID NO: 1736118 - DNA, 12 bp, Homo sapiens
tagccagtgact

SEQ ID NO: 1736119 - DNA, 16 bp, Homo sapiens
tagccagtgctccagg

SEQ ID NO: 1736120 - DNA, 19 bp, Homo sapiens
tagccagttcaaagtgtat

SEQ ID NO: 1736121 - DNA, 18 bp, Homo sapiens
tagccatggctcaggcaa

SEQ ID NO: 1736122 - DNA, 20 bp, Homo sapiens
tagccatggctcaggcaagc

SEQ ID NO: 1736123 - DNA, 23 bp, Homo sapiens
tagccatggctcaggcaagcccc

SEQ ID NO: 1736124 - DNA, 14 bp, Homo sapiens
tagccatggctggg

SEQ ID NO: 1736125 - DNA, 19 bp, Homo sapiens
tagccatttggtagatgtt

SEQ ID NO: 1736126 - DNA, 15 bp, Homo sapiens
tagcccaagaggtct

SEQ ID NO: 1736127 - DNA, 13 bp, Homo sapiens
tagcccacccccc

SEQ ID NO: 1736128 - DNA, 15 bp, Homo sapiens
tagcccactccctgc

SEQ ID NO: 1736129 - DNA, 16 bp, Homo sapiens
tagcccactccctgcc

SEQ ID NO: 1736130 - DNA, 18 bp, Homo sapiens
tagcccactccctgccta

SEQ ID NO: 1736131 - DNA, 21 bp, Homo sapiens
tagcccaggccagagtgcagt

SEQ ID NO: 1736132 - DNA, 21 bp, Homo sapiens
tagccccagactgggcccagg

SEQ ID NO: 1736133 - DNA, 17 bp, Homo sapiens
tagccccgagacaccat

SEQ ID NO: 1736134 - DNA, 19 bp, Homo sapiens
tagccccgagacaccatcc

SEQ ID NO: 1736135 - DNA, 15 bp, Homo sapiens
tagccccggcccccc

SEQ ID NO: 1736136 - DNA, 20 bp, Homo sapiens
tagccccttggattcctgca

SEQ ID NO: 1736137 - DNA, 17 bp, Homo sapiens
tagccccttttctttgg

SEQ ID NO: 1736138 - DNA, 12 bp, Homo sapiens
tagccctcagtc

SEQ ID NO: 1736139 - DNA, 16 bp, Homo sapiens
tagccctcctgagcac

SEQ ID NO: 1736140 - DNA, 17 bp, Homo sapiens
tagccctgccctcccaa

SEQ ID NO: 1736141 - DNA, 21 bp, Homo sapiens
tagccctgccctcccaagtcc

SEQ ID NO: 1736142 - DNA, 20 bp, Homo sapiens
tagccctggttagctgacag

SEQ ID NO: 1736143 - DNA, 14 bp, Homo sapiens
tagccgagagcctg

SEQ ID NO: 1736144 - DNA, 13 bp, Homo sapiens
tagccgcaccctg

SEQ ID NO: 1736145 - DNA, 15 bp, Homo sapiens
tagccgtccatggca

SEQ ID NO: 1736146 - DNA, 17 bp, Homo sapiens
tagccgtccatggcacc

SEQ ID NO: 1736147 - DNA, 17 bp, Homo sapiens
tagcctaaagggcaggg

SEQ ID NO: 1736148 - DNA, 20 bp, Homo sapiens
tagcctaaagggcagggccc

SEQ ID NO: 1736149 - DNA, 21 bp, Homo sapiens
tagcctaaagggcagggccca

SEQ ID NO: 1736150 - DNA, 14 bp, Homo sapiens
tagcctaagatata

SEQ ID NO: 1736151 - DNA, 18 bp, Homo sapiens
tagcctaagatatacttg

SEQ ID NO: 1736152 - DNA, 16 bp, Homo sapiens
tagcctctcccacccg

SEQ ID NO: 1736153 - DNA, 12 bp, Homo sapiens
tagcctgaattt

SEQ ID NO: 1736154 - DNA, 20 bp, Homo sapiens
tagcctggactaaaggcatc

SEQ ID NO: 1736155 - DNA, 14 bp, Homo sapiens
tagcctggactgct

SEQ ID NO: 1736156 - DNA, 13 bp, Homo sapiens
tagcctgggccag

SEQ ID NO: 1736157 - DNA, 14 bp, Homo sapiens
tagcctgggccaga

SEQ ID NO: 1736158 - DNA, 16 bp, Homo sapiens
tagcctgggccagaga

SEQ ID NO: 1736159 - DNA, 13 bp, Homo sapiens
tagccttcctcca

SEQ ID NO: 1736160 - DNA, 23 bp, Homo sapiens
tagccttcctccacatcctttct

SEQ ID NO: 1736161 - DNA, 14 bp, Homo sapiens
tagccttgcttgtt

SEQ ID NO: 1736162 - DNA, 15 bp, Homo sapiens
tagccttgcttgtta

SEQ ID NO: 1736163 - DNA, 17 bp, Homo sapiens
tagcctttgccctgtca

SEQ ID NO: 1736164 - DNA, 15 bp, Homo sapiens
tagcctttttgtata

SEQ ID NO: 1736165 - DNA, 22 bp, Homo sapiens
tagcctttttgtataaaataga

SEQ ID NO: 1736166 - DNA, 20 bp, Homo sapiens
tagcgatctctcctggccta

SEQ ID NO: 1736167 - DNA, 20 bp, Homo sapiens
tagcggaaaagttgtcttaa

SEQ ID NO: 1736168 - DNA, 15 bp, Homo sapiens
tagcggagcccagcc

SEQ ID NO: 1736169 - DNA, 22 bp, Homo sapiens
tagcgggactcagtgagctggg

SEQ ID NO: 1736170 - DNA, 16 bp, Homo sapiens
tagcgtcaagacattt

SEQ ID NO: 1736171 - DNA, 17 bp, Homo sapiens
tagcgtcaagacatttg

SEQ ID NO: 1736172 - DNA, 19 bp, Homo sapiens
tagcgtgcccgtgtgcatg

SEQ ID NO: 1736173 - DNA, 13 bp, Homo sapiens
tagcgttctggac

SEQ ID NO: 1736174 - DNA, 21 bp, Homo sapiens
tagcgttctggactctgcccc

SEQ ID NO: 1736175 - DNA, 16 bp, Homo sapiens
tagctcaccaggcctg

SEQ ID NO: 1736176 - DNA, 17 bp, Homo sapiens
tagctcaccaggcctgg

SEQ ID NO: 1736177 - DNA, 18 bp, Homo sapiens
tagctcaccaggcctggc

SEQ ID NO: 1736178 - DNA, 14 bp, Homo sapiens
tagctcaggtgcct

SEQ ID NO: 1736179 - DNA, 11 bp, Homo sapiens
tagctcagtca

SEQ ID NO: 1736180 - DNA, 19 bp, Homo sapiens
tagctcagtcatcaaagca

SEQ ID NO: 1736181 - DNA, 20 bp, Homo sapiens
tagctccctcctcccatctc

SEQ ID NO: 1736182 - DNA, 21 bp, Homo sapiens
tagctccctgtggggcaggag

SEQ ID NO: 1736183 - DNA, 14 bp, Homo sapiens
tatctgcctcccct

SEQ ID NO: 1736184 - DNA, 11 bp, Homo sapiens
tatctgcctgg

SEQ ID NO: 1736185 - DNA, 14 bp, Homo sapiens
tatctgcctggcct

SEQ ID NO: 1736186 - DNA, 18 bp, Homo sapiens
tatctgcctggcctggct

SEQ ID NO: 1736187 - DNA, 17 bp, Homo sapiens
tatctggcttccctgga

SEQ ID NO: 1736188 - DNA, 19 bp, Homo sapiens
tatctggcttccctggaag

SEQ ID NO: 1736189 - DNA, 21 bp, Homo sapiens
tatctgggtaagaagaaagca

SEQ ID NO: 1736190 - DNA, 22 bp, Homo sapiens
tatctgggtaagaagaaagcaa

SEQ ID NO: 1736191 - DNA, 22 bp, Homo sapiens
tatctgtaatggtactgacttt

SEQ ID NO: 1736192 - DNA, 11 bp, Homo sapiens
tatctgtattt

SEQ ID NO: 1736193 - DNA, 15 bp, Homo sapiens
tatctgtatttaatt

SEQ ID NO: 1736194 - DNA, 17 bp, Homo sapiens
tatctgtatttaatttt

SEQ ID NO: 1736195 - DNA, 23 bp, Homo sapiens
tatcttaaagaaacagctttcaa

SEQ ID NO: 1736196 - DNA, 14 bp, Homo sapiens
tatcttaagcatgt

SEQ ID NO: 1736197 - DNA, 15 bp, Homo sapiens
tatcttatctagcaa

SEQ ID NO: 1736198 - DNA, 21 bp, Homo sapiens
tatcttcaaactttcactttg

SEQ ID NO: 1736199 - DNA, 18 bp, Homo sapiens
tatcttctcaagttctaa

SEQ ID NO: 1736200 - DNA, 14 bp, Homo sapiens
tatcttgaaggaaa

SEQ ID NO: 1736201 - DNA, 22 bp, Homo sapiens
tatcttgggtgtattctctgta

SEQ ID NO: 1736202 - DNA, 16 bp, Homo sapiens
tatcttgtagctttat

SEQ ID NO: 1736203 - DNA, 15 bp, Homo sapiens
tatctttaagaaaaa

SEQ ID NO: 1736204 - DNA, 12 bp, Homo sapiens
tatctttatgct

SEQ ID NO: 1736205 - DNA, 15 bp, Homo sapiens
tatctttattaaaac

SEQ ID NO: 1736206 - DNA, 14 bp, Homo sapiens
tatctttctcttac

SEQ ID NO: 1736207 - DNA, 21 bp, Homo sapiens
tatctttctcttacctgttat

SEQ ID NO: 1736208 - DNA, 16 bp, Homo sapiens
tatctttctttctcta

SEQ ID NO: 1736209 - DNA, 17 bp, Homo sapiens
tatctttctttctctaa

SEQ ID NO: 1736210 - DNA, 21 bp, Homo sapiens
tatcttttgtatatctaagac

SEQ ID NO: 1736211 - DNA, 13 bp, Homo sapiens
tatgaaaaaatat

SEQ ID NO: 1736212 - DNA, 17 bp, Homo sapiens
tatgaaaaaatatgaac

SEQ ID NO: 1736213 - DNA, 19 bp, Homo sapiens
tatgaaaatgagcatcaga

SEQ ID NO: 1736214 - DNA, 17 bp, Homo sapiens
tatgaaatgccactggg

SEQ ID NO: 1736215 - DNA, 23 bp, Homo sapiens
tatgaacacagacaaagtgctat

SEQ ID NO: 1736216 - DNA, 17 bp, Homo sapiens
tatgaacagaaatattg

SEQ ID NO: 1736217 - DNA, 14 bp, Homo sapiens
tatgaacagctgtg

SEQ ID NO: 1736218 - DNA, 16 bp, Homo sapiens
tatgaacagctgtgtc

SEQ ID NO: 1736219 - DNA, 14 bp, Homo sapiens
tatgaacatattgt

SEQ ID NO: 1736220 - DNA, 14 bp, Homo sapiens
tatgaacattgtac

SEQ ID NO: 1736221 - DNA, 15 bp, Homo sapiens
tatgaacattgtact

SEQ ID NO: 1736222 - DNA, 16 bp, Homo sapiens
tatgaacattgtactg

SEQ ID NO: 1736223 - DNA, 23 bp, Homo sapiens
tatgaacattgtactgttgcttt

SEQ ID NO: 1736224 - DNA, 21 bp, Homo sapiens
tatgaacctattttcatttgt

SEQ ID NO: 1736225 - DNA, 18 bp, Homo sapiens
tatgaactcatcattttt

SEQ ID NO: 1736226 - DNA, 20 bp, Homo sapiens
tatgaactttatagttgttt

SEQ ID NO: 1736227 - DNA, 16 bp, Homo sapiens
tatgaagaaaatactt

SEQ ID NO: 1736228 - DNA, 20 bp, Homo sapiens
tatgaagaaaatacttaaat

SEQ ID NO: 1736229 - DNA, 16 bp, Homo sapiens
tatgaagaactgagga

SEQ ID NO: 1736230 - DNA, 15 bp, Homo sapiens
tatgaagacttaaaa

SEQ ID NO: 1736231 - DNA, 20 bp, Homo sapiens
tatgaagggacagctgctgg

SEQ ID NO: 1736232 - DNA, 15 bp, Homo sapiens
tatgaagtatataat

SEQ ID NO: 1736233 - DNA, 17 bp, Homo sapiens
tatgaagttaacagtct

SEQ ID NO: 1736234 - DNA, 14 bp, Homo sapiens
tatgaagttgctgt

SEQ ID NO: 1736235 - DNA, 16 bp, Homo sapiens
tatgaatacagggcat

SEQ ID NO: 1736236 - DNA, 18 bp, Homo sapiens
tatgaatattactctcaa

SEQ ID NO: 1736237 - DNA, 16 bp, Homo sapiens
tatgaatccaacgtgt

SEQ ID NO: 1736238 - DNA, 15 bp, Homo sapiens
tatgaatctatgcca

SEQ ID NO: 1736239 - DNA, 18 bp, Homo sapiens
tatgaatgggttgttaaa

SEQ ID NO: 1736240 - DNA, 13 bp, Homo sapiens
tatgaattcaaga

SEQ ID NO: 1736241 - DNA, 14 bp, Homo sapiens
tatgaattgtacag

SEQ ID NO: 1736242 - DNA, 15 bp, Homo sapiens
tatgaattgtacaga

SEQ ID NO: 1736243 - DNA, 15 bp, Homo sapiens
tatgaatttaaatat

SEQ ID NO: 1736244 - DNA, 16 bp, Homo sapiens
tatgacaaattcaaga

SEQ ID NO: 1736245 - DNA, 22 bp, Homo sapiens
tatgacataaaaacaactttat

SEQ ID NO: 1736246 - DNA, 19 bp, Homo sapiens
tatgacatcacttgtacaa

SEQ ID NO: 1736247 - DNA, 23 bp, Homo sapiens
tatgacatcacttgtacaaaata

SEQ ID NO: 1736248 - DNA, 24 bp, Homo sapiens
tatgacatcacttgtacaaaataa

SEQ ID NO: 1736249 - DNA, 22 bp, Homo sapiens
tatgacatttaaatgtaactta

SEQ ID NO: 1736250 - DNA, 22 bp, Homo sapiens
tatgaccaaaattttaagtagg

SEQ ID NO: 1736251 - DNA, 18 bp, Homo sapiens
tatgaccatatttactct

SEQ ID NO: 1736252 - DNA, 15 bp, Homo sapiens
tatgacccacactgc

SEQ ID NO: 1736253 - DNA, 22 bp, Homo sapiens
tatgacctaaatccattttcta

SEQ ID NO: 1736254 - DNA, 23 bp, Homo sapiens
tatgacctaaatccattttctaa

SEQ ID NO: 1736255 - DNA, 20 bp, Homo sapiens
tatgacgcggctcaaaagga

SEQ ID NO: 1736256 - DNA, 16 bp, Homo sapiens
tatgacggaagaacat

SEQ ID NO: 1736257 - DNA, 12 bp, Homo sapiens
tatgactaaaga

SEQ ID NO: 1736258 - DNA, 17 bp, Homo sapiens
tatgactaaagagagaa

SEQ ID NO: 1736259 - DNA, 19 bp, Homo sapiens
tatgactttttataaaatg

SEQ ID NO: 1736260 - DNA, 23 bp, Homo sapiens
tatgagaaaagaggcgtctgtat

SEQ ID NO: 1736261 - DNA, 16 bp, Homo sapiens
tatgagaatatacctt

SEQ ID NO: 1736262 - DNA, 21 bp, Homo sapiens
tatgagaatataccttattta

SEQ ID NO: 1736263 - DNA, 15 bp, Homo sapiens
tatgagactttatgt

SEQ ID NO: 1736264 - DNA, 18 bp, Homo sapiens
tatgagatggttaaaaag

SEQ ID NO: 1736265 - DNA, 20 bp, Homo sapiens
tatgagatggttaaaaaggc

SEQ ID NO: 1736266 - DNA, 14 bp, Homo sapiens
tatgagattggttt

SEQ ID NO: 1736267 - DNA, 21 bp, Homo sapiens
tatgagcctgccctcactccc

SEQ ID NO: 1736268 - DNA, 22 bp, Homo sapiens
tatgagcctgccctcactccct

SEQ ID NO: 1736269 - DNA, 18 bp, Homo sapiens
tatgagctacaacaaaag

SEQ ID NO: 1736270 - DNA, 14 bp, Homo sapiens
tatgaggaggggag

SEQ ID NO: 1736271 - DNA, 20 bp, Homo sapiens
tatgaggataatgggaagag

SEQ ID NO: 1736272 - DNA, 14 bp, Homo sapiens
tatgaggtgaaatg

SEQ ID NO: 1736273 - DNA, 18 bp, Homo sapiens
tatgagtagatactctca

SEQ ID NO: 1736274 - DNA, 14 bp, Homo sapiens
tatgagtagccagg

SEQ ID NO: 1736275 - DNA, 16 bp, Homo sapiens
tatgagtctagatgtt

SEQ ID NO: 1736276 - DNA, 21 bp, Homo sapiens
tatgagtcttctgtaattcat

SEQ ID NO: 1736277 - DNA, 18 bp, Homo sapiens
tatgagttccctaaacaa

SEQ ID NO: 1736278 - DNA, 15 bp, Homo sapiens
tatgagttcttcgta

SEQ ID NO: 1736279 - DNA, 16 bp, Homo sapiens
tatgagttggacttca

SEQ ID NO: 1736280 - DNA, 15 bp, Homo sapiens
tatgataatagattc

SEQ ID NO: 1736281 - DNA, 19 bp, Homo sapiens
tatgatatttcttgctttc

SEQ ID NO: 1736282 - DNA, 13 bp, Homo sapiens
tatgatatttttc

SEQ ID NO: 1736283 - DNA, 14 bp, Homo sapiens
tatgatatttttca

SEQ ID NO: 1736284 - DNA, 13 bp, Homo sapiens
tatgatcagtgtt

SEQ ID NO: 1736285 - DNA, 15 bp, Homo sapiens
tatgatcccagcact

SEQ ID NO: 1736286 - DNA, 15 bp, Homo sapiens
tatgatcgcgccact

SEQ ID NO: 1736287 - DNA, 18 bp, Homo sapiens
tatgatctaataaacttt

SEQ ID NO: 1736288 - DNA, 19 bp, Homo sapiens
tatgatctaataaacttta

SEQ ID NO: 1736289 - DNA, 22 bp, Homo sapiens
tatgatgcatacagttttctag

SEQ ID NO: 1736290 - DNA, 24 bp, Homo sapiens
tatgatggcaggtcctctgttgca

SEQ ID NO: 1736291 - DNA, 15 bp, Homo sapiens
tatgatgggggaaaa

SEQ ID NO: 1736292 - DNA, 22 bp, Homo sapiens
tatgattactggcctttttcat

SEQ ID NO: 1736293 - DNA, 21 bp, Homo sapiens
tatgattattaacgatgtcca

SEQ ID NO: 1736294 - DNA, 18 bp, Homo sapiens
tatgattccaatctctgt

SEQ ID NO: 1736295 - DNA, 17 bp, Homo sapiens
tatgattgaaaagaaga

SEQ ID NO: 1736296 - DNA, 19 bp, Homo sapiens
tatgattgaaaagaagaaa

SEQ ID NO: 1736297 - DNA, 17 bp, Homo sapiens
tatgatttaaaacatgt

SEQ ID NO: 1736298 - DNA, 18 bp, Homo sapiens
tatgatttaaaacatgta

SEQ ID NO: 1736299 - DNA, 21 bp, Homo sapiens
tatcagttgcaataatacttc

SEQ ID NO: 1736300 - DNA, 13 bp, Homo sapiens
tatcataaaaata

SEQ ID NO: 1736301 - DNA, 23 bp, Homo sapiens
tatcataagttatgcctctgaca

SEQ ID NO: 1736302 - DNA, 16 bp, Homo sapiens
tatcatacaaatcagt

SEQ ID NO: 1736303 - DNA, 16 bp, Homo sapiens
tatcatattattatcc

SEQ ID NO: 1736304 - DNA, 16 bp, Homo sapiens
tatcatccacattgtt

SEQ ID NO: 1736305 - DNA, 19 bp, Homo sapiens
tatcatcccaacagccaag

SEQ ID NO: 1736306 - DNA, 17 bp, Homo sapiens
tatcatgaaacacttct

SEQ ID NO: 1736307 - DNA, 16 bp, Homo sapiens
tatcatgaattttaaa

SEQ ID NO: 1736308 - DNA, 20 bp, Homo sapiens
tatcatgggaaaagaccagg

SEQ ID NO: 1736309 - DNA, 19 bp, Homo sapiens
tatcatgtcgtaggtaaac

SEQ ID NO: 1736310 - DNA, 18 bp, Homo sapiens
tatcattcattcttagct

SEQ ID NO: 1736311 - DNA, 18 bp, Homo sapiens
tatcattccaattctaaa

SEQ ID NO: 1736312 - DNA, 19 bp, Homo sapiens
tatcattccaattctaaat

SEQ ID NO: 1736313 - DNA, 23 bp, Homo sapiens
tatcattccaattctaaatccga

SEQ ID NO: 1736314 - DNA, 14 bp, Homo sapiens
tatcattctaaaga

SEQ ID NO: 1736315 - DNA, 16 bp, Homo sapiens
tatcattctaaagata

SEQ ID NO: 1736316 - DNA, 15 bp, Homo sapiens
tatcattttttcctg

SEQ ID NO: 1736317 - DNA, 13 bp, Homo sapiens
tatccaaaagctt

SEQ ID NO: 1736318 - DNA, 18 bp, Homo sapiens
tatccaaaatgtgtattt

SEQ ID NO: 1736319 - DNA, 23 bp, Homo sapiens
tatccaaaatgtgtatttcttat

SEQ ID NO: 1736320 - DNA, 19 bp, Homo sapiens
tatccaaaccaaataaaaa

SEQ ID NO: 1736321 - DNA, 21 bp, Homo sapiens
tatccaaggaaacattttatc

SEQ ID NO: 1736322 - DNA, 15 bp, Homo sapiens
tatccactttgcaca

SEQ ID NO: 1736323 - DNA, 18 bp, Homo sapiens
tatccaggcaccaggact

SEQ ID NO: 1736324 - DNA, 19 bp, Homo sapiens
tatccaggttccctcccag

SEQ ID NO: 1736325 - DNA, 12 bp, Homo sapiens
tatccatctttt

SEQ ID NO: 1736326 - DNA, 15 bp, Homo sapiens
tatccatgtacttgt

SEQ ID NO: 1736327 - DNA, 16 bp, Homo sapiens
tatccattaacctggg

SEQ ID NO: 1736328 - DNA, 21 bp, Homo sapiens
tatccattctcgttttaggac

SEQ ID NO: 1736329 - DNA, 14 bp, Homo sapiens
tatccatttcttca

SEQ ID NO: 1736330 - DNA, 21 bp, Homo sapiens
tatcccaatcaaagaattaca

SEQ ID NO: 1736331 - DNA, 20 bp, Homo sapiens
tatcccacctccatcccaga

SEQ ID NO: 1736332 - DNA, 18 bp, Homo sapiens
tatccccaggccaggtcc

SEQ ID NO: 1736333 - DNA, 18 bp, Homo sapiens
tatccccatccaggtctt

SEQ ID NO: 1736334 - DNA, 22 bp, Homo sapiens
tatccccatctccctgcctggc

SEQ ID NO: 1736335 - DNA, 20 bp, Homo sapiens
tatccccccatcttgcttcc

SEQ ID NO: 1736336 - DNA, 17 bp, Homo sapiens
tatccctctcttcccct

SEQ ID NO: 1736337 - DNA, 14 bp, Homo sapiens
tatccgtgaattgc

SEQ ID NO: 1736338 - DNA, 17 bp, Homo sapiens
tatccgtgaattgcttt

SEQ ID NO: 1736339 - DNA, 23 bp, Homo sapiens
tatcctaaactttagacttccca

SEQ ID NO: 1736340 - DNA, 16 bp, Homo sapiens
tatcctaattgtccac

SEQ ID NO: 1736341 - DNA, 20 bp, Homo sapiens
tatcctccctggcagacaca

SEQ ID NO: 1736342 - DNA, 22 bp, Homo sapiens
tatcctcctgttctgaaacctt

SEQ ID NO: 1736343 - DNA, 16 bp, Homo sapiens
tatcctgattccaaat

SEQ ID NO: 1736344 - DNA, 18 bp, Homo sapiens
tatcctgccaaaatcatt

SEQ ID NO: 1736345 - DNA, 15 bp, Homo sapiens
tatcctgcctcagcc

SEQ ID NO: 1736346 - DNA, 20 bp, Homo sapiens
tatcctgcctcagcccgcca

SEQ ID NO: 1736347 - DNA, 19 bp, Homo sapiens
tatcctgctagctgtagaa

SEQ ID NO: 1736348 - DNA, 22 bp, Homo sapiens
tatcctgggggacccaatgtag

SEQ ID NO: 1736349 - DNA, 14 bp, Homo sapiens
tatcctggtctttt

SEQ ID NO: 1736350 - DNA, 16 bp, Homo sapiens
tatcctggtgtctagt

SEQ ID NO: 1736351 - DNA, 14 bp, Homo sapiens
tatcctgtattctt

SEQ ID NO: 1736352 - DNA, 21 bp, Homo sapiens
tatccttataggcctgtccct

SEQ ID NO: 1736353 - DNA, 14 bp, Homo sapiens
tatccttccttcag

SEQ ID NO: 1736354 - DNA, 19 bp, Homo sapiens
tatcgaaatgacggtgtta

SEQ ID NO: 1736355 - DNA, 13 bp, Homo sapiens
tatcgaaatttgt

SEQ ID NO: 1736356 - DNA, 16 bp, Homo sapiens
tatcgagtttgcaatg

SEQ ID NO: 1736357 - DNA, 16 bp, Homo sapiens
tatcgatctcttattt

SEQ ID NO: 1736358 - DNA, 19 bp, Homo sapiens
tatcgctgatgcagacaca

SEQ ID NO: 1736359 - DNA, 20 bp, Homo sapiens
tatcgctgatgcagacacag

SEQ ID NO: 1736360 - DNA, 14 bp, Homo sapiens
tatcggaagcagtg

SEQ ID NO: 1736361 - DNA, 16 bp, Homo sapiens
tatcggagacagtgat

SEQ ID NO: 1736362 - DNA, 14 bp, Homo sapiens
tatcgggaacagtg

SEQ ID NO: 1736363 - DNA, 17 bp, Homo sapiens
tatcgggagcagtgtct

SEQ ID NO: 1736364 - DNA, 20 bp, Homo sapiens
tatcgtttttgtattttcat

SEQ ID NO: 1736365 - DNA, 18 bp, Homo sapiens
tatctaaaaaataactgt

SEQ ID NO: 1736366 - DNA, 16 bp, Homo sapiens
tatctaaatgttgaaa

SEQ ID NO: 1736367 - DNA, 16 bp, Homo sapiens
tatctaatacctctgt

SEQ ID NO: 1736368 - DNA, 17 bp, Homo sapiens
tatctaatatatatgaa

SEQ ID NO: 1736369 - DNA, 21 bp, Homo sapiens
tatctaatatatatgaataaa

SEQ ID NO: 1736370 - DNA, 19 bp, Homo sapiens
tatctagcaagaagattct

SEQ ID NO: 1736371 - DNA, 20 bp, Homo sapiens
tatctagcaagaagattcta

SEQ ID NO: 1736372 - DNA, 14 bp, Homo sapiens
tatctagtatgaaa

SEQ ID NO: 1736373 - DNA, 16 bp, Homo sapiens
tatctagtcacataaa

SEQ ID NO: 1736374 - DNA, 17 bp, Homo sapiens
tatctagtgtgtcctgt

SEQ ID NO: 1736375 - DNA, 18 bp, Homo sapiens
tatctagttctaacagtg

SEQ ID NO: 1736376 - DNA, 12 bp, Homo sapiens
tatctataaaat

SEQ ID NO: 1736377 - DNA, 13 bp, Homo sapiens
tatctataaaata

SEQ ID NO: 1736378 - DNA, 19 bp, Homo sapiens
tatctataatttacctaag

SEQ ID NO: 1736379 - DNA, 19 bp, Homo sapiens
tatctatatcatatttctg

SEQ ID NO: 1736380 - DNA, 13 bp, Homo sapiens
tatctattaatat

SEQ ID NO: 1736381 - DNA, 19 bp, Homo sapiens
tatctattaatatatgtat

SEQ ID NO: 1736382 - DNA, 16 bp, Homo sapiens
tatctattctgagaaa

SEQ ID NO: 1736383 - DNA, 23 bp, Homo sapiens
tatctattctgagaaaacaagca

SEQ ID NO: 1736384 - DNA, 14 bp, Homo sapiens
tatctatttgtaca

SEQ ID NO: 1736385 - DNA, 14 bp, Homo sapiens
tatggcttatttct

SEQ ID NO: 1736386 - DNA, 22 bp, Homo sapiens
tatggcttatttctatgacaaa

SEQ ID NO: 1736387 - DNA, 18 bp, Homo sapiens
tatgggactgagcctggc

SEQ ID NO: 1736388 - DNA, 22 bp, Homo sapiens
tatgggaggcagccgaggcctg

SEQ ID NO: 1736389 - DNA, 15 bp, Homo sapiens
tatgggatgtaaaca

SEQ ID NO: 1736390 - DNA, 23 bp, Homo sapiens
tatgggatgtaaacaatgtaaag

SEQ ID NO: 1736391 - DNA, 18 bp, Homo sapiens
tatggggatagatgtgtg

SEQ ID NO: 1736392 - DNA, 22 bp, Homo sapiens
tatgggggcctggattcatttc

SEQ ID NO: 1736393 - DNA, 19 bp, Homo sapiens
tatgggtagggtaaatcag

SEQ ID NO: 1736394 - DNA, 11 bp, Homo sapiens
tatgggtcaca

SEQ ID NO: 1736395 - DNA, 14 bp, Homo sapiens
tatgggtcacagga

SEQ ID NO: 1736396 - DNA, 15 bp, Homo sapiens
tatgggtcctgcaat

SEQ ID NO: 1736397 - DNA, 14 bp, Homo sapiens
tatgggtctaggac

SEQ ID NO: 1736398 - DNA, 15 bp, Homo sapiens
tatggtaaaaaattt

SEQ ID NO: 1736399 - DNA, 14 bp, Homo sapiens
tatggtatttgagt

SEQ ID NO: 1736400 - DNA, 16 bp, Homo sapiens
tatggtccagaaactc

SEQ ID NO: 1736401 - DNA, 21 bp, Homo sapiens
tatggtccagaaactcctgtt

SEQ ID NO: 1736402 - DNA, 17 bp, Homo sapiens
tatggtggatccaaact

SEQ ID NO: 1736403 - DNA, 13 bp, Homo sapiens
tatggttaatact

SEQ ID NO: 1736404 - DNA, 19 bp, Homo sapiens
tatggttacttcttctctt

SEQ ID NO: 1736405 - DNA, 22 bp, Homo sapiens
tatggttacttcttctcttaga

SEQ ID NO: 1736406 - DNA, 20 bp, Homo sapiens
tatggttcccaataaaagtg

SEQ ID NO: 1736407 - DNA, 20 bp, Homo sapiens
tatggttctccaagaaactg

SEQ ID NO: 1736408 - DNA, 22 bp, Homo sapiens
tatggttctccaagaaactgaa

SEQ ID NO: 1736409 - DNA, 21 bp, Homo sapiens
tatggttgatagtttacctga

SEQ ID NO: 1736410 - DNA, 22 bp, Homo sapiens
tatggttgatagtttacctgaa

SEQ ID NO: 1736411 - DNA, 19 bp, Homo sapiens
tatgtaaaataaaattatg

SEQ ID NO: 1736412 - DNA, 15 bp, Homo sapiens
tatgtaaaatgtttt

SEQ ID NO: 1736413 - DNA, 17 bp, Homo sapiens
tatgtaaaatgttttag

SEQ ID NO: 1736414 - DNA, 23 bp, Homo sapiens
tatgtaaacaaatctttccatat

SEQ ID NO: 1736415 - DNA, 17 bp, Homo sapiens
tatgtaacagtcaaata

SEQ ID NO: 1736416 - DNA, 17 bp, Homo sapiens
tatgtaatataaattta

SEQ ID NO: 1736417 - DNA, 19 bp, Homo sapiens
tatgtaatatattgtacaa

SEQ ID NO: 1736418 - DNA, 23 bp, Homo sapiens
tatgtaatatattgtacaaatgt

SEQ ID NO: 1736419 - DNA, 15 bp, Homo sapiens
tatgtaatgcaaaat

SEQ ID NO: 1736420 - DNA, 21 bp, Homo sapiens
tatgtacaatacaatgtacaa

SEQ ID NO: 1736421 - DNA, 16 bp, Homo sapiens
tatgtaccatgtacat

SEQ ID NO: 1736422 - DNA, 20 bp, Homo sapiens
tatgtactaagaatgtcctt

SEQ ID NO: 1736423 - DNA, 14 bp, Homo sapiens
tatgtactagtgtt

SEQ ID NO: 1736424 - DNA, 20 bp, Homo sapiens
tatgtactcctctttacact

SEQ ID NO: 1736425 - DNA, 16 bp, Homo sapiens
tatgttctgtcttccc

SEQ ID NO: 1736426 - DNA, 18 bp, Homo sapiens
tatgttctgtcttcccaa

SEQ ID NO: 1736427 - DNA, 15 bp, Homo sapiens
tatgttcttagcaat

SEQ ID NO: 1736428 - DNA, 18 bp, Homo sapiens
tatgttctttagtttgct

SEQ ID NO: 1736429 - DNA, 18 bp, Homo sapiens
tatgttgacctttgcaaa

SEQ ID NO: 1736430 - DNA, 14 bp, Homo sapiens
tatgttgcctttat

SEQ ID NO: 1736431 - DNA, 22 bp, Homo sapiens
tatgttgtaatatttcttcaaa

SEQ ID NO: 1736432 - DNA, 12 bp, Homo sapiens
tatgtttacaaa

SEQ ID NO: 1736433 - DNA, 13 bp, Homo sapiens
tatgtttcaaact

SEQ ID NO: 1736434 - DNA, 14 bp, Homo sapiens
tatgtttgcacact

SEQ ID NO: 1736435 - DNA, 19 bp, Homo sapiens
tatgtttgcacacttgtgt

SEQ ID NO: 1736436 - DNA, 14 bp, Homo sapiens
tatgtttgtgcctt

SEQ ID NO: 1736437 - DNA, 15 bp, Homo sapiens
tatgttttgtttctg

SEQ ID NO: 1736438 - DNA, 17 bp, Homo sapiens
tatgttttttaaaatat

SEQ ID NO: 1736439 - DNA, 13 bp, Homo sapiens
tattaaaaaacaa

SEQ ID NO: 1736440 - DNA, 22 bp, Homo sapiens
tattaaaatatggctataaata

SEQ ID NO: 1736441 - DNA, 10 bp, Homo sapiens
tattaaaatc

SEQ ID NO: 1736442 - DNA, 19 bp, Homo sapiens
tattaaaattccaaattca

SEQ ID NO: 1736443 - DNA, 17 bp, Homo sapiens
tattaaacaaagtttca

SEQ ID NO: 1736444 - DNA, 14 bp, Homo sapiens
tattaaacatacat

SEQ ID NO: 1736445 - DNA, 22 bp, Homo sapiens
tattaaacatacataatacaat

SEQ ID NO: 1736446 - DNA, 14 bp, Homo sapiens
tattaaagtgctaa

SEQ ID NO: 1736447 - DNA, 19 bp, Homo sapiens
tattaaataataaagtatg

SEQ ID NO: 1736448 - DNA, 20 bp, Homo sapiens
tattaaataataaagtatga

SEQ ID NO: 1736449 - DNA, 21 bp, Homo sapiens
tattaaatacagacactaagt

SEQ ID NO: 1736450 - DNA, 20 bp, Homo sapiens
tattaaatcttaaacaatgt

SEQ ID NO: 1736451 - DNA, 22 bp, Homo sapiens
tattaaatcttaaacaatgtat

SEQ ID NO: 1736452 - DNA, 22 bp, Homo sapiens
tattaaattacatttgtaattt

SEQ ID NO: 1736453 - DNA, 17 bp, Homo sapiens
tattaacactactcaaa

SEQ ID NO: 1736454 - DNA, 14 bp, Homo sapiens
tattaactactgaa

SEQ ID NO: 1736455 - DNA, 17 bp, Homo sapiens
tattaactttaatgttt

SEQ ID NO: 1736456 - DNA, 16 bp, Homo sapiens
tattaagaaagactat

SEQ ID NO: 1736457 - DNA, 24 bp, Homo sapiens
tattaagaaagactatctaaatgt

SEQ ID NO: 1736458 - DNA, 13 bp, Homo sapiens
tattaagaaagga

SEQ ID NO: 1736459 - DNA, 16 bp, Homo sapiens
tattaagacagtgtac

SEQ ID NO: 1736460 - DNA, 14 bp, Homo sapiens
tattaagattggaa

SEQ ID NO: 1736461 - DNA, 17 bp, Homo sapiens
tattaagattggaaatg

SEQ ID NO: 1736462 - DNA, 14 bp, Homo sapiens
tattaagcagtaaa

SEQ ID NO: 1736463 - DNA, 22 bp, Homo sapiens
tattaagtctgggatgtagaac

SEQ ID NO: 1736464 - DNA, 14 bp, Homo sapiens
tattaatatatgta

SEQ ID NO: 1736465 - DNA, 12 bp, Homo sapiens
tattaatatcaa

SEQ ID NO: 1736466 - DNA, 20 bp, Homo sapiens
tattaatatcaactctgaag

SEQ ID NO: 1736467 - DNA, 12 bp, Homo sapiens
tattaatcaaaa

SEQ ID NO: 1736468 - DNA, 18 bp, Homo sapiens
tattaatcaagagaaact

SEQ ID NO: 1736469 - DNA, 20 bp, Homo sapiens
tattaatcaagagaaacttc

SEQ ID NO: 1736470 - DNA, 20 bp, Homo sapiens
tattaatccccatcattact

SEQ ID NO: 1736471 - DNA, 18 bp, Homo sapiens
tattaatgttttcaaaag

SEQ ID NO: 1736472 - DNA, 21 bp, Homo sapiens
tattaattttagtttttcatt

SEQ ID NO: 1736473 - DNA, 15 bp, Homo sapiens
tattacaacatttat

SEQ ID NO: 1736474 - DNA, 16 bp, Homo sapiens
tattacaagtaatgta

SEQ ID NO: 1736475 - DNA, 16 bp, Homo sapiens
tattacaatgtatctt

SEQ ID NO: 1736476 - DNA, 17 bp, Homo sapiens
tattacaatgtatcttt

SEQ ID NO: 1736477 - DNA, 18 bp, Homo sapiens
tattacaatgtatcttta

SEQ ID NO: 1736478 - DNA, 12 bp, Homo sapiens
tattacatcttt

SEQ ID NO: 1736479 - DNA, 17 bp, Homo sapiens
tattacatctttcacat

SEQ ID NO: 1736480 - DNA, 18 bp, Homo sapiens
tattacatgtaatttgat

SEQ ID NO: 1736481 - DNA, 16 bp, Homo sapiens
tattaccagcaagaat

SEQ ID NO: 1736482 - DNA, 20 bp, Homo sapiens
tattaccagcaagaataaaa

SEQ ID NO: 1736483 - DNA, 15 bp, Homo sapiens
tattaccccttttcg

SEQ ID NO: 1736484 - DNA, 11 bp, Homo sapiens
tattacctctg

SEQ ID NO: 1736485 - DNA, 19 bp, Homo sapiens
tattacctctgatacctca

SEQ ID NO: 1736486 - DNA, 21 bp, Homo sapiens
tattactagaagatgaataca

SEQ ID NO: 1736487 - DNA, 22 bp, Homo sapiens
tattactgaataatatcaaata

SEQ ID NO: 1736488 - DNA, 22 bp, Homo sapiens
tattactgtctttattcttatt

SEQ ID NO: 1736489 - DNA, 16 bp, Homo sapiens
tattactgttgcattt

SEQ ID NO: 1736490 - DNA, 22 bp, Homo sapiens
tattactgttgcatttactttt

SEQ ID NO: 1736491 - DNA, 20 bp, Homo sapiens
tattacttcctcaataaaaa

SEQ ID NO: 1736492 - DNA, 18 bp, Homo sapiens
tattactttgtcttttca

SEQ ID NO: 1736493 - DNA, 16 bp, Homo sapiens
tattagagcattgaat

SEQ ID NO: 1736494 - DNA, 18 bp, Homo sapiens
tattagagtatttccctt

SEQ ID NO: 1736495 - DNA, 22 bp, Homo sapiens
tattagatcaaatagttgcata

SEQ ID NO: 1736496 - DNA, 13 bp, Homo sapiens
tattagcatttgt

SEQ ID NO: 1736497 - DNA, 12 bp, Homo sapiens
tattagccaact

SEQ ID NO: 1736498 - DNA, 13 bp, Homo sapiens
tattagccaactg

SEQ ID NO: 1736499 - DNA, 15 bp, Homo sapiens
tattagctgaaacaa

SEQ ID NO: 1736500 - DNA, 14 bp, Homo sapiens
tattagctttactg

SEQ ID NO: 1736501 - DNA, 21 bp, Homo sapiens
tattaggaaaataaacagaca

SEQ ID NO: 1736502 - DNA, 22 bp, Homo sapiens
tattaggatctgcaaacaatga

SEQ ID NO: 1736503 - DNA, 17 bp, Homo sapiens
tattagtattgtgaata

SEQ ID NO: 1736504 - DNA, 13 bp, Homo sapiens
tattataaacaag

SEQ ID NO: 1736505 - DNA, 20 bp, Homo sapiens
tattataaactataaactta

SEQ ID NO: 1736506 - DNA, 16 bp, Homo sapiens
tattataacttaaaaa

SEQ ID NO: 1736507 - DNA, 12 bp, Homo sapiens
tattataattta

SEQ ID NO: 1736508 - DNA, 13 bp, Homo sapiens
tattatactgtat

SEQ ID NO: 1736509 - DNA, 14 bp, Homo sapiens
tattatactgtatt

SEQ ID NO: 1736510 - DNA, 12 bp, Homo sapiens
tattatagaaaa

SEQ ID NO: 1736511 - DNA, 20 bp, Homo sapiens
tattatagacaaaagaataa

SEQ ID NO: 1736512 - DNA, 17 bp, Homo sapiens
tattatagagcagaaat

SEQ ID NO: 1736513 - DNA, 18 bp, Homo sapiens
tattatagagcagaaatt

SEQ ID NO: 1736514 - DNA, 19 bp, Homo sapiens
tattatagagcagaaattc

SEQ ID NO: 1736515 - DNA, 13 bp, Homo sapiens
tattatatacata

SEQ ID NO: 1736516 - DNA, 22 bp, Homo sapiens
tattatatatatctatatcata

SEQ ID NO: 1736517 - DNA, 21 bp, Homo sapiens
tattatatttgacatgggtat

SEQ ID NO: 1736518 - DNA, 16 bp, Homo sapiens
tattatcaagtagact

SEQ ID NO: 1736519 - DNA, 18 bp, Homo sapiens
tattatcatgcaaatgct

SEQ ID NO: 1736520 - DNA, 22 bp, Homo sapiens
tattatcatgcaaatgctgtat

SEQ ID NO: 1736521 - DNA, 20 bp, Homo sapiens
tattatcattgctcccctga

SEQ ID NO: 1736522 - DNA, 18 bp, Homo sapiens
tattatcttgttcaggaa

SEQ ID NO: 1736523 - DNA, 20 bp, Homo sapiens
tattatgaggctattaaaag

SEQ ID NO: 1736524 - DNA, 19 bp, Homo sapiens
tattatgatgttagaagaa

SEQ ID NO: 1736525 - DNA, 21 bp, Homo sapiens
tattatggaagattttaaatt

SEQ ID NO: 1736526 - DNA, 15 bp, Homo sapiens
tattatggcaagtga

SEQ ID NO: 1736527 - DNA, 23 bp, Homo sapiens
tattatggcaagtgatatcacct

SEQ ID NO: 1736528 - DNA, 17 bp, Homo sapiens
tattatgtctcttctga

SEQ ID NO: 1736529 - DNA, 22 bp, Homo sapiens
tattatgttcttagcaataaat

SEQ ID NO: 1736530 - DNA, 18 bp, Homo sapiens
tattattagaaattagaa

SEQ ID NO: 1736531 - DNA, 13 bp, Homo sapiens
tattattatgttc

SEQ ID NO: 1736532 - DNA, 15 bp, Homo sapiens
tattattatgttctt

SEQ ID NO: 1736533 - DNA, 17 bp, Homo sapiens
tattattcccgacgaca

SEQ ID NO: 1736534 - DNA, 13 bp, Homo sapiens
tattatttatata

SEQ ID NO: 1736535 - DNA, 18 bp, Homo sapiens
tattatttattgtattag

SEQ ID NO: 1736536 - DNA, 17 bp, Homo sapiens
tattatttcttctctta

SEQ ID NO: 1736537 - DNA, 14 bp, Homo sapiens
tattatttgtgttt

SEQ ID NO: 1736538 - DNA, 15 bp, Homo sapiens
tattcaaacagtctc

SEQ ID NO: 1736539 - DNA, 14 bp, Homo sapiens
tattcaaatttgat

SEQ ID NO: 1736540 - DNA, 22 bp, Homo sapiens
tattcaaatttgatgatgttaa

SEQ ID NO: 1736541 - DNA, 14 bp, Homo sapiens
tattcaaatttgta

SEQ ID NO: 1736542 - DNA, 17 bp, Homo sapiens
tattcaaatttgtacag

SEQ ID NO: 1736543 - DNA, 18 bp, Homo sapiens
tattcaaatttgtgtcat

SEQ ID NO: 1736544 - DNA, 19 bp, Homo sapiens
tattcaacaatttcaataa

SEQ ID NO: 1736545 - DNA, 17 bp, Homo sapiens
tattcaagaatgaaaaa

SEQ ID NO: 1736546 - DNA, 16 bp, Homo sapiens
tattcaatgcatttaa

SEQ ID NO: 1736547 - DNA, 18 bp, Homo sapiens
tattcaattcctctggga

SEQ ID NO: 1736548 - DNA, 22 bp, Homo sapiens
tattcacgccattggttggaag

SEQ ID NO: 1736549 - DNA, 14 bp, Homo sapiens
tattcactctccat

SEQ ID NO: 1736550 - DNA, 14 bp, Homo sapiens
tattcactgtaagt

SEQ ID NO: 1736551 - DNA, 14 bp, Homo sapiens
tattcagacaagca

SEQ ID NO: 1736552 - DNA, 22 bp, Homo sapiens
tattcagacaagcaacaggttt

SEQ ID NO: 1736553 - DNA, 14 bp, Homo sapiens
tattcagaggcagt

SEQ ID NO: 1736554 - DNA, 18 bp, Homo sapiens
tattcagccagcttaaac

SEQ ID NO: 1736555 - DNA, 15 bp, Homo sapiens
tattcagtgctgtgg

SEQ ID NO: 1736556 - DNA, 21 bp, Homo sapiens
tattcagtgctgtggcctggg

SEQ ID NO: 1736557 - DNA, 22 bp, Homo sapiens
tattcagtgctgtggcctgggc

SEQ ID NO: 1736558 - DNA, 22 bp, Homo sapiens
tattcatagtatactgatttaa

SEQ ID NO: 1736559 - DNA, 23 bp, Homo sapiens
tattcatatttgtactttctgtt

SEQ ID NO: 1736560 - DNA, 15 bp, Homo sapiens
tattcatgaaatgtg

SEQ ID NO: 1736561 - DNA, 14 bp, Homo sapiens
tattcatgccatct

SEQ ID NO: 1736562 - DNA, 15 bp, Homo sapiens
tattcatgttcatgt

SEQ ID NO: 1736563 - DNA, 21 bp, Homo sapiens
tattccaaaaaggttgctgtt

SEQ ID NO: 1736564 - DNA, 23 bp, Homo sapiens
tattccaactgggcatttcaatc

SEQ ID NO: 1736565 - DNA, 17 bp, Homo sapiens
tattccaagacatgtct

SEQ ID NO: 1736566 - DNA, 17 bp, Homo sapiens
tattccaccattcacat

SEQ ID NO: 1736567 - DNA, 22 bp, Homo sapiens
tattccagatctttcagaaata

SEQ ID NO: 1736568 - DNA, 13 bp, Homo sapiens
tattccaggagaa

SEQ ID NO: 1736569 - DNA, 19 bp, Homo sapiens
tattccatccatatacttt

SEQ ID NO: 1736570 - DNA, 16 bp, Homo sapiens
tattccatgaatgtat

SEQ ID NO: 1736571 - DNA, 16 bp, Homo sapiens
tattccatgagctgct

SEQ ID NO: 1736572 - DNA, 15 bp, Homo sapiens
tattccatttacata

SEQ ID NO: 1736573 - DNA, 12 bp, Homo sapiens
tattcccatgag

SEQ ID NO: 1736574 - DNA, 22 bp, Homo sapiens
tattcccctatctctagaattt

SEQ ID NO: 1736575 - DNA, 18 bp, Homo sapiens
tattcctaacctgtcaga

SEQ ID NO: 1736576 - DNA, 18 bp, Homo sapiens
tattcctcctgctcatat

SEQ ID NO: 1736577 - DNA, 18 bp, Homo sapiens
tattcctggacttacaaa

SEQ ID NO: 1736578 - DNA, 19 bp, Homo sapiens
tattcctgtaaataagagt

SEQ ID NO: 1736579 - DNA, 16 bp, Homo sapiens
tattcctgttgctgtc

SEQ ID NO: 1736580 - DNA, 17 bp, Homo sapiens
tattcctgttgctgtct

SEQ ID NO: 1736581 - DNA, 21 bp, Homo sapiens
tattccttttgtgtacagtgt

SEQ ID NO: 1736582 - DNA, 14 bp, Homo sapiens
tattctaaatttta

SEQ ID NO: 1736583 - DNA, 19 bp, Homo sapiens
tattctaaattttatatct

SEQ ID NO: 1736584 - DNA, 21 bp, Homo sapiens
tattctaagccagttttcatt

SEQ ID NO: 1736585 - DNA, 16 bp, Homo sapiens
tattctaataaatata

SEQ ID NO: 1736586 - DNA, 15 bp, Homo sapiens
tattctacacatgta

SEQ ID NO: 1736587 - DNA, 22 bp, Homo sapiens
tattctacacatgtaaaatatg

SEQ ID NO: 1736588 - DNA, 17 bp, Homo sapiens
tattctacttctctgtt

SEQ ID NO: 1736589 - DNA, 19 bp, Homo sapiens
tattctagtcaactgctgt

SEQ ID NO: 1736590 - DNA, 22 bp, Homo sapiens
tattctagtcaactgctgtttt

SEQ ID NO: 1736591 - DNA, 14 bp, Homo sapiens
tattctatatgaat

SEQ ID NO: 1736592 - DNA, 17 bp, Homo sapiens
tattctatgtatgttaa

SEQ ID NO: 1736593 - DNA, 22 bp, Homo sapiens
tattctcaaacacagttacact

SEQ ID NO: 1736594 - DNA, 16 bp, Homo sapiens
tattctcaaagcagga

SEQ ID NO: 1736595 - DNA, 16 bp, Homo sapiens
tattctcactccacca

SEQ ID NO: 1736596 - DNA, 16 bp, Homo sapiens
tattctcatgcctcag

SEQ ID NO: 1736597 - DNA, 17 bp, Homo sapiens
tattctctgcaatttgt

SEQ ID NO: 1736598 - DNA, 13 bp, Homo sapiens
tattctctgtaag

SEQ ID NO: 1736599 - DNA, 15 bp, Homo sapiens
tattctgacatgtaa

SEQ ID NO: 1736600 - DNA, 17 bp, Homo sapiens
tattctgacatgtaaga

SEQ ID NO: 1736601 - DNA, 15 bp, Homo sapiens
tattctgagaaaaca

SEQ ID NO: 1736602 - DNA, 13 bp, Homo sapiens
tattctgtatccg

SEQ ID NO: 1736603 - DNA, 23 bp, Homo sapiens
tattctgtatccgtgaattgctt

SEQ ID NO: 1736604 - DNA, 18 bp, Homo sapiens
tattctgtcagtgttaaa

SEQ ID NO: 1736605 - DNA, 22 bp, Homo sapiens
tattctgtcagtgttaaagatt

SEQ ID NO: 1736606 - DNA, 20 bp, Homo sapiens
tattctgtggattctatatt

SEQ ID NO: 1736607 - DNA, 12 bp, Homo sapiens
tattctgtttgc

SEQ ID NO: 1736608 - DNA, 11 bp, Homo sapiens
tattctgtttt

SEQ ID NO: 1736609 - DNA, 13 bp, Homo sapiens
tattcttccagaa

SEQ ID NO: 1736610 - DNA, 19 bp, Homo sapiens
tattcttgatcagtagttt

SEQ ID NO: 1736611 - DNA, 23 bp, Homo sapiens
tattcttgatcagtagtttgcat

SEQ ID NO: 1736612 - DNA, 15 bp, Homo sapiens
tattcttgatgaaaa

SEQ ID NO: 1736613 - DNA, 16 bp, Homo sapiens
tattcttgctttcaca

SEQ ID NO: 1736614 - DNA, 16 bp, Homo sapiens
tattcttgtggttaaa

SEQ ID NO: 1736615 - DNA, 18 bp, Homo sapiens
tattcttgtggttaaaaa

SEQ ID NO: 1736616 - DNA, 16 bp, Homo sapiens
tattctttctcataaa

SEQ ID NO: 1736617 - DNA, 12 bp, Homo sapiens
tattctttctcc

SEQ ID NO: 1736618 - DNA, 14 bp, Homo sapiens
tattctttgcactt

SEQ ID NO: 1736619 - DNA, 16 bp, Homo sapiens
tattctttgcactttt

SEQ ID NO: 1736620 - DNA, 15 bp, Homo sapiens
tattcttttcaatta

SEQ ID NO: 1736621 - DNA, 13 bp, Homo sapiens
tattcttttctca

SEQ ID NO: 1736622 - DNA, 17 bp, Homo sapiens
tattgaaaacagtgtct

SEQ ID NO: 1736623 - DNA, 20 bp, Homo sapiens
tattgaaaattgaaaagtac

SEQ ID NO: 1736624 - DNA, 20 bp, Homo sapiens
tattgaaaggggacacctgt

SEQ ID NO: 1736625 - DNA, 18 bp, Homo sapiens
tattgaacttggaaagaa

SEQ ID NO: 1736626 - DNA, 14 bp, Homo sapiens
tattgaactttttt

SEQ ID NO: 1736627 - DNA, 14 bp, Homo sapiens
tattgaagacaatt

SEQ ID NO: 1736628 - DNA, 21 bp, Homo sapiens
tattgaagacaatttgataca

SEQ ID NO: 1736629 - DNA, 14 bp, Homo sapiens
tattgaatgttaaa

SEQ ID NO: 1736630 - DNA, 11 bp, Homo sapiens
tattgacactg

SEQ ID NO: 1736631 - DNA, 12 bp, Homo sapiens
tattgacactga

SEQ ID NO: 1736632 - DNA, 19 bp, Homo sapiens
tattgacactgaacttaat

SEQ ID NO: 1736633 - DNA, 24 bp, Homo sapiens
tattgacactgaacttaataactg

SEQ ID NO: 1736634 - DNA, 12 bp, Homo sapiens
tattgacagttg

SEQ ID NO: 1736635 - DNA, 22 bp, Homo sapiens
tattgaccatgtggttcacgta

SEQ ID NO: 1736636 - DNA, 22 bp, Homo sapiens
tattgactaacaggccaaagag

SEQ ID NO: 1736637 - DNA, 17 bp, Homo sapiens
tattgactcaaaccata

SEQ ID NO: 1736638 - DNA, 14 bp, Homo sapiens
tattgactgtcttt

SEQ ID NO: 1736639 - DNA, 15 bp, Homo sapiens
tattgacttttcaat

SEQ ID NO: 1736640 - DNA, 19 bp, Homo sapiens
tattgagaacctggcctgt

SEQ ID NO: 1736641 - DNA, 21 bp, Homo sapiens
tattgagatcagcattcaaaa

SEQ ID NO: 1736642 - DNA, 15 bp, Homo sapiens
tattgagatttctta

SEQ ID NO: 1736643 - DNA, 14 bp, Homo sapiens
tattgagttgttta

SEQ ID NO: 1736644 - DNA, 23 bp, Homo sapiens
tattgataagttcatacattgta

SEQ ID NO: 1736645 - DNA, 20 bp, Homo sapiens
tattgatatgcttatacact

SEQ ID NO: 1736646 - DNA, 14 bp, Homo sapiens
tattgatgcaatat

SEQ ID NO: 1736647 - DNA, 22 bp, Homo sapiens
tattgatgtacagtctgtcatg

SEQ ID NO: 1736648 - DNA, 15 bp, Homo sapiens
tattgatgttaacaa

SEQ ID NO: 1736649 - DNA, 14 bp, Homo sapiens
tattgattgggaaa

SEQ ID NO: 1736650 - DNA, 23 bp, Homo sapiens
tattgcaaaggttccaactgtat

SEQ ID NO: 1736651 - DNA, 15 bp, Homo sapiens
tattgcaactctttt

SEQ ID NO: 1736652 - DNA, 20 bp, Homo sapiens
tattgcaactcttttaagtg

SEQ ID NO: 1736653 - DNA, 18 bp, Homo sapiens
tattgcaataaagtataa

SEQ ID NO: 1736654 - DNA, 15 bp, Homo sapiens
tattgcagttataga

SEQ ID NO: 1736655 - DNA, 17 bp, Homo sapiens
tattgcatgcaatttga

SEQ ID NO: 1736656 - DNA, 14 bp, Homo sapiens
tattgcccccatgg

SEQ ID NO: 1736657 - DNA, 11 bp, Homo sapiens
tattgccttat

SEQ ID NO: 1736658 - DNA, 19 bp, Homo sapiens
tattgccttatttgtctgt

SEQ ID NO: 1736659 - DNA, 19 bp, Homo sapiens
tattgctcgcccagacacc

SEQ ID NO: 1736660 - DNA, 22 bp, Homo sapiens
tattgctcgcccagacaccatg

SEQ ID NO: 1736661 - DNA, 23 bp, Homo sapiens
tattgctcgcccagacaccatgt

SEQ ID NO: 1736662 - DNA, 13 bp, Homo sapiens
tattgctgctgcc

SEQ ID NO: 1736663 - DNA, 12 bp, Homo sapiens
tattgctgtgtc

SEQ ID NO: 1736664 - DNA, 12 bp, Homo sapiens
tattgcttattt

SEQ ID NO: 1736665 - DNA, 14 bp, Homo sapiens
tattggaaatgtga

SEQ ID NO: 1736666 - DNA, 18 bp, Homo sapiens
tattggaagtgttcaaga

SEQ ID NO: 1736667 - DNA, 11 bp, Homo sapiens
tattggccact

SEQ ID NO: 1736668 - DNA, 14 bp, Homo sapiens
tattggcctggagg

SEQ ID NO: 1736669 - DNA, 16 bp, Homo sapiens
tattgggccttttgga

SEQ ID NO: 1736670 - DNA, 20 bp, Homo sapiens
tattgtaaaactttggtgca

SEQ ID NO: 1736671 - DNA, 16 bp, Homo sapiens
tattgtaaatactgga

SEQ ID NO: 1736672 - DNA, 20 bp, Homo sapiens
tattgtacaaatgtaagcaa

SEQ ID NO: 1736673 - DNA, 21 bp, Homo sapiens
tattgtacaaatgtaagcaaa

SEQ ID NO: 1736674 - DNA, 11 bp, Homo sapiens
tattgtacata

SEQ ID NO: 1736675 - DNA, 17 bp, Homo sapiens
tattgtacataaaagaa

SEQ ID NO: 1736676 - DNA, 14 bp, Homo sapiens
tattgtacctctct

SEQ ID NO: 1736677 - DNA, 22 bp, Homo sapiens
tattgtagcagttacagctctg

SEQ ID NO: 1736678 - DNA, 16 bp, Homo sapiens
tattgtagcatttctt

SEQ ID NO: 1736679 - DNA, 14 bp, Homo sapiens
tattgtatgtaagt

SEQ ID NO: 1736680 - DNA, 16 bp, Homo sapiens
tattgtattaggaaaa

SEQ ID NO: 1736681 - DNA, 19 bp, Homo sapiens
tattgtcgctatgtgactt

SEQ ID NO: 1736682 - DNA, 23 bp, Homo sapiens
tattgtctgaacttgcattgtga

SEQ ID NO: 1736683 - DNA, 14 bp, Homo sapiens
tattgtctgtctac

SEQ ID NO: 1736684 - DNA, 15 bp, Homo sapiens
tattgtctgtctaca

SEQ ID NO: 1736685 - DNA, 13 bp, Homo sapiens
tattgtctgtctc

SEQ ID NO: 1736686 - DNA, 20 bp, Homo sapiens
tattgtgtaatttaagtgac

SEQ ID NO: 1736687 - DNA, 17 bp, Homo sapiens
tattgtgtgcgctgcct

SEQ ID NO: 1736688 - DNA, 14 bp, Homo sapiens
tattgtgttgtgaa

SEQ ID NO: 1736689 - DNA, 16 bp, Homo sapiens
tattgttaaacaaatg

SEQ ID NO: 1736690 - DNA, 19 bp, Homo sapiens
tattgttagggtcagccat

SEQ ID NO: 1736691 - DNA, 16 bp, Homo sapiens
tattgttatgttctcc

SEQ ID NO: 1736692 - DNA, 18 bp, Homo sapiens
tattgttcccctaagtgg

SEQ ID NO: 1736693 - DNA, 22 bp, Homo sapiens
tattgttcgatgcctgcatgct

SEQ ID NO: 1736694 - DNA, 19 bp, Homo sapiens
tattgttgacaactgtgac

SEQ ID NO: 1736695 - DNA, 20 bp, Homo sapiens
tattgttttcccaagtgtaa

SEQ ID NO: 1736696 - DNA, 14 bp, Homo sapiens
tattgttttctgta

SEQ ID NO: 1736697 - DNA, 15 bp, Homo sapiens
tattgttttctgtaa

SEQ ID NO: 1736698 - DNA, 22 bp, Homo sapiens
tattgttttctgtaaataacct

SEQ ID NO: 1736699 - DNA, 14 bp, Homo sapiens
tatttaaaaattgt

SEQ ID NO: 1736700 - DNA, 19 bp, Homo sapiens
tatttaaaaattgtttctt

SEQ ID NO: 1736701 - DNA, 21 bp, Homo sapiens
tatttaaaactgggtcatcat

SEQ ID NO: 1736702 - DNA, 13 bp, Homo sapiens
tatttaaaagatt

SEQ ID NO: 1736703 - DNA, 15 bp, Homo sapiens
tatttaaaagattca

SEQ ID NO: 1736704 - DNA, 16 bp, Homo sapiens
tatttaaaagattcat

SEQ ID NO: 1736705 - DNA, 16 bp, Homo sapiens
tatttaaaataaattc

SEQ ID NO: 1736706 - DNA, 15 bp, Homo sapiens
tatttaaaccttttt

SEQ ID NO: 1736707 - DNA, 12 bp, Homo sapiens
tatttaaagaca

SEQ ID NO: 1736708 - DNA, 13 bp, Homo sapiens
tatttaaagttgt

SEQ ID NO: 1736709 - DNA, 22 bp, Homo sapiens
tatttaaatattaaatatgtta

SEQ ID NO: 1736710 - DNA, 18 bp, Homo sapiens
tatttaacaactgggtca

SEQ ID NO: 1736711 - DNA, 22 bp, Homo sapiens
tatttaacaatgacaagatgtt

SEQ ID NO: 1736712 - DNA, 13 bp, Homo sapiens
tatttaacagaaa

SEQ ID NO: 1736713 - DNA, 19 bp, Homo sapiens
tatttaagaaaatacaata

SEQ ID NO: 1736714 - DNA, 22 bp, Homo sapiens
tatttaagaaaatacaataaac

SEQ ID NO: 1736715 - DNA, 14 bp, Homo sapiens
tatttaagatgtga

SEQ ID NO: 1736716 - DNA, 18 bp, Homo sapiens
tatttaagcctaaagatt

SEQ ID NO: 1736717 - DNA, 24 bp, Homo sapiens
tatttaagcctaaagattttgatc

SEQ ID NO: 1736718 - DNA, 16 bp, Homo sapiens
tatttaagcttatgtc

SEQ ID NO: 1736719 - DNA, 15 bp, Homo sapiens
tatttaaggatggat

SEQ ID NO: 1736720 - DNA, 21 bp, Homo sapiens
tatttaaggatggatggcacc

SEQ ID NO: 1736721 - DNA, 22 bp, Homo sapiens
tatttaaggatggatggcaccc

SEQ ID NO: 1736722 - DNA, 18 bp, Homo sapiens
tatttaaggtagcttcag

SEQ ID NO: 1736723 - DNA, 17 bp, Homo sapiens
tatttaagtatatagta

SEQ ID NO: 1736724 - DNA, 19 bp, Homo sapiens
tatttaagtatatagtata

SEQ ID NO: 1736725 - DNA, 22 bp, Homo sapiens
tatttaagtatatagtatattt

SEQ ID NO: 1736726 - DNA, 18 bp, Homo sapiens
tatttaagtgaaggagaa

SEQ ID NO: 1736727 - DNA, 15 bp, Homo sapiens
tatttaagttatcaa

SEQ ID NO: 1736728 - DNA, 20 bp, Homo sapiens
tatttaagttatcaacttta

SEQ ID NO: 1736729 - DNA, 16 bp, Homo sapiens
tatttaataatgcttt

SEQ ID NO: 1736730 - DNA, 23 bp, Homo sapiens
tatttaatacagctgaagtcaaa

SEQ ID NO: 1736731 - DNA, 14 bp, Homo sapiens
tatttaatatcaaa

SEQ ID NO: 1736732 - DNA, 17 bp, Homo sapiens
tatttaatggaagtgta

SEQ ID NO: 1736733 - DNA, 20 bp, Homo sapiens
tatttaatggaagtgtattt

SEQ ID NO: 1736734 - DNA, 12 bp, Homo sapiens
tatttaatgttg

SEQ ID NO: 1736735 - DNA, 13 bp, Homo sapiens
tatttaatgttga

SEQ ID NO: 1736736 - DNA, 14 bp, Homo sapiens
tatttaatgttgaa

SEQ ID NO: 1736737 - DNA, 15 bp, Homo sapiens
tatttaatgttgaac

SEQ ID NO: 1736738 - DNA, 18 bp, Homo sapiens
tatttaatgttgaacaaa

SEQ ID NO: 1736739 - DNA, 23 bp, Homo sapiens
tatttaatgttgaacaaaataaa

SEQ ID NO: 1736740 - DNA, 16 bp, Homo sapiens
tatttaattatgaaaa

SEQ ID NO: 1736741 - DNA, 15 bp, Homo sapiens
tatttacaaataaaa

SEQ ID NO: 1736742 - DNA, 15 bp, Homo sapiens
tatttacactggtct

SEQ ID NO: 1736743 - DNA, 20 bp, Homo sapiens
tatttacatgctactaaatt

SEQ ID NO: 1736744 - DNA, 14 bp, Homo sapiens
tatttacattttat

SEQ ID NO: 1736745 - DNA, 15 bp, Homo sapiens
tatttacattttata

SEQ ID NO: 1736746 - DNA, 17 bp, Homo sapiens
tatttactaactaaata

SEQ ID NO: 1736747 - DNA, 20 bp, Homo sapiens
tatttactctttctaacttt

SEQ ID NO: 1736748 - DNA, 22 bp, Homo sapiens
tatttactgagcttctctgtga

SEQ ID NO: 1736749 - DNA, 23 bp, Homo sapiens
tatttactttttcggtttcaaag

SEQ ID NO: 1736750 - DNA, 13 bp, Homo sapiens
tatttagacaaga

SEQ ID NO: 1736751 - DNA, 20 bp, Homo sapiens
tatttagacaagagatggga

SEQ ID NO: 1736752 - DNA, 20 bp, Homo sapiens
tatttagatctcctgtattc

SEQ ID NO: 1736753 - DNA, 17 bp, Homo sapiens
tatttagattgttaaaa

SEQ ID NO: 1736754 - DNA, 16 bp, Homo sapiens
tatttataaatatatt

SEQ ID NO: 1736755 - DNA, 17 bp, Homo sapiens
tatttataaatatattt

SEQ ID NO: 1736756 - DNA, 19 bp, Homo sapiens
tatttataaatatatttaa

SEQ ID NO: 1736757 - DNA, 19 bp, Homo sapiens
tatttataacaacctaaat

SEQ ID NO: 1736758 - DNA, 20 bp, Homo sapiens
tatttataacaacctaaatt

SEQ ID NO: 1736759 - DNA, 16 bp, Homo sapiens
tatttataatacagaa

SEQ ID NO: 1736760 - DNA, 22 bp, Homo sapiens
tatttataatagcaacttttgt

SEQ ID NO: 1736761 - DNA, 12 bp, Homo sapiens
tatttatactct

SEQ ID NO: 1736762 - DNA, 18 bp, Homo sapiens
tatttatagcaatccatg

SEQ ID NO: 1736763 - DNA, 23 bp, Homo sapiens
tatttatatatgtatttataaat

SEQ ID NO: 1736764 - DNA, 13 bp, Homo sapiens
tatttatatattt

SEQ ID NO: 1736765 - DNA, 17 bp, Homo sapiens
tatttatatatttataa

SEQ ID NO: 1736766 - DNA, 17 bp, Homo sapiens
tatttatatgtactgtt

SEQ ID NO: 1736767 - DNA, 15 bp, Homo sapiens
tatttatatttcact

SEQ ID NO: 1736768 - DNA, 13 bp, Homo sapiens
tatttatatttgg

SEQ ID NO: 1736769 - DNA, 14 bp, Homo sapiens
tatttatatttgga

SEQ ID NO: 1736770 - DNA, 20 bp, Homo sapiens
tatttatcaatttttcccag

SEQ ID NO: 1736771 - DNA, 20 bp, Homo sapiens
tatttatccagaaaactgtg

SEQ ID NO: 1736772 - DNA, 20 bp, Homo sapiens
tatttatcctagtattccta

SEQ ID NO: 1736773 - DNA, 22 bp, Homo sapiens
tatttatctccgcaggctattt

SEQ ID NO: 1736774 - DNA, 22 bp, Homo sapiens
tatttatctgtgtttttgaaat

SEQ ID NO: 1736775 - DNA, 12 bp, Homo sapiens
tatttatcttta

SEQ ID NO: 1736776 - DNA, 15 bp, Homo sapiens
tatttatgaagaaaa

SEQ ID NO: 1736777 - DNA, 20 bp, Homo sapiens
tatttatgcctctgtattta

SEQ ID NO: 1736778 - DNA, 15 bp, Homo sapiens
tatttatgtactttt

SEQ ID NO: 1736779 - DNA, 14 bp, Homo sapiens
tatttatgtgtgag

SEQ ID NO: 1736780 - DNA, 13 bp, Homo sapiens
tatttatgtttgc

SEQ ID NO: 1736781 - DNA, 18 bp, Homo sapiens
tatttattaaaaacatga

SEQ ID NO: 1736782 - DNA, 17 bp, Homo sapiens
tatttattaatatttaa

SEQ ID NO: 1736783 - DNA, 18 bp, Homo sapiens
tatttattaatatttaac

SEQ ID NO: 1736784 - DNA, 19 bp, Homo sapiens
tatttattaatatttaaca

SEQ ID NO: 1736785 - DNA, 15 bp, Homo sapiens
tatttattcactgta

SEQ ID NO: 1736786 - DNA, 14 bp, Homo sapiens
tatttattgcattg

SEQ ID NO: 1736787 - DNA, 20 bp, Homo sapiens
tatttattgcattgctggta

SEQ ID NO: 1736788 - DNA, 24 bp, Homo sapiens
tatttattgttagaaaatgactta

SEQ ID NO: 1736789 - DNA, 22 bp, Homo sapiens
tatttattgtttatttatcagt

SEQ ID NO: 1736790 - DNA, 13 bp, Homo sapiens
tatttatttaaaa

SEQ ID NO: 1736791 - DNA, 15 bp, Homo sapiens
tatttatttaaaaga

SEQ ID NO: 1736792 - DNA, 13 bp, Homo sapiens
tatttatttaatt

SEQ ID NO: 1736793 - DNA, 11 bp, Homo sapiens
tatttatttac

SEQ ID NO: 1736794 - DNA, 14 bp, Homo sapiens
tatttatttatgta

SEQ ID NO: 1736795 - DNA, 18 bp, Homo sapiens
tatttatttatgtacttt

SEQ ID NO: 1736796 - DNA, 14 bp, Homo sapiens
tatttatttattta

SEQ ID NO: 1736797 - DNA, 12 bp, Homo sapiens
tatttatttcta

SEQ ID NO: 1736798 - DNA, 20 bp, Homo sapiens
tatttcaaaatatacattca

SEQ ID NO: 1736799 - DNA, 13 bp, Homo sapiens
tatttcaaacatc

SEQ ID NO: 1736800 - DNA, 17 bp, Homo sapiens
tatttcaaacatcagct

SEQ ID NO: 1736801 - DNA, 22 bp, Homo sapiens
tatttcaaacatcagctgaatt

SEQ ID NO: 1736802 - DNA, 13 bp, Homo sapiens
tatttcacagagc

SEQ ID NO: 1736803 - DNA, 20 bp, Homo sapiens
tatttcactttagatgctga

SEQ ID NO: 1736804 - DNA, 12 bp, Homo sapiens
tatttcagaaat

SEQ ID NO: 1736805 - DNA, 13 bp, Homo sapiens
tatttcagaaata

SEQ ID NO: 1736806 - DNA, 23 bp, Homo sapiens
tatttcagaagtttaaatattaa

SEQ ID NO: 1736807 - DNA, 19 bp, Homo sapiens
tatttcagacattttcact

SEQ ID NO: 1736808 - DNA, 18 bp, Homo sapiens
tatttcagtggaatagat

SEQ ID NO: 1736809 - DNA, 20 bp, Homo sapiens
tatttcagtggaatagatgt

SEQ ID NO: 1736810 - DNA, 17 bp, Homo sapiens
tatttcagtgttttcat

SEQ ID NO: 1736811 - DNA, 15 bp, Homo sapiens
tatttcatattgaga

SEQ ID NO: 1736812 - DNA, 13 bp, Homo sapiens
tatttcatctttt

SEQ ID NO: 1736813 - DNA, 18 bp, Homo sapiens
tatttcatttattttttg

SEQ ID NO: 1736814 - DNA, 16 bp, Homo sapiens
tatttccaaaagcaca

SEQ ID NO: 1736815 - DNA, 21 bp, Homo sapiens
tatttccactattttcaaaga

SEQ ID NO: 1736816 - DNA, 13 bp, Homo sapiens
tatttccagtggt

SEQ ID NO: 1736817 - DNA, 21 bp, Homo sapiens
tatttcccatttgtgccagag

SEQ ID NO: 1736818 - DNA, 14 bp, Homo sapiens
tatttccccttgga

SEQ ID NO: 1736819 - DNA, 15 bp, Homo sapiens
tatttccccttggac

SEQ ID NO: 1736820 - DNA, 18 bp, Homo sapiens
tatttccctctcattttg

SEQ ID NO: 1736821 - DNA, 23 bp, Homo sapiens
tatttcctatattgttttcagtg

SEQ ID NO: 1736822 - DNA, 20 bp, Homo sapiens
tatttcctgaacctggaaat

SEQ ID NO: 1736823 - DNA, 11 bp, Homo sapiens
tatttcctgac

SEQ ID NO: 1736824 - DNA, 15 bp, Homo sapiens
tatttcctgacttga

SEQ ID NO: 1736825 - DNA, 16 bp, Homo sapiens
tatttcctgacttgag

SEQ ID NO: 1736826 - DNA, 15 bp, Homo sapiens
tatttccttaaactg

SEQ ID NO: 1736827 - DNA, 19 bp, Homo sapiens
tatttccttaaactgtgtg

SEQ ID NO: 1736828 - DNA, 11 bp, Homo sapiens
tatttccttta

SEQ ID NO: 1736829 - DNA, 16 bp, Homo sapiens
tatttcctttatgtga

SEQ ID NO: 1736830 - DNA, 17 bp, Homo sapiens
tatttctaagcttattt

SEQ ID NO: 1736831 - DNA, 20 bp, Homo sapiens
tatttctaagcttatttcta

SEQ ID NO: 1736832 - DNA, 20 bp, Homo sapiens
tatttctaatccttttcctt

SEQ ID NO: 1736833 - DNA, 16 bp, Homo sapiens
tatttctatgacaaat

SEQ ID NO: 1736834 - DNA, 15 bp, Homo sapiens
tatttctccatcttt

SEQ ID NO: 1736835 - DNA, 12 bp, Homo sapiens
tatttctgactc

SEQ ID NO: 1736836 - DNA, 16 bp, Homo sapiens
tatttctgagaaggtc

SEQ ID NO: 1736837 - DNA, 22 bp, Homo sapiens
tatttctgctcccctgttcaaa

SEQ ID NO: 1736838 - DNA, 13 bp, Homo sapiens
tatttctgtggag

SEQ ID NO: 1736839 - DNA, 14 bp, Homo sapiens
tatttctgtgtcca

SEQ ID NO: 1736840 - DNA, 15 bp, Homo sapiens
tatttctgtgtccag

SEQ ID NO: 1736841 - DNA, 13 bp, Homo sapiens
tatttctgttctt

SEQ ID NO: 1736842 - DNA, 16 bp, Homo sapiens
tatttcttcccagaat

SEQ ID NO: 1736843 - DNA, 22 bp, Homo sapiens
tatttcttcccagaatctctga

SEQ ID NO: 1736844 - DNA, 13 bp, Homo sapiens
tatttcttccctg

SEQ ID NO: 1736845 - DNA, 14 bp, Homo sapiens
tatttcttccctgc

SEQ ID NO: 1736846 - DNA, 12 bp, Homo sapiens
tatttcttttta

SEQ ID NO: 1736847 - DNA, 18 bp, Homo sapiens
tatttgaaaattttactt

SEQ ID NO: 1736848 - DNA, 14 bp, Homo sapiens
tatttgaaatagta

SEQ ID NO: 1736849 - DNA, 15 bp, Homo sapiens
tatttgaacaagtgg

SEQ ID NO: 1736850 - DNA, 23 bp, Homo sapiens
tatttgaacatgtgccttttctg

SEQ ID NO: 1736851 - DNA, 17 bp, Homo sapiens
tatttgaatatccattc

SEQ ID NO: 1736852 - DNA, 12 bp, Homo sapiens
tatttgaatttt

SEQ ID NO: 1736853 - DNA, 21 bp, Homo sapiens
tatttgacaacgtttcagcga

SEQ ID NO: 1736854 - DNA, 13 bp, Homo sapiens
tatttgacttgaa

SEQ ID NO: 1736855 - DNA, 13 bp, Homo sapiens
tatttgagagact

SEQ ID NO: 1736856 - DNA, 16 bp, Homo sapiens
tatttgagagttctaa

SEQ ID NO: 1736857 - DNA, 18 bp, Homo sapiens
tatttgagagttctaaat

SEQ ID NO: 1736858 - DNA, 19 bp, Homo sapiens
tatttgagagttctaaatt

SEQ ID NO: 1736859 - DNA, 15 bp, Homo sapiens
tatttgattatgtat

SEQ ID NO: 1736860 - DNA, 13 bp, Homo sapiens
tatttgatttata

SEQ ID NO: 1736861 - DNA, 20 bp, Homo sapiens
tatttgcactatttccacat

SEQ ID NO: 1736862 - DNA, 19 bp, Homo sapiens
tatttgcagtatgaactat

SEQ ID NO: 1736863 - DNA, 18 bp, Homo sapiens
tatttgcagttcacctgc

SEQ ID NO: 1736864 - DNA, 16 bp, Homo sapiens
tatttgcatgttacct

SEQ ID NO: 1736865 - DNA, 17 bp, Homo sapiens
tatttgcctgtctgttt

SEQ ID NO: 1736866 - DNA, 16 bp, Homo sapiens
tatttggaaataaagt

SEQ ID NO: 1736867 - DNA, 20 bp, Homo sapiens
tatttggagctatcagtgct

SEQ ID NO: 1736868 - DNA, 22 bp, Homo sapiens
tatttggagctatcagtgcttt

SEQ ID NO: 1736869 - DNA, 18 bp, Homo sapiens
tatttggagtggaggcat

SEQ ID NO: 1736870 - DNA, 18 bp, Homo sapiens
tatttggcataactgtga

SEQ ID NO: 1736871 - DNA, 15 bp, Homo sapiens
tatttggtccaaaaa

SEQ ID NO: 1736872 - DNA, 13 bp, Homo sapiens
tatttgtaaagct

SEQ ID NO: 1736873 - DNA, 14 bp, Homo sapiens
tatttgtaaagcta

SEQ ID NO: 1736874 - DNA, 14 bp, Homo sapiens
tatttgtaaagtga

SEQ ID NO: 1736875 - DNA, 15 bp, Homo sapiens
tatttgtaaagtgat

SEQ ID NO: 1736876 - DNA, 14 bp, Homo sapiens
tatttgtaattaaa

SEQ ID NO: 1736877 - DNA, 19 bp, Homo sapiens
tatttgtacaaataaacct

SEQ ID NO: 1736878 - DNA, 16 bp, Homo sapiens
tatttgtactttctgt

SEQ ID NO: 1736879 - DNA, 21 bp, Homo sapiens
tatttgtagctagaatatcct

SEQ ID NO: 1736880 - DNA, 17 bp, Homo sapiens
tatttgtctttaaacag

SEQ ID NO: 1736881 - DNA, 21 bp, Homo sapiens
tatttgttatatataataaat

SEQ ID NO: 1736882 - DNA, 22 bp, Homo sapiens
tatttgttatatataataaata

SEQ ID NO: 1736883 - DNA, 24 bp, Homo sapiens
tatttgttatatataataaatact

SEQ ID NO: 1736884 - DNA, 13 bp, Homo sapiens
tatttgttcatta

SEQ ID NO: 1736885 - DNA, 14 bp, Homo sapiens
tatttgttcattat

SEQ ID NO: 1736886 - DNA, 13 bp, Homo sapiens
tatttgtttccct

SEQ ID NO: 1736887 - DNA, 19 bp, Homo sapiens
tattttaaaatatatgaag

SEQ ID NO: 1736888 - DNA, 13 bp, Homo sapiens
tattttaaaattt

SEQ ID NO: 1736889 - DNA, 15 bp, Homo sapiens
tattttaaaatttca

SEQ ID NO: 1736890 - DNA, 13 bp, Homo sapiens
tattttaaatatc

SEQ ID NO: 1736891 - DNA, 20 bp, Homo sapiens
tattttaaatatccacagta

SEQ ID NO: 1736892 - DNA, 22 bp, Homo sapiens
tattttaaggttgcacacagta

SEQ ID NO: 1736893 - DNA, 13 bp, Homo sapiens
tattttaatagaa

SEQ ID NO: 1736894 - DNA, 20 bp, Homo sapiens
tattttaatagcctgtcata

SEQ ID NO: 1736895 - DNA, 16 bp, Homo sapiens
tattttaatattttgt

SEQ ID NO: 1736896 - DNA, 17 bp, Homo sapiens
tattttacacagaaaca

SEQ ID NO: 1736897 - DNA, 24 bp, Homo sapiens
tattttacacagaaacactgcctt

SEQ ID NO: 1736898 - DNA, 22 bp, Homo sapiens
tattttacatgaagctgtataa

SEQ ID NO: 1736899 - DNA, 12 bp, Homo sapiens
tattttactatt

SEQ ID NO: 1736900 - DNA, 17 bp, Homo sapiens
tattttataagaaaaac

SEQ ID NO: 1736901 - DNA, 23 bp, Homo sapiens
tattttataatgttgtatttaat

SEQ ID NO: 1736902 - DNA, 23 bp, Homo sapiens
tattttatatttaaaaattgttt

SEQ ID NO: 1736903 - DNA, 13 bp, Homo sapiens
tattttatcctgt

SEQ ID NO: 1736904 - DNA, 18 bp, Homo sapiens
tattttatgaacattgta

SEQ ID NO: 1736905 - DNA, 20 bp, Homo sapiens
tattttattaaattaattga

SEQ ID NO: 1736906 - DNA, 19 bp, Homo sapiens
tattttattaattttctat

SEQ ID NO: 1736907 - DNA, 21 bp, Homo sapiens
tattttattacatctttcaca

SEQ ID NO: 1736908 - DNA, 13 bp, Homo sapiens
tattttattatga

SEQ ID NO: 1736909 - DNA, 19 bp, Homo sapiens
tattttattccctttcaca

SEQ ID NO: 1736910 - DNA, 17 bp, Homo sapiens
tattttatttatttaat

SEQ ID NO: 1736911 - DNA, 13 bp, Homo sapiens
tattttcaaaata

SEQ ID NO: 1736912 - DNA, 12 bp, Homo sapiens
tattttcaaaga

SEQ ID NO: 1736913 - DNA, 16 bp, Homo sapiens
tattttcaagaaactg

SEQ ID NO: 1736914 - DNA, 20 bp, Homo sapiens
tattttctctgtacttttca

SEQ ID NO: 1736915 - DNA, 14 bp, Homo sapiens
tattttctgttcag

SEQ ID NO: 1736916 - DNA, 19 bp, Homo sapiens
tattttcttcatccaactt

SEQ ID NO: 1736917 - DNA, 14 bp, Homo sapiens
tattttctttgaaa

SEQ ID NO: 1736918 - DNA, 16 bp, Homo sapiens
tattttgaatgtgaag

SEQ ID NO: 1736919 - DNA, 21 bp, Homo sapiens
tattttgcactctgtaattgc

SEQ ID NO: 1736920 - DNA, 12 bp, Homo sapiens
tattttgctaac

SEQ ID NO: 1736921 - DNA, 14 bp, Homo sapiens
tattttgctaactg

SEQ ID NO: 1736922 - DNA, 16 bp, Homo sapiens
tattttgctaactggt

SEQ ID NO: 1736923 - DNA, 21 bp, Homo sapiens
tattttgctgagttgttctaa

SEQ ID NO: 1736924 - DNA, 21 bp, Homo sapiens
tattttggctcaaataaaatt

SEQ ID NO: 1736925 - DNA, 18 bp, Homo sapiens
tattttgggcctgttcct

SEQ ID NO: 1736926 - DNA, 19 bp, Homo sapiens
tattttgggcctgttcctt

SEQ ID NO: 1736927 - DNA, 20 bp, Homo sapiens
tattttgtaaactcaaaata

SEQ ID NO: 1736928 - DNA, 14 bp, Homo sapiens
tattttgtgtgaaa

SEQ ID NO: 1736929 - DNA, 16 bp, Homo sapiens
tattttgttgttcctc

SEQ ID NO: 1736930 - DNA, 18 bp, Homo sapiens
tatttttaacacttaaat

SEQ ID NO: 1736931 - DNA, 21 bp, Homo sapiens
tatttttatatttcctttatg

SEQ ID NO: 1736932 - DNA, 19 bp, Homo sapiens
tatttttatttctgactct

SEQ ID NO: 1736933 - DNA, 12 bp, Homo sapiens
tatttttatttg

SEQ ID NO: 1736934 - DNA, 14 bp, Homo sapiens
tatttttctaaggt

SEQ ID NO: 1736935 - DNA, 13 bp, Homo sapiens
tatttttctcttg

SEQ ID NO: 1736936 - DNA, 13 bp, Homo sapiens
tatttttctgtga

SEQ ID NO: 1736937 - DNA, 13 bp, Homo sapiens
tatttttcttact

SEQ ID NO: 1736938 - DNA, 12 bp, Homo sapiens
tatttttcttga

SEQ ID NO: 1736939 - DNA, 19 bp, Homo sapiens
tatttttgaacccctgtgt

SEQ ID NO: 1736940 - DNA, 22 bp, Homo sapiens
tatttttgaagtaaattaaaca

SEQ ID NO: 1736941 - DNA, 23 bp, Homo sapiens
tatttttgacagaatatgtttca

SEQ ID NO: 1736942 - DNA, 20 bp, Homo sapiens
tatttttggcagtctgaatt

SEQ ID NO: 1736943 - DNA, 15 bp, Homo sapiens
tatttttgtagcact

SEQ ID NO: 1736944 - DNA, 14 bp, Homo sapiens
tatttttgtagtga

SEQ ID NO: 1736945 - DNA, 18 bp, Homo sapiens
tatttttgtatttctcta

SEQ ID NO: 1736946 - DNA, 21 bp, Homo sapiens
tatttttgtgaagtattcaca

SEQ ID NO: 1736947 - DNA, 21 bp, Homo sapiens
tatttttgtgttttcttgtaa

SEQ ID NO: 1736948 - DNA, 18 bp, Homo sapiens
tattttttaaatcttgac

SEQ ID NO: 1736949 - DNA, 15 bp, Homo sapiens
tattttttaagtatt

SEQ ID NO: 1736950 - DNA, 12 bp, Homo sapiens
tattttttatga

SEQ ID NO: 1736951 - DNA, 23 bp, Homo sapiens
tattttttatgatggagcaactg

SEQ ID NO: 1736952 - DNA, 14 bp, Homo sapiens
tattttttcccaaa

SEQ ID NO: 1736953 - DNA, 11 bp, Homo sapiens
tattttttcct

SEQ ID NO: 1736954 - DNA, 15 bp, Homo sapiens
tattttttctacaca

SEQ ID NO: 1736955 - DNA, 15 bp, Homo sapiens
tattttttggacttc

SEQ ID NO: 1736956 - DNA, 14 bp, Homo sapiens
tattttttgtataa

SEQ ID NO: 1736957 - DNA, 18 bp, Homo sapiens
tatttttttaaagtgatt

SEQ ID NO: 1736958 - DNA, 20 bp, Homo sapiens
tatttttttaatttaacatg

SEQ ID NO: 1736959 - DNA, 17 bp, Homo sapiens
tattttttttaagtatt

SEQ ID NO: 1736960 - DNA, 20 bp, Homo sapiens
tattttttttggcctgtttg

SEQ ID NO: 1736961 - DNA, 19 bp, Homo sapiens
tattttttttttcttcttg

SEQ ID NO: 1736962 - DNA, 19 bp, Homo sapiens
tcaaaaaaaaaaaaagata

SEQ ID NO: 1736963 - DNA, 16 bp, Homo sapiens
tcaaaaaaaagaaaaa

SEQ ID NO: 1736964 - DNA, 20 bp, Homo sapiens
tcaaaaaactctctcccagg

SEQ ID NO: 1736965 - DNA, 15 bp, Homo sapiens
tcaaaaacattctta

SEQ ID NO: 1736966 - DNA, 16 bp, Homo sapiens
tcaaaaagcagaagga

SEQ ID NO: 1736967 - DNA, 13 bp, Homo sapiens
tcaaaaagcagag

SEQ ID NO: 1736968 - DNA, 18 bp, Homo sapiens
tcaaaaagccttattttt

SEQ ID NO: 1736969 - DNA, 19 bp, Homo sapiens
tcaaaaagctaatgtgcag

SEQ ID NO: 1736970 - DNA, 17 bp, Homo sapiens
tcaaaaagtaatgattt

SEQ ID NO: 1736971 - DNA, 12 bp, Homo sapiens
tcaaaaataaac

SEQ ID NO: 1736972 - DNA, 17 bp, Homo sapiens
tcaaaaataaactagtt

SEQ ID NO: 1736973 - DNA, 16 bp, Homo sapiens
tcaaaaatataactta

SEQ ID NO: 1736974 - DNA, 18 bp, Homo sapiens
tcaaaacaaaacaaaaca

SEQ ID NO: 1736975 - DNA, 16 bp, Homo sapiens
tcaaaacagagggctg

SEQ ID NO: 1736976 - DNA, 18 bp, Homo sapiens
tcaaaacctgcagttaac

SEQ ID NO: 1736977 - DNA, 14 bp, Homo sapiens
tcaaaacctggaga

SEQ ID NO: 1736978 - DNA, 21 bp, Homo sapiens
tcaaaacctggagatgcagct

SEQ ID NO: 1736979 - DNA, 21 bp, Homo sapiens
tcaaaacctgtgccaggctga

SEQ ID NO: 1736980 - DNA, 17 bp, Homo sapiens
tcaaaaccttccttccc

SEQ ID NO: 1736981 - DNA, 19 bp, Homo sapiens
tcaaaaccttccttccctg

SEQ ID NO: 1736982 - DNA, 18 bp, Homo sapiens
tcaaaactcatttcctat

SEQ ID NO: 1736983 - DNA, 13 bp, Homo sapiens
tcaaaactgcact

SEQ ID NO: 1736984 - DNA, 21 bp, Homo sapiens
tcaaaagaaaattgatatttt

SEQ ID NO: 1736985 - DNA, 20 bp, Homo sapiens
tttcctgagggttttctcat

SEQ ID NO: 1736986 - DNA, 23 bp, Homo sapiens
tttcctgatggggaagggacttt

SEQ ID NO: 1736987 - DNA, 13 bp, Homo sapiens
tttcctgcatgtt

SEQ ID NO: 1736988 - DNA, 11 bp, Homo sapiens
tttcctggaaa

SEQ ID NO: 1736989 - DNA, 12 bp, Homo sapiens
tttcctggaagc

SEQ ID NO: 1736990 - DNA, 19 bp, Homo sapiens
tttcctggaattgccagct

SEQ ID NO: 1736991 - DNA, 21 bp, Homo sapiens
tttcctggaatttttcccctt

SEQ ID NO: 1736992 - DNA, 16 bp, Homo sapiens
tttcctggacactcag

SEQ ID NO: 1736993 - DNA, 16 bp, Homo sapiens
tttcctggccctccac

SEQ ID NO: 1736994 - DNA, 12 bp, Homo sapiens
tttcctgggcct

SEQ ID NO: 1736995 - DNA, 21 bp, Homo sapiens
tttcctgtttgaaatatcatg

SEQ ID NO: 1736996 - DNA, 19 bp, Homo sapiens
tttccttaaattatctaaa

SEQ ID NO: 1736997 - DNA, 14 bp, Homo sapiens
tttccttccatccc

SEQ ID NO: 1736998 - DNA, 15 bp, Homo sapiens
tttccttcccaggcc

SEQ ID NO: 1736999 - DNA, 16 bp, Homo sapiens
tttccttccctctcct

SEQ ID NO: 1737000 - DNA, 18 bp, Homo sapiens
tttccttccttccctggc

SEQ ID NO: 1737001 - DNA, 16 bp, Homo sapiens
tttccttctaacatgt

SEQ ID NO: 1737002 - DNA, 23 bp, Homo sapiens
tttccttggctcccattcactct

SEQ ID NO: 1737003 - DNA, 13 bp, Homo sapiens
tttccttgtgcaa

SEQ ID NO: 1737004 - DNA, 21 bp, Homo sapiens
tttcctttaactgacaagcca

SEQ ID NO: 1737005 - DNA, 15 bp, Homo sapiens
tttcctttatgtgaa

SEQ ID NO: 1737006 - DNA, 19 bp, Homo sapiens
tttcctttgttgtctacat

SEQ ID NO: 1737007 - DNA, 13 bp, Homo sapiens
tttcctttttaat

SEQ ID NO: 1737008 - DNA, 22 bp, Homo sapiens
tttcctttttaatatgcttaaa

SEQ ID NO: 1737009 - DNA, 16 bp, Homo sapiens
tttcctttttcttcgc

SEQ ID NO: 1737010 - DNA, 16 bp, Homo sapiens
tttcctttttgacact

SEQ ID NO: 1737011 - DNA, 15 bp, Homo sapiens
tttccttttttgtct

SEQ ID NO: 1737012 - DNA, 17 bp, Homo sapiens
tttccttttttgttatt

SEQ ID NO: 1737013 - DNA, 14 bp, Homo sapiens
tttcgactggtcca

SEQ ID NO: 1737014 - DNA, 13 bp, Homo sapiens
tttcgctatggga

SEQ ID NO: 1737015 - DNA, 17 bp, Homo sapiens
tttcgtaatagctcaga

SEQ ID NO: 1737016 - DNA, 15 bp, Homo sapiens
tttcgtatgcactcc

SEQ ID NO: 1737017 - DNA, 18 bp, Homo sapiens
tttcgtatgcactccctt

SEQ ID NO: 1737018 - DNA, 13 bp, Homo sapiens
tttcgtcacgagc

SEQ ID NO: 1737019 - DNA, 13 bp, Homo sapiens
tttcgttaacatt

SEQ ID NO: 1737020 - DNA, 14 bp, Homo sapiens
tttcgttgttatta

SEQ ID NO: 1737021 - DNA, 14 bp, Homo sapiens
tttcgtttctgtat

SEQ ID NO: 1737022 - DNA, 13 bp, Homo sapiens
tttctaaaactat

SEQ ID NO: 1737023 - DNA, 16 bp, Homo sapiens
tttctaaaactgcctt

SEQ ID NO: 1737024 - DNA, 13 bp, Homo sapiens
tttctaaaagctt

SEQ ID NO: 1737025 - DNA, 21 bp, Homo sapiens
tttctaaaatcttatagttct

SEQ ID NO: 1737026 - DNA, 12 bp, Homo sapiens
tttctaaactgt

SEQ ID NO: 1737027 - DNA, 18 bp, Homo sapiens
tttctaaactgttttcat

SEQ ID NO: 1737028 - DNA, 20 bp, Homo sapiens
tttctaaataaaaatatgta

SEQ ID NO: 1737029 - DNA, 13 bp, Homo sapiens
tttctaaccttga

SEQ ID NO: 1737030 - DNA, 12 bp, Homo sapiens
tttgtttcctct

SEQ ID NO: 1737031 - DNA, 12 bp, Homo sapiens
tttgtttcttaa

SEQ ID NO: 1737032 - DNA, 18 bp, Homo sapiens
tttgtttgtattcatgtt

SEQ ID NO: 1737033 - DNA, 11 bp, Homo sapiens
tttgtttgttt

SEQ ID NO: 1737034 - DNA, 15 bp, Homo sapiens
tttgttttaatctta

SEQ ID NO: 1737035 - DNA, 22 bp, Homo sapiens
tttgttttaatcttagctttta

SEQ ID NO: 1737036 - DNA, 12 bp, Homo sapiens
tttgttttgctt

SEQ ID NO: 1737037 - DNA, 13 bp, Homo sapiens
tttgtttttaatt

SEQ ID NO: 1737038 - DNA, 16 bp, Homo sapiens
tttgtttttattttca

SEQ ID NO: 1737039 - DNA, 15 bp, Homo sapiens
tttgttttttaaaaa

SEQ ID NO: 1737040 - DNA, 13 bp, Homo sapiens
tttgttttttggt

SEQ ID NO: 1737041 - DNA, 17 bp, Homo sapiens
tttgttttttgtaacta

SEQ ID NO: 1737042 - DNA, 21 bp, Homo sapiens
tttgtttttttttttttggta

SEQ ID NO: 1737043 - DNA, 19 bp, Homo sapiens
ttttaaaaaaaaaaacaaa

SEQ ID NO: 1737044 - DNA, 15 bp, Homo sapiens
ttttaaaaaaatttg

SEQ ID NO: 1737045 - DNA, 21 bp, Homo sapiens
ttttaaaaaagggagtttttg

SEQ ID NO: 1737046 - DNA, 13 bp, Homo sapiens
ttttaaaaaccta

SEQ ID NO: 1737047 - DNA, 18 bp, Homo sapiens
ttttaaaaacctgtatct

SEQ ID NO: 1737048 - DNA, 15 bp, Homo sapiens
ttttaaaaactcctt

SEQ ID NO: 1737049 - DNA, 18 bp, Homo sapiens
ttttaaaaagagtaattt

SEQ ID NO: 1737050 - DNA, 23 bp, Homo sapiens
ttttaaaaatgtcctgcctttta

SEQ ID NO: 1737051 - DNA, 13 bp, Homo sapiens
ttttaaaaatgtt

SEQ ID NO: 1737052 - DNA, 13 bp, Homo sapiens
ttttaaaacacat

SEQ ID NO: 1737053 - DNA, 20 bp, Homo sapiens
ttttaaaactggacctgtat

SEQ ID NO: 1737054 - DNA, 13 bp, Homo sapiens
ttttaaaagcctt

SEQ ID NO: 1737055 - DNA, 14 bp, Homo sapiens
ttttaaaatagaaa

SEQ ID NO: 1737056 - DNA, 21 bp, Homo sapiens
ttttaaaatagaaattttgta

SEQ ID NO: 1737057 - DNA, 16 bp, Homo sapiens
ttttaaaatgcaatgt

SEQ ID NO: 1737058 - DNA, 15 bp, Homo sapiens
ttttaaaatgtacat

SEQ ID NO: 1737059 - DNA, 15 bp, Homo sapiens
ttttaaaatttcata

SEQ ID NO: 1737060 - DNA, 13 bp, Homo sapiens
ttttaaacagtga

SEQ ID NO: 1737061 - DNA, 13 bp, Homo sapiens
ttttaaactgtgt

SEQ ID NO: 1737062 - DNA, 23 bp, Homo sapiens
ttttaaactgtgtacataactga

SEQ ID NO: 1737063 - DNA, 14 bp, Homo sapiens
ttttaaacttgaaa

SEQ ID NO: 1737064 - DNA, 15 bp, Homo sapiens
ttttaaacttgaaat

SEQ ID NO: 1737065 - DNA, 16 bp, Homo sapiens
ttttaaacttgaaata

SEQ ID NO: 1737066 - DNA, 17 bp, Homo sapiens
ttttaaagaatgctctt

SEQ ID NO: 1737067 - DNA, 13 bp, Homo sapiens
ttttaaagacatg

SEQ ID NO: 1737068 - DNA, 18 bp, Homo sapiens
ttttaaagcaagtcacct

SEQ ID NO: 1737069 - DNA, 14 bp, Homo sapiens
ttttaaagccttct

SEQ ID NO: 1737070 - DNA, 19 bp, Homo sapiens
ttttaaaggcattagagtc

SEQ ID NO: 1737071 - DNA, 18 bp, Homo sapiens
ttttaaaggtggattttg

SEQ ID NO: 1737072 - DNA, 14 bp, Homo sapiens
ttttaaagtgatta

SEQ ID NO: 1737073 - DNA, 14 bp, Homo sapiens
ttttaaagtgcaaa

SEQ ID NO: 1737074 - DNA, 12 bp, Homo sapiens
ttttaaagttca

SEQ ID NO: 1737075 - DNA, 21 bp, Homo sapiens
ttttaaagttcttattttagt

SEQ ID NO: 1737076 - DNA, 21 bp, Homo sapiens
ttttaaagttttgtcagaaaa

SEQ ID NO: 1737077 - DNA, 19 bp, Homo sapiens
ttttaaataattgcatcag

SEQ ID NO: 1737078 - DNA, 16 bp, Homo sapiens
ttttaaatctgcttta

SEQ ID NO: 1737079 - DNA, 17 bp, Homo sapiens
ttttaaatgaagtgatt

SEQ ID NO: 1737080 - DNA, 14 bp, Homo sapiens
ttttaaatgacttg

SEQ ID NO: 1737081 - DNA, 20 bp, Homo sapiens
ttttaaattatactgtagct

SEQ ID NO: 1737082 - DNA, 18 bp, Homo sapiens
ttttaacaactgctctta

SEQ ID NO: 1737083 - DNA, 12 bp, Homo sapiens
ttttaacagcat

SEQ ID NO: 1737084 - DNA, 21 bp, Homo sapiens
ttttaacagcatgctgctttg

SEQ ID NO: 1737085 - DNA, 16 bp, Homo sapiens
ttttaacctaatatca

SEQ ID NO: 1737086 - DNA, 24 bp, Homo sapiens
ttttaactaaattttaaagccatt

SEQ ID NO: 1737087 - DNA, 12 bp, Homo sapiens
ttttaactagaa

SEQ ID NO: 1737088 - DNA, 14 bp, Homo sapiens
ttttaactgtggat

SEQ ID NO: 1737089 - DNA, 18 bp, Homo sapiens
ttttaactttaatacagc

SEQ ID NO: 1737090 - DNA, 16 bp, Homo sapiens
ttttaagaattgttta

SEQ ID NO: 1737091 - DNA, 19 bp, Homo sapiens
ttttaagagaaaactgcag

SEQ ID NO: 1737092 - DNA, 18 bp, Homo sapiens
ttttaagctaaaatgtta

SEQ ID NO: 1737093 - DNA, 12 bp, Homo sapiens
ttttaaggaaac

SEQ ID NO: 1737094 - DNA, 13 bp, Homo sapiens
ttttaaggtcttt

SEQ ID NO: 1737095 - DNA, 18 bp, Homo sapiens
ttttaaggtctttcagta

SEQ ID NO: 1737096 - DNA, 17 bp, Homo sapiens
ttttaagtgctttgtaa

SEQ ID NO: 1737097 - DNA, 12 bp, Homo sapiens
ttttaagttctt

SEQ ID NO: 1737098 - DNA, 15 bp, Homo sapiens
ttttaagttcttatg

SEQ ID NO: 1737099 - DNA, 23 bp, Homo sapiens
ttttaagttgtcaaagaagcttc

SEQ ID NO: 1737100 - DNA, 15 bp, Homo sapiens
ttttaataaaagatt

SEQ ID NO: 1737101 - DNA, 14 bp, Homo sapiens
ttttaataaacttt

SEQ ID NO: 1737102 - DNA, 15 bp, Homo sapiens
ttttaataaactttt

SEQ ID NO: 1737103 - DNA, 18 bp, Homo sapiens
ttttaatagaataaaata

SEQ ID NO: 1737104 - DNA, 14 bp, Homo sapiens
ttttaatataaatt

SEQ ID NO: 1737105 - DNA, 15 bp, Homo sapiens
ttttaatattttgta

SEQ ID NO: 1737106 - DNA, 16 bp, Homo sapiens
ttttaatcatgaaatt

SEQ ID NO: 1737107 - DNA, 20 bp, Homo sapiens
ttttaatcatgaaattactt

SEQ ID NO: 1737108 - DNA, 14 bp, Homo sapiens
ttttaatcttagct

SEQ ID NO: 1737109 - DNA, 23 bp, Homo sapiens
ttttaatgatctcggatgaccaa

SEQ ID NO: 1737110 - DNA, 14 bp, Homo sapiens
ttttaatggaaacc

SEQ ID NO: 1737111 - DNA, 13 bp, Homo sapiens
ttttaatggcatt

SEQ ID NO: 1737112 - DNA, 20 bp, Homo sapiens
ttttaatgggggtagcagct

SEQ ID NO: 1737113 - DNA, 14 bp, Homo sapiens
ttttaatgtatcta

SEQ ID NO: 1737114 - DNA, 12 bp, Homo sapiens
ttttaatgtgaa

SEQ ID NO: 1737115 - DNA, 18 bp, Homo sapiens
ttttaattattttaaaat

SEQ ID NO: 1737116 - DNA, 12 bp, Homo sapiens
ttttaattgtag

SEQ ID NO: 1737117 - DNA, 17 bp, Homo sapiens
ttttaatttaacatgaa

SEQ ID NO: 1737118 - DNA, 18 bp, Homo sapiens
ttttaatttacttgtttt

SEQ ID NO: 1737119 - DNA, 15 bp, Homo sapiens
ttttaatttatttgt

SEQ ID NO: 1737120 - DNA, 19 bp, Homo sapiens
ttttaatttatttgtttcc

SEQ ID NO: 1737121 - DNA, 15 bp, Homo sapiens
ttttaatttgatgaa

SEQ ID NO: 1737122 - DNA, 19 bp, Homo sapiens
ttttaatttgatgaaagct

SEQ ID NO: 1737123 - DNA, 15 bp, Homo sapiens
ttttacaagatgtat

SEQ ID NO: 1737124 - DNA, 18 bp, Homo sapiens
ttttacacagaaacactg

SEQ ID NO: 1737125 - DNA, 22 bp, Homo sapiens
ttttacacagaaacactgcctt

SEQ ID NO: 1737126 - DNA, 14 bp, Homo sapiens
ttttacacagcacc

SEQ ID NO: 1737127 - DNA, 15 bp, Homo sapiens
tttcatcttaaacta

SEQ ID NO: 1737128 - DNA, 15 bp, Homo sapiens
tttcatcttctggaa

SEQ ID NO: 1737129 - DNA, 13 bp, Homo sapiens
tttcatggacact

SEQ ID NO: 1737130 - DNA, 21 bp, Homo sapiens
tttcatgtagaactcagcagt

SEQ ID NO: 1737131 - DNA, 20 bp, Homo sapiens
tttcatgtgttgcaaattat

SEQ ID NO: 1737132 - DNA, 19 bp, Homo sapiens
tttcatgttcactgtgagt

SEQ ID NO: 1737133 - DNA, 15 bp, Homo sapiens
tttcatgtttttgat

SEQ ID NO: 1737134 - DNA, 16 bp, Homo sapiens
tttcattaaacttgaa

SEQ ID NO: 1737135 - DNA, 14 bp, Homo sapiens
tttcattaaataaa

SEQ ID NO: 1737136 - DNA, 14 bp, Homo sapiens
tttcattagataca

SEQ ID NO: 1737137 - DNA, 21 bp, Homo sapiens
tttcattattagtactgctct

SEQ ID NO: 1737138 - DNA, 14 bp, Homo sapiens
tttcattcaaatca

SEQ ID NO: 1737139 - DNA, 22 bp, Homo sapiens
tttcattgactatcaaactgaa

SEQ ID NO: 1737140 - DNA, 17 bp, Homo sapiens
tttcatttatctataat

SEQ ID NO: 1737141 - DNA, 20 bp, Homo sapiens
tttcatttatctataattta

SEQ ID NO: 1737142 - DNA, 15 bp, Homo sapiens
tttcattttgcttta

SEQ ID NO: 1737143 - DNA, 16 bp, Homo sapiens
tttcattttgctttaa

SEQ ID NO: 1737144 - DNA, 20 bp, Homo sapiens
tttcatttttttctctctgg

SEQ ID NO: 1737145 - DNA, 15 bp, Homo sapiens
tttccaaaacaaaaa

SEQ ID NO: 1737146 - DNA, 20 bp, Homo sapiens
tttccaaaacaatttctttt

SEQ ID NO: 1737147 - DNA, 12 bp, Homo sapiens
tttccaaaacat

SEQ ID NO: 1737148 - DNA, 17 bp, Homo sapiens
tttccaaacatccaaaa

SEQ ID NO: 1737149 - DNA, 17 bp, Homo sapiens
tttccaaataaacattt

SEQ ID NO: 1737150 - DNA, 15 bp, Homo sapiens
tttccaaattcacaa

SEQ ID NO: 1737151 - DNA, 13 bp, Homo sapiens
tttccaaattgcc

SEQ ID NO: 1737152 - DNA, 22 bp, Homo sapiens
tttccaacaaacttactgtcag

SEQ ID NO: 1737153 - DNA, 18 bp, Homo sapiens
tttccaactactaataga

SEQ ID NO: 1737154 - DNA, 16 bp, Homo sapiens
tttccaagaggctgta

SEQ ID NO: 1737155 - DNA, 23 bp, Homo sapiens
tttccaccaagggtatctgctgc

SEQ ID NO: 1737156 - DNA, 23 bp, Homo sapiens
tttccaccacagccagcacctgg

SEQ ID NO: 1737157 - DNA, 13 bp, Homo sapiens
tttccactactgc

SEQ ID NO: 1737158 - DNA, 20 bp, Homo sapiens
tttccactattttcaaagaa

SEQ ID NO: 1737159 - DNA, 16 bp, Homo sapiens
tttccactccattgtc

SEQ ID NO: 1737160 - DNA, 12 bp, Homo sapiens
tttccactgaac

SEQ ID NO: 1737161 - DNA, 13 bp, Homo sapiens
tttccactgaaca

SEQ ID NO: 1737162 - DNA, 20 bp, Homo sapiens
tttccactgaacaaaaccta

SEQ ID NO: 1737163 - DNA, 21 bp, Homo sapiens
tttccactggcttttgcctgt

SEQ ID NO: 1737164 - DNA, 17 bp, Homo sapiens
tttccagaccaataaat

SEQ ID NO: 1737165 - DNA, 18 bp, Homo sapiens
tttccagacttccttgag

SEQ ID NO: 1737166 - DNA, 17 bp, Homo sapiens
tttccagatttggggta

SEQ ID NO: 1737167 - DNA, 21 bp, Homo sapiens
tttccagctgccaagtgctct

SEQ ID NO: 1737168 - DNA, 17 bp, Homo sapiens
tttccagcttgcattga

SEQ ID NO: 1737169 - DNA, 14 bp, Homo sapiens
tttccaggaaaaaa

SEQ ID NO: 1737170 - DNA, 22 bp, Homo sapiens
tttccaggctggttcggatttg

SEQ ID NO: 1737171 - DNA, 13 bp, Homo sapiens
tttccagggaggg

SEQ ID NO: 1737172 - DNA, 15 bp, Homo sapiens
tttccagtacctttg

SEQ ID NO: 1737173 - DNA, 12 bp, Homo sapiens
tttccagtgcaa

SEQ ID NO: 1737174 - DNA, 19 bp, Homo sapiens
tttccatagcaacaggaaa

SEQ ID NO: 1737175 - DNA, 19 bp, Homo sapiens
tttggtaaaaatgctgctc

SEQ ID NO: 1737176 - DNA, 19 bp, Homo sapiens
tttggtaaacggtttttat

SEQ ID NO: 1737177 - DNA, 16 bp, Homo sapiens
tttggtaaatgtttct

SEQ ID NO: 1737178 - DNA, 21 bp, Homo sapiens
tttggtagctgggaaagcata

SEQ ID NO: 1737179 - DNA, 20 bp, Homo sapiens
tttggtaggtaaatctagag

SEQ ID NO: 1737180 - DNA, 21 bp, Homo sapiens
tttggtatgttgggataagga

SEQ ID NO: 1737181 - DNA, 12 bp, Homo sapiens
tttggtcaaatt

SEQ ID NO: 1737182 - DNA, 22 bp, Homo sapiens
tttggtcgaggagtaacaatac

SEQ ID NO: 1737183 - DNA, 15 bp, Homo sapiens
tttggtctccctggg

SEQ ID NO: 1737184 - DNA, 20 bp, Homo sapiens
tttggtctttaatgaaaagc

SEQ ID NO: 1737185 - DNA, 21 bp, Homo sapiens
tttggtctttttttgtattat

SEQ ID NO: 1737186 - DNA, 18 bp, Homo sapiens
tttggtgctggtctattt

SEQ ID NO: 1737187 - DNA, 13 bp, Homo sapiens
tttggtgttcctg

SEQ ID NO: 1737188 - DNA, 16 bp, Homo sapiens
tttggtgttcctggaa

SEQ ID NO: 1737189 - DNA, 18 bp, Homo sapiens
tttggtgttcctggaagc

SEQ ID NO: 1737190 - DNA, 19 bp, Homo sapiens
tttggtgttcctggaagca

SEQ ID NO: 1737191 - DNA, 20 bp, Homo sapiens
tttggttccttctctgggtc

SEQ ID NO: 1737192 - DNA, 13 bp, Homo sapiens
tttggttctaagg

SEQ ID NO: 1737193 - DNA, 14 bp, Homo sapiens
tttggtttcttcat

SEQ ID NO: 1737194 - DNA, 14 bp, Homo sapiens
tttggtttgacaat

SEQ ID NO: 1737195 - DNA, 22 bp, Homo sapiens
tttgtaaaaacagcattgcttt

SEQ ID NO: 1737196 - DNA, 14 bp, Homo sapiens
tttgtaaaaatctt

SEQ ID NO: 1737197 - DNA, 13 bp, Homo sapiens
tttgtaaaacaat

SEQ ID NO: 1737198 - DNA, 13 bp, Homo sapiens
tttgtaaaactgt

SEQ ID NO: 1737199 - DNA, 15 bp, Homo sapiens
tttgtaaagaaaaat

SEQ ID NO: 1737200 - DNA, 16 bp, Homo sapiens
tttgtaaagaaaaata

SEQ ID NO: 1737201 - DNA, 17 bp, Homo sapiens
tttgtaaagaaaaatat

SEQ ID NO: 1737202 - DNA, 17 bp, Homo sapiens
tttgtaaataagagatt

SEQ ID NO: 1737203 - DNA, 14 bp, Homo sapiens
tttgtaaataggat

SEQ ID NO: 1737204 - DNA, 18 bp, Homo sapiens
tttgtaaattatttatgt

SEQ ID NO: 1737205 - DNA, 10 bp, Homo sapiens
tttgtaacta

SEQ ID NO: 1737206 - DNA, 15 bp, Homo sapiens
tttgtaagacatttg

SEQ ID NO: 1737207 - DNA, 14 bp, Homo sapiens
tttgtaagatgctg

SEQ ID NO: 1737208 - DNA, 17 bp, Homo sapiens
tttgtaagtaacacagt

SEQ ID NO: 1737209 - DNA, 15 bp, Homo sapiens
tttgtaatattttcc

SEQ ID NO: 1737210 - DNA, 23 bp, Homo sapiens
tttgtaatgtcaccaccttccca

SEQ ID NO: 1737211 - DNA, 23 bp, Homo sapiens
tttgtaattaaaagcaaatcatt

SEQ ID NO: 1737212 - DNA, 14 bp, Homo sapiens
tttgtaattgtgta

SEQ ID NO: 1737213 - DNA, 13 bp, Homo sapiens
tttgtaatttaag

SEQ ID NO: 1737214 - DNA, 14 bp, Homo sapiens
tttgtacaaataaa

SEQ ID NO: 1737215 - DNA, 19 bp, Homo sapiens
tttgtacaaataaacctga

SEQ ID NO: 1737216 - DNA, 14 bp, Homo sapiens
tttgtacagagtgc

SEQ ID NO: 1737217 - DNA, 19 bp, Homo sapiens
tttgtacatagttatttat

SEQ ID NO: 1737218 - DNA, 21 bp, Homo sapiens
tttgtacattacactaaatta

SEQ ID NO: 1737219 - DNA, 23 bp, Homo sapiens
tttgtacattacactaaattatt

SEQ ID NO: 1737220 - DNA, 14 bp, Homo sapiens
tttgtacattgtgc

SEQ ID NO: 1737221 - DNA, 17 bp, Homo sapiens
tttgtaccatggtgtga

SEQ ID NO: 1737222 - DNA, 14 bp, Homo sapiens
tttgtactgaatct

SEQ ID NO: 1737223 - DNA, 12 bp, Homo sapiens
tttgtactttct

SEQ ID NO: 1737224 - DNA, 14 bp, Homo sapiens
tttgtacttttagt

SEQ ID NO: 1737225 - DNA, 19 bp, Homo sapiens
tttgtagcactgacagatt

SEQ ID NO: 1737226 - DNA, 16 bp, Homo sapiens
tttgtagtaaaagtgg

SEQ ID NO: 1737227 - DNA, 16 bp, Homo sapiens
tttgtataaaatctga

SEQ ID NO: 1737228 - DNA, 17 bp, Homo sapiens
tttgtatagtaaagtga

SEQ ID NO: 1737229 - DNA, 14 bp, Homo sapiens
tttgtatatcatga

SEQ ID NO: 1737230 - DNA, 23 bp, Homo sapiens
tttgtatatcatgaaacacttct

SEQ ID NO: 1737231 - DNA, 17 bp, Homo sapiens
tttgtatatctaagact

SEQ ID NO: 1737232 - DNA, 12 bp, Homo sapiens
tttgtatctttc

SEQ ID NO: 1737233 - DNA, 12 bp, Homo sapiens
tttgtatgaaat

SEQ ID NO: 1737234 - DNA, 13 bp, Homo sapiens
tttgtatgacagt

SEQ ID NO: 1737235 - DNA, 11 bp, Homo sapiens
tttgtatgaga

SEQ ID NO: 1737236 - DNA, 17 bp, Homo sapiens
tttgtattacatctaat

SEQ ID NO: 1737237 - DNA, 19 bp, Homo sapiens
tttgtattcaaatttgtgt

SEQ ID NO: 1737238 - DNA, 20 bp, Homo sapiens
tttgtattcatgttcatgtg

SEQ ID NO: 1737239 - DNA, 13 bp, Homo sapiens
tttgtattttaca

SEQ ID NO: 1737240 - DNA, 15 bp, Homo sapiens
tttgtattttcatga

SEQ ID NO: 1737241 - DNA, 21 bp, Homo sapiens
tttgtattttcatgaaaatac

SEQ ID NO: 1737242 - DNA, 15 bp, Homo sapiens
tttgtattttgtgat

SEQ ID NO: 1737243 - DNA, 14 bp, Homo sapiens
tttgtatttttagt

SEQ ID NO: 1737244 - DNA, 23 bp, Homo sapiens
tttgtatttttcatctttaagaa

SEQ ID NO: 1737245 - DNA, 14 bp, Homo sapiens
tttgtcaaactgta

SEQ ID NO: 1737246 - DNA, 15 bp, Homo sapiens
tttgtcactttttct

SEQ ID NO: 1737247 - DNA, 14 bp, Homo sapiens
tttgtcagacttta

SEQ ID NO: 1737248 - DNA, 12 bp, Homo sapiens
tttgtcattcag

SEQ ID NO: 1737249 - DNA, 15 bp, Homo sapiens
tttgtccatcagatt

SEQ ID NO: 1737250 - DNA, 20 bp, Homo sapiens
tttgtcccatttccttggag

SEQ ID NO: 1737251 - DNA, 24 bp, Homo sapiens
tttgtcccatttccttggaggcca

SEQ ID NO: 1737252 - DNA, 22 bp, Homo sapiens
tttgtcgagcatttcttctact

SEQ ID NO: 1737253 - DNA, 18 bp, Homo sapiens
tttgtctatgaagttgct

SEQ ID NO: 1737254 - DNA, 16 bp, Homo sapiens
tttgtctctgtcacat

SEQ ID NO: 1737255 - DNA, 14 bp, Homo sapiens
tttgtctgaacaaa

SEQ ID NO: 1737256 - DNA, 17 bp, Homo sapiens
tttgtctgtcttcatag

SEQ ID NO: 1737257 - DNA, 13 bp, Homo sapiens
tttgtcttgtact

SEQ ID NO: 1737258 - DNA, 15 bp, Homo sapiens
tttgtcttgtacttc

SEQ ID NO: 1737259 - DNA, 16 bp, Homo sapiens
tttgtcttgtacttct

SEQ ID NO: 1737260 - DNA, 21 bp, Homo sapiens
tttgtgaaacagttgctgtga

SEQ ID NO: 1737261 - DNA, 15 bp, Homo sapiens
tttgtgaactggaag

SEQ ID NO: 1737262 - DNA, 21 bp, Homo sapiens
tttgtgaactggaagaaagca

SEQ ID NO: 1737263 - DNA, 22 bp, Homo sapiens
tttgtgaattaggctgtaacta

SEQ ID NO: 1737264 - DNA, 12 bp, Homo sapiens
tttgtgagagcg

SEQ ID NO: 1737265 - DNA, 16 bp, Homo sapiens
tttgtgagttagcatg

SEQ ID NO: 1737266 - DNA, 19 bp, Homo sapiens
tttgtgatgaatctacatt

SEQ ID NO: 1737267 - DNA, 24 bp, Homo sapiens
tttgtgatgaatctacatttgttt

SEQ ID NO: 1737268 - DNA, 20 bp, Homo sapiens
tttgtgattcaatctgtaaa

SEQ ID NO: 1737269 - DNA, 11 bp, Homo sapiens
tttgtgcagaa

SEQ ID NO: 1737270 - DNA, 11 bp, Homo sapiens
tttgtgcattc

SEQ ID NO: 1737271 - DNA, 17 bp, Homo sapiens
tttgtgcattctttggt

SEQ ID NO: 1737272 - DNA, 13 bp, Homo sapiens
tttgtgccagccg

SEQ ID NO: 1737273 - DNA, 23 bp, Homo sapiens
tttgtgccttaaaaggagagaag

SEQ ID NO: 1737274 - DNA, 17 bp, Homo sapiens
tttgtgcctttggcctg

SEQ ID NO: 1737275 - DNA, 20 bp, Homo sapiens
tttgtgctagaaattttcaa

SEQ ID NO: 1737276 - DNA, 21 bp, Homo sapiens
tttgtgctcatttaagtttca

SEQ ID NO: 1737277 - DNA, 14 bp, Homo sapiens
tttgtggcaattaa

SEQ ID NO: 1737278 - DNA, 22 bp, Homo sapiens
tttgtggtacgacctttagatt

SEQ ID NO: 1737279 - DNA, 13 bp, Homo sapiens
tttgtggtgtctt

SEQ ID NO: 1737280 - DNA, 15 bp, Homo sapiens
tttgtggtttggaat

SEQ ID NO: 1737281 - DNA, 21 bp, Homo sapiens
tttgtgtaactcccagtgatg

SEQ ID NO: 1737282 - DNA, 16 bp, Homo sapiens
tttgtgtaatgaaaat

SEQ ID NO: 1737283 - DNA, 12 bp, Homo sapiens
tttgtgtatgta

SEQ ID NO: 1737284 - DNA, 12 bp, Homo sapiens
tttgtgtcctcc

SEQ ID NO: 1737285 - DNA, 16 bp, Homo sapiens
tttgtgtcgtcttgaa

SEQ ID NO: 1737286 - DNA, 15 bp, Homo sapiens
tttgtgtgagactta

SEQ ID NO: 1737287 - DNA, 22 bp, Homo sapiens
tttgtgtgatttcctaaacata

SEQ ID NO: 1737288 - DNA, 17 bp, Homo sapiens
tttgtgtgttgtctctt

SEQ ID NO: 1737289 - DNA, 18 bp, Homo sapiens
tttgtgtgttgtcttgaa

SEQ ID NO: 1737290 - DNA, 21 bp, Homo sapiens
tttgtgttgttggaaaaagtc

SEQ ID NO: 1737291 - DNA, 12 bp, Homo sapiens
tttgtgtttatt

SEQ ID NO: 1737292 - DNA, 22 bp, Homo sapiens
tttgttaaaattatcaatatct

SEQ ID NO: 1737293 - DNA, 20 bp, Homo sapiens
tttgaatctcataatttata

SEQ ID NO: 1737294 - DNA, 13 bp, Homo sapiens
tttgaatgcagaa

SEQ ID NO: 1737295 - DNA, 16 bp, Homo sapiens
tttgaatgcttcctga

SEQ ID NO: 1737296 - DNA, 14 bp, Homo sapiens
tttgaattcagtaa

SEQ ID NO: 1737297 - DNA, 16 bp, Homo sapiens
tttgaatttaaataaa

SEQ ID NO: 1737298 - DNA, 17 bp, Homo sapiens
tttgaattttaaatcta

SEQ ID NO: 1737299 - DNA, 15 bp, Homo sapiens
tttgaattttgtttt

SEQ ID NO: 1737300 - DNA, 17 bp, Homo sapiens
tttgacaaagtgcctca

SEQ ID NO: 1737301 - DNA, 13 bp, Homo sapiens
tttgacaattact

SEQ ID NO: 1737302 - DNA, 14 bp, Homo sapiens
tttgacaattttgt

SEQ ID NO: 1737303 - DNA, 15 bp, Homo sapiens
tttgacactatatct

SEQ ID NO: 1737304 - DNA, 18 bp, Homo sapiens
tttgacactgaaagtttt

SEQ ID NO: 1737305 - DNA, 19 bp, Homo sapiens
tttgacactgaaagttttg

SEQ ID NO: 1737306 - DNA, 15 bp, Homo sapiens
tttgacagactattt

SEQ ID NO: 1737307 - DNA, 18 bp, Homo sapiens
tttgacagactatttgct

SEQ ID NO: 1737308 - DNA, 18 bp, Homo sapiens
tttgacagtgttgaaaat

SEQ ID NO: 1737309 - DNA, 18 bp, Homo sapiens
tttgacagttattttgat

SEQ ID NO: 1737310 - DNA, 16 bp, Homo sapiens
tttgacatggaaatga

SEQ ID NO: 1737311 - DNA, 20 bp, Homo sapiens
tttgacatttggtggtactt

SEQ ID NO: 1737312 - DNA, 23 bp, Homo sapiens
tttgacctgttgggagtgaggat

SEQ ID NO: 1737313 - DNA, 21 bp, Homo sapiens
tttgacgtcactgatattttt

SEQ ID NO: 1737314 - DNA, 16 bp, Homo sapiens
tttgactaattttaca

SEQ ID NO: 1737315 - DNA, 21 bp, Homo sapiens
tttgactcagttccaggcctg

SEQ ID NO: 1737316 - DNA, 14 bp, Homo sapiens
tttgacttggaaaa

SEQ ID NO: 1737317 - DNA, 12 bp, Homo sapiens
tttgacttttct

SEQ ID NO: 1737318 - DNA, 15 bp, Homo sapiens
tttgacttttctgta

SEQ ID NO: 1737319 - DNA, 22 bp, Homo sapiens
tttgactttttttgtatgtgtg

SEQ ID NO: 1737320 - DNA, 17 bp, Homo sapiens
tttgagaaaaaggaaaa

SEQ ID NO: 1737321 - DNA, 13 bp, Homo sapiens
tttgagaaatgca

SEQ ID NO: 1737322 - DNA, 18 bp, Homo sapiens
tttgagaagttctcagaa

SEQ ID NO: 1737323 - DNA, 15 bp, Homo sapiens
tttgagaatacataa

SEQ ID NO: 1737324 - DNA, 14 bp, Homo sapiens
tttgagaatgtgat

SEQ ID NO: 1737325 - DNA, 19 bp, Homo sapiens
tttgagaccagcctgggca

SEQ ID NO: 1737326 - DNA, 23 bp, Homo sapiens
tttgagacgcaccatgtgggcac

SEQ ID NO: 1737327 - DNA, 16 bp, Homo sapiens
tttgagatctaaaaat

SEQ ID NO: 1737328 - DNA, 21 bp, Homo sapiens
tttgagatctaaaaataactg

SEQ ID NO: 1737329 - DNA, 20 bp, Homo sapiens
tttgcatgcatgcaaatgag

SEQ ID NO: 1737330 - DNA, 13 bp, Homo sapiens
tttgcattccaga

SEQ ID NO: 1737331 - DNA, 19 bp, Homo sapiens
tttgcatttaaaacagaca

SEQ ID NO: 1737332 - DNA, 13 bp, Homo sapiens
tttgcatttcaga

SEQ ID NO: 1737333 - DNA, 15 bp, Homo sapiens
tttgcatttcagaaa

SEQ ID NO: 1737334 - DNA, 21 bp, Homo sapiens
tttgcatttctcttcctaaat

SEQ ID NO: 1737335 - DNA, 13 bp, Homo sapiens
tttgccaataaag

SEQ ID NO: 1737336 - DNA, 23 bp, Homo sapiens
tttgccaataaagcttttggaag

SEQ ID NO: 1737337 - DNA, 13 bp, Homo sapiens
tttgccacagctt

SEQ ID NO: 1737338 - DNA, 13 bp, Homo sapiens
tttgccacataca

SEQ ID NO: 1737339 - DNA, 20 bp, Homo sapiens
tttgccactaattttagtat

SEQ ID NO: 1737340 - DNA, 18 bp, Homo sapiens
tttgccactttggcttct

SEQ ID NO: 1737341 - DNA, 20 bp, Homo sapiens
tttgccactttggcttctcc

SEQ ID NO: 1737342 - DNA, 16 bp, Homo sapiens
tttgccagtgaagact

SEQ ID NO: 1737343 - DNA, 19 bp, Homo sapiens
tttgccagttttccctgga

SEQ ID NO: 1737344 - DNA, 18 bp, Homo sapiens
tttgccatttttctataa

SEQ ID NO: 1737345 - DNA, 17 bp, Homo sapiens
tttgccccaagtcctca

SEQ ID NO: 1737346 - DNA, 16 bp, Homo sapiens
tttgcccctttcagta

SEQ ID NO: 1737347 - DNA, 19 bp, Homo sapiens
tttgcctaaatccaaagaa

SEQ ID NO: 1737348 - DNA, 10 bp, Homo sapiens
tttgcctcaa

SEQ ID NO: 1737349 - DNA, 21 bp, Homo sapiens
tttgcctcttctttgtgcctt

SEQ ID NO: 1737350 - DNA, 16 bp, Homo sapiens
tttgcctgaggctgta

SEQ ID NO: 1737351 - DNA, 13 bp, Homo sapiens
tttgcctgtaaga

SEQ ID NO: 1737352 - DNA, 14 bp, Homo sapiens
tttgcctgtaagaa

SEQ ID NO: 1737353 - DNA, 22 bp, Homo sapiens
tttgccttctactccccttaat

SEQ ID NO: 1737354 - DNA, 12 bp, Homo sapiens
tttgccttctct

SEQ ID NO: 1737355 - DNA, 16 bp, Homo sapiens
tttgcgaaaagataaa

SEQ ID NO: 1737356 - DNA, 17 bp, Homo sapiens
tttgcgctggtggacca

SEQ ID NO: 1737357 - DNA, 21 bp, Homo sapiens
tttgctaactgggttaaatat

SEQ ID NO: 1737358 - DNA, 13 bp, Homo sapiens
tttgctaactggt

SEQ ID NO: 1737359 - DNA, 16 bp, Homo sapiens
tttgctaactggttaa

SEQ ID NO: 1737360 - DNA, 14 bp, Homo sapiens
tttgctaattttta

SEQ ID NO: 1737361 - DNA, 18 bp, Homo sapiens
tttgctacaaatttatgc

SEQ ID NO: 1737362 - DNA, 22 bp, Homo sapiens
tttgctacaaatttatgcattt

SEQ ID NO: 1737363 - DNA, 17 bp, Homo sapiens
tttgctacgattccact

SEQ ID NO: 1737364 - DNA, 19 bp, Homo sapiens
tttgctagactctagacaa

SEQ ID NO: 1737365 - DNA, 15 bp, Homo sapiens
tttgctagcagtaaa

SEQ ID NO: 1737366 - DNA, 14 bp, Homo sapiens
tttgctaggagccc

SEQ ID NO: 1737367 - DNA, 23 bp, Homo sapiens
tttgctagttggagtgcttgttt

SEQ ID NO: 1737368 - DNA, 20 bp, Homo sapiens
tttgctataatcattagttt

SEQ ID NO: 1737369 - DNA, 13 bp, Homo sapiens
tttgctattgaca

SEQ ID NO: 1737370 - DNA, 20 bp, Homo sapiens
tttgctattgacaagtcatt

SEQ ID NO: 1737371 - DNA, 23 bp, Homo sapiens
tttgctccagataactctctttc

SEQ ID NO: 1737372 - DNA, 14 bp, Homo sapiens
tttgctccgaagct

SEQ ID NO: 1737373 - DNA, 22 bp, Homo sapiens
tttgctctctgtgaccctaaga

SEQ ID NO: 1737374 - DNA, 21 bp, Homo sapiens
tttgctctgaccgattccttt

SEQ ID NO: 1737375 - DNA, 21 bp, Homo sapiens
tttgctctggaggaagttctc

SEQ ID NO: 1737376 - DNA, 13 bp, Homo sapiens
tttgctcttcaga

SEQ ID NO: 1737377 - DNA, 12 bp, Homo sapiens
tttgctcttgcc

SEQ ID NO: 1737378 - DNA, 23 bp, Homo sapiens
tttgctcttgtttttattaattt

SEQ ID NO: 1737379 - DNA, 19 bp, Homo sapiens
tttgctgagcatgtactga

SEQ ID NO: 1737380 - DNA, 14 bp, Homo sapiens
tttgctgagttgtt

SEQ ID NO: 1737381 - DNA, 15 bp, Homo sapiens
tttgctgcacaaaca

SEQ ID NO: 1737382 - DNA, 16 bp, Homo sapiens
tttgctgctatgaaaa

SEQ ID NO: 1737383 - DNA, 15 bp, Homo sapiens
tttgctggaataagt

SEQ ID NO: 1737384 - DNA, 14 bp, Homo sapiens
tttgctgtactctt

SEQ ID NO: 1737385 - DNA, 18 bp, Homo sapiens
tttgctgtactcttgctg

SEQ ID NO: 1737386 - DNA, 21 bp, Homo sapiens
tttgctgtgaggctgtcctgt

SEQ ID NO: 1737387 - DNA, 21 bp, Homo sapiens
tttgctgttttaaacattaat

SEQ ID NO: 1737388 - DNA, 16 bp, Homo sapiens
tttgcttagaaaagaa

SEQ ID NO: 1737389 - DNA, 19 bp, Homo sapiens
tttgcttgctcatatgcat

SEQ ID NO: 1737390 - DNA, 18 bp, Homo sapiens
tttgcttgtactgggaca

SEQ ID NO: 1737391 - DNA, 15 bp, Homo sapiens
tttgctttaatgaga

SEQ ID NO: 1737392 - DNA, 15 bp, Homo sapiens
tttgctttcctctga

SEQ ID NO: 1737393 - DNA, 19 bp, Homo sapiens
tttgctttcggtactgtaa

SEQ ID NO: 1737394 - DNA, 12 bp, Homo sapiens
tttgctttctgt

SEQ ID NO: 1737395 - DNA, 14 bp, Homo sapiens
tttgctttttgcta

SEQ ID NO: 1737396 - DNA, 10 bp, Homo sapiens
tttggaaata

SEQ ID NO: 1737397 - DNA, 23 bp, Homo sapiens
tttggaacaagatggttctagca

SEQ ID NO: 1737398 - DNA, 21 bp, Homo sapiens
tttggaacagtgctactgaaa

SEQ ID NO: 1737399 - DNA, 18 bp, Homo sapiens
tttggaaccctaaataat

SEQ ID NO: 1737400 - DNA, 11 bp, Homo sapiens
tttggaaggag

SEQ ID NO: 1737401 - DNA, 13 bp, Homo sapiens
tttggaagttaaa

SEQ ID NO: 1737402 - DNA, 18 bp, Homo sapiens
tttggaagtttgtgttct

SEQ ID NO: 1737403 - DNA, 20 bp, Homo sapiens
tttggaataatttctattaa

SEQ ID NO: 1737404 - DNA, 16 bp, Homo sapiens
tttggaatacatttct

SEQ ID NO: 1737405 - DNA, 11 bp, Homo sapiens
tttggaatgtg

SEQ ID NO: 1737406 - DNA, 18 bp, Homo sapiens
tttggacatggaaagaaa

SEQ ID NO: 1737407 - DNA, 16 bp, Homo sapiens
tttggaccccagctgg

SEQ ID NO: 1737408 - DNA, 17 bp, Homo sapiens
tttggaccccagctggg

SEQ ID NO: 1737409 - DNA, 16 bp, Homo sapiens
tttggactgttttgtt

SEQ ID NO: 1737410 - DNA, 22 bp, Homo sapiens
tttggagaacgccagtctccca

SEQ ID NO: 1737411 - DNA, 20 bp, Homo sapiens
tttggagagggggcctggga

SEQ ID NO: 1737412 - DNA, 20 bp, Homo sapiens
tttggagcacaaaattcaaa

SEQ ID NO: 1737413 - DNA, 22 bp, Homo sapiens
tttggaggctggagtaatcaga

SEQ ID NO: 1737414 - DNA, 22 bp, Homo sapiens
tttggatctgtgacacatcgtt

SEQ ID NO: 1737415 - DNA, 23 bp, Homo sapiens
tttggatggggctggcatgtttt

SEQ ID NO: 1737416 - DNA, 14 bp, Homo sapiens
tttggatggtttgt

SEQ ID NO: 1737417 - DNA, 15 bp, Homo sapiens
tttggcaacatcttg

SEQ ID NO: 1737418 - DNA, 11 bp, Homo sapiens
tttggcactgg

SEQ ID NO: 1737419 - DNA, 13 bp, Homo sapiens
tttggcacttgta

SEQ ID NO: 1737420 - DNA, 14 bp, Homo sapiens
tttggccacaaaac

SEQ ID NO: 1737421 - DNA, 16 bp, Homo sapiens
tttggccctggagcca

SEQ ID NO: 1737422 - DNA, 22 bp, Homo sapiens
tttggcctgtttgatgtatgtg

SEQ ID NO: 1737423 - DNA, 12 bp, Homo sapiens
tttggccttaag

SEQ ID NO: 1737424 - DNA, 19 bp, Homo sapiens
tttggccttaagaactgtg

SEQ ID NO: 1737425 - DNA, 13 bp, Homo sapiens
tttggctagagtt

SEQ ID NO: 1737426 - DNA, 20 bp, Homo sapiens
tttggctgaaattctcctgg

SEQ ID NO: 1737427 - DNA, 23 bp, Homo sapiens
tttgggaaagatggataaactga

SEQ ID NO: 1737428 - DNA, 24 bp, Homo sapiens
tttgggaaagatggataaactgag

SEQ ID NO: 1737429 - DNA, 20 bp, Homo sapiens
tttgggaagcaacaaagagc

SEQ ID NO: 1737430 - DNA, 21 bp, Homo sapiens
tttgggaagttaaagggaaga

SEQ ID NO: 1737431 - DNA, 14 bp, Homo sapiens
tttgggagagactt

SEQ ID NO: 1737432 - DNA, 15 bp, Homo sapiens
tttgggagctctgct

SEQ ID NO: 1737433 - DNA, 23 bp, Homo sapiens
tttgggagctgaaccaaagcctc

SEQ ID NO: 1737434 - DNA, 14 bp, Homo sapiens
tttgggctgccctg

SEQ ID NO: 1737435 - DNA, 14 bp, Homo sapiens
tttgggcttgacac

SEQ ID NO: 1737436 - DNA, 13 bp, Homo sapiens
tttggggactcag

SEQ ID NO: 1737437 - DNA, 22 bp, Homo sapiens
tttggggactcaggaccagatg

SEQ ID NO: 1737438 - DNA, 20 bp, Homo sapiens
tttggggagcagagacacta

SEQ ID NO: 1737439 - DNA, 19 bp, Homo sapiens
tttggggagggggaagaga

SEQ ID NO: 1737440 - DNA, 20 bp, Homo sapiens
tttggggagggggaagagaa

SEQ ID NO: 1737441 - DNA, 22 bp, Homo sapiens
tttgggggaaacgggctccttc

SEQ ID NO: 1737442 - DNA, 22 bp, Homo sapiens
tttgggggcgccctctctgctc

SEQ ID NO: 1737443 - DNA, 21 bp, Homo sapiens
tttggggtataggtctcatct

SEQ ID NO: 1737444 - DNA, 20 bp, Homo sapiens
tttgggtggctcactactga

SEQ ID NO: 1737445 - DNA, 15 bp, Homo sapiens
tttgggttctgcctg

SEQ ID NO: 1737446 - DNA, 17 bp, Homo sapiens
tttcaagaacctggaaa

SEQ ID NO: 1737447 - DNA, 23 bp, Homo sapiens
tttcaagaataatcacgctttcc

SEQ ID NO: 1737448 - DNA, 18 bp, Homo sapiens
tttcaagacccctgtctt

SEQ ID NO: 1737449 - DNA, 18 bp, Homo sapiens
tttcaagactgaattcca

SEQ ID NO: 1737450 - DNA, 17 bp, Homo sapiens
tttcaagattctaaagc

SEQ ID NO: 1737451 - DNA, 20 bp, Homo sapiens
tttcaagcagcatcttctgg

SEQ ID NO: 1737452 - DNA, 22 bp, Homo sapiens
tttcaagcctgcctaggaattc

SEQ ID NO: 1737453 - DNA, 14 bp, Homo sapiens
tttcaagctgcact

SEQ ID NO: 1737454 - DNA, 19 bp, Homo sapiens
tttcaagctggaagaagtg

SEQ ID NO: 1737455 - DNA, 18 bp, Homo sapiens
tttcaaggcactctagat

SEQ ID NO: 1737456 - DNA, 18 bp, Homo sapiens
tttcaaggccctcagcat

SEQ ID NO: 1737457 - DNA, 17 bp, Homo sapiens
tttcaaggccttcagtt

SEQ ID NO: 1737458 - DNA, 16 bp, Homo sapiens
tttcaaggttctaacc

SEQ ID NO: 1737459 - DNA, 15 bp, Homo sapiens
tttcaagtatttaag

SEQ ID NO: 1737460 - DNA, 16 bp, Homo sapiens
tttcaagtatttaagc

SEQ ID NO: 1737461 - DNA, 14 bp, Homo sapiens
tttcaagttattca

SEQ ID NO: 1737462 - DNA, 17 bp, Homo sapiens
tttcaagttattcaaat

SEQ ID NO: 1737463 - DNA, 17 bp, Homo sapiens
tttcaagttttaaagtt

SEQ ID NO: 1737464 - DNA, 22 bp, Homo sapiens
tttcaataaattgttttttaat

SEQ ID NO: 1737465 - DNA, 17 bp, Homo sapiens
tttcaatacccttttaa

SEQ ID NO: 1737466 - DNA, 14 bp, Homo sapiens
tttcaatatattga

SEQ ID NO: 1737467 - DNA, 15 bp, Homo sapiens
tttcaatccattttt

SEQ ID NO: 1737468 - DNA, 21 bp, Homo sapiens
tttcaatcttttaaattgcaa

SEQ ID NO: 1737469 - DNA, 13 bp, Homo sapiens
tttcacaacattt

SEQ ID NO: 1737470 - DNA, 21 bp, Homo sapiens
tttcacaatcttggggctgat

SEQ ID NO: 1737471 - DNA, 15 bp, Homo sapiens
tttcacaatgtgaaa

SEQ ID NO: 1737472 - DNA, 21 bp, Homo sapiens
tttcacaatgtgaaactgaag

SEQ ID NO: 1737473 - DNA, 23 bp, Homo sapiens
tttcacacatctgggtgccctga

SEQ ID NO: 1737474 - DNA, 19 bp, Homo sapiens
tttcacactggtaaatgtt

SEQ ID NO: 1737475 - DNA, 21 bp, Homo sapiens
tttcacagagtgtgctgctat

SEQ ID NO: 1737476 - DNA, 22 bp, Homo sapiens
tttcacagcctttcgttctgct

SEQ ID NO: 1737477 - DNA, 18 bp, Homo sapiens
tttcacaggcatcaggaa

SEQ ID NO: 1737478 - DNA, 14 bp, Homo sapiens
tttcacagtgaagt

SEQ ID NO: 1737479 - DNA, 16 bp, Homo sapiens
tttcacagtgaagtgc

SEQ ID NO: 1737480 - DNA, 13 bp, Homo sapiens
tttcacagttttt

SEQ ID NO: 1737481 - DNA, 14 bp, Homo sapiens
tttcacatagatgt

SEQ ID NO: 1737482 - DNA, 16 bp, Homo sapiens
tttcacatagctgtct

SEQ ID NO: 1737483 - DNA, 18 bp, Homo sapiens
tttcacatatttgtagct

SEQ ID NO: 1737484 - DNA, 14 bp, Homo sapiens
tttcacatgccttg

SEQ ID NO: 1737485 - DNA, 15 bp, Homo sapiens
tttcacatgccttgc

SEQ ID NO: 1737486 - DNA, 13 bp, Homo sapiens
tttcaccagcagc

SEQ ID NO: 1737487 - DNA, 13 bp, Homo sapiens
tttcacccctccc

SEQ ID NO: 1737488 - DNA, 14 bp, Homo sapiens
tttcacccctccct

SEQ ID NO: 1737489 - DNA, 16 bp, Homo sapiens
tttcaccctcatgaaa

SEQ ID NO: 1737490 - DNA, 17 bp, Homo sapiens
tttcaccctcatgaaaa

SEQ ID NO: 1737491 - DNA, 20 bp, Homo sapiens
tttcaccgtgttagccagga

SEQ ID NO: 1737492 - DNA, 17 bp, Homo sapiens
tttcacctgtaaacctg

SEQ ID NO: 1737493 - DNA, 18 bp, Homo sapiens
tttcacctgtaaacctga

SEQ ID NO: 1737494 - DNA, 22 bp, Homo sapiens
tttcacctgtttttaagctgtt

SEQ ID NO: 1737495 - DNA, 23 bp, Homo sapiens
tttcacctgtttttaagctgttt

SEQ ID NO: 1737496 - DNA, 18 bp, Homo sapiens
tttcaccttttcaggaaa

SEQ ID NO: 1737497 - DNA, 21 bp, Homo sapiens
tttataactcatcataaaata

SEQ ID NO: 1737498 - DNA, 18 bp, Homo sapiens
tttataagaaaaactttt

SEQ ID NO: 1737499 - DNA, 18 bp, Homo sapiens
tttataagaattttgctt

SEQ ID NO: 1737500 - DNA, 19 bp, Homo sapiens
tttataagtcattgtatgt

SEQ ID NO: 1737501 - DNA, 13 bp, Homo sapiens
tttataagttttt

SEQ ID NO: 1737502 - DNA, 21 bp, Homo sapiens
tttataatacagaatcttgtt

SEQ ID NO: 1737503 - DNA, 19 bp, Homo sapiens
tttataataggaatttgta

SEQ ID NO: 1737504 - DNA, 20 bp, Homo sapiens
tttataataggaatttgtat

SEQ ID NO: 1737505 - DNA, 15 bp, Homo sapiens
tttataatgttgtat

SEQ ID NO: 1737506 - DNA, 17 bp, Homo sapiens
tttataattctcattaa

SEQ ID NO: 1737507 - DNA, 20 bp, Homo sapiens
tttataattgtacaaaatta

SEQ ID NO: 1737508 - DNA, 21 bp, Homo sapiens
tttataatttaataaaaagga

SEQ ID NO: 1737509 - DNA, 13 bp, Homo sapiens
tttatacaaaata

SEQ ID NO: 1737510 - DNA, 12 bp, Homo sapiens
tttatacagctg

SEQ ID NO: 1737511 - DNA, 14 bp, Homo sapiens
tttatacagctgta

SEQ ID NO: 1737512 - DNA, 13 bp, Homo sapiens
tttatacagtgta

SEQ ID NO: 1737513 - DNA, 16 bp, Homo sapiens
tttatacagtgtacat

SEQ ID NO: 1737514 - DNA, 17 bp, Homo sapiens
tttatacagtgtacatg

SEQ ID NO: 1737515 - DNA, 16 bp, Homo sapiens
tttataccattcagat

SEQ ID NO: 1737516 - DNA, 16 bp, Homo sapiens
tttatacctgtttaaa

SEQ ID NO: 1737517 - DNA, 19 bp, Homo sapiens
tttatactccatacataac

SEQ ID NO: 1737518 - DNA, 16 bp, Homo sapiens
tttatagaacagttga

SEQ ID NO: 1737519 - DNA, 19 bp, Homo sapiens
tttatagaaggaatttgta

SEQ ID NO: 1737520 - DNA, 22 bp, Homo sapiens
tttatagaaggaatttgtactt

SEQ ID NO: 1737521 - DNA, 23 bp, Homo sapiens
tttatagaaggaatttgtacttc

SEQ ID NO: 1737522 - DNA, 19 bp, Homo sapiens
tttatagagataagataaa

SEQ ID NO: 1737523 - DNA, 13 bp, Homo sapiens
tttataggtttta

SEQ ID NO: 1737524 - DNA, 17 bp, Homo sapiens
tttatatactgctattt

SEQ ID NO: 1737525 - DNA, 12 bp, Homo sapiens
tttatatattta

SEQ ID NO: 1737526 - DNA, 13 bp, Homo sapiens
tttatatatttat

SEQ ID NO: 1737527 - DNA, 21 bp, Homo sapiens
tttatatctcctttgtattct

SEQ ID NO: 1737528 - DNA, 16 bp, Homo sapiens
tttatatctgtaaatt

SEQ ID NO: 1737529 - DNA, 18 bp, Homo sapiens
tttatatggggaatatat

SEQ ID NO: 1737530 - DNA, 14 bp, Homo sapiens
tttatatgtactgt

SEQ ID NO: 1737531 - DNA, 13 bp, Homo sapiens
tttatatgttgta

SEQ ID NO: 1737532 - DNA, 16 bp, Homo sapiens
tttatattaatgtact

SEQ ID NO: 1737533 - DNA, 21 bp, Homo sapiens
tttatattgcagattgaatat

SEQ ID NO: 1737534 - DNA, 14 bp, Homo sapiens
tttatattgtagca

SEQ ID NO: 1737535 - DNA, 19 bp, Homo sapiens
tttatatttaaaaattgtt

SEQ ID NO: 1737536 - DNA, 14 bp, Homo sapiens
tttatatttccttt

SEQ ID NO: 1737537 - DNA, 19 bp, Homo sapiens
tttatatttcctttatgtg

SEQ ID NO: 1737538 - DNA, 20 bp, Homo sapiens
tttatatttcctttatgtga

SEQ ID NO: 1737539 - DNA, 13 bp, Homo sapiens
tttatatttggaa

SEQ ID NO: 1737540 - DNA, 16 bp, Homo sapiens
tttatatttggaaaga

SEQ ID NO: 1737541 - DNA, 17 bp, Homo sapiens
tttatatttttgtacat

SEQ ID NO: 1737542 - DNA, 21 bp, Homo sapiens
tttatcaatcagtataattct

SEQ ID NO: 1737543 - DNA, 19 bp, Homo sapiens
tttatcaatttttcccagt

SEQ ID NO: 1737544 - DNA, 13 bp, Homo sapiens
tttatcagtgaca

SEQ ID NO: 1737545 - DNA, 18 bp, Homo sapiens
tttatcagtgacagagtt

SEQ ID NO: 1737546 - DNA, 21 bp, Homo sapiens
tttatcagtgacagagttcac

SEQ ID NO: 1737547 - DNA, 16 bp, Homo sapiens
tttatcatgcatgtcc

SEQ ID NO: 1737548 - DNA, 17 bp, Homo sapiens
tttatccaaaatgtgta

SEQ ID NO: 1737549 - DNA, 22 bp, Homo sapiens
tttatccaaaatgtgtatttct

SEQ ID NO: 1737550 - DNA, 18 bp, Homo sapiens
tttatccagaaaactgtg

SEQ ID NO: 1737551 - DNA, 19 bp, Homo sapiens
tttatccagaaaactgtga

SEQ ID NO: 1737552 - DNA, 21 bp, Homo sapiens
tttatccattcaactgaaaat

SEQ ID NO: 1737553 - DNA, 18 bp, Homo sapiens
tttatcccaaagttgttg

SEQ ID NO: 1737554 - DNA, 16 bp, Homo sapiens
tttatcccttaagaat

SEQ ID NO: 1737555 - DNA, 19 bp, Homo sapiens
tttatcctgaaatttcaga

SEQ ID NO: 1737556 - DNA, 20 bp, Homo sapiens
tttatctaatacctctgtgt

SEQ ID NO: 1737557 - DNA, 17 bp, Homo sapiens
tttatctggccccaggt

SEQ ID NO: 1737558 - DNA, 16 bp, Homo sapiens
tttatctgtagtaaac

SEQ ID NO: 1737559 - DNA, 14 bp, Homo sapiens
tttatcttgtctct

SEQ ID NO: 1737560 - DNA, 18 bp, Homo sapiens
tttatctttatatgaaga

SEQ ID NO: 1737561 - DNA, 13 bp, Homo sapiens
tttatgaaaagag

SEQ ID NO: 1737562 - DNA, 19 bp, Homo sapiens
tttatgaaaggtttacatt

SEQ ID NO: 1737563 - DNA, 16 bp, Homo sapiens
tttatgaacagaaata

SEQ ID NO: 1737564 - DNA, 23 bp, Homo sapiens
tttatgaacagaaatattggttg

SEQ ID NO: 1737565 - DNA, 12 bp, Homo sapiens
tttatgaagaaa

SEQ ID NO: 1737566 - DNA, 13 bp, Homo sapiens
tttatgaagaaaa

SEQ ID NO: 1737567 - DNA, 15 bp, Homo sapiens
tttatgaagaaaata

SEQ ID NO: 1737568 - DNA, 17 bp, Homo sapiens
tttatgagccagacaaa

SEQ ID NO: 1737569 - DNA, 17 bp, Homo sapiens
tttatgagtctttgaga

SEQ ID NO: 1737570 - DNA, 17 bp, Homo sapiens
tttatgataatagattc

SEQ ID NO: 1737571 - DNA, 21 bp, Homo sapiens
tttatgatcagtgttgttgct

SEQ ID NO: 1737572 - DNA, 17 bp, Homo sapiens
tttatgatgcaaatctg

SEQ ID NO: 1737573 - DNA, 18 bp, Homo sapiens
tttatgcaaaaggtttat

SEQ ID NO: 1737574 - DNA, 14 bp, Homo sapiens
tttatgcaaataca

SEQ ID NO: 1737575 - DNA, 15 bp, Homo sapiens
tttatgcaaatacaa

SEQ ID NO: 1737576 - DNA, 17 bp, Homo sapiens
tttatgcaaggaaggaa

SEQ ID NO: 1737577 - DNA, 12 bp, Homo sapiens
tttatgcagaca

SEQ ID NO: 1737578 - DNA, 14 bp, Homo sapiens
tttatgcagcaaat

SEQ ID NO: 1737579 - DNA, 18 bp, Homo sapiens
tttatgcagcaaatatat

SEQ ID NO: 1737580 - DNA, 21 bp, Homo sapiens
tttatgccggatgtgcttttc

SEQ ID NO: 1737581 - DNA, 19 bp, Homo sapiens
tttatgccttcttattgct

SEQ ID NO: 1737582 - DNA, 23 bp, Homo sapiens
tttatggaggatggagagagggg

SEQ ID NO: 1737583 - DNA, 17 bp, Homo sapiens
tttatggatatgctgct

SEQ ID NO: 1737584 - DNA, 12 bp, Homo sapiens
tttatggcctca

SEQ ID NO: 1737585 - DNA, 13 bp, Homo sapiens
tttatggcctcag

SEQ ID NO: 1737586 - DNA, 22 bp, Homo sapiens
tttatggcctcagctgcctcac

SEQ ID NO: 1737587 - DNA, 18 bp, Homo sapiens
tttatgggcccctggcac

SEQ ID NO: 1737588 - DNA, 13 bp, Homo sapiens
tttatgggccttg

SEQ ID NO: 1737589 - DNA, 20 bp, Homo sapiens
tttatgtgaaatgctttctg

SEQ ID NO: 1737590 - DNA, 21 bp, Homo sapiens
tttatgtgaaatgctttctgt

SEQ ID NO: 1737591 - DNA, 22 bp, Homo sapiens
tttatgtgaaatgctttctgta

SEQ ID NO: 1737592 - DNA, 16 bp, Homo sapiens
tttatgtgaattttta

SEQ ID NO: 1737593 - DNA, 16 bp, Homo sapiens
tttatgtgatcaattt

SEQ ID NO: 1737594 - DNA, 16 bp, Homo sapiens
tttatgtgctatgcaa

SEQ ID NO: 1737595 - DNA, 17 bp, Homo sapiens
tttatgttcatttgttt

SEQ ID NO: 1737596 - DNA, 12 bp, Homo sapiens
tttatgttttgt

SEQ ID NO: 1737597 - DNA, 15 bp, Homo sapiens
tttattaaaatctta

SEQ ID NO: 1737598 - DNA, 15 bp, Homo sapiens
tttattaaacacagg

SEQ ID NO: 1737599 - DNA, 17 bp, Homo sapiens
tttattaaacagatttt

SEQ ID NO: 1737600 - DNA, 19 bp, Homo sapiens
tttattaaagcatttccta

SEQ ID NO: 1737601 - DNA, 19 bp, Homo sapiens
tttattaatcttagtgtat

SEQ ID NO: 1737602 - DNA, 23 bp, Homo sapiens
tttattacaatgtatctttatta

SEQ ID NO: 1737603 - DNA, 23 bp, Homo sapiens
tttattaccccctccttcagaca

SEQ ID NO: 1737604 - DNA, 13 bp, Homo sapiens
tttattacctctg

SEQ ID NO: 1737605 - DNA, 14 bp, Homo sapiens
tttattacctctga

SEQ ID NO: 1737606 - DNA, 13 bp, Homo sapiens
tttattactgatt

SEQ ID NO: 1737607 - DNA, 16 bp, Homo sapiens
tttattatgagctttc

SEQ ID NO: 1737608 - DNA, 16 bp, Homo sapiens
tttattatgcattata

SEQ ID NO: 1737609 - DNA, 14 bp, Homo sapiens
tttattattttctt

SEQ ID NO: 1737610 - DNA, 15 bp, Homo sapiens
tttattcactgtaag

SEQ ID NO: 1737611 - DNA, 12 bp, Homo sapiens
tttattcataat

SEQ ID NO: 1737612 - DNA, 19 bp, Homo sapiens
tttaatcaagttgtaactt

SEQ ID NO: 1737613 - DNA, 12 bp, Homo sapiens
tttaatcagaaa

SEQ ID NO: 1737614 - DNA, 19 bp, Homo sapiens
tttaatcagttgtttaata

SEQ ID NO: 1737615 - DNA, 19 bp, Homo sapiens
tttaatcatgaaattactt

SEQ ID NO: 1737616 - DNA, 23 bp, Homo sapiens
tttaatccttctagtttcccaca

SEQ ID NO: 1737617 - DNA, 13 bp, Homo sapiens
tttaatcttagct

SEQ ID NO: 1737618 - DNA, 21 bp, Homo sapiens
tttaatgaaagactgtacaaa

SEQ ID NO: 1737619 - DNA, 23 bp, Homo sapiens
tttaatgaaagactgtacaaagt

SEQ ID NO: 1737620 - DNA, 13 bp, Homo sapiens
tttaatgaaatca

SEQ ID NO: 1737621 - DNA, 17 bp, Homo sapiens
tttaatgagaatagaaa

SEQ ID NO: 1737622 - DNA, 19 bp, Homo sapiens
tttaatgcttcattcaata

SEQ ID NO: 1737623 - DNA, 14 bp, Homo sapiens
tttaatggcagcta

SEQ ID NO: 1737624 - DNA, 16 bp, Homo sapiens
tttaatgtatctattt

SEQ ID NO: 1737625 - DNA, 21 bp, Homo sapiens
tttaatgtatctatttgtaca

SEQ ID NO: 1737626 - DNA, 13 bp, Homo sapiens
tttaatgtctgtt

SEQ ID NO: 1737627 - DNA, 19 bp, Homo sapiens
tttaattaatgaaatatct

SEQ ID NO: 1737628 - DNA, 16 bp, Homo sapiens
tttaattactgctata

SEQ ID NO: 1737629 - DNA, 21 bp, Homo sapiens
tttaattaggggttgctaaga

SEQ ID NO: 1737630 - DNA, 22 bp, Homo sapiens
tttaattatgaaaactagcatt

SEQ ID NO: 1737631 - DNA, 23 bp, Homo sapiens
tttaattattattcttcataaca

SEQ ID NO: 1737632 - DNA, 17 bp, Homo sapiens
tttaattattttaaaat

SEQ ID NO: 1737633 - DNA, 18 bp, Homo sapiens
tttaattcacgtgctttg

SEQ ID NO: 1737634 - DNA, 16 bp, Homo sapiens
tttaattcatgtttct

SEQ ID NO: 1737635 - DNA, 23 bp, Homo sapiens
tttaattcatgtttcttaaatgg

SEQ ID NO: 1737636 - DNA, 17 bp, Homo sapiens
tttaattccatgaatgt

SEQ ID NO: 1737637 - DNA, 14 bp, Homo sapiens
tttaattctcattt

SEQ ID NO: 1737638 - DNA, 20 bp, Homo sapiens
tttaattctgcttgtgacat

SEQ ID NO: 1737639 - DNA, 14 bp, Homo sapiens
tttaattgattatt

SEQ ID NO: 1737640 - DNA, 16 bp, Homo sapiens
tttaattgctttaaat

SEQ ID NO: 1737641 - DNA, 21 bp, Homo sapiens
tttaattgtagttctgtgtac

SEQ ID NO: 1737642 - DNA, 15 bp, Homo sapiens
tttaatttaaactgt

SEQ ID NO: 1737643 - DNA, 16 bp, Homo sapiens
tttaatttcaaatgta

SEQ ID NO: 1737644 - DNA, 15 bp, Homo sapiens
tttaatttcaggaaa

SEQ ID NO: 1737645 - DNA, 11 bp, Homo sapiens
tttaatttgat

SEQ ID NO: 1737646 - DNA, 18 bp, Homo sapiens
tttaatttgatgaaagct

SEQ ID NO: 1737647 - DNA, 19 bp, Homo sapiens
tttaatttgatgaaagctg

SEQ ID NO: 1737648 - DNA, 21 bp, Homo sapiens
tttaattttttactttcagtt

SEQ ID NO: 1737649 - DNA, 19 bp, Homo sapiens
tttacaaaccattacctgt

SEQ ID NO: 1737650 - DNA, 13 bp, Homo sapiens
tttacaagatatt

SEQ ID NO: 1737651 - DNA, 10 bp, Homo sapiens
tttacaagcg

SEQ ID NO: 1737652 - DNA, 16 bp, Homo sapiens
tttacaataaataatc

SEQ ID NO: 1737653 - DNA, 16 bp, Homo sapiens
tttacaattgaaatga

SEQ ID NO: 1737654 - DNA, 19 bp, Homo sapiens
tttacaattttttatcatg

SEQ ID NO: 1737655 - DNA, 19 bp, Homo sapiens
tttacacacttgcatgaat

SEQ ID NO: 1737656 - DNA, 14 bp, Homo sapiens
tttacacaggaaga

SEQ ID NO: 1737657 - DNA, 20 bp, Homo sapiens
tttacaccgactagccagga

SEQ ID NO: 1737658 - DNA, 19 bp, Homo sapiens
tttacactattatttccta

SEQ ID NO: 1737659 - DNA, 14 bp, Homo sapiens
tttacactcaggct

SEQ ID NO: 1737660 - DNA, 19 bp, Homo sapiens
tttacactgcggaagccaa

SEQ ID NO: 1737661 - DNA, 18 bp, Homo sapiens
tttacactggtctaatgt

SEQ ID NO: 1737662 - DNA, 12 bp, Homo sapiens
tttacagaaaaa

SEQ ID NO: 1737663 - DNA, 16 bp, Homo sapiens
tttacagaaaaatctt

SEQ ID NO: 1737664 - DNA, 17 bp, Homo sapiens
tttacagaaaaatcttg

SEQ ID NO: 1737665 - DNA, 20 bp, Homo sapiens
tttacagaggacagtatttg

SEQ ID NO: 1737666 - DNA, 17 bp, Homo sapiens
tttacagatccagaatt

SEQ ID NO: 1737667 - DNA, 22 bp, Homo sapiens
tttacagatccagaatttatta

SEQ ID NO: 1737668 - DNA, 21 bp, Homo sapiens
tttacagcactactctgtgcc

SEQ ID NO: 1737669 - DNA, 15 bp, Homo sapiens
tttacagcattgtct

SEQ ID NO: 1737670 - DNA, 16 bp, Homo sapiens
tttacagcattgtctt

SEQ ID NO: 1737671 - DNA, 15 bp, Homo sapiens
tttacagctgtgtta

SEQ ID NO: 1737672 - DNA, 22 bp, Homo sapiens
tttacagttagggttttgcaat

SEQ ID NO: 1737673 - DNA, 21 bp, Homo sapiens
tttacagtttttttctttgtg

SEQ ID NO: 1737674 - DNA, 15 bp, Homo sapiens
tttacatactgctgt

SEQ ID NO: 1737675 - DNA, 18 bp, Homo sapiens
tttacatgaattgcattt

SEQ ID NO: 1737676 - DNA, 15 bp, Homo sapiens
tttacattgtaaata

SEQ ID NO: 1737677 - DNA, 13 bp, Homo sapiens
tttaagattccca

SEQ ID NO: 1737678 - DNA, 18 bp, Homo sapiens
tttaagccaaagaaacaa

SEQ ID NO: 1737679 - DNA, 16 bp, Homo sapiens
tttaagcctaaagatt

SEQ ID NO: 1737680 - DNA, 19 bp, Homo sapiens
tttaagccttacaaaggga

SEQ ID NO: 1737681 - DNA, 11 bp, Homo sapiens
tttaagctgtt

SEQ ID NO: 1737682 - DNA, 13 bp, Homo sapiens
tttaagctgtttc

SEQ ID NO: 1737683 - DNA, 18 bp, Homo sapiens
tttaagctgtttccatag

SEQ ID NO: 1737684 - DNA, 21 bp, Homo sapiens
tttaagcttcagttgcttgtc

SEQ ID NO: 1737685 - DNA, 12 bp, Homo sapiens
tttaaggaaaca

SEQ ID NO: 1737686 - DNA, 11 bp, Homo sapiens
tttaaggagct

SEQ ID NO: 1737687 - DNA, 12 bp, Homo sapiens
tttaaggatgga

SEQ ID NO: 1737688 - DNA, 14 bp, Homo sapiens
tttaaggatggatg

SEQ ID NO: 1737689 - DNA, 17 bp, Homo sapiens
tttaaggatggatggca

SEQ ID NO: 1737690 - DNA, 20 bp, Homo sapiens
tttaaggatggatggcaccc

SEQ ID NO: 1737691 - DNA, 17 bp, Homo sapiens
tttaaggctctgtgcct

SEQ ID NO: 1737692 - DNA, 23 bp, Homo sapiens
tttaagggccggggatggatctt

SEQ ID NO: 1737693 - DNA, 19 bp, Homo sapiens
tttaaggtagcttcagcta

SEQ ID NO: 1737694 - DNA, 17 bp, Homo sapiens
tttaaggtctgtttgct

SEQ ID NO: 1737695 - DNA, 16 bp, Homo sapiens
tttaaggtttttactg

SEQ ID NO: 1737696 - DNA, 21 bp, Homo sapiens
tttaagtaagacttttattaa

SEQ ID NO: 1737697 - DNA, 18 bp, Homo sapiens
tttaagtaattgcctaca

SEQ ID NO: 1737698 - DNA, 22 bp, Homo sapiens
tttaagtagtgggcatttcata

SEQ ID NO: 1737699 - DNA, 16 bp, Homo sapiens
tttaagtatatagtat

SEQ ID NO: 1737700 - DNA, 13 bp, Homo sapiens
tttaagtatttag

SEQ ID NO: 1737701 - DNA, 13 bp, Homo sapiens
tttaagtatttat

SEQ ID NO: 1737702 - DNA, 15 bp, Homo sapiens
tttaagtatttatat

SEQ ID NO: 1737703 - DNA, 14 bp, Homo sapiens
tttaagtgagtcct

SEQ ID NO: 1737704 - DNA, 18 bp, Homo sapiens
tttaagttaaatatgtag

SEQ ID NO: 1737705 - DNA, 13 bp, Homo sapiens
tttaagttgatta

SEQ ID NO: 1737706 - DNA, 12 bp, Homo sapiens
tttaagtttgca

SEQ ID NO: 1737707 - DNA, 19 bp, Homo sapiens
tttaagttttgattaatgt

SEQ ID NO: 1737708 - DNA, 21 bp, Homo sapiens
tttaagttttgattaatgttt

SEQ ID NO: 1737709 - DNA, 21 bp, Homo sapiens
tttaataaaactgcgaggaca

SEQ ID NO: 1737710 - DNA, 14 bp, Homo sapiens
tttaataaaagatt

SEQ ID NO: 1737711 - DNA, 13 bp, Homo sapiens
tttaataaacttt

SEQ ID NO: 1737712 - DNA, 16 bp, Homo sapiens
tttaataaagcttgtg

SEQ ID NO: 1737713 - DNA, 22 bp, Homo sapiens
tttaataacaaggagatttctt

SEQ ID NO: 1737714 - DNA, 19 bp, Homo sapiens
tttaataacatatctaaag

SEQ ID NO: 1737715 - DNA, 17 bp, Homo sapiens
tttaatacaggaaattg

SEQ ID NO: 1737716 - DNA, 14 bp, Homo sapiens
tttaatacagggta

SEQ ID NO: 1737717 - DNA, 17 bp, Homo sapiens
tttaatagaagttttat

SEQ ID NO: 1737718 - DNA, 15 bp, Homo sapiens
tttaatagcctgtca

SEQ ID NO: 1737719 - DNA, 13 bp, Homo sapiens
tttaatagtgctt

SEQ ID NO: 1737720 - DNA, 17 bp, Homo sapiens
tttaatatctggcactg

SEQ ID NO: 1737721 - DNA, 16 bp, Homo sapiens
tttaatattactgtct

SEQ ID NO: 1737722 - DNA, 17 bp, Homo sapiens
tttaatattactgtctt

SEQ ID NO: 1737723 - DNA, 15 bp, Homo sapiens
ttaggatgggggaga

SEQ ID NO: 1737724 - DNA, 16 bp, Homo sapiens
ttaggattcaggcagc

SEQ ID NO: 1737725 - DNA, 14 bp, Homo sapiens
ttaggatttaacag

SEQ ID NO: 1737726 - DNA, 21 bp, Homo sapiens
ttaggatttaacagtcattta

SEQ ID NO: 1737727 - DNA, 16 bp, Homo sapiens
ttaggattttcacatt

SEQ ID NO: 1737728 - DNA, 15 bp, Homo sapiens
ttaggcagattgaaa

SEQ ID NO: 1737729 - DNA, 18 bp, Homo sapiens
ttaggcatgcacagctgt

SEQ ID NO: 1737730 - DNA, 17 bp, Homo sapiens
ttaggcatgtcccaccc

SEQ ID NO: 1737731 - DNA, 18 bp, Homo sapiens
ttaggcatttcctgctga

SEQ ID NO: 1737732 - DNA, 14 bp, Homo sapiens
ttaggcctctgaga

SEQ ID NO: 1737733 - DNA, 23 bp, Homo sapiens
ttaggccttaacacactggccat

SEQ ID NO: 1737734 - DNA, 15 bp, Homo sapiens
ttaggctattcacaa

SEQ ID NO: 1737735 - DNA, 16 bp, Homo sapiens
ttaggctattcacaac

SEQ ID NO: 1737736 - DNA, 22 bp, Homo sapiens
ttaggctatttgtaaatctgcc

SEQ ID NO: 1737737 - DNA, 19 bp, Homo sapiens
ttaggcttggctgccctgt

SEQ ID NO: 1737738 - DNA, 14 bp, Homo sapiens
ttagggagagaaga

SEQ ID NO: 1737739 - DNA, 19 bp, Homo sapiens
ttagggagtggttcctgtg

SEQ ID NO: 1737740 - DNA, 21 bp, Homo sapiens
ttagggatagtactaagcatt

SEQ ID NO: 1737741 - DNA, 12 bp, Homo sapiens
ttagggcagctt

SEQ ID NO: 1737742 - DNA, 14 bp, Homo sapiens
ttagggcttttatt

SEQ ID NO: 1737743 - DNA, 19 bp, Homo sapiens
ttaggggaaggagaagtaa

SEQ ID NO: 1737744 - DNA, 22 bp, Homo sapiens
ttaggggatttttttttagaca

SEQ ID NO: 1737745 - DNA, 15 bp, Homo sapiens
ttaggggggaaagtc

SEQ ID NO: 1737746 - DNA, 13 bp, Homo sapiens
ttagggtcagcca

SEQ ID NO: 1737747 - DNA, 15 bp, Homo sapiens
ttagggtcagccatt

SEQ ID NO: 1737748 - DNA, 23 bp, Homo sapiens
ttagggtcagccatttttaatga

SEQ ID NO: 1737749 - DNA, 21 bp, Homo sapiens
ttagggtgaaacttaaaaaaa

SEQ ID NO: 1737750 - DNA, 16 bp, Homo sapiens
ttagggtgtgtgttca

SEQ ID NO: 1737751 - DNA, 18 bp, Homo sapiens
ttagggtttgcagagtgg

SEQ ID NO: 1737752 - DNA, 16 bp, Homo sapiens
ttaggtagactttgct

SEQ ID NO: 1737753 - DNA, 17 bp, Homo sapiens
ttaggtagactttgctt

SEQ ID NO: 1737754 - DNA, 22 bp, Homo sapiens
ttaggtcaataacactgtattt

SEQ ID NO: 1737755 - DNA, 23 bp, Homo sapiens
ttaggtcaataacactgtatttt

SEQ ID NO: 1737756 - DNA, 19 bp, Homo sapiens
ttaggtccctcactccaca

SEQ ID NO: 1737757 - DNA, 12 bp, Homo sapiens
ttaggtctggtt

SEQ ID NO: 1737758 - DNA, 18 bp, Homo sapiens
ttaggtgcaatttcaagg

SEQ ID NO: 1737759 - DNA, 16 bp, Homo sapiens
ttaggttattttgctt

SEQ ID NO: 1737760 - DNA, 12 bp, Homo sapiens
ttaggttctaaa

SEQ ID NO: 1737761 - DNA, 16 bp, Homo sapiens
ttaggttctaaagttc

SEQ ID NO: 1737762 - DNA, 20 bp, Homo sapiens
ttaggttctaaagttctaag

SEQ ID NO: 1737763 - DNA, 22 bp, Homo sapiens
ttaggttctaaagttctaagat

SEQ ID NO: 1737764 - DNA, 21 bp, Homo sapiens
ttagtagaaattttacaatag

SEQ ID NO: 1737765 - DNA, 17 bp, Homo sapiens
ttagtagagacagggtt

SEQ ID NO: 1737766 - DNA, 23 bp, Homo sapiens
ttagtatctaacatgtatcccaa

SEQ ID NO: 1737767 - DNA, 12 bp, Homo sapiens
ttagtatgcagt

SEQ ID NO: 1737768 - DNA, 20 bp, Homo sapiens
ttagtcgttatatttgactt

SEQ ID NO: 1737769 - DNA, 22 bp, Homo sapiens
ttagtctagacacaatttcatt

SEQ ID NO: 1737770 - DNA, 22 bp, Homo sapiens
ttagtctcagtttgtgtgtctt

SEQ ID NO: 1737771 - DNA, 23 bp, Homo sapiens
ttagtctcagtttgtgtgtctta

SEQ ID NO: 1737772 - DNA, 15 bp, Homo sapiens
ttagtctgaaactgg

SEQ ID NO: 1737773 - DNA, 22 bp, Homo sapiens
ttagtgaaccaaaaatagaaat

SEQ ID NO: 1737774 - DNA, 16 bp, Homo sapiens
ttagtgaagttgtgca

SEQ ID NO: 1737775 - DNA, 15 bp, Homo sapiens
ttagtgacaaaatag

SEQ ID NO: 1737776 - DNA, 14 bp, Homo sapiens
ttagtgccagaatt

SEQ ID NO: 1737777 - DNA, 15 bp, Homo sapiens
ttagtgctaaacaag

SEQ ID NO: 1737778 - DNA, 14 bp, Homo sapiens
ttagtgctttacat

SEQ ID NO: 1737779 - DNA, 16 bp, Homo sapiens
ttagtgctttacatgc

SEQ ID NO: 1737780 - DNA, 11 bp, Homo sapiens
ttagtggagcc

SEQ ID NO: 1737781 - DNA, 15 bp, Homo sapiens
ttagtggatggaata

SEQ ID NO: 1737782 - DNA, 23 bp, Homo sapiens
ttagtgtcacttacctagattta

SEQ ID NO: 1737783 - DNA, 15 bp, Homo sapiens
ttagtgtgtgtgcat

SEQ ID NO: 1737784 - DNA, 17 bp, Homo sapiens
ttagtgtgtgtgcatgt

SEQ ID NO: 1737785 - DNA, 19 bp, Homo sapiens
ttagtgttaaaaatctagt

SEQ ID NO: 1737786 - DNA, 22 bp, Homo sapiens
ttagttaccttatagttactgt

SEQ ID NO: 1737787 - DNA, 16 bp, Homo sapiens
ttagttatagatgtct

SEQ ID NO: 1737788 - DNA, 15 bp, Homo sapiens
ttagttccagtttct

SEQ ID NO: 1737789 - DNA, 12 bp, Homo sapiens
ttagttcccaac

SEQ ID NO: 1737790 - DNA, 15 bp, Homo sapiens
ttagttctttgttat

SEQ ID NO: 1737791 - DNA, 12 bp, Homo sapiens
ttagttgcacta

SEQ ID NO: 1737792 - DNA, 13 bp, Homo sapiens
ttagttgcactaa

SEQ ID NO: 1737793 - DNA, 20 bp, Homo sapiens
ttagttgcactaactgctgg

SEQ ID NO: 1737794 - DNA, 16 bp, Homo sapiens
ttagtttaatagtttg

SEQ ID NO: 1737795 - DNA, 14 bp, Homo sapiens
ttagtttagtgtgt

SEQ ID NO: 1737796 - DNA, 17 bp, Homo sapiens
ttagtttcaagagtcta

SEQ ID NO: 1737797 - DNA, 20 bp, Homo sapiens
ttagtttcctttttaatatg

SEQ ID NO: 1737798 - DNA, 13 bp, Homo sapiens
ttagtttctgaac

SEQ ID NO: 1737799 - DNA, 17 bp, Homo sapiens
ttagtttctgaactctg

SEQ ID NO: 1737800 - DNA, 18 bp, Homo sapiens
ttagtttggattcttatg

SEQ ID NO: 1737801 - DNA, 15 bp, Homo sapiens
ttagttttagttgca

SEQ ID NO: 1737802 - DNA, 17 bp, Homo sapiens
ttagttttagttgcaga

SEQ ID NO: 1737803 - DNA, 17 bp, Homo sapiens
ttagtttttcattaaat

SEQ ID NO: 1737804 - DNA, 18 bp, Homo sapiens
ttagtttttggttgggaa

SEQ ID NO: 1737805 - DNA, 18 bp, Homo sapiens
ttataaaaaatggttcag

SEQ ID NO: 1737806 - DNA, 14 bp, Homo sapiens
ttataaaaaatgta

SEQ ID NO: 1737807 - DNA, 18 bp, Homo sapiens
ttataaaagcaaaagaga

SEQ ID NO: 1737808 - DNA, 13 bp, Homo sapiens
ttataaaatataa

SEQ ID NO: 1737809 - DNA, 20 bp, Homo sapiens
ttataaaatataaacaaaga

SEQ ID NO: 1737810 - DNA, 20 bp, Homo sapiens
ttataaaatcctgtgcaata

SEQ ID NO: 1737811 - DNA, 16 bp, Homo sapiens
ttataaaattaagcaa

SEQ ID NO: 1737812 - DNA, 17 bp, Homo sapiens
ttataaaattttgcttt

SEQ ID NO: 1737813 - DNA, 21 bp, Homo sapiens
ttataaacaagaatgaaggtt

SEQ ID NO: 1737814 - DNA, 21 bp, Homo sapiens
ttataaacagacaatatgtga

SEQ ID NO: 1737815 - DNA, 23 bp, Homo sapiens
ttataaacagacaatatgtgagt

SEQ ID NO: 1737816 - DNA, 22 bp, Homo sapiens
ttataaactaccaaattagtga

SEQ ID NO: 1737817 - DNA, 23 bp, Homo sapiens
ttataaagataaaatatcctcag

SEQ ID NO: 1737818 - DNA, 17 bp, Homo sapiens
ttataaagtctaagcaa

SEQ ID NO: 1737819 - DNA, 19 bp, Homo sapiens
ttataaatactgcaaatca

SEQ ID NO: 1737820 - DNA, 23 bp, Homo sapiens
ttataaatgtaccagagagagtt

SEQ ID NO: 1737821 - DNA, 16 bp, Homo sapiens
ttataacagttatatt

SEQ ID NO: 1737822 - DNA, 23 bp, Homo sapiens
ttataacctagttaaagaaagga

SEQ ID NO: 1737823 - DNA, 15 bp, Homo sapiens
ttataacctggcaaa

SEQ ID NO: 1737824 - DNA, 19 bp, Homo sapiens
ttataactaacatgtcctg

SEQ ID NO: 1737825 - DNA, 17 bp, Homo sapiens
ttataactcatcataaa

SEQ ID NO: 1737826 - DNA, 18 bp, Homo sapiens
ttataactcatcataaaa

SEQ ID NO: 1737827 - DNA, 20 bp, Homo sapiens
ttataactcatcataaaata

SEQ ID NO: 1737828 - DNA, 21 bp, Homo sapiens
ttataactcatcataaaataa

SEQ ID NO: 1737829 - DNA, 16 bp, Homo sapiens
ttataactctgcacta

SEQ ID NO: 1737830 - DNA, 19 bp, Homo sapiens
ttataactctgcactactc

SEQ ID NO: 1737831 - DNA, 17 bp, Homo sapiens
ttataactgtaaagatg

SEQ ID NO: 1737832 - DNA, 14 bp, Homo sapiens
ttataagaaaaact

SEQ ID NO: 1737833 - DNA, 14 bp, Homo sapiens
ttataagactctca

SEQ ID NO: 1737834 - DNA, 21 bp, Homo sapiens
ttataagagggcatatacagt

SEQ ID NO: 1737835 - DNA, 14 bp, Homo sapiens
ttataagcagattt

SEQ ID NO: 1737836 - DNA, 23 bp, Homo sapiens
ttataaggccatttccttttcac

SEQ ID NO: 1737837 - DNA, 21 bp, Homo sapiens
ttataagtgactttaaacttt

SEQ ID NO: 1737838 - DNA, 15 bp, Homo sapiens
ttataataaatatat

SEQ ID NO: 1737839 - DNA, 13 bp, Homo sapiens
ttaccctttagac

SEQ ID NO: 1737840 - DNA, 18 bp, Homo sapiens
ttaccggttgattgaaat

SEQ ID NO: 1737841 - DNA, 15 bp, Homo sapiens
ttaccgtagcctccg

SEQ ID NO: 1737842 - DNA, 18 bp, Homo sapiens
ttacctaaacagatataa

SEQ ID NO: 1737843 - DNA, 20 bp, Homo sapiens
ttacctaaacagatataaat

SEQ ID NO: 1737844 - DNA, 21 bp, Homo sapiens
ttacctaaacagatataaatg

SEQ ID NO: 1737845 - DNA, 14 bp, Homo sapiens
ttacctaagattac

SEQ ID NO: 1737846 - DNA, 15 bp, Homo sapiens
ttacctaatctccac

SEQ ID NO: 1737847 - DNA, 17 bp, Homo sapiens
ttacctaccacagtgtc

SEQ ID NO: 1737848 - DNA, 21 bp, Homo sapiens
ttacctccatccatccttcca

SEQ ID NO: 1737849 - DNA, 21 bp, Homo sapiens
ttacctctgatacctcaaccc

SEQ ID NO: 1737850 - DNA, 12 bp, Homo sapiens
ttacctctttaa

SEQ ID NO: 1737851 - DNA, 18 bp, Homo sapiens
ttacctgaacaggaatcc

SEQ ID NO: 1737852 - DNA, 13 bp, Homo sapiens
ttacctgacacaa

SEQ ID NO: 1737853 - DNA, 15 bp, Homo sapiens
ttacctgcaggctcc

SEQ ID NO: 1737854 - DNA, 13 bp, Homo sapiens
ttacctgccgccc

SEQ ID NO: 1737855 - DNA, 15 bp, Homo sapiens
ttacctggatgttct

SEQ ID NO: 1737856 - DNA, 12 bp, Homo sapiens
ttacctggatta

SEQ ID NO: 1737857 - DNA, 21 bp, Homo sapiens
ttacctggcttatttaatatg

SEQ ID NO: 1737858 - DNA, 13 bp, Homo sapiens
ttacctgtacctg

SEQ ID NO: 1737859 - DNA, 19 bp, Homo sapiens
ttacctgtgaagtgttact

SEQ ID NO: 1737860 - DNA, 13 bp, Homo sapiens
ttacctgtggata

SEQ ID NO: 1737861 - DNA, 14 bp, Homo sapiens
ttaccttacagaag

SEQ ID NO: 1737862 - DNA, 14 bp, Homo sapiens
ttaccttcccgcct

SEQ ID NO: 1737863 - DNA, 13 bp, Homo sapiens
ttaccttctaaaa

SEQ ID NO: 1737864 - DNA, 20 bp, Homo sapiens
ttacctttttatttgcatgt

SEQ ID NO: 1737865 - DNA, 15 bp, Homo sapiens
ttaccttttttgata

SEQ ID NO: 1737866 - DNA, 16 bp, Homo sapiens
ttacgagttttccctc

SEQ ID NO: 1737867 - DNA, 17 bp, Homo sapiens
ttacgatttcactagga

SEQ ID NO: 1737868 - DNA, 18 bp, Homo sapiens
ttacgatttcactaggac

SEQ ID NO: 1737869 - DNA, 20 bp, Homo sapiens
ttacgcacacgtacttaaat

SEQ ID NO: 1737870 - DNA, 17 bp, Homo sapiens
ttacggcatcacactta

SEQ ID NO: 1737871 - DNA, 14 bp, Homo sapiens
ttacgggtacctga

SEQ ID NO: 1737872 - DNA, 21 bp, Homo sapiens
ttacgttcatcacctgctaga

SEQ ID NO: 1737873 - DNA, 13 bp, Homo sapiens
ttactaaaagatc

SEQ ID NO: 1737874 - DNA, 21 bp, Homo sapiens
ttactaaacattttgttattg

SEQ ID NO: 1737875 - DNA, 15 bp, Homo sapiens
ttactaaagaaagat

SEQ ID NO: 1737876 - DNA, 22 bp, Homo sapiens
ttactaaagatatcagagctct

SEQ ID NO: 1737877 - DNA, 21 bp, Homo sapiens
ttactaactctggtttaattt

SEQ ID NO: 1737878 - DNA, 15 bp, Homo sapiens
ttactaagaagaaaa

SEQ ID NO: 1737879 - DNA, 20 bp, Homo sapiens
ttactacaaaatttgaaatt

SEQ ID NO: 1737880 - DNA, 13 bp, Homo sapiens
ttactacagttgt

SEQ ID NO: 1737881 - DNA, 15 bp, Homo sapiens
ttactacagttgttt

SEQ ID NO: 1737882 - DNA, 13 bp, Homo sapiens
ttactactgtgga

SEQ ID NO: 1737883 - DNA, 22 bp, Homo sapiens
ttactagaaggcgtccatgttt

SEQ ID NO: 1737884 - DNA, 17 bp, Homo sapiens
ttactatcacacatgaa

SEQ ID NO: 1737885 - DNA, 18 bp, Homo sapiens
ttactatggtaacacttt

SEQ ID NO: 1737886 - DNA, 19 bp, Homo sapiens
ttactattaagcagtaaaa

SEQ ID NO: 1737887 - DNA, 16 bp, Homo sapiens
ttactattgctatctt

SEQ ID NO: 1737888 - DNA, 17 bp, Homo sapiens
ttactattttctacaat

SEQ ID NO: 1737889 - DNA, 21 bp, Homo sapiens
ttactattttgacagttattt

SEQ ID NO: 1737890 - DNA, 18 bp, Homo sapiens
ttactcaaaatctgtcat

SEQ ID NO: 1737891 - DNA, 13 bp, Homo sapiens
ttactcagcccag

SEQ ID NO: 1737892 - DNA, 12 bp, Homo sapiens
ttactcagccct

SEQ ID NO: 1737893 - DNA, 22 bp, Homo sapiens
ttactcagccctgggccccacc

SEQ ID NO: 1737894 - DNA, 17 bp, Homo sapiens
ttactcaggaagaacac

SEQ ID NO: 1737895 - DNA, 19 bp, Homo sapiens
ttactcagtgttagagaaa

SEQ ID NO: 1737896 - DNA, 20 bp, Homo sapiens
ttactcagtgttagagaaat

SEQ ID NO: 1737897 - DNA, 20 bp, Homo sapiens
ttactcattaaaaataatag

SEQ ID NO: 1737898 - DNA, 22 bp, Homo sapiens
ttactccattactgtgatttct

SEQ ID NO: 1737899 - DNA, 15 bp, Homo sapiens
ttactccctgtttta

SEQ ID NO: 1737900 - DNA, 19 bp, Homo sapiens
ttactccctgttttagttt

SEQ ID NO: 1737901 - DNA, 19 bp, Homo sapiens
ttactcccttcctggcctc

SEQ ID NO: 1737902 - DNA, 21 bp, Homo sapiens
ttactcgatcaaaaccttcct

SEQ ID NO: 1737903 - DNA, 14 bp, Homo sapiens
ttactctaagatct

SEQ ID NO: 1737904 - DNA, 22 bp, Homo sapiens
ttactctaagatcttagattct

SEQ ID NO: 1737905 - DNA, 13 bp, Homo sapiens
ttactctgagccc

SEQ ID NO: 1737906 - DNA, 16 bp, Homo sapiens
ttactctgagcccagg

SEQ ID NO: 1737907 - DNA, 20 bp, Homo sapiens
ttactctgagcccaggccgt

SEQ ID NO: 1737908 - DNA, 23 bp, Homo sapiens
ttactctggagcaacctactgtc

SEQ ID NO: 1737909 - DNA, 13 bp, Homo sapiens
ttactctttccta

SEQ ID NO: 1737910 - DNA, 16 bp, Homo sapiens
ttactgaataatatca

SEQ ID NO: 1737911 - DNA, 22 bp, Homo sapiens
ttactgaattgtatcaatttgt

SEQ ID NO: 1737912 - DNA, 12 bp, Homo sapiens
ttactgaccatg

SEQ ID NO: 1737913 - DNA, 13 bp, Homo sapiens
ttactgagcttct

SEQ ID NO: 1737914 - DNA, 16 bp, Homo sapiens
ttactgagcttctctg

SEQ ID NO: 1737915 - DNA, 17 bp, Homo sapiens
ttactgagcttctctgt

SEQ ID NO: 1737916 - DNA, 14 bp, Homo sapiens
ttactgataatttt

SEQ ID NO: 1737917 - DNA, 22 bp, Homo sapiens
ttactgatatttatagaacagt

SEQ ID NO: 1737918 - DNA, 15 bp, Homo sapiens
ttactgatgtgatat

SEQ ID NO: 1737919 - DNA, 18 bp, Homo sapiens
ttactgatgtgatattct

SEQ ID NO: 1737920 - DNA, 22 bp, Homo sapiens
ttactgcagcctttgcctcccc

SEQ ID NO: 1737921 - DNA, 19 bp, Homo sapiens
ttactgccggtttgaaaat

SEQ ID NO: 1737922 - DNA, 21 bp, Homo sapiens
ttactgctgattcttgtaaat

SEQ ID NO: 1737923 - DNA, 22 bp, Homo sapiens
ttactgctgattcttgtaaatc

SEQ ID NO: 1737924 - DNA, 17 bp, Homo sapiens
ttactgctttaatcaga

SEQ ID NO: 1737925 - DNA, 20 bp, Homo sapiens
ttactggcctttttcattta

SEQ ID NO: 1737926 - DNA, 18 bp, Homo sapiens
ttactggtccaaaagatt

SEQ ID NO: 1737927 - DNA, 12 bp, Homo sapiens
ttactgtaatat

SEQ ID NO: 1737928 - DNA, 14 bp, Homo sapiens
ttactgtatataaa

SEQ ID NO: 1737929 - DNA, 17 bp, Homo sapiens
ttactgtatatgtattc

SEQ ID NO: 1737930 - DNA, 17 bp, Homo sapiens
ttactgtatttaagaaa

SEQ ID NO: 1737931 - DNA, 13 bp, Homo sapiens
ttactgtcaataa

SEQ ID NO: 1737932 - DNA, 15 bp, Homo sapiens
ttactgtcaataaac

SEQ ID NO: 1737933 - DNA, 17 bp, Homo sapiens
ttactgtcaataaacag

SEQ ID NO: 1737934 - DNA, 14 bp, Homo sapiens
ttactgtgaaactg

SEQ ID NO: 1737935 - DNA, 16 bp, Homo sapiens
ttactgtgatttctgg

SEQ ID NO: 1737936 - DNA, 18 bp, Homo sapiens
ttactgttagtcatttgc

SEQ ID NO: 1737937 - DNA, 17 bp, Homo sapiens
ttactgttttaattgta

SEQ ID NO: 1737938 - DNA, 21 bp, Homo sapiens
ttactgttttaattgtagttc

SEQ ID NO: 1737939 - DNA, 19 bp, Homo sapiens
ttactgttttgggcctcca

SEQ ID NO: 1737940 - DNA, 13 bp, Homo sapiens
ttacttacctaaa

SEQ ID NO: 1737941 - DNA, 17 bp, Homo sapiens
ttacttaggttattttg

SEQ ID NO: 1737942 - DNA, 15 bp, Homo sapiens
ttacttctcccctgg

SEQ ID NO: 1737943 - DNA, 23 bp, Homo sapiens
ttacttctcccctgggtcctcca

SEQ ID NO: 1737944 - DNA, 16 bp, Homo sapiens
ttacttgaatttcaaa

SEQ ID NO: 1737945 - DNA, 15 bp, Homo sapiens
ttacttgcttcagtg

SEQ ID NO: 1737946 - DNA, 16 bp, Homo sapiens
ttacttgtctgaggcc

SEQ ID NO: 1737947 - DNA, 15 bp, Homo sapiens
ttacttgttttggat

SEQ ID NO: 1737948 - DNA, 24 bp, Homo sapiens
ttactttagttagcatgcgcgctg

SEQ ID NO: 1737949 - DNA, 12 bp, Homo sapiens
ttactttcagaa

SEQ ID NO: 1737950 - DNA, 18 bp, Homo sapiens
ttactttctgttgccaca

SEQ ID NO: 1737951 - DNA, 14 bp, Homo sapiens
ttactttgtctttt

SEQ ID NO: 1737952 - DNA, 16 bp, Homo sapiens
ttacttttaaactgtg

SEQ ID NO: 1737953 - DNA, 19 bp, Homo sapiens
ttacttttaaactgtgtac

SEQ ID NO: 1737954 - DNA, 19 bp, Homo sapiens
ttacttttaaatattaact

SEQ ID NO: 1737955 - DNA, 23 bp, Homo sapiens
ttacttttaccactatttaagtt

SEQ ID NO: 1737956 - DNA, 12 bp, Homo sapiens
ttacttttccag

SEQ ID NO: 1737957 - DNA, 21 bp, Homo sapiens
ttacttttgcaaactgtcctc

SEQ ID NO: 1737958 - DNA, 18 bp, Homo sapiens
ttacttttttatagctta

SEQ ID NO: 1737959 - DNA, 16 bp, Homo sapiens
ttagaaaaaaattact

SEQ ID NO: 1737960 - DNA, 21 bp, Homo sapiens
ttagaaaaggtgataaaatca

SEQ ID NO: 1737961 - DNA, 21 bp, Homo sapiens
ttagaaaatgacttatttctg

SEQ ID NO: 1737962 - DNA, 22 bp, Homo sapiens
ttagaaaatgacttatttctgc

SEQ ID NO: 1737963 - DNA, 12 bp, Homo sapiens
ttagaaaatgtg

SEQ ID NO: 1737964 - DNA, 13 bp, Homo sapiens
ttagaaaatgtgt

SEQ ID NO: 1737965 - DNA, 22 bp, Homo sapiens
ttagaaaattttgtaaaacaat

SEQ ID NO: 1737966 - DNA, 15 bp, Homo sapiens
ttagaaacagaaata

SEQ ID NO: 1737967 - DNA, 10 bp, Homo sapiens
ttagaaacta

SEQ ID NO: 1737968 - DNA, 19 bp, Homo sapiens
ttagaaactggaaatacta

SEQ ID NO: 1737969 - DNA, 22 bp, Homo sapiens
ttagaaagaagcccaatattat

SEQ ID NO: 1737970 - DNA, 20 bp, Homo sapiens
ttagaaaggacaacagttct

SEQ ID NO: 1737971 - DNA, 13 bp, Homo sapiens
ttagaaatatttt

SEQ ID NO: 1737972 - DNA, 13 bp, Homo sapiens
ttagaaatgtgaa

SEQ ID NO: 1737973 - DNA, 23 bp, Homo sapiens
ttagaaattacctgtggatattt

SEQ ID NO: 1737974 - DNA, 17 bp, Homo sapiens
ttagaaattgcatttcc

SEQ ID NO: 1737975 - DNA, 20 bp, Homo sapiens
ttagaaccagccgtatttta

SEQ ID NO: 1737976 - DNA, 23 bp, Homo sapiens
ttagaacccagcagttaccttaa

SEQ ID NO: 1737977 - DNA, 22 bp, Homo sapiens
ttagaactctagagagccttaa

SEQ ID NO: 1737978 - DNA, 15 bp, Homo sapiens
ttagaagaaatgcta

SEQ ID NO: 1737979 - DNA, 23 bp, Homo sapiens
ttagaagcactacaccttgcctt

SEQ ID NO: 1737980 - DNA, 16 bp, Homo sapiens
ttagaagtgagagaaa

SEQ ID NO: 1737981 - DNA, 17 bp, Homo sapiens
ttagaataaggaggagg

SEQ ID NO: 1737982 - DNA, 12 bp, Homo sapiens
ttagaatctaga

SEQ ID NO: 1737983 - DNA, 14 bp, Homo sapiens
ttagaatctagaaa

SEQ ID NO: 1737984 - DNA, 20 bp, Homo sapiens
ttagaatgaatttatcttta

SEQ ID NO: 1737985 - DNA, 18 bp, Homo sapiens
ttagaatggtgattttaa

SEQ ID NO: 1737986 - DNA, 21 bp, Homo sapiens
ttagaatggtgattttaaatg

SEQ ID NO: 1737987 - DNA, 17 bp, Homo sapiens
ttagaattaaaaaagca

SEQ ID NO: 1737988 - DNA, 12 bp, Homo sapiens
ttagaattattt

SEQ ID NO: 1737989 - DNA, 13 bp, Homo sapiens
ttagaattattta

SEQ ID NO: 1737990 - DNA, 15 bp, Homo sapiens
ttagaattatttaaa

SEQ ID NO: 1737991 - DNA, 21 bp, Homo sapiens
ttagaattgctggatgcattt

SEQ ID NO: 1737992 - DNA, 22 bp, Homo sapiens
ttagacagaacacctatgcaaa

SEQ ID NO: 1737993 - DNA, 14 bp, Homo sapiens
ttagacctcagcct

SEQ ID NO: 1737994 - DNA, 20 bp, Homo sapiens
ttagacgccttccaggtcag

SEQ ID NO: 1737995 - DNA, 14 bp, Homo sapiens
ttagactatttctt

SEQ ID NO: 1737996 - DNA, 14 bp, Homo sapiens
ttagactgtagcct

SEQ ID NO: 1737997 - DNA, 12 bp, Homo sapiens
ttagagaataaa

SEQ ID NO: 1737998 - DNA, 17 bp, Homo sapiens
ttagagagcctgtcacc

SEQ ID NO: 1737999 - DNA, 23 bp, Homo sapiens
ttagagagcctgtcaccagagct

SEQ ID NO: 1738000 - DNA, 15 bp, Homo sapiens
ttagagataattgct

SEQ ID NO: 1738001 - DNA, 20 bp, Homo sapiens
ttagagataggaaactgaag

SEQ ID NO: 1738002 - DNA, 14 bp, Homo sapiens
ttagagcttccaaa

SEQ ID NO: 1738003 - DNA, 17 bp, Homo sapiens
ttagaggaaaaaaatga

SEQ ID NO: 1738004 - DNA, 20 bp, Homo sapiens
ttagaggaaataagaaaaat

SEQ ID NO: 1738005 - DNA, 22 bp, Homo sapiens
ttagaggaaataagaaaaatca

SEQ ID NO: 1738006 - DNA, 15 bp, Homo sapiens
ttagaggcattgtta

SEQ ID NO: 1738007 - DNA, 18 bp, Homo sapiens
ttagagggaggagaatga

SEQ ID NO: 1738008 - DNA, 13 bp, Homo sapiens
ttagaggttttaa

SEQ ID NO: 1738009 - DNA, 19 bp, Homo sapiens
ttagaggttttaaagtgat

SEQ ID NO: 1738010 - DNA, 21 bp, Homo sapiens
ttagaggttttaaagtgatta

SEQ ID NO: 1738011 - DNA, 20 bp, Homo sapiens
ttagagtatacctcctatat

SEQ ID NO: 1738012 - DNA, 20 bp, Homo sapiens
ttagagtccttaagacggaa

SEQ ID NO: 1738013 - DNA, 15 bp, Homo sapiens
ttagagtgtagctgt

SEQ ID NO: 1738014 - DNA, 16 bp, Homo sapiens
ttagataaacacaggc

SEQ ID NO: 1738015 - DNA, 17 bp, Homo sapiens
ttagataaagatttcta

SEQ ID NO: 1738016 - DNA, 14 bp, Homo sapiens
ttagatacagtagt

SEQ ID NO: 1738017 - DNA, 13 bp, Homo sapiens
ttagatagaagaa

SEQ ID NO: 1738018 - DNA, 14 bp, Homo sapiens
ttagatatttgcct

SEQ ID NO: 1738019 - DNA, 21 bp, Homo sapiens
ttagatcccatgtcacctcag

SEQ ID NO: 1738020 - DNA, 23 bp, Homo sapiens
ttagatgatgactcaagattttt

SEQ ID NO: 1738021 - DNA, 15 bp, Homo sapiens
ttagatgtatttttg

SEQ ID NO: 1738022 - DNA, 19 bp, Homo sapiens
ttagatgttgccatgtgtt

SEQ ID NO: 1738023 - DNA, 19 bp, Homo sapiens
ttagattctctgtgtctaa

SEQ ID NO: 1738024 - DNA, 20 bp, Homo sapiens
ttagattctctgtgtctaag

SEQ ID NO: 1738025 - DNA, 20 bp, Homo sapiens
ttagattcttaattcatgag

SEQ ID NO: 1738026 - DNA, 15 bp, Homo sapiens
ttagattgagaaatg

SEQ ID NO: 1738027 - DNA, 19 bp, Homo sapiens
ttagattgagaaatgtgta

SEQ ID NO: 1738028 - DNA, 13 bp, Homo sapiens
ttagattgcaaag

SEQ ID NO: 1738029 - DNA, 23 bp, Homo sapiens
ttagattttgtgtttattcttga

SEQ ID NO: 1738030 - DNA, 16 bp, Homo sapiens
ttagcagacccagctt

SEQ ID NO: 1738031 - DNA, 16 bp, Homo sapiens
ttagcagtttgctttg

SEQ ID NO: 1738032 - DNA, 17 bp, Homo sapiens
ttagcatcaagttctcc

SEQ ID NO: 1738033 - DNA, 17 bp, Homo sapiens
ttagcatgtgttgaaaa

SEQ ID NO: 1738034 - DNA, 13 bp, Homo sapiens
ttagcattaccta

SEQ ID NO: 1738035 - DNA, 14 bp, Homo sapiens
ttagcatttgtata

SEQ ID NO: 1738036 - DNA, 20 bp, Homo sapiens
ttagcatttttatgcagaca

SEQ ID NO: 1738037 - DNA, 20 bp, Homo sapiens
ttagccaactgtttccctgc

SEQ ID NO: 1738038 - DNA, 21 bp, Homo sapiens
ttagccaactgtttccctgct

SEQ ID NO: 1738039 - DNA, 23 bp, Homo sapiens
ttagccaactgtttccctgctga

SEQ ID NO: 1738040 - DNA, 19 bp, Homo sapiens
ttagccaggtaatgtgaat

SEQ ID NO: 1738041 - DNA, 20 bp, Homo sapiens
ttagccatctaatgcttgtt

SEQ ID NO: 1738042 - DNA, 17 bp, Homo sapiens
ttagcccaagaggtctg

SEQ ID NO: 1738043 - DNA, 21 bp, Homo sapiens
ttagccccttggattcctgca

SEQ ID NO: 1738044 - DNA, 21 bp, Homo sapiens
ttagccgcaccctgcacctgc

SEQ ID NO: 1738045 - DNA, 19 bp, Homo sapiens
ttagccgggcatggtggca

SEQ ID NO: 1738046 - DNA, 15 bp, Homo sapiens
ttagcctccctgaaa

SEQ ID NO: 1738047 - DNA, 21 bp, Homo sapiens
ttagcgtagctaagtgaaaag

SEQ ID NO: 1738048 - DNA, 17 bp, Homo sapiens
ttagcgtcaagacattt

SEQ ID NO: 1738049 - DNA, 14 bp, Homo sapiens
ttagcgttctggac

SEQ ID NO: 1738050 - DNA, 18 bp, Homo sapiens
ttagctactgtatgcaaa

SEQ ID NO: 1738051 - DNA, 13 bp, Homo sapiens
ttagctcatttga

SEQ ID NO: 1738052 - DNA, 13 bp, Homo sapiens
ttagctcccctcc

SEQ ID NO: 1738053 - DNA, 22 bp, Homo sapiens
ttagctccctgtggggcaggag

SEQ ID NO: 1738054 - DNA, 19 bp, Homo sapiens
ttagctctggacgtgaaat

SEQ ID NO: 1738055 - DNA, 12 bp, Homo sapiens
ttagctcttaat

SEQ ID NO: 1738056 - DNA, 15 bp, Homo sapiens
ttagctggcgcatat

SEQ ID NO: 1738057 - DNA, 17 bp, Homo sapiens
ttagctgtctgctcaga

SEQ ID NO: 1738058 - DNA, 15 bp, Homo sapiens
ttagctgtgtgaaat

SEQ ID NO: 1738059 - DNA, 18 bp, Homo sapiens
ttagctgtgttattatag

SEQ ID NO: 1738060 - DNA, 16 bp, Homo sapiens
ttagcttagacctcag

SEQ ID NO: 1738061 - DNA, 15 bp, Homo sapiens
ttagcttttacctta

SEQ ID NO: 1738062 - DNA, 16 bp, Homo sapiens
ttagctttttctcaga

SEQ ID NO: 1738063 - DNA, 18 bp, Homo sapiens
ttaggaatctcttcacta

SEQ ID NO: 1738064 - DNA, 19 bp, Homo sapiens
ttaggaatctcttcactac

SEQ ID NO: 1738065 - DNA, 19 bp, Homo sapiens
ttaggaattaagttatctt

SEQ ID NO: 1738066 - DNA, 23 bp, Homo sapiens
ttaggaattaagttatctttaaa

SEQ ID NO: 1738067 - DNA, 12 bp, Homo sapiens
ttaggagaagcc

SEQ ID NO: 1738068 - DNA, 13 bp, Homo sapiens
ttaggagaagcca

SEQ ID NO: 1738069 - DNA, 20 bp, Homo sapiens
ttaggaggctgcatgctctg

SEQ ID NO: 1738070 - DNA, 21 bp, Homo sapiens
ttaggaggctgcatgctctgg

SEQ ID NO: 1738071 - DNA, 21 bp, Homo sapiens
ttaggagttcgagaccagcct

SEQ ID NO: 1738072 - DNA, 23 bp, Homo sapiens
ttaaggataaatcataaagtcag

SEQ ID NO: 1738073 - DNA, 15 bp, Homo sapiens
ttaaggatggatggc

SEQ ID NO: 1738074 - DNA, 21 bp, Homo sapiens
ttaaggatggatggcaccctg

SEQ ID NO: 1738075 - DNA, 18 bp, Homo sapiens
ttaaggcccaacattaaa

SEQ ID NO: 1738076 - DNA, 15 bp, Homo sapiens
ttaaggcctgaatca

SEQ ID NO: 1738077 - DNA, 16 bp, Homo sapiens
ttaaggctctgtgcct

SEQ ID NO: 1738078 - DNA, 21 bp, Homo sapiens
ttaagggccggggatggatct

SEQ ID NO: 1738079 - DNA, 17 bp, Homo sapiens
ttaaggggaagaatgaa

SEQ ID NO: 1738080 - DNA, 20 bp, Homo sapiens
ttaaggggaagaatgaaagc

SEQ ID NO: 1738081 - DNA, 20 bp, Homo sapiens
ttaaggtatatttagttgca

SEQ ID NO: 1738082 - DNA, 19 bp, Homo sapiens
ttaaggtgagcataaatca

SEQ ID NO: 1738083 - DNA, 17 bp, Homo sapiens
ttaaggtgggtccagga

SEQ ID NO: 1738084 - DNA, 14 bp, Homo sapiens
ttaaggtttgcaaa

SEQ ID NO: 1738085 - DNA, 22 bp, Homo sapiens
ttaagtaattgcctacaataaa

SEQ ID NO: 1738086 - DNA, 19 bp, Homo sapiens
ttaagtagaacaaaaaacc

SEQ ID NO: 1738087 - DNA, 17 bp, Homo sapiens
ttaagtatatagtatat

SEQ ID NO: 1738088 - DNA, 19 bp, Homo sapiens
ttaagtatcttgtgcttct

SEQ ID NO: 1738089 - DNA, 16 bp, Homo sapiens
ttaagtatttatatat

SEQ ID NO: 1738090 - DNA, 19 bp, Homo sapiens
ttaagtatttatatattta

SEQ ID NO: 1738091 - DNA, 14 bp, Homo sapiens
ttaagtcagatttt

SEQ ID NO: 1738092 - DNA, 15 bp, Homo sapiens
ttaagtcttccttaa

SEQ ID NO: 1738093 - DNA, 20 bp, Homo sapiens
ttaagtgaaagagattactt

SEQ ID NO: 1738094 - DNA, 19 bp, Homo sapiens
ttaagtgaatacattaacg

SEQ ID NO: 1738095 - DNA, 18 bp, Homo sapiens
ttaagtgacacagacatt

SEQ ID NO: 1738096 - DNA, 20 bp, Homo sapiens
ttaagtgacacagacatttt

SEQ ID NO: 1738097 - DNA, 18 bp, Homo sapiens
ttaagtgatttaaaaaaa

SEQ ID NO: 1738098 - DNA, 16 bp, Homo sapiens
ttaagtgctttgtaat

SEQ ID NO: 1738099 - DNA, 18 bp, Homo sapiens
ttaagttgctgatgaact

SEQ ID NO: 1738100 - DNA, 13 bp, Homo sapiens
ttaagttgtcaaa

SEQ ID NO: 1738101 - DNA, 14 bp, Homo sapiens
ttaagtttgaagag

SEQ ID NO: 1738102 - DNA, 17 bp, Homo sapiens
ttaagtttttttcctct

SEQ ID NO: 1738103 - DNA, 13 bp, Homo sapiens
ttaataaaaagga

SEQ ID NO: 1738104 - DNA, 14 bp, Homo sapiens
ttaataaaaaggaa

SEQ ID NO: 1738105 - DNA, 15 bp, Homo sapiens
ttaataaaaatacac

SEQ ID NO: 1738106 - DNA, 21 bp, Homo sapiens
ttaataaaactgcgaggacat

SEQ ID NO: 1738107 - DNA, 22 bp, Homo sapiens
ttaataaagacgatttgtcagt

SEQ ID NO: 1738108 - DNA, 14 bp, Homo sapiens
ttaataaagatgag

SEQ ID NO: 1738109 - DNA, 12 bp, Homo sapiens
ttaataaagcat

SEQ ID NO: 1738110 - DNA, 15 bp, Homo sapiens
ttaataagaacagat

SEQ ID NO: 1738111 - DNA, 16 bp, Homo sapiens
ttaataagaacttgaa

SEQ ID NO: 1738112 - DNA, 18 bp, Homo sapiens
ttaataagatatttagta

SEQ ID NO: 1738113 - DNA, 13 bp, Homo sapiens
ttaataatattta

SEQ ID NO: 1738114 - DNA, 17 bp, Homo sapiens
ttaatacagctcagtaa

SEQ ID NO: 1738115 - DNA, 17 bp, Homo sapiens
ttaatacaggaaattga

SEQ ID NO: 1738116 - DNA, 21 bp, Homo sapiens
ttaatacatgcaacagaagtg

SEQ ID NO: 1738117 - DNA, 21 bp, Homo sapiens
ttaataccctgcaatgtaatt

SEQ ID NO: 1738118 - DNA, 22 bp, Homo sapiens
ttaatactcaaatgagtaacat

SEQ ID NO: 1738119 - DNA, 23 bp, Homo sapiens
ttaatactgttattctttgcact

SEQ ID NO: 1738120 - DNA, 22 bp, Homo sapiens
ttaatagcagcctttctctctt

SEQ ID NO: 1738121 - DNA, 19 bp, Homo sapiens
ttaatagtttgaagtgcct

SEQ ID NO: 1738122 - DNA, 23 bp, Homo sapiens
ttaatataaagtagtcctgtgaa

SEQ ID NO: 1738123 - DNA, 15 bp, Homo sapiens
ttaatatatgtatta

SEQ ID NO: 1738124 - DNA, 18 bp, Homo sapiens
ttaatatattaaaattcc

SEQ ID NO: 1738125 - DNA, 13 bp, Homo sapiens
ttaatatatttcc

SEQ ID NO: 1738126 - DNA, 16 bp, Homo sapiens
ttaatatctggcactg

SEQ ID NO: 1738127 - DNA, 19 bp, Homo sapiens
ttaatatgagcttcaatat

SEQ ID NO: 1738128 - DNA, 13 bp, Homo sapiens
ttaatattatata

SEQ ID NO: 1738129 - DNA, 18 bp, Homo sapiens
ttaatattgatatgctta

SEQ ID NO: 1738130 - DNA, 15 bp, Homo sapiens
ttaatatttaccaaa

SEQ ID NO: 1738131 - DNA, 16 bp, Homo sapiens
ttaatattttgtattt

SEQ ID NO: 1738132 - DNA, 12 bp, Homo sapiens
ttaatcaaaggc

SEQ ID NO: 1738133 - DNA, 14 bp, Homo sapiens
ttaatcaaaggcat

SEQ ID NO: 1738134 - DNA, 13 bp, Homo sapiens
ttaatcaactgta

SEQ ID NO: 1738135 - DNA, 17 bp, Homo sapiens
ttaatcatgaatgtgta

SEQ ID NO: 1738136 - DNA, 15 bp, Homo sapiens
ttaatccaatatttt

SEQ ID NO: 1738137 - DNA, 12 bp, Homo sapiens
ttaatccaatgg

SEQ ID NO: 1738138 - DNA, 22 bp, Homo sapiens
ttaatcctttgttttctgacta

SEQ ID NO: 1738139 - DNA, 23 bp, Homo sapiens
ttaatcctttgttttctgactaa

SEQ ID NO: 1738140 - DNA, 12 bp, Homo sapiens
ttaatctctaaa

SEQ ID NO: 1738141 - DNA, 18 bp, Homo sapiens
ttaatctctaaaattcta

SEQ ID NO: 1738142 - DNA, 21 bp, Homo sapiens
ttaatcttagtgtatgattac

SEQ ID NO: 1738143 - DNA, 20 bp, Homo sapiens
ttaatctttctacctctttt

SEQ ID NO: 1738144 - DNA, 17 bp, Homo sapiens
ttaatctttctttacct

SEQ ID NO: 1738145 - DNA, 20 bp, Homo sapiens
ttaatcttttcttatttttg

SEQ ID NO: 1738146 - DNA, 23 bp, Homo sapiens
ttaatcttttttttaaaaaaact

SEQ ID NO: 1738147 - DNA, 15 bp, Homo sapiens
ttaatgaaaatgtca

SEQ ID NO: 1738148 - DNA, 18 bp, Homo sapiens
ttaatgaaagactgtaca

SEQ ID NO: 1738149 - DNA, 19 bp, Homo sapiens
ttaatgaaagactgtacaa

SEQ ID NO: 1738150 - DNA, 21 bp, Homo sapiens
ttaatgaaagggtttgtaata

SEQ ID NO: 1738151 - DNA, 17 bp, Homo sapiens
ttaatgaaatcaaatgt

SEQ ID NO: 1738152 - DNA, 23 bp, Homo sapiens
ttaatgaatcacatttttttatg

SEQ ID NO: 1738153 - DNA, 15 bp, Homo sapiens
ttaatgacattcccc

SEQ ID NO: 1738154 - DNA, 11 bp, Homo sapiens
ttaatgactta

SEQ ID NO: 1738155 - DNA, 22 bp, Homo sapiens
ttaatgagaatagaaacgtaaa

SEQ ID NO: 1738156 - DNA, 20 bp, Homo sapiens
ttaatgagatatttgtattt

SEQ ID NO: 1738157 - DNA, 16 bp, Homo sapiens
ttaatgagccatcact

SEQ ID NO: 1738158 - DNA, 19 bp, Homo sapiens
ttaatgagtgcacctgcct

SEQ ID NO: 1738159 - DNA, 17 bp, Homo sapiens
ttaatgataaactcaga

SEQ ID NO: 1738160 - DNA, 21 bp, Homo sapiens
ttaatgataagtaaatgctag

SEQ ID NO: 1738161 - DNA, 20 bp, Homo sapiens
ttaatgcatgttaggaaaat

SEQ ID NO: 1738162 - DNA, 23 bp, Homo sapiens
ttaatgcctctcccgcaccaggc

SEQ ID NO: 1738163 - DNA, 15 bp, Homo sapiens
ttaatgcctttaaag

SEQ ID NO: 1738164 - DNA, 14 bp, Homo sapiens
ttaatgctatttga

SEQ ID NO: 1738165 - DNA, 21 bp, Homo sapiens
ttaatgctatttgaacaagtg

SEQ ID NO: 1738166 - DNA, 16 bp, Homo sapiens
ttaatgctgtttctaa

SEQ ID NO: 1738167 - DNA, 24 bp, Homo sapiens
ttaatgctgtttctaagaaaatgt

SEQ ID NO: 1738168 - DNA, 13 bp, Homo sapiens
ttaatgcttcatt

SEQ ID NO: 1738169 - DNA, 13 bp, Homo sapiens
ttaatggaaagtt

SEQ ID NO: 1738170 - DNA, 23 bp, Homo sapiens
ttaatggcaaggcagccctgtct

SEQ ID NO: 1738171 - DNA, 16 bp, Homo sapiens
ttaatggcctggaggg

SEQ ID NO: 1738172 - DNA, 15 bp, Homo sapiens
ttaatgtatgttacc

SEQ ID NO: 1738173 - DNA, 17 bp, Homo sapiens
ttaatgtatgttaccaa

SEQ ID NO: 1738174 - DNA, 17 bp, Homo sapiens
ttaatgtcattgctaaa

SEQ ID NO: 1738175 - DNA, 13 bp, Homo sapiens
ttaatgttactca

SEQ ID NO: 1738176 - DNA, 17 bp, Homo sapiens
ttaatgttgaacaaaat

SEQ ID NO: 1738177 - DNA, 11 bp, Homo sapiens
ttaatgtttct

SEQ ID NO: 1738178 - DNA, 16 bp, Homo sapiens
ttaatgttttcaaaag

SEQ ID NO: 1738179 - DNA, 11 bp, Homo sapiens
ttaatgttttt

SEQ ID NO: 1738180 - DNA, 20 bp, Homo sapiens
ttaattaatttggagcacaa

SEQ ID NO: 1738181 - DNA, 17 bp, Homo sapiens
ttaattacatacagatt

SEQ ID NO: 1738182 - DNA, 13 bp, Homo sapiens
ttaattaccttta

SEQ ID NO: 1738183 - DNA, 14 bp, Homo sapiens
ttaattactggaat

SEQ ID NO: 1738184 - DNA, 15 bp, Homo sapiens
ttaattactgtgtgt

SEQ ID NO: 1738185 - DNA, 19 bp, Homo sapiens
ttaattactgtgtgtgagc

SEQ ID NO: 1738186 - DNA, 19 bp, Homo sapiens
ttaattaggggttgctaag

SEQ ID NO: 1738187 - DNA, 20 bp, Homo sapiens
ttaattaggggttgctaaga

SEQ ID NO: 1738188 - DNA, 15 bp, Homo sapiens
ttaattatcttttct

SEQ ID NO: 1738189 - DNA, 16 bp, Homo sapiens
tgttttcccacgagga

SEQ ID NO: 1738190 - DNA, 19 bp, Homo sapiens
tgttttccgtgaaaacgga

SEQ ID NO: 1738191 - DNA, 12 bp, Homo sapiens
tgttttctgaaa

SEQ ID NO: 1738192 - DNA, 18 bp, Homo sapiens
tgttttctgactagttta

SEQ ID NO: 1738193 - DNA, 15 bp, Homo sapiens
tgttttctttgagga

SEQ ID NO: 1738194 - DNA, 19 bp, Homo sapiens
tgttttgaatctcataatt

SEQ ID NO: 1738195 - DNA, 17 bp, Homo sapiens
tgttttgacggatgatt

SEQ ID NO: 1738196 - DNA, 19 bp, Homo sapiens
tgttttgagctttccatgt

SEQ ID NO: 1738197 - DNA, 16 bp, Homo sapiens
tgttttgagtcagtgc

SEQ ID NO: 1738198 - DNA, 13 bp, Homo sapiens
tgttttgcatgta

SEQ ID NO: 1738199 - DNA, 12 bp, Homo sapiens
tgttttgcattc

SEQ ID NO: 1738200 - DNA, 14 bp, Homo sapiens
tgtttctatactgt

SEQ ID NO: 1738201 - DNA, 14 bp, Homo sapiens
tgtttctcaaaaga

SEQ ID NO: 1738202 - DNA, 19 bp, Homo sapiens
tgtttctcaaaagaggtta

SEQ ID NO: 1738203 - DNA, 20 bp, Homo sapiens
tgtttctcaaaagaggttac

SEQ ID NO: 1738204 - DNA, 19 bp, Homo sapiens
tgtttctcacattgctgta

SEQ ID NO: 1738205 - DNA, 16 bp, Homo sapiens
tgtttctccccctggg

SEQ ID NO: 1738206 - DNA, 20 bp, Homo sapiens
tggactgtgcctcaggccag

SEQ ID NO: 1738207 - DNA, 18 bp, Homo sapiens
tggactgttcacggcaga

SEQ ID NO: 1738208 - DNA, 17 bp, Homo sapiens
tggactgttttctctcg

SEQ ID NO: 1738209 - DNA, 20 bp, Homo sapiens
tggactgttttctctcggct

SEQ ID NO: 1738210 - DNA, 22 bp, Homo sapiens
tggactgttttctctcggctcc

SEQ ID NO: 1738211 - DNA, 19 bp, Homo sapiens
tggacttacaaaatgccaa

SEQ ID NO: 1738212 - DNA, 13 bp, Homo sapiens
tggacttaggaag

SEQ ID NO: 1738213 - DNA, 14 bp, Homo sapiens
tggacttcaaagca

SEQ ID NO: 1738214 - DNA, 19 bp, Homo sapiens
tggacttcaaagcaagctg

SEQ ID NO: 1738215 - DNA, 17 bp, Homo sapiens
tggacttcagtgtgtgt

SEQ ID NO: 1738216 - DNA, 14 bp, Homo sapiens
tggacttcctgtca

SEQ ID NO: 1738217 - DNA, 15 bp, Homo sapiens
tggacttcctgtcat

SEQ ID NO: 1738218 - DNA, 14 bp, Homo sapiens
tggacttgcctctg

SEQ ID NO: 1738219 - DNA, 14 bp, Homo sapiens
tggacttgtatatt

SEQ ID NO: 1738220 - DNA, 14 bp, Homo sapiens
tggacttgtatgct

SEQ ID NO: 1738221 - DNA, 19 bp, Homo sapiens
tggacttgtatgctgccca

SEQ ID NO: 1738222 - DNA, 16 bp, Homo sapiens
tggacttgtgattggc

SEQ ID NO: 1738223 - DNA, 20 bp, Homo sapiens
tggacttgtgattggctgca

SEQ ID NO: 1738224 - DNA, 14 bp, Homo sapiens
tggactttcctgca

SEQ ID NO: 1738225 - DNA, 21 bp, Homo sapiens
tggacttttcgttaacattga

SEQ ID NO: 1738226 - DNA, 19 bp, Homo sapiens
tggagaaaattggaactct

SEQ ID NO: 1738227 - DNA, 17 bp, Homo sapiens
tggagaaactgtagtct

SEQ ID NO: 1738228 - DNA, 11 bp, Homo sapiens
tggagaaagaa

SEQ ID NO: 1738229 - DNA, 13 bp, Homo sapiens
tggagaaagaagt

SEQ ID NO: 1738230 - DNA, 14 bp, Homo sapiens
tggagaaagaagtg

SEQ ID NO: 1738231 - DNA, 18 bp, Homo sapiens
tggagaaagagctgcctg

SEQ ID NO: 1738232 - DNA, 19 bp, Homo sapiens
tggagaaagagctgcctgg

SEQ ID NO: 1738233 - DNA, 21 bp, Homo sapiens
tggagaaagagctgcctggat

SEQ ID NO: 1738234 - DNA, 18 bp, Homo sapiens
tggagaaagcactgacct

SEQ ID NO: 1738235 - DNA, 18 bp, Homo sapiens
tggagaaatgtcataaat

SEQ ID NO: 1738236 - DNA, 20 bp, Homo sapiens
tggagaacagtggttgcctg

SEQ ID NO: 1738237 - DNA, 23 bp, Homo sapiens
tggagaacagtggttgcctgggg

SEQ ID NO: 1738238 - DNA, 14 bp, Homo sapiens
tggagaactagaga

SEQ ID NO: 1738239 - DNA, 16 bp, Homo sapiens
tggagaagaatggctt

SEQ ID NO: 1738240 - DNA, 17 bp, Homo sapiens
tggagaagatcgcatgg

SEQ ID NO: 1738241 - DNA, 19 bp, Homo sapiens
tggagaagccacaggcctg

SEQ ID NO: 1738242 - DNA, 22 bp, Homo sapiens
tggagaagccacaggcctgaga

SEQ ID NO: 1738243 - DNA, 14 bp, Homo sapiens
tggagaagctctgt

SEQ ID NO: 1738244 - DNA, 21 bp, Homo sapiens
tggagaagggagggtggccag

SEQ ID NO: 1738245 - DNA, 21 bp, Homo sapiens
tggagaaggtattagcaaagc

SEQ ID NO: 1738246 - DNA, 22 bp, Homo sapiens
tggagacagggtctcgctctgt

SEQ ID NO: 1738247 - DNA, 20 bp, Homo sapiens
tggagaccgcttcacccctg

SEQ ID NO: 1738248 - DNA, 17 bp, Homo sapiens
tggagacgtggtgggac

SEQ ID NO: 1738249 - DNA, 22 bp, Homo sapiens
tggagacgtttataaacagaaa

SEQ ID NO: 1738250 - DNA, 18 bp, Homo sapiens
tggagactcctgccctgt

SEQ ID NO: 1738251 - DNA, 16 bp, Homo sapiens
tggagactcctggtct

SEQ ID NO: 1738252 - DNA, 16 bp, Homo sapiens
tggagacttagggcac

SEQ ID NO: 1738253 - DNA, 21 bp, Homo sapiens
tggagagaaggcctccctagc

SEQ ID NO: 1738254 - DNA, 15 bp, Homo sapiens
tggagagagaggctg

SEQ ID NO: 1738255 - DNA, 12 bp, Homo sapiens
tggagagagggg

SEQ ID NO: 1738256 - DNA, 21 bp, Homo sapiens
tggagagcacagcatgcctta

SEQ ID NO: 1738257 - DNA, 14 bp, Homo sapiens
tggagagcagcagg

SEQ ID NO: 1738258 - DNA, 21 bp, Homo sapiens
tggagagcccggcgcccctgc

SEQ ID NO: 1738259 - DNA, 20 bp, Homo sapiens
tggagagcctcttagtgatt

SEQ ID NO: 1738260 - DNA, 11 bp, Homo sapiens
tggagagctgg

SEQ ID NO: 1738261 - DNA, 14 bp, Homo sapiens
tggagagctggtgc

SEQ ID NO: 1738262 - DNA, 16 bp, Homo sapiens
tggagagctggtgccc

SEQ ID NO: 1738263 - DNA, 13 bp, Homo sapiens
tggagagctgtct

SEQ ID NO: 1738264 - DNA, 20 bp, Homo sapiens
tggagagctgtcttcctgtg

SEQ ID NO: 1738265 - DNA, 11 bp, Homo sapiens
tggagaggaga

SEQ ID NO: 1738266 - DNA, 21 bp, Homo sapiens
tggagaggagagtggcaggtg

SEQ ID NO: 1738267 - DNA, 20 bp, Homo sapiens
tggagagggacagcccactg

SEQ ID NO: 1738268 - DNA, 16 bp, Homo sapiens
tggagagtttcctgaa

SEQ ID NO: 1738269 - DNA, 17 bp, Homo sapiens
tggagagtttcctgaaa

SEQ ID NO: 1738270 - DNA, 21 bp, Homo sapiens
tggagataaaagcaattctga

SEQ ID NO: 1738271 - DNA, 20 bp, Homo sapiens
tggagataaagatttcttga

SEQ ID NO: 1738272 - DNA, 23 bp, Homo sapiens
tggagatatttatggggggagaa

SEQ ID NO: 1738273 - DNA, 20 bp, Homo sapiens
tggagatcagaaagtgacat

SEQ ID NO: 1738274 - DNA, 20 bp, Homo sapiens
tggagatcctcctgcagacc

SEQ ID NO: 1738275 - DNA, 15 bp, Homo sapiens
tggagattataataa

SEQ ID NO: 1738276 - DNA, 16 bp, Homo sapiens
tggagattataataaa

SEQ ID NO: 1738277 - DNA, 15 bp, Homo sapiens
tggagcaaagctgat

SEQ ID NO: 1738278 - DNA, 18 bp, Homo sapiens
tggagcaacctactgtct

SEQ ID NO: 1738279 - DNA, 13 bp, Homo sapiens
tggagcaactgaa

SEQ ID NO: 1738280 - DNA, 18 bp, Homo sapiens
tggagcaagaaggaagga

SEQ ID NO: 1738281 - DNA, 15 bp, Homo sapiens
tggagcacaaaattc

SEQ ID NO: 1738282 - DNA, 17 bp, Homo sapiens
tggagcacaaaattcaa

SEQ ID NO: 1738283 - DNA, 17 bp, Homo sapiens
tggagcaccaggcacga

SEQ ID NO: 1738284 - DNA, 13 bp, Homo sapiens
tggagcagcagcc

SEQ ID NO: 1738285 - DNA, 12 bp, Homo sapiens
tggagcagccag

SEQ ID NO: 1738286 - DNA, 13 bp, Homo sapiens
tggagcagccaga

SEQ ID NO: 1738287 - DNA, 16 bp, Homo sapiens
tggagcagccagagct

SEQ ID NO: 1738288 - DNA, 17 bp, Homo sapiens
tggagcagccagagctg

SEQ ID NO: 1738289 - DNA, 20 bp, Homo sapiens
tggagcagccagagctgtgc

SEQ ID NO: 1738290 - DNA, 17 bp, Homo sapiens
tggagccaagggttcag

SEQ ID NO: 1738291 - DNA, 21 bp, Homo sapiens
tggagccaagtggtccagcgt

SEQ ID NO: 1738292 - DNA, 17 bp, Homo sapiens
tggagccactcctgtcc

SEQ ID NO: 1738293 - DNA, 19 bp, Homo sapiens
tggagccactcctgtcccg

SEQ ID NO: 1738294 - DNA, 11 bp, Homo sapiens
tggagccaggg

SEQ ID NO: 1738295 - DNA, 16 bp, Homo sapiens
tggagccagggcagag

SEQ ID NO: 1738296 - DNA, 18 bp, Homo sapiens
tggagccagggcagagga

SEQ ID NO: 1738297 - DNA, 22 bp, Homo sapiens
tggagccagggcagaggaatgt

SEQ ID NO: 1738298 - DNA, 11 bp, Homo sapiens
tggagccaggt

SEQ ID NO: 1738299 - DNA, 21 bp, Homo sapiens
tggagcccataggccaccccc

SEQ ID NO: 1738300 - DNA, 13 bp, Homo sapiens
tggagccccacct

SEQ ID NO: 1738301 - DNA, 14 bp, Homo sapiens
tggagccccatcag

SEQ ID NO: 1738302 - DNA, 18 bp, Homo sapiens
tggagcccgaggcaccag

SEQ ID NO: 1738303 - DNA, 14 bp, Homo sapiens
tggagcccgcactg

SEQ ID NO: 1738304 - DNA, 18 bp, Homo sapiens
tggagcccgcactgtccc

SEQ ID NO: 1738305 - DNA, 15 bp, Homo sapiens
tggagcccttgggtt

SEQ ID NO: 1738306 - DNA, 12 bp, Homo sapiens
tggagccgaggc

SEQ ID NO: 1738307 - DNA, 13 bp, Homo sapiens
tggagcctgcagg

SEQ ID NO: 1738308 - DNA, 23 bp, Homo sapiens
tggagcctgcagggtggtgctgg

SEQ ID NO: 1738309 - DNA, 15 bp, Homo sapiens
tggagcctgccaaga

SEQ ID NO: 1738310 - DNA, 18 bp, Homo sapiens
tggagcctggcacaggac

SEQ ID NO: 1738311 - DNA, 21 bp, Homo sapiens
tggagcctggcacaggactga

SEQ ID NO: 1738312 - DNA, 14 bp, Homo sapiens
tggagcgcacctgc

SEQ ID NO: 1738313 - DNA, 23 bp, Homo sapiens
tggagcgggcatggccgggccct

SEQ ID NO: 1738314 - DNA, 17 bp, Homo sapiens
tggagctatcagtgctt

SEQ ID NO: 1738315 - DNA, 23 bp, Homo sapiens
tggagctctgtgggtctctggaa

SEQ ID NO: 1738316 - DNA, 14 bp, Homo sapiens
tggagctcttggaa

SEQ ID NO: 1738317 - DNA, 21 bp, Homo sapiens
ttaaattgctcacagttatta

SEQ ID NO: 1738318 - DNA, 17 bp, Homo sapiens
ttaaatttcttatgtga

SEQ ID NO: 1738319 - DNA, 19 bp, Homo sapiens
ttaaatttcttatgtgaca

SEQ ID NO: 1738320 - DNA, 20 bp, Homo sapiens
ttaaattttaccctttagac

SEQ ID NO: 1738321 - DNA, 14 bp, Homo sapiens
ttaaattttgtgtc

SEQ ID NO: 1738322 - DNA, 16 bp, Homo sapiens
ttaaattttgtgtctc

SEQ ID NO: 1738323 - DNA, 14 bp, Homo sapiens
ttaaattttttggc

SEQ ID NO: 1738324 - DNA, 19 bp, Homo sapiens
ttaacaaaccaacatcttt

SEQ ID NO: 1738325 - DNA, 12 bp, Homo sapiens
ttaacaaatgag

SEQ ID NO: 1738326 - DNA, 22 bp, Homo sapiens
ttaacaacaataacactgtctc

SEQ ID NO: 1738327 - DNA, 18 bp, Homo sapiens
ttaacaactgctcttact

SEQ ID NO: 1738328 - DNA, 21 bp, Homo sapiens
ttaacaactgtagcaagaact

SEQ ID NO: 1738329 - DNA, 19 bp, Homo sapiens
ttaacaagaggggaaaaca

SEQ ID NO: 1738330 - DNA, 21 bp, Homo sapiens
ttaacaaggaatgcctgtgcc

SEQ ID NO: 1738331 - DNA, 13 bp, Homo sapiens
ttaacaatgtatt

SEQ ID NO: 1738332 - DNA, 21 bp, Homo sapiens
ttaacaatgtattttaataac

SEQ ID NO: 1738333 - DNA, 20 bp, Homo sapiens
ttaacacaatgtgaatttct

SEQ ID NO: 1738334 - DNA, 20 bp, Homo sapiens
ttaacacgctgcctggtctg

SEQ ID NO: 1738335 - DNA, 18 bp, Homo sapiens
ttaacactggttaaatta

SEQ ID NO: 1738336 - DNA, 15 bp, Homo sapiens
ttaacacttaaattt

SEQ ID NO: 1738337 - DNA, 17 bp, Homo sapiens
ttaacactttgtattac

SEQ ID NO: 1738338 - DNA, 21 bp, Homo sapiens
ttaacactttgtattacttag

SEQ ID NO: 1738339 - DNA, 17 bp, Homo sapiens
ttaacagaaactttcaa

SEQ ID NO: 1738340 - DNA, 21 bp, Homo sapiens
ttaacagaaactttcaaaagg

SEQ ID NO: 1738341 - DNA, 17 bp, Homo sapiens
ttaacagaaattgtata

SEQ ID NO: 1738342 - DNA, 19 bp, Homo sapiens
ttaacagaaattgtatatt

SEQ ID NO: 1738343 - DNA, 16 bp, Homo sapiens
ttaacagtcatttaaa

SEQ ID NO: 1738344 - DNA, 17 bp, Homo sapiens
ttaacagtcatttaaaa

SEQ ID NO: 1738345 - DNA, 15 bp, Homo sapiens
ttaacagttgtattt

SEQ ID NO: 1738346 - DNA, 15 bp, Homo sapiens
ttaacatacatctaa

SEQ ID NO: 1738347 - DNA, 22 bp, Homo sapiens
ttaacatgggctcttcactagt

SEQ ID NO: 1738348 - DNA, 13 bp, Homo sapiens
ttaacattattta

SEQ ID NO: 1738349 - DNA, 19 bp, Homo sapiens
ttaacattccaagactcta

SEQ ID NO: 1738350 - DNA, 19 bp, Homo sapiens
ttaacattgaccaagaact

SEQ ID NO: 1738351 - DNA, 23 bp, Homo sapiens
ttaacattgaccaagaactgcat

SEQ ID NO: 1738352 - DNA, 16 bp, Homo sapiens
ttaacccacctctcct

SEQ ID NO: 1738353 - DNA, 15 bp, Homo sapiens
ttaaccctaatcttt

SEQ ID NO: 1738354 - DNA, 21 bp, Homo sapiens
ttaaccggtaagagtttcagt

SEQ ID NO: 1738355 - DNA, 16 bp, Homo sapiens
ttaacctagatgttta

SEQ ID NO: 1738356 - DNA, 22 bp, Homo sapiens
ttaacctagatgtttaacaaat

SEQ ID NO: 1738357 - DNA, 21 bp, Homo sapiens
ttaaccttaaaattgatatta

SEQ ID NO: 1738358 - DNA, 21 bp, Homo sapiens
ttaaccttactaattatacta

SEQ ID NO: 1738359 - DNA, 14 bp, Homo sapiens
ttaacctttgctat

SEQ ID NO: 1738360 - DNA, 21 bp, Homo sapiens
ttaacctttgctatgtaaggg

SEQ ID NO: 1738361 - DNA, 17 bp, Homo sapiens
ttaacgtcatctcaggg

SEQ ID NO: 1738362 - DNA, 20 bp, Homo sapiens
ttaactaatttgaatgtggt

SEQ ID NO: 1738363 - DNA, 18 bp, Homo sapiens
ttaactacataaaaatag

SEQ ID NO: 1738364 - DNA, 18 bp, Homo sapiens
ttaactactatattgatt

SEQ ID NO: 1738365 - DNA, 17 bp, Homo sapiens
ttaactataaggtgcct

SEQ ID NO: 1738366 - DNA, 12 bp, Homo sapiens
ttaactatttca

SEQ ID NO: 1738367 - DNA, 18 bp, Homo sapiens
ttaactcaccagatttac

SEQ ID NO: 1738368 - DNA, 12 bp, Homo sapiens
ttaactcagtct

SEQ ID NO: 1738369 - DNA, 18 bp, Homo sapiens
ttaactccctccaccagc

SEQ ID NO: 1738370 - DNA, 20 bp, Homo sapiens
ttaactccctccaccagcct

SEQ ID NO: 1738371 - DNA, 13 bp, Homo sapiens
ttaactcttttgg

SEQ ID NO: 1738372 - DNA, 21 bp, Homo sapiens
ttaactgacaagccatcttga

SEQ ID NO: 1738373 - DNA, 13 bp, Homo sapiens
ttaactgcatata

SEQ ID NO: 1738374 - DNA, 16 bp, Homo sapiens
ttaactggtgaagaga

SEQ ID NO: 1738375 - DNA, 22 bp, Homo sapiens
ttaactgtccgtaagcagtata

SEQ ID NO: 1738376 - DNA, 22 bp, Homo sapiens
ttaacttaaattttaatttatt

SEQ ID NO: 1738377 - DNA, 17 bp, Homo sapiens
ttaacttatttagagat

SEQ ID NO: 1738378 - DNA, 21 bp, Homo sapiens
ttaacttcttgcttctttcta

SEQ ID NO: 1738379 - DNA, 16 bp, Homo sapiens
ttaacttgaagaaacc

SEQ ID NO: 1738380 - DNA, 18 bp, Homo sapiens
ttaacttggtcagagcca

SEQ ID NO: 1738381 - DNA, 19 bp, Homo sapiens
ttaacttggtcagagccac

SEQ ID NO: 1738382 - DNA, 13 bp, Homo sapiens
ttaacttgtatat

SEQ ID NO: 1738383 - DNA, 14 bp, Homo sapiens
ttaactttaatgtt

SEQ ID NO: 1738384 - DNA, 23 bp, Homo sapiens
ttaactttatcacattatttgca

SEQ ID NO: 1738385 - DNA, 18 bp, Homo sapiens
ttaactttttttcttcta

SEQ ID NO: 1738386 - DNA, 19 bp, Homo sapiens
ttaagaaaatacaataaac

SEQ ID NO: 1738387 - DNA, 14 bp, Homo sapiens
ttaagaaacactga

SEQ ID NO: 1738388 - DNA, 13 bp, Homo sapiens
ttaagaaaccttg

SEQ ID NO: 1738389 - DNA, 15 bp, Homo sapiens
ttaagaaagcactta

SEQ ID NO: 1738390 - DNA, 12 bp, Homo sapiens
ttaagaaataaa

SEQ ID NO: 1738391 - DNA, 15 bp, Homo sapiens
ttaagaaatagaatt

SEQ ID NO: 1738392 - DNA, 13 bp, Homo sapiens
ttaagaactgtgt

SEQ ID NO: 1738393 - DNA, 23 bp, Homo sapiens
ttaagaatgagtttcttagactt

SEQ ID NO: 1738394 - DNA, 19 bp, Homo sapiens
ttaagaattgagtaatggt

SEQ ID NO: 1738395 - DNA, 14 bp, Homo sapiens
ttaagacaaatggg

SEQ ID NO: 1738396 - DNA, 22 bp, Homo sapiens
ttaagacaaatgggactgatgt

SEQ ID NO: 1738397 - DNA, 15 bp, Homo sapiens
ttaagacagtgtaca

SEQ ID NO: 1738398 - DNA, 22 bp, Homo sapiens
ttaagacctactgttctaaagc

SEQ ID NO: 1738399 - DNA, 14 bp, Homo sapiens
ttaagactgatttt

SEQ ID NO: 1738400 - DNA, 18 bp, Homo sapiens
ttaagactgattttaata

SEQ ID NO: 1738401 - DNA, 24 bp, Homo sapiens
ttaagagcaaatcaattctagtca

SEQ ID NO: 1738402 - DNA, 23 bp, Homo sapiens
ttaagagcagaacagatctttta

SEQ ID NO: 1738403 - DNA, 14 bp, Homo sapiens
ttaagagtccaaga

SEQ ID NO: 1738404 - DNA, 20 bp, Homo sapiens
ttaagataacttactgtata

SEQ ID NO: 1738405 - DNA, 17 bp, Homo sapiens
ttaagatagtgtaactt

SEQ ID NO: 1738406 - DNA, 11 bp, Homo sapiens
ttaagatatcc

SEQ ID NO: 1738407 - DNA, 15 bp, Homo sapiens
ttaagatgtgaaaat

SEQ ID NO: 1738408 - DNA, 14 bp, Homo sapiens
ttaagattataatt

SEQ ID NO: 1738409 - DNA, 15 bp, Homo sapiens
ttaagattataattg

SEQ ID NO: 1738410 - DNA, 20 bp, Homo sapiens
ttataataaatatatacatt

SEQ ID NO: 1738411 - DNA, 15 bp, Homo sapiens
ttataataatgttaa

SEQ ID NO: 1738412 - DNA, 11 bp, Homo sapiens
ttataatagca

SEQ ID NO: 1738413 - DNA, 20 bp, Homo sapiens
ttataataggtatatagaac

SEQ ID NO: 1738414 - DNA, 19 bp, Homo sapiens
ttataatatgtgccttaag

SEQ ID NO: 1738415 - DNA, 20 bp, Homo sapiens
ttataatatgtgccttaagt

SEQ ID NO: 1738416 - DNA, 15 bp, Homo sapiens
ttataatgaatgaaa

SEQ ID NO: 1738417 - DNA, 12 bp, Homo sapiens
ttataatgtatt

SEQ ID NO: 1738418 - DNA, 16 bp, Homo sapiens
ttataattccttctgc

SEQ ID NO: 1738419 - DNA, 17 bp, Homo sapiens
ttataattctcattaaa

SEQ ID NO: 1738420 - DNA, 20 bp, Homo sapiens
ttataattgtacaaaattaa

SEQ ID NO: 1738421 - DNA, 14 bp, Homo sapiens
ttataattgttgca

SEQ ID NO: 1738422 - DNA, 19 bp, Homo sapiens
ttataatttataaatacag

SEQ ID NO: 1738423 - DNA, 21 bp, Homo sapiens
ttataatttttttattactga

SEQ ID NO: 1738424 - DNA, 20 bp, Homo sapiens
ttatacaaacctaccaaaat

SEQ ID NO: 1738425 - DNA, 21 bp, Homo sapiens
ttatacaaacctaccaaaatg

SEQ ID NO: 1738426 - DNA, 13 bp, Homo sapiens
ttatacactgtgt

SEQ ID NO: 1738427 - DNA, 14 bp, Homo sapiens
ttatacaggtcata

SEQ ID NO: 1738428 - DNA, 20 bp, Homo sapiens
ttatacatgtgatacatttt

SEQ ID NO: 1738429 - DNA, 22 bp, Homo sapiens
ttataccagcttaatagctgta

SEQ ID NO: 1738430 - DNA, 16 bp, Homo sapiens
ttataccattcagatc

SEQ ID NO: 1738431 - DNA, 23 bp, Homo sapiens
ttatacccagaaagttattgata

SEQ ID NO: 1738432 - DNA, 22 bp, Homo sapiens
ttatacccccaggaaactagct

SEQ ID NO: 1738433 - DNA, 14 bp, Homo sapiens
ttatacctgtttaa

SEQ ID NO: 1738434 - DNA, 22 bp, Homo sapiens
ttatacgctggcaacacagagg

SEQ ID NO: 1738435 - DNA, 14 bp, Homo sapiens
ttatacgcttttct

SEQ ID NO: 1738436 - DNA, 15 bp, Homo sapiens
ttatacggaaaaaat

SEQ ID NO: 1738437 - DNA, 22 bp, Homo sapiens
ttatactctagaacatgcacat

SEQ ID NO: 1738438 - DNA, 11 bp, Homo sapiens
ttatacttact

SEQ ID NO: 1738439 - DNA, 14 bp, Homo sapiens
ttatactttattga

SEQ ID NO: 1738440 - DNA, 15 bp, Homo sapiens
ttatagaaaacctga

SEQ ID NO: 1738441 - DNA, 18 bp, Homo sapiens
ttatagaaggaatttgta

SEQ ID NO: 1738442 - DNA, 22 bp, Homo sapiens
ttatagaataaaagctataaag

SEQ ID NO: 1738443 - DNA, 15 bp, Homo sapiens
ttatagaatactttt

SEQ ID NO: 1738444 - DNA, 16 bp, Homo sapiens
ttatagaatatggact

SEQ ID NO: 1738445 - DNA, 23 bp, Homo sapiens
ttatagaatatttattacctctg

SEQ ID NO: 1738446 - DNA, 15 bp, Homo sapiens
ttatagagcagaaat

SEQ ID NO: 1738447 - DNA, 21 bp, Homo sapiens
ttatagaggctagcttctgct

SEQ ID NO: 1738448 - DNA, 16 bp, Homo sapiens
ttatagctcagtttat

SEQ ID NO: 1738449 - DNA, 16 bp, Homo sapiens
ttataggagaaagcaa

SEQ ID NO: 1738450 - DNA, 23 bp, Homo sapiens
ttataggcctgtcccttgcctct

SEQ ID NO: 1738451 - DNA, 20 bp, Homo sapiens
ttataggtaaaatctctgaa

SEQ ID NO: 1738452 - DNA, 18 bp, Homo sapiens
ttataggtcactcctggg

SEQ ID NO: 1738453 - DNA, 18 bp, Homo sapiens
ttataggtcctttagaaa

SEQ ID NO: 1738454 - DNA, 14 bp, Homo sapiens
ttataggtgagaaa

SEQ ID NO: 1738455 - DNA, 21 bp, Homo sapiens
ttataggttatcaaaactgtt

SEQ ID NO: 1738456 - DNA, 16 bp, Homo sapiens
ttatagtactgacaga

SEQ ID NO: 1738457 - DNA, 18 bp, Homo sapiens
ttatagtactgacagata

SEQ ID NO: 1738458 - DNA, 19 bp, Homo sapiens
ttatagttactgtgtaatt

SEQ ID NO: 1738459 - DNA, 22 bp, Homo sapiens
ttatataactgtatttgaaata

SEQ ID NO: 1738460 - DNA, 13 bp, Homo sapiens
ttatataagtatt

SEQ ID NO: 1738461 - DNA, 23 bp, Homo sapiens
ttatatacagtacacagatacct

SEQ ID NO: 1738462 - DNA, 21 bp, Homo sapiens
ttatatacctggcttttactt

SEQ ID NO: 1738463 - DNA, 16 bp, Homo sapiens
ttatatacttagctat

SEQ ID NO: 1738464 - DNA, 15 bp, Homo sapiens
ttatatatacagtaa

SEQ ID NO: 1738465 - DNA, 14 bp, Homo sapiens
ttatatatatatgt

SEQ ID NO: 1738466 - DNA, 12 bp, Homo sapiens
ttatatatatct

SEQ ID NO: 1738467 - DNA, 15 bp, Homo sapiens
ttatatatatctata

SEQ ID NO: 1738468 - DNA, 18 bp, Homo sapiens
ttatatatccctgataaa

SEQ ID NO: 1738469 - DNA, 23 bp, Homo sapiens
ttatatatgtgaacatttatcaa

SEQ ID NO: 1738470 - DNA, 13 bp, Homo sapiens
ttatatatttata

SEQ ID NO: 1738471 - DNA, 23 bp, Homo sapiens
ttatatattttgttgttcctcta

SEQ ID NO: 1738472 - DNA, 16 bp, Homo sapiens
ttatatcagcctgagt

SEQ ID NO: 1738473 - DNA, 15 bp, Homo sapiens
ttatatcatatgtat

SEQ ID NO: 1738474 - DNA, 12 bp, Homo sapiens
ttatatcatcaa

SEQ ID NO: 1738475 - DNA, 19 bp, Homo sapiens
ttatatgcttactgatata

SEQ ID NO: 1738476 - DNA, 15 bp, Homo sapiens
ttatatgtactttta

SEQ ID NO: 1738477 - DNA, 24 bp, Homo sapiens
ttatattaaagtaaatggcatgga

SEQ ID NO: 1738478 - DNA, 18 bp, Homo sapiens
ttatattgcagattgaat

SEQ ID NO: 1738479 - DNA, 23 bp, Homo sapiens
ttatattggtgcgtttttacagt

SEQ ID NO: 1738480 - DNA, 15 bp, Homo sapiens
ttatatttagtaact

SEQ ID NO: 1738481 - DNA, 14 bp, Homo sapiens
ttatatttccttta

SEQ ID NO: 1738482 - DNA, 19 bp, Homo sapiens
ttcaaattcttctgaactc

SEQ ID NO: 1738483 - DNA, 17 bp, Homo sapiens
ttcaaattgctgcttgg

SEQ ID NO: 1738484 - DNA, 18 bp, Homo sapiens
ttcaaattgctgcttgga

SEQ ID NO: 1738485 - DNA, 22 bp, Homo sapiens
ttcaaattggaatggaactact

SEQ ID NO: 1738486 - DNA, 12 bp, Homo sapiens
ttcaaatttgta

SEQ ID NO: 1738487 - DNA, 11 bp, Homo sapiens
ttcaacaaatg

SEQ ID NO: 1738488 - DNA, 17 bp, Homo sapiens
ttcaacaatttcaataa

SEQ ID NO: 1738489 - DNA, 17 bp, Homo sapiens
ttcaacacttattttct

SEQ ID NO: 1738490 - DNA, 13 bp, Homo sapiens
ttcaacagggaag

SEQ ID NO: 1738491 - DNA, 15 bp, Homo sapiens
ttcaacagggaagaa

SEQ ID NO: 1738492 - DNA, 22 bp, Homo sapiens
ttcaaccaaggaggaattgaaa

SEQ ID NO: 1738493 - DNA, 19 bp, Homo sapiens
ttcaaccactgtaaaatga

SEQ ID NO: 1738494 - DNA, 15 bp, Homo sapiens
ttcaacgcagccctg

SEQ ID NO: 1738495 - DNA, 14 bp, Homo sapiens
ttcaactgaaaaga

SEQ ID NO: 1738496 - DNA, 12 bp, Homo sapiens
ttcaagaaactg

SEQ ID NO: 1738497 - DNA, 22 bp, Homo sapiens
ttcaagaaagcttcaaactgca

SEQ ID NO: 1738498 - DNA, 12 bp, Homo sapiens
ttcaagaaataa

SEQ ID NO: 1738499 - DNA, 16 bp, Homo sapiens
ttcaagaatgaaaaat

SEQ ID NO: 1738500 - DNA, 20 bp, Homo sapiens
ttcaagaatgaaaaatataa

SEQ ID NO: 1738501 - DNA, 18 bp, Homo sapiens
ttcaagacattaaatcta

SEQ ID NO: 1738502 - DNA, 18 bp, Homo sapiens
ttcaagactgaattccaa

SEQ ID NO: 1738503 - DNA, 18 bp, Homo sapiens
ttcaagagatttaattaa

SEQ ID NO: 1738504 - DNA, 15 bp, Homo sapiens
ttcaagattctaaag

SEQ ID NO: 1738505 - DNA, 21 bp, Homo sapiens
ttcaagattctaaagctcaat

SEQ ID NO: 1738506 - DNA, 17 bp, Homo sapiens
ttcaagcacactggaat

SEQ ID NO: 1738507 - DNA, 17 bp, Homo sapiens
ttcaagcacttacagct

SEQ ID NO: 1738508 - DNA, 16 bp, Homo sapiens
ttcaagcagcatcttc

SEQ ID NO: 1738509 - DNA, 20 bp, Homo sapiens
ttcaagcctgtgcaatgcat

SEQ ID NO: 1738510 - DNA, 15 bp, Homo sapiens
ttcaagcctgtggga

SEQ ID NO: 1738511 - DNA, 20 bp, Homo sapiens
ttcaagctgtcccctctgtc

SEQ ID NO: 1738512 - DNA, 11 bp, Homo sapiens
ttcaagctttc

SEQ ID NO: 1738513 - DNA, 14 bp, Homo sapiens
ttcaaggaaagtga

SEQ ID NO: 1738514 - DNA, 14 bp, Homo sapiens
ttcaaggaacagcc

SEQ ID NO: 1738515 - DNA, 17 bp, Homo sapiens
ttcaaggactgtttcag

SEQ ID NO: 1738516 - DNA, 16 bp, Homo sapiens
ttcaaggagaatatga

SEQ ID NO: 1738517 - DNA, 18 bp, Homo sapiens
ttcaaggagaatatgata

SEQ ID NO: 1738518 - DNA, 16 bp, Homo sapiens
ttcaaggcactctaga

SEQ ID NO: 1738519 - DNA, 17 bp, Homo sapiens
ttcaaggcactctagat

SEQ ID NO: 1738520 - DNA, 18 bp, Homo sapiens
ttcaaggcactctagatt

SEQ ID NO: 1738521 - DNA, 11 bp, Homo sapiens
ttcaaggcaga

SEQ ID NO: 1738522 - DNA, 20 bp, Homo sapiens
ttcaaggcatcatgcagagt

SEQ ID NO: 1738523 - DNA, 11 bp, Homo sapiens
ttcaaggcatt

SEQ ID NO: 1738524 - DNA, 16 bp, Homo sapiens
ttcaaggcatttgtct

SEQ ID NO: 1738525 - DNA, 15 bp, Homo sapiens
ttcaaggcttccact

SEQ ID NO: 1738526 - DNA, 12 bp, Homo sapiens
ttcaagtgccaa

SEQ ID NO: 1738527 - DNA, 14 bp, Homo sapiens
ttcaagtgccaaac

SEQ ID NO: 1738528 - DNA, 11 bp, Homo sapiens
ttcaagtgcct

SEQ ID NO: 1738529 - DNA, 12 bp, Homo sapiens
ttcaagtgccta

SEQ ID NO: 1738530 - DNA, 14 bp, Homo sapiens
ttcaagtgcctaga

SEQ ID NO: 1738531 - DNA, 17 bp, Homo sapiens
ttcaagtgcctcttgtt

SEQ ID NO: 1738532 - DNA, 21 bp, Homo sapiens
ttcaagtgcctttctgcagtt

SEQ ID NO: 1738533 - DNA, 23 bp, Homo sapiens
ttcaagtgcctttctgcagtttt

SEQ ID NO: 1738534 - DNA, 22 bp, Homo sapiens
ttcaagtggggctcgccatgcc

SEQ ID NO: 1738535 - DNA, 21 bp, Homo sapiens
ttcaagtgttgctcttggaaa

SEQ ID NO: 1738536 - DNA, 13 bp, Homo sapiens
ttcaagttattca

SEQ ID NO: 1738537 - DNA, 14 bp, Homo sapiens
ttcaagttattcaa

SEQ ID NO: 1738538 - DNA, 16 bp, Homo sapiens
ttcaagttattcaaat

SEQ ID NO: 1738539 - DNA, 16 bp, Homo sapiens
ttcaagttttaaagtt

SEQ ID NO: 1738540 - DNA, 20 bp, Homo sapiens
ttcaagttttgggtatgttt

SEQ ID NO: 1738541 - DNA, 15 bp, Homo sapiens
ttcaataccgctcag

SEQ ID NO: 1738542 - DNA, 17 bp, Homo sapiens
ttcaatatattgaactt

SEQ ID NO: 1738543 - DNA, 18 bp, Homo sapiens
ttcaatatattgaacttt

SEQ ID NO: 1738544 - DNA, 20 bp, Homo sapiens
ttcaatatcagctttgataa

SEQ ID NO: 1738545 - DNA, 21 bp, Homo sapiens
ttaattattatttgtgtttta

SEQ ID NO: 1738546 - DNA, 21 bp, Homo sapiens
ttaattcacagaatagcacaa

SEQ ID NO: 1738547 - DNA, 15 bp, Homo sapiens
ttaattcactcccac

SEQ ID NO: 1738548 - DNA, 19 bp, Homo sapiens
ttaattcagtctcagctgc

SEQ ID NO: 1738549 - DNA, 14 bp, Homo sapiens
ttaattcatgtttc

SEQ ID NO: 1738550 - DNA, 18 bp, Homo sapiens
ttaattgctttaaatctt

SEQ ID NO: 1738551 - DNA, 18 bp, Homo sapiens
ttaatttaaacacctcct

SEQ ID NO: 1738552 - DNA, 16 bp, Homo sapiens
ttaatttaggacacat

SEQ ID NO: 1738553 - DNA, 18 bp, Homo sapiens
ttaatttcaggaaaatgt

SEQ ID NO: 1738554 - DNA, 22 bp, Homo sapiens
ttaatttccaggaaaaaataaa

SEQ ID NO: 1738555 - DNA, 12 bp, Homo sapiens
ttaatttccttt

SEQ ID NO: 1738556 - DNA, 20 bp, Homo sapiens
ttaatttcctttttgacact

SEQ ID NO: 1738557 - DNA, 21 bp, Homo sapiens
ttaatttcctttttgacactg

SEQ ID NO: 1738558 - DNA, 15 bp, Homo sapiens
ttaatttgaaatctg

SEQ ID NO: 1738559 - DNA, 18 bp, Homo sapiens
ttaatttgatgaaagctg

SEQ ID NO: 1738560 - DNA, 13 bp, Homo sapiens
ttaattttaatgc

SEQ ID NO: 1738561 - DNA, 20 bp, Homo sapiens
ttaattttaatgctgtttct

SEQ ID NO: 1738562 - DNA, 17 bp, Homo sapiens
ttaattttactccataa

SEQ ID NO: 1738563 - DNA, 15 bp, Homo sapiens
ttaattttagttttt

SEQ ID NO: 1738564 - DNA, 23 bp, Homo sapiens
ttaattttattttttataaaata

SEQ ID NO: 1738565 - DNA, 19 bp, Homo sapiens
ttaattttctctttgtatg

SEQ ID NO: 1738566 - DNA, 19 bp, Homo sapiens
ttaattttgaagtgctgtt

SEQ ID NO: 1738567 - DNA, 23 bp, Homo sapiens
ttaattttgaagtgctgtttatt

SEQ ID NO: 1738568 - DNA, 17 bp, Homo sapiens
ttaattttgatatacat

SEQ ID NO: 1738569 - DNA, 14 bp, Homo sapiens
ttaatttttaaatg

SEQ ID NO: 1738570 - DNA, 17 bp, Homo sapiens
ttaatttttaatgatga

SEQ ID NO: 1738571 - DNA, 15 bp, Homo sapiens
ttaatttttccaact

SEQ ID NO: 1738572 - DNA, 16 bp, Homo sapiens
ttaattttttttaatg

SEQ ID NO: 1738573 - DNA, 13 bp, Homo sapiens
ttacaaaagatgt

SEQ ID NO: 1738574 - DNA, 15 bp, Homo sapiens
ttacaaaatgccaag

SEQ ID NO: 1738575 - DNA, 20 bp, Homo sapiens
ttacaaaccattacctgtac

SEQ ID NO: 1738576 - DNA, 15 bp, Homo sapiens
ttacaaactgcaata

SEQ ID NO: 1738577 - DNA, 23 bp, Homo sapiens
ttacaaactgcaatagagactgt

SEQ ID NO: 1738578 - DNA, 14 bp, Homo sapiens
ttacaaagcagtta

SEQ ID NO: 1738579 - DNA, 18 bp, Homo sapiens
ttacaactatgtaattta

SEQ ID NO: 1738580 - DNA, 13 bp, Homo sapiens
ttacaacttccat

SEQ ID NO: 1738581 - DNA, 22 bp, Homo sapiens
ttacaagatattattaattttt

SEQ ID NO: 1738582 - DNA, 20 bp, Homo sapiens
ttacaagggagaagacaaca

SEQ ID NO: 1738583 - DNA, 17 bp, Homo sapiens
ttacaagtaatgtaaag

SEQ ID NO: 1738584 - DNA, 14 bp, Homo sapiens
ttacaagtgttctt

SEQ ID NO: 1738585 - DNA, 14 bp, Homo sapiens
ttacaataaatatt

SEQ ID NO: 1738586 - DNA, 17 bp, Homo sapiens
ttacaataggagtggtg

SEQ ID NO: 1738587 - DNA, 21 bp, Homo sapiens
ttacaatattgattgggaaaa

SEQ ID NO: 1738588 - DNA, 12 bp, Homo sapiens
ttacaatcaaag

SEQ ID NO: 1738589 - DNA, 16 bp, Homo sapiens
ttacaatgtatcttta

SEQ ID NO: 1738590 - DNA, 13 bp, Homo sapiens
ttacaattgaaat

SEQ ID NO: 1738591 - DNA, 18 bp, Homo sapiens
ttacaatttggagcataa

SEQ ID NO: 1738592 - DNA, 18 bp, Homo sapiens
ttacaattttatctgttt

SEQ ID NO: 1738593 - DNA, 15 bp, Homo sapiens
ttacaattttctgta

SEQ ID NO: 1738594 - DNA, 16 bp, Homo sapiens
ttacaattttctgtaa

SEQ ID NO: 1738595 - DNA, 19 bp, Homo sapiens
ttacaatttttaataaatt

SEQ ID NO: 1738596 - DNA, 15 bp, Homo sapiens
ttacaattttttatc

SEQ ID NO: 1738597 - DNA, 16 bp, Homo sapiens
ttacacagaaacactg

SEQ ID NO: 1738598 - DNA, 18 bp, Homo sapiens
ttacacagaaacactgcc

SEQ ID NO: 1738599 - DNA, 19 bp, Homo sapiens
ttacacagaaacactgcct

SEQ ID NO: 1738600 - DNA, 18 bp, Homo sapiens
ttacacagaaatgctgct

SEQ ID NO: 1738601 - DNA, 15 bp, Homo sapiens
ttacacagcccaaga

SEQ ID NO: 1738602 - DNA, 17 bp, Homo sapiens
ttacacatcttcaacag

SEQ ID NO: 1738603 - DNA, 14 bp, Homo sapiens
ttacactctttgta

SEQ ID NO: 1738604 - DNA, 20 bp, Homo sapiens
ttacactggtctaatgtttg

SEQ ID NO: 1738605 - DNA, 19 bp, Homo sapiens
ttacacttataaaataact

SEQ ID NO: 1738606 - DNA, 15 bp, Homo sapiens
ttacacttggagccc

SEQ ID NO: 1738607 - DNA, 13 bp, Homo sapiens
ttacagaaaaaga

SEQ ID NO: 1738608 - DNA, 19 bp, Homo sapiens
ttacagaaaattgttgtgc

SEQ ID NO: 1738609 - DNA, 23 bp, Homo sapiens
ttacagatgtttttaattctagt

SEQ ID NO: 1738610 - DNA, 17 bp, Homo sapiens
ttacagctctgtagttt

SEQ ID NO: 1738611 - DNA, 19 bp, Homo sapiens
ttacaggaggttgtggatg

SEQ ID NO: 1738612 - DNA, 21 bp, Homo sapiens
ttacaggaggttgtggatgct

SEQ ID NO: 1738613 - DNA, 13 bp, Homo sapiens
ttacaggtgatta

SEQ ID NO: 1738614 - DNA, 20 bp, Homo sapiens
ttacaggtgattaacttgga

SEQ ID NO: 1738615 - DNA, 18 bp, Homo sapiens
ttacaggtggacacacaa

SEQ ID NO: 1738616 - DNA, 15 bp, Homo sapiens
ttacaggtttgaatt

SEQ ID NO: 1738617 - DNA, 22 bp, Homo sapiens
ttacagttagggttttgcaata

SEQ ID NO: 1738618 - DNA, 12 bp, Homo sapiens
ttacagttctgt

SEQ ID NO: 1738619 - DNA, 14 bp, Homo sapiens
ttacagttctgtgg

SEQ ID NO: 1738620 - DNA, 22 bp, Homo sapiens
ttacagttctgtggtttcatgt

SEQ ID NO: 1738621 - DNA, 19 bp, Homo sapiens
ttacagtttttttctttgt

SEQ ID NO: 1738622 - DNA, 18 bp, Homo sapiens
ttacataaggatgacttt

SEQ ID NO: 1738623 - DNA, 14 bp, Homo sapiens
ttacatactgctgt

SEQ ID NO: 1738624 - DNA, 19 bp, Homo sapiens
ttacatagacttaggcatt

SEQ ID NO: 1738625 - DNA, 24 bp, Homo sapiens
ttacatagacttaggcattaacat

SEQ ID NO: 1738626 - DNA, 22 bp, Homo sapiens
ttacatatcacctcatggccta

SEQ ID NO: 1738627 - DNA, 19 bp, Homo sapiens
ttacatatgtatacatgtg

SEQ ID NO: 1738628 - DNA, 14 bp, Homo sapiens
ttacatcatttctt

SEQ ID NO: 1738629 - DNA, 14 bp, Homo sapiens
ttacatcttttcta

SEQ ID NO: 1738630 - DNA, 17 bp, Homo sapiens
ttacatgaattgcattt

SEQ ID NO: 1738631 - DNA, 19 bp, Homo sapiens
ttacatgctgtgctctttg

SEQ ID NO: 1738632 - DNA, 22 bp, Homo sapiens
ttacatggttaaggtaaagtaa

SEQ ID NO: 1738633 - DNA, 15 bp, Homo sapiens
ttacatgtaatttga

SEQ ID NO: 1738634 - DNA, 19 bp, Homo sapiens
ttacattcctaactagaat

SEQ ID NO: 1738635 - DNA, 17 bp, Homo sapiens
ttacattgaaaacagat

SEQ ID NO: 1738636 - DNA, 19 bp, Homo sapiens
ttacattgaaaacagatat

SEQ ID NO: 1738637 - DNA, 14 bp, Homo sapiens
ttacattggcacaa

SEQ ID NO: 1738638 - DNA, 17 bp, Homo sapiens
ttacattgtcctgtagc

SEQ ID NO: 1738639 - DNA, 10 bp, Homo sapiens
ttacatttca

SEQ ID NO: 1738640 - DNA, 20 bp, Homo sapiens
ttacattttattaagctttt

SEQ ID NO: 1738641 - DNA, 13 bp, Homo sapiens
ttacatttttaca

SEQ ID NO: 1738642 - DNA, 14 bp, Homo sapiens
ttacatttttacaa

SEQ ID NO: 1738643 - DNA, 21 bp, Homo sapiens
ttacatttttacaataaataa

SEQ ID NO: 1738644 - DNA, 20 bp, Homo sapiens
ttaccaaagcatcaatacaa

SEQ ID NO: 1738645 - DNA, 16 bp, Homo sapiens
ttaccaaagtgtcttt

SEQ ID NO: 1738646 - DNA, 17 bp, Homo sapiens
ttaccaatagcctgaat

SEQ ID NO: 1738647 - DNA, 18 bp, Homo sapiens
ttaccaatagcctgaatt

SEQ ID NO: 1738648 - DNA, 17 bp, Homo sapiens
ttaccagaagcttccat

SEQ ID NO: 1738649 - DNA, 22 bp, Homo sapiens
ttaccagcaagaataaaaaaga

SEQ ID NO: 1738650 - DNA, 21 bp, Homo sapiens
ttaccagggactatctttgct

SEQ ID NO: 1738651 - DNA, 17 bp, Homo sapiens
ttaccaggtgagaagtg

SEQ ID NO: 1738652 - DNA, 14 bp, Homo sapiens
ttaccatcatctct

SEQ ID NO: 1738653 - DNA, 13 bp, Homo sapiens
ttaccatttgtaa

SEQ ID NO: 1738654 - DNA, 14 bp, Homo sapiens
ttaccatttgtaat

SEQ ID NO: 1738655 - DNA, 23 bp, Homo sapiens
ttaccatttgtaataaagtatat

SEQ ID NO: 1738656 - DNA, 15 bp, Homo sapiens
ttacccaagctgtgg

SEQ ID NO: 1738657 - DNA, 15 bp, Homo sapiens
ttacccacctagaac

SEQ ID NO: 1738658 - DNA, 22 bp, Homo sapiens
ttacccacctagaacactaact

SEQ ID NO: 1738659 - DNA, 21 bp, Homo sapiens
ttacccagattgtgtacatag

SEQ ID NO: 1738660 - DNA, 12 bp, Homo sapiens
ttacccataaac

SEQ ID NO: 1738661 - DNA, 16 bp, Homo sapiens
ttaccccttagcctcc

SEQ ID NO: 1738662 - DNA, 22 bp, Homo sapiens
ttcaccaccccctgtcccattc

SEQ ID NO: 1738663 - DNA, 17 bp, Homo sapiens
ttcaccagagcccatgc

SEQ ID NO: 1738664 - DNA, 12 bp, Homo sapiens
ttcaccagcagc

SEQ ID NO: 1738665 - DNA, 17 bp, Homo sapiens
ttcaccaggggtgctca

SEQ ID NO: 1738666 - DNA, 20 bp, Homo sapiens
ttcaccagtctgtctactgt

SEQ ID NO: 1738667 - DNA, 18 bp, Homo sapiens
ttcacccagctaatctgt

SEQ ID NO: 1738668 - DNA, 20 bp, Homo sapiens
ttcacccccctctgctgccg

SEQ ID NO: 1738669 - DNA, 16 bp, Homo sapiens
ttcaccccctttcctg

SEQ ID NO: 1738670 - DNA, 19 bp, Homo sapiens
ttcaccccctttcctggac

SEQ ID NO: 1738671 - DNA, 21 bp, Homo sapiens
ttcacccctacactgtgaagg

SEQ ID NO: 1738672 - DNA, 15 bp, Homo sapiens
ttcacccctcccttt

SEQ ID NO: 1738673 - DNA, 18 bp, Homo sapiens
ttcacccctccctttctc

SEQ ID NO: 1738674 - DNA, 20 bp, Homo sapiens
ttcacccctccctttctccc

SEQ ID NO: 1738675 - DNA, 13 bp, Homo sapiens
ttcacccctgcac

SEQ ID NO: 1738676 - DNA, 13 bp, Homo sapiens
ttcaccctccact

SEQ ID NO: 1738677 - DNA, 16 bp, Homo sapiens
ttcaccctccacttcc

SEQ ID NO: 1738678 - DNA, 15 bp, Homo sapiens
ttcaccgtggctacc

SEQ ID NO: 1738679 - DNA, 19 bp, Homo sapiens
ttcacctaagtctctgtga

SEQ ID NO: 1738680 - DNA, 21 bp, Homo sapiens
ttcacctcttccactccttct

SEQ ID NO: 1738681 - DNA, 16 bp, Homo sapiens
ttcacctcttcctctg

SEQ ID NO: 1738682 - DNA, 17 bp, Homo sapiens
ttcacctgtaaacctga

SEQ ID NO: 1738683 - DNA, 19 bp, Homo sapiens
ttcacctgtttttaagctg

SEQ ID NO: 1738684 - DNA, 14 bp, Homo sapiens
ttcaccttggaagg

SEQ ID NO: 1738685 - DNA, 22 bp, Homo sapiens
ttcacgacaatgttgagaagtt

SEQ ID NO: 1738686 - DNA, 23 bp, Homo sapiens
ttcacgacaatgttgagaagttc

SEQ ID NO: 1738687 - DNA, 19 bp, Homo sapiens
ttcacgccgtaattctttc

SEQ ID NO: 1738688 - DNA, 23 bp, Homo sapiens
ttcacgccgtaattctttctgtc

SEQ ID NO: 1738689 - DNA, 18 bp, Homo sapiens
ttcacgtggcctccgcag

SEQ ID NO: 1738690 - DNA, 13 bp, Homo sapiens
ttcactaaagcag

SEQ ID NO: 1738691 - DNA, 15 bp, Homo sapiens
ttcactaaatgtaaa

SEQ ID NO: 1738692 - DNA, 14 bp, Homo sapiens
ttcactaacctttt

SEQ ID NO: 1738693 - DNA, 19 bp, Homo sapiens
ttcactatttcctttataa

SEQ ID NO: 1738694 - DNA, 19 bp, Homo sapiens
ttcactccagtcaacagat

SEQ ID NO: 1738695 - DNA, 21 bp, Homo sapiens
ttcactccggtgtgcctgcag

SEQ ID NO: 1738696 - DNA, 15 bp, Homo sapiens
ttcactcttccagaa

SEQ ID NO: 1738697 - DNA, 17 bp, Homo sapiens
ttcactgaccagcggct

SEQ ID NO: 1738698 - DNA, 19 bp, Homo sapiens
ttcactgcaatgtcaaagt

SEQ ID NO: 1738699 - DNA, 20 bp, Homo sapiens
ttcactgcatggctcccaca

SEQ ID NO: 1738700 - DNA, 24 bp, Homo sapiens
ttcactgccatgatagctggggct

SEQ ID NO: 1738701 - DNA, 22 bp, Homo sapiens
ttcactggcccctactttgtgg

SEQ ID NO: 1738702 - DNA, 21 bp, Homo sapiens
ttcactggcgccttctcggag

SEQ ID NO: 1738703 - DNA, 18 bp, Homo sapiens
ttcactgtactgcatgtg

SEQ ID NO: 1738704 - DNA, 19 bp, Homo sapiens
ttcactgtactgcatgtga

SEQ ID NO: 1738705 - DNA, 15 bp, Homo sapiens
ttcactgtagaatga

SEQ ID NO: 1738706 - DNA, 22 bp, Homo sapiens
ttcactgtagaatgatttcatg

SEQ ID NO: 1738707 - DNA, 16 bp, Homo sapiens
ttcactgttccctctg

SEQ ID NO: 1738708 - DNA, 20 bp, Homo sapiens
ttcacttaagtttttccaaa

SEQ ID NO: 1738709 - DNA, 17 bp, Homo sapiens
ttcacttgaaagatttt

SEQ ID NO: 1738710 - DNA, 19 bp, Homo sapiens
ttcactttcacatagatgt

SEQ ID NO: 1738711 - DNA, 21 bp, Homo sapiens
ttcagaaaatattatgtgttt

SEQ ID NO: 1738712 - DNA, 21 bp, Homo sapiens
ttcagaaagcctttcattttg

SEQ ID NO: 1738713 - DNA, 22 bp, Homo sapiens
ttcagaaaggggcattttgtac

SEQ ID NO: 1738714 - DNA, 15 bp, Homo sapiens
ttcagaaatgctgcc

SEQ ID NO: 1738715 - DNA, 20 bp, Homo sapiens
ttcagaaatgctgcctgcct

SEQ ID NO: 1738716 - DNA, 13 bp, Homo sapiens
ttcagaaattgga

SEQ ID NO: 1738717 - DNA, 17 bp, Homo sapiens
ttcagaacctcttcccc

SEQ ID NO: 1738718 - DNA, 11 bp, Homo sapiens
ttcagaagacc

SEQ ID NO: 1738719 - DNA, 21 bp, Homo sapiens
ttcagaaggtaggggccgtgt

SEQ ID NO: 1738720 - DNA, 23 bp, Homo sapiens
ttcagaaggtaggggccgtgtcc

SEQ ID NO: 1738721 - DNA, 21 bp, Homo sapiens
ttcagaagtgagctttgctgc

SEQ ID NO: 1738722 - DNA, 13 bp, Homo sapiens
ttcagaagtttaa

SEQ ID NO: 1738723 - DNA, 14 bp, Homo sapiens
ttcagaagtttaaa

SEQ ID NO: 1738724 - DNA, 16 bp, Homo sapiens
ttcagaataagcttcc

SEQ ID NO: 1738725 - DNA, 23 bp, Homo sapiens
ttcagaatcatgtcgatcctggg

SEQ ID NO: 1738726 - DNA, 16 bp, Homo sapiens
ttcagaattttgtata

SEQ ID NO: 1738727 - DNA, 11 bp, Homo sapiens
ttcagacaaca

SEQ ID NO: 1738728 - DNA, 14 bp, Homo sapiens
ttcagctaagctag

SEQ ID NO: 1738729 - DNA, 12 bp, Homo sapiens
ttcagctctgga

SEQ ID NO: 1738730 - DNA, 14 bp, Homo sapiens
ttcagctctttcca

SEQ ID NO: 1738731 - DNA, 21 bp, Homo sapiens
ttcagcttgtttctatactgt

SEQ ID NO: 1738732 - DNA, 14 bp, Homo sapiens
ttcaggaatttaaa

SEQ ID NO: 1738733 - DNA, 10 bp, Homo sapiens
ttcaggactt

SEQ ID NO: 1738734 - DNA, 21 bp, Homo sapiens
ttcaggacttaacggctccag

SEQ ID NO: 1738735 - DNA, 21 bp, Homo sapiens
ttcaggagaacctaacatgct

SEQ ID NO: 1738736 - DNA, 17 bp, Homo sapiens
ttcaggagtcccaagga

SEQ ID NO: 1738737 - DNA, 17 bp, Homo sapiens
ttcaggatactctgtca

SEQ ID NO: 1738738 - DNA, 17 bp, Homo sapiens
ttcaggatgctgtgata

SEQ ID NO: 1738739 - DNA, 12 bp, Homo sapiens
ttcaggcagcag

SEQ ID NO: 1738740 - DNA, 18 bp, Homo sapiens
ttcaggccagcccagcca

SEQ ID NO: 1738741 - DNA, 20 bp, Homo sapiens
ttcaggccagcccagccagg

SEQ ID NO: 1738742 - DNA, 15 bp, Homo sapiens
ttcaggctcttctcc

SEQ ID NO: 1738743 - DNA, 18 bp, Homo sapiens
ttcagggaccgtccaggg

SEQ ID NO: 1738744 - DNA, 21 bp, Homo sapiens
ttcaggggagtcccgtcagga

SEQ ID NO: 1738745 - DNA, 14 bp, Homo sapiens
ttcaggtaggccct

SEQ ID NO: 1738746 - DNA, 20 bp, Homo sapiens
ttcaggtgcttttgatgtga

SEQ ID NO: 1738747 - DNA, 13 bp, Homo sapiens
ttcaggtttttcc

SEQ ID NO: 1738748 - DNA, 23 bp, Homo sapiens
ttcagtaagtctcataggttaaa

SEQ ID NO: 1738749 - DNA, 14 bp, Homo sapiens
ttcagtagaattac

SEQ ID NO: 1738750 - DNA, 15 bp, Homo sapiens
ttcagtagaattacc

SEQ ID NO: 1738751 - DNA, 20 bp, Homo sapiens
ttcagtattatgtagttgtt

SEQ ID NO: 1738752 - DNA, 12 bp, Homo sapiens
ttcagtccgcct

SEQ ID NO: 1738753 - DNA, 22 bp, Homo sapiens
ttcagtctcagctgctgaaatt

SEQ ID NO: 1738754 - DNA, 20 bp, Homo sapiens
ttcagtctgaatgctgccac

SEQ ID NO: 1738755 - DNA, 12 bp, Homo sapiens
ttcagtgaatat

SEQ ID NO: 1738756 - DNA, 22 bp, Homo sapiens
ttcagtgaatatttttgtattt

SEQ ID NO: 1738757 - DNA, 22 bp, Homo sapiens
ttcagtgagagacgccctattt

SEQ ID NO: 1738758 - DNA, 20 bp, Homo sapiens
ttcagtgagggtcttcttac

SEQ ID NO: 1738759 - DNA, 21 bp, Homo sapiens
ttcagtgcagtttcttttcac

SEQ ID NO: 1738760 - DNA, 19 bp, Homo sapiens
ttcagtgctgtggcctggg

SEQ ID NO: 1738761 - DNA, 19 bp, Homo sapiens
ttcagtgtgagtcagaatg

SEQ ID NO: 1738762 - DNA, 18 bp, Homo sapiens
ttcagtgttacctgtgtg

SEQ ID NO: 1738763 - DNA, 15 bp, Homo sapiens
ttcagttcagcttta

SEQ ID NO: 1738764 - DNA, 22 bp, Homo sapiens
ttcagttcccaccatctgatta

SEQ ID NO: 1738765 - DNA, 20 bp, Homo sapiens
ttcagttctttggattctaa

SEQ ID NO: 1738766 - DNA, 18 bp, Homo sapiens
ttcagttgcttgtcttct

SEQ ID NO: 1738767 - DNA, 22 bp, Homo sapiens
ttcagttggttcgttctgtact

SEQ ID NO: 1738768 - DNA, 15 bp, Homo sapiens
ttcagtttgtaaagt

SEQ ID NO: 1738769 - DNA, 17 bp, Homo sapiens
ttcagtttttcatttgt

SEQ ID NO: 1738770 - DNA, 12 bp, Homo sapiens
ttcataagtatt

SEQ ID NO: 1738771 - DNA, 22 bp, Homo sapiens
ttcataatgcagaagtattctt

SEQ ID NO: 1738772 - DNA, 17 bp, Homo sapiens
ttcatagatgcaggagg

SEQ ID NO: 1738773 - DNA, 13 bp, Homo sapiens
ttcatagcccagt

SEQ ID NO: 1738774 - DNA, 18 bp, Homo sapiens
ttcatagctgtacttctt

SEQ ID NO: 1738775 - DNA, 14 bp, Homo sapiens
ttcataggtcactg

SEQ ID NO: 1738776 - DNA, 18 bp, Homo sapiens
ttcatagttttatatccc

SEQ ID NO: 1738777 - DNA, 18 bp, Homo sapiens
ttcatatatgaggacttg

SEQ ID NO: 1738778 - DNA, 21 bp, Homo sapiens
ttcatatatgaggacttgtgt

SEQ ID NO: 1738779 - DNA, 13 bp, Homo sapiens
ttcatatgctgta

SEQ ID NO: 1738780 - DNA, 20 bp, Homo sapiens
ttcatatgtacttgtttgct

SEQ ID NO: 1738781 - DNA, 14 bp, Homo sapiens
ttcatattaagaca

SEQ ID NO: 1738782 - DNA, 18 bp, Homo sapiens
ttcatattaagacagtgt

SEQ ID NO: 1738783 - DNA, 20 bp, Homo sapiens
ttcatattaagacagtgtac

SEQ ID NO: 1738784 - DNA, 14 bp, Homo sapiens
ttcatattttaaat

SEQ ID NO: 1738785 - DNA, 15 bp, Homo sapiens
ttcatcagtgttaaa

SEQ ID NO: 1738786 - DNA, 19 bp, Homo sapiens
ttcatcattccctctcatc

SEQ ID NO: 1738787 - DNA, 22 bp, Homo sapiens
ttcatcattgtttctgcatgaa

SEQ ID NO: 1738788 - DNA, 20 bp, Homo sapiens
ttcatccaatcctcactggg

SEQ ID NO: 1738789 - DNA, 17 bp, Homo sapiens
ttcatccaatgtgaagt

SEQ ID NO: 1738790 - DNA, 21 bp, Homo sapiens
ttcatccaggcccaactgtga

SEQ ID NO: 1738791 - DNA, 14 bp, Homo sapiens
ttcatcccattcca

SEQ ID NO: 1738792 - DNA, 14 bp, Homo sapiens
ttcatcccctcaga

SEQ ID NO: 1738793 - DNA, 18 bp, Homo sapiens
ttcatcccgtatcacagt

SEQ ID NO: 1738794 - DNA, 18 bp, Homo sapiens
ttcatccggcagcctgga

SEQ ID NO: 1738795 - DNA, 22 bp, Homo sapiens
ttcatcctcctccccagctctt

SEQ ID NO: 1738796 - DNA, 16 bp, Homo sapiens
ttcatccttccatcca

SEQ ID NO: 1738797 - DNA, 17 bp, Homo sapiens
ttcatccttccatccat

SEQ ID NO: 1738798 - DNA, 16 bp, Homo sapiens
ttcatcgtaaagtgct

SEQ ID NO: 1738799 - DNA, 17 bp, Homo sapiens
gaatcccctccctgtca

SEQ ID NO: 1738800 - DNA, 19 bp, Homo sapiens
gaatcccttaacagttgta

SEQ ID NO: 1738801 - DNA, 14 bp, Homo sapiens
gaatccgtgtgtgt

SEQ ID NO: 1738802 - DNA, 19 bp, Homo sapiens
ttgagaagccttcagctcc

SEQ ID NO: 1738803 - DNA, 15 bp, Homo sapiens
ttgagaatgtgattc

SEQ ID NO: 1738804 - DNA, 15 bp, Homo sapiens
ttgagacaagccctg

SEQ ID NO: 1738805 - DNA, 22 bp, Homo sapiens
ttgagacacggagcccagccct

SEQ ID NO: 1738806 - DNA, 20 bp, Homo sapiens
ttaaaatagaaattttgtaa

SEQ ID NO: 1738807 - DNA, 21 bp, Homo sapiens
ttaaaatagaaattttgtaag

SEQ ID NO: 1738808 - DNA, 23 bp, Homo sapiens
ttaaaatatacttaaaaattaat

SEQ ID NO: 1738809 - DNA, 16 bp, Homo sapiens
ttaaaatatagagaca

SEQ ID NO: 1738810 - DNA, 17 bp, Homo sapiens
ttaaaatatagagacag

SEQ ID NO: 1738811 - DNA, 16 bp, Homo sapiens
ttaaaatatatgaaga

SEQ ID NO: 1738812 - DNA, 18 bp, Homo sapiens
ttaaaatcaaatgtaaat

SEQ ID NO: 1738813 - DNA, 16 bp, Homo sapiens
ttaaaatcatgatcct

SEQ ID NO: 1738814 - DNA, 22 bp, Homo sapiens
ttaaaatggaaaattttctcct

SEQ ID NO: 1738815 - DNA, 17 bp, Homo sapiens
ttaaaatgtaagattat

SEQ ID NO: 1738816 - DNA, 17 bp, Homo sapiens
ttaaaatgtaatttaaa

SEQ ID NO: 1738817 - DNA, 21 bp, Homo sapiens
ttaaaatgtacatgtattaaa

SEQ ID NO: 1738818 - DNA, 22 bp, Homo sapiens
ttaaaatgttacttattttaaa

SEQ ID NO: 1738819 - DNA, 17 bp, Homo sapiens
ttaaaatgtttactgta

SEQ ID NO: 1738820 - DNA, 11 bp, Homo sapiens
gacaggagaaa

SEQ ID NO: 1738821 - DNA, 11 bp, Homo sapiens
gacaggagcct

SEQ ID NO: 1738822 - DNA, 19 bp, Homo sapiens
gacaggagcctagcggagc

SEQ ID NO: 1738823 - DNA, 16 bp, Homo sapiens
gacaggatgaggacag

SEQ ID NO: 1738824 - DNA, 17 bp, Homo sapiens
gacaggatgaggacaga

SEQ ID NO: 1738825 - DNA, 22 bp, Homo sapiens
gacaggatgaggacagagggca

SEQ ID NO: 1738826 - DNA, 14 bp, Homo sapiens
gacaggcagcctcc

SEQ ID NO: 1738827 - DNA, 14 bp, Homo sapiens
gacaggcccaagag

SEQ ID NO: 1738828 - DNA, 15 bp, Homo sapiens
gacaggcccaagaga

SEQ ID NO: 1738829 - DNA, 16 bp, Homo sapiens
gacaggcccaagagat

SEQ ID NO: 1738830 - DNA, 22 bp, Homo sapiens
gacaggcccaagagatgaagag

SEQ ID NO: 1738831 - DNA, 21 bp, Homo sapiens
gacaggcccagcgcggccagc

SEQ ID NO: 1738832 - DNA, 22 bp, Homo sapiens
gacaggcccagcgcggccagcg

SEQ ID NO: 1738833 - DNA, 15 bp, Homo sapiens
gacaggcgcctgcca

SEQ ID NO: 1738834 - DNA, 16 bp, Homo sapiens
gacaggcggggcccag

SEQ ID NO: 1738835 - DNA, 20 bp, Homo sapiens
tggccccagccctgctgggg

SEQ ID NO: 1738836 - DNA, 19 bp, Homo sapiens
tggccccatgtctctcaga

SEQ ID NO: 1738837 - DNA, 17 bp, Homo sapiens
tggcccccaataaaggc

SEQ ID NO: 1738838 - DNA, 12 bp, Homo sapiens
tggcccccaggg

SEQ ID NO: 1738839 - DNA, 15 bp, Homo sapiens
tggcccccatacttg

SEQ ID NO: 1738840 - DNA, 22 bp, Homo sapiens
tggcccccatacttggctgctt

SEQ ID NO: 1738841 - DNA, 12 bp, Homo sapiens
tggcccctccag

SEQ ID NO: 1738842 - DNA, 14 bp, Homo sapiens
tggcccctccagca

SEQ ID NO: 1738843 - DNA, 16 bp, Homo sapiens
tggcccctccagcaca

SEQ ID NO: 1738844 - DNA, 14 bp, Homo sapiens
tggcccctctgacc

SEQ ID NO: 1738845 - DNA, 18 bp, Homo sapiens
tggcccctctgacctgca

SEQ ID NO: 1738846 - DNA, 16 bp, Homo sapiens
tggcccctgagcccag

SEQ ID NO: 1738847 - DNA, 16 bp, Homo sapiens
tgagattacaggcatg

SEQ ID NO: 1738848 - DNA, 15 bp, Homo sapiens
tgagattctcaaagg

SEQ ID NO: 1738849 - DNA, 19 bp, Homo sapiens
tgagattctttaaggagat

SEQ ID NO: 1738850 - DNA, 13 bp, Homo sapiens
tgagattggtttt

SEQ ID NO: 1738851 - DNA, 18 bp, Homo sapiens
tgagatttcatctgctct

SEQ ID NO: 1738852 - DNA, 22 bp, Homo sapiens
tgagatttcatctgctctcctt

SEQ ID NO: 1738853 - DNA, 22 bp, Homo sapiens
tgagatttgccagcacaggggc

SEQ ID NO: 1738854 - DNA, 21 bp, Homo sapiens
tgagattttcctccattttta

SEQ ID NO: 1738855 - DNA, 22 bp, Homo sapiens
tgagatttttaaaaaatatttt

SEQ ID NO: 1738856 - DNA, 19 bp, Homo sapiens
tgagcaaatattaaaattg

SEQ ID NO: 1738857 - DNA, 17 bp, Homo sapiens
tgagcaactgcgacaaa

SEQ ID NO: 1738858 - DNA, 21 bp, Homo sapiens
tgagcaagatcttgtctccac

SEQ ID NO: 1738859 - DNA, 21 bp, Homo sapiens
tgagcaaggagcacaagccac

SEQ ID NO: 1738860 - DNA, 17 bp, Homo sapiens
tgagcaagggggcccaa

SEQ ID NO: 1738861 - DNA, 17 bp, Homo sapiens
tgagcaatgtctgtgct

SEQ ID NO: 1738862 - DNA, 18 bp, Homo sapiens
tgagcacacccgtgtgca

SEQ ID NO: 1738863 - DNA, 16 bp, Homo sapiens
tgagcaccctctggat

SEQ ID NO: 1738864 - DNA, 22 bp, Homo sapiens
tgagcaccgtgtcaagctgctc

SEQ ID NO: 1738865 - DNA, 14 bp, Homo sapiens
tgagcacctcccag

SEQ ID NO: 1738866 - DNA, 15 bp, Homo sapiens
tgagcacctcccagc

SEQ ID NO: 1738867 - DNA, 16 bp, Homo sapiens
tgagcacctcccagcc

SEQ ID NO: 1738868 - DNA, 22 bp, Homo sapiens
tggaatcttcacctcagagtgg

SEQ ID NO: 1738869 - DNA, 21 bp, Homo sapiens
tggaatcttctctttgacaat

SEQ ID NO: 1738870 - DNA, 22 bp, Homo sapiens
tggaatcttctctttgacaatt

SEQ ID NO: 1738871 - DNA, 15 bp, Homo sapiens
tggaatgcagaggtc

SEQ ID NO: 1738872 - DNA, 20 bp, Homo sapiens
tggaatgcagaggtctccaa

SEQ ID NO: 1738873 - DNA, 16 bp, Homo sapiens
tggaatgcttcctaga

SEQ ID NO: 1738874 - DNA, 18 bp, Homo sapiens
tggaatggaactactgta

SEQ ID NO: 1738875 - DNA, 20 bp, Homo sapiens
tggaatggaactactgtact

SEQ ID NO: 1738876 - DNA, 15 bp, Homo sapiens
tggaatggatttttc

SEQ ID NO: 1738877 - DNA, 23 bp, Homo sapiens
tggaattagaacccttgcacagc

SEQ ID NO: 1738878 - DNA, 13 bp, Homo sapiens
tggaattcagcac

SEQ ID NO: 1738879 - DNA, 17 bp, Homo sapiens
tggaattcagcaccctg

SEQ ID NO: 1738880 - DNA, 15 bp, Homo sapiens
tggaatttgttcaag

SEQ ID NO: 1738881 - DNA, 15 bp, Homo sapiens
tggaattttgcaaag

SEQ ID NO: 1738882 - DNA, 13 bp, Homo sapiens
tggacaaaggaat

SEQ ID NO: 1738883 - DNA, 23 bp, Homo sapiens
tggacaaatcacatattttaaaa

SEQ ID NO: 1738884 - DNA, 21 bp, Homo sapiens
tggacaacttatttaaaaata

SEQ ID NO: 1738885 - DNA, 16 bp, Homo sapiens
tggacacagctcttca

SEQ ID NO: 1738886 - DNA, 17 bp, Homo sapiens
tggacacagctcttcat

SEQ ID NO: 1738887 - DNA, 18 bp, Homo sapiens
tggacacagctcttcatt

SEQ ID NO: 1738888 - DNA, 15 bp, Homo sapiens
tggacaccctctgcc

SEQ ID NO: 1738889 - DNA, 16 bp, Homo sapiens
tggacaccctctgccg

SEQ ID NO: 1738890 - DNA, 15 bp, Homo sapiens
ttccactacacctgg

SEQ ID NO: 1738891 - DNA, 16 bp, Homo sapiens
ttccactacacctggc

SEQ ID NO: 1738892 - DNA, 18 bp, Homo sapiens
ttccactacacctggctg

SEQ ID NO: 1738893 - DNA, 16 bp, Homo sapiens
ttccactcctatggaa

SEQ ID NO: 1738894 - DNA, 23 bp, Homo sapiens
ttccactggcttttgcctgtaag

SEQ ID NO: 1738895 - DNA, 17 bp, Homo sapiens
ttccacttgtttgcact

SEQ ID NO: 1738896 - DNA, 17 bp, Homo sapiens
ttccagaaaaccccagc

SEQ ID NO: 1738897 - DNA, 22 bp, Homo sapiens
ttccagaaaggatatttaagaa

SEQ ID NO: 1738898 - DNA, 15 bp, Homo sapiens
ttccagaacagccct

SEQ ID NO: 1738899 - DNA, 16 bp, Homo sapiens
ttccagaacagccctc

SEQ ID NO: 1738900 - DNA, 19 bp, Homo sapiens
ttccagaacagccctcggc

SEQ ID NO: 1738901 - DNA, 21 bp, Homo sapiens
ttccagaagaaagatggaaat

SEQ ID NO: 1738902 - DNA, 16 bp, Homo sapiens
ttccagaagaagagaa

SEQ ID NO: 1738903 - DNA, 18 bp, Homo sapiens
ttccagaagaagagaagc

SEQ ID NO: 1738904 - DNA, 15 bp, Homo sapiens
ttccagaatcccaag

SEQ ID NO: 1738905 - DNA, 15 bp, Homo sapiens
ttccagaatgctgaa

SEQ ID NO: 1738906 - DNA, 23 bp, Homo sapiens
ttccagactgcttccaattttct

SEQ ID NO: 1738907 - DNA, 21 bp, Homo sapiens
ttccagagagtggctcctccc

SEQ ID NO: 1738908 - DNA, 16 bp, Homo sapiens
ttccagaggtattcct

SEQ ID NO: 1738909 - DNA, 21 bp, Homo sapiens
ttccagatggcccccagctgg

SEQ ID NO: 1738910 - DNA, 16 bp, Homo sapiens
ttccagcagaagacaa

SEQ ID NO: 1738911 - DNA, 22 bp, Homo sapiens
ttccagcagaagacaaaaagac

SEQ ID NO: 1738912 - DNA, 22 bp, Homo sapiens
ttccagcagtgaatgctagaca

SEQ ID NO: 1738913 - DNA, 20 bp, Homo sapiens
ttccagcatttagctggcca

SEQ ID NO: 1738914 - DNA, 14 bp, Homo sapiens
ttccagcccctctg

SEQ ID NO: 1738915 - DNA, 17 bp, Homo sapiens
ttccagcccctctggtc

SEQ ID NO: 1738916 - DNA, 11 bp, Homo sapiens
ttccagctcct

SEQ ID NO: 1738917 - DNA, 15 bp, Homo sapiens
ttccagctctgcccc

SEQ ID NO: 1738918 - DNA, 16 bp, Homo sapiens
ttccagctctgccccc

SEQ ID NO: 1738919 - DNA, 13 bp, Homo sapiens
ttccagctgctgt

SEQ ID NO: 1738920 - DNA, 15 bp, Homo sapiens
ttccaggaaaaaata

SEQ ID NO: 1738921 - DNA, 21 bp, Homo sapiens
ttccaggaaactccacatctg

SEQ ID NO: 1738922 - DNA, 22 bp, Homo sapiens
ttccaggaaactccacatctgc

SEQ ID NO: 1738923 - DNA, 19 bp, Homo sapiens
ttccaggcagcctctgtca

SEQ ID NO: 1738924 - DNA, 13 bp, Homo sapiens
ttccaggcccctg

SEQ ID NO: 1738925 - DNA, 21 bp, Homo sapiens
ttccaggcccctgaggactgg

SEQ ID NO: 1738926 - DNA, 11 bp, Homo sapiens
ttccaggctct

SEQ ID NO: 1738927 - DNA, 11 bp, Homo sapiens
ttccaggctga

SEQ ID NO: 1738928 - DNA, 14 bp, Homo sapiens
ttccaggctgagcc

SEQ ID NO: 1738929 - DNA, 23 bp, Homo sapiens
ttctgtggttttcccctccctgg

SEQ ID NO: 1738930 - DNA, 14 bp, Homo sapiens
ttctgtgtatctct

SEQ ID NO: 1738931 - DNA, 23 bp, Homo sapiens
ttctgtgtcagagcccagcccag

SEQ ID NO: 1738932 - DNA, 23 bp, Homo sapiens
ttctgtgtctttcacagctcctc

SEQ ID NO: 1738933 - DNA, 12 bp, Homo sapiens
ttctgtgtgtga

SEQ ID NO: 1738934 - DNA, 20 bp, Homo sapiens
ttcttgtaagccatcagaag

SEQ ID NO: 1738935 - DNA, 23 bp, Homo sapiens
ttcttgtaatttaaacaggccca

SEQ ID NO: 1738936 - DNA, 14 bp, Homo sapiens
ttcttgtcacaaat

SEQ ID NO: 1738937 - DNA, 16 bp, Homo sapiens
ttcttgtcacaataaa

SEQ ID NO: 1738938 - DNA, 22 bp, Homo sapiens
ttcttgtgccatagtcacatgg

SEQ ID NO: 1738939 - DNA, 14 bp, Homo sapiens
ttcttgtgcttttc

SEQ ID NO: 1738940 - DNA, 19 bp, Homo sapiens
ttcttgtggttaaaaacct

SEQ ID NO: 1738941 - DNA, 16 bp, Homo sapiens
ttcttgtgtcctggta

SEQ ID NO: 1738942 - DNA, 14 bp, Homo sapiens
ttcttgtttaccaa

SEQ ID NO: 1738943 - DNA, 14 bp, Homo sapiens
ttcttgtttgaatt

SEQ ID NO: 1738944 - DNA, 14 bp, Homo sapiens
ttcttgtttgtcag

SEQ ID NO: 1738945 - DNA, 20 bp, Homo sapiens
ttctttaaagttcttctaag

SEQ ID NO: 1738946 - DNA, 19 bp, Homo sapiens
ttctttaacatacatctaa

SEQ ID NO: 1738947 - DNA, 13 bp, Homo sapiens
ttctttaaggaga

SEQ ID NO: 1738948 - DNA, 14 bp, Homo sapiens
ttctttacctgaga

SEQ ID NO: 1738949 - DNA, 18 bp, Homo sapiens
ttctttactgcactcaga

SEQ ID NO: 1738950 - DNA, 11 bp, Homo sapiens
ttctttagaac

SEQ ID NO: 1738951 - DNA, 20 bp, Homo sapiens
ttctttagaatttttaccca

SEQ ID NO: 1738952 - DNA, 22 bp, Homo sapiens
ttctttagcatttttatgcaga

SEQ ID NO: 1738953 - DNA, 15 bp, Homo sapiens
ttctttagtactcaa

SEQ ID NO: 1738954 - DNA, 15 bp, Homo sapiens
ttctttattctgtgt

SEQ ID NO: 1738955 - DNA, 13 bp, Homo sapiens
ttctttcctccca

SEQ ID NO: 1738956 - DNA, 14 bp, Homo sapiens
ttctttcctcccag

SEQ ID NO: 1738957 - DNA, 19 bp, Homo sapiens
ttctttcctccccctgcaa

SEQ ID NO: 1738958 - DNA, 21 bp, Homo sapiens
ttctttcctccccctgcaact

SEQ ID NO: 1738959 - DNA, 21 bp, Homo sapiens
ttctttcctctttctgctctg

SEQ ID NO: 1738960 - DNA, 12 bp, Homo sapiens
ttctttctatgt

SEQ ID NO: 1738961 - DNA, 12 bp, Homo sapiens
ttctttctgaga

SEQ ID NO: 1738962 - DNA, 12 bp, Homo sapiens
ttctttctgtct

SEQ ID NO: 1738963 - DNA, 9 bp, Homo sapiens
ttctttctt

SEQ ID NO: 1738964 - DNA, 13 bp, Homo sapiens
ttctttcttcctc

SEQ ID NO: 1738965 - DNA, 15 bp, Homo sapiens
ttctttgaaattgtt

SEQ ID NO: 1738966 - DNA, 18 bp, Homo sapiens
ttctttgaccagatcttt

SEQ ID NO: 1738967 - DNA, 17 bp, Homo sapiens
ttctttgagtaatgtga

SEQ ID NO: 1738968 - DNA, 15 bp, Homo sapiens
ttctttgatcatgaa

SEQ ID NO: 1738969 - DNA, 22 bp, Homo sapiens
ttctttgcaccaaagacatcag

SEQ ID NO: 1738970 - DNA, 13 bp, Homo sapiens
ttctttgcctctg

SEQ ID NO: 1738971 - DNA, 22 bp, Homo sapiens
ttctttgctagttggagtgctt

SEQ ID NO: 1738972 - DNA, 15 bp, Homo sapiens
ttctttgtacctttt

SEQ ID NO: 1738973 - DNA, 13 bp, Homo sapiens
ttctttgtgcctt

SEQ ID NO: 1738974 - DNA, 12 bp, Homo sapiens
ttctttgtgtag

SEQ ID NO: 1738975 - DNA, 11 bp, Homo sapiens
ttctttgtgtt

SEQ ID NO: 1738976 - DNA, 12 bp, Homo sapiens
ttctttgtttct

SEQ ID NO: 1738977 - DNA, 16 bp, Homo sapiens
ttcttttatatctgta

SEQ ID NO: 1738978 - DNA, 13 bp, Homo sapiens
ttcttttcacatt

SEQ ID NO: 1738979 - DNA, 14 bp, Homo sapiens
ttcttttcatcaaa

SEQ ID NO: 1738980 - DNA, 14 bp, Homo sapiens
ttcttttctattta

SEQ ID NO: 1738981 - DNA, 21 bp, Homo sapiens
ttcttttctggaatgtaatca

SEQ ID NO: 1738982 - DNA, 15 bp, Homo sapiens
ttcttttctggccaa

SEQ ID NO: 1738983 - DNA, 12 bp, Homo sapiens
ttcttttgtaaa

SEQ ID NO: 1738984 - DNA, 18 bp, Homo sapiens
ttctttttacagcattgt

SEQ ID NO: 1738985 - DNA, 20 bp, Homo sapiens
ttctttttacagcattgtct

SEQ ID NO: 1738986 - DNA, 15 bp, Homo sapiens
ttctttttctttctt

SEQ ID NO: 1738987 - DNA, 14 bp, Homo sapiens
ttctttttgccagt

SEQ ID NO: 1738988 - DNA, 20 bp, Homo sapiens
ttctttttgctctaaaatat

SEQ ID NO: 1738989 - DNA, 19 bp, Homo sapiens
ttctttttgggagagactt

SEQ ID NO: 1738990 - DNA, 21 bp, Homo sapiens
ttctttttgggagagacttgt

SEQ ID NO: 1738991 - DNA, 12 bp, Homo sapiens
ttctttttgggg

SEQ ID NO: 1738992 - DNA, 14 bp, Homo sapiens
ttcttttttaagtt

SEQ ID NO: 1738993 - DNA, 14 bp, Homo sapiens
ttctttttttaact

SEQ ID NO: 1738994 - DNA, 16 bp, Homo sapiens
ttgaaaaaaaagtttt

SEQ ID NO: 1738995 - DNA, 12 bp, Homo sapiens
ttgaaaaacaaa

SEQ ID NO: 1738996 - DNA, 17 bp, Homo sapiens
ttgaaaaatataaaatt

SEQ ID NO: 1738997 - DNA, 19 bp, Homo sapiens
ttgaaaaatataaaattat

SEQ ID NO: 1738998 - DNA, 13 bp, Homo sapiens
ttgaaaacagata

SEQ ID NO: 1738999 - DNA, 19 bp, Homo sapiens
ttgaaaacagatattacag

SEQ ID NO: 1739000 - DNA, 16 bp, Homo sapiens
ttgaaaaccacagtca

SEQ ID NO: 1739001 - DNA, 16 bp, Homo sapiens
ttgaaaacttttctca

SEQ ID NO: 1739002 - DNA, 15 bp, Homo sapiens
ttgaaaagaaagaaa

SEQ ID NO: 1739003 - DNA, 20 bp, Homo sapiens
ttgaaaagaagaaagtctat

SEQ ID NO: 1739004 - DNA, 22 bp, Homo sapiens
ttgaaaagaagaaagtctatgc

SEQ ID NO: 1739005 - DNA, 23 bp, Homo sapiens
ttgaaaagactccaaagaaatgt

SEQ ID NO: 1739006 - DNA, 15 bp, Homo sapiens
ttgaaaatcttgtgt

SEQ ID NO: 1739007 - DNA, 16 bp, Homo sapiens
ttgaaaattatgcaaa

SEQ ID NO: 1739008 - DNA, 18 bp, Homo sapiens
ttgaaaattatgcaaaag

SEQ ID NO: 1739009 - DNA, 14 bp, Homo sapiens
ttgaaacctgttaa

SEQ ID NO: 1739010 - DNA, 23 bp, Homo sapiens
ttgaaactgagatgtgaacacat

SEQ ID NO: 1739011 - DNA, 20 bp, Homo sapiens
ttgaaactttgagatctaaa

SEQ ID NO: 1739012 - DNA, 12 bp, Homo sapiens
ttgaaagacatc

SEQ ID NO: 1739013 - DNA, 14 bp, Homo sapiens
ttgaaagacatcaa

SEQ ID NO: 1739014 - DNA, 17 bp, Homo sapiens
ttgaaagagaaccagtt

SEQ ID NO: 1739015 - DNA, 20 bp, Homo sapiens
ttgaaagagaaccagtttca

SEQ ID NO: 1739016 - DNA, 14 bp, Homo sapiens
ttgaaagagatggc

SEQ ID NO: 1739017 - DNA, 23 bp, Homo sapiens
ttgaaagccaacaactctgcctt

SEQ ID NO: 1739018 - DNA, 22 bp, Homo sapiens
ttgaaagctgtggccagcttgt

SEQ ID NO: 1739019 - DNA, 21 bp, Homo sapiens
ttgaaaggcattctctgaaga

SEQ ID NO: 1739020 - DNA, 12 bp, Homo sapiens
ttgaaagtagag

SEQ ID NO: 1739021 - DNA, 16 bp, Homo sapiens
ttgaaagtagagctag

SEQ ID NO: 1739022 - DNA, 15 bp, Homo sapiens
ttgaaagttctggaa

SEQ ID NO: 1739023 - DNA, 16 bp, Homo sapiens
ttgaaataagaattca

SEQ ID NO: 1739024 - DNA, 21 bp, Homo sapiens
ttgaaataagaattcagacat

SEQ ID NO: 1739025 - DNA, 19 bp, Homo sapiens
ttgaaatagtatacattgt

SEQ ID NO: 1739026 - DNA, 20 bp, Homo sapiens
ttgaaatatgtagtattaaa

SEQ ID NO: 1739027 - DNA, 17 bp, Homo sapiens
ttgaaatgaaagggaaa

SEQ ID NO: 1739028 - DNA, 21 bp, Homo sapiens
ttgaaatgagtaaaaactaga

SEQ ID NO: 1739029 - DNA, 21 bp, Homo sapiens
ttgaaatgctcttttgcacaa

SEQ ID NO: 1739030 - DNA, 11 bp, Homo sapiens
ttgaaatgctg

SEQ ID NO: 1739031 - DNA, 13 bp, Homo sapiens
ttgaaatgctgaa

SEQ ID NO: 1739032 - DNA, 17 bp, Homo sapiens
ttgaaatgctgaaaatt

SEQ ID NO: 1739033 - DNA, 13 bp, Homo sapiens
ttgaaattctatt

SEQ ID NO: 1739034 - DNA, 22 bp, Homo sapiens
ttgaacacaattgatacttcag

SEQ ID NO: 1739035 - DNA, 14 bp, Homo sapiens
ttgaaccccctccc

SEQ ID NO: 1739036 - DNA, 12 bp, Homo sapiens
ttgaacctggga

SEQ ID NO: 1739037 - DNA, 17 bp, Homo sapiens
ttgaacgagcagcccag

SEQ ID NO: 1739038 - DNA, 15 bp, Homo sapiens
ttgaacgtgcttctt

SEQ ID NO: 1739039 - DNA, 19 bp, Homo sapiens
ttgaacgtgcttctttgta

SEQ ID NO: 1739040 - DNA, 23 bp, Homo sapiens
ttgaactctgttcccccaccctc

SEQ ID NO: 1739041 - DNA, 17 bp, Homo sapiens
ttgaactgttagaatgt

SEQ ID NO: 1739042 - DNA, 14 bp, Homo sapiens
ttgaacttttgtac

SEQ ID NO: 1739043 - DNA, 12 bp, Homo sapiens
ttgaagacaatt

SEQ ID NO: 1739044 - DNA, 16 bp, Homo sapiens
ttgaagacaatttgat

SEQ ID NO: 1739045 - DNA, 20 bp, Homo sapiens
ttgaagacacagcctccccc

SEQ ID NO: 1739046 - DNA, 22 bp, Homo sapiens
ttgaagacagagcaaagcgccc

SEQ ID NO: 1739047 - DNA, 13 bp, Homo sapiens
ttgaagacgtgga

SEQ ID NO: 1739048 - DNA, 14 bp, Homo sapiens
ttgaagacgtggac

SEQ ID NO: 1739049 - DNA, 20 bp, Homo sapiens
ttgaagagacagagacaagt

SEQ ID NO: 1739050 - DNA, 13 bp, Homo sapiens
ttcctgaatccaa

SEQ ID NO: 1739051 - DNA, 14 bp, Homo sapiens
ttcctgaatgaaat

SEQ ID NO: 1739052 - DNA, 20 bp, Homo sapiens
ttcctgaattctatttgctg

SEQ ID NO: 1739053 - DNA, 22 bp, Homo sapiens
ttcctgaattctatttgctggg

SEQ ID NO: 1739054 - DNA, 15 bp, Homo sapiens
ttcctgacccaggcc

SEQ ID NO: 1739055 - DNA, 16 bp, Homo sapiens
ttcctgacccaggccg

SEQ ID NO: 1739056 - DNA, 16 bp, Homo sapiens
ttcctgacttgagtgt

SEQ ID NO: 1739057 - DNA, 16 bp, Homo sapiens
ttcctgagctgtcgct

SEQ ID NO: 1739058 - DNA, 21 bp, Homo sapiens
ttcctgaggaagagggactgt

SEQ ID NO: 1739059 - DNA, 20 bp, Homo sapiens
ttcctgagttaggctttctc

SEQ ID NO: 1739060 - DNA, 19 bp, Homo sapiens
ttcctgataataattgatc

SEQ ID NO: 1739061 - DNA, 13 bp, Homo sapiens
ttcctgatgaccc

SEQ ID NO: 1739062 - DNA, 21 bp, Homo sapiens
ttcctgatgacccaggctgcc

SEQ ID NO: 1739063 - DNA, 23 bp, Homo sapiens
ttcctgatgctgggcaatgaggc

SEQ ID NO: 1739064 - DNA, 17 bp, Homo sapiens
ttcctgattgtttacag

SEQ ID NO: 1739065 - DNA, 20 bp, Homo sapiens
ttcctgcaactcaaggactt

SEQ ID NO: 1739066 - DNA, 21 bp, Homo sapiens
ttcctgcaggcaggaacaaac

SEQ ID NO: 1739067 - DNA, 11 bp, Homo sapiens
ttcctgcatgt

SEQ ID NO: 1739068 - DNA, 18 bp, Homo sapiens
ttcctgccatgtttagtg

SEQ ID NO: 1739069 - DNA, 13 bp, Homo sapiens
ttcctgccccagg

SEQ ID NO: 1739070 - DNA, 19 bp, Homo sapiens
ttcctgccctgctgtttat

SEQ ID NO: 1739071 - DNA, 17 bp, Homo sapiens
ttcctgcccttcctcag

SEQ ID NO: 1739072 - DNA, 18 bp, Homo sapiens
ttcctgcccttcctcagt

SEQ ID NO: 1739073 - DNA, 18 bp, Homo sapiens
ttcctgcctgtctccttt

SEQ ID NO: 1739074 - DNA, 19 bp, Homo sapiens
ttcctgcctttaagccaaa

SEQ ID NO: 1739075 - DNA, 19 bp, Homo sapiens
ttcctgcgtcctcctcacc

SEQ ID NO: 1739076 - DNA, 18 bp, Homo sapiens
ttcctgctgaacgtttcc

SEQ ID NO: 1739077 - DNA, 11 bp, Homo sapiens
ttcgaggcctg

SEQ ID NO: 1739078 - DNA, 20 bp, Homo sapiens
ttcgaggcctgaagccagct

SEQ ID NO: 1739079 - DNA, 18 bp, Homo sapiens
ttcgcaccattctcctgc

SEQ ID NO: 1739080 - DNA, 22 bp, Homo sapiens
ttcgccgaatggggcagcacca

SEQ ID NO: 1739081 - DNA, 16 bp, Homo sapiens
ttcgcctttgtcttgt

SEQ ID NO: 1739082 - DNA, 20 bp, Homo sapiens
ttcgcctttgtcttgtactt

SEQ ID NO: 1739083 - DNA, 12 bp, Homo sapiens
ttcgctgcaacc

SEQ ID NO: 1739084 - DNA, 15 bp, Homo sapiens
ttcgctgctctagct

SEQ ID NO: 1739085 - DNA, 22 bp, Homo sapiens
ttcgcttcttgcctctgtgctg

SEQ ID NO: 1739086 - DNA, 17 bp, Homo sapiens
ttcggatttggggtgga

SEQ ID NO: 1739087 - DNA, 18 bp, Homo sapiens
ttcggccccatgtatctc

SEQ ID NO: 1739088 - DNA, 13 bp, Homo sapiens
ttcgggctgtgcc

SEQ ID NO: 1739089 - DNA, 13 bp, Homo sapiens
ttcggggcctcct

SEQ ID NO: 1739090 - DNA, 15 bp, Homo sapiens
ttcgtagcatgagtt

SEQ ID NO: 1739091 - DNA, 17 bp, Homo sapiens
ttcgtccatgtttctca

SEQ ID NO: 1739092 - DNA, 12 bp, Homo sapiens
ttcgtgaacata

SEQ ID NO: 1739093 - DNA, 21 bp, Homo sapiens
ttcgtgaagtatactgtattt

SEQ ID NO: 1739094 - DNA, 13 bp, Homo sapiens
ttcgtgagctggg

SEQ ID NO: 1739095 - DNA, 15 bp, Homo sapiens
ttcgtgagctgggga

SEQ ID NO: 1739096 - DNA, 18 bp, Homo sapiens
ttcgtgagctggggactc

SEQ ID NO: 1739097 - DNA, 13 bp, Homo sapiens
ttcgtggggaggt

SEQ ID NO: 1739098 - DNA, 22 bp, Homo sapiens
ttcgtggtgatcaattaaatgt

SEQ ID NO: 1739099 - DNA, 23 bp, Homo sapiens
ttcgtgtagtggaagagcagcct

SEQ ID NO: 1739100 - DNA, 17 bp, Homo sapiens
ttcgtgtgtgtctgctt

SEQ ID NO: 1739101 - DNA, 19 bp, Homo sapiens
ttcgttaactgtgtatgta

SEQ ID NO: 1739102 - DNA, 14 bp, Homo sapiens
ttcgttgtccaatt

SEQ ID NO: 1739103 - DNA, 14 bp, Homo sapiens
ttcgtttccatcat

SEQ ID NO: 1739104 - DNA, 12 bp, Homo sapiens
ttcgttttggag

SEQ ID NO: 1739105 - DNA, 16 bp, Homo sapiens
ttctaaaacaataaag

SEQ ID NO: 1739106 - DNA, 15 bp, Homo sapiens
ttctaaaacattctt

SEQ ID NO: 1739107 - DNA, 23 bp, Homo sapiens
ttctaaaatgtgatgttctaagg

SEQ ID NO: 1739108 - DNA, 13 bp, Homo sapiens
ttctaaactgttt

SEQ ID NO: 1739109 - DNA, 21 bp, Homo sapiens
ttctaaactgttttcatgtgt

SEQ ID NO: 1739110 - DNA, 13 bp, Homo sapiens
ttctaaagatgga

SEQ ID NO: 1739111 - DNA, 19 bp, Homo sapiens
ttctaaatccgacttgaat

SEQ ID NO: 1739112 - DNA, 15 bp, Homo sapiens
ttctaaatgaatgtt

SEQ ID NO: 1739113 - DNA, 20 bp, Homo sapiens
ttctaaatgcatatcctgag

SEQ ID NO: 1739114 - DNA, 14 bp, Homo sapiens
ttctaaattttata

SEQ ID NO: 1739115 - DNA, 20 bp, Homo sapiens
ttctaacaaaaaaatatatt

SEQ ID NO: 1739116 - DNA, 20 bp, Homo sapiens
ttctaaccttgaatgctgcc

SEQ ID NO: 1739117 - DNA, 21 bp, Homo sapiens
ttctaaccttgaatgctgcca

SEQ ID NO: 1739118 - DNA, 16 bp, Homo sapiens
ttctaagaaaagcatt

SEQ ID NO: 1739119 - DNA, 16 bp, Homo sapiens
ttctaagaaaatgtag

SEQ ID NO: 1739120 - DNA, 20 bp, Homo sapiens
ttctaagactcaaatgttct

SEQ ID NO: 1739121 - DNA, 12 bp, Homo sapiens
ttctaagagaag

SEQ ID NO: 1739122 - DNA, 22 bp, Homo sapiens
ttctaagagcgaacttcacata

SEQ ID NO: 1739123 - DNA, 23 bp, Homo sapiens
ttctaagatgccagcatatactg

SEQ ID NO: 1739124 - DNA, 21 bp, Homo sapiens
ttctaagatgtgatattctaa

SEQ ID NO: 1739125 - DNA, 15 bp, Homo sapiens
ttctaagattctaat

SEQ ID NO: 1739126 - DNA, 17 bp, Homo sapiens
ttctaagattctaatga

SEQ ID NO: 1739127 - DNA, 18 bp, Homo sapiens
ttctaagcaatgcaaatg

SEQ ID NO: 1739128 - DNA, 21 bp, Homo sapiens
ttctaagcaatgcaaatgtct

SEQ ID NO: 1739129 - DNA, 17 bp, Homo sapiens
ttctaaggcctaggatt

SEQ ID NO: 1739130 - DNA, 12 bp, Homo sapiens
ttctaaggctct

SEQ ID NO: 1739131 - DNA, 17 bp, Homo sapiens
ttctaagtaaaaccaca

SEQ ID NO: 1739132 - DNA, 19 bp, Homo sapiens
ttctaagtaaaaccacagc

SEQ ID NO: 1739133 - DNA, 20 bp, Homo sapiens
ttctaagtaaaaccacagca

SEQ ID NO: 1739134 - DNA, 20 bp, Homo sapiens
ttctaagtttctaagattct

SEQ ID NO: 1739135 - DNA, 18 bp, Homo sapiens
ttctaataaatatactat

SEQ ID NO: 1739136 - DNA, 22 bp, Homo sapiens
ttctaataaatatactatgaaa

SEQ ID NO: 1739137 - DNA, 12 bp, Homo sapiens
ttctaatagaac

SEQ ID NO: 1739138 - DNA, 13 bp, Homo sapiens
ttctaatgtttct

SEQ ID NO: 1739139 - DNA, 22 bp, Homo sapiens
ttctaattaaccttactaatta

SEQ ID NO: 1739140 - DNA, 17 bp, Homo sapiens
ttctaattcctgtttgt

SEQ ID NO: 1739141 - DNA, 14 bp, Homo sapiens
ttctaattgtaagt

SEQ ID NO: 1739142 - DNA, 20 bp, Homo sapiens
ttctacaactgattgcaaca

SEQ ID NO: 1739143 - DNA, 13 bp, Homo sapiens
ttctacaaggact

SEQ ID NO: 1739144 - DNA, 16 bp, Homo sapiens
ttctacaaggactcca

SEQ ID NO: 1739145 - DNA, 22 bp, Homo sapiens
ttctacaaggactccattggat

SEQ ID NO: 1739146 - DNA, 17 bp, Homo sapiens
ttctacacatgtaaaat

SEQ ID NO: 1739147 - DNA, 17 bp, Homo sapiens
ttctacataattgtgac

SEQ ID NO: 1739148 - DNA, 16 bp, Homo sapiens
ttctacatttcttaga

SEQ ID NO: 1739149 - DNA, 20 bp, Homo sapiens
ttctacatttgagggcccag

SEQ ID NO: 1739150 - DNA, 19 bp, Homo sapiens
ttctaccaaggtcttctta

SEQ ID NO: 1739151 - DNA, 17 bp, Homo sapiens
ttctaccaggcaaattc

SEQ ID NO: 1739152 - DNA, 22 bp, Homo sapiens
ttctaccatgaacagaaaacat

SEQ ID NO: 1739153 - DNA, 18 bp, Homo sapiens
ttctaccatttcagagag

SEQ ID NO: 1739154 - DNA, 20 bp, Homo sapiens
ttctacccagatggaaaaat

SEQ ID NO: 1739155 - DNA, 21 bp, Homo sapiens
ttctaccccaaggccagtagt

SEQ ID NO: 1739156 - DNA, 14 bp, Homo sapiens
ttctaccctagcca

SEQ ID NO: 1739157 - DNA, 18 bp, Homo sapiens
ttctaccctagccattcc

SEQ ID NO: 1739158 - DNA, 23 bp, Homo sapiens
ttctaccggagagagaatgtatt

SEQ ID NO: 1739159 - DNA, 21 bp, Homo sapiens
ttctaccgtggatttgtactt

SEQ ID NO: 1739160 - DNA, 18 bp, Homo sapiens
ttctactggaaaaaaata

SEQ ID NO: 1739161 - DNA, 23 bp, Homo sapiens
ttctactggcctgtaatctacca

SEQ ID NO: 1739162 - DNA, 22 bp, Homo sapiens
ttctacttttaactaataaaat

SEQ ID NO: 1739163 - DNA, 21 bp, Homo sapiens
ttctagaaacaaacatctaat

SEQ ID NO: 1739164 - DNA, 19 bp, Homo sapiens
ttctagaaagagaaacagt

SEQ ID NO: 1739165 - DNA, 19 bp, Homo sapiens
ttctagaaagtactttggc

SEQ ID NO: 1739166 - DNA, 15 bp, Homo sapiens
ttctagaagcacatg

SEQ ID NO: 1739167 - DNA, 19 bp, Homo sapiens
ttctagaagccacagtgcc

SEQ ID NO: 1739168 - DNA, 15 bp, Homo sapiens
ttctagaatttatca

SEQ ID NO: 1739169 - DNA, 15 bp, Homo sapiens
ttctagacacagtgt

SEQ ID NO: 1739170 - DNA, 16 bp, Homo sapiens
ttctcccttgccctcc

SEQ ID NO: 1739171 - DNA, 21 bp, Homo sapiens
ttctccgccagcctcctctgg

SEQ ID NO: 1739172 - DNA, 23 bp, Homo sapiens
ttctccggggtctgtgctgtgcc

SEQ ID NO: 1739173 - DNA, 19 bp, Homo sapiens
ttctccgttagctcctgtg

SEQ ID NO: 1739174 - DNA, 14 bp, Homo sapiens
ttctcctaaagctt

SEQ ID NO: 1739175 - DNA, 13 bp, Homo sapiens
ttctcctcccagg

SEQ ID NO: 1739176 - DNA, 11 bp, Homo sapiens
ttctcctcccc

SEQ ID NO: 1739177 - DNA, 13 bp, Homo sapiens
ttctcctgcctca

SEQ ID NO: 1739178 - DNA, 14 bp, Homo sapiens
ttctcctgcctcac

SEQ ID NO: 1739179 - DNA, 15 bp, Homo sapiens
ttctcctgcctgtgc

SEQ ID NO: 1739180 - DNA, 10 bp, Homo sapiens
ttctcctgga

SEQ ID NO: 1739181 - DNA, 20 bp, Homo sapiens
ttctcctttgataaaataaa

SEQ ID NO: 1739182 - DNA, 14 bp, Homo sapiens
ttctccttttccta

SEQ ID NO: 1739183 - DNA, 21 bp, Homo sapiens
ttctctaacttcaaggcccat

SEQ ID NO: 1739184 - DNA, 19 bp, Homo sapiens
ttctgccatctagccagcc

SEQ ID NO: 1739185 - DNA, 21 bp, Homo sapiens
ttctgccatctagccagcccc

SEQ ID NO: 1739186 - DNA, 19 bp, Homo sapiens
ttctgcccacattggaccc

SEQ ID NO: 1739187 - DNA, 19 bp, Homo sapiens
ttctgcccccgttccagct

SEQ ID NO: 1739188 - DNA, 20 bp, Homo sapiens
ttctgcccccgttccagctg

SEQ ID NO: 1739189 - DNA, 20 bp, Homo sapiens
ttctgcccggctacatcagc

SEQ ID NO: 1739190 - DNA, 19 bp, Homo sapiens
ttctgccctgcctgaggag

SEQ ID NO: 1739191 - DNA, 12 bp, Homo sapiens
ttctgcccttct

SEQ ID NO: 1739192 - DNA, 15 bp, Homo sapiens
ttctgcctaacttgt

SEQ ID NO: 1739193 - DNA, 15 bp, Homo sapiens
ttctgcctagagtgt

SEQ ID NO: 1739194 - DNA, 14 bp, Homo sapiens
ttctgcctcagcct

SEQ ID NO: 1739195 - DNA, 21 bp, Homo sapiens
ttctgcctcagcctcctgagt

SEQ ID NO: 1739196 - DNA, 18 bp, Homo sapiens
ttctgcctctctaggacc

SEQ ID NO: 1739197 - DNA, 11 bp, Homo sapiens
ttctgcctgag

SEQ ID NO: 1739198 - DNA, 16 bp, Homo sapiens
ttctgcctgagattct

SEQ ID NO: 1739199 - DNA, 12 bp, Homo sapiens
ttctgcctgcca

SEQ ID NO: 1739200 - DNA, 13 bp, Homo sapiens
ttctgcctgttat

SEQ ID NO: 1739201 - DNA, 15 bp, Homo sapiens
ttctgcctgttataa

SEQ ID NO: 1739202 - DNA, 21 bp, Homo sapiens
ttctgcctgttataactctgc

SEQ ID NO: 1739203 - DNA, 24 bp, Homo sapiens
ttctgcctgttataactctgcact

SEQ ID NO: 1739204 - DNA, 16 bp, Homo sapiens
ttctgccttctcatga

SEQ ID NO: 1739205 - DNA, 13 bp, Homo sapiens
ttctgcctttaat

SEQ ID NO: 1739206 - DNA, 21 bp, Homo sapiens
ttctgcctttaattttcttgt

SEQ ID NO: 1739207 - DNA, 14 bp, Homo sapiens
ttctgcgctgtgta

SEQ ID NO: 1739208 - DNA, 23 bp, Homo sapiens
ttctgcgctgtgtacaatgtgag

SEQ ID NO: 1739209 - DNA, 15 bp, Homo sapiens
ttctgctaaatatca

SEQ ID NO: 1739210 - DNA, 16 bp, Homo sapiens
ttctgctaaatttcaa

SEQ ID NO: 1739211 - DNA, 15 bp, Homo sapiens
ttctgctacctcact

SEQ ID NO: 1739212 - DNA, 21 bp, Homo sapiens
ttctgctacctcactggggtc

SEQ ID NO: 1739213 - DNA, 15 bp, Homo sapiens
ttctgctacttcact

SEQ ID NO: 1739214 - DNA, 9 bp, Homo sapiens
ttctgctcc

SEQ ID NO: 1739215 - DNA, 13 bp, Homo sapiens
ttctgctccaccc

SEQ ID NO: 1739216 - DNA, 14 bp, Homo sapiens
ttctgctgcccctg

SEQ ID NO: 1739217 - DNA, 21 bp, Homo sapiens
ttctgctggataaaatgaggt

SEQ ID NO: 1739218 - DNA, 14 bp, Homo sapiens
ttctgctggcctgg

SEQ ID NO: 1739219 - DNA, 19 bp, Homo sapiens
ttctgctggcctggatctc

SEQ ID NO: 1739220 - DNA, 17 bp, Homo sapiens
ttctgcttcgaagtatt

SEQ ID NO: 1739221 - DNA, 15 bp, Homo sapiens
ttctgcttgtgacat

SEQ ID NO: 1739222 - DNA, 16 bp, Homo sapiens
ttctgcttgtgacatt

SEQ ID NO: 1739223 - DNA, 15 bp, Homo sapiens
ttctgctttctgcct

SEQ ID NO: 1739224 - DNA, 19 bp, Homo sapiens
ttctgcttttctgccctgg

SEQ ID NO: 1739225 - DNA, 18 bp, Homo sapiens
ttctggaactgtctgaat

SEQ ID NO: 1739226 - DNA, 16 bp, Homo sapiens
ttctggaatgtaatca

SEQ ID NO: 1739227 - DNA, 19 bp, Homo sapiens
ttctggaatttgttcaagt

SEQ ID NO: 1739228 - DNA, 20 bp, Homo sapiens
ttctggaatttgttcaagtt

SEQ ID NO: 1739229 - DNA, 18 bp, Homo sapiens
ttctggacctgggcatga

SEQ ID NO: 1739230 - DNA, 23 bp, Homo sapiens
ttctggagatggaagcttgttga

SEQ ID NO: 1739231 - DNA, 17 bp, Homo sapiens
ttctggagatggatcct

SEQ ID NO: 1739232 - DNA, 19 bp, Homo sapiens
ttctggaggggagagcttt

SEQ ID NO: 1739233 - DNA, 20 bp, Homo sapiens
ttctggatagagtcctggga

SEQ ID NO: 1739234 - DNA, 14 bp, Homo sapiens
ttctggatctcctg

SEQ ID NO: 1739235 - DNA, 23 bp, Homo sapiens
ttctggatggccgggctgctgct

SEQ ID NO: 1739236 - DNA, 21 bp, Homo sapiens
ttctggcaaaaaggagccttt

SEQ ID NO: 1739237 - DNA, 11 bp, Homo sapiens
ttctggcaccg

SEQ ID NO: 1739238 - DNA, 17 bp, Homo sapiens
ttctggccagtgtttaa

SEQ ID NO: 1739239 - DNA, 12 bp, Homo sapiens
ttctggcccagc

SEQ ID NO: 1739240 - DNA, 14 bp, Homo sapiens
ttctggcctctgct

SEQ ID NO: 1739241 - DNA, 20 bp, Homo sapiens
ttctggcctgccttcgttaa

SEQ ID NO: 1739242 - DNA, 22 bp, Homo sapiens
ttctggctctcccatttcctga

SEQ ID NO: 1739243 - DNA, 21 bp, Homo sapiens
ttctgggaagcttgagcctcc

SEQ ID NO: 1739244 - DNA, 22 bp, Homo sapiens
ttctgggagctgcgccggacag

SEQ ID NO: 1739245 - DNA, 23 bp, Homo sapiens
ttctgggatatatggaggattct

SEQ ID NO: 1739246 - DNA, 19 bp, Homo sapiens
ttctgggcaccctcccacc

SEQ ID NO: 1739247 - DNA, 18 bp, Homo sapiens
ttctgggcagccaggctg

SEQ ID NO: 1739248 - DNA, 15 bp, Homo sapiens
ttctgggcgtctgag

SEQ ID NO: 1739249 - DNA, 20 bp, Homo sapiens
ttctggggaaaggggacaag

SEQ ID NO: 1739250 - DNA, 18 bp, Homo sapiens
ttctggggcaggctgggc

SEQ ID NO: 1739251 - DNA, 23 bp, Homo sapiens
ttctggggggacccagtgcagaa

SEQ ID NO: 1739252 - DNA, 19 bp, Homo sapiens
ttctggggggatatttcct

SEQ ID NO: 1739253 - DNA, 17 bp, Homo sapiens
ttctgggtcttttgcta

SEQ ID NO: 1739254 - DNA, 15 bp, Homo sapiens
ttctggtactttctg

SEQ ID NO: 1739255 - DNA, 14 bp, Homo sapiens
ttctggtccttttt

SEQ ID NO: 1739256 - DNA, 16 bp, Homo sapiens
ttctggtcctttttgg

SEQ ID NO: 1739257 - DNA, 20 bp, Homo sapiens
ttctggtgctactccatgca

SEQ ID NO: 1739258 - DNA, 15 bp, Homo sapiens
ttctggttccagggt

SEQ ID NO: 1739259 - DNA, 14 bp, Homo sapiens
ttctggttctaaca

SEQ ID NO: 1739260 - DNA, 13 bp, Homo sapiens
ttctggttgtatt

SEQ ID NO: 1739261 - DNA, 17 bp, Homo sapiens
ttctggtttaaacttgt

SEQ ID NO: 1739262 - DNA, 22 bp, Homo sapiens
ttctgtaagagaaaatattact

SEQ ID NO: 1739263 - DNA, 23 bp, Homo sapiens
ttctgtaataactagaacaaata

SEQ ID NO: 1739264 - DNA, 17 bp, Homo sapiens
ttctgtaatggaactga

SEQ ID NO: 1739265 - DNA, 17 bp, Homo sapiens
ttctgtaatgtaaataa

SEQ ID NO: 1739266 - DNA, 18 bp, Homo sapiens
ttctgtaatgtaaataaa

SEQ ID NO: 1739267 - DNA, 20 bp, Homo sapiens
ttctgtaatgtaaataaact

SEQ ID NO: 1739268 - DNA, 16 bp, Homo sapiens
ttctgtaattcaggtt

SEQ ID NO: 1739269 - DNA, 20 bp, Homo sapiens
ttctgtactgatttttgtaa

SEQ ID NO: 1739270 - DNA, 15 bp, Homo sapiens
ttctgtactgttact

SEQ ID NO: 1739271 - DNA, 16 bp, Homo sapiens
ttctgtagacttttga

SEQ ID NO: 1739272 - DNA, 23 bp, Homo sapiens
ttctgtaggtttctctcttccct

SEQ ID NO: 1739273 - DNA, 23 bp, Homo sapiens
ttctgtagttgcagctgatgcct

SEQ ID NO: 1739274 - DNA, 24 bp, Homo sapiens
ttctgtatacaaccctggcattat

SEQ ID NO: 1739275 - DNA, 14 bp, Homo sapiens
ttctgtatttcctt

SEQ ID NO: 1739276 - DNA, 22 bp, Homo sapiens
ttctgtccttttggcactgaga

SEQ ID NO: 1739277 - DNA, 19 bp, Homo sapiens
ttctgtctagactggccta

SEQ ID NO: 1739278 - DNA, 19 bp, Homo sapiens
ttctgtctcccttctctct

SEQ ID NO: 1739279 - DNA, 16 bp, Homo sapiens
ttctgtctcctgtctt

SEQ ID NO: 1739280 - DNA, 21 bp, Homo sapiens
ttctgtcttcatcccctcaga

SEQ ID NO: 1739281 - DNA, 14 bp, Homo sapiens
ttctgtcttcccaa

SEQ ID NO: 1739282 - DNA, 20 bp, Homo sapiens
ttctgtcttggggcttttgg

SEQ ID NO: 1739283 - DNA, 13 bp, Homo sapiens
ttctgtgaaattc

SEQ ID NO: 1739284 - DNA, 18 bp, Homo sapiens
ttctgtgaaattctcaga

SEQ ID NO: 1739285 - DNA, 17 bp, Homo sapiens
ttctgtgacccatctgt

SEQ ID NO: 1739286 - DNA, 18 bp, Homo sapiens
ttctgtgatgagctgatc

SEQ ID NO: 1739287 - DNA, 20 bp, Homo sapiens
ttctgtgcactagcctgtga

SEQ ID NO: 1739288 - DNA, 17 bp, Homo sapiens
ttctgtgcgtctgtttt

SEQ ID NO: 1739289 - DNA, 20 bp, Homo sapiens
ttctgtggttttcccctccc

SEQ ID NO: 1739290 - DNA, 22 bp, Homo sapiens
ttctgtggttttcccctccctg

SEQ ID NO: 1739291 - DNA, 19 bp, Homo sapiens
ttttacacattagatttta

SEQ ID NO: 1739292 - DNA, 15 bp, Homo sapiens
ttttacatactgctg

SEQ ID NO: 1739293 - DNA, 13 bp, Homo sapiens
ttttacattgtga

SEQ ID NO: 1739294 - DNA, 11 bp, Homo sapiens
ttttaccaaag

SEQ ID NO: 1739295 - DNA, 16 bp, Homo sapiens
ttttaccaaagcatca

SEQ ID NO: 1739296 - DNA, 22 bp, Homo sapiens
ttttaccactatttaagttatc

SEQ ID NO: 1739297 - DNA, 13 bp, Homo sapiens
ttttaccagctcc

SEQ ID NO: 1739298 - DNA, 19 bp, Homo sapiens
ttttaccagctcccagggt

SEQ ID NO: 1739299 - DNA, 22 bp, Homo sapiens
ttttaccatgcccctgagcaat

SEQ ID NO: 1739300 - DNA, 13 bp, Homo sapiens
ttttacctaatct

SEQ ID NO: 1739301 - DNA, 22 bp, Homo sapiens
ttttactaaagaaagattactt

SEQ ID NO: 1739302 - DNA, 16 bp, Homo sapiens
ttttactaatatatat

SEQ ID NO: 1739303 - DNA, 16 bp, Homo sapiens
ttttactgctctgaga

SEQ ID NO: 1739304 - DNA, 13 bp, Homo sapiens
ttttactgtctat

SEQ ID NO: 1739305 - DNA, 12 bp, Homo sapiens
ttttactgtttt

SEQ ID NO: 1739306 - DNA, 22 bp, Homo sapiens
ttttacttgcattgaatatatt

SEQ ID NO: 1739307 - DNA, 17 bp, Homo sapiens
ttttacttttaaactgt

SEQ ID NO: 1739308 - DNA, 14 bp, Homo sapiens
ttttagaaaacagc

SEQ ID NO: 1739309 - DNA, 17 bp, Homo sapiens
aaatacagacactaagt

SEQ ID NO: 1739310 - DNA, 16 bp, Homo sapiens
aaatacagataaatga

SEQ ID NO: 1739311 - DNA, 22 bp, Homo sapiens
aaatacagataaatgattcaaa

SEQ ID NO: 1739312 - DNA, 14 bp, Homo sapiens
aaatacaggaaaca

SEQ ID NO: 1739313 - DNA, 16 bp, Homo sapiens
aaatacaggaaacagt

SEQ ID NO: 1739314 - DNA, 14 bp, Homo sapiens
aaatacagttattt

SEQ ID NO: 1739315 - DNA, 22 bp, Homo sapiens
aaataccacaagcctgagaact

SEQ ID NO: 1739316 - DNA, 22 bp, Homo sapiens
aaataccatttagtaagaatac

SEQ ID NO: 1739317 - DNA, 18 bp, Homo sapiens
aaatacctcaatttttgt

SEQ ID NO: 1739318 - DNA, 14 bp, Homo sapiens
aaatactactcctg

SEQ ID NO: 1739319 - DNA, 20 bp, Homo sapiens
aaatactatttaaagcctcc

SEQ ID NO: 1739320 - DNA, 14 bp, Homo sapiens
aaatactcagtgat

SEQ ID NO: 1739321 - DNA, 20 bp, Homo sapiens
aaatactctgctatttctct

SEQ ID NO: 1739322 - DNA, 19 bp, Homo sapiens
aaatactgtcaaacaataa

SEQ ID NO: 1739323 - DNA, 13 bp, Homo sapiens
aaatacttaaatg

SEQ ID NO: 1739324 - DNA, 18 bp, Homo sapiens
aaatacttcgatgatgat

SEQ ID NO: 1739325 - DNA, 17 bp, Homo sapiens
aaatacttttactctgc

SEQ ID NO: 1739326 - DNA, 14 bp, Homo sapiens
aaatagaaattttg

SEQ ID NO: 1739327 - DNA, 19 bp, Homo sapiens
aaatagaaattttgtaaga

SEQ ID NO: 1739328 - DNA, 16 bp, Homo sapiens
aaatagaagagagagg

SEQ ID NO: 1739329 - DNA, 13 bp, Homo sapiens
aaatagaataatt

SEQ ID NO: 1739330 - DNA, 18 bp, Homo sapiens
aaatagaataattctttt

SEQ ID NO: 1739331 - DNA, 19 bp, Homo sapiens
aaatagacagtatatttat

SEQ ID NO: 1739332 - DNA, 20 bp, Homo sapiens
aaatagacttaataaaggtt

SEQ ID NO: 1739333 - DNA, 18 bp, Homo sapiens
aaatagacttgcacctta

SEQ ID NO: 1739334 - DNA, 13 bp, Homo sapiens
aaatagataattt

SEQ ID NO: 1739335 - DNA, 15 bp, Homo sapiens
aaatagatatatttt

SEQ ID NO: 1739336 - DNA, 12 bp, Homo sapiens
aaatagcaaaga

SEQ ID NO: 1739337 - DNA, 21 bp, Homo sapiens
aaatagccgggcatggtggcg

SEQ ID NO: 1739338 - DNA, 15 bp, Homo sapiens
aaatagcctaaatga

SEQ ID NO: 1739339 - DNA, 13 bp, Homo sapiens
aaataggaaacaa

SEQ ID NO: 1739340 - DNA, 14 bp, Homo sapiens
aaataggattttta

SEQ ID NO: 1739341 - DNA, 18 bp, Homo sapiens
aaataggtttatattatt

SEQ ID NO: 1739342 - DNA, 15 bp, Homo sapiens
aaatagtagacattt

SEQ ID NO: 1739343 - DNA, 17 bp, Homo sapiens
aaatagtagacatttgt

SEQ ID NO: 1739344 - DNA, 22 bp, Homo sapiens
aaatagtatacattgtcttgat

SEQ ID NO: 1739345 - DNA, 18 bp, Homo sapiens
aaatagtgtaagaactgt

SEQ ID NO: 1739346 - DNA, 20 bp, Homo sapiens
aaatagtgtaagaactgtac

SEQ ID NO: 1739347 - DNA, 18 bp, Homo sapiens
aaatagtgtgaaatatat

SEQ ID NO: 1739348 - DNA, 22 bp, Homo sapiens
aaatagttctgtgactaggaaa

SEQ ID NO: 1739349 - DNA, 12 bp, Homo sapiens
aaatcctggaag

SEQ ID NO: 1739350 - DNA, 17 bp, Homo sapiens
aaatcctggaaggacac

SEQ ID NO: 1739351 - DNA, 17 bp, Homo sapiens
aaatccttaacatttct

SEQ ID NO: 1739352 - DNA, 17 bp, Homo sapiens
aaatcctttttctttat

SEQ ID NO: 1739353 - DNA, 19 bp, Homo sapiens
aaatcctttttctttataa

SEQ ID NO: 1739354 - DNA, 15 bp, Homo sapiens
aaatcgattggcttt

SEQ ID NO: 1739355 - DNA, 17 bp, Homo sapiens
aaatctaaaatttaaaa

SEQ ID NO: 1739356 - DNA, 12 bp, Homo sapiens
aaatctaaacaa

SEQ ID NO: 1739357 - DNA, 15 bp, Homo sapiens
aaatctaaatctatt

SEQ ID NO: 1739358 - DNA, 17 bp, Homo sapiens
aaatctaaatctattta

SEQ ID NO: 1739359 - DNA, 13 bp, Homo sapiens
aaatctaatctct

SEQ ID NO: 1739360 - DNA, 18 bp, Homo sapiens
aaatctagagtttataca

SEQ ID NO: 1739361 - DNA, 20 bp, Homo sapiens
aaatctagagtttatacagt

SEQ ID NO: 1739362 - DNA, 17 bp, Homo sapiens
aaatctaggatgtgatg

SEQ ID NO: 1739363 - DNA, 22 bp, Homo sapiens
aaatctagtatttcatgctggg

SEQ ID NO: 1739364 - DNA, 17 bp, Homo sapiens
aaatctattacttttgc

SEQ ID NO: 1739365 - DNA, 19 bp, Homo sapiens
aaatctattcagacaagca

SEQ ID NO: 1739366 - DNA, 12 bp, Homo sapiens
aaatctatttat

SEQ ID NO: 1739367 - DNA, 14 bp, Homo sapiens
aaatctcaattgaa

SEQ ID NO: 1739368 - DNA, 17 bp, Homo sapiens
aaatctcaccccatccc

SEQ ID NO: 1739369 - DNA, 22 bp, Homo sapiens
aaatctcagttgtttgcttctt

SEQ ID NO: 1739370 - DNA, 17 bp, Homo sapiens
aaatctcctaacaaaag

SEQ ID NO: 1739371 - DNA, 14 bp, Homo sapiens
aaatctctgttact

SEQ ID NO: 1739372 - DNA, 11 bp, Homo sapiens
aaatctgaatt

SEQ ID NO: 1739373 - DNA, 17 bp, Homo sapiens
aaatctgaattttgcaa

SEQ ID NO: 1739374 - DNA, 18 bp, Homo sapiens
aaatctgaattttgcaat

SEQ ID NO: 1739375 - DNA, 21 bp, Homo sapiens
aaatctgaattttgcaatgta

SEQ ID NO: 1739376 - DNA, 23 bp, Homo sapiens
aaatctgaattttgcaatgtatt

SEQ ID NO: 1739377 - DNA, 17 bp, Homo sapiens
aaatctgaccaaaacaa

SEQ ID NO: 1739378 - DNA, 15 bp, Homo sapiens
aaatctgcaaagcat

SEQ ID NO: 1739379 - DNA, 19 bp, Homo sapiens
aaatctgctagaaagttag

SEQ ID NO: 1739380 - DNA, 14 bp, Homo sapiens
aaatctgctgcacc

SEQ ID NO: 1739381 - DNA, 11 bp, Homo sapiens
aaatctgcttt

SEQ ID NO: 1739382 - DNA, 18 bp, Homo sapiens
aaatctgctttttaaaga

SEQ ID NO: 1739383 - DNA, 12 bp, Homo sapiens
aaatctggaagc

SEQ ID NO: 1739384 - DNA, 17 bp, Homo sapiens
aaatctggcccagggtg

SEQ ID NO: 1739385 - DNA, 15 bp, Homo sapiens
aaatctggtcttgtt

SEQ ID NO: 1739386 - DNA, 16 bp, Homo sapiens
aaatctgtaaagccag

SEQ ID NO: 1739387 - DNA, 16 bp, Homo sapiens
aaatctgtatatgttg

SEQ ID NO: 1739388 - DNA, 19 bp, Homo sapiens
aaatctgtattctgtttgc

SEQ ID NO: 1739389 - DNA, 16 bp, Homo sapiens
aaatctgtctgattct

SEQ ID NO: 1739390 - DNA, 22 bp, Homo sapiens
aaatctgtctgattctatgcct

SEQ ID NO: 1739391 - DNA, 13 bp, Homo sapiens
aaatcttaaacaa

SEQ ID NO: 1739392 - DNA, 16 bp, Homo sapiens
aaatcttaaacaatgt

SEQ ID NO: 1739393 - DNA, 14 bp, Homo sapiens
aaatcttaagcaat

SEQ ID NO: 1739394 - DNA, 16 bp, Homo sapiens
aaatcttatagttcta

SEQ ID NO: 1739395 - DNA, 17 bp, Homo sapiens
aaatcttatagttctag

SEQ ID NO: 1739396 - DNA, 13 bp, Homo sapiens
aaatcttcccatg

SEQ ID NO: 1739397 - DNA, 18 bp, Homo sapiens
aaatcttccttgtgagga

SEQ ID NO: 1739398 - DNA, 16 bp, Homo sapiens
aaatcttgtcatgtgt

SEQ ID NO: 1739399 - DNA, 21 bp, Homo sapiens
aaatcttgtcatgtgtataaa

SEQ ID NO: 1739400 - DNA, 19 bp, Homo sapiens
aaatctttagggaatgaga

SEQ ID NO: 1739401 - DNA, 15 bp, Homo sapiens
aaatcttttgaagca

SEQ ID NO: 1739402 - DNA, 21 bp, Homo sapiens
aaatctttttgcttctacttt

SEQ ID NO: 1739403 - DNA, 11 bp, Homo sapiens
aaatgaaaatt

SEQ ID NO: 1739404 - DNA, 12 bp, Homo sapiens
aaatgaaagaaa

SEQ ID NO: 1739405 - DNA, 20 bp, Homo sapiens
aaatgaaagaaaattgagtt

SEQ ID NO: 1739406 - DNA, 17 bp, Homo sapiens
aaatgaaagatttttac

SEQ ID NO: 1739407 - DNA, 15 bp, Homo sapiens
aaatgaaagcatgtg

SEQ ID NO: 1739408 - DNA, 13 bp, Homo sapiens
aaatgaaagctac

SEQ ID NO: 1739409 - DNA, 22 bp, Homo sapiens
aaatgaacgatatgtagcagaa

SEQ ID NO: 1739410 - DNA, 22 bp, Homo sapiens
aaatgaaggttaggatttaaca

SEQ ID NO: 1739411 - DNA, 15 bp, Homo sapiens
aaatgaataatttcc

SEQ ID NO: 1739412 - DNA, 15 bp, Homo sapiens
aaatgaatactgaat

SEQ ID NO: 1739413 - DNA, 17 bp, Homo sapiens
aaatgaatatctattaa

SEQ ID NO: 1739414 - DNA, 20 bp, Homo sapiens
aaatgacaacagaaaaacaa

SEQ ID NO: 1739415 - DNA, 23 bp, Homo sapiens
aaatgacaacagaaaaacaatct

SEQ ID NO: 1739416 - DNA, 15 bp, Homo sapiens
aaatgacaatgatga

SEQ ID NO: 1739417 - DNA, 21 bp, Homo sapiens
aaatgacagtggaagtttttt

SEQ ID NO: 1739418 - DNA, 19 bp, Homo sapiens
aaatgacatgcactgaccc

SEQ ID NO: 1739419 - DNA, 19 bp, Homo sapiens
aaatgaccaacgaaattgt

SEQ ID NO: 1739420 - DNA, 16 bp, Homo sapiens
aaatgaccgagccctg

SEQ ID NO: 1739421 - DNA, 18 bp, Homo sapiens
aaatgaccgagccctgga

SEQ ID NO: 1739422 - DNA, 21 bp, Homo sapiens
aaatgaccgagccctggagag

SEQ ID NO: 1739423 - DNA, 18 bp, Homo sapiens
aaatgacggtgttaattt

SEQ ID NO: 1739424 - DNA, 15 bp, Homo sapiens
aaatgagaagtactt

SEQ ID NO: 1739425 - DNA, 18 bp, Homo sapiens
aaatgagaattttatatt

SEQ ID NO: 1739426 - DNA, 15 bp, Homo sapiens
aaatgagctctgaaa

SEQ ID NO: 1739427 - DNA, 19 bp, Homo sapiens
aaatgagctctgaaatctt

SEQ ID NO: 1739428 - DNA, 13 bp, Homo sapiens
aaatgagctgttg

SEQ ID NO: 1739429 - DNA, 19 bp, Homo sapiens
aaatgagcttgattaaatc

SEQ ID NO: 1739430 - DNA, 24 bp, Homo sapiens
caggcccgtcggagctgcctgcag

SEQ ID NO: 1739431 - DNA, 16 bp, Homo sapiens
caggcccgtgggcgca

SEQ ID NO: 1739432 - DNA, 21 bp, Homo sapiens
caggcccgtgggcgcaaaggt

SEQ ID NO: 1739433 - DNA, 17 bp, Homo sapiens
caggccctccatgggct

SEQ ID NO: 1739434 - DNA, 22 bp, Homo sapiens
caggccctccctgttccccaga

SEQ ID NO: 1739435 - DNA, 14 bp, Homo sapiens
caggccctcctctc

SEQ ID NO: 1739436 - DNA, 14 bp, Homo sapiens
caggccctctgcct

SEQ ID NO: 1739437 - DNA, 19 bp, Homo sapiens
caggccctctgcctgcact

SEQ ID NO: 1739438 - DNA, 20 bp, Homo sapiens
caggccctctgcctgcactc

SEQ ID NO: 1739439 - DNA, 22 bp, Homo sapiens
caggccctctgcctgcactccc

SEQ ID NO: 1739440 - DNA, 23 bp, Homo sapiens
caggccctctgcctgcactccct

SEQ ID NO: 1739441 - DNA, 14 bp, Homo sapiens
caggccctggcctc

SEQ ID NO: 1739442 - DNA, 17 bp, Homo sapiens
caggccctggcctcccc

SEQ ID NO: 1739443 - DNA, 21 bp, Homo sapiens
caggccctgggtcttgccatg

SEQ ID NO: 1739444 - DNA, 15 bp, Homo sapiens
caggcccttcctctc

SEQ ID NO: 1739445 - DNA, 20 bp, Homo sapiens
caggcccttcctctccactg

SEQ ID NO: 1739446 - DNA, 18 bp, Homo sapiens
caggcccttggctgcagg

SEQ ID NO: 1739447 - DNA, 16 bp, Homo sapiens
caggccctttggcttc

SEQ ID NO: 1739448 - DNA, 17 bp, Homo sapiens
caggccctttggcttct

SEQ ID NO: 1739449 - DNA, 16 bp, Homo sapiens
caggccgaggcaggtg

SEQ ID NO: 1739450 - DNA, 13 bp, Homo sapiens
caggccgcagctc

SEQ ID NO: 1739451 - DNA, 15 bp, Homo sapiens
caggccgcagctctt

SEQ ID NO: 1739452 - DNA, 22 bp, Homo sapiens
caggccgcagctcttgcccttc

SEQ ID NO: 1739453 - DNA, 15 bp, Homo sapiens
caggccgcgcccagc

SEQ ID NO: 1739454 - DNA, 17 bp, Homo sapiens
caggccgcgcccagcag

SEQ ID NO: 1739455 - DNA, 18 bp, Homo sapiens
caggccgcgccctttccc

SEQ ID NO: 1739456 - DNA, 18 bp, Homo sapiens
caggccggagcccagata

SEQ ID NO: 1739457 - DNA, 16 bp, Homo sapiens
ccagccccacccagga

SEQ ID NO: 1739458 - DNA, 18 bp, Homo sapiens
ccagccccacccaggagg

SEQ ID NO: 1739459 - DNA, 16 bp, Homo sapiens
ccagccccactgccag

SEQ ID NO: 1739460 - DNA, 19 bp, Homo sapiens
ccagccccactgccagcag

SEQ ID NO: 1739461 - DNA, 23 bp, Homo sapiens
ccagccccactgccagcagcagc

SEQ ID NO: 1739462 - DNA, 14 bp, Homo sapiens
ccagccccgctccc

SEQ ID NO: 1739463 - DNA, 24 bp, Homo sapiens
ccagccccgctcccacctagtgcc

SEQ ID NO: 1739464 - DNA, 15 bp, Homo sapiens
ccagcccctactgct

SEQ ID NO: 1739465 - DNA, 15 bp, Homo sapiens
ccagcccctctggtc

SEQ ID NO: 1739466 - DNA, 13 bp, Homo sapiens
ccagcccctcttg

SEQ ID NO: 1739467 - DNA, 20 bp, Homo sapiens
ccagcccctcttggagaagt

SEQ ID NO: 1739468 - DNA, 16 bp, Homo sapiens
ccagcccctgcccctc

SEQ ID NO: 1739469 - DNA, 11 bp, Homo sapiens
ccagcccctgt

SEQ ID NO: 1739470 - DNA, 12 bp, Homo sapiens
ccagccccttcc

SEQ ID NO: 1739471 - DNA, 22 bp, Homo sapiens
ccagcccggccgctccaccagc

SEQ ID NO: 1739472 - DNA, 23 bp, Homo sapiens
ccagccctagctgtcccatgggg

SEQ ID NO: 1739473 - DNA, 14 bp, Homo sapiens
ccagccctccccat

SEQ ID NO: 1739474 - DNA, 21 bp, Homo sapiens
ccagccctccctggctgtgag

SEQ ID NO: 1739475 - DNA, 17 bp, Homo sapiens
ccagccctccctgtcct

SEQ ID NO: 1739476 - DNA, 12 bp, Homo sapiens
ccagccctgctg

SEQ ID NO: 1739477 - DNA, 20 bp, Homo sapiens
ccagccctgctggggatccc

SEQ ID NO: 1739478 - DNA, 14 bp, Homo sapiens
ccagccctgggaac

SEQ ID NO: 1739479 - DNA, 15 bp, Homo sapiens
ccagccctgggaacc

SEQ ID NO: 1739480 - DNA, 13 bp, Homo sapiens
ccagcccttctgc

SEQ ID NO: 1739481 - DNA, 15 bp, Homo sapiens
ccagcccttctgcct

SEQ ID NO: 1739482 - DNA, 20 bp, Homo sapiens
ccagccgccattgccaccag

SEQ ID NO: 1739483 - DNA, 23 bp, Homo sapiens
ccagccgctgcagggctcccatg

SEQ ID NO: 1739484 - DNA, 22 bp, Homo sapiens
ccagccggcctctctggcctcc

SEQ ID NO: 1739485 - DNA, 23 bp, Homo sapiens
ccagccggcctctctggcctccc

SEQ ID NO: 1739486 - DNA, 14 bp, Homo sapiens
ccagccgtatttta

SEQ ID NO: 1739487 - DNA, 21 bp, Homo sapiens
ccagccgtgatgctcaggctt

SEQ ID NO: 1739488 - DNA, 16 bp, Homo sapiens
ccagcctaagaagctc

SEQ ID NO: 1739489 - DNA, 18 bp, Homo sapiens
ccagcctcagtgccactt

SEQ ID NO: 1739490 - DNA, 16 bp, Homo sapiens
ccagcctccagggcat

SEQ ID NO: 1739491 - DNA, 13 bp, Homo sapiens
ccagcctccctga

SEQ ID NO: 1739492 - DNA, 15 bp, Homo sapiens
ccagcctccctgaag

SEQ ID NO: 1739493 - DNA, 14 bp, Homo sapiens
ccagcctccctgtc

SEQ ID NO: 1739494 - DNA, 20 bp, Homo sapiens
ccagcctccctgtctccagc

SEQ ID NO: 1739495 - DNA, 24 bp, Homo sapiens
ccagcctccctgtctccagctgcc

SEQ ID NO: 1739496 - DNA, 19 bp, Homo sapiens
ccagcctccgagagggaga

SEQ ID NO: 1739497 - DNA, 21 bp, Homo sapiens
ccagcctccgagagggagaga

SEQ ID NO: 1739498 - DNA, 13 bp, Homo sapiens
ccagcctcctctg

SEQ ID NO: 1739499 - DNA, 14 bp, Homo sapiens
ccagcctcctctgg

SEQ ID NO: 1739500 - DNA, 14 bp, Homo sapiens
ccagcctcctgggg

SEQ ID NO: 1739501 - DNA, 17 bp, Homo sapiens
ccagcctcctgtttgca

SEQ ID NO: 1739502 - DNA, 13 bp, Homo sapiens
ccagcctctcccg

SEQ ID NO: 1739503 - DNA, 21 bp, Homo sapiens
ccagcctctcccggctgcctg

SEQ ID NO: 1739504 - DNA, 20 bp, Homo sapiens
ccagcctcttgctcagagct

SEQ ID NO: 1739505 - DNA, 17 bp, Homo sapiens
ccagcctgagtgacaga

SEQ ID NO: 1739506 - DNA, 22 bp, Homo sapiens
ccagcctgagtgacagagcgag

SEQ ID NO: 1739507 - DNA, 13 bp, Homo sapiens
ccagcctgctgac

SEQ ID NO: 1739508 - DNA, 10 bp, Homo sapiens
ccagcctggc

SEQ ID NO: 1739509 - DNA, 19 bp, Homo sapiens
ccagcctggccacgcagcc

SEQ ID NO: 1739510 - DNA, 15 bp, Homo sapiens
ccagcctggctctgc

SEQ ID NO: 1739511 - DNA, 13 bp, Homo sapiens
ccagcctggcttc

SEQ ID NO: 1739512 - DNA, 17 bp, Homo sapiens
ccagcctggcttctgga

SEQ ID NO: 1739513 - DNA, 15 bp, Homo sapiens
ccagcctgggagccc

SEQ ID NO: 1739514 - DNA, 17 bp, Homo sapiens
ccagcctgggagcccag

SEQ ID NO: 1739515 - DNA, 19 bp, Homo sapiens
ccagcctgggcaacagagc

SEQ ID NO: 1739516 - DNA, 16 bp, Homo sapiens
ccagcctgggcagcca

SEQ ID NO: 1739517 - DNA, 18 bp, Homo sapiens
ccagcctgggcagccagg

SEQ ID NO: 1739518 - DNA, 19 bp, Homo sapiens
ccagcctgggcgacagagc

SEQ ID NO: 1739519 - DNA, 15 bp, Homo sapiens
ccagcctggggaccc

SEQ ID NO: 1739520 - DNA, 14 bp, Homo sapiens
ccagcctggggctc

SEQ ID NO: 1739521 - DNA, 16 bp, Homo sapiens
ccagcctggggctccc

SEQ ID NO: 1739522 - DNA, 19 bp, Homo sapiens
ccagcctggggctccctct

SEQ ID NO: 1739523 - DNA, 23 bp, Homo sapiens
ccagcctggggctccctctctgg

SEQ ID NO: 1739524 - DNA, 22 bp, Homo sapiens
ccagcctgggtcacagagtgag

SEQ ID NO: 1739525 - DNA, 18 bp, Homo sapiens
ccagcctgtaccttgctg

SEQ ID NO: 1739526 - DNA, 21 bp, Homo sapiens
ccagcctgtaccttgctgtgg

SEQ ID NO: 1739527 - DNA, 14 bp, Homo sapiens
ccagccttccaggt

SEQ ID NO: 1739528 - DNA, 15 bp, Homo sapiens
ccagccttccaggtg

SEQ ID NO: 1739529 - DNA, 20 bp, Homo sapiens
ccagccttcctctgcagctg

SEQ ID NO: 1739530 - DNA, 15 bp, Homo sapiens
ccagcctttctccca

SEQ ID NO: 1739531 - DNA, 20 bp, Homo sapiens
ccagcctttgggtcctgggc

SEQ ID NO: 1739532 - DNA, 23 bp, Homo sapiens
ccagcctttgggtcctgggcagg

SEQ ID NO: 1739533 - DNA, 13 bp, Homo sapiens
ccagcgatggtgc

SEQ ID NO: 1739534 - DNA, 15 bp, Homo sapiens
ccagcgcccccagaa

SEQ ID NO: 1739535 - DNA, 18 bp, Homo sapiens
ccagcgctctcctggacg

SEQ ID NO: 1739536 - DNA, 20 bp, Homo sapiens
ccagcgctctcctggacgcc

SEQ ID NO: 1739537 - DNA, 22 bp, Homo sapiens
ccagcggccccccgcacagcca

SEQ ID NO: 1739538 - DNA, 23 bp, Homo sapiens
ccagcggccccccgcacagccac

SEQ ID NO: 1739539 - DNA, 14 bp, Homo sapiens
ccagcggcccctcc

SEQ ID NO: 1739540 - DNA, 15 bp, Homo sapiens
ccagcggcccctccc

SEQ ID NO: 1739541 - DNA, 15 bp, Homo sapiens
ccagcggccctgtca

SEQ ID NO: 1739542 - DNA, 13 bp, Homo sapiens
ccagcggctccaa

SEQ ID NO: 1739543 - DNA, 12 bp, Homo sapiens
ctctgcctgcct

SEQ ID NO: 1739544 - DNA, 12 bp, Homo sapiens
ctctgcctgctg

SEQ ID NO: 1739545 - DNA, 11 bp, Homo sapiens
ctctgcctgga

SEQ ID NO: 1739546 - DNA, 22 bp, Homo sapiens
ctctgccttagggtttgcagag

SEQ ID NO: 1739547 - DNA, 14 bp, Homo sapiens
ctctgccttctcag

SEQ ID NO: 1739548 - DNA, 22 bp, Homo sapiens
ctctgcctttgcaccacgggac

SEQ ID NO: 1739549 - DNA, 15 bp, Homo sapiens
ctctgcgccaggcag

SEQ ID NO: 1739550 - DNA, 18 bp, Homo sapiens
ctctgcgccaggcagagc

SEQ ID NO: 1739551 - DNA, 16 bp, Homo sapiens
ctctgctaatcatgtg

SEQ ID NO: 1739552 - DNA, 21 bp, Homo sapiens
ctctgctagactcctcaggag

SEQ ID NO: 1739553 - DNA, 23 bp, Homo sapiens
ctctgctagactcctcaggagag

SEQ ID NO: 1739554 - DNA, 22 bp, Homo sapiens
ctctgctatttctcttgctgga

SEQ ID NO: 1739555 - DNA, 12 bp, Homo sapiens
ctctgctccacc

SEQ ID NO: 1739556 - DNA, 14 bp, Homo sapiens
ctctgctccaccac

SEQ ID NO: 1739557 - DNA, 19 bp, Homo sapiens
ctctgctccaccacatcct

SEQ ID NO: 1739558 - DNA, 13 bp, Homo sapiens
ctctgctccccag

SEQ ID NO: 1739559 - DNA, 12 bp, Homo sapiens
ctctgctctagc

SEQ ID NO: 1739560 - DNA, 13 bp, Homo sapiens
ctctgctctagcc

SEQ ID NO: 1739561 - DNA, 23 bp, Homo sapiens
ctctgctctagccaggagtctgt

SEQ ID NO: 1739562 - DNA, 14 bp, Homo sapiens
ctctgctctgtcct

SEQ ID NO: 1739563 - DNA, 23 bp, Homo sapiens
ctctgctgagcggtactaaacgg

SEQ ID NO: 1739564 - DNA, 13 bp, Homo sapiens
ctctgctgccatg

SEQ ID NO: 1739565 - DNA, 15 bp, Homo sapiens
ctctgctgccatggc

SEQ ID NO: 1739566 - DNA, 22 bp, Homo sapiens
ctctgctgccggctctgggcct

SEQ ID NO: 1739567 - DNA, 22 bp, Homo sapiens
ctctgctggggaagggttttct

SEQ ID NO: 1739568 - DNA, 15 bp, Homo sapiens
ctctgctgtcctgca

SEQ ID NO: 1739569 - DNA, 16 bp, Homo sapiens
ctctgctgtcctgcag

SEQ ID NO: 1739570 - DNA, 16 bp, Homo sapiens
ctctgcttcctcagcc

SEQ ID NO: 1739571 - DNA, 18 bp, Homo sapiens
ctctgcttctcggggtcc

SEQ ID NO: 1739572 - DNA, 22 bp, Homo sapiens
ctctgcttctcggggtccagtg

SEQ ID NO: 1739573 - DNA, 20 bp, Homo sapiens
ctctggaataaagttgcaga

SEQ ID NO: 1739574 - DNA, 16 bp, Homo sapiens
ctctggacaaagcgtt

SEQ ID NO: 1739575 - DNA, 16 bp, Homo sapiens
ctctggacggcaggct

SEQ ID NO: 1739576 - DNA, 23 bp, Homo sapiens
ctctggacggcaggctcactgcc

SEQ ID NO: 1739577 - DNA, 16 bp, Homo sapiens
ctctggacgtgaaata

SEQ ID NO: 1739578 - DNA, 18 bp, Homo sapiens
ctctggacgttgtgagaa

SEQ ID NO: 1739579 - DNA, 15 bp, Homo sapiens
ctctggactggctag

SEQ ID NO: 1739580 - DNA, 18 bp, Homo sapiens
ctctggagaacagtggtt

SEQ ID NO: 1739581 - DNA, 13 bp, Homo sapiens
ctctggagcagcc

SEQ ID NO: 1739582 - DNA, 14 bp, Homo sapiens
ctctggagcccctc

SEQ ID NO: 1739583 - DNA, 21 bp, Homo sapiens
ctctggaggaagttctccagc

SEQ ID NO: 1739584 - DNA, 22 bp, Homo sapiens
ctctggatctagaagggaccat

SEQ ID NO: 1739585 - DNA, 15 bp, Homo sapiens
ctctggatgaaggca

SEQ ID NO: 1739586 - DNA, 19 bp, Homo sapiens
ctctggcagttctggaatg

SEQ ID NO: 1739587 - DNA, 11 bp, Homo sapiens
ctctggccacc

SEQ ID NO: 1739588 - DNA, 12 bp, Homo sapiens
ctctggccaccc

SEQ ID NO: 1739589 - DNA, 16 bp, Homo sapiens
ctctggccaccctggc

SEQ ID NO: 1739590 - DNA, 19 bp, Homo sapiens
ctctggccaccctggcccg

SEQ ID NO: 1739591 - DNA, 10 bp, Homo sapiens
ctctggccag

SEQ ID NO: 1739592 - DNA, 14 bp, Homo sapiens
ctctggccaggcat

SEQ ID NO: 1739593 - DNA, 16 bp, Homo sapiens
ctctggccaggcatgg

SEQ ID NO: 1739594 - DNA, 15 bp, Homo sapiens
ctctggcccagaaag

SEQ ID NO: 1739595 - DNA, 16 bp, Homo sapiens
ctctggccccaggctt

SEQ ID NO: 1739596 - DNA, 18 bp, Homo sapiens
ctctggccccaggcttgt

SEQ ID NO: 1739597 - DNA, 16 bp, Homo sapiens
ctctggcctcccaccc

SEQ ID NO: 1739598 - DNA, 17 bp, Homo sapiens
ctctggcctcccacccg

SEQ ID NO: 1739599 - DNA, 15 bp, Homo sapiens
ctctggcggcttcct

SEQ ID NO: 1739600 - DNA, 22 bp, Homo sapiens
ctctggcggcttcctgtccact

SEQ ID NO: 1739601 - DNA, 13 bp, Homo sapiens
ctctggctagagc

SEQ ID NO: 1739602 - DNA, 18 bp, Homo sapiens
ctctggctagagccgagg

SEQ ID NO: 1739603 - DNA, 14 bp, Homo sapiens
ctctggctagaggc

SEQ ID NO: 1739604 - DNA, 16 bp, Homo sapiens
ctctggctagaggcca

SEQ ID NO: 1739605 - DNA, 20 bp, Homo sapiens
ctctggctagaggccagccc

SEQ ID NO: 1739606 - DNA, 21 bp, Homo sapiens
ctctggctagaggccagcccc

SEQ ID NO: 1739607 - DNA, 14 bp, Homo sapiens
ctctggctccaggc

SEQ ID NO: 1739608 - DNA, 16 bp, Homo sapiens
ctctggctccaggcag

SEQ ID NO: 1739609 - DNA, 18 bp, Homo sapiens
ctctggctccaggcagaa

SEQ ID NO: 1739610 - DNA, 11 bp, Homo sapiens
ctctggctctg

SEQ ID NO: 1739611 - DNA, 15 bp, Homo sapiens
ctctggctgaaccct

SEQ ID NO: 1739612 - DNA, 19 bp, Homo sapiens
ctctggctgaaccctgtgc

SEQ ID NO: 1739613 - DNA, 20 bp, Homo sapiens
ctctggctgtaaggctctag

SEQ ID NO: 1739614 - DNA, 21 bp, Homo sapiens
ctctggctgtaaggctctaga

SEQ ID NO: 1739615 - DNA, 23 bp, Homo sapiens
ctctggcttcccatagtggggcc

SEQ ID NO: 1739616 - DNA, 13 bp, Homo sapiens
ctctggcttctct

SEQ ID NO: 1739617 - DNA, 18 bp, Homo sapiens
ctctgggacgtggacatg

SEQ ID NO: 1739618 - DNA, 20 bp, Homo sapiens
ctctgggactctcctcctcc

SEQ ID NO: 1739619 - DNA, 14 bp, Homo sapiens
ctctgggagaaaat

SEQ ID NO: 1739620 - DNA, 18 bp, Homo sapiens
ctctgggagaaaatcatc

SEQ ID NO: 1739621 - DNA, 14 bp, Homo sapiens
ctctgggagcccag

SEQ ID NO: 1739622 - DNA, 12 bp, Homo sapiens
ctctgggcacag

SEQ ID NO: 1739623 - DNA, 13 bp, Homo sapiens
ctctgggcacagt

SEQ ID NO: 1739624 - DNA, 23 bp, Homo sapiens
ctctgggcacagtgggcctgtgt

SEQ ID NO: 1739625 - DNA, 14 bp, Homo sapiens
ctctgggcctgagg

SEQ ID NO: 1739626 - DNA, 13 bp, Homo sapiens
ctctgggcctgtt

SEQ ID NO: 1739627 - DNA, 18 bp, Homo sapiens
ctctgggcctgttctctt

SEQ ID NO: 1739628 - DNA, 15 bp, Homo sapiens
ctctgggctcagggc

SEQ ID NO: 1739629 - DNA, 17 bp, Homo sapiens
ctctgggctcagggctg

SEQ ID NO: 1739630 - DNA, 19 bp, Homo sapiens
ctctgggctcagggctgga

SEQ ID NO: 1739631 - DNA, 20 bp, Homo sapiens
ctctgggctcagggctggag

SEQ ID NO: 1739632 - DNA, 23 bp, Homo sapiens
ctctgggctgtaacgtggcactg

SEQ ID NO: 1739633 - DNA, 18 bp, Homo sapiens
ctctggggacagcttcct

SEQ ID NO: 1739634 - DNA, 19 bp, Homo sapiens
ctctggggacagcttcctc

SEQ ID NO: 1739635 - DNA, 17 bp, Homo sapiens
ctctggggatttctggg

SEQ ID NO: 1739636 - DNA, 18 bp, Homo sapiens
ctctgggggtcctctctg

SEQ ID NO: 1739637 - DNA, 15 bp, Homo sapiens
ctctggggtgggcag

SEQ ID NO: 1739638 - DNA, 19 bp, Homo sapiens
ctctgggtacctgcaagca

SEQ ID NO: 1739639 - DNA, 22 bp, Homo sapiens
ctctgggtctgattttctcact

SEQ ID NO: 1739640 - DNA, 18 bp, Homo sapiens
ctctggtcgctcctgccc

SEQ ID NO: 1739641 - DNA, 18 bp, Homo sapiens
ctctggtgacaccagcct

SEQ ID NO: 1739642 - DNA, 22 bp, Homo sapiens
ctctggtgagtcttggcggcag

SEQ ID NO: 1739643 - DNA, 17 bp, Homo sapiens
ctctggtggcacaggag

SEQ ID NO: 1739644 - DNA, 15 bp, Homo sapiens
ctctggtggctcctc

SEQ ID NO: 1739645 - DNA, 16 bp, Homo sapiens
ctctggtggctcctcc

SEQ ID NO: 1739646 - DNA, 19 bp, Homo sapiens
ctctggtggctcctcctag

SEQ ID NO: 1739647 - DNA, 20 bp, Homo sapiens
ctctggtggtcttccttcta

SEQ ID NO: 1739648 - DNA, 23 bp, Homo sapiens
ctctggtgtgtggtgaggggctt

SEQ ID NO: 1739649 - DNA, 14 bp, Homo sapiens
ctctggttgaagct

SEQ ID NO: 1739650 - DNA, 19 bp, Homo sapiens
ctctgtaagtgtagctcaa

SEQ ID NO: 1739651 - DNA, 19 bp, Homo sapiens
cctgggcctgtgcagcagc

SEQ ID NO: 1739652 - DNA, 22 bp, Homo sapiens
cctgggcctgtgcagcagccca

SEQ ID NO: 1739653 - DNA, 23 bp, Homo sapiens
cctgggcctgtgcagcagcccag

SEQ ID NO: 1739654 - DNA, 21 bp, Homo sapiens
cctgggcgagcccctccttct

SEQ ID NO: 1739655 - DNA, 12 bp, Homo sapiens
cctgggcgccct

SEQ ID NO: 1739656 - DNA, 18 bp, Homo sapiens
cctgggcgccctggaagc

SEQ ID NO: 1739657 - DNA, 13 bp, Homo sapiens
cctgggcggagtc

SEQ ID NO: 1739658 - DNA, 17 bp, Homo sapiens
cctgggctaccatctgc

SEQ ID NO: 1739659 - DNA, 14 bp, Homo sapiens
cctgggctcagcct

SEQ ID NO: 1739660 - DNA, 16 bp, Homo sapiens
cctgggctccacacag

SEQ ID NO: 1739661 - DNA, 19 bp, Homo sapiens
cctgggctccacacagcag

SEQ ID NO: 1739662 - DNA, 13 bp, Homo sapiens
cctgggctctcac

SEQ ID NO: 1739663 - DNA, 17 bp, Homo sapiens
cctgggctctcacccag

SEQ ID NO: 1739664 - DNA, 20 bp, Homo sapiens
cctgggctctcacccagtcc

SEQ ID NO: 1739665 - DNA, 14 bp, Homo sapiens
cctgggctggaatc

SEQ ID NO: 1739666 - DNA, 13 bp, Homo sapiens
cctgggctgggaa

SEQ ID NO: 1739667 - DNA, 14 bp, Homo sapiens
cctgggctggggag

SEQ ID NO: 1739668 - DNA, 19 bp, Homo sapiens
cctgggctggggaggagga

SEQ ID NO: 1739669 - DNA, 14 bp, Homo sapiens
cctgggctgggtgg

SEQ ID NO: 1739670 - DNA, 13 bp, Homo sapiens
cctgggctgtgct

SEQ ID NO: 1739671 - DNA, 16 bp, Homo sapiens
cctgggctgttggcac

SEQ ID NO: 1739672 - DNA, 18 bp, Homo sapiens
cctgggcttggcctgctg

SEQ ID NO: 1739673 - DNA, 12 bp, Homo sapiens
cctggggaagga

SEQ ID NO: 1739674 - DNA, 17 bp, Homo sapiens
cctggggaaggagccag

SEQ ID NO: 1739675 - DNA, 17 bp, Homo sapiens
cctggggaccaggagct

SEQ ID NO: 1739676 - DNA, 21 bp, Homo sapiens
cctggggaccccactccctgc

SEQ ID NO: 1739677 - DNA, 22 bp, Homo sapiens
cctggggaccccactccctgct

SEQ ID NO: 1739678 - DNA, 16 bp, Homo sapiens
cctggggaccccactt

SEQ ID NO: 1739679 - DNA, 18 bp, Homo sapiens
cctggggccccgctggga

SEQ ID NO: 1739680 - DNA, 13 bp, Homo sapiens
cctggggctccct

SEQ ID NO: 1739681 - DNA, 20 bp, Homo sapiens
cctggggctcctttctccag

SEQ ID NO: 1739682 - DNA, 18 bp, Homo sapiens
cctggggctgatctcagg

SEQ ID NO: 1739683 - DNA, 13 bp, Homo sapiens
cctgggggagaga

SEQ ID NO: 1739684 - DNA, 23 bp, Homo sapiens
cctgggggcacaggaggcaggca

SEQ ID NO: 1739685 - DNA, 21 bp, Homo sapiens
cctgggggcagtgactggcag

SEQ ID NO: 1739686 - DNA, 12 bp, Homo sapiens
cctggggggcag

SEQ ID NO: 1739687 - DNA, 21 bp, Homo sapiens
cctggggtataaaactttcct

SEQ ID NO: 1739688 - DNA, 14 bp, Homo sapiens
cctggggtgcatct

SEQ ID NO: 1739689 - DNA, 16 bp, Homo sapiens
cctgggtatcccctgc

SEQ ID NO: 1739690 - DNA, 19 bp, Homo sapiens
cctgggtatcccctgcctc

SEQ ID NO: 1739691 - DNA, 23 bp, Homo sapiens
ccagctactggggaggctgaggc

SEQ ID NO: 1739692 - DNA, 17 bp, Homo sapiens
ccagctacttcctcctc

SEQ ID NO: 1739693 - DNA, 16 bp, Homo sapiens
ccagctacttgggagg

SEQ ID NO: 1739694 - DNA, 17 bp, Homo sapiens
ccagctcaatggactgg

SEQ ID NO: 1739695 - DNA, 22 bp, Homo sapiens
ccagctcagaggcccaggaatc

SEQ ID NO: 1739696 - DNA, 15 bp, Homo sapiens
ccagctcagtcccat

SEQ ID NO: 1739697 - DNA, 22 bp, Homo sapiens
ccagctccaaggggaatcagaa

SEQ ID NO: 1739698 - DNA, 13 bp, Homo sapiens
ccagctccagggc

SEQ ID NO: 1739699 - DNA, 14 bp, Homo sapiens
ccagctccagggcc

SEQ ID NO: 1739700 - DNA, 12 bp, Homo sapiens
ccagctcccagg

SEQ ID NO: 1739701 - DNA, 12 bp, Homo sapiens
ccagctcccccc

SEQ ID NO: 1739702 - DNA, 19 bp, Homo sapiens
ccagctccccccgcccacc

SEQ ID NO: 1739703 - DNA, 18 bp, Homo sapiens
ccagctcccgctgtggcc

SEQ ID NO: 1739704 - DNA, 23 bp, Homo sapiens
ccagctccctcgtcttcagctgc

SEQ ID NO: 1739705 - DNA, 16 bp, Homo sapiens
ccagctccgcctgctg

SEQ ID NO: 1739706 - DNA, 21 bp, Homo sapiens
ccagctcctgggcagcttgag

SEQ ID NO: 1739707 - DNA, 20 bp, Homo sapiens
ccagctccttttgtccccag

SEQ ID NO: 1739708 - DNA, 21 bp, Homo sapiens
ccagctccttttgtccccagg

SEQ ID NO: 1739709 - DNA, 17 bp, Homo sapiens
ccagctcgctggctttc

SEQ ID NO: 1739710 - DNA, 20 bp, Homo sapiens
ccagctcgctggctttctct

SEQ ID NO: 1739711 - DNA, 15 bp, Homo sapiens
ccagctctcagccaa

SEQ ID NO: 1739712 - DNA, 17 bp, Homo sapiens
ccagctctccctctggc

SEQ ID NO: 1739713 - DNA, 12 bp, Homo sapiens
ccagctctctga

SEQ ID NO: 1739714 - DNA, 14 bp, Homo sapiens
ccagctctctgacg

SEQ ID NO: 1739715 - DNA, 19 bp, Homo sapiens
ccagctctcttcctgtctt

SEQ ID NO: 1739716 - DNA, 17 bp, Homo sapiens
ccagctctgacatccct

SEQ ID NO: 1739717 - DNA, 14 bp, Homo sapiens
ccagctctggatga

SEQ ID NO: 1739718 - DNA, 19 bp, Homo sapiens
ccagctctggatgaaggca

SEQ ID NO: 1739719 - DNA, 17 bp, Homo sapiens
ccagctctgtcctcttg

SEQ ID NO: 1739720 - DNA, 16 bp, Homo sapiens
ccagctctgtggcctg

SEQ ID NO: 1739721 - DNA, 22 bp, Homo sapiens
ccagctctgtggcctgtgtcca

SEQ ID NO: 1739722 - DNA, 16 bp, Homo sapiens
ccagctcttgctctct

SEQ ID NO: 1739723 - DNA, 11 bp, Homo sapiens
ccagctcttgg

SEQ ID NO: 1739724 - DNA, 19 bp, Homo sapiens
ccagctgaaggcagtggca

SEQ ID NO: 1739725 - DNA, 22 bp, Homo sapiens
ccagctgaaggcagtggcaggg

SEQ ID NO: 1739726 - DNA, 17 bp, Homo sapiens
ccagctgacatcttgaa

SEQ ID NO: 1739727 - DNA, 23 bp, Homo sapiens
ccagctgactaaactttttttct

SEQ ID NO: 1739728 - DNA, 15 bp, Homo sapiens
ccagctgactgtggc

SEQ ID NO: 1739729 - DNA, 17 bp, Homo sapiens
ccagctgcacctgccag

SEQ ID NO: 1739730 - DNA, 23 bp, Homo sapiens
ccagctgcagatgccacacctgc

SEQ ID NO: 1739731 - DNA, 18 bp, Homo sapiens
ccagctgccaagtgctct

SEQ ID NO: 1739732 - DNA, 18 bp, Homo sapiens
ccagctgccccggcccct

SEQ ID NO: 1739733 - DNA, 23 bp, Homo sapiens
ccagctgccccgggatgcgaggc

SEQ ID NO: 1739734 - DNA, 20 bp, Homo sapiens
ccagctgccctatgggcctg

SEQ ID NO: 1739735 - DNA, 20 bp, Homo sapiens
ccagctgccgaccagagccc

SEQ ID NO: 1739736 - DNA, 15 bp, Homo sapiens
ccagctgccgcacca

SEQ ID NO: 1739737 - DNA, 11 bp, Homo sapiens
ccagctgcctt

SEQ ID NO: 1739738 - DNA, 13 bp, Homo sapiens
ccagctgccttcc

SEQ ID NO: 1739739 - DNA, 17 bp, Homo sapiens
ccagctgcgcttgcttt

SEQ ID NO: 1739740 - DNA, 22 bp, Homo sapiens
ccagctgctccgaggacccagg

SEQ ID NO: 1739741 - DNA, 15 bp, Homo sapiens
ccagctgctctgccc

SEQ ID NO: 1739742 - DNA, 21 bp, Homo sapiens
ccagctgctctgccccttggg

SEQ ID NO: 1739743 - DNA, 22 bp, Homo sapiens
ccagctgctctgccccttgggc

SEQ ID NO: 1739744 - DNA, 20 bp, Homo sapiens
ccagctgctgtgccccacca

SEQ ID NO: 1739745 - DNA, 13 bp, Homo sapiens
ccagctggccacc

SEQ ID NO: 1739746 - DNA, 16 bp, Homo sapiens
ccagctggcctggaca

SEQ ID NO: 1739747 - DNA, 17 bp, Homo sapiens
ccagctggcctggacag

SEQ ID NO: 1739748 - DNA, 20 bp, Homo sapiens
ccagctgggcctcctgcctc

SEQ ID NO: 1739749 - DNA, 12 bp, Homo sapiens
ccagctgggctc

SEQ ID NO: 1739750 - DNA, 16 bp, Homo sapiens
ccagctgggctctgcc

SEQ ID NO: 1739751 - DNA, 14 bp, Homo sapiens
ccagctgtagccat

SEQ ID NO: 1739752 - DNA, 18 bp, Homo sapiens
ccagctgtagccatggct

SEQ ID NO: 1739753 - DNA, 21 bp, Homo sapiens
ccagctgtagccatggctcag

SEQ ID NO: 1739754 - DNA, 24 bp, Homo sapiens
ccagctgtagccatggctcaggca

SEQ ID NO: 1739755 - DNA, 15 bp, Homo sapiens
ccagctgtgcacttt

SEQ ID NO: 1739756 - DNA, 21 bp, Homo sapiens
ccagcttaaacccatacaatg

SEQ ID NO: 1739757 - DNA, 23 bp, Homo sapiens
ccagcttaaacccatacaatgta

SEQ ID NO: 1739758 - DNA, 18 bp, Homo sapiens
ccagcttaatagctgtag

SEQ ID NO: 1739759 - DNA, 22 bp, Homo sapiens
ccagcttattgtgtgcgctgcc

SEQ ID NO: 1739760 - DNA, 23 bp, Homo sapiens
ccagcttattgtgtgcgctgcct

SEQ ID NO: 1739761 - DNA, 13 bp, Homo sapiens
ccagcttcagctc

SEQ ID NO: 1739762 - DNA, 15 bp, Homo sapiens
ccagcttcagctcaa

SEQ ID NO: 1739763 - DNA, 15 bp, Homo sapiens
ccagcttcctggtgt

SEQ ID NO: 1739764 - DNA, 12 bp, Homo sapiens
ccagcttcctgt

SEQ ID NO: 1739765 - DNA, 16 bp, Homo sapiens
ccagcttctctctcca

SEQ ID NO: 1739766 - DNA, 17 bp, Homo sapiens
ccagcttctctctccag

SEQ ID NO: 1739767 - DNA, 18 bp, Homo sapiens
ccagcttctctctccagg

SEQ ID NO: 1739768 - DNA, 19 bp, Homo sapiens
ccagcttctctctccaggg

SEQ ID NO: 1739769 - DNA, 22 bp, Homo sapiens
ccagcttggggccaccaaagct

SEQ ID NO: 1739770 - DNA, 14 bp, Homo sapiens
ccagcttggttcca

SEQ ID NO: 1739771 - DNA, 21 bp, Homo sapiens
ctctgtagctccctcctccca

SEQ ID NO: 1739772 - DNA, 20 bp, Homo sapiens
ctctgtataagttgaaggaa

SEQ ID NO: 1739773 - DNA, 13 bp, Homo sapiens
ctctgtcaggcct

SEQ ID NO: 1739774 - DNA, 18 bp, Homo sapiens
ctctgtcatcactccctg

SEQ ID NO: 1739775 - DNA, 16 bp, Homo sapiens
ctctgtccaggccact

SEQ ID NO: 1739776 - DNA, 17 bp, Homo sapiens
ctctgtccaggccactg

SEQ ID NO: 1739777 - DNA, 21 bp, Homo sapiens
ctctgtccaggccactgtggc

SEQ ID NO: 1739778 - DNA, 23 bp, Homo sapiens
ctctgtccaggccactgtggcca

SEQ ID NO: 1739779 - DNA, 24 bp, Homo sapiens
ctctgtccaggccactgtggccag

SEQ ID NO: 1739780 - DNA, 15 bp, Homo sapiens
ctctgtccccttctc

SEQ ID NO: 1739781 - DNA, 18 bp, Homo sapiens
ctctgtccccttctctca

SEQ ID NO: 1739782 - DNA, 21 bp, Homo sapiens
ctctgtccccttctctcatct

SEQ ID NO: 1739783 - DNA, 16 bp, Homo sapiens
ctctgtcccttgctgt

SEQ ID NO: 1739784 - DNA, 17 bp, Homo sapiens
ctctgtcctcttggcca

SEQ ID NO: 1739785 - DNA, 21 bp, Homo sapiens
ctctgtctaggactgcagtgt

SEQ ID NO: 1739786 - DNA, 22 bp, Homo sapiens
ctctgtctgagtaagaaacaga

SEQ ID NO: 1739787 - DNA, 21 bp, Homo sapiens
ctctgtcttttggagaaccag

SEQ ID NO: 1739788 - DNA, 23 bp, Homo sapiens
ctctgtgaacgatttagaaagaa

SEQ ID NO: 1739789 - DNA, 19 bp, Homo sapiens
ctctgtgagaaggtttatt

SEQ ID NO: 1739790 - DNA, 23 bp, Homo sapiens
ctctgtgagaaggtttattgtta

SEQ ID NO: 1739791 - DNA, 13 bp, Homo sapiens
ctctgtgagactc

SEQ ID NO: 1739792 - DNA, 17 bp, Homo sapiens
ctctgtgagactcgaga

SEQ ID NO: 1739793 - DNA, 14 bp, Homo sapiens
ctctgtgcacagtg

SEQ ID NO: 1739794 - DNA, 20 bp, Homo sapiens
ctctgtgcacagtggcttct

SEQ ID NO: 1739795 - DNA, 22 bp, Homo sapiens
ctctgtgcacagtggcttcttt

SEQ ID NO: 1739796 - DNA, 15 bp, Homo sapiens
ctctgtgcaggtgct

SEQ ID NO: 1739797 - DNA, 16 bp, Homo sapiens
ctctgtgcaggtgctg

SEQ ID NO: 1739798 - DNA, 23 bp, Homo sapiens
ctctgtgcaggtgctgccttgag

SEQ ID NO: 1739799 - DNA, 20 bp, Homo sapiens
ctctgtgcagtcactggagg

SEQ ID NO: 1739800 - DNA, 15 bp, Homo sapiens
ctctgtgccttcttt

SEQ ID NO: 1739801 - DNA, 13 bp, Homo sapiens
ctctgtgccttgg

SEQ ID NO: 1739802 - DNA, 15 bp, Homo sapiens
ctctgtggcctgtgt

SEQ ID NO: 1739803 - DNA, 18 bp, Homo sapiens
ctctgtgggtctctggaa

SEQ ID NO: 1739804 - DNA, 19 bp, Homo sapiens
ctctgtgtaatctctgatt

SEQ ID NO: 1739805 - DNA, 21 bp, Homo sapiens
ctctgtgtagccgccctgaga

SEQ ID NO: 1739806 - DNA, 22 bp, Homo sapiens
ctctgtgtagccgccctgagag

SEQ ID NO: 1739807 - DNA, 17 bp, Homo sapiens
ctctgtgtgcacaaata

SEQ ID NO: 1739808 - DNA, 15 bp, Homo sapiens
ctctgttacccaggc

SEQ ID NO: 1739809 - DNA, 18 bp, Homo sapiens
ctctgttcacagtctctg

SEQ ID NO: 1739810 - DNA, 23 bp, Homo sapiens
ctctgttccatgcaactggagtt

SEQ ID NO: 1739811 - DNA, 21 bp, Homo sapiens
ctctgttcccccaccctccat

SEQ ID NO: 1739812 - DNA, 16 bp, Homo sapiens
ctctgttccttcacat

SEQ ID NO: 1739813 - DNA, 18 bp, Homo sapiens
ctctgttcggcctttggg

SEQ ID NO: 1739814 - DNA, 17 bp, Homo sapiens
ctctgttgagtaaaaca

SEQ ID NO: 1739815 - DNA, 17 bp, Homo sapiens
ctctgttgcccaagctg

SEQ ID NO: 1739816 - DNA, 14 bp, Homo sapiens
ctctgttgtaagaa

SEQ ID NO: 1739817 - DNA, 22 bp, Homo sapiens
ctctgttgtcaaactgaaattc

SEQ ID NO: 1739818 - DNA, 17 bp, Homo sapiens
ctctgttgtcctcccct

SEQ ID NO: 1739819 - DNA, 21 bp, Homo sapiens
ctctgttgtcctccccttggg

SEQ ID NO: 1739820 - DNA, 14 bp, Homo sapiens
ctctgtttctcttt

SEQ ID NO: 1739821 - DNA, 18 bp, Homo sapiens
ctctgtttgatgctattt

SEQ ID NO: 1739822 - DNA, 16 bp, Homo sapiens
ctcttaaaaaataaaa

SEQ ID NO: 1739823 - DNA, 17 bp, Homo sapiens
ctcttaaaaaataaaaa

SEQ ID NO: 1739824 - DNA, 19 bp, Homo sapiens
ctcttaaaaaataaaaact

SEQ ID NO: 1739825 - DNA, 14 bp, Homo sapiens
ctcttaaattatat

SEQ ID NO: 1739826 - DNA, 14 bp, Homo sapiens
ctcttacaaaagct

SEQ ID NO: 1739827 - DNA, 14 bp, Homo sapiens
ctcttacagagcct

SEQ ID NO: 1739828 - DNA, 20 bp, Homo sapiens
ctcttacctgttatttatca

SEQ ID NO: 1739829 - DNA, 16 bp, Homo sapiens
ctcttactctttccta

SEQ ID NO: 1739830 - DNA, 18 bp, Homo sapiens
ctcttactctttcctatt

SEQ ID NO: 1739831 - DNA, 14 bp, Homo sapiens
ctcttacttgccaa

SEQ ID NO: 1739832 - DNA, 14 bp, Homo sapiens
ctcttactttgctt

SEQ ID NO: 1739833 - DNA, 18 bp, Homo sapiens
ctcttagattcttaattc

SEQ ID NO: 1739834 - DNA, 15 bp, Homo sapiens
ctcttagcctctgga

SEQ ID NO: 1739835 - DNA, 21 bp, Homo sapiens
ctcttagctactgtatgcaaa

SEQ ID NO: 1739836 - DNA, 17 bp, Homo sapiens
ctcttagctcccctcca

SEQ ID NO: 1739837 - DNA, 13 bp, Homo sapiens
ctcttagctgtct

SEQ ID NO: 1739838 - DNA, 20 bp, Homo sapiens
ctcttagtgattgtgtctgc

SEQ ID NO: 1739839 - DNA, 13 bp, Homo sapiens
ctcttagtgcccg

SEQ ID NO: 1739840 - DNA, 16 bp, Homo sapiens
ctcttagtgcccgcct

SEQ ID NO: 1739841 - DNA, 18 bp, Homo sapiens
ctcttatagaatatttat

SEQ ID NO: 1739842 - DNA, 17 bp, Homo sapiens
ctcttatcctctctctc

SEQ ID NO: 1739843 - DNA, 18 bp, Homo sapiens
ctcttcaaaaagcagagt

SEQ ID NO: 1739844 - DNA, 17 bp, Homo sapiens
ctcttcaaattagaaga

SEQ ID NO: 1739845 - DNA, 18 bp, Homo sapiens
ctcttcaagtactgtttt

SEQ ID NO: 1739846 - DNA, 22 bp, Homo sapiens
ctcttcacccctacactgtgaa

SEQ ID NO: 1739847 - DNA, 17 bp, Homo sapiens
ctcttcactcccaataa

SEQ ID NO: 1739848 - DNA, 20 bp, Homo sapiens
ctcttcagatgccacttcta

SEQ ID NO: 1739849 - DNA, 13 bp, Homo sapiens
ctcttcaggcctc

SEQ ID NO: 1739850 - DNA, 14 bp, Homo sapiens
ctcttcaggcctcc

SEQ ID NO: 1739851 - DNA, 21 bp, Homo sapiens
ctcttcagtgactcctgctgg

SEQ ID NO: 1739852 - DNA, 14 bp, Homo sapiens
ctcttcagttaatt

SEQ ID NO: 1739853 - DNA, 17 bp, Homo sapiens
ctcttcagttaattctt

SEQ ID NO: 1739854 - DNA, 19 bp, Homo sapiens
ctcttcatggcatcttcaa

SEQ ID NO: 1739855 - DNA, 13 bp, Homo sapiens
ctcttcatttttt

SEQ ID NO: 1739856 - DNA, 18 bp, Homo sapiens
ctcttcatttttttttca

SEQ ID NO: 1739857 - DNA, 22 bp, Homo sapiens
ctcttccagtcttcctgacact

SEQ ID NO: 1739858 - DNA, 14 bp, Homo sapiens
ctcttccatgctgt

SEQ ID NO: 1739859 - DNA, 13 bp, Homo sapiens
ctcttcccatgtc

SEQ ID NO: 1739860 - DNA, 15 bp, Homo sapiens
ctcttcccatgtccc

SEQ ID NO: 1739861 - DNA, 20 bp, Homo sapiens
ctcttcccatgtcccaccct

SEQ ID NO: 1739862 - DNA, 23 bp, Homo sapiens
ctcttcccatgtcccaccctccc

SEQ ID NO: 1739863 - DNA, 21 bp, Homo sapiens
ctcttccccagaaaggagact

SEQ ID NO: 1739864 - DNA, 20 bp, Homo sapiens
ctcttcccccatgtgcctgt

SEQ ID NO: 1739865 - DNA, 22 bp, Homo sapiens
ctcttccccttcctgtttcaga

SEQ ID NO: 1739866 - DNA, 21 bp, Homo sapiens
ctcttccctctccctctctct

SEQ ID NO: 1739867 - DNA, 22 bp, Homo sapiens
ctcttccctctccctctctctg

SEQ ID NO: 1739868 - DNA, 18 bp, Homo sapiens
ctcttccctctgggcctg

SEQ ID NO: 1739869 - DNA, 22 bp, Homo sapiens
ctcttccctgaacgttttcttc

SEQ ID NO: 1739870 - DNA, 22 bp, Homo sapiens
ctcttccctgcgcctgtgatgc

SEQ ID NO: 1739871 - DNA, 16 bp, Homo sapiens
ctcttcccttagcctc

SEQ ID NO: 1739872 - DNA, 21 bp, Homo sapiens
ctcttcccttagcctctccca

SEQ ID NO: 1739873 - DNA, 23 bp, Homo sapiens
ctcttcccttagcctctcccacc

SEQ ID NO: 1739874 - DNA, 14 bp, Homo sapiens
ctcttcccttcaac

SEQ ID NO: 1739875 - DNA, 18 bp, Homo sapiens
ctcttcccttcccagacc

SEQ ID NO: 1739876 - DNA, 12 bp, Homo sapiens
ctcttcctaccc

SEQ ID NO: 1739877 - DNA, 15 bp, Homo sapiens
ctcttcctacccaac

SEQ ID NO: 1739878 - DNA, 20 bp, Homo sapiens
ctcttcctacccaaccactc

SEQ ID NO: 1739879 - DNA, 20 bp, Homo sapiens
ctcttcctctggttcctttc

SEQ ID NO: 1739880 - DNA, 13 bp, Homo sapiens
ctcttcctttctt

SEQ ID NO: 1739881 - DNA, 15 bp, Homo sapiens
ctcttcgctgtgatg

SEQ ID NO: 1739882 - DNA, 14 bp, Homo sapiens
ctcttcggcaggga

SEQ ID NO: 1739883 - DNA, 20 bp, Homo sapiens
gcgaagtctttgccttctct

SEQ ID NO: 1739884 - DNA, 15 bp, Homo sapiens
gcgacaagagtgaga

SEQ ID NO: 1739885 - DNA, 19 bp, Homo sapiens
gcgacagagcgagagtctg

SEQ ID NO: 1739886 - DNA, 22 bp, Homo sapiens
gcgaccaataaacagctcccag

SEQ ID NO: 1739887 - DNA, 14 bp, Homo sapiens
gcgaccgccccctc

SEQ ID NO: 1739888 - DNA, 18 bp, Homo sapiens
gcgactccgttggccact

SEQ ID NO: 1739889 - DNA, 13 bp, Homo sapiens
gcgactctgcaga

SEQ ID NO: 1739890 - DNA, 12 bp, Homo sapiens
gcgactttctgc

SEQ ID NO: 1739891 - DNA, 16 bp, Homo sapiens
gcgagagtctgtctca

SEQ ID NO: 1739892 - DNA, 13 bp, Homo sapiens
gcgagcacccacg

SEQ ID NO: 1739893 - DNA, 18 bp, Homo sapiens
gcgagcatgggggctgcc

SEQ ID NO: 1739894 - DNA, 14 bp, Homo sapiens
gcgagctgagaagc

SEQ ID NO: 1739895 - DNA, 16 bp, Homo sapiens
gcgagggcagctgcta

SEQ ID NO: 1739896 - DNA, 14 bp, Homo sapiens
gcgagtcccctgcc

SEQ ID NO: 1739897 - DNA, 14 bp, Homo sapiens
gcgagtggtcaagg

SEQ ID NO: 1739898 - DNA, 13 bp, Homo sapiens
gcgatagagtctc

SEQ ID NO: 1739899 - DNA, 18 bp, Homo sapiens
gcgatggggcaagacaga

SEQ ID NO: 1739900 - DNA, 21 bp, Homo sapiens
gcgatgtttcaggaggctgga

SEQ ID NO: 1739901 - DNA, 23 bp, Homo sapiens
gcgatgtttcaggaggctggagg

SEQ ID NO: 1739902 - DNA, 16 bp, Homo sapiens
gcgattccctctcacc

SEQ ID NO: 1739903 - DNA, 23 bp, Homo sapiens
gcgattctcccgcctcagcctcc

SEQ ID NO: 1739904 - DNA, 19 bp, Homo sapiens
gcgattctggataaagcca

SEQ ID NO: 1739905 - DNA, 20 bp, Homo sapiens
gcgattctggataaagccac

SEQ ID NO: 1739906 - DNA, 13 bp, Homo sapiens
gcgatttgaaaca

SEQ ID NO: 1739907 - DNA, 17 bp, Homo sapiens
gcgcaaaggtgcctcat

SEQ ID NO: 1739908 - DNA, 20 bp, Homo sapiens
gcgcaagatagatttggaat

SEQ ID NO: 1739909 - DNA, 13 bp, Homo sapiens
gcgcaagcctgta

SEQ ID NO: 1739910 - DNA, 21 bp, Homo sapiens
gcgcaagcctgtaatcccagc

SEQ ID NO: 1739911 - DNA, 22 bp, Homo sapiens
gcgcaagcctgtaatcccagct

SEQ ID NO: 1739912 - DNA, 21 bp, Homo sapiens
gcgcaatctcggctcactgca

SEQ ID NO: 1739913 - DNA, 18 bp, Homo sapiens
gcgcacaaggctgaccaa

SEQ ID NO: 1739914 - DNA, 14 bp, Homo sapiens
gcgcacaccgccag

SEQ ID NO: 1739915 - DNA, 21 bp, Homo sapiens
gcgcagagccctccaggcctg

SEQ ID NO: 1739916 - DNA, 21 bp, Homo sapiens
gcgcaggcctgcgtgcgctgg

SEQ ID NO: 1739917 - DNA, 17 bp, Homo sapiens
gcgcaggtgccatgcct

SEQ ID NO: 1739918 - DNA, 22 bp, Homo sapiens
gcgcaggtgccatgcctgctcc

SEQ ID NO: 1739919 - DNA, 19 bp, Homo sapiens
gcgcaggtgggctggactt

SEQ ID NO: 1739920 - DNA, 22 bp, Homo sapiens
gcgcagtgcttctctacagact

SEQ ID NO: 1739921 - DNA, 15 bp, Homo sapiens
gcgcagtggccctga

SEQ ID NO: 1739922 - DNA, 11 bp, Homo sapiens
gcgcatctaac

SEQ ID NO: 1739923 - DNA, 21 bp, Homo sapiens
gcgcatgtaatcccagctact

SEQ ID NO: 1739924 - DNA, 22 bp, Homo sapiens
gcgcatgtaatcccagctactc

SEQ ID NO: 1739925 - DNA, 18 bp, Homo sapiens
gcgccaaataatgtctct

SEQ ID NO: 1739926 - DNA, 14 bp, Homo sapiens
gcgccaccatcctg

SEQ ID NO: 1739927 - DNA, 21 bp, Homo sapiens
gcgccactacactccagcctg

SEQ ID NO: 1739928 - DNA, 21 bp, Homo sapiens
gcgccagcacagaaacagagg

SEQ ID NO: 1739929 - DNA, 18 bp, Homo sapiens
gcgccagctccttggggc

SEQ ID NO: 1739930 - DNA, 16 bp, Homo sapiens
gcgccaggcagagctg

SEQ ID NO: 1739931 - DNA, 19 bp, Homo sapiens
gcgccaggcagagctgagg

SEQ ID NO: 1739932 - DNA, 21 bp, Homo sapiens
gcgccaggcagagctgagggc

SEQ ID NO: 1739933 - DNA, 23 bp, Homo sapiens
gcgccaggcagagctgagggccc

SEQ ID NO: 1739934 - DNA, 13 bp, Homo sapiens
gcgcccacccagg

SEQ ID NO: 1739935 - DNA, 16 bp, Homo sapiens
gcgcccacccaggtcc

SEQ ID NO: 1739936 - DNA, 14 bp, Homo sapiens
gcgcccaccctggg

SEQ ID NO: 1739937 - DNA, 13 bp, Homo sapiens
gcgcccagggctg

SEQ ID NO: 1739938 - DNA, 19 bp, Homo sapiens
gcgccccgcccccacccct

SEQ ID NO: 1739939 - DNA, 20 bp, Homo sapiens
gcgccccgcccccaccccta

SEQ ID NO: 1739940 - DNA, 13 bp, Homo sapiens
gcgcccgcgcccg

SEQ ID NO: 1739941 - DNA, 20 bp, Homo sapiens
gcgcccttggcttctgtgat

SEQ ID NO: 1739942 - DNA, 12 bp, Homo sapiens
gcgccctttccc

SEQ ID NO: 1739943 - DNA, 23 bp, Homo sapiens
gcgccctttccccgacgcccacc

SEQ ID NO: 1739944 - DNA, 18 bp, Homo sapiens
gcgccggcgggcgggccg

SEQ ID NO: 1739945 - DNA, 19 bp, Homo sapiens
gcgcctactcttcagggtc

SEQ ID NO: 1739946 - DNA, 15 bp, Homo sapiens
gcgcctccttccttg

SEQ ID NO: 1739947 - DNA, 18 bp, Homo sapiens
gcgcctcggtatctggct

SEQ ID NO: 1739948 - DNA, 21 bp, Homo sapiens
gcgcctcggtatctggcttcc

SEQ ID NO: 1739949 - DNA, 14 bp, Homo sapiens
gcgcctgaaaaggg

SEQ ID NO: 1739950 - DNA, 23 bp, Homo sapiens
gcgcctgaaaagggcggaagagt

SEQ ID NO: 1739951 - DNA, 21 bp, Homo sapiens
gcgcgatcccacacaggctgg

SEQ ID NO: 1739952 - DNA, 16 bp, Homo sapiens
gcgcgatctcagctca

SEQ ID NO: 1739953 - DNA, 14 bp, Homo sapiens
gcgcgcccctgccc

SEQ ID NO: 1739954 - DNA, 20 bp, Homo sapiens
gcgcgccctcccttggcgtg

SEQ ID NO: 1739955 - DNA, 18 bp, Homo sapiens
gcgcgcccttccttcccg

SEQ ID NO: 1739956 - DNA, 22 bp, Homo sapiens
gcgcgggaggcaccagctctgt

SEQ ID NO: 1739957 - DNA, 17 bp, Homo sapiens
gcgcgggcagccaccca

SEQ ID NO: 1739958 - DNA, 20 bp, Homo sapiens
gcgcggtggcgggcacctgt

SEQ ID NO: 1739959 - DNA, 13 bp, Homo sapiens
gcgcggtggctca

SEQ ID NO: 1739960 - DNA, 19 bp, Homo sapiens
gcgcgtgtgggtctctggg

SEQ ID NO: 1739961 - DNA, 20 bp, Homo sapiens
gcgcgtgtgggtctctgggc

SEQ ID NO: 1739962 - DNA, 22 bp, Homo sapiens
gcgctaattcaaggaatttctt

SEQ ID NO: 1739963 - DNA, 16 bp, Homo sapiens
gcgctcacctcagagc

SEQ ID NO: 1739964 - DNA, 19 bp, Homo sapiens
gcgctcagacggcggccag

SEQ ID NO: 1739965 - DNA, 12 bp, Homo sapiens
gcgctcaggacc

SEQ ID NO: 1739966 - DNA, 13 bp, Homo sapiens
gcgctcaggaccc

SEQ ID NO: 1739967 - DNA, 18 bp, Homo sapiens
gcgctcaggacccaggcc

SEQ ID NO: 1739968 - DNA, 20 bp, Homo sapiens
gcgctcaggacccaggccct

SEQ ID NO: 1739969 - DNA, 18 bp, Homo sapiens
gcgctcatgttgagccag

SEQ ID NO: 1739970 - DNA, 13 bp, Homo sapiens
gcgctcccactca

SEQ ID NO: 1739971 - DNA, 17 bp, Homo sapiens
gcgctcccactcagaac

SEQ ID NO: 1739972 - DNA, 15 bp, Homo sapiens
gcgctcgcccagcag

SEQ ID NO: 1739973 - DNA, 16 bp, Homo sapiens
gcgctcgcccagcagg

SEQ ID NO: 1739974 - DNA, 16 bp, Homo sapiens
gcgctctccaccaccc

SEQ ID NO: 1739975 - DNA, 16 bp, Homo sapiens
gcgctgagcatggggc

SEQ ID NO: 1739976 - DNA, 22 bp, Homo sapiens
gcgctgcaggtacttcctcctg

SEQ ID NO: 1739977 - DNA, 17 bp, Homo sapiens
gcgctgccgcaccccag

SEQ ID NO: 1739978 - DNA, 19 bp, Homo sapiens
gcgctgccgcaccccagag

SEQ ID NO: 1739979 - DNA, 13 bp, Homo sapiens
gcgctgctggtgt

SEQ ID NO: 1739980 - DNA, 14 bp, Homo sapiens
gcgctgctggtgtt

SEQ ID NO: 1739981 - DNA, 16 bp, Homo sapiens
gcgctggcccagccgg

SEQ ID NO: 1739982 - DNA, 17 bp, Homo sapiens
gcgctggcccagccggc

SEQ ID NO: 1739983 - DNA, 13 bp, Homo sapiens
gcgctggggagac

SEQ ID NO: 1739984 - DNA, 12 bp, Homo sapiens
gcgctgtggact

SEQ ID NO: 1739985 - DNA, 13 bp, Homo sapiens
gcgctgtgtacaa

SEQ ID NO: 1739986 - DNA, 18 bp, Homo sapiens
gcgctgtttttgttgtgt

SEQ ID NO: 1739987 - DNA, 21 bp, Homo sapiens
gcgctgtttttgttgtgtgtg

SEQ ID NO: 1739988 - DNA, 20 bp, Homo sapiens
gcggaacaaggagtcagaca

SEQ ID NO: 1739989 - DNA, 22 bp, Homo sapiens
gcggaagagttacaataaagtt

SEQ ID NO: 1739990 - DNA, 14 bp, Homo sapiens
gcggacggctgtgg

SEQ ID NO: 1739991 - DNA, 17 bp, Homo sapiens
gcggacggctgtggacc

SEQ ID NO: 1739992 - DNA, 13 bp, Homo sapiens
gcggagagagcca

SEQ ID NO: 1739993 - DNA, 16 bp, Homo sapiens
tatttactctttctaa

SEQ ID NO: 1739994 - DNA, 14 bp, Homo sapiens
tatttactgagctt

SEQ ID NO: 1739995 - DNA, 22 bp, Homo sapiens
tatttactttttcggtttcaaa

SEQ ID NO: 1739996 - DNA, 16 bp, Homo sapiens
tatttagaaaattttg

SEQ ID NO: 1739997 - DNA, 15 bp, Homo sapiens
tatttagacaagaga

SEQ ID NO: 1739998 - DNA, 21 bp, Homo sapiens
tatttagactcatcttactgt

SEQ ID NO: 1739999 - DNA, 19 bp, Homo sapiens
tatttagattgttaaaata

SEQ ID NO: 1740000 - DNA, 19 bp, Homo sapiens
tatttagctacagcttgtt

SEQ ID NO: 1740001 - DNA, 15 bp, Homo sapiens
tatttaggaagtgtt

SEQ ID NO: 1740002 - DNA, 17 bp, Homo sapiens
tatttagggaactgctt

SEQ ID NO: 1740003 - DNA, 20 bp, Homo sapiens
tatttagggccttttctgtg

SEQ ID NO: 1740004 - DNA, 14 bp, Homo sapiens
tatttagtttttaa

SEQ ID NO: 1740005 - DNA, 18 bp, Homo sapiens
tatttataacagcattct

SEQ ID NO: 1740006 - DNA, 13 bp, Homo sapiens
tatttataactca

SEQ ID NO: 1740007 - DNA, 14 bp, Homo sapiens
tatttataagcaga

SEQ ID NO: 1740008 - DNA, 22 bp, Homo sapiens
tatttataagtgactttaaact

SEQ ID NO: 1740009 - DNA, 23 bp, Homo sapiens
tatttatactctagaacatgcac

SEQ ID NO: 1740010 - DNA, 19 bp, Homo sapiens
tatttatatatttataact

SEQ ID NO: 1740011 - DNA, 15 bp, Homo sapiens
tatttatatgtactg

SEQ ID NO: 1740012 - DNA, 16 bp, Homo sapiens
tatttatatttcacta

SEQ ID NO: 1740013 - DNA, 16 bp, Homo sapiens
tatttatatttggaaa

SEQ ID NO: 1740014 - DNA, 21 bp, Homo sapiens
tatttatatttggaaagagac

SEQ ID NO: 1740015 - DNA, 13 bp, Homo sapiens
tatttatcagtga

SEQ ID NO: 1740016 - DNA, 18 bp, Homo sapiens
tatttatcagtgacagag

SEQ ID NO: 1740017 - DNA, 15 bp, Homo sapiens
tatttatctgattaa

SEQ ID NO: 1740018 - DNA, 21 bp, Homo sapiens
tatttatctgattaagttgtc

SEQ ID NO: 1740019 - DNA, 21 bp, Homo sapiens
tatttatctgtagtaaactat

SEQ ID NO: 1740020 - DNA, 14 bp, Homo sapiens
tatttatgaagaaa

SEQ ID NO: 1740021 - DNA, 20 bp, Homo sapiens
tatttatgaagaaaatactt

SEQ ID NO: 1740022 - DNA, 19 bp, Homo sapiens
tatttatgcactgtgggat

SEQ ID NO: 1740023 - DNA, 15 bp, Homo sapiens
tatttattaaaaaca

SEQ ID NO: 1740024 - DNA, 13 bp, Homo sapiens
tatttattaatat

SEQ ID NO: 1740025 - DNA, 13 bp, Homo sapiens
tatttattacctc

SEQ ID NO: 1740026 - DNA, 17 bp, Homo sapiens
tatttattagccaactg

SEQ ID NO: 1740027 - DNA, 14 bp, Homo sapiens
tatttattatttat

SEQ ID NO: 1740028 - DNA, 15 bp, Homo sapiens
tatttattcataatg

SEQ ID NO: 1740029 - DNA, 14 bp, Homo sapiens
tatttattgattaa

SEQ ID NO: 1740030 - DNA, 22 bp, Homo sapiens
tatttattgcattgctggtaga

SEQ ID NO: 1740031 - DNA, 14 bp, Homo sapiens
tatttattggtttt

SEQ ID NO: 1740032 - DNA, 10 bp, Homo sapiens
tatttattgt

SEQ ID NO: 1740033 - DNA, 15 bp, Homo sapiens
tatttattgtattag

SEQ ID NO: 1740034 - DNA, 15 bp, Homo sapiens
tatttattgttagaa

SEQ ID NO: 1740035 - DNA, 20 bp, Homo sapiens
tattttatcctgtattcttg

SEQ ID NO: 1740036 - DNA, 14 bp, Homo sapiens
tattttatgaacat

SEQ ID NO: 1740037 - DNA, 21 bp, Homo sapiens
tattttattaattttctatgt

SEQ ID NO: 1740038 - DNA, 20 bp, Homo sapiens
tattttatttagacaagaga

SEQ ID NO: 1740039 - DNA, 19 bp, Homo sapiens
tattttattttttaccata

SEQ ID NO: 1740040 - DNA, 20 bp, Homo sapiens
tattttcaaccataaaagaa

SEQ ID NO: 1740041 - DNA, 21 bp, Homo sapiens
tattttcaacgcagccctgct

SEQ ID NO: 1740042 - DNA, 11 bp, Homo sapiens
tattttcaaga

SEQ ID NO: 1740043 - DNA, 21 bp, Homo sapiens
tattttcaaggccctcagcat

SEQ ID NO: 1740044 - DNA, 13 bp, Homo sapiens
tattttcagtccc

SEQ ID NO: 1740045 - DNA, 22 bp, Homo sapiens
tattttcagtcccctctctctg

SEQ ID NO: 1740046 - DNA, 16 bp, Homo sapiens
tattttcatacaaatt

SEQ ID NO: 1740047 - DNA, 20 bp, Homo sapiens
tattttcatgaaaataccat

SEQ ID NO: 1740048 - DNA, 12 bp, Homo sapiens
tattttcctaaa

SEQ ID NO: 1740049 - DNA, 19 bp, Homo sapiens
tattttcctgatagcatat

SEQ ID NO: 1740050 - DNA, 14 bp, Homo sapiens
tattttctacagtg

SEQ ID NO: 1740051 - DNA, 14 bp, Homo sapiens
tattttctatttta

SEQ ID NO: 1740052 - DNA, 19 bp, Homo sapiens
tattttctattttaagact

SEQ ID NO: 1740053 - DNA, 18 bp, Homo sapiens
tattttctcaatctcctc

SEQ ID NO: 1740054 - DNA, 12 bp, Homo sapiens
tattttctgaat

SEQ ID NO: 1740055 - DNA, 13 bp, Homo sapiens
tattttctgaatt

SEQ ID NO: 1740056 - DNA, 14 bp, Homo sapiens
tattttctgaattc

SEQ ID NO: 1740057 - DNA, 19 bp, Homo sapiens
tattttctgaattcataaa

SEQ ID NO: 1740058 - DNA, 21 bp, Homo sapiens
tattttgagaaactgctgcag

SEQ ID NO: 1740059 - DNA, 21 bp, Homo sapiens
tattttgagtcctaggactta

SEQ ID NO: 1740060 - DNA, 14 bp, Homo sapiens
tattttgcacagtt

SEQ ID NO: 1740061 - DNA, 20 bp, Homo sapiens
tattttgcactctgtaattg

SEQ ID NO: 1740062 - DNA, 18 bp, Homo sapiens
tattttgctgagttgttc

SEQ ID NO: 1740063 - DNA, 16 bp, Homo sapiens
tattttgctttggtta

SEQ ID NO: 1740064 - DNA, 11 bp, Homo sapiens
tattttggaac

SEQ ID NO: 1740065 - DNA, 16 bp, Homo sapiens
tattttggaactatga

SEQ ID NO: 1740066 - DNA, 21 bp, Homo sapiens
tattttgtaaactcaaaatat

SEQ ID NO: 1740067 - DNA, 15 bp, Homo sapiens
tattttgtactttgt

SEQ ID NO: 1740068 - DNA, 14 bp, Homo sapiens
tattttgtagatgt

SEQ ID NO: 1740069 - DNA, 10 bp, Homo sapiens
tattttgtat

SEQ ID NO: 1740070 - DNA, 23 bp, Homo sapiens
tattttgtgggctggttgctgta

SEQ ID NO: 1740071 - DNA, 16 bp, Homo sapiens
tattttgttcatacat

SEQ ID NO: 1740072 - DNA, 17 bp, Homo sapiens
tattttgttgctttctt

SEQ ID NO: 1740073 - DNA, 21 bp, Homo sapiens
tatttttatactcttcctatt

SEQ ID NO: 1740074 - DNA, 15 bp, Homo sapiens
tatttttatacttta

SEQ ID NO: 1740075 - DNA, 17 bp, Homo sapiens
tatttttattaaatgta

SEQ ID NO: 1740076 - DNA, 12 bp, Homo sapiens
tatttttattga

SEQ ID NO: 1740077 - DNA, 12 bp, Homo sapiens
tatttttcacat

SEQ ID NO: 1740078 - DNA, 13 bp, Homo sapiens
tatttttcacata

SEQ ID NO: 1740079 - DNA, 18 bp, Homo sapiens
tatttttcataaacaagt

SEQ ID NO: 1740080 - DNA, 20 bp, Homo sapiens
tatttttccactattaatct

SEQ ID NO: 1740081 - DNA, 15 bp, Homo sapiens
tatttttctgccctg

SEQ ID NO: 1740082 - DNA, 14 bp, Homo sapiens
tatttttgacagaa

SEQ ID NO: 1740083 - DNA, 13 bp, Homo sapiens
tatttttgattaa

SEQ ID NO: 1740084 - DNA, 22 bp, Homo sapiens
tatttttgctaggagccccagc

SEQ ID NO: 1740085 - DNA, 20 bp, Homo sapiens
tatttttggggcatcctgga

SEQ ID NO: 1740086 - DNA, 13 bp, Homo sapiens
tatttttgtacat

SEQ ID NO: 1740087 - DNA, 20 bp, Homo sapiens
tatttttgtacatattgtta

SEQ ID NO: 1740088 - DNA, 14 bp, Homo sapiens
tatttttgtacatg

SEQ ID NO: 1740089 - DNA, 13 bp, Homo sapiens
tatttttgtagca

SEQ ID NO: 1740090 - DNA, 16 bp, Homo sapiens
tatttttgtattttac

SEQ ID NO: 1740091 - DNA, 22 bp, Homo sapiens
tatttttgtgaagtattcacaa

SEQ ID NO: 1740092 - DNA, 15 bp, Homo sapiens
tatttttgtgtaggt

SEQ ID NO: 1740093 - DNA, 13 bp, Homo sapiens
tatttttgttgtt

SEQ ID NO: 1740094 - DNA, 22 bp, Homo sapiens
tatttttgttgttgttgtttgt

SEQ ID NO: 1740095 - DNA, 16 bp, Homo sapiens
tattttttaaaaatga

SEQ ID NO: 1740096 - DNA, 15 bp, Homo sapiens
tattttttaattatt

SEQ ID NO: 1740097 - DNA, 13 bp, Homo sapiens
tattttttcccaa

SEQ ID NO: 1740098 - DNA, 20 bp, Homo sapiens
tattttttgctctaatctct

SEQ ID NO: 1740099 - DNA, 16 bp, Homo sapiens
tatttttttaaatcaa

SEQ ID NO: 1740100 - DNA, 18 bp, Homo sapiens
tatttttttcttaccaaa

SEQ ID NO: 1740101 - DNA, 21 bp, Homo sapiens
tattttttttggcctgtttga

SEQ ID NO: 1740102 - DNA, 13 bp, Homo sapiens
tatttttttttgg

SEQ ID NO: 1740103 - DNA, 16 bp, Homo sapiens
tattttttttttcttc

SEQ ID NO: 1740104 - DNA, 17 bp, Homo sapiens
tattttttttttcttct

SEQ ID NO: 1740105 - DNA, 22 bp, Homo sapiens
tcaaaaaaaaaaaaaaaagcct

SEQ ID NO: 1740106 - DNA, 15 bp, Homo sapiens
tcaaaaaaaaaaaga

SEQ ID NO: 1740107 - DNA, 14 bp, Homo sapiens
tcaaaaaaacacta

SEQ ID NO: 1740108 - DNA, 16 bp, Homo sapiens
tcaaaaaaagccttta

SEQ ID NO: 1740109 - DNA, 18 bp, Homo sapiens
tcaaaaaacctttacagt

SEQ ID NO: 1740110 - DNA, 19 bp, Homo sapiens
tcaaaaaactctctcccag

SEQ ID NO: 1740111 - DNA, 19 bp, Homo sapiens
tcaaaaaattatttgctat

SEQ ID NO: 1740112 - DNA, 13 bp, Homo sapiens
tcaaaaactattt

SEQ ID NO: 1740113 - DNA, 17 bp, Homo sapiens
tcaaaaactttggagtc

SEQ ID NO: 1740114 - DNA, 14 bp, Homo sapiens
tcaaaaagaaatca

SEQ ID NO: 1740115 - DNA, 14 bp, Homo sapiens
gccttcacaaatgt

SEQ ID NO: 1740116 - DNA, 14 bp, Homo sapiens
gccttcactgtgct

SEQ ID NO: 1740117 - DNA, 18 bp, Homo sapiens
gccttcagacacatgcta

SEQ ID NO: 1740118 - DNA, 20 bp, Homo sapiens
gccttcagcagcagctcaca

SEQ ID NO: 1740119 - DNA, 13 bp, Homo sapiens
gccttcagctcca

SEQ ID NO: 1740120 - DNA, 13 bp, Homo sapiens
gccttcagctcta

SEQ ID NO: 1740121 - DNA, 14 bp, Homo sapiens
gccttcaggcttct

SEQ ID NO: 1740122 - DNA, 19 bp, Homo sapiens
gccttcagtttatttccac

SEQ ID NO: 1740123 - DNA, 17 bp, Homo sapiens
gccttcatcctcctccc

SEQ ID NO: 1740124 - DNA, 20 bp, Homo sapiens
gccttcatcctcctccccag

SEQ ID NO: 1740125 - DNA, 13 bp, Homo sapiens
gccttcattacct

SEQ ID NO: 1740126 - DNA, 19 bp, Homo sapiens
gccttccaaaacctgcttc

SEQ ID NO: 1740127 - DNA, 18 bp, Homo sapiens
gccttccacagtgaatgt

SEQ ID NO: 1740128 - DNA, 16 bp, Homo sapiens
gccttccaggtcagga

SEQ ID NO: 1740129 - DNA, 14 bp, Homo sapiens
gccttccaggtggc

SEQ ID NO: 1740130 - DNA, 13 bp, Homo sapiens
gccttccataatt

SEQ ID NO: 1740131 - DNA, 17 bp, Homo sapiens
gccttccccagcctctt

SEQ ID NO: 1740132 - DNA, 12 bp, Homo sapiens
gccttcccctca

SEQ ID NO: 1740133 - DNA, 16 bp, Homo sapiens
gccttccccttgccca

SEQ ID NO: 1740134 - DNA, 18 bp, Homo sapiens
gccttccccttttgcctg

SEQ ID NO: 1740135 - DNA, 21 bp, Homo sapiens
gccttccccttttgcctggct

SEQ ID NO: 1740136 - DNA, 24 bp, Homo sapiens
gccttccctagctttagaccctgg

SEQ ID NO: 1740137 - DNA, 15 bp, Homo sapiens
gccttcctcatcccc

SEQ ID NO: 1740138 - DNA, 13 bp, Homo sapiens
gccttcctcctcc

SEQ ID NO: 1740139 - DNA, 15 bp, Homo sapiens
gccttcctcctccac

SEQ ID NO: 1740140 - DNA, 19 bp, Homo sapiens
gccttcctcctccacagtg

SEQ ID NO: 1740141 - DNA, 22 bp, Homo sapiens
gccttcctcctccacagtgctg

SEQ ID NO: 1740142 - DNA, 13 bp, Homo sapiens
gccttcctctctc

SEQ ID NO: 1740143 - DNA, 18 bp, Homo sapiens
gccttcctctctccagat

SEQ ID NO: 1740144 - DNA, 20 bp, Homo sapiens
gccttcctctgcagctgacc

SEQ ID NO: 1740145 - DNA, 21 bp, Homo sapiens
gccttcctctgcagctgacct

SEQ ID NO: 1740146 - DNA, 19 bp, Homo sapiens
gccttcctgtttttcacat

SEQ ID NO: 1740147 - DNA, 21 bp, Homo sapiens
gccttcctttctcctgcccca

SEQ ID NO: 1740148 - DNA, 16 bp, Homo sapiens
gccttcgaccacagca

SEQ ID NO: 1740149 - DNA, 23 bp, Homo sapiens
gccttcgatacaccgggcctgga

SEQ ID NO: 1740150 - DNA, 22 bp, Homo sapiens
gccttcgcttcttgcctctgtg

SEQ ID NO: 1740151 - DNA, 15 bp, Homo sapiens
gccttctcagaagca

SEQ ID NO: 1740152 - DNA, 14 bp, Homo sapiens
gccttctcccacat

SEQ ID NO: 1740153 - DNA, 15 bp, Homo sapiens
gccttctcccacatg

SEQ ID NO: 1740154 - DNA, 16 bp, Homo sapiens
gccttctcctcccaag

SEQ ID NO: 1740155 - DNA, 14 bp, Homo sapiens
gccttctcctcccc

SEQ ID NO: 1740156 - DNA, 22 bp, Homo sapiens
gccttctcggagctggcccagg

SEQ ID NO: 1740157 - DNA, 12 bp, Homo sapiens
gccttctctcag

SEQ ID NO: 1740158 - DNA, 18 bp, Homo sapiens
gccttctctcagctccca

SEQ ID NO: 1740159 - DNA, 20 bp, Homo sapiens
gccttctctcagctcccagg

SEQ ID NO: 1740160 - DNA, 24 bp, Homo sapiens
gccttctctcagctcccaggccaa

SEQ ID NO: 1740161 - DNA, 17 bp, Homo sapiens
gccttctgaactccata

SEQ ID NO: 1740162 - DNA, 14 bp, Homo sapiens
gccttctggagctg

SEQ ID NO: 1740163 - DNA, 18 bp, Homo sapiens
gccttctggagctgggag

SEQ ID NO: 1740164 - DNA, 19 bp, Homo sapiens
gccttctgggaactctcct

SEQ ID NO: 1740165 - DNA, 21 bp, Homo sapiens
gccttctgggaactctccttt

SEQ ID NO: 1740166 - DNA, 23 bp, Homo sapiens
gccttcttattctcactccacca

SEQ ID NO: 1740167 - DNA, 21 bp, Homo sapiens
gccttctttccatcaactccc

SEQ ID NO: 1740168 - DNA, 23 bp, Homo sapiens
gccttctttccatcaactcccaa

SEQ ID NO: 1740169 - DNA, 22 bp, Homo sapiens
gccttcttttgattatgttttt

SEQ ID NO: 1740170 - DNA, 13 bp, Homo sapiens
gccttgaaaaaca

SEQ ID NO: 1740171 - DNA, 17 bp, Homo sapiens
gccttgaagacagagca

SEQ ID NO: 1740172 - DNA, 23 bp, Homo sapiens
gccttgagagaaaaagtgcccct

SEQ ID NO: 1740173 - DNA, 19 bp, Homo sapiens
gccttgcagatatctgcat

SEQ ID NO: 1740174 - DNA, 12 bp, Homo sapiens
gccttgccagag

SEQ ID NO: 1740175 - DNA, 17 bp, Homo sapiens
gccttgcccgccagcct

SEQ ID NO: 1740176 - DNA, 23 bp, Homo sapiens
gccttgctaaagctaggggccca

SEQ ID NO: 1740177 - DNA, 11 bp, Homo sapiens
gccttgcttgt

SEQ ID NO: 1740178 - DNA, 17 bp, Homo sapiens
gccttgctttgggcttt

SEQ ID NO: 1740179 - DNA, 15 bp, Homo sapiens
gccttggcctcagag

SEQ ID NO: 1740180 - DNA, 15 bp, Homo sapiens
gccttggccttgcag

SEQ ID NO: 1740181 - DNA, 18 bp, Homo sapiens
gccttggggaatttcctc

SEQ ID NO: 1740182 - DNA, 22 bp, Homo sapiens
gccttggtggagcagccagagc

SEQ ID NO: 1740183 - DNA, 19 bp, Homo sapiens
gccttggtgtccacctggc

SEQ ID NO: 1740184 - DNA, 21 bp, Homo sapiens
gccttggtgtccacctggccc

SEQ ID NO: 1740185 - DNA, 22 bp, Homo sapiens
gccttggtgtccacctggcccc

SEQ ID NO: 1740186 - DNA, 20 bp, Homo sapiens
gccttgtaattctaaatgaa

SEQ ID NO: 1740187 - DNA, 23 bp, Homo sapiens
gccttgtccctctcactccccag

SEQ ID NO: 1740188 - DNA, 14 bp, Homo sapiens
gccttgtgccctgc

SEQ ID NO: 1740189 - DNA, 16 bp, Homo sapiens
gccttgtgccctgccc

SEQ ID NO: 1740190 - DNA, 17 bp, Homo sapiens
gccttgtgccctgcccc

SEQ ID NO: 1740191 - DNA, 21 bp, Homo sapiens
gccttgtgtgtcaggccctct

SEQ ID NO: 1740192 - DNA, 14 bp, Homo sapiens
gccttgttcctgct

SEQ ID NO: 1740193 - DNA, 15 bp, Homo sapiens
gcctttaaagtatga

SEQ ID NO: 1740194 - DNA, 17 bp, Homo sapiens
gcctttaaatctgtgat

SEQ ID NO: 1740195 - DNA, 19 bp, Homo sapiens
gcctttaaatctgtgatga

SEQ ID NO: 1740196 - DNA, 21 bp, Homo sapiens
gcctttaagccaaagaaacaa

SEQ ID NO: 1740197 - DNA, 13 bp, Homo sapiens
gcctttagcctgg

SEQ ID NO: 1740198 - DNA, 14 bp, Homo sapiens
gcctttatggtttc

SEQ ID NO: 1740199 - DNA, 22 bp, Homo sapiens
gcctttcattttgctttaattt

SEQ ID NO: 1740200 - DNA, 16 bp, Homo sapiens
gcctttcgaggcctga

SEQ ID NO: 1740201 - DNA, 22 bp, Homo sapiens
gcctttctacaactgattgcaa

SEQ ID NO: 1740202 - DNA, 19 bp, Homo sapiens
gcctttctgcagtttttca

SEQ ID NO: 1740203 - DNA, 12 bp, Homo sapiens
gcctttctttgc

SEQ ID NO: 1740204 - DNA, 12 bp, Homo sapiens
gcctttgaggtt

SEQ ID NO: 1740205 - DNA, 19 bp, Homo sapiens
gcctttgcaagatgcttgg

SEQ ID NO: 1740206 - DNA, 18 bp, Homo sapiens
gcctttgctctggtctat

SEQ ID NO: 1740207 - DNA, 21 bp, Homo sapiens
gcctttggaagtctgcgccct

SEQ ID NO: 1740208 - DNA, 17 bp, Homo sapiens
gcctttgggtcctgggc

SEQ ID NO: 1740209 - DNA, 15 bp, Homo sapiens
gcctttgtatctttc

SEQ ID NO: 1740210 - DNA, 19 bp, Homo sapiens
gcctttgtcttgtacttct

SEQ ID NO: 1740211 - DNA, 13 bp, Homo sapiens
gccttttccctct

SEQ ID NO: 1740212 - DNA, 20 bp, Homo sapiens
gccttttccctctttggctc

SEQ ID NO: 1740213 - DNA, 15 bp, Homo sapiens
gccttttctggagtt

SEQ ID NO: 1740214 - DNA, 15 bp, Homo sapiens
gccttttctggcacc

SEQ ID NO: 1740215 - DNA, 17 bp, Homo sapiens
gccttttctttaacttt

SEQ ID NO: 1740216 - DNA, 14 bp, Homo sapiens
gccttttgaataca

SEQ ID NO: 1740217 - DNA, 16 bp, Homo sapiens
gccttttgcacccctc

SEQ ID NO: 1740218 - DNA, 20 bp, Homo sapiens
gccttttgctctctgtgacc

SEQ ID NO: 1740219 - DNA, 18 bp, Homo sapiens
gcctttttaaaacacatg

SEQ ID NO: 1740220 - DNA, 22 bp, Homo sapiens
gcctttttaaaacacatgtttt

SEQ ID NO: 1740221 - DNA, 22 bp, Homo sapiens
tcaaatccagtggtgggtaatt

SEQ ID NO: 1740222 - DNA, 14 bp, Homo sapiens
tcaaatctattcag

SEQ ID NO: 1740223 - DNA, 17 bp, Homo sapiens
tcaaatctattcagaca

SEQ ID NO: 1740224 - DNA, 22 bp, Homo sapiens
tcaaatctctacaaatttttct

SEQ ID NO: 1740225 - DNA, 14 bp, Homo sapiens
tcaaatctgggctc

SEQ ID NO: 1740226 - DNA, 12 bp, Homo sapiens
tcaaatctgtat

SEQ ID NO: 1740227 - DNA, 21 bp, Homo sapiens
tcaaatctgtatatgttgtaa

SEQ ID NO: 1740228 - DNA, 18 bp, Homo sapiens
tcaaatcttaagaaataa

SEQ ID NO: 1740229 - DNA, 17 bp, Homo sapiens
tcaaatgatcctcccac

SEQ ID NO: 1740230 - DNA, 23 bp, Homo sapiens
tcaaatgcgcgtgtgcacgtgtg

SEQ ID NO: 1740231 - DNA, 17 bp, Homo sapiens
tcaaatgctagaaaaat

SEQ ID NO: 1740232 - DNA, 19 bp, Homo sapiens
tcaaatggggccagatcca

SEQ ID NO: 1740233 - DNA, 14 bp, Homo sapiens
tcaaatgtaaatca

SEQ ID NO: 1740234 - DNA, 14 bp, Homo sapiens
tcaaatgtatgtat

SEQ ID NO: 1740235 - DNA, 14 bp, Homo sapiens
tcaaatgttctaag

SEQ ID NO: 1740236 - DNA, 21 bp, Homo sapiens
tcaaatgttctaagtttctaa

SEQ ID NO: 1740237 - DNA, 22 bp, Homo sapiens
tcaaatgttctaagtttctaag

SEQ ID NO: 1740238 - DNA, 14 bp, Homo sapiens
tcaaatgtttcctt

SEQ ID NO: 1740239 - DNA, 20 bp, Homo sapiens
tcaaattaaaacagctgcat

SEQ ID NO: 1740240 - DNA, 14 bp, Homo sapiens
tcaaattaccgtgt

SEQ ID NO: 1740241 - DNA, 16 bp, Homo sapiens
tcaaattagaagacat

SEQ ID NO: 1740242 - DNA, 20 bp, Homo sapiens
tcaaattcatttttttcact

SEQ ID NO: 1740243 - DNA, 15 bp, Homo sapiens
tcaaattcttctgaa

SEQ ID NO: 1740244 - DNA, 16 bp, Homo sapiens
tcaaattcttctgaac

SEQ ID NO: 1740245 - DNA, 21 bp, Homo sapiens
tcaaattcttctgaactcaaa

SEQ ID NO: 1740246 - DNA, 23 bp, Homo sapiens
tcaaatttgtacaggactgtaaa

SEQ ID NO: 1740247 - DNA, 14 bp, Homo sapiens
tcaaatttgtgtca

SEQ ID NO: 1740248 - DNA, 14 bp, Homo sapiens
tcaacaaactattt

SEQ ID NO: 1740249 - DNA, 14 bp, Homo sapiens
aatctgatggcctt

SEQ ID NO: 1740250 - DNA, 15 bp, Homo sapiens
aatctgatggcctta

SEQ ID NO: 1740251 - DNA, 19 bp, Homo sapiens
aatctgatggccttaattt

SEQ ID NO: 1740252 - DNA, 20 bp, Homo sapiens
aatctgatggccttaatttc

SEQ ID NO: 1740253 - DNA, 19 bp, Homo sapiens
aatctgattggacattttc

SEQ ID NO: 1740254 - DNA, 17 bp, Homo sapiens
aatctgccaagagagat

SEQ ID NO: 1740255 - DNA, 17 bp, Homo sapiens
aatctgctagaaagtta

SEQ ID NO: 1740256 - DNA, 14 bp, Homo sapiens
aatctgctcacttt

SEQ ID NO: 1740257 - DNA, 21 bp, Homo sapiens
aatctgctgttgccatagccc

SEQ ID NO: 1740258 - DNA, 22 bp, Homo sapiens
aatctgctttttaaagaatgct

SEQ ID NO: 1740259 - DNA, 13 bp, Homo sapiens
aatctggcccagg

SEQ ID NO: 1740260 - DNA, 16 bp, Homo sapiens
aatctggcccagggtg

SEQ ID NO: 1740261 - DNA, 20 bp, Homo sapiens
aatctggctcactgcagcct

SEQ ID NO: 1740262 - DNA, 18 bp, Homo sapiens
aatctggcttagtgccac

SEQ ID NO: 1740263 - DNA, 16 bp, Homo sapiens
aatctgggtggtaact

SEQ ID NO: 1740264 - DNA, 14 bp, Homo sapiens
aatctggtctcttc

SEQ ID NO: 1740265 - DNA, 22 bp, Homo sapiens
aatctggtgacaaatattctct

SEQ ID NO: 1740266 - DNA, 15 bp, Homo sapiens
aatctgtaaactgtg

SEQ ID NO: 1740267 - DNA, 16 bp, Homo sapiens
aatctgtaaactgtgt

SEQ ID NO: 1740268 - DNA, 15 bp, Homo sapiens
aatctgtaaagccag

SEQ ID NO: 1740269 - DNA, 13 bp, Homo sapiens
aatctgtaaattt

SEQ ID NO: 1740270 - DNA, 15 bp, Homo sapiens
aatctgtagggctgg

SEQ ID NO: 1740271 - DNA, 16 bp, Homo sapiens
aatctgtagggctgga

SEQ ID NO: 1740272 - DNA, 20 bp, Homo sapiens
aatctgtccaaaggaggctg

SEQ ID NO: 1740273 - DNA, 15 bp, Homo sapiens
aatctgtcctctgta

SEQ ID NO: 1740274 - DNA, 19 bp, Homo sapiens
aatctgtctgattctatgc

SEQ ID NO: 1740275 - DNA, 16 bp, Homo sapiens
aatctgtgaattaaaa

SEQ ID NO: 1740276 - DNA, 12 bp, Homo sapiens
aatctgtgcctg

SEQ ID NO: 1740277 - DNA, 19 bp, Homo sapiens
aatctgtgggtctgggagt

SEQ ID NO: 1740278 - DNA, 20 bp, Homo sapiens
aatctgttatgtactagtgt

SEQ ID NO: 1740279 - DNA, 19 bp, Homo sapiens
aatctgttgataaatccat

SEQ ID NO: 1740280 - DNA, 14 bp, Homo sapiens
aatctgtttctctg

SEQ ID NO: 1740281 - DNA, 17 bp, Homo sapiens
aatctgtttctctgctg

SEQ ID NO: 1740282 - DNA, 15 bp, Homo sapiens
aatctgtttttctca

SEQ ID NO: 1740283 - DNA, 13 bp, Homo sapiens
aatcttaagaaat

SEQ ID NO: 1740284 - DNA, 14 bp, Homo sapiens
aatcttaatactgt

SEQ ID NO: 1740285 - DNA, 15 bp, Homo sapiens
aatcttagcttttaa

SEQ ID NO: 1740286 - DNA, 19 bp, Homo sapiens
aatcttagcttttaatagt

SEQ ID NO: 1740287 - DNA, 19 bp, Homo sapiens
aatcttaggggagagcttt

SEQ ID NO: 1740288 - DNA, 17 bp, Homo sapiens
aatcttataattgttct

SEQ ID NO: 1740289 - DNA, 20 bp, Homo sapiens
aatcttattccgagcattcc

SEQ ID NO: 1740290 - DNA, 16 bp, Homo sapiens
aatcttcaaagccttc

SEQ ID NO: 1740291 - DNA, 14 bp, Homo sapiens
aatcttcacctcag

SEQ ID NO: 1740292 - DNA, 21 bp, Homo sapiens
aatcttcacgacaatgttgag

SEQ ID NO: 1740293 - DNA, 17 bp, Homo sapiens
aatcttgaatgtttgtg

SEQ ID NO: 1740294 - DNA, 19 bp, Homo sapiens
aatcttgaccaacagaaac

SEQ ID NO: 1740295 - DNA, 13 bp, Homo sapiens
aatcttgctctgc

SEQ ID NO: 1740296 - DNA, 18 bp, Homo sapiens
aatcttgcttcattgtta

SEQ ID NO: 1740297 - DNA, 21 bp, Homo sapiens
aatcttgctttctttagaatt

SEQ ID NO: 1740298 - DNA, 22 bp, Homo sapiens
aatcttgctttctttagaattt

SEQ ID NO: 1740299 - DNA, 13 bp, Homo sapiens
aatcttggattaa

SEQ ID NO: 1740300 - DNA, 18 bp, Homo sapiens
aatcttggggctgatgaa

SEQ ID NO: 1740301 - DNA, 13 bp, Homo sapiens
aatcttgtatttg

SEQ ID NO: 1740302 - DNA, 17 bp, Homo sapiens
aatcttgtcatgtgtat

SEQ ID NO: 1740303 - DNA, 16 bp, Homo sapiens
aatcttgtgctagaat

SEQ ID NO: 1740304 - DNA, 22 bp, Homo sapiens
aatcttgtgctagaatactttt

SEQ ID NO: 1740305 - DNA, 20 bp, Homo sapiens
aatcttgttaatgtcattgc

SEQ ID NO: 1740306 - DNA, 21 bp, Homo sapiens
aatcttgttaatgtcattgct

SEQ ID NO: 1740307 - DNA, 21 bp, Homo sapiens
aatcttgtttacaaaatattc

SEQ ID NO: 1740308 - DNA, 13 bp, Homo sapiens
aatcttgttttga

SEQ ID NO: 1740309 - DNA, 17 bp, Homo sapiens
aatcttgttttgaaaat

SEQ ID NO: 1740310 - DNA, 13 bp, Homo sapiens
aatctttaattaa

SEQ ID NO: 1740311 - DNA, 14 bp, Homo sapiens
aatctttaattaaa

SEQ ID NO: 1740312 - DNA, 15 bp, Homo sapiens
aatctttacctgtat

SEQ ID NO: 1740313 - DNA, 13 bp, Homo sapiens
aatctttctgcag

SEQ ID NO: 1740314 - DNA, 13 bp, Homo sapiens
aatctttgaaata

SEQ ID NO: 1740315 - DNA, 23 bp, Homo sapiens
aatctttgtaccaaaattttaaa

SEQ ID NO: 1740316 - DNA, 16 bp, Homo sapiens
aatcttttaaattgca

SEQ ID NO: 1740317 - DNA, 13 bp, Homo sapiens
aatcttttcttat

SEQ ID NO: 1740318 - DNA, 14 bp, Homo sapiens
aatcttttcttatt

SEQ ID NO: 1740319 - DNA, 13 bp, Homo sapiens
aatcttttgaagc

SEQ ID NO: 1740320 - DNA, 15 bp, Homo sapiens
aatctttttgcttct

SEQ ID NO: 1740321 - DNA, 17 bp, Homo sapiens
aatgaaaaattctcagt

SEQ ID NO: 1740322 - DNA, 15 bp, Homo sapiens
aatgaaaaggaagtt

SEQ ID NO: 1740323 - DNA, 12 bp, Homo sapiens
aatgaaaatgtc

SEQ ID NO: 1740324 - DNA, 13 bp, Homo sapiens
aatgaaagaaaat

SEQ ID NO: 1740325 - DNA, 18 bp, Homo sapiens
aatgaaagactgtacaaa

SEQ ID NO: 1740326 - DNA, 22 bp, Homo sapiens
aatgaaagcatgtggcatgttc

SEQ ID NO: 1740327 - DNA, 18 bp, Homo sapiens
aatgaaagctactcatag

SEQ ID NO: 1740328 - DNA, 12 bp, Homo sapiens
aatgaaataatc

SEQ ID NO: 1740329 - DNA, 15 bp, Homo sapiens
aatgaaatcaaatgt

SEQ ID NO: 1740330 - DNA, 14 bp, Homo sapiens
aatgaaatgtatgc

SEQ ID NO: 1740331 - DNA, 16 bp, Homo sapiens
aatgaaatgtatgtgc

SEQ ID NO: 1740332 - DNA, 21 bp, Homo sapiens
aatgaaattaaaaataaaatt

SEQ ID NO: 1740333 - DNA, 15 bp, Homo sapiens
aatgaacaaacctgt

SEQ ID NO: 1740334 - DNA, 14 bp, Homo sapiens
aatgaacagctcct

SEQ ID NO: 1740335 - DNA, 17 bp, Homo sapiens
aatgaacagctcctcct

SEQ ID NO: 1740336 - DNA, 13 bp, Homo sapiens
aatgaacatctct

SEQ ID NO: 1740337 - DNA, 14 bp, Homo sapiens
aatgaacattttgt

SEQ ID NO: 1740338 - DNA, 18 bp, Homo sapiens
aatgaaccataaattcaa

SEQ ID NO: 1740339 - DNA, 18 bp, Homo sapiens
aatgaacctgcaagcctt

SEQ ID NO: 1740340 - DNA, 22 bp, Homo sapiens
aatgaactaccatctgatgttt

SEQ ID NO: 1740341 - DNA, 15 bp, Homo sapiens
aatgaactgcttttc

SEQ ID NO: 1740342 - DNA, 17 bp, Homo sapiens
aatgaactgcttttcct

SEQ ID NO: 1740343 - DNA, 15 bp, Homo sapiens
aatgaacttccattt

SEQ ID NO: 1740344 - DNA, 22 bp, Homo sapiens
aatgaagaaagtcaaaaaatta

SEQ ID NO: 1740345 - DNA, 17 bp, Homo sapiens
aatgaagaagacaaagt

SEQ ID NO: 1740346 - DNA, 22 bp, Homo sapiens
aatgaagcagctttaaacaaat

SEQ ID NO: 1740347 - DNA, 16 bp, Homo sapiens
aatgaagcagtatttt

SEQ ID NO: 1740348 - DNA, 20 bp, Homo sapiens
aatgaaggtttttgtaaaga

SEQ ID NO: 1740349 - DNA, 15 bp, Homo sapiens
aatgaataataatta

SEQ ID NO: 1740350 - DNA, 21 bp, Homo sapiens
aatgaataataattatccaga

SEQ ID NO: 1740351 - DNA, 15 bp, Homo sapiens
aatgaataatggaaa

SEQ ID NO: 1740352 - DNA, 22 bp, Homo sapiens
aatgaatatcaggctattattt

SEQ ID NO: 1740353 - DNA, 17 bp, Homo sapiens
aatgaattaaataaacc

SEQ ID NO: 1740354 - DNA, 16 bp, Homo sapiens
aatgaattataacagt

SEQ ID NO: 1740355 - DNA, 22 bp, Homo sapiens
aatgaattataacagttatatt

SEQ ID NO: 1740356 - DNA, 12 bp, Homo sapiens
aatgaattgaaa

SEQ ID NO: 1740357 - DNA, 13 bp, Homo sapiens
aatgaattgaaaa

SEQ ID NO: 1740358 - DNA, 17 bp, Homo sapiens
aatgaatttttatgata

SEQ ID NO: 1740359 - DNA, 12 bp, Homo sapiens
aatgacaaaaga

SEQ ID NO: 1740360 - DNA, 16 bp, Homo sapiens
aatgacaaaagataca

SEQ ID NO: 1740361 - DNA, 17 bp, Homo sapiens
aatgacaaaagatacaa

SEQ ID NO: 1740362 - DNA, 19 bp, Homo sapiens
aatgacaacagaaaaacaa

SEQ ID NO: 1740363 - DNA, 20 bp, Homo sapiens
aatgacaacagaaaaacaat

SEQ ID NO: 1740364 - DNA, 21 bp, Homo sapiens
aatgacaacagaaaaacaatc

SEQ ID NO: 1740365 - DNA, 20 bp, Homo sapiens
aatgttggacacctttaggt

SEQ ID NO: 1740366 - DNA, 19 bp, Homo sapiens
aatgttgtatcatactctt

SEQ ID NO: 1740367 - DNA, 16 bp, Homo sapiens
aatgtttaaatataaa

SEQ ID NO: 1740368 - DNA, 14 bp, Homo sapiens
aatgtttaatgctg

SEQ ID NO: 1740369 - DNA, 22 bp, Homo sapiens
aatgtttatgagccagacaaat

SEQ ID NO: 1740370 - DNA, 22 bp, Homo sapiens
aatgtttatgcaaggaaggaaa

SEQ ID NO: 1740371 - DNA, 23 bp, Homo sapiens
aatgtttatgcaaggaaggaaag

SEQ ID NO: 1740372 - DNA, 16 bp, Homo sapiens
aatgtttattaaatgc

SEQ ID NO: 1740373 - DNA, 23 bp, Homo sapiens
aatgtttcttctaggttctaaaa

SEQ ID NO: 1740374 - DNA, 13 bp, Homo sapiens
aatgtttcttttc

SEQ ID NO: 1740375 - DNA, 18 bp, Homo sapiens
aatgtttcttttccctta

SEQ ID NO: 1740376 - DNA, 15 bp, Homo sapiens
aatgtttggatggtt

SEQ ID NO: 1740377 - DNA, 21 bp, Homo sapiens
aatgtttgtgatattaaattt

SEQ ID NO: 1740378 - DNA, 19 bp, Homo sapiens
aatgtttgttaaaaataaa

SEQ ID NO: 1740379 - DNA, 16 bp, Homo sapiens
aatgttttcaaaaggt

SEQ ID NO: 1740380 - DNA, 12 bp, Homo sapiens
aatgttttgtac

SEQ ID NO: 1740381 - DNA, 17 bp, Homo sapiens
aatgttttgtacaatta

SEQ ID NO: 1740382 - DNA, 11 bp, Homo sapiens
aatgtttttaa

SEQ ID NO: 1740383 - DNA, 22 bp, Homo sapiens
aatgtttttaaaaagagtaatt

SEQ ID NO: 1740384 - DNA, 17 bp, Homo sapiens
aatgtttttatttttgt

SEQ ID NO: 1740385 - DNA, 21 bp, Homo sapiens
aatgtttttctgccagggagc

SEQ ID NO: 1740386 - DNA, 15 bp, Homo sapiens
aatgttttttagaac

SEQ ID NO: 1740387 - DNA, 13 bp, Homo sapiens
aatgttttttgcc

SEQ ID NO: 1740388 - DNA, 15 bp, Homo sapiens
aatgttttttgccac

SEQ ID NO: 1740389 - DNA, 23 bp, Homo sapiens
aatgttttttgccacagcttttg

SEQ ID NO: 1740390 - DNA, 18 bp, Homo sapiens
aattaaaaaaaaattgta

SEQ ID NO: 1740391 - DNA, 16 bp, Homo sapiens
aattaaaacaaatata

SEQ ID NO: 1740392 - DNA, 16 bp, Homo sapiens
aattaaaagcaaatca

SEQ ID NO: 1740393 - DNA, 18 bp, Homo sapiens
aattaaaagcaaatcatt

SEQ ID NO: 1740394 - DNA, 14 bp, Homo sapiens
aattaaacattttt

SEQ ID NO: 1740395 - DNA, 16 bp, Homo sapiens
aattaaaccgcatgtg

SEQ ID NO: 1740396 - DNA, 20 bp, Homo sapiens
aattaaagatggtttatgca

SEQ ID NO: 1740397 - DNA, 12 bp, Homo sapiens
aattaaatgtag

SEQ ID NO: 1740398 - DNA, 16 bp, Homo sapiens
aattaacaataaagaa

SEQ ID NO: 1740399 - DNA, 15 bp, Homo sapiens
aattaacacaaagga

SEQ ID NO: 1740400 - DNA, 15 bp, Homo sapiens
aattaacttttaaat

SEQ ID NO: 1740401 - DNA, 22 bp, Homo sapiens
aattaagatacaaattaatttt

SEQ ID NO: 1740402 - DNA, 13 bp, Homo sapiens
aattaagcaaatg

SEQ ID NO: 1740403 - DNA, 15 bp, Homo sapiens
aattaagcaaatgtt

SEQ ID NO: 1740404 - DNA, 12 bp, Homo sapiens
aattaaggaagt

SEQ ID NO: 1740405 - DNA, 18 bp, Homo sapiens
aattaagttgaaaaagga

SEQ ID NO: 1740406 - DNA, 21 bp, Homo sapiens
aattaataaatcatgttttga

SEQ ID NO: 1740407 - DNA, 14 bp, Homo sapiens
aattaataatatgt

SEQ ID NO: 1740408 - DNA, 19 bp, Homo sapiens
aattaataatatgtactaa

SEQ ID NO: 1740409 - DNA, 21 bp, Homo sapiens
aattaatatggtgtatttttc

SEQ ID NO: 1740410 - DNA, 16 bp, Homo sapiens
aattaatgaaatatct

SEQ ID NO: 1740411 - DNA, 17 bp, Homo sapiens
aattaatgaaatatctg

SEQ ID NO: 1740412 - DNA, 15 bp, Homo sapiens
aattacaattttatc

SEQ ID NO: 1740413 - DNA, 15 bp, Homo sapiens
aattacatttgtaat

SEQ ID NO: 1740414 - DNA, 17 bp, Homo sapiens
aattaccattaattaca

SEQ ID NO: 1740415 - DNA, 17 bp, Homo sapiens
aattacccataaacagc

SEQ ID NO: 1740416 - DNA, 22 bp, Homo sapiens
aattacccctatacctgagcct

SEQ ID NO: 1740417 - DNA, 18 bp, Homo sapiens
aattacctggatgttctt

SEQ ID NO: 1740418 - DNA, 14 bp, Homo sapiens
aattaccttctatt

SEQ ID NO: 1740419 - DNA, 18 bp, Homo sapiens
aattacctttatgtgaac

SEQ ID NO: 1740420 - DNA, 19 bp, Homo sapiens
aattactatctgttgaaaa

SEQ ID NO: 1740421 - DNA, 21 bp, Homo sapiens
aattactgtacacattaaggt

SEQ ID NO: 1740422 - DNA, 21 bp, Homo sapiens
aattactgtgtgtgagccaga

SEQ ID NO: 1740423 - DNA, 22 bp, Homo sapiens
aattacttatcatccacattgt

SEQ ID NO: 1740424 - DNA, 13 bp, Homo sapiens
aattacttatttt

SEQ ID NO: 1740425 - DNA, 17 bp, Homo sapiens
aattacttgtgttactt

SEQ ID NO: 1740426 - DNA, 13 bp, Homo sapiens
aattactttcaga

SEQ ID NO: 1740427 - DNA, 23 bp, Homo sapiens
aattactttggggctaatttaac

SEQ ID NO: 1740428 - DNA, 20 bp, Homo sapiens
aattagaaaaaaattactaa

SEQ ID NO: 1740429 - DNA, 14 bp, Homo sapiens
aattagaagacatt

SEQ ID NO: 1740430 - DNA, 17 bp, Homo sapiens
aattagaatgaatttat

SEQ ID NO: 1740431 - DNA, 18 bp, Homo sapiens
aattagaatgaatttatc

SEQ ID NO: 1740432 - DNA, 22 bp, Homo sapiens
aattagaatgaatttatcttta

SEQ ID NO: 1740433 - DNA, 16 bp, Homo sapiens
aattagacactttgga

SEQ ID NO: 1740434 - DNA, 17 bp, Homo sapiens
aattagacactttggaa

SEQ ID NO: 1740435 - DNA, 16 bp, Homo sapiens
aattagagaagctgaa

SEQ ID NO: 1740436 - DNA, 17 bp, Homo sapiens
aattagagaagctgaaa

SEQ ID NO: 1740437 - DNA, 21 bp, Homo sapiens
aattagatttgtgcaaacatg

SEQ ID NO: 1740438 - DNA, 18 bp, Homo sapiens
aattagctatttctgctc

SEQ ID NO: 1740439 - DNA, 20 bp, Homo sapiens
aattaggaataaataaaaat

SEQ ID NO: 1740440 - DNA, 20 bp, Homo sapiens
aattaggcaaggctatgtga

SEQ ID NO: 1740441 - DNA, 18 bp, Homo sapiens
aattaggctgtaactact

SEQ ID NO: 1740442 - DNA, 22 bp, Homo sapiens
aattaggctgtaactactttat

SEQ ID NO: 1740443 - DNA, 20 bp, Homo sapiens
aattaggggttgctaagaag

SEQ ID NO: 1740444 - DNA, 15 bp, Homo sapiens
aattagtatgtctgt

SEQ ID NO: 1740445 - DNA, 23 bp, Homo sapiens
aattagtatgtctgtttttgtat

SEQ ID NO: 1740446 - DNA, 15 bp, Homo sapiens
aattagtgccactta

SEQ ID NO: 1740447 - DNA, 19 bp, Homo sapiens
aattagtggtcataaaata

SEQ ID NO: 1740448 - DNA, 20 bp, Homo sapiens
aattagtgtgacagtttcca

SEQ ID NO: 1740449 - DNA, 21 bp, Homo sapiens
aattagtgtgacagtttccaa

SEQ ID NO: 1740450 - DNA, 12 bp, Homo sapiens
aattagtttcct

SEQ ID NO: 1740451 - DNA, 14 bp, Homo sapiens
aattagtttccttt

SEQ ID NO: 1740452 - DNA, 15 bp, Homo sapiens
aattagtttcctttt

SEQ ID NO: 1740453 - DNA, 17 bp, Homo sapiens
aattataacagttatat

SEQ ID NO: 1740454 - DNA, 13 bp, Homo sapiens
aattataatgtat

SEQ ID NO: 1740455 - DNA, 15 bp, Homo sapiens
aattataattgtaat

SEQ ID NO: 1740456 - DNA, 21 bp, Homo sapiens
aattatagtgtcatgcagagt

SEQ ID NO: 1740457 - DNA, 16 bp, Homo sapiens
aattatagtttctgag

SEQ ID NO: 1740458 - DNA, 21 bp, Homo sapiens
aattatataactgtatttgaa

SEQ ID NO: 1740459 - DNA, 14 bp, Homo sapiens
aattatataatttt

SEQ ID NO: 1740460 - DNA, 12 bp, Homo sapiens
aattatatattt

SEQ ID NO: 1740461 - DNA, 18 bp, Homo sapiens
aattatatattttgttgt

SEQ ID NO: 1740462 - DNA, 21 bp, Homo sapiens
aattatattcaatgcatttaa

SEQ ID NO: 1740463 - DNA, 14 bp, Homo sapiens
aattatattgttag

SEQ ID NO: 1740464 - DNA, 20 bp, Homo sapiens
aattatcaatatctaatata

SEQ ID NO: 1740465 - DNA, 16 bp, Homo sapiens
aattatcagcaaagaa

SEQ ID NO: 1740466 - DNA, 21 bp, Homo sapiens
aattatcagcaaagaaaaaaa

SEQ ID NO: 1740467 - DNA, 15 bp, Homo sapiens
aattatcatgcgttt

SEQ ID NO: 1740468 - DNA, 18 bp, Homo sapiens
aattatcatgcgttttat

SEQ ID NO: 1740469 - DNA, 16 bp, Homo sapiens
aattatcatgggaaaa

SEQ ID NO: 1740470 - DNA, 18 bp, Homo sapiens
aattatccaggatgtgtg

SEQ ID NO: 1740471 - DNA, 21 bp, Homo sapiens
aattatcggaagcagtgcctt

SEQ ID NO: 1740472 - DNA, 23 bp, Homo sapiens
aattatcgggaacagtgtttccc

SEQ ID NO: 1740473 - DNA, 14 bp, Homo sapiens
aattatctaattta

SEQ ID NO: 1740474 - DNA, 15 bp, Homo sapiens
aattatctaatttat

SEQ ID NO: 1740475 - DNA, 12 bp, Homo sapiens
aattatgacaat

SEQ ID NO: 1740476 - DNA, 21 bp, Homo sapiens
aattatgatcctctatttcct

SEQ ID NO: 1740477 - DNA, 15 bp, Homo sapiens
aattatggcatttct

SEQ ID NO: 1740478 - DNA, 17 bp, Homo sapiens
aattatggcatttctat

SEQ ID NO: 1740479 - DNA, 21 bp, Homo sapiens
aattatggcccagggggctaa

SEQ ID NO: 1740480 - DNA, 12 bp, Homo sapiens
cccccaccccta

SEQ ID NO: 1740481 - DNA, 14 bp, Homo sapiens
cccccacccctcca

SEQ ID NO: 1740482 - DNA, 20 bp, Homo sapiens
cccccaccccttccccaggc

SEQ ID NO: 1740483 - DNA, 18 bp, Homo sapiens
cccccaccggtccagctg

SEQ ID NO: 1740484 - DNA, 21 bp, Homo sapiens
cccccaccggtccagctggcc

SEQ ID NO: 1740485 - DNA, 22 bp, Homo sapiens
cccccacctgacaatggcagct

SEQ ID NO: 1740486 - DNA, 15 bp, Homo sapiens
cccccagaccccgcc

SEQ ID NO: 1740487 - DNA, 20 bp, Homo sapiens
cccccagcaacgcccctcca

SEQ ID NO: 1740488 - DNA, 13 bp, Homo sapiens
cccccagcactga

SEQ ID NO: 1740489 - DNA, 15 bp, Homo sapiens
cccccagcccaataa

SEQ ID NO: 1740490 - DNA, 13 bp, Homo sapiens
cccccagctaaga

SEQ ID NO: 1740491 - DNA, 21 bp, Homo sapiens
cccccagctaagaacctggaa

SEQ ID NO: 1740492 - DNA, 18 bp, Homo sapiens
cccccagctaataaacca

SEQ ID NO: 1740493 - DNA, 22 bp, Homo sapiens
cccccagctcgctggctttctc

SEQ ID NO: 1740494 - DNA, 12 bp, Homo sapiens
cccccagctctg

SEQ ID NO: 1740495 - DNA, 11 bp, Homo sapiens
cccccagctgg

SEQ ID NO: 1740496 - DNA, 23 bp, Homo sapiens
cccccagctttgctaccaaagca

SEQ ID NO: 1740497 - DNA, 15 bp, Homo sapiens
cccccaggactgggc

SEQ ID NO: 1740498 - DNA, 22 bp, Homo sapiens
cccccaggcctgtccaccctgc

SEQ ID NO: 1740499 - DNA, 12 bp, Homo sapiens
cccccagggcct

SEQ ID NO: 1740500 - DNA, 16 bp, Homo sapiens
cccccagggcctccag

SEQ ID NO: 1740501 - DNA, 17 bp, Homo sapiens
cccccagggcctccagg

SEQ ID NO: 1740502 - DNA, 15 bp, Homo sapiens
cccccagtacctcca

SEQ ID NO: 1740503 - DNA, 15 bp, Homo sapiens
cccccagtccccacc

SEQ ID NO: 1740504 - DNA, 22 bp, Homo sapiens
cccccagtccccacccctgccc

SEQ ID NO: 1740505 - DNA, 13 bp, Homo sapiens
cccccagttccta

SEQ ID NO: 1740506 - DNA, 16 bp, Homo sapiens
cccccatcacccaagc

SEQ ID NO: 1740507 - DNA, 13 bp, Homo sapiens
cccccatccagcc

SEQ ID NO: 1740508 - DNA, 17 bp, Homo sapiens
cccccatctccccaggc

SEQ ID NO: 1740509 - DNA, 15 bp, Homo sapiens
cccccatgccaccac

SEQ ID NO: 1740510 - DNA, 15 bp, Homo sapiens
cccccatgcccctcc

SEQ ID NO: 1740511 - DNA, 19 bp, Homo sapiens
cccccatggggtccttgga

SEQ ID NO: 1740512 - DNA, 23 bp, Homo sapiens
cccccatggggtccttggagtga

SEQ ID NO: 1740513 - DNA, 23 bp, Homo sapiens
cccccatgttgtaatgctgcact

SEQ ID NO: 1740514 - DNA, 13 bp, Homo sapiens
cccccctcctcca

SEQ ID NO: 1740515 - DNA, 13 bp, Homo sapiens
cccccctcctgct

SEQ ID NO: 1740516 - DNA, 19 bp, Homo sapiens
cccccctgctgcccagtgc

SEQ ID NO: 1740517 - DNA, 13 bp, Homo sapiens
cccccgacactgc

SEQ ID NO: 1740518 - DNA, 16 bp, Homo sapiens
cccccgacactgctgc

SEQ ID NO: 1740519 - DNA, 17 bp, Homo sapiens
cccccgaccctgccctg

SEQ ID NO: 1740520 - DNA, 18 bp, Homo sapiens
cccccgcacagccacccg

SEQ ID NO: 1740521 - DNA, 22 bp, Homo sapiens
cccccgcagtccccagcccttc

SEQ ID NO: 1740522 - DNA, 13 bp, Homo sapiens
cccccgccacggc

SEQ ID NO: 1740523 - DNA, 15 bp, Homo sapiens
cccccgccacggcca

SEQ ID NO: 1740524 - DNA, 14 bp, Homo sapiens
cccccgccatcctt

SEQ ID NO: 1740525 - DNA, 17 bp, Homo sapiens
cccccgccatccttcac

SEQ ID NO: 1740526 - DNA, 14 bp, Homo sapiens
cccccgccccacag

SEQ ID NO: 1740527 - DNA, 21 bp, Homo sapiens
cccccggctgggcctccttct

SEQ ID NO: 1740528 - DNA, 15 bp, Homo sapiens
cccccgttccagctg

SEQ ID NO: 1740529 - DNA, 13 bp, Homo sapiens
ccccctaagagac

SEQ ID NO: 1740530 - DNA, 16 bp, Homo sapiens
ccccctccccaaagcc

SEQ ID NO: 1740531 - DNA, 13 bp, Homo sapiens
ccccctccccagg

SEQ ID NO: 1740532 - DNA, 19 bp, Homo sapiens
ccccctccccctcctgctg

SEQ ID NO: 1740533 - DNA, 11 bp, Homo sapiens
ccccctcctgc

SEQ ID NO: 1740534 - DNA, 22 bp, Homo sapiens
ccccctctgccggtcgggcagc

SEQ ID NO: 1740535 - DNA, 11 bp, Homo sapiens
ccccctgcacc

SEQ ID NO: 1740536 - DNA, 13 bp, Homo sapiens
ccccctgcaccca

SEQ ID NO: 1740537 - DNA, 12 bp, Homo sapiens
ccccctgccctc

SEQ ID NO: 1740538 - DNA, 16 bp, Homo sapiens
ccccctgccctcgtgg

SEQ ID NO: 1740539 - DNA, 19 bp, Homo sapiens
ccccctgccctcgtggcca

SEQ ID NO: 1740540 - DNA, 14 bp, Homo sapiens
ccccctgctgccat

SEQ ID NO: 1740541 - DNA, 15 bp, Homo sapiens
ccccctggccctgcc

SEQ ID NO: 1740542 - DNA, 15 bp, Homo sapiens
ccccctggcctctgt

SEQ ID NO: 1740543 - DNA, 18 bp, Homo sapiens
ccccctgtagactagtgc

SEQ ID NO: 1740544 - DNA, 12 bp, Homo sapiens
ccccctgtccca

SEQ ID NO: 1740545 - DNA, 11 bp, Homo sapiens
ccccctgtggc

SEQ ID NO: 1740546 - DNA, 17 bp, Homo sapiens
cccccttcccgccttcc

SEQ ID NO: 1740547 - DNA, 15 bp, Homo sapiens
cccccttccctggga

SEQ ID NO: 1740548 - DNA, 15 bp, Homo sapiens
cccccttctctgctc

SEQ ID NO: 1740549 - DNA, 23 bp, Homo sapiens
cccccttgaggattgtggaaaac

SEQ ID NO: 1740550 - DNA, 18 bp, Homo sapiens
ccccctttcacactggat

SEQ ID NO: 1740551 - DNA, 12 bp, Homo sapiens
ccccctttcctg

SEQ ID NO: 1740552 - DNA, 11 bp, Homo sapiens
ccccgaagagt

SEQ ID NO: 1740553 - DNA, 12 bp, Homo sapiens
ccccgacactgc

SEQ ID NO: 1740554 - DNA, 13 bp, Homo sapiens
ccccgaccctgcc

SEQ ID NO: 1740555 - DNA, 14 bp, Homo sapiens
ccccgacgccacag

SEQ ID NO: 1740556 - DNA, 12 bp, Homo sapiens
ccccgacggctg

SEQ ID NO: 1740557 - DNA, 15 bp, Homo sapiens
ccccgacggctgtga

SEQ ID NO: 1740558 - DNA, 16 bp, Homo sapiens
ccccgagaaccctgag

SEQ ID NO: 1740559 - DNA, 17 bp, Homo sapiens
ccccgagaaccctgagc

SEQ ID NO: 1740560 - DNA, 16 bp, Homo sapiens
ccccgagacaccatcc

SEQ ID NO: 1740561 - DNA, 21 bp, Homo sapiens
ccccgagacaccatcctgagc

SEQ ID NO: 1740562 - DNA, 23 bp, Homo sapiens
ccccgagacaccatcctgagcca

SEQ ID NO: 1740563 - DNA, 22 bp, Homo sapiens
ccccgaggctgccccaggccgg

SEQ ID NO: 1740564 - DNA, 13 bp, Homo sapiens
ccccgaggctgct

SEQ ID NO: 1740565 - DNA, 15 bp, Homo sapiens
ccccgatggactcct

SEQ ID NO: 1740566 - DNA, 14 bp, Homo sapiens
ccccgatgtcccct

SEQ ID NO: 1740567 - DNA, 16 bp, Homo sapiens
ccccgcaacccacagc

SEQ ID NO: 1740568 - DNA, 22 bp, Homo sapiens
ccccgcaacccacagctcagct

SEQ ID NO: 1740569 - DNA, 23 bp, Homo sapiens
ccccgcaacccacagctcagctg

SEQ ID NO: 1740570 - DNA, 14 bp, Homo sapiens
ccccgcagacacct

SEQ ID NO: 1740571 - DNA, 18 bp, Homo sapiens
ccccgcagcccgcctgcc

SEQ ID NO: 1740572 - DNA, 20 bp, Homo sapiens
ccccgcaggatccctcctga

SEQ ID NO: 1740573 - DNA, 12 bp, Homo sapiens
ccccgccacagc

SEQ ID NO: 1740574 - DNA, 14 bp, Homo sapiens
ccccgccacggcca

SEQ ID NO: 1740575 - DNA, 21 bp, Homo sapiens
ccccgccacggccaccctcct

SEQ ID NO: 1740576 - DNA, 13 bp, Homo sapiens
ccccgccagggct

SEQ ID NO: 1740577 - DNA, 13 bp, Homo sapiens
ccccgccatcctt

SEQ ID NO: 1740578 - DNA, 14 bp, Homo sapiens
ccccgcccacccac

SEQ ID NO: 1740579 - DNA, 15 bp, Homo sapiens
ccccgccccacaggg

SEQ ID NO: 1740580 - DNA, 14 bp, Homo sapiens
ccccgcccccaccc

SEQ ID NO: 1740581 - DNA, 22 bp, Homo sapiens
ccccgcccccacccctacagcc

SEQ ID NO: 1740582 - DNA, 16 bp, Homo sapiens
ccccgcccctcccacg

SEQ ID NO: 1740583 - DNA, 22 bp, Homo sapiens
ccccgcccctgggctaccatct

SEQ ID NO: 1740584 - DNA, 15 bp, Homo sapiens
ccccgcccctgtggc

SEQ ID NO: 1740585 - DNA, 18 bp, Homo sapiens
ccccgccgcgccagtccc

SEQ ID NO: 1740586 - DNA, 16 bp, Homo sapiens
ccccgcctggccagga

SEQ ID NO: 1740587 - DNA, 14 bp, Homo sapiens
ccccgcgcgcccac

SEQ ID NO: 1740588 - DNA, 18 bp, Homo sapiens
ccccgcgctcgcccagca

SEQ ID NO: 1740589 - DNA, 21 bp, Homo sapiens
ccccgcgctcgcccagcagga

SEQ ID NO: 1740590 - DNA, 17 bp, Homo sapiens
ccccgcggtgctctggc

SEQ ID NO: 1740591 - DNA, 21 bp, Homo sapiens
ccccgctagcggggccaggag

SEQ ID NO: 1740592 - DNA, 13 bp, Homo sapiens
ccccgctccgtct

SEQ ID NO: 1740593 - DNA, 15 bp, Homo sapiens
ccccgctctccctgt

SEQ ID NO: 1740594 - DNA, 13 bp, Homo sapiens
ccccgctgctgtg

SEQ ID NO: 1740595 - DNA, 17 bp, Homo sapiens
ccccgcttccccacaga

SEQ ID NO: 1740596 - DNA, 21 bp, Homo sapiens
ccccggcatgagactcagtgc

SEQ ID NO: 1740597 - DNA, 23 bp, Homo sapiens
ccccggcatgagactcagtgcag

SEQ ID NO: 1740598 - DNA, 19 bp, Homo sapiens
ccccggccacgctccctct

SEQ ID NO: 1740599 - DNA, 16 bp, Homo sapiens
ccccggccccagccag

SEQ ID NO: 1740600 - DNA, 17 bp, Homo sapiens
ccccggccccagccaga

SEQ ID NO: 1740601 - DNA, 18 bp, Homo sapiens
ccccggccccggccccag

SEQ ID NO: 1740602 - DNA, 18 bp, Homo sapiens
ccccggccctaccagcgc

SEQ ID NO: 1740603 - DNA, 23 bp, Homo sapiens
ccccggcctcagggcgctcagac

SEQ ID NO: 1740604 - DNA, 13 bp, Homo sapiens
ccccggctgggcc

SEQ ID NO: 1740605 - DNA, 17 bp, Homo sapiens
ccccgggatgcgaggct

SEQ ID NO: 1740606 - DNA, 16 bp, Homo sapiens
ccccgggctctctgct

SEQ ID NO: 1740607 - DNA, 17 bp, Homo sapiens
ccccgggctctctgctg

SEQ ID NO: 1740608 - DNA, 18 bp, Homo sapiens
ccccgggctctctgctgt

SEQ ID NO: 1740609 - DNA, 16 bp, Homo sapiens
ccccgggctctggcca

SEQ ID NO: 1740610 - DNA, 21 bp, Homo sapiens
ccccgggctctggccaccctg

SEQ ID NO: 1740611 - DNA, 18 bp, Homo sapiens
ccccgggctggagaaaga

SEQ ID NO: 1740612 - DNA, 22 bp, Homo sapiens
ccccgggctggagaaagagctg

SEQ ID NO: 1740613 - DNA, 23 bp, Homo sapiens
ccccgggcttcccttctccccag

SEQ ID NO: 1740614 - DNA, 17 bp, Homo sapiens
ccccggggaccctgtga

SEQ ID NO: 1740615 - DNA, 13 bp, Homo sapiens
ccccggggctggc

SEQ ID NO: 1740616 - DNA, 18 bp, Homo sapiens
ccccgggtccccagctcc

SEQ ID NO: 1740617 - DNA, 20 bp, Homo sapiens
ccccggtcacctagcaagct

SEQ ID NO: 1740618 - DNA, 15 bp, Homo sapiens
ccccggtcccttgag

SEQ ID NO: 1740619 - DNA, 15 bp, Homo sapiens
ccccggtggctgggc

SEQ ID NO: 1740620 - DNA, 22 bp, Homo sapiens
ccccgtctggggttcagcccct

SEQ ID NO: 1740621 - DNA, 17 bp, Homo sapiens
ccccgtgtctggatgca

SEQ ID NO: 1740622 - DNA, 20 bp, Homo sapiens
cccctaaaagaaaccctgca

SEQ ID NO: 1740623 - DNA, 19 bp, Homo sapiens
cccctaagtgcccaaagtg

SEQ ID NO: 1740624 - DNA, 18 bp, Homo sapiens
cccctacagcctgcacac

SEQ ID NO: 1740625 - DNA, 16 bp, Homo sapiens
cccctacccaaccctg

SEQ ID NO: 1740626 - DNA, 13 bp, Homo sapiens
cccctactgctgt

SEQ ID NO: 1740627 - DNA, 22 bp, Homo sapiens
cccctagagacagtgatgcctg

SEQ ID NO: 1740628 - DNA, 20 bp, Homo sapiens
cccctagctcaccaggcctg

SEQ ID NO: 1740629 - DNA, 21 bp, Homo sapiens
cccctagctcaccaggcctgg

SEQ ID NO: 1740630 - DNA, 22 bp, Homo sapiens
cccctagctcaccaggcctggc

SEQ ID NO: 1740631 - DNA, 20 bp, Homo sapiens
cccctagcttactgataaac

SEQ ID NO: 1740632 - DNA, 18 bp, Homo sapiens
cccctaggatgctgcagc

SEQ ID NO: 1740633 - DNA, 20 bp, Homo sapiens
cccctaggatgctgcagcag

SEQ ID NO: 1740634 - DNA, 17 bp, Homo sapiens
cccctaggtgcccaggg

SEQ ID NO: 1740635 - DNA, 19 bp, Homo sapiens
cccctatccacccagccca

SEQ ID NO: 1740636 - DNA, 14 bp, Homo sapiens
cccctatttattga

SEQ ID NO: 1740637 - DNA, 18 bp, Homo sapiens
cccctcaaatcgtccagc

SEQ ID NO: 1740638 - DNA, 23 bp, Homo sapiens
cccctcaaggacaaagtctccag

SEQ ID NO: 1740639 - DNA, 13 bp, Homo sapiens
cccctcaccatcc

SEQ ID NO: 1740640 - DNA, 14 bp, Homo sapiens
cccctcagcccttg

SEQ ID NO: 1740641 - DNA, 15 bp, Homo sapiens
cccctcagcccttgc

SEQ ID NO: 1740642 - DNA, 17 bp, Homo sapiens
cccctcagcccttgccc

SEQ ID NO: 1740643 - DNA, 19 bp, Homo sapiens
cccctccaaacctccagcc

SEQ ID NO: 1740644 - DNA, 14 bp, Homo sapiens
cccctccaacctgg

SEQ ID NO: 1740645 - DNA, 12 bp, Homo sapiens
cccctccacagc

SEQ ID NO: 1740646 - DNA, 18 bp, Homo sapiens
cccctccacagctgcagc

SEQ ID NO: 1740647 - DNA, 23 bp, Homo sapiens
cccctccagaccctgcctgagcc

SEQ ID NO: 1740648 - DNA, 13 bp, Homo sapiens
cccctccagcaca

SEQ ID NO: 1740649 - DNA, 15 bp, Homo sapiens
cccctccagcacaca

SEQ ID NO: 1740650 - DNA, 14 bp, Homo sapiens
cccctcccccactc

SEQ ID NO: 1740651 - DNA, 17 bp, Homo sapiens
cccctcccccactcctc

SEQ ID NO: 1740652 - DNA, 17 bp, Homo sapiens
cccctccccccagactc

SEQ ID NO: 1740653 - DNA, 18 bp, Homo sapiens
cccctccccccagactct

SEQ ID NO: 1740654 - DNA, 13 bp, Homo sapiens
cccctccccgtgt

SEQ ID NO: 1740655 - DNA, 18 bp, Homo sapiens
cccctccctgcttgcaca

SEQ ID NO: 1740656 - DNA, 12 bp, Homo sapiens
cccctccctggc

SEQ ID NO: 1740657 - DNA, 15 bp, Homo sapiens
cccctccctggctcc

SEQ ID NO: 1740658 - DNA, 22 bp, Homo sapiens
cccctccctggctcccatgacc

SEQ ID NO: 1740659 - DNA, 19 bp, Homo sapiens
cccctccctgtcccagggc

SEQ ID NO: 1740660 - DNA, 15 bp, Homo sapiens
cccctcccttcaacc

SEQ ID NO: 1740661 - DNA, 15 bp, Homo sapiens
cccctccctttctcc

SEQ ID NO: 1740662 - DNA, 17 bp, Homo sapiens
cccctccgatgctgagg

SEQ ID NO: 1740663 - DNA, 18 bp, Homo sapiens
cccctccgatgctgaggc

SEQ ID NO: 1740664 - DNA, 16 bp, Homo sapiens
cccctccgccctgcca

SEQ ID NO: 1740665 - DNA, 19 bp, Homo sapiens
cccctccgccctgccactc

SEQ ID NO: 1740666 - DNA, 17 bp, Homo sapiens
cccctccggactggtgc

SEQ ID NO: 1740667 - DNA, 12 bp, Homo sapiens
cccctcctagac

SEQ ID NO: 1740668 - DNA, 19 bp, Homo sapiens
cccctcctagtttgggagg

SEQ ID NO: 1740669 - DNA, 12 bp, Homo sapiens
cccctcctcagt

SEQ ID NO: 1740670 - DNA, 18 bp, Homo sapiens
cccctcctccactctccc

SEQ ID NO: 1740671 - DNA, 13 bp, Homo sapiens
cccctcctctgcc

SEQ ID NO: 1740672 - DNA, 14 bp, Homo sapiens
cccctcctctgcca

SEQ ID NO: 1740673 - DNA, 12 bp, Homo sapiens
cccctcctgctc

SEQ ID NO: 1740674 - DNA, 19 bp, Homo sapiens
cccctcctgctcctccctg

SEQ ID NO: 1740675 - DNA, 14 bp, Homo sapiens
cccctcctgctggg

SEQ ID NO: 1740676 - DNA, 15 bp, Homo sapiens
cccctcctgctgggc

SEQ ID NO: 1740677 - DNA, 16 bp, Homo sapiens
cccctcctgctgtgct

SEQ ID NO: 1740678 - DNA, 20 bp, Homo sapiens
cccctccttccttgaccagc

SEQ ID NO: 1740679 - DNA, 13 bp, Homo sapiens
cccctccttgggc

SEQ ID NO: 1740680 - DNA, 16 bp, Homo sapiens
cccctcgttagccttc

SEQ ID NO: 1740681 - DNA, 11 bp, Homo sapiens
cccctctcaga

SEQ ID NO: 1740682 - DNA, 13 bp, Homo sapiens
cccctctcagaac

SEQ ID NO: 1740683 - DNA, 14 bp, Homo sapiens
cccctctccttcct

SEQ ID NO: 1740684 - DNA, 15 bp, Homo sapiens
cccctctccttctta

SEQ ID NO: 1740685 - DNA, 18 bp, Homo sapiens
cccctctgacctgcactg

SEQ ID NO: 1740686 - DNA, 18 bp, Homo sapiens
cccctctgcaacccccca

SEQ ID NO: 1740687 - DNA, 13 bp, Homo sapiens
cccctctgcccag

SEQ ID NO: 1740688 - DNA, 22 bp, Homo sapiens
cccctctgccggtcccccatgc

SEQ ID NO: 1740689 - DNA, 21 bp, Homo sapiens
cccctctgccggtcgggcagc

SEQ ID NO: 1740690 - DNA, 15 bp, Homo sapiens
cccctctgctctgtc

SEQ ID NO: 1740691 - DNA, 16 bp, Homo sapiens
cccctctggccaggat

SEQ ID NO: 1740692 - DNA, 21 bp, Homo sapiens
cccctctgtcatcactccctg

SEQ ID NO: 1740693 - DNA, 12 bp, Homo sapiens
cccctctgtctt

SEQ ID NO: 1740694 - DNA, 16 bp, Homo sapiens
cccctgaaagcctcac

SEQ ID NO: 1740695 - DNA, 22 bp, Homo sapiens
cccctgacctaccccagccagg

SEQ ID NO: 1740696 - DNA, 22 bp, Homo sapiens
cccctgagagtggtgccctgga

SEQ ID NO: 1740697 - DNA, 18 bp, Homo sapiens
cccctgagcaatgtctgt

SEQ ID NO: 1740698 - DNA, 14 bp, Homo sapiens
cccctgaggactgg

SEQ ID NO: 1740699 - DNA, 15 bp, Homo sapiens
cccctgaggactgga

SEQ ID NO: 1740700 - DNA, 17 bp, Homo sapiens
cccctgaggcagcccag

SEQ ID NO: 1740701 - DNA, 21 bp, Homo sapiens
cccctgagtgggctgggccct

SEQ ID NO: 1740702 - DNA, 14 bp, Homo sapiens
cccctgatagaaga

SEQ ID NO: 1740703 - DNA, 11 bp, Homo sapiens
cccctgcacag

SEQ ID NO: 1740704 - DNA, 12 bp, Homo sapiens
cccctgcaccca

SEQ ID NO: 1740705 - DNA, 14 bp, Homo sapiens
cccctgcacccacc

SEQ ID NO: 1740706 - DNA, 22 bp, Homo sapiens
cccctgcacccacccctgccca

SEQ ID NO: 1740707 - DNA, 19 bp, Homo sapiens
cccctgcagtttggccctg

SEQ ID NO: 1740708 - DNA, 12 bp, Homo sapiens
cccctgccccag

SEQ ID NO: 1740709 - DNA, 14 bp, Homo sapiens
cccctgccccagag

SEQ ID NO: 1740710 - DNA, 23 bp, Homo sapiens
cccctgcccccaggactgggcca

SEQ ID NO: 1740711 - DNA, 13 bp, Homo sapiens
cccctgccccgtt

SEQ ID NO: 1740712 - DNA, 16 bp, Homo sapiens
cccctgcccctctgtt

SEQ ID NO: 1740713 - DNA, 13 bp, Homo sapiens
cccctgccctcgt

SEQ ID NO: 1740714 - DNA, 15 bp, Homo sapiens
cccctgccctcgtgg

SEQ ID NO: 1740715 - DNA, 21 bp, Homo sapiens
cccctgccctcgtggccagcc

SEQ ID NO: 1740716 - DNA, 13 bp, Homo sapiens
cccctgccctggg

SEQ ID NO: 1740717 - DNA, 21 bp, Homo sapiens
cccctgccggtgcacaggcct

SEQ ID NO: 1740718 - DNA, 22 bp, Homo sapiens
cccctgccggtgcacaggcctc

SEQ ID NO: 1740719 - DNA, 22 bp, Homo sapiens
cccctgcgggcgcgggcagcca

SEQ ID NO: 1740720 - DNA, 14 bp, Homo sapiens
cccctgcgtggggg

SEQ ID NO: 1740721 - DNA, 19 bp, Homo sapiens
cccctgctccaccagcagc

SEQ ID NO: 1740722 - DNA, 20 bp, Homo sapiens
cccctgctccaccagcagca

SEQ ID NO: 1740723 - DNA, 15 bp, Homo sapiens
cccctgctcccattc

SEQ ID NO: 1740724 - DNA, 21 bp, Homo sapiens
cccctgctcccattcctccct

SEQ ID NO: 1740725 - DNA, 18 bp, Homo sapiens
cccctgctgtctctctgg

SEQ ID NO: 1740726 - DNA, 23 bp, Homo sapiens
cccctggaaacccacctctctgg

SEQ ID NO: 1740727 - DNA, 17 bp, Homo sapiens
cccctggaagagcccag

SEQ ID NO: 1740728 - DNA, 19 bp, Homo sapiens
cccctggaccaccagcccc

SEQ ID NO: 1740729 - DNA, 20 bp, Homo sapiens
cccctggaccaccagcccca

SEQ ID NO: 1740730 - DNA, 21 bp, Homo sapiens
cccctggagccagcagggctg

SEQ ID NO: 1740731 - DNA, 20 bp, Homo sapiens
cccctggaggcactgaagtg

SEQ ID NO: 1740732 - DNA, 22 bp, Homo sapiens
cccctggatgtcccctgtccca

SEQ ID NO: 1740733 - DNA, 12 bp, Homo sapiens
cccctggccagc

SEQ ID NO: 1740734 - DNA, 17 bp, Homo sapiens
cccctggcccagcggcc

SEQ ID NO: 1740735 - DNA, 22 bp, Homo sapiens
cccctggcccagcggcccctcc

SEQ ID NO: 1740736 - DNA, 13 bp, Homo sapiens
cccctggcctcag

SEQ ID NO: 1740737 - DNA, 11 bp, Homo sapiens
cccctggcctt

SEQ ID NO: 1740738 - DNA, 14 bp, Homo sapiens
cccctggctctggg

SEQ ID NO: 1740739 - DNA, 17 bp, Homo sapiens
cccctggctttgcctct

SEQ ID NO: 1740740 - DNA, 12 bp, Homo sapiens
cccctgggctct

SEQ ID NO: 1740741 - DNA, 16 bp, Homo sapiens
cccctgggcttggcct

SEQ ID NO: 1740742 - DNA, 18 bp, Homo sapiens
cccctgggcttggcctgc

SEQ ID NO: 1740743 - DNA, 20 bp, Homo sapiens
cccctggggcttctcctgac

SEQ ID NO: 1740744 - DNA, 13 bp, Homo sapiens
cccctggggtggc

SEQ ID NO: 1740745 - DNA, 15 bp, Homo sapiens
cccctgtcccattct

SEQ ID NO: 1740746 - DNA, 19 bp, Homo sapiens
cccctgtcccattctagat

SEQ ID NO: 1740747 - DNA, 22 bp, Homo sapiens
cccctgtctctaaggagcagcg

SEQ ID NO: 1740748 - DNA, 11 bp, Homo sapiens
cccctgtgctc

SEQ ID NO: 1740749 - DNA, 21 bp, Homo sapiens
cccctgtgctcccctgccaca

SEQ ID NO: 1740750 - DNA, 13 bp, Homo sapiens
cccctgtggccaa

SEQ ID NO: 1740751 - DNA, 21 bp, Homo sapiens
cccctgtggggatctcagggg

SEQ ID NO: 1740752 - DNA, 19 bp, Homo sapiens
cccctgtgtattcaccacc

SEQ ID NO: 1740753 - DNA, 24 bp, Homo sapiens
cccctgtgtgagttgagtctcctc

SEQ ID NO: 1740754 - DNA, 15 bp, Homo sapiens
cccctgttcactcta

SEQ ID NO: 1740755 - DNA, 14 bp, Homo sapiens
cccctgttcatgcc

SEQ ID NO: 1740756 - DNA, 23 bp, Homo sapiens
ccccttaagggttgaaggcagtc

SEQ ID NO: 1740757 - DNA, 21 bp, Homo sapiens
ccccttaatcttgctttcttt

SEQ ID NO: 1740758 - DNA, 13 bp, Homo sapiens
ccccttccatgtg

SEQ ID NO: 1740759 - DNA, 10 bp, Homo sapiens
ccccttccca

SEQ ID NO: 1740760 - DNA, 14 bp, Homo sapiens
ccccttccccaggc

SEQ ID NO: 1740761 - DNA, 12 bp, Homo sapiens
ccccttccctgg

SEQ ID NO: 1740762 - DNA, 15 bp, Homo sapiens
ccccttccctggcag

SEQ ID NO: 1740763 - DNA, 13 bp, Homo sapiens
ccccttccctggg

SEQ ID NO: 1740764 - DNA, 16 bp, Homo sapiens
ccccttccctgggagg

SEQ ID NO: 1740765 - DNA, 13 bp, Homo sapiens
ccccttccctgtc

SEQ ID NO: 1740766 - DNA, 11 bp, Homo sapiens
ccccttcctgt

SEQ ID NO: 1740767 - DNA, 19 bp, Homo sapiens
ccccttcctgtgtccatgt

SEQ ID NO: 1740768 - DNA, 17 bp, Homo sapiens
ccccttcctgtttcaga

SEQ ID NO: 1740769 - DNA, 12 bp, Homo sapiens
ccccttctcccc

SEQ ID NO: 1740770 - DNA, 15 bp, Homo sapiens
ccccttctctcctcc

SEQ ID NO: 1740771 - DNA, 22 bp, Homo sapiens
ccccttgaagaggggaggggcc

SEQ ID NO: 1740772 - DNA, 20 bp, Homo sapiens
ccccttgcccagggctcagc

SEQ ID NO: 1740773 - DNA, 23 bp, Homo sapiens
ccccttgcccagggctcagcctg

SEQ ID NO: 1740774 - DNA, 21 bp, Homo sapiens
ccccttgccctccgcctggga

SEQ ID NO: 1740775 - DNA, 23 bp, Homo sapiens
ccccttgccctccgcctgggatc

SEQ ID NO: 1740776 - DNA, 13 bp, Homo sapiens
ccccttggagaga

SEQ ID NO: 1740777 - DNA, 13 bp, Homo sapiens
ccccttgggcatc

SEQ ID NO: 1740778 - DNA, 23 bp, Homo sapiens
ccccttgggcatccacccagtgc

SEQ ID NO: 1740779 - DNA, 15 bp, Homo sapiens
ccccttgggcggctg

SEQ ID NO: 1740780 - DNA, 19 bp, Homo sapiens
ccccttgtttctgttgttc

SEQ ID NO: 1740781 - DNA, 20 bp, Homo sapiens
cccctttaccctctttgctg

SEQ ID NO: 1740782 - DNA, 19 bp, Homo sapiens
cccctttactcagcccagc

SEQ ID NO: 1740783 - DNA, 19 bp, Homo sapiens
cccctttactcgtgcatta

SEQ ID NO: 1740784 - DNA, 14 bp, Homo sapiens
cccctttcacactg

SEQ ID NO: 1740785 - DNA, 24 bp, Homo sapiens
cccctttcagatgtcttctgcctg

SEQ ID NO: 1740786 - DNA, 23 bp, Homo sapiens
cccctttcctggacactcagacc

SEQ ID NO: 1740787 - DNA, 20 bp, Homo sapiens
cccctttgatgattaattca

SEQ ID NO: 1740788 - DNA, 15 bp, Homo sapiens
ccccttttcttttct

SEQ ID NO: 1740789 - DNA, 19 bp, Homo sapiens
ccccttttcttttctaccc

SEQ ID NO: 1740790 - DNA, 14 bp, Homo sapiens
ccccttttgcctgg

SEQ ID NO: 1740791 - DNA, 19 bp, Homo sapiens
ccccttttgcctggctgtg

SEQ ID NO: 1740792 - DNA, 20 bp, Homo sapiens
ccccttttgtgggtttctct

SEQ ID NO: 1740793 - DNA, 22 bp, Homo sapiens
ccccttttgtgggtttctctgt

SEQ ID NO: 1740794 - DNA, 20 bp, Homo sapiens
ccccttttttgtcccccaac

SEQ ID NO: 1740795 - DNA, 21 bp, Homo sapiens
cccgaagccatcacttctccc

SEQ ID NO: 1740796 - DNA, 19 bp, Homo sapiens
cccgacactgctgcaccag

SEQ ID NO: 1740797 - DNA, 18 bp, Homo sapiens
cccgaccctgccctgggc

SEQ ID NO: 1740798 - DNA, 23 bp, Homo sapiens
cccgacgccacagcccagccacg

SEQ ID NO: 1740799 - DNA, 16 bp, Homo sapiens
cccgacttcctgactc

SEQ ID NO: 1740800 - DNA, 15 bp, Homo sapiens
cccgagaaccctgag

SEQ ID NO: 1740801 - DNA, 14 bp, Homo sapiens
cccgagaagtgctc

SEQ ID NO: 1740802 - DNA, 15 bp, Homo sapiens
cccgagacaccatcc

SEQ ID NO: 1740803 - DNA, 16 bp, Homo sapiens
cccgagacaccatcct

SEQ ID NO: 1740804 - DNA, 18 bp, Homo sapiens
cccgagacaccatcctga

SEQ ID NO: 1740805 - DNA, 20 bp, Homo sapiens
cccgagatgtgacccaccag

SEQ ID NO: 1740806 - DNA, 17 bp, Homo sapiens
cccgagctcctcttcca

SEQ ID NO: 1740807 - DNA, 16 bp, Homo sapiens
cccgaggagctgggcc

SEQ ID NO: 1740808 - DNA, 15 bp, Homo sapiens
cccgaggatttctgg

SEQ ID NO: 1740809 - DNA, 13 bp, Homo sapiens
cccgaggcccgca

SEQ ID NO: 1740810 - DNA, 15 bp, Homo sapiens
cccgaggcccgcatg

SEQ ID NO: 1740811 - DNA, 19 bp, Homo sapiens
cccgaggccgcgtgcgtga

SEQ ID NO: 1740812 - DNA, 17 bp, Homo sapiens
cccgaggctgccccagg

SEQ ID NO: 1740813 - DNA, 21 bp, Homo sapiens
cccgaggctgccccaggccgg

SEQ ID NO: 1740814 - DNA, 15 bp, Homo sapiens
cccgaggctgctaga

SEQ ID NO: 1740815 - DNA, 22 bp, Homo sapiens
cccgatacctcagccctggccc

SEQ ID NO: 1740816 - DNA, 23 bp, Homo sapiens
cccgatacctcagccctggccct

SEQ ID NO: 1740817 - DNA, 20 bp, Homo sapiens
cccgatatattttagcattt

SEQ ID NO: 1740818 - DNA, 13 bp, Homo sapiens
cccgatggactcc

SEQ ID NO: 1740819 - DNA, 20 bp, Homo sapiens
cccgatggactcctgaccat

SEQ ID NO: 1740820 - DNA, 19 bp, Homo sapiens
cccgatgtcccctgcgggc

SEQ ID NO: 1740821 - DNA, 15 bp, Homo sapiens
cccgcaacccacagc

SEQ ID NO: 1740822 - DNA, 17 bp, Homo sapiens
cccgcaacccacagctc

SEQ ID NO: 1740823 - DNA, 12 bp, Homo sapiens
cccgcactctgc

SEQ ID NO: 1740824 - DNA, 16 bp, Homo sapiens
cccgcagacaccttgg

SEQ ID NO: 1740825 - DNA, 18 bp, Homo sapiens
cccgcaggaactgggctg

SEQ ID NO: 1740826 - DNA, 21 bp, Homo sapiens
cccgcaggaactgggctgggc

SEQ ID NO: 1740827 - DNA, 20 bp, Homo sapiens
cccgcaggatccctcctgag

SEQ ID NO: 1740828 - DNA, 21 bp, Homo sapiens
cccgcaggatccctcctgagc

SEQ ID NO: 1740829 - DNA, 16 bp, Homo sapiens
cccgcagggccatgca

SEQ ID NO: 1740830 - DNA, 21 bp, Homo sapiens
cccgcagggccatgcagacct

SEQ ID NO: 1740831 - DNA, 12 bp, Homo sapiens
cccgcagtgctg

SEQ ID NO: 1740832 - DNA, 18 bp, Homo sapiens
cccgcagtgctgggacca

SEQ ID NO: 1740833 - DNA, 24 bp, Homo sapiens
cccgcagtgctgggaccagagcca

SEQ ID NO: 1740834 - DNA, 17 bp, Homo sapiens
cccgccacggccaccct

SEQ ID NO: 1740835 - DNA, 19 bp, Homo sapiens
cccgccacggccaccctcc

SEQ ID NO: 1740836 - DNA, 11 bp, Homo sapiens
cccgccagggc

SEQ ID NO: 1740837 - DNA, 12 bp, Homo sapiens
cccgccagggct

SEQ ID NO: 1740838 - DNA, 15 bp, Homo sapiens
cccgccagggctggg

SEQ ID NO: 1740839 - DNA, 17 bp, Homo sapiens
cccgcccactgtcctgg

SEQ ID NO: 1740840 - DNA, 13 bp, Homo sapiens
cccgcccagctgc

SEQ ID NO: 1740841 - DNA, 17 bp, Homo sapiens
cccgcccccacccctac

SEQ ID NO: 1740842 - DNA, 18 bp, Homo sapiens
cccgcccctcccacgcct

SEQ ID NO: 1740843 - DNA, 16 bp, Homo sapiens
cccgcccctcgctgct

SEQ ID NO: 1740844 - DNA, 21 bp, Homo sapiens
cccgcccctgggctaccatct

SEQ ID NO: 1740845 - DNA, 19 bp, Homo sapiens
cccgcccctgtggccctgg

SEQ ID NO: 1740846 - DNA, 20 bp, Homo sapiens
cccgcccctgtggccctggc

SEQ ID NO: 1740847 - DNA, 21 bp, Homo sapiens
cccgcccttccatgtgccttt

SEQ ID NO: 1740848 - DNA, 16 bp, Homo sapiens
cccgccgatagaggga

SEQ ID NO: 1740849 - DNA, 16 bp, Homo sapiens
cccgccgcctcccacg

SEQ ID NO: 1740850 - DNA, 13 bp, Homo sapiens
cccgcctcagcct

SEQ ID NO: 1740851 - DNA, 19 bp, Homo sapiens
cccgcctcagcctcctgag

SEQ ID NO: 1740852 - DNA, 16 bp, Homo sapiens
cccgcctgagctcctg

SEQ ID NO: 1740853 - DNA, 23 bp, Homo sapiens
cccgcctgagctcctgctgcgga

SEQ ID NO: 1740854 - DNA, 17 bp, Homo sapiens
cccgcctgccctcatgg

SEQ ID NO: 1740855 - DNA, 14 bp, Homo sapiens
cccgcctgccgtgc

SEQ ID NO: 1740856 - DNA, 11 bp, Homo sapiens
cccgcctgcct

SEQ ID NO: 1740857 - DNA, 15 bp, Homo sapiens
cccgcctgcctcctg

SEQ ID NO: 1740858 - DNA, 13 bp, Homo sapiens
cccgcctgcctgc

SEQ ID NO: 1740859 - DNA, 14 bp, Homo sapiens
cccgcctggccagg

SEQ ID NO: 1740860 - DNA, 15 bp, Homo sapiens
cccgcctggccagga

SEQ ID NO: 1740861 - DNA, 16 bp, Homo sapiens
cccgcctggccaggag

SEQ ID NO: 1740862 - DNA, 12 bp, Homo sapiens
cccgccttccaa

SEQ ID NO: 1740863 - DNA, 16 bp, Homo sapiens
cccgccttcctcctcc

SEQ ID NO: 1740864 - DNA, 20 bp, Homo sapiens
cccgccttcctcctccacag

SEQ ID NO: 1740865 - DNA, 23 bp, Homo sapiens
cccgccttcctcctccacagtgc

SEQ ID NO: 1740866 - DNA, 19 bp, Homo sapiens
cccgcgctcgcccagcagg

SEQ ID NO: 1740867 - DNA, 22 bp, Homo sapiens
cccgcggtgctgactgaggcct

SEQ ID NO: 1740868 - DNA, 15 bp, Homo sapiens
cccgcgttcaagact

SEQ ID NO: 1740869 - DNA, 17 bp, Homo sapiens
cccgcgttcaagacttg

SEQ ID NO: 1740870 - DNA, 18 bp, Homo sapiens
cccgctcaggggcctgga

SEQ ID NO: 1740871 - DNA, 19 bp, Homo sapiens
cccgctccgtctctgtcct

SEQ ID NO: 1740872 - DNA, 18 bp, Homo sapiens
cccgctcctgccgcagac

SEQ ID NO: 1740873 - DNA, 17 bp, Homo sapiens
cccgctgacgcttccct

SEQ ID NO: 1740874 - DNA, 22 bp, Homo sapiens
cccgctgatggagccccacctt

SEQ ID NO: 1740875 - DNA, 16 bp, Homo sapiens
cccgctgctgctgctg

SEQ ID NO: 1740876 - DNA, 11 bp, Homo sapiens
cccgctgctgt

SEQ ID NO: 1740877 - DNA, 13 bp, Homo sapiens
cccgctgctgtgc

SEQ ID NO: 1740878 - DNA, 12 bp, Homo sapiens
cccgctgggctg

SEQ ID NO: 1740879 - DNA, 19 bp, Homo sapiens
cccgcttccccacagaact

SEQ ID NO: 1740880 - DNA, 15 bp, Homo sapiens
cccgcttcctggcct

SEQ ID NO: 1740881 - DNA, 14 bp, Homo sapiens
cccgcttgtccagc

SEQ ID NO: 1740882 - DNA, 18 bp, Homo sapiens
cccgcttgtccagcgcct

SEQ ID NO: 1740883 - DNA, 21 bp, Homo sapiens
cccggactcaccaacttgcca

SEQ ID NO: 1740884 - DNA, 13 bp, Homo sapiens
cccggagaaggcc

SEQ ID NO: 1740885 - DNA, 21 bp, Homo sapiens
cccggagaaggccgctgcccc

SEQ ID NO: 1740886 - DNA, 22 bp, Homo sapiens
cccggagaaggccgctgcccca

SEQ ID NO: 1740887 - DNA, 19 bp, Homo sapiens
cccggagattggacggcct

SEQ ID NO: 1740888 - DNA, 14 bp, Homo sapiens
cccggagcacagcc

SEQ ID NO: 1740889 - DNA, 15 bp, Homo sapiens
cccggagcacagccc

SEQ ID NO: 1740890 - DNA, 12 bp, Homo sapiens
cccggagcccca

SEQ ID NO: 1740891 - DNA, 14 bp, Homo sapiens
cccggagctggagg

SEQ ID NO: 1740892 - DNA, 18 bp, Homo sapiens
cccggaggggcctggcag

SEQ ID NO: 1740893 - DNA, 18 bp, Homo sapiens
cccggaggttgggtgggc

SEQ ID NO: 1740894 - DNA, 21 bp, Homo sapiens
cccggagtaatcaggcagcct

SEQ ID NO: 1740895 - DNA, 23 bp, Homo sapiens
cccggcaagcgcttctgctgaaa

SEQ ID NO: 1740896 - DNA, 21 bp, Homo sapiens
cccggcaggcctgagaatgag

SEQ ID NO: 1740897 - DNA, 14 bp, Homo sapiens
cccggccacatgcc

SEQ ID NO: 1740898 - DNA, 11 bp, Homo sapiens
cccggccagcg

SEQ ID NO: 1740899 - DNA, 14 bp, Homo sapiens
cccggccagcgggc

SEQ ID NO: 1740900 - DNA, 19 bp, Homo sapiens
cccggccagcgggcacagg

SEQ ID NO: 1740901 - DNA, 20 bp, Homo sapiens
cccggccagcgggcacaggg

SEQ ID NO: 1740902 - DNA, 23 bp, Homo sapiens
cccggccagcgggcacagggcac

SEQ ID NO: 1740903 - DNA, 15 bp, Homo sapiens
cccggccagctctgg

SEQ ID NO: 1740904 - DNA, 17 bp, Homo sapiens
cccggccagctctggag

SEQ ID NO: 1740905 - DNA, 17 bp, Homo sapiens
cccggccgcgccgccgc

SEQ ID NO: 1740906 - DNA, 11 bp, Homo sapiens
cccggcctctt

SEQ ID NO: 1740907 - DNA, 17 bp, Homo sapiens
cccggcctgctcccagc

SEQ ID NO: 1740908 - DNA, 18 bp, Homo sapiens
cccggcctgctcccagca

SEQ ID NO: 1740909 - DNA, 20 bp, Homo sapiens
cccggcctgctcccagcagc

SEQ ID NO: 1740910 - DNA, 21 bp, Homo sapiens
cccggcctgctcccagcagcc

SEQ ID NO: 1740911 - DNA, 14 bp, Homo sapiens
cccggcgccgggca

SEQ ID NO: 1740912 - DNA, 19 bp, Homo sapiens
cccggcgcggtggctcacg

SEQ ID NO: 1740913 - DNA, 22 bp, Homo sapiens
cccggcggaaagcctctgtccg

SEQ ID NO: 1740914 - DNA, 17 bp, Homo sapiens
cccggcggccctgctga

SEQ ID NO: 1740915 - DNA, 22 bp, Homo sapiens
cccggctcgagcagtcctgcct

SEQ ID NO: 1740916 - DNA, 18 bp, Homo sapiens
cccggctctacgggggcc

SEQ ID NO: 1740917 - DNA, 17 bp, Homo sapiens
cccggctgagcccccca

SEQ ID NO: 1740918 - DNA, 19 bp, Homo sapiens
cccggctgagccccccatg

SEQ ID NO: 1740919 - DNA, 12 bp, Homo sapiens
cccggctgggcc

SEQ ID NO: 1740920 - DNA, 13 bp, Homo sapiens
cccgggaaggaag

SEQ ID NO: 1740921 - DNA, 19 bp, Homo sapiens
cccgggaaggaaggctctc

SEQ ID NO: 1740922 - DNA, 17 bp, Homo sapiens
cccgggaccacagctgc

SEQ ID NO: 1740923 - DNA, 23 bp, Homo sapiens
cccgggaggtggagcttgcagtg

SEQ ID NO: 1740924 - DNA, 19 bp, Homo sapiens
cccgggataaactgagcct

SEQ ID NO: 1740925 - DNA, 19 bp, Homo sapiens
cccgggatgcgaggctcgg

SEQ ID NO: 1740926 - DNA, 21 bp, Homo sapiens
cccgggcagggctcccacaga

SEQ ID NO: 1740927 - DNA, 14 bp, Homo sapiens
cccgggcccagagg

SEQ ID NO: 1740928 - DNA, 17 bp, Homo sapiens
cccgggctctctgctgt

SEQ ID NO: 1740929 - DNA, 12 bp, Homo sapiens
cccgggctgcct

SEQ ID NO: 1740930 - DNA, 13 bp, Homo sapiens
cccgggctgcctg

SEQ ID NO: 1740931 - DNA, 12 bp, Homo sapiens
cccgggcttccc

SEQ ID NO: 1740932 - DNA, 17 bp, Homo sapiens
cccggggaccctgtgac

SEQ ID NO: 1740933 - DNA, 18 bp, Homo sapiens
cccggggaccctgtgaca

SEQ ID NO: 1740934 - DNA, 23 bp, Homo sapiens
cccggggctggcaagcagggaaa

SEQ ID NO: 1740935 - DNA, 18 bp, Homo sapiens
cccgggggagcccagtga

SEQ ID NO: 1740936 - DNA, 16 bp, Homo sapiens
cccgggtctctcactg

SEQ ID NO: 1740937 - DNA, 22 bp, Homo sapiens
cccgggtttggctgagcctggc

SEQ ID NO: 1740938 - DNA, 22 bp, Homo sapiens
cccggtcccttgagacctcagc

SEQ ID NO: 1740939 - DNA, 18 bp, Homo sapiens
cccggtgcccaagaatag

SEQ ID NO: 1740940 - DNA, 19 bp, Homo sapiens
cccggtggcggccccagca

SEQ ID NO: 1740941 - DNA, 18 bp, Homo sapiens
ccctccaggcccatctca

SEQ ID NO: 1740942 - DNA, 16 bp, Homo sapiens
ccctcccaacctcaat

SEQ ID NO: 1740943 - DNA, 21 bp, Homo sapiens
ccctcccaaggagccattctg

SEQ ID NO: 1740944 - DNA, 17 bp, Homo sapiens
ccctcccaatcctctct

SEQ ID NO: 1740945 - DNA, 21 bp, Homo sapiens
ccctcccaatcctctctcccc

SEQ ID NO: 1740946 - DNA, 13 bp, Homo sapiens
ccctcccacacac

SEQ ID NO: 1740947 - DNA, 13 bp, Homo sapiens
ccctcccaccccc

SEQ ID NO: 1740948 - DNA, 11 bp, Homo sapiens
ccctcccatgg

SEQ ID NO: 1740949 - DNA, 13 bp, Homo sapiens
ccctccccaaagc

SEQ ID NO: 1740950 - DNA, 20 bp, Homo sapiens
ccctccccaaagccactgga

SEQ ID NO: 1740951 - DNA, 22 bp, Homo sapiens
ccctccccaaagccactggaag

SEQ ID NO: 1740952 - DNA, 14 bp, Homo sapiens
ccctccccacagtg

SEQ ID NO: 1740953 - DNA, 13 bp, Homo sapiens
ccctccccagggg

SEQ ID NO: 1740954 - DNA, 18 bp, Homo sapiens
ccctccccattcacagag

SEQ ID NO: 1740955 - DNA, 18 bp, Homo sapiens
ccctccccattcagacac

SEQ ID NO: 1740956 - DNA, 16 bp, Homo sapiens
ccctcccccaaccccc

SEQ ID NO: 1740957 - DNA, 13 bp, Homo sapiens
ccctccccccaga

SEQ ID NO: 1740958 - DNA, 17 bp, Homo sapiens
ccctccccccagactct

SEQ ID NO: 1740959 - DNA, 18 bp, Homo sapiens
ccctcccccccatgcact

SEQ ID NO: 1740960 - DNA, 13 bp, Homo sapiens
ccctccccctcct

SEQ ID NO: 1740961 - DNA, 12 bp, Homo sapiens
ccctcccccttg

SEQ ID NO: 1740962 - DNA, 17 bp, Homo sapiens
ccctccccgcacccccc

SEQ ID NO: 1740963 - DNA, 15 bp, Homo sapiens
ccctccccgcccctg

SEQ ID NO: 1740964 - DNA, 16 bp, Homo sapiens
ccctccccgccctttt

SEQ ID NO: 1740965 - DNA, 14 bp, Homo sapiens
ccctccccggccct

SEQ ID NO: 1740966 - DNA, 15 bp, Homo sapiens
ccctcccctccccgt

SEQ ID NO: 1740967 - DNA, 16 bp, Homo sapiens
ccctcccctctcagaa

SEQ ID NO: 1740968 - DNA, 13 bp, Homo sapiens
ccctcccctgctc

SEQ ID NO: 1740969 - DNA, 22 bp, Homo sapiens
ccctccccttcgtgtttccccc

SEQ ID NO: 1740970 - DNA, 14 bp, Homo sapiens
ccctccctgaggca

SEQ ID NO: 1740971 - DNA, 20 bp, Homo sapiens
ccctccctgccgaacacaca

SEQ ID NO: 1740972 - DNA, 23 bp, Homo sapiens
ccctccctgcttgcacacttccc

SEQ ID NO: 1740973 - DNA, 14 bp, Homo sapiens
ccctccctggctcc

SEQ ID NO: 1740974 - DNA, 15 bp, Homo sapiens
ccctccctggctgtg

SEQ ID NO: 1740975 - DNA, 23 bp, Homo sapiens
ccctcccttggaaacctgccctg

SEQ ID NO: 1740976 - DNA, 21 bp, Homo sapiens
ccctccgaccacttccagggg

SEQ ID NO: 1740977 - DNA, 18 bp, Homo sapiens
ccctccgaccctcatggc

SEQ ID NO: 1740978 - DNA, 19 bp, Homo sapiens
ccctccgatgctgaggcca

SEQ ID NO: 1740979 - DNA, 14 bp, Homo sapiens
ccctccgccctgcc

SEQ ID NO: 1740980 - DNA, 15 bp, Homo sapiens
ccctccgccctgcca

SEQ ID NO: 1740981 - DNA, 13 bp, Homo sapiens
ccctccgccttca

SEQ ID NO: 1740982 - DNA, 15 bp, Homo sapiens
ccctcctagacccag

SEQ ID NO: 1740983 - DNA, 16 bp, Homo sapiens
ccctcctagacccagg

SEQ ID NO: 1740984 - DNA, 19 bp, Homo sapiens
ccctcctagacccaggtgg

SEQ ID NO: 1740985 - DNA, 22 bp, Homo sapiens
ccctcctagacccaggtggagg

SEQ ID NO: 1740986 - DNA, 21 bp, Homo sapiens
ccctcctcacagttgccatgt

SEQ ID NO: 1740987 - DNA, 13 bp, Homo sapiens
ccctcctcacctc

SEQ ID NO: 1740988 - DNA, 17 bp, Homo sapiens
ccctcctcacctctgga

SEQ ID NO: 1740989 - DNA, 19 bp, Homo sapiens
ccctcctccagcccctgtc

SEQ ID NO: 1740990 - DNA, 21 bp, Homo sapiens
ccctcctccagcccctgtccc

SEQ ID NO: 1740991 - DNA, 13 bp, Homo sapiens
ccctcctccaggt

SEQ ID NO: 1740992 - DNA, 14 bp, Homo sapiens
ccctcctccagtac

SEQ ID NO: 1740993 - DNA, 13 bp, Homo sapiens
ccctcctcccatc

SEQ ID NO: 1740994 - DNA, 14 bp, Homo sapiens
ccctcctcccccag

SEQ ID NO: 1740995 - DNA, 15 bp, Homo sapiens
ccctcctcgggccga

SEQ ID NO: 1740996 - DNA, 12 bp, Homo sapiens
ccctcctctgcc

SEQ ID NO: 1740997 - DNA, 13 bp, Homo sapiens
ccctcctctgcca

SEQ ID NO: 1740998 - DNA, 14 bp, Homo sapiens
ccctcctcttccct

SEQ ID NO: 1740999 - DNA, 23 bp, Homo sapiens
ccctcctcttcccttagcctctc

SEQ ID NO: 1741000 - DNA, 22 bp, Homo sapiens
ccctcctgaaccgcacagctca

SEQ ID NO: 1741001 - DNA, 23 bp, Homo sapiens
ccctcctgaaccgcacagctcag

SEQ ID NO: 1741002 - DNA, 12 bp, Homo sapiens
ccctcctgagct

SEQ ID NO: 1741003 - DNA, 16 bp, Homo sapiens
ccctcctgagctcggg

SEQ ID NO: 1741004 - DNA, 12 bp, Homo sapiens
ccctcctgcagg

SEQ ID NO: 1741005 - DNA, 13 bp, Homo sapiens
ccctcctgcaggc

SEQ ID NO: 1741006 - DNA, 14 bp, Homo sapiens
ccctcctgcaggct

SEQ ID NO: 1741007 - DNA, 14 bp, Homo sapiens
ccctcctgctcctc

SEQ ID NO: 1741008 - DNA, 15 bp, Homo sapiens
ccctcctgctcctcc

SEQ ID NO: 1741009 - DNA, 13 bp, Homo sapiens
ccctcctgctggg

SEQ ID NO: 1741010 - DNA, 13 bp, Homo sapiens
ccctcctgctgtg

SEQ ID NO: 1741011 - DNA, 15 bp, Homo sapiens
ccctcctgctgtgct

SEQ ID NO: 1741012 - DNA, 17 bp, Homo sapiens
ccctcctgctgtgctgg

SEQ ID NO: 1741013 - DNA, 19 bp, Homo sapiens
ccctcctggagctctgtgg

SEQ ID NO: 1741014 - DNA, 23 bp, Homo sapiens
ccctcctggcgagttctctttgg

SEQ ID NO: 1741015 - DNA, 13 bp, Homo sapiens
ccctcctggctct

SEQ ID NO: 1741016 - DNA, 16 bp, Homo sapiens
ccctcctggctgtgac

SEQ ID NO: 1741017 - DNA, 12 bp, Homo sapiens
ccctccttcaga

SEQ ID NO: 1741018 - DNA, 11 bp, Homo sapiens
ccctccttcca

SEQ ID NO: 1741019 - DNA, 12 bp, Homo sapiens
ccctccttctcc

SEQ ID NO: 1741020 - DNA, 21 bp, Homo sapiens
ccctccttctcccctgccggt

SEQ ID NO: 1741021 - DNA, 14 bp, Homo sapiens
ccctccttgggcac

SEQ ID NO: 1741022 - DNA, 20 bp, Homo sapiens
ccctcgaaccaaggcagcct

SEQ ID NO: 1741023 - DNA, 24 bp, Homo sapiens
ccctcgaaccaaggcagcctccag

SEQ ID NO: 1741024 - DNA, 16 bp, Homo sapiens
ccctcgaccctgtgca

SEQ ID NO: 1741025 - DNA, 17 bp, Homo sapiens
ccctcgatcatatttcc

SEQ ID NO: 1741026 - DNA, 16 bp, Homo sapiens
ccctcgccacctttca

SEQ ID NO: 1741027 - DNA, 22 bp, Homo sapiens
ccctcggaagccgtctgactcc

SEQ ID NO: 1741028 - DNA, 13 bp, Homo sapiens
ccctcggagaaga

SEQ ID NO: 1741029 - DNA, 22 bp, Homo sapiens
ccctcggcctccgaggctcccc

SEQ ID NO: 1741030 - DNA, 17 bp, Homo sapiens
ccctcgggaagcagcca

SEQ ID NO: 1741031 - DNA, 14 bp, Homo sapiens
ccctcgggcccacc

SEQ ID NO: 1741032 - DNA, 19 bp, Homo sapiens
ccctcgggcccacctggcc

SEQ ID NO: 1741033 - DNA, 16 bp, Homo sapiens
ccctcgggggcctgtg

SEQ ID NO: 1741034 - DNA, 13 bp, Homo sapiens
ccctcgtccacag

SEQ ID NO: 1741035 - DNA, 19 bp, Homo sapiens
ccctcgtccacaggggcag

SEQ ID NO: 1741036 - DNA, 19 bp, Homo sapiens
ccctcgtccgtctgtctcg

SEQ ID NO: 1741037 - DNA, 16 bp, Homo sapiens
ccctcgtggccttccc

SEQ ID NO: 1741038 - DNA, 14 bp, Homo sapiens
ccctcgttagcctt

SEQ ID NO: 1741039 - DNA, 15 bp, Homo sapiens
ccctctaacccagtg

SEQ ID NO: 1741040 - DNA, 21 bp, Homo sapiens
ccctctaagcacattccaaac

SEQ ID NO: 1741041 - DNA, 19 bp, Homo sapiens
ccctctagaaatttttcag

SEQ ID NO: 1741042 - DNA, 17 bp, Homo sapiens
ccctctagtgccttctt

SEQ ID NO: 1741043 - DNA, 18 bp, Homo sapiens
ccctctatttattagcca

SEQ ID NO: 1741044 - DNA, 16 bp, Homo sapiens
ccctctcactccccag

SEQ ID NO: 1741045 - DNA, 19 bp, Homo sapiens
ccctctcagaggcctgctg

SEQ ID NO: 1741046 - DNA, 20 bp, Homo sapiens
ccctctcagaggcctgctgc

SEQ ID NO: 1741047 - DNA, 17 bp, Homo sapiens
ccctctcagctccaggt

SEQ ID NO: 1741048 - DNA, 13 bp, Homo sapiens
ccctctcccagga

SEQ ID NO: 1741049 - DNA, 10 bp, Homo sapiens
ccctctccct

SEQ ID NO: 1741050 - DNA, 15 bp, Homo sapiens
ccctctcctgcttcc

SEQ ID NO: 1741051 - DNA, 15 bp, Homo sapiens
ccctctccttcctta

SEQ ID NO: 1741052 - DNA, 18 bp, Homo sapiens
ccctctctcataccctcc

SEQ ID NO: 1741053 - DNA, 10 bp, Homo sapiens
ccctctctct

SEQ ID NO: 1741054 - DNA, 13 bp, Homo sapiens
ccctctctcttct

SEQ ID NO: 1741055 - DNA, 23 bp, Homo sapiens
ccctctctcttctgctccaccct

SEQ ID NO: 1741056 - DNA, 10 bp, Homo sapiens
ccctctctgc

SEQ ID NO: 1741057 - DNA, 17 bp, Homo sapiens
gtcctggctcctgaggg

SEQ ID NO: 1741058 - DNA, 14 bp, Homo sapiens
gtcctggctgcact

SEQ ID NO: 1741059 - DNA, 14 bp, Homo sapiens
gtcctgggcaggtg

SEQ ID NO: 1741060 - DNA, 22 bp, Homo sapiens
gtcctgggcatgggtccagggc

SEQ ID NO: 1741061 - DNA, 16 bp, Homo sapiens
gtcctgggcctgcccc

SEQ ID NO: 1741062 - DNA, 14 bp, Homo sapiens
gtcctggggcctcg

SEQ ID NO: 1741063 - DNA, 16 bp, Homo sapiens
gtcctggggctctgtg

SEQ ID NO: 1741064 - DNA, 21 bp, Homo sapiens
gtcctggtaattcctctccag

SEQ ID NO: 1741065 - DNA, 22 bp, Homo sapiens
gtcctggtaattcctctccagg

SEQ ID NO: 1741066 - DNA, 24 bp, Homo sapiens
gtcctggtaattcctctccaggcc

SEQ ID NO: 1741067 - DNA, 11 bp, Homo sapiens
gtcctggtgct

SEQ ID NO: 1741068 - DNA, 16 bp, Homo sapiens
gtcctggtgctctctg

SEQ ID NO: 1741069 - DNA, 18 bp, Homo sapiens
gtcctggtgctctctgcc

SEQ ID NO: 1741070 - DNA, 18 bp, Homo sapiens
gtcctggtggctgggccc

SEQ ID NO: 1741071 - DNA, 19 bp, Homo sapiens
gtcctggtggggctgagcc

SEQ ID NO: 1741072 - DNA, 21 bp, Homo sapiens
gtcctggtggggctgagcctg

SEQ ID NO: 1741073 - DNA, 20 bp, Homo sapiens
gtcctggtgggtcagcccag

SEQ ID NO: 1741074 - DNA, 22 bp, Homo sapiens
gtcctggtgggtcagcccagca

SEQ ID NO: 1741075 - DNA, 22 bp, Homo sapiens
gtcctggtttcctggcagcctg

SEQ ID NO: 1741076 - DNA, 13 bp, Homo sapiens
gtcctgtcccaga

SEQ ID NO: 1741077 - DNA, 16 bp, Homo sapiens
gtcctgtcctggtcct

SEQ ID NO: 1741078 - DNA, 17 bp, Homo sapiens
gtcctgtcctttcttgc

SEQ ID NO: 1741079 - DNA, 15 bp, Homo sapiens
gtcctgtctctgcct

SEQ ID NO: 1741080 - DNA, 16 bp, Homo sapiens
gtcctgtctctgcctg

SEQ ID NO: 1741081 - DNA, 19 bp, Homo sapiens
gtcctgtgaatgccactgc

SEQ ID NO: 1741082 - DNA, 23 bp, Homo sapiens
gtcctgtgacaacactcatcaca

SEQ ID NO: 1741083 - DNA, 14 bp, Homo sapiens
gtcctgttcttcct

SEQ ID NO: 1741084 - DNA, 22 bp, Homo sapiens
gtccttaaaaatcacactgtaa

SEQ ID NO: 1741085 - DNA, 23 bp, Homo sapiens
gtccttaacccacctctcctgcc

SEQ ID NO: 1741086 - DNA, 23 bp, Homo sapiens
gtccttattcttgtggttaaaaa

SEQ ID NO: 1741087 - DNA, 18 bp, Homo sapiens
gtccttcactggcgcctt

SEQ ID NO: 1741088 - DNA, 20 bp, Homo sapiens
gtccttcactggcgccttct

SEQ ID NO: 1741089 - DNA, 21 bp, Homo sapiens
gtccttcactggcgccttctc

SEQ ID NO: 1741090 - DNA, 20 bp, Homo sapiens
gtccttcagtcttctagaaa

SEQ ID NO: 1741091 - DNA, 21 bp, Homo sapiens
gtccttcattccgttaggaat

SEQ ID NO: 1741092 - DNA, 22 bp, Homo sapiens
gtccttccaggcccccaccact

SEQ ID NO: 1741093 - DNA, 17 bp, Homo sapiens
gtccttccctgccactt

SEQ ID NO: 1741094 - DNA, 21 bp, Homo sapiens
gtccttctagcttttctcttt

SEQ ID NO: 1741095 - DNA, 11 bp, Homo sapiens
gtccttgaaaa

SEQ ID NO: 1741096 - DNA, 16 bp, Homo sapiens
gtccttgaaaaacaaa

SEQ ID NO: 1741097 - DNA, 14 bp, Homo sapiens
gtccttgaaaatat

SEQ ID NO: 1741098 - DNA, 19 bp, Homo sapiens
gtccttgagtgctcttgct

SEQ ID NO: 1741099 - DNA, 18 bp, Homo sapiens
gtccttgatgccagaggg

SEQ ID NO: 1741100 - DNA, 16 bp, Homo sapiens
gtccttgatttcaaag

SEQ ID NO: 1741101 - DNA, 15 bp, Homo sapiens
gtccttgcacctgca

SEQ ID NO: 1741102 - DNA, 12 bp, Homo sapiens
gtcctttagaaa

SEQ ID NO: 1741103 - DNA, 16 bp, Homo sapiens
gtcctttatgtggaaa

SEQ ID NO: 1741104 - DNA, 21 bp, Homo sapiens
gtcctttatgtggaaaacaga

SEQ ID NO: 1741105 - DNA, 18 bp, Homo sapiens
gtcctttccaaggcttct

SEQ ID NO: 1741106 - DNA, 15 bp, Homo sapiens
gtcctttctggaagt

SEQ ID NO: 1741107 - DNA, 21 bp, Homo sapiens
gtcctttggggcatagatcag

SEQ ID NO: 1741108 - DNA, 22 bp, Homo sapiens
gtccttttcagaagtgagcttt

SEQ ID NO: 1741109 - DNA, 20 bp, Homo sapiens
gtccttttgacactgctcta

SEQ ID NO: 1741110 - DNA, 22 bp, Homo sapiens
gtccttttgtaccatggtgtga

SEQ ID NO: 1741111 - DNA, 16 bp, Homo sapiens
gtcgaaagctctagaa

SEQ ID NO: 1741112 - DNA, 14 bp, Homo sapiens
gtcgagagctggcc

SEQ ID NO: 1741113 - DNA, 16 bp, Homo sapiens
gtcgagagctggccaa

SEQ ID NO: 1741114 - DNA, 13 bp, Homo sapiens
gtcgagatctcag

SEQ ID NO: 1741115 - DNA, 22 bp, Homo sapiens
gtcgaggccacattgctggctg

SEQ ID NO: 1741116 - DNA, 17 bp, Homo sapiens
gtcgcacccacagcgaa

SEQ ID NO: 1741117 - DNA, 14 bp, Homo sapiens
gtcgcagctaccct

SEQ ID NO: 1741118 - DNA, 18 bp, Homo sapiens
gtcgcagctaccctcagc

SEQ ID NO: 1741119 - DNA, 23 bp, Homo sapiens
gtcgcagctaccctcagcctcca

SEQ ID NO: 1741120 - DNA, 17 bp, Homo sapiens
gtcgccagtcactgctg

SEQ ID NO: 1741121 - DNA, 20 bp, Homo sapiens
gtcgcccaggctggagtgca

SEQ ID NO: 1741122 - DNA, 13 bp, Homo sapiens
gtcgctgcctcca

SEQ ID NO: 1741123 - DNA, 15 bp, Homo sapiens
gtcggagctgcctgc

SEQ ID NO: 1741124 - DNA, 21 bp, Homo sapiens
gtcggagctgcctgcagcaca

SEQ ID NO: 1741125 - DNA, 16 bp, Homo sapiens
gtcggagtgcctggag

SEQ ID NO: 1741126 - DNA, 14 bp, Homo sapiens
gtcggccccatctc

SEQ ID NO: 1741127 - DNA, 14 bp, Homo sapiens
gtcggccgaccagg

SEQ ID NO: 1741128 - DNA, 15 bp, Homo sapiens
gtcggccgaccaggc

SEQ ID NO: 1741129 - DNA, 18 bp, Homo sapiens
gtcggccgaccaggctgg

SEQ ID NO: 1741130 - DNA, 14 bp, Homo sapiens
gtcggctgaccatg

SEQ ID NO: 1741131 - DNA, 18 bp, Homo sapiens
gtcgggcaccagccagcg

SEQ ID NO: 1741132 - DNA, 13 bp, Homo sapiens
gtcgggcagccag

SEQ ID NO: 1741133 - DNA, 14 bp, Homo sapiens
gtcgggcagccagc

SEQ ID NO: 1741134 - DNA, 20 bp, Homo sapiens
gtcggggatcggggcaagag

SEQ ID NO: 1741135 - DNA, 12 bp, Homo sapiens
gtcggggtgggg

SEQ ID NO: 1741136 - DNA, 20 bp, Homo sapiens
gtcgtagccaaggtgggctg

SEQ ID NO: 1741137 - DNA, 19 bp, Homo sapiens
gtcgtcttgaacgagcagc

SEQ ID NO: 1741138 - DNA, 23 bp, Homo sapiens
gtcgtcttgaacgagcagcccag

SEQ ID NO: 1741139 - DNA, 17 bp, Homo sapiens
gtcgtgatgtggaggaa

SEQ ID NO: 1741140 - DNA, 14 bp, Homo sapiens
gtcgtgcctgtgtc

SEQ ID NO: 1741141 - DNA, 17 bp, Homo sapiens
gtcgtgcctgtgtccat

SEQ ID NO: 1741142 - DNA, 19 bp, Homo sapiens
gtcgtggggtgtgctggga

SEQ ID NO: 1741143 - DNA, 21 bp, Homo sapiens
gtcgtggggtgtgctgggagc

SEQ ID NO: 1741144 - DNA, 14 bp, Homo sapiens
gtcgtgggtgtgtg

SEQ ID NO: 1741145 - DNA, 15 bp, Homo sapiens
gtcgttcccagtgtg

SEQ ID NO: 1741146 - DNA, 21 bp, Homo sapiens
gtctaaaaataaaatgcattt

SEQ ID NO: 1741147 - DNA, 22 bp, Homo sapiens
gtctaaaaataaaatgcattta

SEQ ID NO: 1741148 - DNA, 21 bp, Homo sapiens
gtctaaacaatgctgatttgg

SEQ ID NO: 1741149 - DNA, 14 bp, Homo sapiens
gtctaacttttgtg

SEQ ID NO: 1741150 - DNA, 23 bp, Homo sapiens
gtctaagactatatatataaatg

SEQ ID NO: 1741151 - DNA, 13 bp, Homo sapiens
gtctaagattcta

SEQ ID NO: 1741152 - DNA, 18 bp, Homo sapiens
gtctaagattctagatca

SEQ ID NO: 1741153 - DNA, 20 bp, Homo sapiens
gtctaagcagttttgtaaat

SEQ ID NO: 1741154 - DNA, 14 bp, Homo sapiens
gtctaaggaagaat

SEQ ID NO: 1741155 - DNA, 17 bp, Homo sapiens
gtctaatgaagagaaaa

SEQ ID NO: 1741156 - DNA, 22 bp, Homo sapiens
gtctaattgcatctcaaaatta

SEQ ID NO: 1741157 - DNA, 14 bp, Homo sapiens
gtctacatgtgcca

SEQ ID NO: 1741158 - DNA, 14 bp, Homo sapiens
gtctacctggcaga

SEQ ID NO: 1741159 - DNA, 18 bp, Homo sapiens
gtctactcctagaagaac

SEQ ID NO: 1741160 - DNA, 14 bp, Homo sapiens
gtctactctagaag

SEQ ID NO: 1741161 - DNA, 12 bp, Homo sapiens
gtctactgcaag

SEQ ID NO: 1741162 - DNA, 18 bp, Homo sapiens
gtctactgcaagagccaa

SEQ ID NO: 1741163 - DNA, 14 bp, Homo sapiens
gtctactgtggtga

SEQ ID NO: 1741164 - DNA, 22 bp, Homo sapiens
gtctactgtggtgatctgtaga

SEQ ID NO: 1741165 - DNA, 16 bp, Homo sapiens
gtctagaatgtggatt

SEQ ID NO: 1741166 - DNA, 22 bp, Homo sapiens
gtctagatgtttattcttctag

SEQ ID NO: 1741167 - DNA, 11 bp, Homo sapiens
gtctagattca

SEQ ID NO: 1741168 - DNA, 15 bp, Homo sapiens
gtctagattcaaagg

SEQ ID NO: 1741169 - DNA, 20 bp, Homo sapiens
gtctagattcaaaggttcta

SEQ ID NO: 1741170 - DNA, 19 bp, Homo sapiens
gtctagcagagcaggggca

SEQ ID NO: 1741171 - DNA, 23 bp, Homo sapiens
gtctcttcttggggcccagtgca

SEQ ID NO: 1741172 - DNA, 16 bp, Homo sapiens
gtctcttgagcatcaa

SEQ ID NO: 1741173 - DNA, 24 bp, Homo sapiens
gtctcttgagcatcaatcttgtta

SEQ ID NO: 1741174 - DNA, 17 bp, Homo sapiens
gtctctttaatcttcag

SEQ ID NO: 1741175 - DNA, 18 bp, Homo sapiens
gtctctttaatcttcagt

SEQ ID NO: 1741176 - DNA, 20 bp, Homo sapiens
gtctctttttttggcccagg

SEQ ID NO: 1741177 - DNA, 15 bp, Homo sapiens
gtctgaaacagagaa

SEQ ID NO: 1741178 - DNA, 15 bp, Homo sapiens
gtctgaacccttgtg

SEQ ID NO: 1741179 - DNA, 18 bp, Homo sapiens
gtctgaacccttgtgctt

SEQ ID NO: 1741180 - DNA, 19 bp, Homo sapiens
gtctgaaggaatagccaga

SEQ ID NO: 1741181 - DNA, 20 bp, Homo sapiens
gtctgaaggaatagccagag

SEQ ID NO: 1741182 - DNA, 22 bp, Homo sapiens
gtctgaaggactggattggcca

SEQ ID NO: 1741183 - DNA, 19 bp, Homo sapiens
gtctgaagtcactgcacag

SEQ ID NO: 1741184 - DNA, 18 bp, Homo sapiens
gtctgaatattctagaac

SEQ ID NO: 1741185 - DNA, 15 bp, Homo sapiens
gtctgaccagagaat

SEQ ID NO: 1741186 - DNA, 13 bp, Homo sapiens
gtctgacctggtg

SEQ ID NO: 1741187 - DNA, 19 bp, Homo sapiens
gtctgacctggtgggagca

SEQ ID NO: 1741188 - DNA, 17 bp, Homo sapiens
gtctgactccagagtct

SEQ ID NO: 1741189 - DNA, 23 bp, Homo sapiens
gtctgactccagagtctgagccc

SEQ ID NO: 1741190 - DNA, 12 bp, Homo sapiens
gtctgagccccc

SEQ ID NO: 1741191 - DNA, 16 bp, Homo sapiens
gtctgagcccccggct

SEQ ID NO: 1741192 - DNA, 12 bp, Homo sapiens
gtctgagccctg

SEQ ID NO: 1741193 - DNA, 18 bp, Homo sapiens
gtctgagcggcgcagagc

SEQ ID NO: 1741194 - DNA, 19 bp, Homo sapiens
gtctgagcggcgcagagcc

SEQ ID NO: 1741195 - DNA, 12 bp, Homo sapiens
gtctgagctggg

SEQ ID NO: 1741196 - DNA, 14 bp, Homo sapiens
gtctgaggcctcat

SEQ ID NO: 1741197 - DNA, 18 bp, Homo sapiens
gtctgagtcctgtctctg

SEQ ID NO: 1741198 - DNA, 23 bp, Homo sapiens
gtctgagtcctgtctctgcctgc

SEQ ID NO: 1741199 - DNA, 19 bp, Homo sapiens
gtctgagttcttgtgtcct

SEQ ID NO: 1741200 - DNA, 13 bp, Homo sapiens
gtctgatccatat

SEQ ID NO: 1741201 - DNA, 13 bp, Homo sapiens
gtctgattctatg

SEQ ID NO: 1741202 - DNA, 13 bp, Homo sapiens
gtctgattggctg

SEQ ID NO: 1741203 - DNA, 18 bp, Homo sapiens
gtctgattggctgcttaa

SEQ ID NO: 1741204 - DNA, 16 bp, Homo sapiens
gtctgattttctcact

SEQ ID NO: 1741205 - DNA, 18 bp, Homo sapiens
gtctgcaagggcccagag

SEQ ID NO: 1741206 - DNA, 21 bp, Homo sapiens
gtctgcaagggcccagagtga

SEQ ID NO: 1741207 - DNA, 21 bp, Homo sapiens
gtctgcagctcaagggctggc

SEQ ID NO: 1741208 - DNA, 23 bp, Homo sapiens
gtctgcagctcaagggctggcac

SEQ ID NO: 1741209 - DNA, 17 bp, Homo sapiens
gtctgcagtcctggtgg

SEQ ID NO: 1741210 - DNA, 14 bp, Homo sapiens
gtctgccagccagc

SEQ ID NO: 1741211 - DNA, 16 bp, Homo sapiens
gtctgccagccagcag

SEQ ID NO: 1741212 - DNA, 18 bp, Homo sapiens
gtctgccagccagcagcc

SEQ ID NO: 1741213 - DNA, 14 bp, Homo sapiens
gtctgccaggccca

SEQ ID NO: 1741214 - DNA, 22 bp, Homo sapiens
gtctgccaggcccatctcaggt

SEQ ID NO: 1741215 - DNA, 17 bp, Homo sapiens
gtctgcctaggagctgg

SEQ ID NO: 1741216 - DNA, 14 bp, Homo sapiens
gtctgcctgtattt

SEQ ID NO: 1741217 - DNA, 18 bp, Homo sapiens
gtctgccttcacaaatgt

SEQ ID NO: 1741218 - DNA, 22 bp, Homo sapiens
gtctgcgcctgaaaagggcgga

SEQ ID NO: 1741219 - DNA, 15 bp, Homo sapiens
gtctgctaggcgctg

SEQ ID NO: 1741220 - DNA, 16 bp, Homo sapiens
gtctgctccccaggaa

SEQ ID NO: 1741221 - DNA, 22 bp, Homo sapiens
gtctgctctttctctgccagtg

SEQ ID NO: 1741222 - DNA, 17 bp, Homo sapiens
gtctgctgaataataaa

SEQ ID NO: 1741223 - DNA, 19 bp, Homo sapiens
gtctgctgaataataaact

SEQ ID NO: 1741224 - DNA, 18 bp, Homo sapiens
gtctgctgagttggcctg

SEQ ID NO: 1741225 - DNA, 19 bp, Homo sapiens
gtctgcttaaagcttccct

SEQ ID NO: 1741226 - DNA, 20 bp, Homo sapiens
gtctgcttctctctctctca

SEQ ID NO: 1741227 - DNA, 21 bp, Homo sapiens
gtctgcttctctctctctcac

SEQ ID NO: 1741228 - DNA, 17 bp, Homo sapiens
gtctggaaaacagaaac

SEQ ID NO: 1741229 - DNA, 17 bp, Homo sapiens
gtctggagaagcagtga

SEQ ID NO: 1741230 - DNA, 19 bp, Homo sapiens
gtctggagtcccctcctcc

SEQ ID NO: 1741231 - DNA, 15 bp, Homo sapiens
gtctggcccaccagg

SEQ ID NO: 1741232 - DNA, 21 bp, Homo sapiens
gtctggctcggacccacccca

SEQ ID NO: 1741233 - DNA, 17 bp, Homo sapiens
gtctggctgagcccctg

SEQ ID NO: 1741234 - DNA, 17 bp, Homo sapiens
gtctgggattaagggca

SEQ ID NO: 1741235 - DNA, 22 bp, Homo sapiens
gtctggggaagaggatgagcag

SEQ ID NO: 1741236 - DNA, 19 bp, Homo sapiens
gtctggggtgagggagtta

SEQ ID NO: 1741237 - DNA, 16 bp, Homo sapiens
gtctggggttcagccc

SEQ ID NO: 1741238 - DNA, 17 bp, Homo sapiens
gtctggggttcagcccc

SEQ ID NO: 1741239 - DNA, 15 bp, Homo sapiens
gtctggtgggtggag

SEQ ID NO: 1741240 - DNA, 13 bp, Homo sapiens
gtctggtttctag

SEQ ID NO: 1741241 - DNA, 15 bp, Homo sapiens
gtctgtaaaaaatgg

SEQ ID NO: 1741242 - DNA, 19 bp, Homo sapiens
gtctgtaaaaaatggagct

SEQ ID NO: 1741243 - DNA, 20 bp, Homo sapiens
gtctgtaaaaaatggagctc

SEQ ID NO: 1741244 - DNA, 22 bp, Homo sapiens
gtctgtaactttccactcttcc

SEQ ID NO: 1741245 - DNA, 14 bp, Homo sapiens
gtctgtaatacact

SEQ ID NO: 1741246 - DNA, 16 bp, Homo sapiens
gtctgtcaaatgtttc

SEQ ID NO: 1741247 - DNA, 21 bp, Homo sapiens
gtctgtcaaatgtttccttaa

SEQ ID NO: 1741248 - DNA, 15 bp, Homo sapiens
gtctgtcccaccagc

SEQ ID NO: 1741249 - DNA, 22 bp, Homo sapiens
gtctgtccctgaactcccagaa

SEQ ID NO: 1741250 - DNA, 21 bp, Homo sapiens
gtctgtcccttttctttgacc

SEQ ID NO: 1741251 - DNA, 23 bp, Homo sapiens
gtctgtctccctcccctctcaga

SEQ ID NO: 1741252 - DNA, 15 bp, Homo sapiens
gtctgtctttgtggg

SEQ ID NO: 1741253 - DNA, 14 bp, Homo sapiens
gtctgtgaagagcc

SEQ ID NO: 1741254 - DNA, 13 bp, Homo sapiens
gtctgtgactgga

SEQ ID NO: 1741255 - DNA, 12 bp, Homo sapiens
gtctgtgctctt

SEQ ID NO: 1741256 - DNA, 12 bp, Homo sapiens
gtctgtgctgag

SEQ ID NO: 1741257 - DNA, 17 bp, Homo sapiens
gtctgtgctgtgcctgc

SEQ ID NO: 1741258 - DNA, 22 bp, Homo sapiens
gtctgtgtaacatccaagccag

SEQ ID NO: 1741259 - DNA, 23 bp, Homo sapiens
gtctgtgtaacatccaagccaga

SEQ ID NO: 1741260 - DNA, 15 bp, Homo sapiens
gtctgtgtatgtata

SEQ ID NO: 1741261 - DNA, 15 bp, Homo sapiens
gtctgtgtcatttct

SEQ ID NO: 1741262 - DNA, 15 bp, Homo sapiens
gtctgtgtcccagcc

SEQ ID NO: 1741263 - DNA, 15 bp, Homo sapiens
gtctgtgtggtggga

SEQ ID NO: 1741264 - DNA, 22 bp, Homo sapiens
gtctgtgttgcgtgtcgtgggt

SEQ ID NO: 1741265 - DNA, 17 bp, Homo sapiens
gtctgtgttttgaaaga

SEQ ID NO: 1741266 - DNA, 16 bp, Homo sapiens
gtctgttatgctgtga

SEQ ID NO: 1741267 - DNA, 21 bp, Homo sapiens
gtctgttccccatggccactt

SEQ ID NO: 1741268 - DNA, 14 bp, Homo sapiens
gtctgttggcaggc

SEQ ID NO: 1741269 - DNA, 19 bp, Homo sapiens
gtctgttggcaggctggcc

SEQ ID NO: 1741270 - DNA, 18 bp, Homo sapiens
gtctgttgtgtgtcatgc

SEQ ID NO: 1741271 - DNA, 20 bp, Homo sapiens
gtctgtttcaatgacctgta

SEQ ID NO: 1741272 - DNA, 21 bp, Homo sapiens
gtctgtttgctcaaaattgct

SEQ ID NO: 1741273 - DNA, 17 bp, Homo sapiens
gtctgtttgtttcaaga

SEQ ID NO: 1741274 - DNA, 23 bp, Homo sapiens
gtctgtttgtttcaagaacctgg

SEQ ID NO: 1741275 - DNA, 14 bp, Homo sapiens
gtctgtttttgtat

SEQ ID NO: 1741276 - DNA, 16 bp, Homo sapiens
gtctgtttttgtatct

SEQ ID NO: 1741277 - DNA, 14 bp, Homo sapiens
gtcttaaaagatat

SEQ ID NO: 1741278 - DNA, 17 bp, Homo sapiens
gtcttaaatgctcattt

SEQ ID NO: 1741279 - DNA, 18 bp, Homo sapiens
gtcttaaatgctcatttt

SEQ ID NO: 1741280 - DNA, 23 bp, Homo sapiens
gtcttaaatgctcattttctggt

SEQ ID NO: 1741281 - DNA, 18 bp, Homo sapiens
gtcttaacgaataaaggt

SEQ ID NO: 1741282 - DNA, 16 bp, Homo sapiens
gtcttaagtgtttctc

SEQ ID NO: 1741283 - DNA, 21 bp, Homo sapiens
gtcttaattaaaagaatattt

SEQ ID NO: 1741284 - DNA, 22 bp, Homo sapiens
gtcttaattaaaagaatatttt

SEQ ID NO: 1741285 - DNA, 15 bp, Homo sapiens
gtgagccaccgctgc

SEQ ID NO: 1741286 - DNA, 20 bp, Homo sapiens
gtgagccaccgctgccagca

SEQ ID NO: 1741287 - DNA, 24 bp, Homo sapiens
gtgagccaccgctgccagcacaga

SEQ ID NO: 1741288 - DNA, 19 bp, Homo sapiens
gtgagccagagggagctgt

SEQ ID NO: 1741289 - DNA, 12 bp, Homo sapiens
gtgagccagtga

SEQ ID NO: 1741290 - DNA, 12 bp, Homo sapiens
gtgagccgcatc

SEQ ID NO: 1741291 - DNA, 21 bp, Homo sapiens
gtgagccgcggggcacatgct

SEQ ID NO: 1741292 - DNA, 17 bp, Homo sapiens
gtgagcctagccctggg

SEQ ID NO: 1741293 - DNA, 23 bp, Homo sapiens
gtgagctctggttatttttctct

SEQ ID NO: 1741294 - DNA, 19 bp, Homo sapiens
gtgagctggatagacttgg

SEQ ID NO: 1741295 - DNA, 23 bp, Homo sapiens
gtgagctggatagacttgggatg

SEQ ID NO: 1741296 - DNA, 14 bp, Homo sapiens
gtgagctgggaagc

SEQ ID NO: 1741297 - DNA, 12 bp, Homo sapiens
gtgagctgggga

SEQ ID NO: 1741298 - DNA, 19 bp, Homo sapiens
gtgagctggggactcaggg

SEQ ID NO: 1741299 - DNA, 13 bp, Homo sapiens
gtgagctggggcc

SEQ ID NO: 1741300 - DNA, 16 bp, Homo sapiens
gtgagctttgctgcta

SEQ ID NO: 1741301 - DNA, 22 bp, Homo sapiens
gtgaggaaccctgatctctcag

SEQ ID NO: 1741302 - DNA, 11 bp, Homo sapiens
gtgaggagctg

SEQ ID NO: 1741303 - DNA, 15 bp, Homo sapiens
gtgaggagctgctgg

SEQ ID NO: 1741304 - DNA, 17 bp, Homo sapiens
gtgaggagctgctggct

SEQ ID NO: 1741305 - DNA, 18 bp, Homo sapiens
gtgaggagctgctggctt

SEQ ID NO: 1741306 - DNA, 12 bp, Homo sapiens
gtgaggcagggg

SEQ ID NO: 1741307 - DNA, 13 bp, Homo sapiens
gtgaggcccaagg

SEQ ID NO: 1741308 - DNA, 20 bp, Homo sapiens
gtgaggccgggcgcagtggc

SEQ ID NO: 1741309 - DNA, 19 bp, Homo sapiens
gtgaggctgacatgctcac

SEQ ID NO: 1741310 - DNA, 13 bp, Homo sapiens
gtgaggctgctgc

SEQ ID NO: 1741311 - DNA, 15 bp, Homo sapiens
gtgaggctgctgcca

SEQ ID NO: 1741312 - DNA, 16 bp, Homo sapiens
gtgaggctgctgccat

SEQ ID NO: 1741313 - DNA, 17 bp, Homo sapiens
gtgaggcttccaggctc

SEQ ID NO: 1741314 - DNA, 22 bp, Homo sapiens
gtgagggcttgtcattaccaga

SEQ ID NO: 1741315 - DNA, 14 bp, Homo sapiens
gtgaggggaaggcc

SEQ ID NO: 1741316 - DNA, 19 bp, Homo sapiens
gtgaggggcaagctaggcc

SEQ ID NO: 1741317 - DNA, 16 bp, Homo sapiens
gtgagggggagctgaa

SEQ ID NO: 1741318 - DNA, 23 bp, Homo sapiens
gtgagggtgccccgcctgagtca

SEQ ID NO: 1741319 - DNA, 14 bp, Homo sapiens
gtgaggtgctgatg

SEQ ID NO: 1741320 - DNA, 15 bp, Homo sapiens
gtgagtaagagctgg

SEQ ID NO: 1741321 - DNA, 17 bp, Homo sapiens
gtgagtcacctgctcca

SEQ ID NO: 1741322 - DNA, 21 bp, Homo sapiens
gtgagtcacctgctccagaag

SEQ ID NO: 1741323 - DNA, 14 bp, Homo sapiens
gtgagtcagaatgt

SEQ ID NO: 1741324 - DNA, 18 bp, Homo sapiens
gtgagtcctgttcttcct

SEQ ID NO: 1741325 - DNA, 18 bp, Homo sapiens
gtgagtcttggcggcagc

SEQ ID NO: 1741326 - DNA, 20 bp, Homo sapiens
gtgagtgacatagcctcatg

SEQ ID NO: 1741327 - DNA, 17 bp, Homo sapiens
gtgagtggagttgaggt

SEQ ID NO: 1741328 - DNA, 15 bp, Homo sapiens
gtgagtttgagctgc

SEQ ID NO: 1741329 - DNA, 17 bp, Homo sapiens
gtgagtttgagctgcct

SEQ ID NO: 1741330 - DNA, 21 bp, Homo sapiens
gtgagtttgagctgccttccc

SEQ ID NO: 1741331 - DNA, 19 bp, Homo sapiens
gtgataatattgtttccct

SEQ ID NO: 1741332 - DNA, 20 bp, Homo sapiens
gtgatacaacttcaagtgca

SEQ ID NO: 1741333 - DNA, 14 bp, Homo sapiens
gtgatacactgtat

SEQ ID NO: 1741334 - DNA, 17 bp, Homo sapiens
gtgatacactgtatcta

SEQ ID NO: 1741335 - DNA, 17 bp, Homo sapiens
gtgatagaaaagtgtgg

SEQ ID NO: 1741336 - DNA, 14 bp, Homo sapiens
gtgatatcacctct

SEQ ID NO: 1741337 - DNA, 19 bp, Homo sapiens
gtgatatcacctctcttca

SEQ ID NO: 1741338 - DNA, 20 bp, Homo sapiens
gtgatatcacctctcttcag

SEQ ID NO: 1741339 - DNA, 19 bp, Homo sapiens
gtgatatggtgaagggaag

SEQ ID NO: 1741340 - DNA, 17 bp, Homo sapiens
gtgatatttcagaaata

SEQ ID NO: 1741341 - DNA, 18 bp, Homo sapiens
gtgatcaataaaatgtga

SEQ ID NO: 1741342 - DNA, 19 bp, Homo sapiens
gtgatcaataaaatgtgat

SEQ ID NO: 1741343 - DNA, 16 bp, Homo sapiens
gtgatcatgtgtggaa

SEQ ID NO: 1741344 - DNA, 19 bp, Homo sapiens
gtgatccatccatctccag

SEQ ID NO: 1741345 - DNA, 14 bp, Homo sapiens
gtgatcctgttctg

SEQ ID NO: 1741346 - DNA, 19 bp, Homo sapiens
gtgatcctgttctgcgctg

SEQ ID NO: 1741347 - DNA, 14 bp, Homo sapiens
gtgatctcagctca

SEQ ID NO: 1741348 - DNA, 20 bp, Homo sapiens
gtgatctctgttacaaaaga

SEQ ID NO: 1741349 - DNA, 22 bp, Homo sapiens
gtgatcttggcttactgcagcc

SEQ ID NO: 1741350 - DNA, 18 bp, Homo sapiens
gtgatgaatctacatttg

SEQ ID NO: 1741351 - DNA, 19 bp, Homo sapiens
gtgatgccacacagagtgg

SEQ ID NO: 1741352 - DNA, 12 bp, Homo sapiens
gtgatgcctgcc

SEQ ID NO: 1741353 - DNA, 15 bp, Homo sapiens
gtgatgtaccagttt

SEQ ID NO: 1741354 - DNA, 14 bp, Homo sapiens
gtgatgtggaggaa

SEQ ID NO: 1741355 - DNA, 21 bp, Homo sapiens
gtgatgtggaggaagagccac

SEQ ID NO: 1741356 - DNA, 22 bp, Homo sapiens
gtgatgtggaggaagagccacc

SEQ ID NO: 1741357 - DNA, 12 bp, Homo sapiens
gtgatgttctaa

SEQ ID NO: 1741358 - DNA, 13 bp, Homo sapiens
gtgatgttctaag

SEQ ID NO: 1741359 - DNA, 22 bp, Homo sapiens
gtgatgttctaaggctctgaga

SEQ ID NO: 1741360 - DNA, 16 bp, Homo sapiens
gtgatgtttccagctg

SEQ ID NO: 1741361 - DNA, 18 bp, Homo sapiens
gtgatgtttccagctgcc

SEQ ID NO: 1741362 - DNA, 14 bp, Homo sapiens
gtgatgtttgtcct

SEQ ID NO: 1741363 - DNA, 23 bp, Homo sapiens
gtgattcaatctgtaaactgtgt

SEQ ID NO: 1741364 - DNA, 20 bp, Homo sapiens
gtgattcactgccttcctct

SEQ ID NO: 1741365 - DNA, 22 bp, Homo sapiens
gtgattccactacacctggctg

SEQ ID NO: 1741366 - DNA, 23 bp, Homo sapiens
gtgattccactacacctggctga

SEQ ID NO: 1741367 - DNA, 21 bp, Homo sapiens
gtgattctgatttcagttttt

SEQ ID NO: 1741368 - DNA, 18 bp, Homo sapiens
gtgattctgtttattctt

SEQ ID NO: 1741369 - DNA, 18 bp, Homo sapiens
gtgattgcagctttatgt

SEQ ID NO: 1741370 - DNA, 19 bp, Homo sapiens
gtgattgcagctttatgtt

SEQ ID NO: 1741371 - DNA, 22 bp, Homo sapiens
gtgattgcagctttatgttcat

SEQ ID NO: 1741372 - DNA, 13 bp, Homo sapiens
gtgattgctgcca

SEQ ID NO: 1741373 - DNA, 15 bp, Homo sapiens
gtgattgctgccagg

SEQ ID NO: 1741374 - DNA, 12 bp, Homo sapiens
gtgattggctgc

SEQ ID NO: 1741375 - DNA, 13 bp, Homo sapiens
gtgattggctgca

SEQ ID NO: 1741376 - DNA, 13 bp, Homo sapiens
gtgattggctggt

SEQ ID NO: 1741377 - DNA, 14 bp, Homo sapiens
gtgatttatttgga

SEQ ID NO: 1741378 - DNA, 15 bp, Homo sapiens
gtgatttatttggag

SEQ ID NO: 1741379 - DNA, 19 bp, Homo sapiens
gtgatttcagactgcagag

SEQ ID NO: 1741380 - DNA, 12 bp, Homo sapiens
gtgatttctggc

SEQ ID NO: 1741381 - DNA, 23 bp, Homo sapiens
gtgatttgaaaaatataaaatta

SEQ ID NO: 1741382 - DNA, 16 bp, Homo sapiens
gtgatttgaattctgt

SEQ ID NO: 1741383 - DNA, 18 bp, Homo sapiens
gtgcaaacccactcagag

SEQ ID NO: 1741384 - DNA, 17 bp, Homo sapiens
gtgcaacatctctgaat

SEQ ID NO: 1741385 - DNA, 23 bp, Homo sapiens
gtgcaacccttaccccttagcct

SEQ ID NO: 1741386 - DNA, 19 bp, Homo sapiens
gtgcaacctcgctgagggc

SEQ ID NO: 1741387 - DNA, 17 bp, Homo sapiens
gtgcaacggccagggtt

SEQ ID NO: 1741388 - DNA, 20 bp, Homo sapiens
gtgcaagtagcacatggttt

SEQ ID NO: 1741389 - DNA, 22 bp, Homo sapiens
gtgcaataaatctgacccagtg

SEQ ID NO: 1741390 - DNA, 14 bp, Homo sapiens
gtgcaatacatttt

SEQ ID NO: 1741391 - DNA, 15 bp, Homo sapiens
gtgcaatacattttt

SEQ ID NO: 1741392 - DNA, 23 bp, Homo sapiens
gtgcaatgcttgtagaagtagga

SEQ ID NO: 1741393 - DNA, 15 bp, Homo sapiens
gtgcacaaatattta

SEQ ID NO: 1741394 - DNA, 20 bp, Homo sapiens
gtgcacaagtaacacatttg

SEQ ID NO: 1741395 - DNA, 15 bp, Homo sapiens
gtgcacaggagccaa

SEQ ID NO: 1741396 - DNA, 16 bp, Homo sapiens
gtgcacaggcctctgc

SEQ ID NO: 1741397 - DNA, 14 bp, Homo sapiens
gtgcacccacctgt

SEQ ID NO: 1741398 - DNA, 15 bp, Homo sapiens
gtgcacccacctgtt

SEQ ID NO: 1741399 - DNA, 21 bp, Homo sapiens
gtgcacccactcaccagggtc

SEQ ID NO: 1741400 - DNA, 13 bp, Homo sapiens
caggctgagccat

SEQ ID NO: 1741401 - DNA, 15 bp, Homo sapiens
caggctgagccatga

SEQ ID NO: 1741402 - DNA, 22 bp, Homo sapiens
caggctgagtccagagcttgtg

SEQ ID NO: 1741403 - DNA, 16 bp, Homo sapiens
caggctgagtgagcca

SEQ ID NO: 1741404 - DNA, 19 bp, Homo sapiens
caggctgagtgagccacag

SEQ ID NO: 1741405 - DNA, 15 bp, Homo sapiens
caggctgcagcctcc

SEQ ID NO: 1741406 - DNA, 21 bp, Homo sapiens
caggctgccaaggccagagtg

SEQ ID NO: 1741407 - DNA, 12 bp, Homo sapiens
caggctgcctcg

SEQ ID NO: 1741408 - DNA, 17 bp, Homo sapiens
caggctgctcagggctg

SEQ ID NO: 1741409 - DNA, 16 bp, Homo sapiens
caggctggacaccctc

SEQ ID NO: 1741410 - DNA, 17 bp, Homo sapiens
caggctggacaccctct

SEQ ID NO: 1741411 - DNA, 23 bp, Homo sapiens
caggctggacaccctctgccgag

SEQ ID NO: 1741412 - DNA, 23 bp, Homo sapiens
caggctggagactggaccgctga

SEQ ID NO: 1741413 - DNA, 12 bp, Homo sapiens
caggctggccag

SEQ ID NO: 1741414 - DNA, 13 bp, Homo sapiens
caggctggcgcag

SEQ ID NO: 1741415 - DNA, 10 bp, Homo sapiens
caggctgggc

SEQ ID NO: 1741416 - DNA, 23 bp, Homo sapiens
caggctgggccatgtccaaagag

SEQ ID NO: 1741417 - DNA, 16 bp, Homo sapiens
caggctggtctaaaac

SEQ ID NO: 1741418 - DNA, 17 bp, Homo sapiens
caggctggtctaaaact

SEQ ID NO: 1741419 - DNA, 19 bp, Homo sapiens
caggctgtggggcagctga

SEQ ID NO: 1741420 - DNA, 22 bp, Homo sapiens
tgtcagcatctgaccatctgtg

SEQ ID NO: 1741421 - DNA, 21 bp, Homo sapiens
tgtcagcattggcctctgtgt

SEQ ID NO: 1741422 - DNA, 15 bp, Homo sapiens
tgtcagccgggccct

SEQ ID NO: 1741423 - DNA, 22 bp, Homo sapiens
tgtcagcgctctggtgctgcag

SEQ ID NO: 1741424 - DNA, 20 bp, Homo sapiens
tgtcagcgttctaccaggca

SEQ ID NO: 1741425 - DNA, 19 bp, Homo sapiens
tgtcagctactaatgatgt

SEQ ID NO: 1741426 - DNA, 23 bp, Homo sapiens
tgtcagctcccctcggagaagag

SEQ ID NO: 1741427 - DNA, 14 bp, Homo sapiens
tgtcagctgaggct

SEQ ID NO: 1741428 - DNA, 19 bp, Homo sapiens
tgtcagctgaggctggggg

SEQ ID NO: 1741429 - DNA, 23 bp, Homo sapiens
tgtcagctgcaaggtactctggt

SEQ ID NO: 1741430 - DNA, 19 bp, Homo sapiens
tgtcagcttggctgtagga

SEQ ID NO: 1741431 - DNA, 20 bp, Homo sapiens
tgtcagcttggctgtaggac

SEQ ID NO: 1741432 - DNA, 20 bp, Homo sapiens
tgtcaggcccgtcggagctg

SEQ ID NO: 1741433 - DNA, 15 bp, Homo sapiens
tgtcaggccctctgc

SEQ ID NO: 1741434 - DNA, 18 bp, Homo sapiens
tgtcaggccctctgcctg

SEQ ID NO: 1741435 - DNA, 19 bp, Homo sapiens
tgtcaggccctctgcctgc

SEQ ID NO: 1741436 - DNA, 21 bp, Homo sapiens
tgtcaggccctctgcctgcac

SEQ ID NO: 1741437 - DNA, 19 bp, Homo sapiens
tgtcaggccttcagggttc

SEQ ID NO: 1741438 - DNA, 17 bp, Homo sapiens
tgtcagtactattcagg

SEQ ID NO: 1741439 - DNA, 22 bp, Homo sapiens
tgtcagtgctataaatgccaga

SEQ ID NO: 1741440 - DNA, 22 bp, Homo sapiens
tgtcagtgttaaagattttgtt

SEQ ID NO: 1741441 - DNA, 20 bp, Homo sapiens
tgtcagttctctgggaagtg

SEQ ID NO: 1741442 - DNA, 17 bp, Homo sapiens
tgtcagtttatcttaag

SEQ ID NO: 1741443 - DNA, 22 bp, Homo sapiens
tgtcataaagattataatatgt

SEQ ID NO: 1741444 - DNA, 18 bp, Homo sapiens
tgtcataaattactgttt

SEQ ID NO: 1741445 - DNA, 17 bp, Homo sapiens
tgtcataagaatgaata

SEQ ID NO: 1741446 - DNA, 19 bp, Homo sapiens
tgtcataccagaaagctct

SEQ ID NO: 1741447 - DNA, 21 bp, Homo sapiens
tgtcataccagaaagctctac

SEQ ID NO: 1741448 - DNA, 14 bp, Homo sapiens
tgtcatactctgtg

SEQ ID NO: 1741449 - DNA, 17 bp, Homo sapiens
tgtcatagaaagtgcca

SEQ ID NO: 1741450 - DNA, 21 bp, Homo sapiens
tgtcatagtcttgaaatgaaa

SEQ ID NO: 1741451 - DNA, 15 bp, Homo sapiens
tgtcatatgactgat

SEQ ID NO: 1741452 - DNA, 14 bp, Homo sapiens
tgtcatcactccct

SEQ ID NO: 1741453 - DNA, 15 bp, Homo sapiens
tgtcatcactccctg

SEQ ID NO: 1741454 - DNA, 17 bp, Homo sapiens
tgtcatcactccctgga

SEQ ID NO: 1741455 - DNA, 15 bp, Homo sapiens
tgtcatcagaagata

SEQ ID NO: 1741456 - DNA, 17 bp, Homo sapiens
tgtcatcagaagataac

SEQ ID NO: 1741457 - DNA, 21 bp, Homo sapiens
tgtcatccacacaacaccagg

SEQ ID NO: 1741458 - DNA, 13 bp, Homo sapiens
tgtcatccacctg

SEQ ID NO: 1741459 - DNA, 13 bp, Homo sapiens
tgtcatcttttca

SEQ ID NO: 1741460 - DNA, 15 bp, Homo sapiens
tgtcatgcccccctc

SEQ ID NO: 1741461 - DNA, 17 bp, Homo sapiens
tgtcatgcttcatcatt

SEQ ID NO: 1741462 - DNA, 22 bp, Homo sapiens
tgtcatgcttcatcattccctc

SEQ ID NO: 1741463 - DNA, 12 bp, Homo sapiens
tgtcatggtcct

SEQ ID NO: 1741464 - DNA, 21 bp, Homo sapiens
tgtcatggtcctttctggaag

SEQ ID NO: 1741465 - DNA, 22 bp, Homo sapiens
tgtcatgtacttcctgtgtact

SEQ ID NO: 1741466 - DNA, 15 bp, Homo sapiens
tgtcatgtagctgtt

SEQ ID NO: 1741467 - DNA, 14 bp, Homo sapiens
tgtcatgtgtataa

SEQ ID NO: 1741468 - DNA, 15 bp, Homo sapiens
tgtcatgtgtataaa

SEQ ID NO: 1741469 - DNA, 19 bp, Homo sapiens
tgtcattaccagacggttc

SEQ ID NO: 1741470 - DNA, 16 bp, Homo sapiens
tgtcattcaagcctgt

SEQ ID NO: 1741471 - DNA, 23 bp, Homo sapiens
tgtcattcaagcctgtgaataaa

SEQ ID NO: 1741472 - DNA, 19 bp, Homo sapiens
tgtcattcagagtcagcca

SEQ ID NO: 1741473 - DNA, 22 bp, Homo sapiens
tgtcattcagagtcagccagga

SEQ ID NO: 1741474 - DNA, 19 bp, Homo sapiens
tgtcattcccctttgcact

SEQ ID NO: 1741475 - DNA, 22 bp, Homo sapiens
tgtcattcccctttgcactgta

SEQ ID NO: 1741476 - DNA, 14 bp, Homo sapiens
tgtcattgcccctc

SEQ ID NO: 1741477 - DNA, 14 bp, Homo sapiens
tgtcattggaagcc

SEQ ID NO: 1741478 - DNA, 21 bp, Homo sapiens
tgtcatttactcaaaatctgt

SEQ ID NO: 1741479 - DNA, 15 bp, Homo sapiens
tgtcatttcagaagt

SEQ ID NO: 1741480 - DNA, 22 bp, Homo sapiens
tgtcatttcttcacttcaagct

SEQ ID NO: 1741481 - DNA, 16 bp, Homo sapiens
tgtcattttgcactgt

SEQ ID NO: 1741482 - DNA, 22 bp, Homo sapiens
aaatgcggttataaaaaatggt

SEQ ID NO: 1741483 - DNA, 20 bp, Homo sapiens
aaatgctaggttaattccaa

SEQ ID NO: 1741484 - DNA, 18 bp, Homo sapiens
aaatgctcttttgcacaa

SEQ ID NO: 1741485 - DNA, 15 bp, Homo sapiens
aaatgcttcattgaa

SEQ ID NO: 1741486 - DNA, 19 bp, Homo sapiens
aaatgcttcatttgtatgt

SEQ ID NO: 1741487 - DNA, 22 bp, Homo sapiens
aaatgcttctaaatatgaagga

SEQ ID NO: 1741488 - DNA, 18 bp, Homo sapiens
aaatgctttatgcaaacc

SEQ ID NO: 1741489 - DNA, 20 bp, Homo sapiens
aaatggaaaggtcctgctgt

SEQ ID NO: 1741490 - DNA, 20 bp, Homo sapiens
aaatggaaagtaactcattt

SEQ ID NO: 1741491 - DNA, 14 bp, Homo sapiens
aaatggaaattttg

SEQ ID NO: 1741492 - DNA, 16 bp, Homo sapiens
aaatggaattattttg

SEQ ID NO: 1741493 - DNA, 16 bp, Homo sapiens
ccacctttcaccctca

SEQ ID NO: 1741494 - DNA, 22 bp, Homo sapiens
ccacctttggaaagctctgacc

SEQ ID NO: 1741495 - DNA, 15 bp, Homo sapiens
ccacgactggccagg

SEQ ID NO: 1741496 - DNA, 17 bp, Homo sapiens
ccacgagggctggctgg

SEQ ID NO: 1741497 - DNA, 19 bp, Homo sapiens
ccacgagggctggctggcc

SEQ ID NO: 1741498 - DNA, 23 bp, Homo sapiens
ccacgagtcacctgcaagcccca

SEQ ID NO: 1741499 - DNA, 17 bp, Homo sapiens
ccacgatgtggccctgg

SEQ ID NO: 1741500 - DNA, 14 bp, Homo sapiens
ccacgcactgggcc

SEQ ID NO: 1741501 - DNA, 15 bp, Homo sapiens
ccacgcagccaggac

SEQ ID NO: 1741502 - DNA, 22 bp, Homo sapiens
ccacgcagggccatccactgtg

SEQ ID NO: 1741503 - DNA, 22 bp, Homo sapiens
ccacgccccgtgtctggatgca

SEQ ID NO: 1741504 - DNA, 18 bp, Homo sapiens
ccacgcccgtcctgcctg

SEQ ID NO: 1741505 - DNA, 19 bp, Homo sapiens
ccacgcctcaccagccccc

SEQ ID NO: 1741506 - DNA, 21 bp, Homo sapiens
ccacgcctcttgaccaggctg

SEQ ID NO: 1741507 - DNA, 14 bp, Homo sapiens
ccacgcctggaagg

SEQ ID NO: 1741508 - DNA, 20 bp, Homo sapiens
ccacggacgtttccatcagg

SEQ ID NO: 1741509 - DNA, 17 bp, Homo sapiens
ccacggactccagtctg

SEQ ID NO: 1741510 - DNA, 21 bp, Homo sapiens
ccacggccaccctccttcccg

SEQ ID NO: 1741511 - DNA, 14 bp, Homo sapiens
ccacggccctgtca

SEQ ID NO: 1741512 - DNA, 14 bp, Homo sapiens
ccacggcctgccca

SEQ ID NO: 1741513 - DNA, 12 bp, Homo sapiens
ccacggcctggc

SEQ ID NO: 1741514 - DNA, 19 bp, Homo sapiens
ccacggcctggctggtggg

SEQ ID NO: 1741515 - DNA, 18 bp, Homo sapiens
ccacgggaagtttagaga

SEQ ID NO: 1741516 - DNA, 20 bp, Homo sapiens
ccacgggacatcacagggtg

SEQ ID NO: 1741517 - DNA, 17 bp, Homo sapiens
ccacggggactcagccc

SEQ ID NO: 1741518 - DNA, 19 bp, Homo sapiens
ccacggtctggaggccgag

SEQ ID NO: 1741519 - DNA, 20 bp, Homo sapiens
ccacggtctggaggccgagg

SEQ ID NO: 1741520 - DNA, 13 bp, Homo sapiens
ccacggtgcgtgg

SEQ ID NO: 1741521 - DNA, 17 bp, Homo sapiens
ccacggtgcgtggctgt

SEQ ID NO: 1741522 - DNA, 24 bp, Homo sapiens
ccacggtgcgtggctgtggcacag

SEQ ID NO: 1741523 - DNA, 18 bp, Homo sapiens
ccacgtccaatcatgggc

SEQ ID NO: 1741524 - DNA, 18 bp, Homo sapiens
ccacgtcccagcatccct

SEQ ID NO: 1741525 - DNA, 21 bp, Homo sapiens
ccacgtcccagcatccctgga

SEQ ID NO: 1741526 - DNA, 14 bp, Homo sapiens
ccacgtctcctcct

SEQ ID NO: 1741527 - DNA, 14 bp, Homo sapiens
ccacgtctgccagg

SEQ ID NO: 1741528 - DNA, 16 bp, Homo sapiens
ccacgtctgccaggcc

SEQ ID NO: 1741529 - DNA, 19 bp, Homo sapiens
ccacgtctggctccctgcc

SEQ ID NO: 1741530 - DNA, 23 bp, Homo sapiens
ccacgtgaatggccctagaactg

SEQ ID NO: 1741531 - DNA, 18 bp, Homo sapiens
ccacgtgagagaatctgc

SEQ ID NO: 1741532 - DNA, 15 bp, Homo sapiens
ccacgtgccaggccc

SEQ ID NO: 1741533 - DNA, 17 bp, Homo sapiens
ccacgtgcgacagagag

SEQ ID NO: 1741534 - DNA, 22 bp, Homo sapiens
ccacgtgtatagtatctgtata

SEQ ID NO: 1741535 - DNA, 14 bp, Homo sapiens
ccacgtgtccgtcc

SEQ ID NO: 1741536 - DNA, 19 bp, Homo sapiens
ccacgtgtccgtccaccct

SEQ ID NO: 1741537 - DNA, 21 bp, Homo sapiens
ccacgttccttactgcagaat

SEQ ID NO: 1741538 - DNA, 19 bp, Homo sapiens
ccacgttctcacacccacc

SEQ ID NO: 1741539 - DNA, 22 bp, Homo sapiens
ccactaaaagatcgcagtttgc

SEQ ID NO: 1741540 - DNA, 14 bp, Homo sapiens
ccactaaagcttca

SEQ ID NO: 1741541 - DNA, 16 bp, Homo sapiens
ccactaaagcttcaga

SEQ ID NO: 1741542 - DNA, 18 bp, Homo sapiens
ccactaaagcttcagact

SEQ ID NO: 1741543 - DNA, 21 bp, Homo sapiens
ccactaaagcttcagactcaa

SEQ ID NO: 1741544 - DNA, 22 bp, Homo sapiens
ccactaaagcttcagactcaag

SEQ ID NO: 1741545 - DNA, 18 bp, Homo sapiens
ccactaaatgagctcctg

SEQ ID NO: 1741546 - DNA, 23 bp, Homo sapiens
ccactaaatgagctcctgcggga

SEQ ID NO: 1741547 - DNA, 13 bp, Homo sapiens
ccactaaccatcc

SEQ ID NO: 1741548 - DNA, 16 bp, Homo sapiens
ccactaaccatcccca

SEQ ID NO: 1741549 - DNA, 19 bp, Homo sapiens
ccactaaccatccccaact

SEQ ID NO: 1741550 - DNA, 15 bp, Homo sapiens
ccactacacctggct

SEQ ID NO: 1741551 - DNA, 16 bp, Homo sapiens
ccactacacctggctg

SEQ ID NO: 1741552 - DNA, 20 bp, Homo sapiens
ccactacactccagcctgag

SEQ ID NO: 1741553 - DNA, 13 bp, Homo sapiens
ccactaccagcca

SEQ ID NO: 1741554 - DNA, 14 bp, Homo sapiens
ccactaccagccag

SEQ ID NO: 1741555 - DNA, 17 bp, Homo sapiens
ccactaccagccagcct

SEQ ID NO: 1741556 - DNA, 18 bp, Homo sapiens
ccactaccagccagcctc

SEQ ID NO: 1741557 - DNA, 17 bp, Homo sapiens
ccactacccttctcctt

SEQ ID NO: 1741558 - DNA, 20 bp, Homo sapiens
ccactagagggcccatcagg

SEQ ID NO: 1741559 - DNA, 22 bp, Homo sapiens
ccactagagggcccatcaggca

SEQ ID NO: 1741560 - DNA, 14 bp, Homo sapiens
ccactagcttactg

SEQ ID NO: 1741561 - DNA, 20 bp, Homo sapiens
ccactaggactctgaggctc

SEQ ID NO: 1741562 - DNA, 20 bp, Homo sapiens
ccactaggatcccactggcg

SEQ ID NO: 1741563 - DNA, 15 bp, Homo sapiens
ccactaggtgtcccc

SEQ ID NO: 1741564 - DNA, 17 bp, Homo sapiens
ccactcaacagagagga

SEQ ID NO: 1741565 - DNA, 15 bp, Homo sapiens
ccactcaccagggtc

SEQ ID NO: 1741566 - DNA, 17 bp, Homo sapiens
ccactcaccagggtccg

SEQ ID NO: 1741567 - DNA, 22 bp, Homo sapiens
ccactcactaggcccccacttg

SEQ ID NO: 1741568 - DNA, 14 bp, Homo sapiens
ccactcactccagc

SEQ ID NO: 1741569 - DNA, 17 bp, Homo sapiens
ccactcagaactctcca

SEQ ID NO: 1741570 - DNA, 18 bp, Homo sapiens
ccactcagaactctccag

SEQ ID NO: 1741571 - DNA, 13 bp, Homo sapiens
ccactcaggccaa

SEQ ID NO: 1741572 - DNA, 22 bp, Homo sapiens
ccactcagttaaggaagatcct

SEQ ID NO: 1741573 - DNA, 19 bp, Homo sapiens
ccactccagacccctggct

SEQ ID NO: 1741574 - DNA, 14 bp, Homo sapiens
ccactccagccctg

SEQ ID NO: 1741575 - DNA, 13 bp, Homo sapiens
ccactccagcctg

SEQ ID NO: 1741576 - DNA, 14 bp, Homo sapiens
ccactccagcctgg

SEQ ID NO: 1741577 - DNA, 18 bp, Homo sapiens
ccactccagcctggggac

SEQ ID NO: 1741578 - DNA, 12 bp, Homo sapiens
ccactcccagca

SEQ ID NO: 1741579 - DNA, 22 bp, Homo sapiens
ccactcccagcagctcaaccta

SEQ ID NO: 1741580 - DNA, 22 bp, Homo sapiens
ccactcccccgtttctcctttt

SEQ ID NO: 1741581 - DNA, 18 bp, Homo sapiens
ccactccctgagctttgg

SEQ ID NO: 1741582 - DNA, 14 bp, Homo sapiens
ccactccctttcca

SEQ ID NO: 1741583 - DNA, 23 bp, Homo sapiens
ccactccctttccaacctcactt

SEQ ID NO: 1741584 - DNA, 11 bp, Homo sapiens
ccactcctccc

SEQ ID NO: 1741585 - DNA, 13 bp, Homo sapiens
ccactcctccctc

SEQ ID NO: 1741586 - DNA, 15 bp, Homo sapiens
ccactcctccctccg

SEQ ID NO: 1741587 - DNA, 12 bp, Homo sapiens
ccactcctgctg

SEQ ID NO: 1741588 - DNA, 13 bp, Homo sapiens
ccactcctgctgc

SEQ ID NO: 1741589 - DNA, 19 bp, Homo sapiens
ccactcctgttccttgcta

SEQ ID NO: 1741590 - DNA, 13 bp, Homo sapiens
ccactccttgtcc

SEQ ID NO: 1741591 - DNA, 18 bp, Homo sapiens
ccactcgtgcatccctga

SEQ ID NO: 1741592 - DNA, 18 bp, Homo sapiens
ccactctaccctcccacc

SEQ ID NO: 1741593 - DNA, 20 bp, Homo sapiens
ccactctaccctcccacccc

SEQ ID NO: 1741594 - DNA, 23 bp, Homo sapiens
ccactctaggggtcaggctccat

SEQ ID NO: 1741595 - DNA, 19 bp, Homo sapiens
ccactctagttctagatga

SEQ ID NO: 1741596 - DNA, 17 bp, Homo sapiens
ccactctcattccccag

SEQ ID NO: 1741597 - DNA, 20 bp, Homo sapiens
ccactctcccccaccccctc

SEQ ID NO: 1741598 - DNA, 11 bp, Homo sapiens
ccactctcctt

SEQ ID NO: 1741599 - DNA, 20 bp, Homo sapiens
ccactctgattcacctcttc

SEQ ID NO: 1741600 - DNA, 22 bp, Homo sapiens
ccactctgattcacctcttcct

SEQ ID NO: 1741601 - DNA, 23 bp, Homo sapiens
ccactctgattcacctcttcctc

SEQ ID NO: 1741602 - DNA, 20 bp, Homo sapiens
ccactctgcttctctgactt

SEQ ID NO: 1741603 - DNA, 15 bp, Homo sapiens
ccactcttgatctct

SEQ ID NO: 1741604 - DNA, 13 bp, Homo sapiens
ccactctttgaat

SEQ ID NO: 1741605 - DNA, 20 bp, Homo sapiens
ccactgaaatgaccaagaca

SEQ ID NO: 1741606 - DNA, 21 bp, Homo sapiens
ccactgaaatgaccaagacag

SEQ ID NO: 1741607 - DNA, 13 bp, Homo sapiens
ccactgaacaaaa

SEQ ID NO: 1741608 - DNA, 16 bp, Homo sapiens
ccactgaattcactcc

SEQ ID NO: 1741609 - DNA, 19 bp, Homo sapiens
aaatggacataggactcaa

SEQ ID NO: 1741610 - DNA, 17 bp, Homo sapiens
aaatggagctttctgta

SEQ ID NO: 1741611 - DNA, 17 bp, Homo sapiens
aaatggaggcttttcac

SEQ ID NO: 1741612 - DNA, 19 bp, Homo sapiens
aaatggaggcttttcactg

SEQ ID NO: 1741613 - DNA, 16 bp, Homo sapiens
aaatggccatttgctt

SEQ ID NO: 1741614 - DNA, 11 bp, Homo sapiens
aaatggcctca

SEQ ID NO: 1741615 - DNA, 21 bp, Homo sapiens
aaatggcctcatgtggctgga

SEQ ID NO: 1741616 - DNA, 20 bp, Homo sapiens
aaatggcgtctgctctggtg

SEQ ID NO: 1741617 - DNA, 21 bp, Homo sapiens
aaatggcgtctgctctggtgg

SEQ ID NO: 1741618 - DNA, 21 bp, Homo sapiens
aaatggctaataaactgtatt

SEQ ID NO: 1741619 - DNA, 23 bp, Homo sapiens
aaatggctaataaactgtattaa

SEQ ID NO: 1741620 - DNA, 11 bp, Homo sapiens
aaatggctggg

SEQ ID NO: 1741621 - DNA, 15 bp, Homo sapiens
aaatggcttttgcca

SEQ ID NO: 1741622 - DNA, 15 bp, Homo sapiens
aaatgggaattctca

SEQ ID NO: 1741623 - DNA, 21 bp, Homo sapiens
aaatgggactgatgtcatctt

SEQ ID NO: 1741624 - DNA, 21 bp, Homo sapiens
aaatggggataataatactga

SEQ ID NO: 1741625 - DNA, 13 bp, Homo sapiens
aaatggggccaga

SEQ ID NO: 1741626 - DNA, 18 bp, Homo sapiens
aaatggtacagcttctgg

SEQ ID NO: 1741627 - DNA, 20 bp, Homo sapiens
aaatggtacagcttctggag

SEQ ID NO: 1741628 - DNA, 23 bp, Homo sapiens
aaatggtataaaaggttgccaaa

SEQ ID NO: 1741629 - DNA, 21 bp, Homo sapiens
aaatggtccaattagtttcct

SEQ ID NO: 1741630 - DNA, 22 bp, Homo sapiens
aaatggtcccaattaagaaatt

SEQ ID NO: 1741631 - DNA, 18 bp, Homo sapiens
aaatggtcgcccaggaga

SEQ ID NO: 1741632 - DNA, 16 bp, Homo sapiens
aaatggtgtacataat

SEQ ID NO: 1741633 - DNA, 14 bp, Homo sapiens
aaatggttcagaat

SEQ ID NO: 1741634 - DNA, 16 bp, Homo sapiens
aaatggtttcctctgg

SEQ ID NO: 1741635 - DNA, 17 bp, Homo sapiens
aaatgtaaaagtactct

SEQ ID NO: 1741636 - DNA, 19 bp, Homo sapiens
aaatgtaacatcataatta

SEQ ID NO: 1741637 - DNA, 22 bp, Homo sapiens
aaatgtaacatcataattacat

SEQ ID NO: 1741638 - DNA, 21 bp, Homo sapiens
aaatgtaagattatagattct

SEQ ID NO: 1741639 - DNA, 17 bp, Homo sapiens
aaatgtaaggattctgg

SEQ ID NO: 1741640 - DNA, 20 bp, Homo sapiens
aaatgtaatagccaaaccca

SEQ ID NO: 1741641 - DNA, 14 bp, Homo sapiens
aaatgtaatttaaa

SEQ ID NO: 1741642 - DNA, 19 bp, Homo sapiens
aaatgtaggatcaaaaggc

SEQ ID NO: 1741643 - DNA, 16 bp, Homo sapiens
aaatgtaggtatgaat

SEQ ID NO: 1741644 - DNA, 13 bp, Homo sapiens
aaatgtataaaaa

SEQ ID NO: 1741645 - DNA, 15 bp, Homo sapiens
aaatgtataaatata

SEQ ID NO: 1741646 - DNA, 17 bp, Homo sapiens
aaatgtatcatagaaat

SEQ ID NO: 1741647 - DNA, 21 bp, Homo sapiens
aaatgtatccaaggaaacatt

SEQ ID NO: 1741648 - DNA, 20 bp, Homo sapiens
aaatgtatcctgataaacat

SEQ ID NO: 1741649 - DNA, 13 bp, Homo sapiens
aaatgtatgcatt

SEQ ID NO: 1741650 - DNA, 14 bp, Homo sapiens
aaatgtattcaaat

SEQ ID NO: 1741651 - DNA, 15 bp, Homo sapiens
aaatgtattcaaata

SEQ ID NO: 1741652 - DNA, 12 bp, Homo sapiens
aaatgtcataaa

SEQ ID NO: 1741653 - DNA, 13 bp, Homo sapiens
aaatgtcataaat

SEQ ID NO: 1741654 - DNA, 20 bp, Homo sapiens
aaatgtcataaattactgtt

SEQ ID NO: 1741655 - DNA, 18 bp, Homo sapiens
aaatgtcattgtctactc

SEQ ID NO: 1741656 - DNA, 13 bp, Homo sapiens
aaatgtctgctgg

SEQ ID NO: 1741657 - DNA, 14 bp, Homo sapiens
aaatgtctgctggt

SEQ ID NO: 1741658 - DNA, 21 bp, Homo sapiens
aaatgtctgctggtatttcta

SEQ ID NO: 1741659 - DNA, 13 bp, Homo sapiens
aaatgtctgtttc

SEQ ID NO: 1741660 - DNA, 15 bp, Homo sapiens
aaatgtgatgttcta

SEQ ID NO: 1741661 - DNA, 22 bp, Homo sapiens
aaatgtgatgttctaaggctct

SEQ ID NO: 1741662 - DNA, 15 bp, Homo sapiens
aaatgtgcttttaaa

SEQ ID NO: 1741663 - DNA, 19 bp, Homo sapiens
aaatgtgggattatgggtc

SEQ ID NO: 1741664 - DNA, 19 bp, Homo sapiens
aaatgtggttgcttaattc

SEQ ID NO: 1741665 - DNA, 24 bp, Homo sapiens
aaatgtgtacagtgaattgtcttt

SEQ ID NO: 1741666 - DNA, 21 bp, Homo sapiens
aaatgtgtcagaataggaaaa

SEQ ID NO: 1741667 - DNA, 19 bp, Homo sapiens
aaatgtgtgagtgcatgta

SEQ ID NO: 1741668 - DNA, 16 bp, Homo sapiens
aaatgttaaaagtttt

SEQ ID NO: 1741669 - DNA, 19 bp, Homo sapiens
aaatgttaaaagttttata

SEQ ID NO: 1741670 - DNA, 23 bp, Homo sapiens
aaatgttaaaagttttatatgct

SEQ ID NO: 1741671 - DNA, 19 bp, Homo sapiens
aaatgttacctaattatta

SEQ ID NO: 1741672 - DNA, 15 bp, Homo sapiens
aaatgttacctctga

SEQ ID NO: 1741673 - DNA, 23 bp, Homo sapiens
aaatgttactccctgttttagtt

SEQ ID NO: 1741674 - DNA, 17 bp, Homo sapiens
aaatgttatcttctcaa

SEQ ID NO: 1741675 - DNA, 18 bp, Homo sapiens
aaatgttatcttctcaag

SEQ ID NO: 1741676 - DNA, 20 bp, Homo sapiens
aaatgttattttttaattat

SEQ ID NO: 1741677 - DNA, 21 bp, Homo sapiens
aaatgttattttttaattatt

SEQ ID NO: 1741678 - DNA, 15 bp, Homo sapiens
aaatgttcagaaggt

SEQ ID NO: 1741679 - DNA, 21 bp, Homo sapiens
aaatgttcagaaggttgctct

SEQ ID NO: 1741680 - DNA, 19 bp, Homo sapiens
aaatgttctaagtttctaa

SEQ ID NO: 1741681 - DNA, 15 bp, Homo sapiens
aaatgtttactgtaa

SEQ ID NO: 1741682 - DNA, 18 bp, Homo sapiens
aaatgtttactgtaaatt

SEQ ID NO: 1741683 - DNA, 20 bp, Homo sapiens
aaatgtttatgttttcaact

SEQ ID NO: 1741684 - DNA, 12 bp, Homo sapiens
aaatgtttcatt

SEQ ID NO: 1741685 - DNA, 11 bp, Homo sapiens
aaatgtttcct

SEQ ID NO: 1741686 - DNA, 13 bp, Homo sapiens
aaatgtttcctta

SEQ ID NO: 1741687 - DNA, 14 bp, Homo sapiens
aaatgtttccttaa

SEQ ID NO: 1741688 - DNA, 11 bp, Homo sapiens
aaatgtttctt

SEQ ID NO: 1741689 - DNA, 15 bp, Homo sapiens
aaatgtttcttttaa

SEQ ID NO: 1741690 - DNA, 18 bp, Homo sapiens
aaatgtttcttttaaaga

SEQ ID NO: 1741691 - DNA, 18 bp, Homo sapiens
aaatgtttcttttccctt

SEQ ID NO: 1741692 - DNA, 14 bp, Homo sapiens
aaatgtttcttttg

SEQ ID NO: 1741693 - DNA, 19 bp, Homo sapiens
aaatgtttggatggtttgt

SEQ ID NO: 1741694 - DNA, 19 bp, Homo sapiens
aaatgtttgttatttacac

SEQ ID NO: 1741695 - DNA, 13 bp, Homo sapiens
aaatgttttctgg

SEQ ID NO: 1741696 - DNA, 21 bp, Homo sapiens
aaatgttttctggggaaaggg

SEQ ID NO: 1741697 - DNA, 18 bp, Homo sapiens
aaatgtttttatttttgt

SEQ ID NO: 1741698 - DNA, 23 bp, Homo sapiens
aaatgtttttggtcttttataat

SEQ ID NO: 1741699 - DNA, 12 bp, Homo sapiens
aaattaaaaaaa

SEQ ID NO: 1741700 - DNA, 22 bp, Homo sapiens
aaattaaaaaaaaattgtatct

SEQ ID NO: 1741701 - DNA, 14 bp, Homo sapiens
aaattaaaaataaa

SEQ ID NO: 1741702 - DNA, 12 bp, Homo sapiens
aaattaaaacaa

SEQ ID NO: 1741703 - DNA, 14 bp, Homo sapiens
aaattaaacatttt

SEQ ID NO: 1741704 - DNA, 19 bp, Homo sapiens
aaattaaaccggaccatct

SEQ ID NO: 1741705 - DNA, 12 bp, Homo sapiens
aaattaaatgcc

SEQ ID NO: 1741706 - DNA, 17 bp, Homo sapiens
aaattaacaataaagaa

SEQ ID NO: 1741707 - DNA, 11 bp, Homo sapiens
aaattaacaca

SEQ ID NO: 1741708 - DNA, 20 bp, Homo sapiens
aaattaaccatagatgtaga

SEQ ID NO: 1741709 - DNA, 14 bp, Homo sapiens
aaattaagtagaac

SEQ ID NO: 1741710 - DNA, 15 bp, Homo sapiens
aaattaagtagaaca

SEQ ID NO: 1741711 - DNA, 12 bp, Homo sapiens
aaattaatcttg

SEQ ID NO: 1741712 - DNA, 23 bp, Homo sapiens
aaattaatcttgcttcattgtta

SEQ ID NO: 1741713 - DNA, 22 bp, Homo sapiens
aaattaatgcagatttctcttt

SEQ ID NO: 1741714 - DNA, 17 bp, Homo sapiens
aaattaattgaatctag

SEQ ID NO: 1741715 - DNA, 17 bp, Homo sapiens
aaattacaaaaggctcg

SEQ ID NO: 1741716 - DNA, 21 bp, Homo sapiens
aaattacaaggcaatggaaac

SEQ ID NO: 1741717 - DNA, 14 bp, Homo sapiens
aaattacaatttta

SEQ ID NO: 1741718 - DNA, 16 bp, Homo sapiens
aaattacaattttatc

SEQ ID NO: 1741719 - DNA, 16 bp, Homo sapiens
aaattacacccaaaga

SEQ ID NO: 1741720 - DNA, 22 bp, Homo sapiens
aaattacacccaaagaggtatt

SEQ ID NO: 1741721 - DNA, 14 bp, Homo sapiens
aaattacagcttca

SEQ ID NO: 1741722 - DNA, 16 bp, Homo sapiens
aaattacatttgtaat

SEQ ID NO: 1741723 - DNA, 20 bp, Homo sapiens
aaattacatttgtaatttaa

SEQ ID NO: 1741724 - DNA, 23 bp, Homo sapiens
aaattacatttgtaatttaaggt

SEQ ID NO: 1741725 - DNA, 16 bp, Homo sapiens
aaattacctttaattt

SEQ ID NO: 1741726 - DNA, 19 bp, Homo sapiens
ccactgacaaacgtcccca

SEQ ID NO: 1741727 - DNA, 20 bp, Homo sapiens
ccactgacaaacgtccccag

SEQ ID NO: 1741728 - DNA, 19 bp, Homo sapiens
ccactgacacccagtgtcc

SEQ ID NO: 1741729 - DNA, 16 bp, Homo sapiens
ccactgacagcctccc

SEQ ID NO: 1741730 - DNA, 13 bp, Homo sapiens
ccactgaccagaa

SEQ ID NO: 1741731 - DNA, 15 bp, Homo sapiens
ccactgacccaactg

SEQ ID NO: 1741732 - DNA, 16 bp, Homo sapiens
ccactgactgcaggga

SEQ ID NO: 1741733 - DNA, 17 bp, Homo sapiens
ccactgacttgctgtgt

SEQ ID NO: 1741734 - DNA, 19 bp, Homo sapiens
ccactgagactttcccctc

SEQ ID NO: 1741735 - DNA, 11 bp, Homo sapiens
ccactgaggag

SEQ ID NO: 1741736 - DNA, 12 bp, Homo sapiens
ccactgaggaga

SEQ ID NO: 1741737 - DNA, 13 bp, Homo sapiens
ccactgcactcca

SEQ ID NO: 1741738 - DNA, 20 bp, Homo sapiens
ccactgcactccagcctggg

SEQ ID NO: 1741739 - DNA, 23 bp, Homo sapiens
ccactgcactccagcctgggtca

SEQ ID NO: 1741740 - DNA, 17 bp, Homo sapiens
ccactgccagcagcagc

SEQ ID NO: 1741741 - DNA, 11 bp, Homo sapiens
ccactgccagg

SEQ ID NO: 1741742 - DNA, 13 bp, Homo sapiens
ccactgccaggca

SEQ ID NO: 1741743 - DNA, 17 bp, Homo sapiens
ccactgccaggcacctg

SEQ ID NO: 1741744 - DNA, 19 bp, Homo sapiens
ccactgccaggcacctggc

SEQ ID NO: 1741745 - DNA, 20 bp, Homo sapiens
ccactgccaggcacctggcc

SEQ ID NO: 1741746 - DNA, 24 bp, Homo sapiens
ccactgccaggcacctggcctgct

SEQ ID NO: 1741747 - DNA, 16 bp, Homo sapiens
ccactgccattaccca

SEQ ID NO: 1741748 - DNA, 15 bp, Homo sapiens
ccactgcccaccccc

SEQ ID NO: 1741749 - DNA, 19 bp, Homo sapiens
ccactgccccccgaggctg

SEQ ID NO: 1741750 - DNA, 13 bp, Homo sapiens
ccactgccctgcc

SEQ ID NO: 1741751 - DNA, 19 bp, Homo sapiens
ccactgccctgcctgccca

SEQ ID NO: 1741752 - DNA, 18 bp, Homo sapiens
ccactgccctggcagcag

SEQ ID NO: 1741753 - DNA, 12 bp, Homo sapiens
ccactgccttcg

SEQ ID NO: 1741754 - DNA, 15 bp, Homo sapiens
ccactgccttcgctt

SEQ ID NO: 1741755 - DNA, 18 bp, Homo sapiens
ccactgccttcgcttctt

SEQ ID NO: 1741756 - DNA, 23 bp, Homo sapiens
ccactgccttcgcttcttgcctc

SEQ ID NO: 1741757 - DNA, 21 bp, Homo sapiens
ccactgcgggagctctgtatg

SEQ ID NO: 1741758 - DNA, 23 bp, Homo sapiens
ccactgcgggagctctgtatggt

SEQ ID NO: 1741759 - DNA, 16 bp, Homo sapiens
ccactgcttcccactg

SEQ ID NO: 1741760 - DNA, 16 bp, Homo sapiens
ccactggaaggagcac

SEQ ID NO: 1741761 - DNA, 20 bp, Homo sapiens
ccactggaaggagcacatac

SEQ ID NO: 1741762 - DNA, 15 bp, Homo sapiens
ccactggaagggcag

SEQ ID NO: 1741763 - DNA, 20 bp, Homo sapiens
ccactggacttgagcttggc

SEQ ID NO: 1741764 - DNA, 22 bp, Homo sapiens
ccactggacttgagcttggcag

SEQ ID NO: 1741765 - DNA, 16 bp, Homo sapiens
ccactggcttttgcct

SEQ ID NO: 1741766 - DNA, 20 bp, Homo sapiens
ccactggcttttgcctgtaa

SEQ ID NO: 1741767 - DNA, 20 bp, Homo sapiens
ccactgggacagctggctgg

SEQ ID NO: 1741768 - DNA, 11 bp, Homo sapiens
ccactgggagg

SEQ ID NO: 1741769 - DNA, 14 bp, Homo sapiens
ccactgggcacctg

SEQ ID NO: 1741770 - DNA, 24 bp, Homo sapiens
ccactgggccagccctgcagccca

SEQ ID NO: 1741771 - DNA, 17 bp, Homo sapiens
ccactggggactttatt

SEQ ID NO: 1741772 - DNA, 18 bp, Homo sapiens
ccactgggtctcactcct

SEQ ID NO: 1741773 - DNA, 19 bp, Homo sapiens
ccactggttaaaataaagc

SEQ ID NO: 1741774 - DNA, 23 bp, Homo sapiens
ccactggttaaaataaagcctat

SEQ ID NO: 1741775 - DNA, 15 bp, Homo sapiens
ccactggtttctcag

SEQ ID NO: 1741776 - DNA, 21 bp, Homo sapiens
ccactgtatgatttataaaca

SEQ ID NO: 1741777 - DNA, 11 bp, Homo sapiens
ccactgtcctg

SEQ ID NO: 1741778 - DNA, 13 bp, Homo sapiens
ccactgtcctggg

SEQ ID NO: 1741779 - DNA, 22 bp, Homo sapiens
ccactgtctccacccaccttga

SEQ ID NO: 1741780 - DNA, 17 bp, Homo sapiens
ccactgtctgtccctga

SEQ ID NO: 1741781 - DNA, 14 bp, Homo sapiens
ccactgtgccactg

SEQ ID NO: 1741782 - DNA, 20 bp, Homo sapiens
ccactgtgcctcagagacca

SEQ ID NO: 1741783 - DNA, 18 bp, Homo sapiens
ccactgtggcaaatggag

SEQ ID NO: 1741784 - DNA, 20 bp, Homo sapiens
ccactgtggccagagctgga

SEQ ID NO: 1741785 - DNA, 13 bp, Homo sapiens
ccactgtgtccag

SEQ ID NO: 1741786 - DNA, 23 bp, Homo sapiens
ccactgtttctcttgagctggcc

SEQ ID NO: 1741787 - DNA, 19 bp, Homo sapiens
ccacttaaaaaatgtccat

SEQ ID NO: 1741788 - DNA, 21 bp, Homo sapiens
ccacttaaaaaatgtccatga

SEQ ID NO: 1741789 - DNA, 21 bp, Homo sapiens
ccacttagaaattgcatttcc

SEQ ID NO: 1741790 - DNA, 18 bp, Homo sapiens
ccacttagccgcaccctg

SEQ ID NO: 1741791 - DNA, 15 bp, Homo sapiens
ccacttagccgtcca

SEQ ID NO: 1741792 - DNA, 18 bp, Homo sapiens
ccacttagtcgtcttttt

SEQ ID NO: 1741793 - DNA, 16 bp, Homo sapiens
ccacttattttacatt

SEQ ID NO: 1741794 - DNA, 16 bp, Homo sapiens
ccacttcaacccccag

SEQ ID NO: 1741795 - DNA, 13 bp, Homo sapiens
ccacttcagaagg

SEQ ID NO: 1741796 - DNA, 14 bp, Homo sapiens
ccacttcagcctcc

SEQ ID NO: 1741797 - DNA, 12 bp, Homo sapiens
ccacttcccctc

SEQ ID NO: 1741798 - DNA, 17 bp, Homo sapiens
ccacttcccgtttcctc

SEQ ID NO: 1741799 - DNA, 18 bp, Homo sapiens
ccacttctccatgctgca

SEQ ID NO: 1741800 - DNA, 15 bp, Homo sapiens
ccacttctgggtggg

SEQ ID NO: 1741801 - DNA, 22 bp, Homo sapiens
ccacttcttaaaggcctggaac

SEQ ID NO: 1741802 - DNA, 17 bp, Homo sapiens
ccacttgaaatgttagt

SEQ ID NO: 1741803 - DNA, 13 bp, Homo sapiens
ccacttgaggcct

SEQ ID NO: 1741804 - DNA, 14 bp, Homo sapiens
ccacttgattgaga

SEQ ID NO: 1741805 - DNA, 17 bp, Homo sapiens
ccacttgattgagaaag

SEQ ID NO: 1741806 - DNA, 12 bp, Homo sapiens
ccacttgcctct

SEQ ID NO: 1741807 - DNA, 17 bp, Homo sapiens
ccacttgcctcttcctt

SEQ ID NO: 1741808 - DNA, 17 bp, Homo sapiens
ccacttgggtcttccct

SEQ ID NO: 1741809 - DNA, 21 bp, Homo sapiens
ccacttgtccgctgggtggta

SEQ ID NO: 1741810 - DNA, 18 bp, Homo sapiens
ccactttcacgtggcctc

SEQ ID NO: 1741811 - DNA, 19 bp, Homo sapiens
ccactttcacgtggcctcc

SEQ ID NO: 1741812 - DNA, 13 bp, Homo sapiens
ccactttcagagc

SEQ ID NO: 1741813 - DNA, 23 bp, Homo sapiens
ccactttcagagcccccagccct

SEQ ID NO: 1741814 - DNA, 18 bp, Homo sapiens
ccactttcatctaccttt

SEQ ID NO: 1741815 - DNA, 19 bp, Homo sapiens
ccactttcatctacctttt

SEQ ID NO: 1741816 - DNA, 15 bp, Homo sapiens
ccactttcctgagct

SEQ ID NO: 1741817 - DNA, 23 bp, Homo sapiens
ccactttcctgagctgtcgctgc

SEQ ID NO: 1741818 - DNA, 17 bp, Homo sapiens
ccactttcttattctgt

SEQ ID NO: 1741819 - DNA, 20 bp, Homo sapiens
ccactttgcacagctctccg

SEQ ID NO: 1741820 - DNA, 16 bp, Homo sapiens
ccacttttattcattt

SEQ ID NO: 1741821 - DNA, 13 bp, Homo sapiens
ccacttttttcat

SEQ ID NO: 1741822 - DNA, 19 bp, Homo sapiens
ccactttttttttttctgc

SEQ ID NO: 1741823 - DNA, 16 bp, Homo sapiens
ccagaaaaccccagca

SEQ ID NO: 1741824 - DNA, 17 bp, Homo sapiens
ccagaaaacctccagta

SEQ ID NO: 1741825 - DNA, 13 bp, Homo sapiens
ccagaaacatctc

SEQ ID NO: 1741826 - DNA, 15 bp, Homo sapiens
ccagaaactcctgtt

SEQ ID NO: 1741827 - DNA, 22 bp, Homo sapiens
ccagaaactcctgtttctcctt

SEQ ID NO: 1741828 - DNA, 20 bp, Homo sapiens
ccagaaagcaggagcagctg

SEQ ID NO: 1741829 - DNA, 21 bp, Homo sapiens
ccagaaagcaggagcagctgt

SEQ ID NO: 1741830 - DNA, 16 bp, Homo sapiens
ccagaaagcctctctc

SEQ ID NO: 1741831 - DNA, 20 bp, Homo sapiens
ccagaaagctctacatttgc

SEQ ID NO: 1741832 - DNA, 23 bp, Homo sapiens
ccagaaataaagttggtgacaga

SEQ ID NO: 1741833 - DNA, 22 bp, Homo sapiens
ccagaaatatcgctgatgcaga

SEQ ID NO: 1741834 - DNA, 22 bp, Homo sapiens
ccagaaatgtctaaatgctgaa

SEQ ID NO: 1741835 - DNA, 13 bp, Homo sapiens
ccagaaattctgg

SEQ ID NO: 1741836 - DNA, 19 bp, Homo sapiens
ccagaaattctggcccagc

SEQ ID NO: 1741837 - DNA, 22 bp, Homo sapiens
ccagaaattgtgtgtgcaagaa

SEQ ID NO: 1741838 - DNA, 17 bp, Homo sapiens
ccagaacagccctcggc

SEQ ID NO: 1741839 - DNA, 20 bp, Homo sapiens
ccagaacagccctcggcctc

SEQ ID NO: 1741840 - DNA, 15 bp, Homo sapiens
ccagaacctgtcctt

SEQ ID NO: 1741841 - DNA, 19 bp, Homo sapiens
ccagaactcactggggcct

SEQ ID NO: 1741842 - DNA, 20 bp, Homo sapiens
aaattactcaggaagaacac

SEQ ID NO: 1741843 - DNA, 13 bp, Homo sapiens
aaattactgtttt

SEQ ID NO: 1741844 - DNA, 21 bp, Homo sapiens
aaattacttatcatccacatt

SEQ ID NO: 1741845 - DNA, 19 bp, Homo sapiens
aaattagaaaaaaattact

SEQ ID NO: 1741846 - DNA, 20 bp, Homo sapiens
aaattagatcctaagatgtg

SEQ ID NO: 1741847 - DNA, 14 bp, Homo sapiens
aaattagatgaact

SEQ ID NO: 1741848 - DNA, 13 bp, Homo sapiens
aaattagctattt

SEQ ID NO: 1741849 - DNA, 18 bp, Homo sapiens
aaattagctatttctgct

SEQ ID NO: 1741850 - DNA, 17 bp, Homo sapiens
aaattagctgtgtgaaa

SEQ ID NO: 1741851 - DNA, 19 bp, Homo sapiens
aaattagctgtgtgaaata

SEQ ID NO: 1741852 - DNA, 16 bp, Homo sapiens
aaattaggaataaata

SEQ ID NO: 1741853 - DNA, 15 bp, Homo sapiens
aaattagtcttttgt

SEQ ID NO: 1741854 - DNA, 16 bp, Homo sapiens
aaattataacttaaaa

SEQ ID NO: 1741855 - DNA, 17 bp, Homo sapiens
aaattataacttaaaat

SEQ ID NO: 1741856 - DNA, 12 bp, Homo sapiens
aaattataatgt

SEQ ID NO: 1741857 - DNA, 14 bp, Homo sapiens
aaattataatgtat

SEQ ID NO: 1741858 - DNA, 15 bp, Homo sapiens
aaattataatgtatt

SEQ ID NO: 1741859 - DNA, 19 bp, Homo sapiens
aaattataatgtattcata

SEQ ID NO: 1741860 - DNA, 17 bp, Homo sapiens
aaattatagtagcttat

SEQ ID NO: 1741861 - DNA, 16 bp, Homo sapiens
aaattatataagtatt

SEQ ID NO: 1741862 - DNA, 22 bp, Homo sapiens
aaattatataagtattctaaat

SEQ ID NO: 1741863 - DNA, 15 bp, Homo sapiens
aaattatatatttat

SEQ ID NO: 1741864 - DNA, 22 bp, Homo sapiens
aaattatatatttattttattc

SEQ ID NO: 1741865 - DNA, 22 bp, Homo sapiens
aaattatgatcctctatttcct

SEQ ID NO: 1741866 - DNA, 12 bp, Homo sapiens
aaattatgcaaa

SEQ ID NO: 1741867 - DNA, 15 bp, Homo sapiens
aaattattagcattt

SEQ ID NO: 1741868 - DNA, 21 bp, Homo sapiens
aaattattttaatattttgta

SEQ ID NO: 1741869 - DNA, 17 bp, Homo sapiens
aaattattttgttcata

SEQ ID NO: 1741870 - DNA, 17 bp, Homo sapiens
aaattcaaaacctgcag

SEQ ID NO: 1741871 - DNA, 16 bp, Homo sapiens
aaattcaaaagtattg

SEQ ID NO: 1741872 - DNA, 14 bp, Homo sapiens
aaattcaaagcatg

SEQ ID NO: 1741873 - DNA, 16 bp, Homo sapiens
aaattcaacaaatgat

SEQ ID NO: 1741874 - DNA, 17 bp, Homo sapiens
aaattcaacacttattt

SEQ ID NO: 1741875 - DNA, 20 bp, Homo sapiens
aaattcaactttgtaaaaat

SEQ ID NO: 1741876 - DNA, 16 bp, Homo sapiens
aaattcaagaaaataa

SEQ ID NO: 1741877 - DNA, 18 bp, Homo sapiens
aaattcaagagcctcccc

SEQ ID NO: 1741878 - DNA, 18 bp, Homo sapiens
aaattcaagagctagaaa

SEQ ID NO: 1741879 - DNA, 19 bp, Homo sapiens
aaattcactgtttcactga

SEQ ID NO: 1741880 - DNA, 12 bp, Homo sapiens
aaattcagacaa

SEQ ID NO: 1741881 - DNA, 18 bp, Homo sapiens
aaattcagacaacattat

SEQ ID NO: 1741882 - DNA, 19 bp, Homo sapiens
aaattcagacaacattatg

SEQ ID NO: 1741883 - DNA, 23 bp, Homo sapiens
aaattcagacaacattatgatct

SEQ ID NO: 1741884 - DNA, 9 bp, Homo sapiens
aaattcagg

SEQ ID NO: 1741885 - DNA, 23 bp, Homo sapiens
aaattcaggtacagaaaacatgt

SEQ ID NO: 1741886 - DNA, 19 bp, Homo sapiens
aaattcataaccaaagaga

SEQ ID NO: 1741887 - DNA, 21 bp, Homo sapiens
aaattcatggcatgcttaaat

SEQ ID NO: 1741888 - DNA, 19 bp, Homo sapiens
aaattcattttttaaattc

SEQ ID NO: 1741889 - DNA, 22 bp, Homo sapiens
aaattccaagtcctgaagtaga

SEQ ID NO: 1741890 - DNA, 17 bp, Homo sapiens
aaattccagaaaggata

SEQ ID NO: 1741891 - DNA, 17 bp, Homo sapiens
aaattcccgttttgtca

SEQ ID NO: 1741892 - DNA, 21 bp, Homo sapiens
aaattcccttttcaccttttc

SEQ ID NO: 1741893 - DNA, 23 bp, Homo sapiens
aaattcctgtgttcaatatttag

SEQ ID NO: 1741894 - DNA, 23 bp, Homo sapiens
aaattccttagcttagacctcag

SEQ ID NO: 1741895 - DNA, 15 bp, Homo sapiens
aaattctacaacaca

SEQ ID NO: 1741896 - DNA, 22 bp, Homo sapiens
aaattctagaaagtactttggc

SEQ ID NO: 1741897 - DNA, 19 bp, Homo sapiens
aaattctattacagtatgt

SEQ ID NO: 1741898 - DNA, 15 bp, Homo sapiens
aaattctattgaaaa

SEQ ID NO: 1741899 - DNA, 17 bp, Homo sapiens
aaattctattgaaaaca

SEQ ID NO: 1741900 - DNA, 16 bp, Homo sapiens
aaattctcagagtgtt

SEQ ID NO: 1741901 - DNA, 13 bp, Homo sapiens
aaattctgaaaac

SEQ ID NO: 1741902 - DNA, 17 bp, Homo sapiens
aaattctgacttatgaa

SEQ ID NO: 1741903 - DNA, 21 bp, Homo sapiens
aaattctgatgtttctgtgaa

SEQ ID NO: 1741904 - DNA, 20 bp, Homo sapiens
aaattctgcaagtttctgtt

SEQ ID NO: 1741905 - DNA, 14 bp, Homo sapiens
aaattctgccccca

SEQ ID NO: 1741906 - DNA, 14 bp, Homo sapiens
aaattctgtttctt

SEQ ID NO: 1741907 - DNA, 15 bp, Homo sapiens
aaattctgtttcttg

SEQ ID NO: 1741908 - DNA, 19 bp, Homo sapiens
aaattctgtttttaaaaat

SEQ ID NO: 1741909 - DNA, 19 bp, Homo sapiens
aaattcttatgttgaatat

SEQ ID NO: 1741910 - DNA, 17 bp, Homo sapiens
aaattctttagtactca

SEQ ID NO: 1741911 - DNA, 22 bp, Homo sapiens
aaattctttagtactcaatgtt

SEQ ID NO: 1741912 - DNA, 21 bp, Homo sapiens
aaattgaaaagttatttccct

SEQ ID NO: 1741913 - DNA, 15 bp, Homo sapiens
aaattgaaagaactt

SEQ ID NO: 1741914 - DNA, 21 bp, Homo sapiens
aaattgaataggtagtatcat

SEQ ID NO: 1741915 - DNA, 21 bp, Homo sapiens
aaattgatgtgtttatttata

SEQ ID NO: 1741916 - DNA, 18 bp, Homo sapiens
aaattgatttttctcttc

SEQ ID NO: 1741917 - DNA, 19 bp, Homo sapiens
aaattgatttttctcttca

SEQ ID NO: 1741918 - DNA, 15 bp, Homo sapiens
aaattgcagaattca

SEQ ID NO: 1741919 - DNA, 14 bp, Homo sapiens
aaattgcatacttt

SEQ ID NO: 1741920 - DNA, 18 bp, Homo sapiens
aaattgccctatgctgtg

SEQ ID NO: 1741921 - DNA, 12 bp, Homo sapiens
aaattgccttca

SEQ ID NO: 1741922 - DNA, 16 bp, Homo sapiens
aaattgcctttctgtg

SEQ ID NO: 1741923 - DNA, 21 bp, Homo sapiens
aaattgcctttctgtgtttat

SEQ ID NO: 1741924 - DNA, 17 bp, Homo sapiens
aaattgctatgttacta

SEQ ID NO: 1741925 - DNA, 20 bp, Homo sapiens
aaattgctattttatttgta

SEQ ID NO: 1741926 - DNA, 15 bp, Homo sapiens
aaattgctcacagtt

SEQ ID NO: 1741927 - DNA, 23 bp, Homo sapiens
aaattgctcacagttattacata

SEQ ID NO: 1741928 - DNA, 23 bp, Homo sapiens
aaattgctgtgctttatggatag

SEQ ID NO: 1741929 - DNA, 18 bp, Homo sapiens
aaattgcttactttggaa

SEQ ID NO: 1741930 - DNA, 18 bp, Homo sapiens
aaattgcttttgttgtga

SEQ ID NO: 1741931 - DNA, 23 bp, Homo sapiens
aaattgcttttgttgtgactttt

SEQ ID NO: 1741932 - DNA, 15 bp, Homo sapiens
aaattggcaccatgt

SEQ ID NO: 1741933 - DNA, 18 bp, Homo sapiens
aaattgggtgaagagctt

SEQ ID NO: 1741934 - DNA, 13 bp, Homo sapiens
aaattgtatattg

SEQ ID NO: 1741935 - DNA, 15 bp, Homo sapiens
aaattgtatattgta

SEQ ID NO: 1741936 - DNA, 15 bp, Homo sapiens
aaattgtatctcagt

SEQ ID NO: 1741937 - DNA, 13 bp, Homo sapiens
aaattgtatgaaa

SEQ ID NO: 1741938 - DNA, 23 bp, Homo sapiens
aaattgtttagtgatattacatt

SEQ ID NO: 1741939 - DNA, 20 bp, Homo sapiens
aaattgtttcttgacaagct

SEQ ID NO: 1741940 - DNA, 21 bp, Homo sapiens
aaattgtttggcttcctcctg

SEQ ID NO: 1741941 - DNA, 22 bp, Homo sapiens
aaattgtttggcttcctcctga

SEQ ID NO: 1741942 - DNA, 18 bp, Homo sapiens
aaattgttttcacttgta

SEQ ID NO: 1741943 - DNA, 19 bp, Homo sapiens
aaattgttttcacttgtat

SEQ ID NO: 1741944 - DNA, 16 bp, Homo sapiens
aaatttaaaaaataaa

SEQ ID NO: 1741945 - DNA, 21 bp, Homo sapiens
aaatttaaaatgttacttatt

SEQ ID NO: 1741946 - DNA, 23 bp, Homo sapiens
aaatttaaagggtgtacttatat

SEQ ID NO: 1741947 - DNA, 13 bp, Homo sapiens
aaatttaagcaaa

SEQ ID NO: 1741948 - DNA, 15 bp, Homo sapiens
aaatttaagtatctt

SEQ ID NO: 1741949 - DNA, 14 bp, Homo sapiens
aaatttaatatact

SEQ ID NO: 1741950 - DNA, 15 bp, Homo sapiens
aaatttaatgctgcc

SEQ ID NO: 1741951 - DNA, 18 bp, Homo sapiens
aaatttaattcatgtttc

SEQ ID NO: 1741952 - DNA, 17 bp, Homo sapiens
aaatttacatcatttct

SEQ ID NO: 1741953 - DNA, 19 bp, Homo sapiens
aaatttacatttaatacag

SEQ ID NO: 1741954 - DNA, 21 bp, Homo sapiens
aaatttactacaatatgtaca

SEQ ID NO: 1741955 - DNA, 23 bp, Homo sapiens
aaatttatggttttggtattttt

SEQ ID NO: 1741956 - DNA, 18 bp, Homo sapiens
aaatttatttatattccg

SEQ ID NO: 1741957 - DNA, 23 bp, Homo sapiens
aaatttattttataagaaaaact

SEQ ID NO: 1741958 - DNA, 16 bp, Homo sapiens
atcggggtagaaatgc

SEQ ID NO: 1741959 - DNA, 19 bp, Homo sapiens
atcggtgaaactaacagat

SEQ ID NO: 1741960 - DNA, 18 bp, Homo sapiens
atcgtagacacagggatg

SEQ ID NO: 1741961 - DNA, 16 bp, Homo sapiens
atcgtaggcagccacg

SEQ ID NO: 1741962 - DNA, 20 bp, Homo sapiens
atcgtaggcagccacggccc

SEQ ID NO: 1741963 - DNA, 22 bp, Homo sapiens
atcgtagtgtgtttaaataaac

SEQ ID NO: 1741964 - DNA, 17 bp, Homo sapiens
atcgtcatgcacagtat

SEQ ID NO: 1741965 - DNA, 22 bp, Homo sapiens
atcgtccaccccagtgtgcacg

SEQ ID NO: 1741966 - DNA, 21 bp, Homo sapiens
atcgtgtattgagatttctta

SEQ ID NO: 1741967 - DNA, 14 bp, Homo sapiens
atctaaaaatatac

SEQ ID NO: 1741968 - DNA, 23 bp, Homo sapiens
atctaaaaatatacatgtttatg

SEQ ID NO: 1741969 - DNA, 18 bp, Homo sapiens
atctaaaagctctgttcc

SEQ ID NO: 1741970 - DNA, 11 bp, Homo sapiens
atctaaaattt

SEQ ID NO: 1741971 - DNA, 18 bp, Homo sapiens
atctaaaatttaaaatta

SEQ ID NO: 1741972 - DNA, 16 bp, Homo sapiens
atctaaacgtggtcac

SEQ ID NO: 1741973 - DNA, 20 bp, Homo sapiens
atctaaccccttacccatct

SEQ ID NO: 1741974 - DNA, 15 bp, Homo sapiens
atctaaccctcccat

SEQ ID NO: 1741975 - DNA, 22 bp, Homo sapiens
atctaaccctcccatggcacct

SEQ ID NO: 1741976 - DNA, 13 bp, Homo sapiens
atctaataaactt

SEQ ID NO: 1741977 - DNA, 15 bp, Homo sapiens
atctaatacctctgt

SEQ ID NO: 1741978 - DNA, 17 bp, Homo sapiens
atctaatacctctgtgt

SEQ ID NO: 1741979 - DNA, 17 bp, Homo sapiens
atctaatatatatgaat

SEQ ID NO: 1741980 - DNA, 13 bp, Homo sapiens
atctaatatgaag

SEQ ID NO: 1741981 - DNA, 15 bp, Homo sapiens
atctaattctgattc

SEQ ID NO: 1741982 - DNA, 13 bp, Homo sapiens
atctaatttataa

SEQ ID NO: 1741983 - DNA, 14 bp, Homo sapiens
atctaatttataaa

SEQ ID NO: 1741984 - DNA, 15 bp, Homo sapiens
atctaatttataaaa

SEQ ID NO: 1741985 - DNA, 17 bp, Homo sapiens
atctacaatatatatta

SEQ ID NO: 1741986 - DNA, 20 bp, Homo sapiens
atctacaatcagttgacttt

SEQ ID NO: 1741987 - DNA, 14 bp, Homo sapiens
atctacacagcctg

SEQ ID NO: 1741988 - DNA, 18 bp, Homo sapiens
atctacacagcctggact

SEQ ID NO: 1741989 - DNA, 22 bp, Homo sapiens
atctacacagcctggactttgg

SEQ ID NO: 1741990 - DNA, 11 bp, Homo sapiens
atctacacatg

SEQ ID NO: 1741991 - DNA, 12 bp, Homo sapiens
atctacacatgt

SEQ ID NO: 1741992 - DNA, 16 bp, Homo sapiens
atctacaccaatgaaa

SEQ ID NO: 1741993 - DNA, 19 bp, Homo sapiens
atctacagaactacatatt

SEQ ID NO: 1741994 - DNA, 20 bp, Homo sapiens
atctacagaactacatattt

SEQ ID NO: 1741995 - DNA, 19 bp, Homo sapiens
atctacagtacttccagat

SEQ ID NO: 1741996 - DNA, 12 bp, Homo sapiens
atctacatttgt

SEQ ID NO: 1741997 - DNA, 17 bp, Homo sapiens
atctacatttgtttgta

SEQ ID NO: 1741998 - DNA, 18 bp, Homo sapiens
atctacatttgtttgtat

SEQ ID NO: 1741999 - DNA, 22 bp, Homo sapiens
atctaccccagactagatgtag

SEQ ID NO: 1742000 - DNA, 16 bp, Homo sapiens
atctactcagaaattt

SEQ ID NO: 1742001 - DNA, 16 bp, Homo sapiens
atctactctaaagaaa

SEQ ID NO: 1742002 - DNA, 17 bp, Homo sapiens
atctactctaaagaaaa

SEQ ID NO: 1742003 - DNA, 23 bp, Homo sapiens
atctacttctgtaattgtgtgga

SEQ ID NO: 1742004 - DNA, 14 bp, Homo sapiens
atctacttgcctca

SEQ ID NO: 1742005 - DNA, 17 bp, Homo sapiens
atctagaaagaaaagac

SEQ ID NO: 1742006 - DNA, 19 bp, Homo sapiens
atctagaagatgtgtaaac

SEQ ID NO: 1742007 - DNA, 16 bp, Homo sapiens
atctagagtttataca

SEQ ID NO: 1742008 - DNA, 23 bp, Homo sapiens
atctagagtttatacagtgtaca

SEQ ID NO: 1742009 - DNA, 15 bp, Homo sapiens
atctagcaagaagat

SEQ ID NO: 1742010 - DNA, 22 bp, Homo sapiens
atctagcaagaagattctaaaa

SEQ ID NO: 1742011 - DNA, 17 bp, Homo sapiens
atctagccgatggaaaa

SEQ ID NO: 1742012 - DNA, 15 bp, Homo sapiens
atctaggtgtggctg

SEQ ID NO: 1742013 - DNA, 20 bp, Homo sapiens
atctaggtgtggctgtgaag

SEQ ID NO: 1742014 - DNA, 18 bp, Homo sapiens
atctagtaatatatttaa

SEQ ID NO: 1742015 - DNA, 19 bp, Homo sapiens
atctagtaatatatttaaa

SEQ ID NO: 1742016 - DNA, 22 bp, Homo sapiens
atctagtaatatatttaaaggg

SEQ ID NO: 1742017 - DNA, 14 bp, Homo sapiens
atctagtatgaaat

SEQ ID NO: 1742018 - DNA, 15 bp, Homo sapiens
atctagtatgaaatt

SEQ ID NO: 1742019 - DNA, 19 bp, Homo sapiens
atctagtgggttgaccttt

SEQ ID NO: 1742020 - DNA, 11 bp, Homo sapiens
atctataaaat

SEQ ID NO: 1742021 - DNA, 14 bp, Homo sapiens
atctataaaataga

SEQ ID NO: 1742022 - DNA, 20 bp, Homo sapiens
atctataaaatagatataaa

SEQ ID NO: 1742023 - DNA, 22 bp, Homo sapiens
atctataagtagtaaatcagaa

SEQ ID NO: 1742024 - DNA, 16 bp, Homo sapiens
atctataatttaccta

SEQ ID NO: 1742025 - DNA, 14 bp, Homo sapiens
atctatatatataa

SEQ ID NO: 1742026 - DNA, 16 bp, Homo sapiens
atctatatatgtgtat

SEQ ID NO: 1742027 - DNA, 17 bp, Homo sapiens
atctatatatgtgtatg

SEQ ID NO: 1742028 - DNA, 19 bp, Homo sapiens
atctatatatgtgtatgta

SEQ ID NO: 1742029 - DNA, 12 bp, Homo sapiens
atctatattaga

SEQ ID NO: 1742030 - DNA, 18 bp, Homo sapiens
atctatatttgtcttccg

SEQ ID NO: 1742031 - DNA, 13 bp, Homo sapiens
atctatcacctgt

SEQ ID NO: 1742032 - DNA, 13 bp, Homo sapiens
atctatccctgcg

SEQ ID NO: 1742033 - DNA, 17 bp, Homo sapiens
atctatcgagtttgcaa

SEQ ID NO: 1742034 - DNA, 18 bp, Homo sapiens
atctatgaagtatataat

SEQ ID NO: 1742035 - DNA, 19 bp, Homo sapiens
atctatgaagtatataatg

SEQ ID NO: 1742036 - DNA, 23 bp, Homo sapiens
atctatgatgtttcttttgcaat

SEQ ID NO: 1742037 - DNA, 17 bp, Homo sapiens
atctatgccaaagatca

SEQ ID NO: 1742038 - DNA, 20 bp, Homo sapiens
atctatggcagtccagccag

SEQ ID NO: 1742039 - DNA, 21 bp, Homo sapiens
atctatggcagtccagccagc

SEQ ID NO: 1742040 - DNA, 21 bp, Homo sapiens
atctatggcttatttctatga

SEQ ID NO: 1742041 - DNA, 21 bp, Homo sapiens
atctattacttttgcaaactg

SEQ ID NO: 1742042 - DNA, 17 bp, Homo sapiens
atctattcagacaagca

SEQ ID NO: 1742043 - DNA, 22 bp, Homo sapiens
atctattcagacaagcaacagg

SEQ ID NO: 1742044 - DNA, 22 bp, Homo sapiens
atctattcctgtaaataagagt

SEQ ID NO: 1742045 - DNA, 22 bp, Homo sapiens
atctattctgagaaaacaagca

SEQ ID NO: 1742046 - DNA, 23 bp, Homo sapiens
atctattgcagagactcatttca

SEQ ID NO: 1742047 - DNA, 14 bp, Homo sapiens
atctattgctcatc

SEQ ID NO: 1742048 - DNA, 19 bp, Homo sapiens
atctattgtctacttgcga

SEQ ID NO: 1742049 - DNA, 15 bp, Homo sapiens
atctatttattaata

SEQ ID NO: 1742050 - DNA, 19 bp, Homo sapiens
atctatttcatgtttttga

SEQ ID NO: 1742051 - DNA, 15 bp, Homo sapiens
atctatttctgagaa

SEQ ID NO: 1742052 - DNA, 13 bp, Homo sapiens
atctatttgagag

SEQ ID NO: 1742053 - DNA, 12 bp, Homo sapiens
atctatttgtac

SEQ ID NO: 1742054 - DNA, 15 bp, Homo sapiens
atctatttgtacaat

SEQ ID NO: 1742055 - DNA, 16 bp, Homo sapiens
atctatttgtacaatt

SEQ ID NO: 1742056 - DNA, 14 bp, Homo sapiens
atctcaaaaaataa

SEQ ID NO: 1742057 - DNA, 13 bp, Homo sapiens
atctcaaaacaaa

SEQ ID NO: 1742058 - DNA, 14 bp, Homo sapiens
atctcaaaacaaaa

SEQ ID NO: 1742059 - DNA, 19 bp, Homo sapiens
atctcaaaggagaaaaaaa

SEQ ID NO: 1742060 - DNA, 21 bp, Homo sapiens
atctcaaataactaaaaggta

SEQ ID NO: 1742061 - DNA, 22 bp, Homo sapiens
atctcaagatgggggcagggct

SEQ ID NO: 1742062 - DNA, 19 bp, Homo sapiens
atctcaagtatatgtcatt

SEQ ID NO: 1742063 - DNA, 16 bp, Homo sapiens
atctcacaggctgaga

SEQ ID NO: 1742064 - DNA, 14 bp, Homo sapiens
atctcaccccatcc

SEQ ID NO: 1742065 - DNA, 23 bp, Homo sapiens
atctcaccccatcccacaccctg

SEQ ID NO: 1742066 - DNA, 16 bp, Homo sapiens
atctcacttagtcctt

SEQ ID NO: 1742067 - DNA, 15 bp, Homo sapiens
atctcagaaagtgcc

SEQ ID NO: 1742068 - DNA, 20 bp, Homo sapiens
atctcagaaagtgcctgaca

SEQ ID NO: 1742069 - DNA, 14 bp, Homo sapiens
atctcagagacagg

SEQ ID NO: 1742070 - DNA, 13 bp, Homo sapiens
atctcagctcact

SEQ ID NO: 1742071 - DNA, 13 bp, Homo sapiens
atctcagctttga

SEQ ID NO: 1742072 - DNA, 22 bp, Homo sapiens
atctcagctttgagaagccttc

SEQ ID NO: 1742073 - DNA, 12 bp, Homo sapiens
atctcaggagcc

SEQ ID NO: 1742074 - DNA, 22 bp, Homo sapiens
atctcagggaagcccagctcca

SEQ ID NO: 1742075 - DNA, 22 bp, Homo sapiens
atcctgagagacctgccctctc

SEQ ID NO: 1742076 - DNA, 16 bp, Homo sapiens
atcctgagccagggaa

SEQ ID NO: 1742077 - DNA, 12 bp, Homo sapiens
atcctgagccat

SEQ ID NO: 1742078 - DNA, 13 bp, Homo sapiens
atcctgattccaa

SEQ ID NO: 1742079 - DNA, 18 bp, Homo sapiens
atcctgattcctctctaa

SEQ ID NO: 1742080 - DNA, 20 bp, Homo sapiens
atcctgattcctctctaagt

SEQ ID NO: 1742081 - DNA, 14 bp, Homo sapiens
atcctgcaccccag

SEQ ID NO: 1742082 - DNA, 15 bp, Homo sapiens
atcctgcaccccagc

SEQ ID NO: 1742083 - DNA, 16 bp, Homo sapiens
atcctgcaccccagca

SEQ ID NO: 1742084 - DNA, 19 bp, Homo sapiens
atcctgcaggaacgagcac

SEQ ID NO: 1742085 - DNA, 23 bp, Homo sapiens
atcctgcaggaacgagcactggc

SEQ ID NO: 1742086 - DNA, 20 bp, Homo sapiens
atcctgcagggcttctcctc

SEQ ID NO: 1742087 - DNA, 13 bp, Homo sapiens
atcctgccattta

SEQ ID NO: 1742088 - DNA, 16 bp, Homo sapiens
atcctgccatttaaaa

SEQ ID NO: 1742089 - DNA, 22 bp, Homo sapiens
atcctgcccagtgttgtttgta

SEQ ID NO: 1742090 - DNA, 18 bp, Homo sapiens
atcctgctagctgtagaa

SEQ ID NO: 1742091 - DNA, 14 bp, Homo sapiens
atcctgctccagca

SEQ ID NO: 1742092 - DNA, 14 bp, Homo sapiens
atcctgctgacctc

SEQ ID NO: 1742093 - DNA, 11 bp, Homo sapiens
atcctgctggg

SEQ ID NO: 1742094 - DNA, 23 bp, Homo sapiens
atcctgctggggccgccacggcc

SEQ ID NO: 1742095 - DNA, 16 bp, Homo sapiens
atcctggagaagcctc

SEQ ID NO: 1742096 - DNA, 14 bp, Homo sapiens
atcctggaggccca

SEQ ID NO: 1742097 - DNA, 16 bp, Homo sapiens
atcctggaggcccagt

SEQ ID NO: 1742098 - DNA, 20 bp, Homo sapiens
atcctggaggcccagttcac

SEQ ID NO: 1742099 - DNA, 19 bp, Homo sapiens
atcctggaggtcttttcta

SEQ ID NO: 1742100 - DNA, 21 bp, Homo sapiens
atcctggaggtcttttctagt

SEQ ID NO: 1742101 - DNA, 23 bp, Homo sapiens
atcctggatgatttcatcttctg

SEQ ID NO: 1742102 - DNA, 20 bp, Homo sapiens
atcctggattcactcactca

SEQ ID NO: 1742103 - DNA, 21 bp, Homo sapiens
atcctggcacgccctactcca

SEQ ID NO: 1742104 - DNA, 11 bp, Homo sapiens
atcctggcagc

SEQ ID NO: 1742105 - DNA, 15 bp, Homo sapiens
atcctggcagcccag

SEQ ID NO: 1742106 - DNA, 19 bp, Homo sapiens
atcctggcagcccagagac

SEQ ID NO: 1742107 - DNA, 12 bp, Homo sapiens
atcctggccaac

SEQ ID NO: 1742108 - DNA, 15 bp, Homo sapiens
atcctggcccctcca

SEQ ID NO: 1742109 - DNA, 15 bp, Homo sapiens
atcctgggatgtaaa

SEQ ID NO: 1742110 - DNA, 16 bp, Homo sapiens
atcctggggccctcag

SEQ ID NO: 1742111 - DNA, 19 bp, Homo sapiens
atcctggtaaccaaatatt

SEQ ID NO: 1742112 - DNA, 14 bp, Homo sapiens
atcctggtcttttt

SEQ ID NO: 1742113 - DNA, 23 bp, Homo sapiens
atcctggtttcataacttcctgt

SEQ ID NO: 1742114 - DNA, 19 bp, Homo sapiens
atcctgtctttaaggaaaa

SEQ ID NO: 1742115 - DNA, 15 bp, Homo sapiens
atcctgtgacatgta

SEQ ID NO: 1742116 - DNA, 22 bp, Homo sapiens
atcctgtgagtaggctgggcct

SEQ ID NO: 1742117 - DNA, 18 bp, Homo sapiens
atcctgtgccagaggaag

SEQ ID NO: 1742118 - DNA, 23 bp, Homo sapiens
atcctgtgtaacacttggctctt

SEQ ID NO: 1742119 - DNA, 14 bp, Homo sapiens
atcctgtgtggaga

SEQ ID NO: 1742120 - DNA, 16 bp, Homo sapiens
atcctgtgtggagagg

SEQ ID NO: 1742121 - DNA, 19 bp, Homo sapiens
atcctgtgtggagagggaa

SEQ ID NO: 1742122 - DNA, 17 bp, Homo sapiens
atcctgttactctgtcc

SEQ ID NO: 1742123 - DNA, 22 bp, Homo sapiens
atcctgttacttgcttcagtgg

SEQ ID NO: 1742124 - DNA, 15 bp, Homo sapiens
atcctgttctgcgct

SEQ ID NO: 1742125 - DNA, 16 bp, Homo sapiens
atcctgttctgcgctg

SEQ ID NO: 1742126 - DNA, 18 bp, Homo sapiens
atcctgtttgtatgaaat

SEQ ID NO: 1742127 - DNA, 13 bp, Homo sapiens
atccttacaagtt

SEQ ID NO: 1742128 - DNA, 21 bp, Homo sapiens
atccttagaggtcctctggag

SEQ ID NO: 1742129 - DNA, 16 bp, Homo sapiens
atccttatctataaaa

SEQ ID NO: 1742130 - DNA, 17 bp, Homo sapiens
atccttatctataaaag

SEQ ID NO: 1742131 - DNA, 18 bp, Homo sapiens
atccttatctataaaagg

SEQ ID NO: 1742132 - DNA, 23 bp, Homo sapiens
atccttcaaggtggcagctgtta

SEQ ID NO: 1742133 - DNA, 20 bp, Homo sapiens
atccttcacaggcagtgcat

SEQ ID NO: 1742134 - DNA, 16 bp, Homo sapiens
atccttcaccagagcc

SEQ ID NO: 1742135 - DNA, 21 bp, Homo sapiens
atccttcaccagagcccatgc

SEQ ID NO: 1742136 - DNA, 14 bp, Homo sapiens
atccttcagcacag

SEQ ID NO: 1742137 - DNA, 14 bp, Homo sapiens
atccttccagtggc

SEQ ID NO: 1742138 - DNA, 17 bp, Homo sapiens
atccttccagtggctcg

SEQ ID NO: 1742139 - DNA, 23 bp, Homo sapiens
atccttccatcttgtggggccag

SEQ ID NO: 1742140 - DNA, 16 bp, Homo sapiens
atccttccattccaca

SEQ ID NO: 1742141 - DNA, 20 bp, Homo sapiens
atccttccattccacacaga

SEQ ID NO: 1742142 - DNA, 19 bp, Homo sapiens
atccttccccaacttccct

SEQ ID NO: 1742143 - DNA, 15 bp, Homo sapiens
atccttccctgctct

SEQ ID NO: 1742144 - DNA, 16 bp, Homo sapiens
atccttccctttggag

SEQ ID NO: 1742145 - DNA, 14 bp, Homo sapiens
atccttcctgggga

SEQ ID NO: 1742146 - DNA, 15 bp, Homo sapiens
atccttcctggggac

SEQ ID NO: 1742147 - DNA, 19 bp, Homo sapiens
atccttcgggtgctggaag

SEQ ID NO: 1742148 - DNA, 12 bp, Homo sapiens
atccttctagtt

SEQ ID NO: 1742149 - DNA, 13 bp, Homo sapiens
atccttctgagct

SEQ ID NO: 1742150 - DNA, 18 bp, Homo sapiens
atccttgctgcagcttct

SEQ ID NO: 1742151 - DNA, 17 bp, Homo sapiens
atccttggagtcccagg

SEQ ID NO: 1742152 - DNA, 18 bp, Homo sapiens
atccttggagtcccaggg

SEQ ID NO: 1742153 - DNA, 19 bp, Homo sapiens
atccttggctttcagagcc

SEQ ID NO: 1742154 - DNA, 12 bp, Homo sapiens
atccttgtcttt

SEQ ID NO: 1742155 - DNA, 21 bp, Homo sapiens
atccttgtcttttgagctatt

SEQ ID NO: 1742156 - DNA, 12 bp, Homo sapiens
atccttgtttca

SEQ ID NO: 1742157 - DNA, 14 bp, Homo sapiens
atcctttgttctga

SEQ ID NO: 1742158 - DNA, 19 bp, Homo sapiens
atcctttgttctgagcatt

SEQ ID NO: 1742159 - DNA, 14 bp, Homo sapiens
atccttttcctaat

SEQ ID NO: 1742160 - DNA, 21 bp, Homo sapiens
atccttttcctaattcacaca

SEQ ID NO: 1742161 - DNA, 21 bp, Homo sapiens
atccttttctcatttggggag

SEQ ID NO: 1742162 - DNA, 23 bp, Homo sapiens
atcgaagggtttttagagaatgt

SEQ ID NO: 1742163 - DNA, 11 bp, Homo sapiens
atcgagtgtag

SEQ ID NO: 1742164 - DNA, 19 bp, Homo sapiens
atcgagtgtagctgtgaaa

SEQ ID NO: 1742165 - DNA, 20 bp, Homo sapiens
atcgagtgtagctgtgaaat

SEQ ID NO: 1742166 - DNA, 12 bp, Homo sapiens
atcgatgtgctc

SEQ ID NO: 1742167 - DNA, 20 bp, Homo sapiens
atcgatttagtaagtatgtt

SEQ ID NO: 1742168 - DNA, 14 bp, Homo sapiens
atcgcaaggcctgt

SEQ ID NO: 1742169 - DNA, 20 bp, Homo sapiens
atcgcaccactgtgtattta

SEQ ID NO: 1742170 - DNA, 17 bp, Homo sapiens
atcgcaccattctgact

SEQ ID NO: 1742171 - DNA, 19 bp, Homo sapiens
atcgccagaggtgcttcac

SEQ ID NO: 1742172 - DNA, 20 bp, Homo sapiens
atcgccagaggtgcttcacc

SEQ ID NO: 1742173 - DNA, 18 bp, Homo sapiens
atcgccatcttcttccct

SEQ ID NO: 1742174 - DNA, 17 bp, Homo sapiens
atcgcccaggctggagc

SEQ ID NO: 1742175 - DNA, 15 bp, Homo sapiens
atcgccctcctttcc

SEQ ID NO: 1742176 - DNA, 17 bp, Homo sapiens
atcgccctcctttccct

SEQ ID NO: 1742177 - DNA, 13 bp, Homo sapiens
atcgctgatgcag

SEQ ID NO: 1742178 - DNA, 16 bp, Homo sapiens
atcgcttgagcccagg

SEQ ID NO: 1742179 - DNA, 17 bp, Homo sapiens
atcgcttgagcccagga

SEQ ID NO: 1742180 - DNA, 17 bp, Homo sapiens
atcgctttatgtttttg

SEQ ID NO: 1742181 - DNA, 17 bp, Homo sapiens
atcggacatagagttgg

SEQ ID NO: 1742182 - DNA, 16 bp, Homo sapiens
atcggagcctcctctc

SEQ ID NO: 1742183 - DNA, 17 bp, Homo sapiens
atcggaggcccatgccc

SEQ ID NO: 1742184 - DNA, 18 bp, Homo sapiens
atcggagtcagccaggag

SEQ ID NO: 1742185 - DNA, 23 bp, Homo sapiens
atcggccaagaatacttgaagaa

SEQ ID NO: 1742186 - DNA, 16 bp, Homo sapiens
atcggccacagggcgg

SEQ ID NO: 1742187 - DNA, 23 bp, Homo sapiens
atcggcccacagctcccacccca

SEQ ID NO: 1742188 - DNA, 15 bp, Homo sapiens
atcgggaacagtgtt

SEQ ID NO: 1742189 - DNA, 17 bp, Homo sapiens
atcgggaacagtgtttc

SEQ ID NO: 1742190 - DNA, 18 bp, Homo sapiens
atcgggagcacccagagc

SEQ ID NO: 1742191 - DNA, 17 bp, Homo sapiens
atcgggagcagtgtctt

SEQ ID NO: 1742192 - DNA, 16 bp, Homo sapiens
aaatttccagtacctt

SEQ ID NO: 1742193 - DNA, 23 bp, Homo sapiens
aaatttcccagttaaagattatt

SEQ ID NO: 1742194 - DNA, 17 bp, Homo sapiens
aaatttccttcaggttt

SEQ ID NO: 1742195 - DNA, 12 bp, Homo sapiens
aaatttcgttgt

SEQ ID NO: 1742196 - DNA, 16 bp, Homo sapiens
aaatttcgttgtccaa

SEQ ID NO: 1742197 - DNA, 11 bp, Homo sapiens
aaatttcttat

SEQ ID NO: 1742198 - DNA, 17 bp, Homo sapiens
aaatttgactaatttta

SEQ ID NO: 1742199 - DNA, 15 bp, Homo sapiens
aaatttgatgatgtt

SEQ ID NO: 1742200 - DNA, 15 bp, Homo sapiens
aaatttgatttccat

SEQ ID NO: 1742201 - DNA, 21 bp, Homo sapiens
aaatttggccttaagaactgt

SEQ ID NO: 1742202 - DNA, 23 bp, Homo sapiens
aaatttggccttaagaactgtgt

SEQ ID NO: 1742203 - DNA, 15 bp, Homo sapiens
aaatttggttctaat

SEQ ID NO: 1742204 - DNA, 12 bp, Homo sapiens
aaatttgtacag

SEQ ID NO: 1742205 - DNA, 12 bp, Homo sapiens
aaatttgtacta

SEQ ID NO: 1742206 - DNA, 18 bp, Homo sapiens
aaatttgttataatgaat

SEQ ID NO: 1742207 - DNA, 18 bp, Homo sapiens
aaatttgttgaaattatg

SEQ ID NO: 1742208 - DNA, 22 bp, Homo sapiens
aaatttgttttgacggatgatt

SEQ ID NO: 1742209 - DNA, 22 bp, Homo sapiens
aaattttaaagccattctgatt

SEQ ID NO: 1742210 - DNA, 14 bp, Homo sapiens
aaattttaatgtaa

SEQ ID NO: 1742211 - DNA, 11 bp, Homo sapiens
aaattttatgt

SEQ ID NO: 1742212 - DNA, 21 bp, Homo sapiens
aaattttatgtcatagaaata

SEQ ID NO: 1742213 - DNA, 13 bp, Homo sapiens
aaattttcagcat

SEQ ID NO: 1742214 - DNA, 15 bp, Homo sapiens
aaattttctccttgg

SEQ ID NO: 1742215 - DNA, 21 bp, Homo sapiens
aaattttcttcctttgaagct

SEQ ID NO: 1742216 - DNA, 22 bp, Homo sapiens
aaattttgcttttaattaaata

SEQ ID NO: 1742217 - DNA, 14 bp, Homo sapiens
aaattttgtaagaa

SEQ ID NO: 1742218 - DNA, 17 bp, Homo sapiens
aaattttgtttcagaat

SEQ ID NO: 1742219 - DNA, 16 bp, Homo sapiens
aaatttttatgtaaaa

SEQ ID NO: 1742220 - DNA, 17 bp, Homo sapiens
aaatttttcagatgctt

SEQ ID NO: 1742221 - DNA, 13 bp, Homo sapiens
aaatttttgcaaa

SEQ ID NO: 1742222 - DNA, 23 bp, Homo sapiens
aaattttttgactttttttgtat

SEQ ID NO: 1742223 - DNA, 14 bp, Homo sapiens
aacaaaaaatacat

SEQ ID NO: 1742224 - DNA, 15 bp, Homo sapiens
aacaaaacaaaacaa

SEQ ID NO: 1742225 - DNA, 21 bp, Homo sapiens
aacaaaaccaaaagttattaa

SEQ ID NO: 1742226 - DNA, 14 bp, Homo sapiens
aacaaaatacattc

SEQ ID NO: 1742227 - DNA, 23 bp, Homo sapiens
aacaaacactgcagtttcctgga

SEQ ID NO: 1742228 - DNA, 21 bp, Homo sapiens
aacaaacagaaacgagatttg

SEQ ID NO: 1742229 - DNA, 17 bp, Homo sapiens
aacaaacctcactgaga

SEQ ID NO: 1742230 - DNA, 17 bp, Homo sapiens
aacaaagaagacaacat

SEQ ID NO: 1742231 - DNA, 11 bp, Homo sapiens
aacaaagacat

SEQ ID NO: 1742232 - DNA, 20 bp, Homo sapiens
aacaaagacatgctttccat

SEQ ID NO: 1742233 - DNA, 19 bp, Homo sapiens
aacaaagacgggtattgtt

SEQ ID NO: 1742234 - DNA, 15 bp, Homo sapiens
aacaaagtactcttt

SEQ ID NO: 1742235 - DNA, 16 bp, Homo sapiens
aacaaataatcacatt

SEQ ID NO: 1742236 - DNA, 16 bp, Homo sapiens
aacaaatctaatctct

SEQ ID NO: 1742237 - DNA, 23 bp, Homo sapiens
aacaaatctaatctcttattcta

SEQ ID NO: 1742238 - DNA, 22 bp, Homo sapiens
aacaaatggagctttctgtata

SEQ ID NO: 1742239 - DNA, 17 bp, Homo sapiens
aacaaattctttagtac

SEQ ID NO: 1742240 - DNA, 21 bp, Homo sapiens
aacaaattctttagtactcaa

SEQ ID NO: 1742241 - DNA, 23 bp, Homo sapiens
aacaaattctttagtactcaatg

SEQ ID NO: 1742242 - DNA, 16 bp, Homo sapiens
aacaacaataataaag

SEQ ID NO: 1742243 - DNA, 12 bp, Homo sapiens
aacaacagcttc

SEQ ID NO: 1742244 - DNA, 14 bp, Homo sapiens
aacaacatgaaact

SEQ ID NO: 1742245 - DNA, 14 bp, Homo sapiens
aacaacctcaactg

SEQ ID NO: 1742246 - DNA, 13 bp, Homo sapiens
aacaaccttttac

SEQ ID NO: 1742247 - DNA, 12 bp, Homo sapiens
aacaactgggtc

SEQ ID NO: 1742248 - DNA, 14 bp, Homo sapiens
aacaacttggcatt

SEQ ID NO: 1742249 - DNA, 16 bp, Homo sapiens
aacaacttggcatttc

SEQ ID NO: 1742250 - DNA, 16 bp, Homo sapiens
aacaactttcacttct

SEQ ID NO: 1742251 - DNA, 20 bp, Homo sapiens
aacaactttcacttcttcct

SEQ ID NO: 1742252 - DNA, 13 bp, Homo sapiens
aacaagaaaacat

SEQ ID NO: 1742253 - DNA, 19 bp, Homo sapiens
aacaagaaatggatgtaag

SEQ ID NO: 1742254 - DNA, 21 bp, Homo sapiens
aacaagaagccacagacctag

SEQ ID NO: 1742255 - DNA, 13 bp, Homo sapiens
aacaagacagcct

SEQ ID NO: 1742256 - DNA, 22 bp, Homo sapiens
aacaagaccaccacttcgaaac

SEQ ID NO: 1742257 - DNA, 17 bp, Homo sapiens
aacaagaccgccccagg

SEQ ID NO: 1742258 - DNA, 22 bp, Homo sapiens
aacaagaccgccccagggctat

SEQ ID NO: 1742259 - DNA, 23 bp, Homo sapiens
aacaagacctcagtgccttcctg

SEQ ID NO: 1742260 - DNA, 19 bp, Homo sapiens
aacaagagcgaaactccgt

SEQ ID NO: 1742261 - DNA, 17 bp, Homo sapiens
aacaagaggggaaaaca

SEQ ID NO: 1742262 - DNA, 17 bp, Homo sapiens
aacaagatctttcagga

SEQ ID NO: 1742263 - DNA, 23 bp, Homo sapiens
aacaagcaatgatgacccactaa

SEQ ID NO: 1742264 - DNA, 23 bp, Homo sapiens
aacaagcatgatcttgttactgt

SEQ ID NO: 1742265 - DNA, 17 bp, Homo sapiens
aacaagcatgtctctct

SEQ ID NO: 1742266 - DNA, 14 bp, Homo sapiens
aacaagctgtgcag

SEQ ID NO: 1742267 - DNA, 14 bp, Homo sapiens
aacaaggaagccaa

SEQ ID NO: 1742268 - DNA, 19 bp, Homo sapiens
aacaaggaatgcctgtgcc

SEQ ID NO: 1742269 - DNA, 19 bp, Homo sapiens
aacaagggctgcaatgccc

SEQ ID NO: 1742270 - DNA, 12 bp, Homo sapiens
aacaaggtgtct

SEQ ID NO: 1742271 - DNA, 16 bp, Homo sapiens
aacaagtaagaaaaat

SEQ ID NO: 1742272 - DNA, 15 bp, Homo sapiens
aacaagtaatgtatt

SEQ ID NO: 1742273 - DNA, 18 bp, Homo sapiens
aacaagtcatttttgtat

SEQ ID NO: 1742274 - DNA, 21 bp, Homo sapiens
aacaagtcatttttgtatttt

SEQ ID NO: 1742275 - DNA, 17 bp, Homo sapiens
aacaagtgcctcctgga

SEQ ID NO: 1742276 - DNA, 14 bp, Homo sapiens
aacaagttgttaaa

SEQ ID NO: 1742277 - DNA, 18 bp, Homo sapiens
aacaagttgttaaaacat

SEQ ID NO: 1742278 - DNA, 22 bp, Homo sapiens
aacaagttgttaaaacatttaa

SEQ ID NO: 1742279 - DNA, 22 bp, Homo sapiens
aacaataaaaacaactttcact

SEQ ID NO: 1742280 - DNA, 16 bp, Homo sapiens
aacaataaaatttttt

SEQ ID NO: 1742281 - DNA, 16 bp, Homo sapiens
aacaataaacaggaat

SEQ ID NO: 1742282 - DNA, 13 bp, Homo sapiens
aacaataataaaa

SEQ ID NO: 1742283 - DNA, 15 bp, Homo sapiens
aacaataataaagat

SEQ ID NO: 1742284 - DNA, 19 bp, Homo sapiens
aacaataatatttcaagtg

SEQ ID NO: 1742285 - DNA, 18 bp, Homo sapiens
aacaataatgagagcaaa

SEQ ID NO: 1742286 - DNA, 15 bp, Homo sapiens
aacaatacaaatgga

SEQ ID NO: 1742287 - DNA, 16 bp, Homo sapiens
aacaatacaaatggat

SEQ ID NO: 1742288 - DNA, 15 bp, Homo sapiens
aacaatagtaactct

SEQ ID NO: 1742289 - DNA, 21 bp, Homo sapiens
aacaatatgtttgcaaacttg

SEQ ID NO: 1742290 - DNA, 16 bp, Homo sapiens
aacaatattactttgt

SEQ ID NO: 1742291 - DNA, 15 bp, Homo sapiens
aacaatctaacaata

SEQ ID NO: 1742292 - DNA, 19 bp, Homo sapiens
aacaatctaacaataatat

SEQ ID NO: 1742293 - DNA, 20 bp, Homo sapiens
aacaatctggaagaaaaaaa

SEQ ID NO: 1742294 - DNA, 14 bp, Homo sapiens
aacaatcttattcc

SEQ ID NO: 1742295 - DNA, 23 bp, Homo sapiens
aacaatcttattccgagcattcc

SEQ ID NO: 1742296 - DNA, 14 bp, Homo sapiens
aacaatgaagataa

SEQ ID NO: 1742297 - DNA, 14 bp, Homo sapiens
aacaatgatatatg

SEQ ID NO: 1742298 - DNA, 17 bp, Homo sapiens
aacaatggaaactgaat

SEQ ID NO: 1742299 - DNA, 17 bp, Homo sapiens
aacaatggggactttgt

SEQ ID NO: 1742300 - DNA, 13 bp, Homo sapiens
aacaatgtataaa

SEQ ID NO: 1742301 - DNA, 16 bp, Homo sapiens
aacaatgtataaagat

SEQ ID NO: 1742302 - DNA, 19 bp, Homo sapiens
aacaatgtataaagattgt

SEQ ID NO: 1742303 - DNA, 22 bp, Homo sapiens
aacaatgtataaagattgtact

SEQ ID NO: 1742304 - DNA, 22 bp, Homo sapiens
aacaatgttgtccaacaataaa

SEQ ID NO: 1742305 - DNA, 20 bp, Homo sapiens
aacaatgttgttttaagact

SEQ ID NO: 1742306 - DNA, 17 bp, Homo sapiens
aacaattgaagtaaact

SEQ ID NO: 1742307 - DNA, 23 bp, Homo sapiens
aacaattgaagtaaactttttgt

SEQ ID NO: 1742308 - DNA, 22 bp, Homo sapiens
aacaattgtcgaaaagagtctt

SEQ ID NO: 1742309 - DNA, 17 bp, Homo sapiens
ccagaacttagccttta

SEQ ID NO: 1742310 - DNA, 18 bp, Homo sapiens
ccagaagagcttgtcagc

SEQ ID NO: 1742311 - DNA, 18 bp, Homo sapiens
ccagaagatgccagcttc

SEQ ID NO: 1742312 - DNA, 15 bp, Homo sapiens
ccagaagcctctgcc

SEQ ID NO: 1742313 - DNA, 15 bp, Homo sapiens
ccagaagcctctggc

SEQ ID NO: 1742314 - DNA, 19 bp, Homo sapiens
ccagaagcctctggctaga

SEQ ID NO: 1742315 - DNA, 17 bp, Homo sapiens
ccagaaggagggcagag

SEQ ID NO: 1742316 - DNA, 22 bp, Homo sapiens
ccagaaggagggcagagccatg

SEQ ID NO: 1742317 - DNA, 17 bp, Homo sapiens
ccagaatactgggttct

SEQ ID NO: 1742318 - DNA, 23 bp, Homo sapiens
ccagaatccataaatgtgttcct

SEQ ID NO: 1742319 - DNA, 17 bp, Homo sapiens
ccagaatctgctgttgc

SEQ ID NO: 1742320 - DNA, 19 bp, Homo sapiens
ccagaatcttgactttctg

SEQ ID NO: 1742321 - DNA, 18 bp, Homo sapiens
ccagacaaaatttgagaa

SEQ ID NO: 1742322 - DNA, 15 bp, Homo sapiens
ccagacacatgggct

SEQ ID NO: 1742323 - DNA, 14 bp, Homo sapiens
ccagacacccagga

SEQ ID NO: 1742324 - DNA, 18 bp, Homo sapiens
ccagacatacgaaacaca

SEQ ID NO: 1742325 - DNA, 20 bp, Homo sapiens
ccagacatacgaaacacaaa

SEQ ID NO: 1742326 - DNA, 14 bp, Homo sapiens
ccagacatgccaca

SEQ ID NO: 1742327 - DNA, 22 bp, Homo sapiens
ccagaccaggaaaggcttggct

SEQ ID NO: 1742328 - DNA, 14 bp, Homo sapiens
ccagacccactgaa

SEQ ID NO: 1742329 - DNA, 17 bp, Homo sapiens
ccagacccactgaaatg

SEQ ID NO: 1742330 - DNA, 23 bp, Homo sapiens
ccagacccctctggccaggatgg

SEQ ID NO: 1742331 - DNA, 14 bp, Homo sapiens
ccagacccctggct

SEQ ID NO: 1742332 - DNA, 17 bp, Homo sapiens
ccagacccctggctttt

SEQ ID NO: 1742333 - DNA, 17 bp, Homo sapiens
ccagaccctgcctgagc

SEQ ID NO: 1742334 - DNA, 19 bp, Homo sapiens
ccagaccctgcctgagccc

SEQ ID NO: 1742335 - DNA, 21 bp, Homo sapiens
ccagaccctgcctgagcccag

SEQ ID NO: 1742336 - DNA, 14 bp, Homo sapiens
ccagaccctgggca

SEQ ID NO: 1742337 - DNA, 16 bp, Homo sapiens
ccagacctgatcctgg

SEQ ID NO: 1742338 - DNA, 19 bp, Homo sapiens
ccagacctgatcctggagg

SEQ ID NO: 1742339 - DNA, 19 bp, Homo sapiens
ccagacctggctccactct

SEQ ID NO: 1742340 - DNA, 15 bp, Homo sapiens
ccagacctgtcgtct

SEQ ID NO: 1742341 - DNA, 18 bp, Homo sapiens
ccagactagatgtagtat

SEQ ID NO: 1742342 - DNA, 22 bp, Homo sapiens
ccagactagatgtagtattttt

SEQ ID NO: 1742343 - DNA, 20 bp, Homo sapiens
ccagactatcgtaacctggt

SEQ ID NO: 1742344 - DNA, 20 bp, Homo sapiens
ccagactcagagaccgtgag

SEQ ID NO: 1742345 - DNA, 14 bp, Homo sapiens
ccagactcaggttc

SEQ ID NO: 1742346 - DNA, 13 bp, Homo sapiens
ccagactggaaga

SEQ ID NO: 1742347 - DNA, 17 bp, Homo sapiens
ccagactggaagacact

SEQ ID NO: 1742348 - DNA, 16 bp, Homo sapiens
ccagactgggcccagg

SEQ ID NO: 1742349 - DNA, 17 bp, Homo sapiens
ccagactgggcccaggc

SEQ ID NO: 1742350 - DNA, 19 bp, Homo sapiens
ccagagaaaggggagccca

SEQ ID NO: 1742351 - DNA, 20 bp, Homo sapiens
ccagagaagctggaagcctg

SEQ ID NO: 1742352 - DNA, 20 bp, Homo sapiens
ccagagaaggacggtgccaa

SEQ ID NO: 1742353 - DNA, 21 bp, Homo sapiens
ccagagaaggacggtgccaag

SEQ ID NO: 1742354 - DNA, 12 bp, Homo sapiens
ccagagacagga

SEQ ID NO: 1742355 - DNA, 21 bp, Homo sapiens
ccagagacagggaaaggtcag

SEQ ID NO: 1742356 - DNA, 22 bp, Homo sapiens
ccagagacatacttgaagggcc

SEQ ID NO: 1742357 - DNA, 23 bp, Homo sapiens
ccagagacatacttgaagggcca

SEQ ID NO: 1742358 - DNA, 21 bp, Homo sapiens
ccagagacatgggcctcccac

SEQ ID NO: 1742359 - DNA, 20 bp, Homo sapiens
ccagagaccaggctgtgtcc

SEQ ID NO: 1742360 - DNA, 20 bp, Homo sapiens
ccagagacccaacagcagtg

SEQ ID NO: 1742361 - DNA, 16 bp, Homo sapiens
ccagagactttgtaga

SEQ ID NO: 1742362 - DNA, 17 bp, Homo sapiens
ccagagagagcaaggaa

SEQ ID NO: 1742363 - DNA, 18 bp, Homo sapiens
ccagagagaggggcctgc

SEQ ID NO: 1742364 - DNA, 19 bp, Homo sapiens
ccagagagaggggcctgca

SEQ ID NO: 1742365 - DNA, 22 bp, Homo sapiens
ccagagagaggggcctgcaggt

SEQ ID NO: 1742366 - DNA, 15 bp, Homo sapiens
ccagagaggagcacc

SEQ ID NO: 1742367 - DNA, 20 bp, Homo sapiens
ccagagaggagcacctgaac

SEQ ID NO: 1742368 - DNA, 13 bp, Homo sapiens
ccagagagggccc

SEQ ID NO: 1742369 - DNA, 16 bp, Homo sapiens
ccagagagggcccagc

SEQ ID NO: 1742370 - DNA, 18 bp, Homo sapiens
ccagagagggcccagctg

SEQ ID NO: 1742371 - DNA, 19 bp, Homo sapiens
ccagagagggcccagctgt

SEQ ID NO: 1742372 - DNA, 21 bp, Homo sapiens
ccagagagggcccagctgtag

SEQ ID NO: 1742373 - DNA, 17 bp, Homo sapiens
ccagagaggggctgctc

SEQ ID NO: 1742374 - DNA, 15 bp, Homo sapiens
ccagagagtggctcc

SEQ ID NO: 1742375 - DNA, 16 bp, Homo sapiens
ccagagagtggctcct

SEQ ID NO: 1742376 - DNA, 18 bp, Homo sapiens
ccagagagtggctcctcc

SEQ ID NO: 1742377 - DNA, 20 bp, Homo sapiens
ccagagatccaaaagaagcc

SEQ ID NO: 1742378 - DNA, 14 bp, Homo sapiens
ccagagatgcctcc

SEQ ID NO: 1742379 - DNA, 16 bp, Homo sapiens
ccagagatgcctccac

SEQ ID NO: 1742380 - DNA, 18 bp, Homo sapiens
ccagagatgcctccaccg

SEQ ID NO: 1742381 - DNA, 13 bp, Homo sapiens
ccagagcaaaata

SEQ ID NO: 1742382 - DNA, 21 bp, Homo sapiens
ccagagcaggaggcccctggc

SEQ ID NO: 1742383 - DNA, 17 bp, Homo sapiens
ccagagccaacctggac

SEQ ID NO: 1742384 - DNA, 19 bp, Homo sapiens
ccagagccaacctggactt

SEQ ID NO: 1742385 - DNA, 22 bp, Homo sapiens
ccagagccaacctggacttcct

SEQ ID NO: 1742386 - DNA, 20 bp, Homo sapiens
ccagagccagatgcaggaca

SEQ ID NO: 1742387 - DNA, 23 bp, Homo sapiens
ccagagccagatgcaggacagga

SEQ ID NO: 1742388 - DNA, 13 bp, Homo sapiens
ccagagccagcct

SEQ ID NO: 1742389 - DNA, 16 bp, Homo sapiens
ccagagccagcctggg

SEQ ID NO: 1742390 - DNA, 18 bp, Homo sapiens
ccagagccagcctgggac

SEQ ID NO: 1742391 - DNA, 12 bp, Homo sapiens
ccagagccaggg

SEQ ID NO: 1742392 - DNA, 14 bp, Homo sapiens
ccagagcccagctc

SEQ ID NO: 1742393 - DNA, 16 bp, Homo sapiens
ccagagcccagctctt

SEQ ID NO: 1742394 - DNA, 14 bp, Homo sapiens
ccagagccccacac

SEQ ID NO: 1742395 - DNA, 16 bp, Homo sapiens
ccagagccgggaggaa

SEQ ID NO: 1742396 - DNA, 21 bp, Homo sapiens
ccagagcctctgctggaaggg

SEQ ID NO: 1742397 - DNA, 17 bp, Homo sapiens
ccagagccttcaagtgc

SEQ ID NO: 1742398 - DNA, 19 bp, Homo sapiens
ccagagccttcaagtgcca

SEQ ID NO: 1742399 - DNA, 18 bp, Homo sapiens
ccagagctcatcccccct

SEQ ID NO: 1742400 - DNA, 23 bp, Homo sapiens
ccagagctcatcccccctgctgc

SEQ ID NO: 1742401 - DNA, 13 bp, Homo sapiens
ccagagctggaag

SEQ ID NO: 1742402 - DNA, 21 bp, Homo sapiens
ccagagctggaaggcagggca

SEQ ID NO: 1742403 - DNA, 15 bp, Homo sapiens
ccagagctgtgccag

SEQ ID NO: 1742404 - DNA, 18 bp, Homo sapiens
ccagagctgtgcctgctc

SEQ ID NO: 1742405 - DNA, 23 bp, Homo sapiens
ccagagctgtgcctgctcagcag

SEQ ID NO: 1742406 - DNA, 20 bp, Homo sapiens
ccagagctgtttatggcctc

SEQ ID NO: 1742407 - DNA, 23 bp, Homo sapiens
ccagagctgtttatggcctcagc

SEQ ID NO: 1742408 - DNA, 24 bp, Homo sapiens
ccagagctgtttatggcctcagct

SEQ ID NO: 1742409 - DNA, 18 bp, Homo sapiens
ccagagcttattggccac

SEQ ID NO: 1742410 - DNA, 21 bp, Homo sapiens
ccagagcttattggccactgg

SEQ ID NO: 1742411 - DNA, 14 bp, Homo sapiens
ccagagcttctctg

SEQ ID NO: 1742412 - DNA, 19 bp, Homo sapiens
ccagagcttctctgggctg

SEQ ID NO: 1742413 - DNA, 22 bp, Homo sapiens
ccagagcttctctgggctgaat

SEQ ID NO: 1742414 - DNA, 19 bp, Homo sapiens
ccagagctttgttttatat

SEQ ID NO: 1742415 - DNA, 12 bp, Homo sapiens
ccagaggaagcc

SEQ ID NO: 1742416 - DNA, 19 bp, Homo sapiens
ccagaggaatcctggcagc

SEQ ID NO: 1742417 - DNA, 23 bp, Homo sapiens
ccagaggaatcctggcagcccag

SEQ ID NO: 1742418 - DNA, 20 bp, Homo sapiens
ccagaggagctgggagccgg

SEQ ID NO: 1742419 - DNA, 20 bp, Homo sapiens
ccagaggatgctctttccca

SEQ ID NO: 1742420 - DNA, 23 bp, Homo sapiens
ccagaggatgctctttcccagga

SEQ ID NO: 1742421 - DNA, 13 bp, Homo sapiens
ccagaggcagagg

SEQ ID NO: 1742422 - DNA, 15 bp, Homo sapiens
ccagaggcagaggtt

SEQ ID NO: 1742423 - DNA, 14 bp, Homo sapiens
ccagaggcccccag

SEQ ID NO: 1742424 - DNA, 22 bp, Homo sapiens
aacaattgtgtagcctttttgt

SEQ ID NO: 1742425 - DNA, 23 bp, Homo sapiens
aacaattttaggaggaccagagc

SEQ ID NO: 1742426 - DNA, 20 bp, Homo sapiens
aacacaaaatccatgggcag

SEQ ID NO: 1742427 - DNA, 14 bp, Homo sapiens
aacacaaaggaagt

SEQ ID NO: 1742428 - DNA, 20 bp, Homo sapiens
aacacaattgatacttcagg

SEQ ID NO: 1742429 - DNA, 21 bp, Homo sapiens
aacacacaggtgcaacagact

SEQ ID NO: 1742430 - DNA, 15 bp, Homo sapiens
aacacacctctgcca

SEQ ID NO: 1742431 - DNA, 20 bp, Homo sapiens
aacacacgagcaaacccaga

SEQ ID NO: 1742432 - DNA, 16 bp, Homo sapiens
aacacactgtgtcctg

SEQ ID NO: 1742433 - DNA, 21 bp, Homo sapiens
aacacactgtgtcctggtgct

SEQ ID NO: 1742434 - DNA, 19 bp, Homo sapiens
aacacagataattttttct

SEQ ID NO: 1742435 - DNA, 18 bp, Homo sapiens
aacacagcaagggtgatg

SEQ ID NO: 1742436 - DNA, 17 bp, Homo sapiens
aacacagctgttcttct

SEQ ID NO: 1742437 - DNA, 18 bp, Homo sapiens
aacacagctgttcttctg

SEQ ID NO: 1742438 - DNA, 22 bp, Homo sapiens
aacacagtcattctaggatgtg

SEQ ID NO: 1742439 - DNA, 20 bp, Homo sapiens
aacacagttttgaaagaaaa

SEQ ID NO: 1742440 - DNA, 17 bp, Homo sapiens
aacacataattaacact

SEQ ID NO: 1742441 - DNA, 18 bp, Homo sapiens
aacacataattaacactt

SEQ ID NO: 1742442 - DNA, 16 bp, Homo sapiens
aacacatcagcttgcc

SEQ ID NO: 1742443 - DNA, 21 bp, Homo sapiens
aacacattatcgggagcagtg

SEQ ID NO: 1742444 - DNA, 19 bp, Homo sapiens
aacacattcttattgacaa

SEQ ID NO: 1742445 - DNA, 22 bp, Homo sapiens
aacacatttctttttaaaaaaa

SEQ ID NO: 1742446 - DNA, 15 bp, Homo sapiens
aacaccaaaaaatat

SEQ ID NO: 1742447 - DNA, 13 bp, Homo sapiens
aacaccacagaca

SEQ ID NO: 1742448 - DNA, 13 bp, Homo sapiens
aacaccaggactt

SEQ ID NO: 1742449 - DNA, 23 bp, Homo sapiens
aacaccatggagatgaaatgcct

SEQ ID NO: 1742450 - DNA, 14 bp, Homo sapiens
aacaccccgcctgc

SEQ ID NO: 1742451 - DNA, 18 bp, Homo sapiens
aacaccccgcctgcctcc

SEQ ID NO: 1742452 - DNA, 21 bp, Homo sapiens
aacaccccgcctgcctcctgg

SEQ ID NO: 1742453 - DNA, 15 bp, Homo sapiens
aacacccttagaaaa

SEQ ID NO: 1742454 - DNA, 19 bp, Homo sapiens
aacacctgggcttaagaaa

SEQ ID NO: 1742455 - DNA, 15 bp, Homo sapiens
aacacgaaagaaatg

SEQ ID NO: 1742456 - DNA, 22 bp, Homo sapiens
aacacgccttgttcctgctctt

SEQ ID NO: 1742457 - DNA, 14 bp, Homo sapiens
aacacgctgcctgg

SEQ ID NO: 1742458 - DNA, 18 bp, Homo sapiens
aacacgctgcctggtctg

SEQ ID NO: 1742459 - DNA, 16 bp, Homo sapiens
aacacgtgtctataat

SEQ ID NO: 1742460 - DNA, 13 bp, Homo sapiens
aacactaaacatt

SEQ ID NO: 1742461 - DNA, 20 bp, Homo sapiens
aacactaaagatccaagaag

SEQ ID NO: 1742462 - DNA, 18 bp, Homo sapiens
aacactaactcaccagcc

SEQ ID NO: 1742463 - DNA, 14 bp, Homo sapiens
aacactaatatatt

SEQ ID NO: 1742464 - DNA, 14 bp, Homo sapiens
aacactaattcata

SEQ ID NO: 1742465 - DNA, 15 bp, Homo sapiens
aacactaattcataa

SEQ ID NO: 1742466 - DNA, 17 bp, Homo sapiens
aacactaattcataatc

SEQ ID NO: 1742467 - DNA, 23 bp, Homo sapiens
aacactactgctaaatcctcatg

SEQ ID NO: 1742468 - DNA, 14 bp, Homo sapiens
aacactacttccct

SEQ ID NO: 1742469 - DNA, 15 bp, Homo sapiens
aacactataaaggtt

SEQ ID NO: 1742470 - DNA, 19 bp, Homo sapiens
aacactattgtaatcattt

SEQ ID NO: 1742471 - DNA, 17 bp, Homo sapiens
aacactcagtccactgt

SEQ ID NO: 1742472 - DNA, 21 bp, Homo sapiens
aacactccccattaacagatg

SEQ ID NO: 1742473 - DNA, 13 bp, Homo sapiens
aacactcctctgc

SEQ ID NO: 1742474 - DNA, 13 bp, Homo sapiens
aacactctatatt

SEQ ID NO: 1742475 - DNA, 14 bp, Homo sapiens
aacactgcaagaag

SEQ ID NO: 1742476 - DNA, 16 bp, Homo sapiens
aacactgcaagaagtc

SEQ ID NO: 1742477 - DNA, 18 bp, Homo sapiens
aacactgcagccctctcc

SEQ ID NO: 1742478 - DNA, 16 bp, Homo sapiens
aacactgcagtttcct

SEQ ID NO: 1742479 - DNA, 18 bp, Homo sapiens
aacactgcagtttcctgg

SEQ ID NO: 1742480 - DNA, 22 bp, Homo sapiens
aacactgccatcttagtttgga

SEQ ID NO: 1742481 - DNA, 15 bp, Homo sapiens
aacactgccttttta

SEQ ID NO: 1742482 - DNA, 16 bp, Homo sapiens
aacactgggggagggg

SEQ ID NO: 1742483 - DNA, 15 bp, Homo sapiens
aacactgtccttccc

SEQ ID NO: 1742484 - DNA, 16 bp, Homo sapiens
aacactgtccttccct

SEQ ID NO: 1742485 - DNA, 18 bp, Homo sapiens
aacactgtccttccctgc

SEQ ID NO: 1742486 - DNA, 13 bp, Homo sapiens
aacactgtgccct

SEQ ID NO: 1742487 - DNA, 12 bp, Homo sapiens
aacactgttatc

SEQ ID NO: 1742488 - DNA, 21 bp, Homo sapiens
aacactgttatcattttttcc

SEQ ID NO: 1742489 - DNA, 17 bp, Homo sapiens
aacactgttttatagaa

SEQ ID NO: 1742490 - DNA, 14 bp, Homo sapiens
aacacttaaatttc

SEQ ID NO: 1742491 - DNA, 16 bp, Homo sapiens
aacacttaaatttctt

SEQ ID NO: 1742492 - DNA, 17 bp, Homo sapiens
aacacttatcttctgga

SEQ ID NO: 1742493 - DNA, 18 bp, Homo sapiens
aacacttatcttctggat

SEQ ID NO: 1742494 - DNA, 17 bp, Homo sapiens
aacacttattttctgaa

SEQ ID NO: 1742495 - DNA, 11 bp, Homo sapiens
aacacttccag

SEQ ID NO: 1742496 - DNA, 20 bp, Homo sapiens
aacacttctcatcatattgt

SEQ ID NO: 1742497 - DNA, 13 bp, Homo sapiens
aacacttctgctt

SEQ ID NO: 1742498 - DNA, 14 bp, Homo sapiens
aacacttctgcttt

SEQ ID NO: 1742499 - DNA, 19 bp, Homo sapiens
aacacttggcatacaaaat

SEQ ID NO: 1742500 - DNA, 16 bp, Homo sapiens
aacacttgtgactttt

SEQ ID NO: 1742501 - DNA, 14 bp, Homo sapiens
aacactttgctttc

SEQ ID NO: 1742502 - DNA, 16 bp, Homo sapiens
aacactttgtattact

SEQ ID NO: 1742503 - DNA, 12 bp, Homo sapiens
aacacttttcaa

SEQ ID NO: 1742504 - DNA, 14 bp, Homo sapiens
aacagaaaacatcc

SEQ ID NO: 1742505 - DNA, 14 bp, Homo sapiens
aacagaaaacattc

SEQ ID NO: 1742506 - DNA, 19 bp, Homo sapiens
aacagaaagttggaaagga

SEQ ID NO: 1742507 - DNA, 20 bp, Homo sapiens
aacagaacatcattagaaca

SEQ ID NO: 1742508 - DNA, 19 bp, Homo sapiens
aacagaagcagcaaatgaa

SEQ ID NO: 1742509 - DNA, 22 bp, Homo sapiens
aacagaagctcttactctttcc

SEQ ID NO: 1742510 - DNA, 14 bp, Homo sapiens
aacagaagcttcca

SEQ ID NO: 1742511 - DNA, 21 bp, Homo sapiens
aacagaagtgacttctggaga

SEQ ID NO: 1742512 - DNA, 13 bp, Homo sapiens
aacagaagtggtt

SEQ ID NO: 1742513 - DNA, 17 bp, Homo sapiens
aacagaatcttctgggt

SEQ ID NO: 1742514 - DNA, 15 bp, Homo sapiens
aacagaatttgagaa

SEQ ID NO: 1742515 - DNA, 18 bp, Homo sapiens
aacagacaaaaacagcct

SEQ ID NO: 1742516 - DNA, 11 bp, Homo sapiens
aacagacaagt

SEQ ID NO: 1742517 - DNA, 22 bp, Homo sapiens
agagggactgttcttttgtccc

SEQ ID NO: 1742518 - DNA, 19 bp, Homo sapiens
agagggagaagggatggag

SEQ ID NO: 1742519 - DNA, 24 bp, Homo sapiens
agagggaggagaatgagcctcggc

SEQ ID NO: 1742520 - DNA, 18 bp, Homo sapiens
agagggcaaacccaaaac

SEQ ID NO: 1742521 - DNA, 20 bp, Homo sapiens
agagggcaatctttgccttt

SEQ ID NO: 1742522 - DNA, 18 bp, Homo sapiens
agagggcagactgtgaac

SEQ ID NO: 1742523 - DNA, 11 bp, Homo sapiens
agagggcaggg

SEQ ID NO: 1742524 - DNA, 12 bp, Homo sapiens
agagggcagggg

SEQ ID NO: 1742525 - DNA, 16 bp, Homo sapiens
agagggcagtacctgg

SEQ ID NO: 1742526 - DNA, 15 bp, Homo sapiens
agagggccagcaggc

SEQ ID NO: 1742527 - DNA, 19 bp, Homo sapiens
agagggccagcaggctcct

SEQ ID NO: 1742528 - DNA, 17 bp, Homo sapiens
agagggcccagcccaga

SEQ ID NO: 1742529 - DNA, 19 bp, Homo sapiens
agagggcccagcccagagc

SEQ ID NO: 1742530 - DNA, 16 bp, Homo sapiens
agagggcccagctgta

SEQ ID NO: 1742531 - DNA, 18 bp, Homo sapiens
agagggcccatcaggcag

SEQ ID NO: 1742532 - DNA, 17 bp, Homo sapiens
agagggcctctgcctgg

SEQ ID NO: 1742533 - DNA, 20 bp, Homo sapiens
agagggctcgaggggtgggc

SEQ ID NO: 1742534 - DNA, 12 bp, Homo sapiens
agagggctggag

SEQ ID NO: 1742535 - DNA, 20 bp, Homo sapiens
agagggctggtccttattta

SEQ ID NO: 1742536 - DNA, 21 bp, Homo sapiens
agagggctgttggacagctgc

SEQ ID NO: 1742537 - DNA, 22 bp, Homo sapiens
agaggggaaaccagtgtagcct

SEQ ID NO: 1742538 - DNA, 16 bp, Homo sapiens
agaggggaagggccag

SEQ ID NO: 1742539 - DNA, 18 bp, Homo sapiens
agaggggcagcccttgct

SEQ ID NO: 1742540 - DNA, 14 bp, Homo sapiens
agaggggcagccgc

SEQ ID NO: 1742541 - DNA, 15 bp, Homo sapiens
agaggggcagccgct

SEQ ID NO: 1742542 - DNA, 20 bp, Homo sapiens
agaggggcagccgctaggag

SEQ ID NO: 1742543 - DNA, 18 bp, Homo sapiens
agaggggctttctggaga

SEQ ID NO: 1742544 - DNA, 19 bp, Homo sapiens
agagggggagtagccaagc

SEQ ID NO: 1742545 - DNA, 13 bp, Homo sapiens
agagggggctctc

SEQ ID NO: 1742546 - DNA, 14 bp, Homo sapiens
agagggggctctcc

SEQ ID NO: 1742547 - DNA, 15 bp, Homo sapiens
agaggggtgcaccca

SEQ ID NO: 1742548 - DNA, 15 bp, Homo sapiens
agagggtgcagtcca

SEQ ID NO: 1742549 - DNA, 15 bp, Homo sapiens
agaggtaccctgggt

SEQ ID NO: 1742550 - DNA, 17 bp, Homo sapiens
agaggtatttatcttta

SEQ ID NO: 1742551 - DNA, 18 bp, Homo sapiens
agaggtcctctggagccc

SEQ ID NO: 1742552 - DNA, 23 bp, Homo sapiens
agaggtcgcagctaccctcagcc

SEQ ID NO: 1742553 - DNA, 12 bp, Homo sapiens
agaggtctgagc

SEQ ID NO: 1742554 - DNA, 13 bp, Homo sapiens
agaggtctgagcc

SEQ ID NO: 1742555 - DNA, 15 bp, Homo sapiens
agaggtctgattggc

SEQ ID NO: 1742556 - DNA, 20 bp, Homo sapiens
agaggtctgattggctgctt

SEQ ID NO: 1742557 - DNA, 19 bp, Homo sapiens
agaggtctgtgctgaggcc

SEQ ID NO: 1742558 - DNA, 18 bp, Homo sapiens
agaggtgagaaaactcaa

SEQ ID NO: 1742559 - DNA, 19 bp, Homo sapiens
agaggtggaggttgcagtg

SEQ ID NO: 1742560 - DNA, 14 bp, Homo sapiens
agaggtggatgtta

SEQ ID NO: 1742561 - DNA, 23 bp, Homo sapiens
agaggtggatgttatgaacagct

SEQ ID NO: 1742562 - DNA, 19 bp, Homo sapiens
agaggtgggatcctccctc

SEQ ID NO: 1742563 - DNA, 20 bp, Homo sapiens
agaggtgggatcctccctca

SEQ ID NO: 1742564 - DNA, 21 bp, Homo sapiens
agaggtgggatcctccctcat

SEQ ID NO: 1742565 - DNA, 18 bp, Homo sapiens
agaggtgggcagctgggc

SEQ ID NO: 1742566 - DNA, 20 bp, Homo sapiens
agaggtgggcagctgggccc

SEQ ID NO: 1742567 - DNA, 13 bp, Homo sapiens
agaggtgggcagg

SEQ ID NO: 1742568 - DNA, 20 bp, Homo sapiens
agaggttgtagtgagccaag

SEQ ID NO: 1742569 - DNA, 17 bp, Homo sapiens
agagtaagtattatgcc

SEQ ID NO: 1742570 - DNA, 18 bp, Homo sapiens
agagtaatgggtttcata

SEQ ID NO: 1742571 - DNA, 17 bp, Homo sapiens
agagtagccgagagcct

SEQ ID NO: 1742572 - DNA, 18 bp, Homo sapiens
agagtagccgagagcctg

SEQ ID NO: 1742573 - DNA, 15 bp, Homo sapiens
agagtagttagagaa

SEQ ID NO: 1742574 - DNA, 21 bp, Homo sapiens
agagtatttcccttccaaaga

SEQ ID NO: 1742575 - DNA, 13 bp, Homo sapiens
agagtatttttaa

SEQ ID NO: 1742576 - DNA, 15 bp, Homo sapiens
agagtatttttaaca

SEQ ID NO: 1742577 - DNA, 18 bp, Homo sapiens
agagtatttttgacagaa

SEQ ID NO: 1742578 - DNA, 20 bp, Homo sapiens
agagtatttttgacagaata

SEQ ID NO: 1742579 - DNA, 13 bp, Homo sapiens
agagtcagaggag

SEQ ID NO: 1742580 - DNA, 14 bp, Homo sapiens
agagtcagccagga

SEQ ID NO: 1742581 - DNA, 18 bp, Homo sapiens
agagtcagccaggaccat

SEQ ID NO: 1742582 - DNA, 21 bp, Homo sapiens
agagtcagccccgacttcctg

SEQ ID NO: 1742583 - DNA, 15 bp, Homo sapiens
agagtcagctctctg

SEQ ID NO: 1742584 - DNA, 16 bp, Homo sapiens
agagtcagctctctgc

SEQ ID NO: 1742585 - DNA, 18 bp, Homo sapiens
agagtcatctccatcagc

SEQ ID NO: 1742586 - DNA, 16 bp, Homo sapiens
agagtcattgtaatgt

SEQ ID NO: 1742587 - DNA, 21 bp, Homo sapiens
agagtcattgtaatgttgtga

SEQ ID NO: 1742588 - DNA, 21 bp, Homo sapiens
agagtccatttcccacatctt

SEQ ID NO: 1742589 - DNA, 22 bp, Homo sapiens
agagtccatttcccacatcttt

SEQ ID NO: 1742590 - DNA, 23 bp, Homo sapiens
agagtccatttcccacatctttc

SEQ ID NO: 1742591 - DNA, 14 bp, Homo sapiens
agagtcctcactcc

SEQ ID NO: 1742592 - DNA, 15 bp, Homo sapiens
agagtcggtctgctt

SEQ ID NO: 1742593 - DNA, 14 bp, Homo sapiens
agagtctaaagatg

SEQ ID NO: 1742594 - DNA, 17 bp, Homo sapiens
agagtctaaagatggag

SEQ ID NO: 1742595 - DNA, 11 bp, Homo sapiens
agagtctagat

SEQ ID NO: 1742596 - DNA, 21 bp, Homo sapiens
aatataaacaaagattcatga

SEQ ID NO: 1742597 - DNA, 17 bp, Homo sapiens
aatataaatttaagcaa

SEQ ID NO: 1742598 - DNA, 18 bp, Homo sapiens
aatataactatgtggctg

SEQ ID NO: 1742599 - DNA, 21 bp, Homo sapiens
aatataaggaaagcaataaat

SEQ ID NO: 1742600 - DNA, 23 bp, Homo sapiens
aatataaggaaagcaataaatga

SEQ ID NO: 1742601 - DNA, 14 bp, Homo sapiens
aatataataatgat

SEQ ID NO: 1742602 - DNA, 17 bp, Homo sapiens
aatataatacacaaaat

SEQ ID NO: 1742603 - DNA, 13 bp, Homo sapiens
aatataatgtatt

SEQ ID NO: 1742604 - DNA, 15 bp, Homo sapiens
aatataatgtatttt

SEQ ID NO: 1742605 - DNA, 23 bp, Homo sapiens
aatataatgtattttctttttat

SEQ ID NO: 1742606 - DNA, 13 bp, Homo sapiens
aatataattctgt

SEQ ID NO: 1742607 - DNA, 18 bp, Homo sapiens
aatatacatgtttatgta

SEQ ID NO: 1742608 - DNA, 15 bp, Homo sapiens
aatatacattttcta

SEQ ID NO: 1742609 - DNA, 17 bp, Homo sapiens
aatatacattttctaaa

SEQ ID NO: 1742610 - DNA, 16 bp, Homo sapiens
aatatacctggtttac

SEQ ID NO: 1742611 - DNA, 16 bp, Homo sapiens
aatataccttatttat

SEQ ID NO: 1742612 - DNA, 22 bp, Homo sapiens
aatataccttatttatttttgt

SEQ ID NO: 1742613 - DNA, 19 bp, Homo sapiens
aatatagacattctcacat

SEQ ID NO: 1742614 - DNA, 15 bp, Homo sapiens
aatatagctgagact

SEQ ID NO: 1742615 - DNA, 12 bp, Homo sapiens
aatatagttaat

SEQ ID NO: 1742616 - DNA, 15 bp, Homo sapiens
aatatagttaattgt

SEQ ID NO: 1742617 - DNA, 21 bp, Homo sapiens
aatatagttaattgtggcttt

SEQ ID NO: 1742618 - DNA, 22 bp, Homo sapiens
aatatagttaattgtggcttta

SEQ ID NO: 1742619 - DNA, 16 bp, Homo sapiens
aatatagttgaacaag

SEQ ID NO: 1742620 - DNA, 18 bp, Homo sapiens
aatatagttgaacaagat

SEQ ID NO: 1742621 - DNA, 20 bp, Homo sapiens
aatatatagtgggtacatca

SEQ ID NO: 1742622 - DNA, 12 bp, Homo sapiens
aatatatatcta

SEQ ID NO: 1742623 - DNA, 15 bp, Homo sapiens
aatatatatctacaa

SEQ ID NO: 1742624 - DNA, 20 bp, Homo sapiens
aatatatatctacaatatat

SEQ ID NO: 1742625 - DNA, 13 bp, Homo sapiens
aatatatatgaat

SEQ ID NO: 1742626 - DNA, 16 bp, Homo sapiens
aatatatatgtcaata

SEQ ID NO: 1742627 - DNA, 16 bp, Homo sapiens
aatatatattaagtgt

SEQ ID NO: 1742628 - DNA, 15 bp, Homo sapiens
aatatatattttaag

SEQ ID NO: 1742629 - DNA, 14 bp, Homo sapiens
aatatatattttgt

SEQ ID NO: 1742630 - DNA, 14 bp, Homo sapiens
aatatatctctatt

SEQ ID NO: 1742631 - DNA, 23 bp, Homo sapiens
aatatatctgttggagaaagaaa

SEQ ID NO: 1742632 - DNA, 14 bp, Homo sapiens
aatatatgtatata

SEQ ID NO: 1742633 - DNA, 18 bp, Homo sapiens
aatatatgtattatttat

SEQ ID NO: 1742634 - DNA, 21 bp, Homo sapiens
aatatatgtattatttataat

SEQ ID NO: 1742635 - DNA, 20 bp, Homo sapiens
aatatatgtttaccttttaa

SEQ ID NO: 1742636 - DNA, 16 bp, Homo sapiens
aatatattataatctt

SEQ ID NO: 1742637 - DNA, 14 bp, Homo sapiens
aatatattgtacaa

SEQ ID NO: 1742638 - DNA, 22 bp, Homo sapiens
aatatatttaaagggaaattga

SEQ ID NO: 1742639 - DNA, 20 bp, Homo sapiens
aatatatttaagataattat

SEQ ID NO: 1742640 - DNA, 18 bp, Homo sapiens
aatatatttcagacattt

SEQ ID NO: 1742641 - DNA, 14 bp, Homo sapiens
aatatatttcttct

SEQ ID NO: 1742642 - DNA, 20 bp, Homo sapiens
aatatatttcttcttctaag

SEQ ID NO: 1742643 - DNA, 16 bp, Homo sapiens
aatatattttcagtac

SEQ ID NO: 1742644 - DNA, 23 bp, Homo sapiens
aatatcaaaagaaaattgatatt

SEQ ID NO: 1742645 - DNA, 15 bp, Homo sapiens
aatatcaaataaaat

SEQ ID NO: 1742646 - DNA, 12 bp, Homo sapiens
aatatcacttaa

SEQ ID NO: 1742647 - DNA, 13 bp, Homo sapiens
aatatcagacaag

SEQ ID NO: 1742648 - DNA, 22 bp, Homo sapiens
aatatcagacaagcactatttt

SEQ ID NO: 1742649 - DNA, 16 bp, Homo sapiens
aatatcagctttgata

SEQ ID NO: 1742650 - DNA, 18 bp, Homo sapiens
aatatcagtattctgaca

SEQ ID NO: 1742651 - DNA, 23 bp, Homo sapiens
aatatcagtattctgacatgtaa

SEQ ID NO: 1742652 - DNA, 16 bp, Homo sapiens
aatatcatttactctt

SEQ ID NO: 1742653 - DNA, 23 bp, Homo sapiens
aatatcatttattttttacatta

SEQ ID NO: 1742654 - DNA, 17 bp, Homo sapiens
aatatccatttatcttt

SEQ ID NO: 1742655 - DNA, 18 bp, Homo sapiens
aatatccatttatctttt

SEQ ID NO: 1742656 - DNA, 17 bp, Homo sapiens
aatatccctcttgtaag

SEQ ID NO: 1742657 - DNA, 18 bp, Homo sapiens
aatatccctcttgtaagt

SEQ ID NO: 1742658 - DNA, 23 bp, Homo sapiens
aatatcctatactggttatagtt

SEQ ID NO: 1742659 - DNA, 13 bp, Homo sapiens
aatatcctcaggg

SEQ ID NO: 1742660 - DNA, 24 bp, Homo sapiens
aatatccttgatgtacagatttta

SEQ ID NO: 1742661 - DNA, 18 bp, Homo sapiens
aatatctaataaaaagtc

SEQ ID NO: 1742662 - DNA, 21 bp, Homo sapiens
aatatctaatatatatgaata

SEQ ID NO: 1742663 - DNA, 15 bp, Homo sapiens
aatatctattaatat

SEQ ID NO: 1742664 - DNA, 16 bp, Homo sapiens
aatatctattaatata

SEQ ID NO: 1742665 - DNA, 17 bp, Homo sapiens
aatatctgaaaatgtat

SEQ ID NO: 1742666 - DNA, 20 bp, Homo sapiens
aatatctgaaaatgtatgtg

SEQ ID NO: 1742667 - DNA, 12 bp, Homo sapiens
aatatctgaagc

SEQ ID NO: 1742668 - DNA, 13 bp, Homo sapiens
aatatctgtattt

SEQ ID NO: 1742669 - DNA, 20 bp, Homo sapiens
aatatctgtgaggtgctgat

SEQ ID NO: 1742670 - DNA, 18 bp, Homo sapiens
aatatcttaattctttgt

SEQ ID NO: 1742671 - DNA, 18 bp, Homo sapiens
aatatcttgctggattaa

SEQ ID NO: 1742672 - DNA, 15 bp, Homo sapiens
aatatcttgcttgaa

SEQ ID NO: 1742673 - DNA, 15 bp, Homo sapiens
aatatcttggcctaa

SEQ ID NO: 1742674 - DNA, 16 bp, Homo sapiens
aatatgaacctatttt

SEQ ID NO: 1742675 - DNA, 22 bp, Homo sapiens
aatatgacagctgtccctgtca

SEQ ID NO: 1742676 - DNA, 17 bp, Homo sapiens
aatatgacggaagaaca

SEQ ID NO: 1742677 - DNA, 16 bp, Homo sapiens
aatatgagaatcagat

SEQ ID NO: 1742678 - DNA, 20 bp, Homo sapiens
aatatgagcttcaatataag

SEQ ID NO: 1742679 - DNA, 20 bp, Homo sapiens
aatatgatcaggtaactttc

SEQ ID NO: 1742680 - DNA, 15 bp, Homo sapiens
aatatgcaaagcact

SEQ ID NO: 1742681 - DNA, 24 bp, Homo sapiens
aatatgcaaagcactgacttctaa

SEQ ID NO: 1742682 - DNA, 21 bp, Homo sapiens
aatatgctgttatgtccagaa

SEQ ID NO: 1742683 - DNA, 23 bp, Homo sapiens
aatatgcttaaaataagcaggtg

SEQ ID NO: 1742684 - DNA, 15 bp, Homo sapiens
aatatggtgtatttt

SEQ ID NO: 1742685 - DNA, 16 bp, Homo sapiens
aatatgtacatttcta

SEQ ID NO: 1742686 - DNA, 17 bp, Homo sapiens
aatatgtatatgacatt

SEQ ID NO: 1742687 - DNA, 19 bp, Homo sapiens
aatatgtatatgacattta

SEQ ID NO: 1742688 - DNA, 16 bp, Homo sapiens
aatatgtattaacact

SEQ ID NO: 1742689 - DNA, 16 bp, Homo sapiens
aatatgtattttccta

SEQ ID NO: 1742690 - DNA, 12 bp, Homo sapiens
aatatgtctttt

SEQ ID NO: 1742691 - DNA, 21 bp, Homo sapiens
aatatgttaacctcagtgtca

SEQ ID NO: 1742692 - DNA, 16 bp, Homo sapiens
aatatgttagcaaaga

SEQ ID NO: 1742693 - DNA, 15 bp, Homo sapiens
aatatgtttcaaact

SEQ ID NO: 1742694 - DNA, 14 bp, Homo sapiens
aatatgtttgtgcc

SEQ ID NO: 1742695 - DNA, 22 bp, Homo sapiens
aatatgtttgtgccttaaaagg

SEQ ID NO: 1742696 - DNA, 13 bp, Homo sapiens
aatattaaaaaac

SEQ ID NO: 1742697 - DNA, 21 bp, Homo sapiens
aatattaaaaaacttcatgta

SEQ ID NO: 1742698 - DNA, 19 bp, Homo sapiens
aatattaaagattctcttt

SEQ ID NO: 1742699 - DNA, 16 bp, Homo sapiens
aatattaaatacagac

SEQ ID NO: 1742700 - DNA, 19 bp, Homo sapiens
aatattaaatacagacact

SEQ ID NO: 1742701 - DNA, 22 bp, Homo sapiens
aatattaaatacagacactaag

SEQ ID NO: 1742702 - DNA, 15 bp, Homo sapiens
aatattaacattctt

SEQ ID NO: 1742703 - DNA, 13 bp, Homo sapiens
aatattaagaaag

SEQ ID NO: 1742704 - DNA, 15 bp, Homo sapiens
aatattagctttact

SEQ ID NO: 1742705 - DNA, 14 bp, Homo sapiens
aatattagtgattc

SEQ ID NO: 1742706 - DNA, 21 bp, Homo sapiens
tcatctgattggacaggcatg

SEQ ID NO: 1742707 - DNA, 14 bp, Homo sapiens
tcatctgctctcct

SEQ ID NO: 1742708 - DNA, 15 bp, Homo sapiens
tcatctgtacatact

SEQ ID NO: 1742709 - DNA, 17 bp, Homo sapiens
tcatctgtagatactag

SEQ ID NO: 1742710 - DNA, 14 bp, Homo sapiens
tcatctgtggagct

SEQ ID NO: 1742711 - DNA, 18 bp, Homo sapiens
tcatctgttatcctgcta

SEQ ID NO: 1742712 - DNA, 12 bp, Homo sapiens
tcatcttaaact

SEQ ID NO: 1742713 - DNA, 13 bp, Homo sapiens
tcatcttcctgtg

SEQ ID NO: 1742714 - DNA, 14 bp, Homo sapiens
tcatcttcctgtgt

SEQ ID NO: 1742715 - DNA, 13 bp, Homo sapiens
tcatcttctctgg

SEQ ID NO: 1742716 - DNA, 14 bp, Homo sapiens
tcatcttctggaat

SEQ ID NO: 1742717 - DNA, 21 bp, Homo sapiens
tcatcttgcagcatttactat

SEQ ID NO: 1742718 - DNA, 21 bp, Homo sapiens
tcatcttgctaccagtattta

SEQ ID NO: 1742719 - DNA, 22 bp, Homo sapiens
tcatcttggaaaggggaggagc

SEQ ID NO: 1742720 - DNA, 23 bp, Homo sapiens
tcatcttgtgagtggataatcag

SEQ ID NO: 1742721 - DNA, 22 bp, Homo sapiens
tcatctttcttgatcaacatct

SEQ ID NO: 1742722 - DNA, 21 bp, Homo sapiens
tcatgaaaaagctgcttctta

SEQ ID NO: 1742723 - DNA, 18 bp, Homo sapiens
tcatgaagcttacttttt

SEQ ID NO: 1742724 - DNA, 19 bp, Homo sapiens
tcatgaagtgcacaggagc

SEQ ID NO: 1742725 - DNA, 21 bp, Homo sapiens
tcatgaataactgattagtaa

SEQ ID NO: 1742726 - DNA, 13 bp, Homo sapiens
tcatgaatgcttt

SEQ ID NO: 1742727 - DNA, 12 bp, Homo sapiens
tcatgaatgtaa

SEQ ID NO: 1742728 - DNA, 14 bp, Homo sapiens
tcatgaatgtaaat

SEQ ID NO: 1742729 - DNA, 20 bp, Homo sapiens
tcatgaatgtgctggtgaac

SEQ ID NO: 1742730 - DNA, 15 bp, Homo sapiens
tcatgaattttaaag

SEQ ID NO: 1742731 - DNA, 18 bp, Homo sapiens
tcatgacaagatgggaca

SEQ ID NO: 1742732 - DNA, 20 bp, Homo sapiens
tcatgagctgggtactgact

SEQ ID NO: 1742733 - DNA, 21 bp, Homo sapiens
tcatgataccacctttactgt

SEQ ID NO: 1742734 - DNA, 16 bp, Homo sapiens
tcatgatccaactaat

SEQ ID NO: 1742735 - DNA, 16 bp, Homo sapiens
tcatgatctccctgcc

SEQ ID NO: 1742736 - DNA, 19 bp, Homo sapiens
tcatgatctccctgccgcc

SEQ ID NO: 1742737 - DNA, 13 bp, Homo sapiens
tcatgattagcaa

SEQ ID NO: 1742738 - DNA, 23 bp, Homo sapiens
tcatgatttcatttcaactgttt

SEQ ID NO: 1742739 - DNA, 15 bp, Homo sapiens
tcatgcaatgacatc

SEQ ID NO: 1742740 - DNA, 17 bp, Homo sapiens
tcatgcacagtatttgt

SEQ ID NO: 1742741 - DNA, 21 bp, Homo sapiens
tcatgcagacaaagccctgtc

SEQ ID NO: 1742742 - DNA, 17 bp, Homo sapiens
tcatgcagagtatttct

SEQ ID NO: 1742743 - DNA, 17 bp, Homo sapiens
tcatgcatgtcaaacat

SEQ ID NO: 1742744 - DNA, 18 bp, Homo sapiens
tcatgcatgtcctgtaaa

SEQ ID NO: 1742745 - DNA, 12 bp, Homo sapiens
tcatgcattggt

SEQ ID NO: 1742746 - DNA, 19 bp, Homo sapiens
tcatgccaccatggccagc

SEQ ID NO: 1742747 - DNA, 23 bp, Homo sapiens
tcatgccagctacttcctcctcc

SEQ ID NO: 1742748 - DNA, 22 bp, Homo sapiens
tcatgcccaccccctgccctgc

SEQ ID NO: 1742749 - DNA, 18 bp, Homo sapiens
tcatgcccagctctctga

SEQ ID NO: 1742750 - DNA, 19 bp, Homo sapiens
tcatgcccagctctctgac

SEQ ID NO: 1742751 - DNA, 21 bp, Homo sapiens
tcatgccccctttcagatgtc

SEQ ID NO: 1742752 - DNA, 14 bp, Homo sapiens
tcatgcctttgtaa

SEQ ID NO: 1742753 - DNA, 17 bp, Homo sapiens
tcatgcctttgtaagtt

SEQ ID NO: 1742754 - DNA, 16 bp, Homo sapiens
tcatgcgcaactggag

SEQ ID NO: 1742755 - DNA, 22 bp, Homo sapiens
tcatgcgttttatatcttccta

SEQ ID NO: 1742756 - DNA, 15 bp, Homo sapiens
tcatgctatctctgt

SEQ ID NO: 1742757 - DNA, 23 bp, Homo sapiens
tcatgctgttgctgctactgtct

SEQ ID NO: 1742758 - DNA, 17 bp, Homo sapiens
tcatgcttttgccactt

SEQ ID NO: 1742759 - DNA, 20 bp, Homo sapiens
tcatggaatggcaggtgtca

SEQ ID NO: 1742760 - DNA, 19 bp, Homo sapiens
tcatggcagctgtttctca

SEQ ID NO: 1742761 - DNA, 23 bp, Homo sapiens
tcatggcagctgtttctcatgaa

SEQ ID NO: 1742762 - DNA, 15 bp, Homo sapiens
tcatggcccccaggg

SEQ ID NO: 1742763 - DNA, 13 bp, Homo sapiens
tcatggcccctct

SEQ ID NO: 1742764 - DNA, 14 bp, Homo sapiens
tcatggcccctctg

SEQ ID NO: 1742765 - DNA, 20 bp, Homo sapiens
tcatggcctattatattaaa

SEQ ID NO: 1742766 - DNA, 15 bp, Homo sapiens
tcatggccttgtcta

SEQ ID NO: 1742767 - DNA, 18 bp, Homo sapiens
tcatggctgtgtccactg

SEQ ID NO: 1742768 - DNA, 14 bp, Homo sapiens
tcatggcttaggat

SEQ ID NO: 1742769 - DNA, 17 bp, Homo sapiens
tcatgggaaaagaccag

SEQ ID NO: 1742770 - DNA, 23 bp, Homo sapiens
tcatgggagggggcttgaagcca

SEQ ID NO: 1742771 - DNA, 17 bp, Homo sapiens
tcatgggatagcacgtg

SEQ ID NO: 1742772 - DNA, 22 bp, Homo sapiens
tcatgggtcccttgaaggaaga

SEQ ID NO: 1742773 - DNA, 12 bp, Homo sapiens
tcatgtaacatt

SEQ ID NO: 1742774 - DNA, 15 bp, Homo sapiens
tcatgtaacattggt

SEQ ID NO: 1742775 - DNA, 13 bp, Homo sapiens
tcatgtaatttta

SEQ ID NO: 1742776 - DNA, 15 bp, Homo sapiens
tcatgtaccatcaat

SEQ ID NO: 1742777 - DNA, 16 bp, Homo sapiens
tcatgtaccatcaata

SEQ ID NO: 1742778 - DNA, 14 bp, Homo sapiens
tgtctcgatgcctg

SEQ ID NO: 1742779 - DNA, 14 bp, Homo sapiens
tgtctctaaaaaga

SEQ ID NO: 1742780 - DNA, 17 bp, Homo sapiens
tgtctctagctgttctg

SEQ ID NO: 1742781 - DNA, 22 bp, Homo sapiens
tgtctctcccaccccggcctcc

SEQ ID NO: 1742782 - DNA, 13 bp, Homo sapiens
tgtctctctgggc

SEQ ID NO: 1742783 - DNA, 14 bp, Homo sapiens
tgtctctgccatgt

SEQ ID NO: 1742784 - DNA, 12 bp, Homo sapiens
tgtctctgttca

SEQ ID NO: 1742785 - DNA, 20 bp, Homo sapiens
tgtctcttgagcatcaatct

SEQ ID NO: 1742786 - DNA, 17 bp, Homo sapiens
tgtctcttgagtttgtc

SEQ ID NO: 1742787 - DNA, 18 bp, Homo sapiens
tgtctcttgtagaagatg

SEQ ID NO: 1742788 - DNA, 21 bp, Homo sapiens
tgtctcttttctcttttgctt

SEQ ID NO: 1742789 - DNA, 22 bp, Homo sapiens
tgtctgaaaaattcctttgtgt

SEQ ID NO: 1742790 - DNA, 13 bp, Homo sapiens
tgtctgaaacaga

SEQ ID NO: 1742791 - DNA, 15 bp, Homo sapiens
tgtctgaaacagaga

SEQ ID NO: 1742792 - DNA, 16 bp, Homo sapiens
tgtctgaagtcactgc

SEQ ID NO: 1742793 - DNA, 18 bp, Homo sapiens
tgtctgaagtcactgcac

SEQ ID NO: 1742794 - DNA, 19 bp, Homo sapiens
tgtctgaatattctagaac

SEQ ID NO: 1742795 - DNA, 17 bp, Homo sapiens
tgtctgacttttgttaa

SEQ ID NO: 1742796 - DNA, 14 bp, Homo sapiens
tgtctgcagctcaa

SEQ ID NO: 1742797 - DNA, 23 bp, Homo sapiens
tgtctgcagctcaagggctggca

SEQ ID NO: 1742798 - DNA, 15 bp, Homo sapiens
tgtctgcagtcctgg

SEQ ID NO: 1742799 - DNA, 16 bp, Homo sapiens
tgtctgcagtgtgccc

SEQ ID NO: 1742800 - DNA, 19 bp, Homo sapiens
tgtctgcagtgtgcccccc

SEQ ID NO: 1742801 - DNA, 16 bp, Homo sapiens
tgtctgccaaacacat

SEQ ID NO: 1742802 - DNA, 15 bp, Homo sapiens
tgtctgccaacctaa

SEQ ID NO: 1742803 - DNA, 15 bp, Homo sapiens
tgtctgccagccagc

SEQ ID NO: 1742804 - DNA, 19 bp, Homo sapiens
tgtctgcccaatgaataat

SEQ ID NO: 1742805 - DNA, 14 bp, Homo sapiens
tgtctgccccagcc

SEQ ID NO: 1742806 - DNA, 23 bp, Homo sapiens
tgtctgccctctgggtccctcct

SEQ ID NO: 1742807 - DNA, 13 bp, Homo sapiens
tgtctgccttcac

SEQ ID NO: 1742808 - DNA, 15 bp, Homo sapiens
tgtctgcgcctgaaa

SEQ ID NO: 1742809 - DNA, 17 bp, Homo sapiens
tgtctgctaaataaaca

SEQ ID NO: 1742810 - DNA, 18 bp, Homo sapiens
tgtctgctaaataaacat

SEQ ID NO: 1742811 - DNA, 21 bp, Homo sapiens
tgtctgctaggcgctggggag

SEQ ID NO: 1742812 - DNA, 17 bp, Homo sapiens
tgtctgctggtatttct

SEQ ID NO: 1742813 - DNA, 23 bp, Homo sapiens
tgtctggaacatggactttcttg

SEQ ID NO: 1742814 - DNA, 20 bp, Homo sapiens
tgtctggcgttctcaagaat

SEQ ID NO: 1742815 - DNA, 21 bp, Homo sapiens
tgtctgggattaagggcaaat

SEQ ID NO: 1742816 - DNA, 12 bp, Homo sapiens
tgtctggtaact

SEQ ID NO: 1742817 - DNA, 14 bp, Homo sapiens
tgtctggtggcccc

SEQ ID NO: 1742818 - DNA, 16 bp, Homo sapiens
tgtctgtaaaaaatgg

SEQ ID NO: 1742819 - DNA, 21 bp, Homo sapiens
tgtctgtaaaaaatggagctc

SEQ ID NO: 1742820 - DNA, 23 bp, Homo sapiens
tgtctgtagctcctcaactcacc

SEQ ID NO: 1742821 - DNA, 20 bp, Homo sapiens
tgtctgtcccttttctttga

SEQ ID NO: 1742822 - DNA, 12 bp, Homo sapiens
tgtctgtctaca

SEQ ID NO: 1742823 - DNA, 19 bp, Homo sapiens
tgtctgtctctccatctgt

SEQ ID NO: 1742824 - DNA, 20 bp, Homo sapiens
tgtctgtgccctccaaagag

SEQ ID NO: 1742825 - DNA, 17 bp, Homo sapiens
tgtctgtggatggtcat

SEQ ID NO: 1742826 - DNA, 16 bp, Homo sapiens
tgtctgtgtcccagcc

SEQ ID NO: 1742827 - DNA, 15 bp, Homo sapiens
tgtctgttctacata

SEQ ID NO: 1742828 - DNA, 21 bp, Homo sapiens
tgtctgttctacatagatgct

SEQ ID NO: 1742829 - DNA, 21 bp, Homo sapiens
tgtctgtttattaactactga

SEQ ID NO: 1742830 - DNA, 22 bp, Homo sapiens
tgtctgtttcaatgacctgtat

SEQ ID NO: 1742831 - DNA, 19 bp, Homo sapiens
tgtctgtttgtttcaagaa

SEQ ID NO: 1742832 - DNA, 18 bp, Homo sapiens
tgtctgtttttgtatctt

SEQ ID NO: 1742833 - DNA, 18 bp, Homo sapiens
tgtcttaaactaaatgtg

SEQ ID NO: 1742834 - DNA, 20 bp, Homo sapiens
tgtcttaaactaaatgtgca

SEQ ID NO: 1742835 - DNA, 20 bp, Homo sapiens
tgtcttaagatggaaataca

SEQ ID NO: 1742836 - DNA, 22 bp, Homo sapiens
tgtcttaagatggaaatacagt

SEQ ID NO: 1742837 - DNA, 19 bp, Homo sapiens
tgtcttaagtgtttctcaa

SEQ ID NO: 1742838 - DNA, 12 bp, Homo sapiens
tgtcttaattaa

SEQ ID NO: 1742839 - DNA, 16 bp, Homo sapiens
tgtcttatggtccaga

SEQ ID NO: 1742840 - DNA, 16 bp, Homo sapiens
tgtcttatgtgaaaaa

SEQ ID NO: 1742841 - DNA, 14 bp, Homo sapiens
tgtcttcacaacag

SEQ ID NO: 1742842 - DNA, 23 bp, Homo sapiens
tgtcttcagtctcacagagaagc

SEQ ID NO: 1742843 - DNA, 13 bp, Homo sapiens
tgtcttccataat

SEQ ID NO: 1742844 - DNA, 18 bp, Homo sapiens
tgtcttccatgtgaacag

SEQ ID NO: 1742845 - DNA, 18 bp, Homo sapiens
tgtcttccgatcaacatt

SEQ ID NO: 1742846 - DNA, 17 bp, Homo sapiens
tgtcttcctatttcaga

SEQ ID NO: 1742847 - DNA, 16 bp, Homo sapiens
tgtcttcctcaaaata

SEQ ID NO: 1742848 - DNA, 22 bp, Homo sapiens
tgtcttcctcaaaataaagaag

SEQ ID NO: 1742849 - DNA, 22 bp, Homo sapiens
tgtcttctcaggctctgccctg

SEQ ID NO: 1742850 - DNA, 23 bp, Homo sapiens
tgtcttctcaggctctgccctgc

SEQ ID NO: 1742851 - DNA, 14 bp, Homo sapiens
tgtcttctgcctgt

SEQ ID NO: 1742852 - DNA, 11 bp, Homo sapiens
tgtcttctgga

SEQ ID NO: 1742853 - DNA, 24 bp, Homo sapiens
tgtcttctggacttggtcttgaag

SEQ ID NO: 1742854 - DNA, 13 bp, Homo sapiens
tgtcttctgggca

SEQ ID NO: 1742855 - DNA, 16 bp, Homo sapiens
tgtcttctgggcacag

SEQ ID NO: 1742856 - DNA, 19 bp, Homo sapiens
tgtcttctgggcacagtgg

SEQ ID NO: 1742857 - DNA, 14 bp, Homo sapiens
tgtcttcttttgtg

SEQ ID NO: 1742858 - DNA, 15 bp, Homo sapiens
tgtcttgaaagtggc

SEQ ID NO: 1742859 - DNA, 20 bp, Homo sapiens
tgtcttgagagcttggcctt

SEQ ID NO: 1742860 - DNA, 15 bp, Homo sapiens
tgtcttgagctctaa

SEQ ID NO: 1742861 - DNA, 21 bp, Homo sapiens
tgtcttgatgttttttctgta

SEQ ID NO: 1742862 - DNA, 22 bp, Homo sapiens
tgtcttgatgttttttctgtaa

SEQ ID NO: 1742863 - DNA, 16 bp, Homo sapiens
tgtcttgccagccaga

SEQ ID NO: 1742864 - DNA, 13 bp, Homo sapiens
tgtcttggaacat

SEQ ID NO: 1742865 - DNA, 19 bp, Homo sapiens
tgtcttggacactgtacaa

SEQ ID NO: 1742866 - DNA, 17 bp, Homo sapiens
tgtcttggagtgcattt

SEQ ID NO: 1742867 - DNA, 22 bp, Homo sapiens
tgtcttgttcattttgagtatt

SEQ ID NO: 1742868 - DNA, 14 bp, Homo sapiens
tgtcttgtttcagt

SEQ ID NO: 1742869 - DNA, 14 bp, Homo sapiens
tgtctttaaggaaa

SEQ ID NO: 1742870 - DNA, 19 bp, Homo sapiens
tgtctttaggcagcagctt

SEQ ID NO: 1742871 - DNA, 21 bp, Homo sapiens
tgtctttaggcagcagctttt

SEQ ID NO: 1742872 - DNA, 12 bp, Homo sapiens
tgtctttctgag

SEQ ID NO: 1742873 - DNA, 12 bp, Homo sapiens
tgtctttgctgt

SEQ ID NO: 1742874 - DNA, 19 bp, Homo sapiens
tgtctttgttggaaaagaa

SEQ ID NO: 1742875 - DNA, 19 bp, Homo sapiens
tgtctttgttgtctccctc

SEQ ID NO: 1742876 - DNA, 20 bp, Homo sapiens
tgtctttgttgtctccctct

SEQ ID NO: 1742877 - DNA, 14 bp, Homo sapiens
tgtcttttagacaa

SEQ ID NO: 1742878 - DNA, 18 bp, Homo sapiens
tgtcttttcaatcttcta

SEQ ID NO: 1742879 - DNA, 12 bp, Homo sapiens
tgtcttttgaca

SEQ ID NO: 1742880 - DNA, 14 bp, Homo sapiens
tgtcttttgacatt

SEQ ID NO: 1742881 - DNA, 12 bp, Homo sapiens
tgtctttttcat

SEQ ID NO: 1742882 - DNA, 22 bp, Homo sapiens
tgtctttttcatttttttctct

SEQ ID NO: 1742883 - DNA, 17 bp, Homo sapiens
tgtctttttctggactg

SEQ ID NO: 1742884 - DNA, 15 bp, Homo sapiens
tgtctttttgttgta

SEQ ID NO: 1742885 - DNA, 18 bp, Homo sapiens
tgtcttttttaaggctct

SEQ ID NO: 1742886 - DNA, 12 bp, Homo sapiens
tgtgaaaaagga

SEQ ID NO: 1742887 - DNA, 12 bp, Homo sapiens
tgtgaaaaatta

SEQ ID NO: 1742888 - DNA, 15 bp, Homo sapiens
tgtgaaaaattaact

SEQ ID NO: 1742889 - DNA, 15 bp, Homo sapiens
tgtgaaaatagtgta

SEQ ID NO: 1742890 - DNA, 21 bp, Homo sapiens
tgtgaaaatagtgtaagaact

SEQ ID NO: 1742891 - DNA, 19 bp, Homo sapiens
tgtgaaaatcatgaaaaga

SEQ ID NO: 1742892 - DNA, 16 bp, Homo sapiens
tgtgaaacacagctgt

SEQ ID NO: 1742893 - DNA, 18 bp, Homo sapiens
tgtggaaaaccaggaaaa

SEQ ID NO: 1742894 - DNA, 20 bp, Homo sapiens
tgtggaaagcctctgctgcc

SEQ ID NO: 1742895 - DNA, 19 bp, Homo sapiens
tgtggaaatcataccagtt

SEQ ID NO: 1742896 - DNA, 23 bp, Homo sapiens
tgtggaaggcacccgccctttcc

SEQ ID NO: 1742897 - DNA, 15 bp, Homo sapiens
tgtggaagtgtgggt

SEQ ID NO: 1742898 - DNA, 23 bp, Homo sapiens
tgtggacaggatgaggacagagg

SEQ ID NO: 1742899 - DNA, 18 bp, Homo sapiens
tgtggaccgtggacaggc

SEQ ID NO: 1742900 - DNA, 22 bp, Homo sapiens
tgtggaccgtggacaggcccag

SEQ ID NO: 1742901 - DNA, 19 bp, Homo sapiens
tgtggacgagagggctgtg

SEQ ID NO: 1742902 - DNA, 14 bp, Homo sapiens
tgtggactgtcctg

SEQ ID NO: 1742903 - DNA, 22 bp, Homo sapiens
tgtggactgtgcctcaggccag

SEQ ID NO: 1742904 - DNA, 23 bp, Homo sapiens
tgtggactgtggcacttgcctgg

SEQ ID NO: 1742905 - DNA, 23 bp, Homo sapiens
tgtggagaaactgtagtctcagg

SEQ ID NO: 1742906 - DNA, 20 bp, Homo sapiens
tgtggagagggaatgtgaaa

SEQ ID NO: 1742907 - DNA, 14 bp, Homo sapiens
tgtggagaggggtg

SEQ ID NO: 1742908 - DNA, 15 bp, Homo sapiens
tgtggagcagcagcc

SEQ ID NO: 1742909 - DNA, 23 bp, Homo sapiens
tgtggaggaagagccacctgcaa

SEQ ID NO: 1742910 - DNA, 12 bp, Homo sapiens
tgtggaggcctg

SEQ ID NO: 1742911 - DNA, 13 bp, Homo sapiens
tgtggaggcctga

SEQ ID NO: 1742912 - DNA, 22 bp, Homo sapiens
tgtggagggtcaccaggttggg

SEQ ID NO: 1742913 - DNA, 17 bp, Homo sapiens
tgtggagggttgccatg

SEQ ID NO: 1742914 - DNA, 18 bp, Homo sapiens
tgtggagttcaccttgga

SEQ ID NO: 1742915 - DNA, 21 bp, Homo sapiens
tgtggagttcaccttggaagg

SEQ ID NO: 1742916 - DNA, 19 bp, Homo sapiens
tgtggagttcctgctccgt

SEQ ID NO: 1742917 - DNA, 19 bp, Homo sapiens
tgtggatcaaccatcgctt

SEQ ID NO: 1742918 - DNA, 16 bp, Homo sapiens
tgtggatgctccaggg

SEQ ID NO: 1742919 - DNA, 14 bp, Homo sapiens
tgtggattctttaa

SEQ ID NO: 1742920 - DNA, 22 bp, Homo sapiens
tgtggatttgattcattttcct

SEQ ID NO: 1742921 - DNA, 17 bp, Homo sapiens
tgtggcaatctgtgggc

SEQ ID NO: 1742922 - DNA, 18 bp, Homo sapiens
tgtggcaatctgtgggct

SEQ ID NO: 1742923 - DNA, 13 bp, Homo sapiens
tgtggcacagccc

SEQ ID NO: 1742924 - DNA, 19 bp, Homo sapiens
tgtggcacttgcctgggtc

SEQ ID NO: 1742925 - DNA, 15 bp, Homo sapiens
tgtggcagtggccag

SEQ ID NO: 1742926 - DNA, 22 bp, Homo sapiens
tgtggcagtggccaggcaggga

SEQ ID NO: 1742927 - DNA, 16 bp, Homo sapiens
tgtggcagtggttttg

SEQ ID NO: 1742928 - DNA, 17 bp, Homo sapiens
tgtggcatctttgcctt

SEQ ID NO: 1742929 - DNA, 15 bp, Homo sapiens
tgtggcatttccaaa

SEQ ID NO: 1742930 - DNA, 16 bp, Homo sapiens
tgtggcatttccaaac

SEQ ID NO: 1742931 - DNA, 15 bp, Homo sapiens
tgtggccacagcccc

SEQ ID NO: 1742932 - DNA, 15 bp, Homo sapiens
tgtggccagagctgg

SEQ ID NO: 1742933 - DNA, 17 bp, Homo sapiens
tgtggccccaccctggg

SEQ ID NO: 1742934 - DNA, 23 bp, Homo sapiens
tgtggccccaccctgggccctgg

SEQ ID NO: 1742935 - DNA, 17 bp, Homo sapiens
tgtggcccctgaacaag

SEQ ID NO: 1742936 - DNA, 22 bp, Homo sapiens
tgtggcccctgaacaagaattg

SEQ ID NO: 1742937 - DNA, 19 bp, Homo sapiens
tgtggccccttttactttt

SEQ ID NO: 1742938 - DNA, 23 bp, Homo sapiens
tgtggccccttttacttttttat

SEQ ID NO: 1742939 - DNA, 21 bp, Homo sapiens
tgtggccctgccatcttccca

SEQ ID NO: 1742940 - DNA, 23 bp, Homo sapiens
tgtggccctgccatcttcccagc

SEQ ID NO: 1742941 - DNA, 12 bp, Homo sapiens
tgtggccctggc

SEQ ID NO: 1742942 - DNA, 16 bp, Homo sapiens
tgtggccctggccact

SEQ ID NO: 1742943 - DNA, 20 bp, Homo sapiens
tgtggccgcctggcaggtgg

SEQ ID NO: 1742944 - DNA, 16 bp, Homo sapiens
tgtggccgtctcctcc

SEQ ID NO: 1742945 - DNA, 17 bp, Homo sapiens
tgtggccgtctcctccc

SEQ ID NO: 1742946 - DNA, 18 bp, Homo sapiens
tgtggccgttatctggaa

SEQ ID NO: 1742947 - DNA, 16 bp, Homo sapiens
tgtggcctgtggcctg

SEQ ID NO: 1742948 - DNA, 17 bp, Homo sapiens
tgtggcctgtggcctgt

SEQ ID NO: 1742949 - DNA, 23 bp, Homo sapiens
tgtggcctgtgtccagcagctgc

SEQ ID NO: 1742950 - DNA, 19 bp, Homo sapiens
tgtggcctttatctcaacg

SEQ ID NO: 1742951 - DNA, 23 bp, Homo sapiens
tgtggcgccgtctccaggggctg

SEQ ID NO: 1742952 - DNA, 16 bp, Homo sapiens
tgtggcgggcagtggg

SEQ ID NO: 1742953 - DNA, 16 bp, Homo sapiens
tgtggctagtgacaaa

SEQ ID NO: 1742954 - DNA, 18 bp, Homo sapiens
tgtggctcctatctgtgt

SEQ ID NO: 1742955 - DNA, 19 bp, Homo sapiens
tgtggctcctatctgtgtt

SEQ ID NO: 1742956 - DNA, 12 bp, Homo sapiens
tgtggctcctgg

SEQ ID NO: 1742957 - DNA, 15 bp, Homo sapiens
tgtggctcctgggcc

SEQ ID NO: 1742958 - DNA, 15 bp, Homo sapiens
tgtggctccttccca

SEQ ID NO: 1742959 - DNA, 13 bp, Homo sapiens
tgtggctgaaaat

SEQ ID NO: 1742960 - DNA, 23 bp, Homo sapiens
tgtggctgaaaatgcaaagctga

SEQ ID NO: 1742961 - DNA, 14 bp, Homo sapiens
tgtggctgctagca

SEQ ID NO: 1742962 - DNA, 17 bp, Homo sapiens
tgtggctggaggagctg

SEQ ID NO: 1742963 - DNA, 15 bp, Homo sapiens
tgtggctgggggcag

SEQ ID NO: 1742964 - DNA, 21 bp, Homo sapiens
tgtggctgggggcaggagggc

SEQ ID NO: 1742965 - DNA, 19 bp, Homo sapiens
tgtggctgttgagatgtgc

SEQ ID NO: 1742966 - DNA, 17 bp, Homo sapiens
tgtgggacacctgggag

SEQ ID NO: 1742967 - DNA, 14 bp, Homo sapiens
tgtgggagacagca

SEQ ID NO: 1742968 - DNA, 14 bp, Homo sapiens
tgtgggagtgtgta

SEQ ID NO: 1742969 - DNA, 18 bp, Homo sapiens
tgtgggattatgggtcac

SEQ ID NO: 1742970 - DNA, 11 bp, Homo sapiens
tgtgggcaggg

SEQ ID NO: 1742971 - DNA, 19 bp, Homo sapiens
tgtgggcgcccaccctggg

SEQ ID NO: 1742972 - DNA, 13 bp, Homo sapiens
tgtgggctgtgag

SEQ ID NO: 1742973 - DNA, 17 bp, Homo sapiens
tgtgggcttcaggtgtt

SEQ ID NO: 1742974 - DNA, 21 bp, Homo sapiens
tgtggggaacatggctggcct

SEQ ID NO: 1742975 - DNA, 23 bp, Homo sapiens
tgtggggaacatggctggcctgg

SEQ ID NO: 1742976 - DNA, 12 bp, Homo sapiens
tgtggggccagg

SEQ ID NO: 1742977 - DNA, 12 bp, Homo sapiens
tgtggggccttg

SEQ ID NO: 1742978 - DNA, 13 bp, Homo sapiens
tgtggggcgtgga

SEQ ID NO: 1742979 - DNA, 17 bp, Homo sapiens
tgtggggctgagctggg

SEQ ID NO: 1742980 - DNA, 19 bp, Homo sapiens
tgtggggggtaatccctgc

SEQ ID NO: 1742981 - DNA, 12 bp, Homo sapiens
tgtggggtgggg

SEQ ID NO: 1742982 - DNA, 14 bp, Homo sapiens
tgtgggtaagagga

SEQ ID NO: 1742983 - DNA, 20 bp, Homo sapiens
tgtgggtaagaggagcagag

SEQ ID NO: 1742984 - DNA, 12 bp, Homo sapiens
tgtgggtcccgc

SEQ ID NO: 1742985 - DNA, 14 bp, Homo sapiens
tgtgggtcccgcac

SEQ ID NO: 1742986 - DNA, 14 bp, Homo sapiens
tgtgggtctctgaa

SEQ ID NO: 1742987 - DNA, 14 bp, Homo sapiens
tgtgggtctctgga

SEQ ID NO: 1742988 - DNA, 14 bp, Homo sapiens
tgtgggtctgtgtg

SEQ ID NO: 1742989 - DNA, 14 bp, Homo sapiens
tgtgggtgaccagg

SEQ ID NO: 1742990 - DNA, 15 bp, Homo sapiens
tgtgggtgaccaggt

SEQ ID NO: 1742991 - DNA, 14 bp, Homo sapiens
tgtgggtggagaag

SEQ ID NO: 1742992 - DNA, 20 bp, Homo sapiens
tgtgggtggagaagggaggg

SEQ ID NO: 1742993 - DNA, 20 bp, Homo sapiens
tgtgggtgggagtgtgtctg

SEQ ID NO: 1742994 - DNA, 16 bp, Homo sapiens
tgtgggtttctctgtg

SEQ ID NO: 1742995 - DNA, 18 bp, Homo sapiens
tgtgggtttggttagagg

SEQ ID NO: 1742996 - DNA, 18 bp, Homo sapiens
tgtgggtttttcatcttt

SEQ ID NO: 1742997 - DNA, 19 bp, Homo sapiens
tgtggtacatggtgtttgt

SEQ ID NO: 1742998 - DNA, 21 bp, Homo sapiens
tgtggtactggcaataagata

SEQ ID NO: 1742999 - DNA, 22 bp, Homo sapiens
tgtggtagggacttaaaaaact

SEQ ID NO: 1743000 - DNA, 15 bp, Homo sapiens
tgtggtaggggcagg

SEQ ID NO: 1743001 - DNA, 14 bp, Homo sapiens
tgtggtatgagggg

SEQ ID NO: 1743002 - DNA, 14 bp, Homo sapiens
tgtggtctattgtc

SEQ ID NO: 1743003 - DNA, 18 bp, Homo sapiens
tgtggtgaggggctttct

SEQ ID NO: 1743004 - DNA, 23 bp, Homo sapiens
tgtggtgaggggctttctcttcc

SEQ ID NO: 1743005 - DNA, 18 bp, Homo sapiens
tgtggtggattctccctg

SEQ ID NO: 1743006 - DNA, 14 bp, Homo sapiens
tgtggtggggagag

SEQ ID NO: 1743007 - DNA, 20 bp, Homo sapiens
tgtggtgtgaccatgttcat

SEQ ID NO: 1743008 - DNA, 14 bp, Homo sapiens
gagctcctccgcag

SEQ ID NO: 1743009 - DNA, 14 bp, Homo sapiens
gagctcctcttcca

SEQ ID NO: 1743010 - DNA, 19 bp, Homo sapiens
gagctcgcggggcagcaaa

SEQ ID NO: 1743011 - DNA, 20 bp, Homo sapiens
gagctcgtgtatcctggggc

SEQ ID NO: 1743012 - DNA, 18 bp, Homo sapiens
gagctctccaggccaggt

SEQ ID NO: 1743013 - DNA, 20 bp, Homo sapiens
gagctctcccctcctgctgg

SEQ ID NO: 1743014 - DNA, 15 bp, Homo sapiens
gagctctgcgccagg

SEQ ID NO: 1743015 - DNA, 16 bp, Homo sapiens
gagctctgcgccaggc

SEQ ID NO: 1743016 - DNA, 17 bp, Homo sapiens
gagctctgcgccaggca

SEQ ID NO: 1743017 - DNA, 23 bp, Homo sapiens
gagctctggggacagcttcctca

SEQ ID NO: 1743018 - DNA, 17 bp, Homo sapiens
gagctctggtgctttag

SEQ ID NO: 1743019 - DNA, 15 bp, Homo sapiens
gagctcttaatgttg

SEQ ID NO: 1743020 - DNA, 22 bp, Homo sapiens
gagctcttcaagctgtcccctc

SEQ ID NO: 1743021 - DNA, 16 bp, Homo sapiens
gagctcttcaggcctc

SEQ ID NO: 1743022 - DNA, 12 bp, Homo sapiens
gagctcttccta

SEQ ID NO: 1743023 - DNA, 21 bp, Homo sapiens
gagctcttcctatccctctcc

SEQ ID NO: 1743024 - DNA, 17 bp, Homo sapiens
gagctcttgggtcagag

SEQ ID NO: 1743025 - DNA, 23 bp, Homo sapiens
gagctgaaagggagcccctcctc

SEQ ID NO: 1743026 - DNA, 17 bp, Homo sapiens
gagctgaaatgctgcat

SEQ ID NO: 1743027 - DNA, 15 bp, Homo sapiens
gagctgaaccttgag

SEQ ID NO: 1743028 - DNA, 19 bp, Homo sapiens
gagctgagatgagccccac

SEQ ID NO: 1743029 - DNA, 16 bp, Homo sapiens
gagctgagggccctgt

SEQ ID NO: 1743030 - DNA, 17 bp, Homo sapiens
gagctgagtcacctcct

SEQ ID NO: 1743031 - DNA, 16 bp, Homo sapiens
gagctgatggcagctg

SEQ ID NO: 1743032 - DNA, 18 bp, Homo sapiens
gagctgatggcagctggg

SEQ ID NO: 1743033 - DNA, 16 bp, Homo sapiens
gagctgatttccaggc

SEQ ID NO: 1743034 - DNA, 12 bp, Homo sapiens
gagctgccaaga

SEQ ID NO: 1743035 - DNA, 15 bp, Homo sapiens
gagctgccactgggc

SEQ ID NO: 1743036 - DNA, 16 bp, Homo sapiens
gagctgccactgggca

SEQ ID NO: 1743037 - DNA, 21 bp, Homo sapiens
gagctgccactgggcacctgc

SEQ ID NO: 1743038 - DNA, 22 bp, Homo sapiens
gagctgcctgcttggcccggcc

SEQ ID NO: 1743039 - DNA, 11 bp, Homo sapiens
gagctgcctgg

SEQ ID NO: 1743040 - DNA, 11 bp, Homo sapiens
gagctgccttc

SEQ ID NO: 1743041 - DNA, 13 bp, Homo sapiens
gagctgccttccc

SEQ ID NO: 1743042 - DNA, 22 bp, Homo sapiens
gagctgccttggctcagacatg

SEQ ID NO: 1743043 - DNA, 13 bp, Homo sapiens
gagctgctgagtg

SEQ ID NO: 1743044 - DNA, 18 bp, Homo sapiens
gagctgctttttttgaaa

SEQ ID NO: 1743045 - DNA, 15 bp, Homo sapiens
gagctggaaggcagg

SEQ ID NO: 1743046 - DNA, 17 bp, Homo sapiens
gagctggaaggcagggc

SEQ ID NO: 1743047 - DNA, 16 bp, Homo sapiens
gagctggactccctca

SEQ ID NO: 1743048 - DNA, 16 bp, Homo sapiens
gagctggaggggtggg

SEQ ID NO: 1743049 - DNA, 19 bp, Homo sapiens
gagctggatagacttggga

SEQ ID NO: 1743050 - DNA, 19 bp, Homo sapiens
gagctggcaaccagccagc

SEQ ID NO: 1743051 - DNA, 21 bp, Homo sapiens
gagctggcaaccagccagcgt

SEQ ID NO: 1743052 - DNA, 18 bp, Homo sapiens
gagctggccaaagagcct

SEQ ID NO: 1743053 - DNA, 20 bp, Homo sapiens
gagctggccaaagagccttt

SEQ ID NO: 1743054 - DNA, 13 bp, Homo sapiens
gagctggcccagg

SEQ ID NO: 1743055 - DNA, 14 bp, Homo sapiens
gagctggcccaggg

SEQ ID NO: 1743056 - DNA, 20 bp, Homo sapiens
gagctggcccagggggcctg

SEQ ID NO: 1743057 - DNA, 21 bp, Homo sapiens
gagctggcccagggggcctgg

SEQ ID NO: 1743058 - DNA, 22 bp, Homo sapiens
gagctggcccagggggcctgga

SEQ ID NO: 1743059 - DNA, 23 bp, Homo sapiens
gagctggccgcgccaaataatgt

SEQ ID NO: 1743060 - DNA, 11 bp, Homo sapiens
gagctggcctc

SEQ ID NO: 1743061 - DNA, 14 bp, Homo sapiens
gagctggcctgtgg

SEQ ID NO: 1743062 - DNA, 16 bp, Homo sapiens
gagctggcctgtggca

SEQ ID NO: 1743063 - DNA, 12 bp, Homo sapiens
gagctggctctg

SEQ ID NO: 1743064 - DNA, 13 bp, Homo sapiens
gagctggctctga

SEQ ID NO: 1743065 - DNA, 18 bp, Homo sapiens
gagctggctggcaggtgt

SEQ ID NO: 1743066 - DNA, 19 bp, Homo sapiens
gagctgggaagctgtactc

SEQ ID NO: 1743067 - DNA, 21 bp, Homo sapiens
gagctgggacacttaacagat

SEQ ID NO: 1743068 - DNA, 13 bp, Homo sapiens
gagctgggagaca

SEQ ID NO: 1743069 - DNA, 14 bp, Homo sapiens
gagctgggagaccc

SEQ ID NO: 1743070 - DNA, 13 bp, Homo sapiens
gagctgggagccg

SEQ ID NO: 1743071 - DNA, 14 bp, Homo sapiens
gagctgggagccgg

SEQ ID NO: 1743072 - DNA, 22 bp, Homo sapiens
gagctgggagccgggccgcaga

SEQ ID NO: 1743073 - DNA, 19 bp, Homo sapiens
gagctgggcagaaggccaa

SEQ ID NO: 1743074 - DNA, 19 bp, Homo sapiens
gagctgggcccctgcacag

SEQ ID NO: 1743075 - DNA, 20 bp, Homo sapiens
gagctgggcccgacatggct

SEQ ID NO: 1743076 - DNA, 15 bp, Homo sapiens
gagctggggacctgg

SEQ ID NO: 1743077 - DNA, 20 bp, Homo sapiens
gagcttttaaaaatgtttgg

SEQ ID NO: 1743078 - DNA, 16 bp, Homo sapiens
gaggaaaaaagaacca

SEQ ID NO: 1743079 - DNA, 17 bp, Homo sapiens
gaggaaaaaatggtata

SEQ ID NO: 1743080 - DNA, 18 bp, Homo sapiens
gaggaaaaaatggtataa

SEQ ID NO: 1743081 - DNA, 22 bp, Homo sapiens
gaggaaaaaatggtataaaagg

SEQ ID NO: 1743082 - DNA, 14 bp, Homo sapiens
gaggaaaaaggtca

SEQ ID NO: 1743083 - DNA, 23 bp, Homo sapiens
gaggaaaaatgggagccaggagt

SEQ ID NO: 1743084 - DNA, 20 bp, Homo sapiens
gaggaaaaccaagccgtggc

SEQ ID NO: 1743085 - DNA, 23 bp, Homo sapiens
gaggaaaaccaagccgtggcttc

SEQ ID NO: 1743086 - DNA, 18 bp, Homo sapiens
gaggaaaaggcccctgca

SEQ ID NO: 1743087 - DNA, 14 bp, Homo sapiens
gaggaaaatgagta

SEQ ID NO: 1743088 - DNA, 17 bp, Homo sapiens
gaggaaagggcctggcc

SEQ ID NO: 1743089 - DNA, 18 bp, Homo sapiens
gaggaaagggcctggcca

SEQ ID NO: 1743090 - DNA, 22 bp, Homo sapiens
gaggaaagggcctggccagtcc

SEQ ID NO: 1743091 - DNA, 17 bp, Homo sapiens
gaggaaattctccactg

SEQ ID NO: 1743092 - DNA, 20 bp, Homo sapiens
gaggaacaagcatgtctctc

SEQ ID NO: 1743093 - DNA, 17 bp, Homo sapiens
gaggaacaggtggatgt

SEQ ID NO: 1743094 - DNA, 14 bp, Homo sapiens
gaggaactccagag

SEQ ID NO: 1743095 - DNA, 16 bp, Homo sapiens
gaggaactcgcctcag

SEQ ID NO: 1743096 - DNA, 18 bp, Homo sapiens
gaggaactcgcctcagcc

SEQ ID NO: 1743097 - DNA, 23 bp, Homo sapiens
gaggaagaacggggctcttctca

SEQ ID NO: 1743098 - DNA, 17 bp, Homo sapiens
gaggaagacaagcattt

SEQ ID NO: 1743099 - DNA, 18 bp, Homo sapiens
gaggaagagagagaccct

SEQ ID NO: 1743100 - DNA, 17 bp, Homo sapiens
gaggaagagccacctgc

SEQ ID NO: 1743101 - DNA, 22 bp, Homo sapiens
gaggaaggaaaaggaggaaatt

SEQ ID NO: 1743102 - DNA, 18 bp, Homo sapiens
gaggaaggtgctgagctt

SEQ ID NO: 1743103 - DNA, 16 bp, Homo sapiens
gaggaagttgattctt

SEQ ID NO: 1743104 - DNA, 23 bp, Homo sapiens
gaggaatagcaaaattcctgtgt

SEQ ID NO: 1743105 - DNA, 19 bp, Homo sapiens
gaggaatagttgagcccca

SEQ ID NO: 1743106 - DNA, 13 bp, Homo sapiens
gaggaatatcaat

SEQ ID NO: 1743107 - DNA, 15 bp, Homo sapiens
gaggaatcctggcag

SEQ ID NO: 1743108 - DNA, 19 bp, Homo sapiens
gaggaatctgtgggtctgg

SEQ ID NO: 1743109 - DNA, 21 bp, Homo sapiens
gaggaatctgtgggtctggga

SEQ ID NO: 1743110 - DNA, 15 bp, Homo sapiens
gaggaatctgtttct

SEQ ID NO: 1743111 - DNA, 19 bp, Homo sapiens
gaggaatctgtttctctgc

SEQ ID NO: 1743112 - DNA, 21 bp, Homo sapiens
gaggaatctgtttctctgctg

SEQ ID NO: 1743113 - DNA, 13 bp, Homo sapiens
gaggaatgtgctt

SEQ ID NO: 1743114 - DNA, 18 bp, Homo sapiens
gaggaatgtgcttttcca

SEQ ID NO: 1743115 - DNA, 19 bp, Homo sapiens
gaggaattatcatgggaaa

SEQ ID NO: 1743116 - DNA, 14 bp, Homo sapiens
gaggaatttcacct

SEQ ID NO: 1743117 - DNA, 17 bp, Homo sapiens
gaggacacagcacaagg

SEQ ID NO: 1743118 - DNA, 15 bp, Homo sapiens
gaggacacctaatgt

SEQ ID NO: 1743119 - DNA, 17 bp, Homo sapiens
gaggacacgtggcctgc

SEQ ID NO: 1743120 - DNA, 18 bp, Homo sapiens
gaggacacgtggcctgca

SEQ ID NO: 1743121 - DNA, 12 bp, Homo sapiens
gaggacagaagg

SEQ ID NO: 1743122 - DNA, 13 bp, Homo sapiens
gaggacagaagga

SEQ ID NO: 1743123 - DNA, 15 bp, Homo sapiens
gaggacagaaggact

SEQ ID NO: 1743124 - DNA, 17 bp, Homo sapiens
gaggacagaaggactgg

SEQ ID NO: 1743125 - DNA, 20 bp, Homo sapiens
gaggacagaaggactggtgc

SEQ ID NO: 1743126 - DNA, 10 bp, Homo sapiens
gaggacagag

SEQ ID NO: 1743127 - DNA, 17 bp, Homo sapiens
gaggacagagggcacat

SEQ ID NO: 1743128 - DNA, 20 bp, Homo sapiens
gaggacagtctggagaaggt

SEQ ID NO: 1743129 - DNA, 16 bp, Homo sapiens
gaggacatcaaagtgg

SEQ ID NO: 1743130 - DNA, 23 bp, Homo sapiens
gaggaccacagtgggtggcacct

SEQ ID NO: 1743131 - DNA, 13 bp, Homo sapiens
gaggaccaccagc

SEQ ID NO: 1743132 - DNA, 13 bp, Homo sapiens
gaggaccactcct

SEQ ID NO: 1743133 - DNA, 11 bp, Homo sapiens
gaggacccagg

SEQ ID NO: 1743134 - DNA, 12 bp, Homo sapiens
gaggacccagga

SEQ ID NO: 1743135 - DNA, 21 bp, Homo sapiens
gaggacccttacgtgagaaat

SEQ ID NO: 1743136 - DNA, 16 bp, Homo sapiens
gaggaccgctgataag

SEQ ID NO: 1743137 - DNA, 19 bp, Homo sapiens
gaggacgagacccccatcc

SEQ ID NO: 1743138 - DNA, 21 bp, Homo sapiens
gaggacgagacccccatccag

SEQ ID NO: 1743139 - DNA, 17 bp, Homo sapiens
gaggactcccaaccctg

SEQ ID NO: 1743140 - DNA, 12 bp, Homo sapiens
gaggactctcct

SEQ ID NO: 1743141 - DNA, 13 bp, Homo sapiens
gaggactctcctc

SEQ ID NO: 1743142 - DNA, 21 bp, Homo sapiens
gaggactgtagggagggcggc

SEQ ID NO: 1743143 - DNA, 16 bp, Homo sapiens
gaggacttgtgtctct

SEQ ID NO: 1743144 - DNA, 17 bp, Homo sapiens
gaggacttgtgtctctg

SEQ ID NO: 1743145 - DNA, 23 bp, Homo sapiens
gaggactttgattgcacattgtt

SEQ ID NO: 1743146 - DNA, 12 bp, Homo sapiens
gaggagaagaat

SEQ ID NO: 1743147 - DNA, 22 bp, Homo sapiens
gaggagaagaattttcagaccc

SEQ ID NO: 1743148 - DNA, 13 bp, Homo sapiens
gaggatctggaga

SEQ ID NO: 1743149 - DNA, 15 bp, Homo sapiens
gaggatgagcagagg

SEQ ID NO: 1743150 - DNA, 13 bp, Homo sapiens
gaggatgagctgg

SEQ ID NO: 1743151 - DNA, 15 bp, Homo sapiens
gaggatgctctttcc

SEQ ID NO: 1743152 - DNA, 15 bp, Homo sapiens
gaggatggagagagg

SEQ ID NO: 1743153 - DNA, 19 bp, Homo sapiens
gaggatgggcagctggggg

SEQ ID NO: 1743154 - DNA, 17 bp, Homo sapiens
gaggatgggtcagagct

SEQ ID NO: 1743155 - DNA, 22 bp, Homo sapiens
gaggatgtgttttgcacgtctt

SEQ ID NO: 1743156 - DNA, 19 bp, Homo sapiens
gaggattatgggtcctgca

SEQ ID NO: 1743157 - DNA, 13 bp, Homo sapiens
gaggattctttcc

SEQ ID NO: 1743158 - DNA, 18 bp, Homo sapiens
gaggattctttccccaga

SEQ ID NO: 1743159 - DNA, 15 bp, Homo sapiens
gaggattgctatctg

SEQ ID NO: 1743160 - DNA, 19 bp, Homo sapiens
gaggattgcttgagcccag

SEQ ID NO: 1743161 - DNA, 23 bp, Homo sapiens
gaggattgtggaaaaccaggaaa

SEQ ID NO: 1743162 - DNA, 14 bp, Homo sapiens
gaggattttccagt

SEQ ID NO: 1743163 - DNA, 22 bp, Homo sapiens
gaggattttccagttctgacac

SEQ ID NO: 1743164 - DNA, 14 bp, Homo sapiens
gaggcaagagactg

SEQ ID NO: 1743165 - DNA, 18 bp, Homo sapiens
gaggcaaggttatatgca

SEQ ID NO: 1743166 - DNA, 23 bp, Homo sapiens
gaggcaatgtcaggaacagaagg

SEQ ID NO: 1743167 - DNA, 21 bp, Homo sapiens
gaggcaattagacactttgga

SEQ ID NO: 1743168 - DNA, 13 bp, Homo sapiens
gaggcacactttc

SEQ ID NO: 1743169 - DNA, 14 bp, Homo sapiens
gaggcacactttct

SEQ ID NO: 1743170 - DNA, 18 bp, Homo sapiens
gaggcacactttctggca

SEQ ID NO: 1743171 - DNA, 19 bp, Homo sapiens
gaggcaccagctctgtggc

SEQ ID NO: 1743172 - DNA, 22 bp, Homo sapiens
gaggcaccagctctgtggcctg

SEQ ID NO: 1743173 - DNA, 23 bp, Homo sapiens
gaggcaccagctctgtggcctgt

SEQ ID NO: 1743174 - DNA, 15 bp, Homo sapiens
gaggcaccggcgctg

SEQ ID NO: 1743175 - DNA, 16 bp, Homo sapiens
gaggcaccggcgctgc

SEQ ID NO: 1743176 - DNA, 18 bp, Homo sapiens
gaggcaccgtccaggccc

SEQ ID NO: 1743177 - DNA, 14 bp, Homo sapiens
gaggcacctccagg

SEQ ID NO: 1743178 - DNA, 20 bp, Homo sapiens
gaggcacctccaggcaggcc

SEQ ID NO: 1743179 - DNA, 18 bp, Homo sapiens
gaggcacgcaccactgct

SEQ ID NO: 1743180 - DNA, 20 bp, Homo sapiens
gaggcagaaaattgcacaat

SEQ ID NO: 1743181 - DNA, 12 bp, Homo sapiens
gaggcagacagc

SEQ ID NO: 1743182 - DNA, 15 bp, Homo sapiens
gaggcagacagcagc

SEQ ID NO: 1743183 - DNA, 23 bp, Homo sapiens
gaggcagcccagctcctgaataa

SEQ ID NO: 1743184 - DNA, 17 bp, Homo sapiens
gaggcagccgaggcctg

SEQ ID NO: 1743185 - DNA, 18 bp, Homo sapiens
gaggcagccgaggcctgg

SEQ ID NO: 1743186 - DNA, 21 bp, Homo sapiens
gaggcagccgaggcctggcca

SEQ ID NO: 1743187 - DNA, 23 bp, Homo sapiens
gaggcaggaggattgcttgagcc

SEQ ID NO: 1743188 - DNA, 20 bp, Homo sapiens
gaggcaggcatggccctggg

SEQ ID NO: 1743189 - DNA, 14 bp, Homo sapiens
gaggcaggctccag

SEQ ID NO: 1743190 - DNA, 17 bp, Homo sapiens
gaggcagggaggggact

SEQ ID NO: 1743191 - DNA, 15 bp, Homo sapiens
gaggcagggccttgc

SEQ ID NO: 1743192 - DNA, 20 bp, Homo sapiens
gaggcagggccttgcccaga

SEQ ID NO: 1743193 - DNA, 21 bp, Homo sapiens
gaggcagggccttgcccagag

SEQ ID NO: 1743194 - DNA, 22 bp, Homo sapiens
gaggcagggccttgcccagaga

SEQ ID NO: 1743195 - DNA, 14 bp, Homo sapiens
gaggcaggggcgga

SEQ ID NO: 1743196 - DNA, 22 bp, Homo sapiens
gaggcaggtggatcacgaggtc

SEQ ID NO: 1743197 - DNA, 14 bp, Homo sapiens
gaggcataaagact

SEQ ID NO: 1743198 - DNA, 21 bp, Homo sapiens
gaggcatcatggaaagactgg

SEQ ID NO: 1743199 - DNA, 23 bp, Homo sapiens
gaggcatcttttctagagacaca

SEQ ID NO: 1743200 - DNA, 14 bp, Homo sapiens
gaggcattcgggga

SEQ ID NO: 1743201 - DNA, 17 bp, Homo sapiens
gaggccaaaggctggtg

SEQ ID NO: 1743202 - DNA, 19 bp, Homo sapiens
gaggccaaaggctggtggc

SEQ ID NO: 1743203 - DNA, 15 bp, Homo sapiens
gaggccaagatggct

SEQ ID NO: 1743204 - DNA, 15 bp, Homo sapiens
gaggccaaggcaggt

SEQ ID NO: 1743205 - DNA, 21 bp, Homo sapiens
gaggccacattgctggctgcc

SEQ ID NO: 1743206 - DNA, 11 bp, Homo sapiens
gaggccaccca

SEQ ID NO: 1743207 - DNA, 23 bp, Homo sapiens
gaggccaccgggacagacctgga

SEQ ID NO: 1743208 - DNA, 10 bp, Homo sapiens
gaggccacct

SEQ ID NO: 1743209 - DNA, 15 bp, Homo sapiens
gaggccacctctcca

SEQ ID NO: 1743210 - DNA, 17 bp, Homo sapiens
gaggccacctctccaag

SEQ ID NO: 1743211 - DNA, 18 bp, Homo sapiens
gaggccagccccacccag

SEQ ID NO: 1743212 - DNA, 20 bp, Homo sapiens
gaggccagccccacccagga

SEQ ID NO: 1743213 - DNA, 14 bp, Homo sapiens
gaggccagcctggc

SEQ ID NO: 1743214 - DNA, 22 bp, Homo sapiens
gaggccaggagtttgagaccag

SEQ ID NO: 1743215 - DNA, 13 bp, Homo sapiens
gaggccagggcag

SEQ ID NO: 1743216 - DNA, 16 bp, Homo sapiens
gaggccagtaggagac

SEQ ID NO: 1743217 - DNA, 17 bp, Homo sapiens
gaggccatctcaggaga

SEQ ID NO: 1743218 - DNA, 18 bp, Homo sapiens
gaggccatctcaggagat

SEQ ID NO: 1743219 - DNA, 19 bp, Homo sapiens
gaggccattgtgtgagcct

SEQ ID NO: 1743220 - DNA, 13 bp, Homo sapiens
gaggcccaaatga

SEQ ID NO: 1743221 - DNA, 14 bp, Homo sapiens
gaggcccaaggagc

SEQ ID NO: 1743222 - DNA, 15 bp, Homo sapiens
gaggcccaaggagct

SEQ ID NO: 1743223 - DNA, 14 bp, Homo sapiens
ttccacctgccaca

SEQ ID NO: 1743224 - DNA, 21 bp, Homo sapiens
ttccacctgtgccctcaccac

SEQ ID NO: 1743225 - DNA, 17 bp, Homo sapiens
ttccacgtcttcctcca

SEQ ID NO: 1743226 - DNA, 22 bp, Homo sapiens
ttccactacacctggctgaggt

SEQ ID NO: 1743227 - DNA, 15 bp, Homo sapiens
ttccactactgctac

SEQ ID NO: 1743228 - DNA, 20 bp, Homo sapiens
ttccactcgatgatgcttct

SEQ ID NO: 1743229 - DNA, 22 bp, Homo sapiens
ttccactggacttgagcttggc

SEQ ID NO: 1743230 - DNA, 20 bp, Homo sapiens
ttccactgtcaagaaagagc

SEQ ID NO: 1743231 - DNA, 21 bp, Homo sapiens
ttccacttagaaattgcattt

SEQ ID NO: 1743232 - DNA, 21 bp, Homo sapiens
ttccagaaagcaggagcagct

SEQ ID NO: 1743233 - DNA, 21 bp, Homo sapiens
ttccagaaccacacttgaaac

SEQ ID NO: 1743234 - DNA, 20 bp, Homo sapiens
ttccagaagaagagaagctg

SEQ ID NO: 1743235 - DNA, 21 bp, Homo sapiens
ttccagaagaagagaagctgc

SEQ ID NO: 1743236 - DNA, 20 bp, Homo sapiens
ttccagactcaggttccaga

SEQ ID NO: 1743237 - DNA, 21 bp, Homo sapiens
ttccagactcaggttccagaa

SEQ ID NO: 1743238 - DNA, 17 bp, Homo sapiens
ttccagagagtggctcc

SEQ ID NO: 1743239 - DNA, 20 bp, Homo sapiens
ttccagagagtggctcctcc

SEQ ID NO: 1743240 - DNA, 19 bp, Homo sapiens
ttccagaggctattatttt

SEQ ID NO: 1743241 - DNA, 18 bp, Homo sapiens
ttccagatcactgccaca

SEQ ID NO: 1743242 - DNA, 23 bp, Homo sapiens
ttccagatggtcatccagactca

SEQ ID NO: 1743243 - DNA, 20 bp, Homo sapiens
ttccagattttaaattttat

SEQ ID NO: 1743244 - DNA, 22 bp, Homo sapiens
ttccagattttaaattttatgt

SEQ ID NO: 1743245 - DNA, 14 bp, Homo sapiens
ttccagcaattctc

SEQ ID NO: 1743246 - DNA, 21 bp, Homo sapiens
ttccagcatttagctggccac

SEQ ID NO: 1743247 - DNA, 16 bp, Homo sapiens
ttccagcccctctggt

SEQ ID NO: 1743248 - DNA, 20 bp, Homo sapiens
ttccagcccctctggtcgct

SEQ ID NO: 1743249 - DNA, 14 bp, Homo sapiens
ttccagctcctgta

SEQ ID NO: 1743250 - DNA, 14 bp, Homo sapiens
ttccagctctgccc

SEQ ID NO: 1743251 - DNA, 11 bp, Homo sapiens
ttccagctgcc

SEQ ID NO: 1743252 - DNA, 23 bp, Homo sapiens
ctcagcccttgcccccatccctc

SEQ ID NO: 1743253 - DNA, 22 bp, Homo sapiens
ctcagcctactccgctcactga

SEQ ID NO: 1743254 - DNA, 13 bp, Homo sapiens
ctcagcctcatcc

SEQ ID NO: 1743255 - DNA, 14 bp, Homo sapiens
ctcagcctcatcct

SEQ ID NO: 1743256 - DNA, 20 bp, Homo sapiens
ctcagcctcccaaccccagg

SEQ ID NO: 1743257 - DNA, 14 bp, Homo sapiens
ctcagcctcccaca

SEQ ID NO: 1743258 - DNA, 20 bp, Homo sapiens
ctcagcctcccagagtgctg

SEQ ID NO: 1743259 - DNA, 12 bp, Homo sapiens
ctcagcctcctg

SEQ ID NO: 1743260 - DNA, 13 bp, Homo sapiens
ctcagcctgcaca

SEQ ID NO: 1743261 - DNA, 13 bp, Homo sapiens
ctcagcctggcca

SEQ ID NO: 1743262 - DNA, 20 bp, Homo sapiens
ctcagcctggccagacacag

SEQ ID NO: 1743263 - DNA, 18 bp, Homo sapiens
ctcagcctggtgggcctc

SEQ ID NO: 1743264 - DNA, 17 bp, Homo sapiens
ctcagccttcagacaga

SEQ ID NO: 1743265 - DNA, 13 bp, Homo sapiens
ctcagccttctcc

SEQ ID NO: 1743266 - DNA, 15 bp, Homo sapiens
ctcagccttctcctc

SEQ ID NO: 1743267 - DNA, 21 bp, Homo sapiens
ctcagccttctcctcccaagg

SEQ ID NO: 1743268 - DNA, 16 bp, Homo sapiens
ctcagccttgccagag

SEQ ID NO: 1743269 - DNA, 17 bp, Homo sapiens
ctcagccttgccagaga

SEQ ID NO: 1743270 - DNA, 18 bp, Homo sapiens
ctcagccttgccagagat

SEQ ID NO: 1743271 - DNA, 20 bp, Homo sapiens
ctcagccttgccagagatcc

SEQ ID NO: 1743272 - DNA, 21 bp, Homo sapiens
ctcagccttgccagagatcca

SEQ ID NO: 1743273 - DNA, 19 bp, Homo sapiens
ctcagccttgctgctctgc

SEQ ID NO: 1743274 - DNA, 20 bp, Homo sapiens
ctcagccttgctgctctgcg

SEQ ID NO: 1743275 - DNA, 23 bp, Homo sapiens
ctcagccttgctgctctgcgtgg

SEQ ID NO: 1743276 - DNA, 11 bp, Homo sapiens
ctcagccttgg

SEQ ID NO: 1743277 - DNA, 18 bp, Homo sapiens
ctcagcgggggccttgaa

SEQ ID NO: 1743278 - DNA, 19 bp, Homo sapiens
ctcagcgggggccttgaag

SEQ ID NO: 1743279 - DNA, 20 bp, Homo sapiens
ctcagcgtcctgggctcaaa

SEQ ID NO: 1743280 - DNA, 23 bp, Homo sapiens
ctcagcgtttttttgtttttaat

SEQ ID NO: 1743281 - DNA, 18 bp, Homo sapiens
ctcagctataattctgtt

SEQ ID NO: 1743282 - DNA, 14 bp, Homo sapiens
ctcagctcaatgca

SEQ ID NO: 1743283 - DNA, 14 bp, Homo sapiens
ctcagctcactgca

SEQ ID NO: 1743284 - DNA, 20 bp, Homo sapiens
ctcagctcactgcaacctcc

SEQ ID NO: 1743285 - DNA, 13 bp, Homo sapiens
ctcagctcccagg

SEQ ID NO: 1743286 - DNA, 22 bp, Homo sapiens
ctcagctctggtccaggccctg

SEQ ID NO: 1743287 - DNA, 20 bp, Homo sapiens
ctcagctgagaaggccagcc

SEQ ID NO: 1743288 - DNA, 14 bp, Homo sapiens
ctcagctgcacatt

SEQ ID NO: 1743289 - DNA, 15 bp, Homo sapiens
ctcagctgcacattc

SEQ ID NO: 1743290 - DNA, 12 bp, Homo sapiens
ctcagctgccaa

SEQ ID NO: 1743291 - DNA, 13 bp, Homo sapiens
ctcagctgcccat

SEQ ID NO: 1743292 - DNA, 14 bp, Homo sapiens
ctcagctgcccatc

SEQ ID NO: 1743293 - DNA, 18 bp, Homo sapiens
ctcagctgcccatcccag

SEQ ID NO: 1743294 - DNA, 21 bp, Homo sapiens
ctcagctgcccatcccagtcc

SEQ ID NO: 1743295 - DNA, 12 bp, Homo sapiens
ctcagctgcctc

SEQ ID NO: 1743296 - DNA, 16 bp, Homo sapiens
ctcagctgcctcactt

SEQ ID NO: 1743297 - DNA, 13 bp, Homo sapiens
ctcagctgtggct

SEQ ID NO: 1743298 - DNA, 15 bp, Homo sapiens
ctcagctgtggctgg

SEQ ID NO: 1743299 - DNA, 17 bp, Homo sapiens
ctcagcttgcagctgga

SEQ ID NO: 1743300 - DNA, 13 bp, Homo sapiens
ctcagctttgaga

SEQ ID NO: 1743301 - DNA, 18 bp, Homo sapiens
ctcaggaattcagtgcct

SEQ ID NO: 1743302 - DNA, 16 bp, Homo sapiens
ctcaggacagatgcca

SEQ ID NO: 1743303 - DNA, 19 bp, Homo sapiens
ctcaggacagatgccacac

SEQ ID NO: 1743304 - DNA, 17 bp, Homo sapiens
ctcaggacccaggccct

SEQ ID NO: 1743305 - DNA, 12 bp, Homo sapiens
ctcaggacctag

SEQ ID NO: 1743306 - DNA, 17 bp, Homo sapiens
ctcaggagagacccctc

SEQ ID NO: 1743307 - DNA, 22 bp, Homo sapiens
ctcaggagatggagggcttggc

SEQ ID NO: 1743308 - DNA, 12 bp, Homo sapiens
ctcaggagcaca

SEQ ID NO: 1743309 - DNA, 21 bp, Homo sapiens
ctcaggagcttgcaagaagca

SEQ ID NO: 1743310 - DNA, 16 bp, Homo sapiens
ctcaggaggcaggacc

SEQ ID NO: 1743311 - DNA, 18 bp, Homo sapiens
ctcaggaggctgagacag

SEQ ID NO: 1743312 - DNA, 19 bp, Homo sapiens
ctcaggaggctgagacagg

SEQ ID NO: 1743313 - DNA, 17 bp, Homo sapiens
ctcaggaggctgaggca

SEQ ID NO: 1743314 - DNA, 18 bp, Homo sapiens
ctcaggaggctgaggcag

SEQ ID NO: 1743315 - DNA, 20 bp, Homo sapiens
ctcaggaggctgaggcagaa

SEQ ID NO: 1743316 - DNA, 20 bp, Homo sapiens
ctcaggaggctgaggcagga

SEQ ID NO: 1743317 - DNA, 17 bp, Homo sapiens
ctcaggagtctgccact

SEQ ID NO: 1743318 - DNA, 19 bp, Homo sapiens
ctcaggagtttgagaccag

SEQ ID NO: 1743319 - DNA, 18 bp, Homo sapiens
ctcaggatccaagctaag

SEQ ID NO: 1743320 - DNA, 14 bp, Homo sapiens
ctcaggcaagcccc

SEQ ID NO: 1743321 - DNA, 16 bp, Homo sapiens
ctcaggcaagcccctc

SEQ ID NO: 1743322 - DNA, 18 bp, Homo sapiens
ctcaggcacacagctact

SEQ ID NO: 1743323 - DNA, 18 bp, Homo sapiens
ctcaggcagacaagagct

SEQ ID NO: 1743324 - DNA, 21 bp, Homo sapiens
ctcaggcagacaagagctgct

SEQ ID NO: 1743325 - DNA, 20 bp, Homo sapiens
ctcaggcagcaccacactgg

SEQ ID NO: 1743326 - DNA, 21 bp, Homo sapiens
ctcaggcagcaccacactggg

SEQ ID NO: 1743327 - DNA, 22 bp, Homo sapiens
ctcaggcagcgttagggctgct

SEQ ID NO: 1743328 - DNA, 23 bp, Homo sapiens
ctcaggcagcgttagggctgctt

SEQ ID NO: 1743329 - DNA, 14 bp, Homo sapiens
ctcaggcagctcaa

SEQ ID NO: 1743330 - DNA, 15 bp, Homo sapiens
ctcaggcagctcaag

SEQ ID NO: 1743331 - DNA, 14 bp, Homo sapiens
ctcaggccagggct

SEQ ID NO: 1743332 - DNA, 15 bp, Homo sapiens
ctcaggccaggtgca

SEQ ID NO: 1743333 - DNA, 12 bp, Homo sapiens
ctcaggcccaga

SEQ ID NO: 1743334 - DNA, 15 bp, Homo sapiens
ctcaggccccgggct

SEQ ID NO: 1743335 - DNA, 20 bp, Homo sapiens
ctcaggccccgggcttccct

SEQ ID NO: 1743336 - DNA, 13 bp, Homo sapiens
ctcaggcctctgc

SEQ ID NO: 1743337 - DNA, 14 bp, Homo sapiens
ctcaggcctctgca

SEQ ID NO: 1743338 - DNA, 15 bp, Homo sapiens
ctcaggcctctgcag

SEQ ID NO: 1743339 - DNA, 11 bp, Homo sapiens
ctcaggctctg

SEQ ID NO: 1743340 - DNA, 12 bp, Homo sapiens
ctcaggctctgc

SEQ ID NO: 1743341 - DNA, 14 bp, Homo sapiens
ctcaggctctgccc

SEQ ID NO: 1743342 - DNA, 16 bp, Homo sapiens
ctcaggctctgccctg

SEQ ID NO: 1743343 - DNA, 12 bp, Homo sapiens
ctcaggctcttg

SEQ ID NO: 1743344 - DNA, 17 bp, Homo sapiens
ctcaggcttccttggca

SEQ ID NO: 1743345 - DNA, 21 bp, Homo sapiens
ctcaggctttcactatttcct

SEQ ID NO: 1743346 - DNA, 20 bp, Homo sapiens
ctcagggaagcccagctcca

SEQ ID NO: 1743347 - DNA, 21 bp, Homo sapiens
ctcagggacagagacacctgc

SEQ ID NO: 1743348 - DNA, 21 bp, Homo sapiens
ctcagggagcagggaaggcct

SEQ ID NO: 1743349 - DNA, 22 bp, Homo sapiens
ctcagggagcagggaaggcctg

SEQ ID NO: 1743350 - DNA, 14 bp, Homo sapiens
ctcagggcacgcag

SEQ ID NO: 1743351 - DNA, 20 bp, Homo sapiens
ctcagggccatgcctgcccc

SEQ ID NO: 1743352 - DNA, 20 bp, Homo sapiens
ctcagggccatgctgaggcc

SEQ ID NO: 1743353 - DNA, 14 bp, Homo sapiens
ctcagggccccagc

SEQ ID NO: 1743354 - DNA, 16 bp, Homo sapiens
ctcagggccccagcac

SEQ ID NO: 1743355 - DNA, 18 bp, Homo sapiens
ctcagggccccagcacta

SEQ ID NO: 1743356 - DNA, 16 bp, Homo sapiens
ctcagggcgctcagac

SEQ ID NO: 1743357 - DNA, 13 bp, Homo sapiens
ctcagggctccca

SEQ ID NO: 1743358 - DNA, 16 bp, Homo sapiens
ctcagggctcccaggg

SEQ ID NO: 1743359 - DNA, 18 bp, Homo sapiens
ctcagggctcgggagcca

SEQ ID NO: 1743360 - DNA, 12 bp, Homo sapiens
ctcagggctgga

SEQ ID NO: 1743361 - DNA, 17 bp, Homo sapiens
ctcaggggcctggaggt

SEQ ID NO: 1743362 - DNA, 16 bp, Homo sapiens
ctcaggggctctaggg

SEQ ID NO: 1743363 - DNA, 15 bp, Homo sapiens
ctcaggggctgtttg

SEQ ID NO: 1743364 - DNA, 19 bp, Homo sapiens
ctcagggggtcagcagagt

SEQ ID NO: 1743365 - DNA, 20 bp, Homo sapiens
ctcagggggtcagcagagtt

SEQ ID NO: 1743366 - DNA, 14 bp, Homo sapiens
ctcaggggtggaga

SEQ ID NO: 1743367 - DNA, 16 bp, Homo sapiens
ctcaggggtggagaag

SEQ ID NO: 1743368 - DNA, 21 bp, Homo sapiens
ctcagggtcactgaaccactg

SEQ ID NO: 1743369 - DNA, 11 bp, Homo sapiens
ttccagctgct

SEQ ID NO: 1743370 - DNA, 13 bp, Homo sapiens
ttccagcttagaa

SEQ ID NO: 1743371 - DNA, 14 bp, Homo sapiens
ttccaggaaaaaat

SEQ ID NO: 1743372 - DNA, 23 bp, Homo sapiens
ttccaggaaactccacatctgcc

SEQ ID NO: 1743373 - DNA, 14 bp, Homo sapiens
ttccaggaattcct

SEQ ID NO: 1743374 - DNA, 20 bp, Homo sapiens
ttccaggaattttgtgtgat

SEQ ID NO: 1743375 - DNA, 16 bp, Homo sapiens
ttccaggatcctgcag

SEQ ID NO: 1743376 - DNA, 13 bp, Homo sapiens
ttccaggcagcct

SEQ ID NO: 1743377 - DNA, 11 bp, Homo sapiens
ttccaggcccc

SEQ ID NO: 1743378 - DNA, 12 bp, Homo sapiens
ttccaggcccct

SEQ ID NO: 1743379 - DNA, 15 bp, Homo sapiens
ttccaggctgagcca

SEQ ID NO: 1743380 - DNA, 23 bp, Homo sapiens
ttccaggcttccctgacttgctt

SEQ ID NO: 1743381 - DNA, 15 bp, Homo sapiens
ttccagggaggggcc

SEQ ID NO: 1743382 - DNA, 19 bp, Homo sapiens
ttccagggtccctctgtgt

SEQ ID NO: 1743383 - DNA, 20 bp, Homo sapiens
ttccagtaacttttttgtgt

SEQ ID NO: 1743384 - DNA, 17 bp, Homo sapiens
ttccagtacagtattct

SEQ ID NO: 1743385 - DNA, 17 bp, Homo sapiens
ttccagtacctttgtca

SEQ ID NO: 1743386 - DNA, 12 bp, Homo sapiens
ttccagtataaa

SEQ ID NO: 1743387 - DNA, 17 bp, Homo sapiens
ttccagtataaccagct

SEQ ID NO: 1743388 - DNA, 17 bp, Homo sapiens
ttccagtcttcctgaca

SEQ ID NO: 1743389 - DNA, 17 bp, Homo sapiens
ttccagtgaacattccc

SEQ ID NO: 1743390 - DNA, 21 bp, Homo sapiens
ttccagtggtcatgctcagcc

SEQ ID NO: 1743391 - DNA, 17 bp, Homo sapiens
ttccagtttctccttga

SEQ ID NO: 1743392 - DNA, 12 bp, Homo sapiens
ttccataattat

SEQ ID NO: 1743393 - DNA, 14 bp, Homo sapiens
ttccataattatga

SEQ ID NO: 1743394 - DNA, 18 bp, Homo sapiens
ttccatacttctctcaga

SEQ ID NO: 1743395 - DNA, 13 bp, Homo sapiens
ttccatagcaaca

SEQ ID NO: 1743396 - DNA, 17 bp, Homo sapiens
ttccatatgctccagga

SEQ ID NO: 1743397 - DNA, 19 bp, Homo sapiens
ttccatcaccccaacctct

SEQ ID NO: 1743398 - DNA, 17 bp, Homo sapiens
ttccatcatcactgtaa

SEQ ID NO: 1743399 - DNA, 19 bp, Homo sapiens
ttccatcatcactgtaaag

SEQ ID NO: 1743400 - DNA, 20 bp, Homo sapiens
ttccatcatcactgtaaaga

SEQ ID NO: 1743401 - DNA, 14 bp, Homo sapiens
ttccatccaccacc

SEQ ID NO: 1743402 - DNA, 21 bp, Homo sapiens
ttccatccattacctccatcc

SEQ ID NO: 1743403 - DNA, 15 bp, Homo sapiens
ttccatccccgtcca

SEQ ID NO: 1743404 - DNA, 21 bp, Homo sapiens
ttccatccctaccccctaaga

SEQ ID NO: 1743405 - DNA, 12 bp, Homo sapiens
ttccatctaaaa

SEQ ID NO: 1743406 - DNA, 14 bp, Homo sapiens
ttccatctagtcac

SEQ ID NO: 1743407 - DNA, 12 bp, Homo sapiens
ttccatctctgc

SEQ ID NO: 1743408 - DNA, 16 bp, Homo sapiens
ttccatctctgcctgt

SEQ ID NO: 1743409 - DNA, 18 bp, Homo sapiens
ttccatctctgcctgtca

SEQ ID NO: 1743410 - DNA, 12 bp, Homo sapiens
ttccatgaatgt

SEQ ID NO: 1743411 - DNA, 18 bp, Homo sapiens
ttccatgagaacagcagg

SEQ ID NO: 1743412 - DNA, 16 bp, Homo sapiens
ttccatgcctgagggt

SEQ ID NO: 1743413 - DNA, 23 bp, Homo sapiens
ttccatgcctgagggtggagact

SEQ ID NO: 1743414 - DNA, 23 bp, Homo sapiens
ttccatgcctgtagctttcctgg

SEQ ID NO: 1743415 - DNA, 21 bp, Homo sapiens
ttccatgcgtgtttctgactc

SEQ ID NO: 1743416 - DNA, 14 bp, Homo sapiens
ttccatgctgtgcg

SEQ ID NO: 1743417 - DNA, 21 bp, Homo sapiens
ttccatgggactttccttccc

SEQ ID NO: 1743418 - DNA, 23 bp, Homo sapiens
ttccatgggactttccttccctc

SEQ ID NO: 1743419 - DNA, 23 bp, Homo sapiens
ttccatgggagccagctgctttt

SEQ ID NO: 1743420 - DNA, 17 bp, Homo sapiens
ttccatgtatcttttga

SEQ ID NO: 1743421 - DNA, 18 bp, Homo sapiens
ttccatgtgaacagcata

SEQ ID NO: 1743422 - DNA, 22 bp, Homo sapiens
ttccatgtgcctttctttgcct

SEQ ID NO: 1743423 - DNA, 17 bp, Homo sapiens
ttccattgaccagctct

SEQ ID NO: 1743424 - DNA, 22 bp, Homo sapiens
ttccatttatttatgaaaaaat

SEQ ID NO: 1743425 - DNA, 14 bp, Homo sapiens
ttccatttcatttg

SEQ ID NO: 1743426 - DNA, 23 bp, Homo sapiens
ttccatttctcaatcagtgcagt

SEQ ID NO: 1743427 - DNA, 16 bp, Homo sapiens
ttccattttatgcaga

SEQ ID NO: 1743428 - DNA, 21 bp, Homo sapiens
ttccatttttcctctgttcac

SEQ ID NO: 1743429 - DNA, 16 bp, Homo sapiens
ttcccaaacgcctccc

SEQ ID NO: 1743430 - DNA, 23 bp, Homo sapiens
ttcccaaaggcattataaaaaga

SEQ ID NO: 1743431 - DNA, 16 bp, Homo sapiens
ttcccaaagtcctctg

SEQ ID NO: 1743432 - DNA, 15 bp, Homo sapiens
ttcccaacttgcctt

SEQ ID NO: 1743433 - DNA, 18 bp, Homo sapiens
ttcccaagtatgccttaa

SEQ ID NO: 1743434 - DNA, 16 bp, Homo sapiens
ttcccaatcagcactg

SEQ ID NO: 1743435 - DNA, 19 bp, Homo sapiens
ttcccaatcagcactgaaa

SEQ ID NO: 1743436 - DNA, 20 bp, Homo sapiens
ttcccaatcagcactgaaaa

SEQ ID NO: 1743437 - DNA, 15 bp, Homo sapiens
ttcccacacctgcct

SEQ ID NO: 1743438 - DNA, 18 bp, Homo sapiens
ttcccacatctttcctca

SEQ ID NO: 1743439 - DNA, 14 bp, Homo sapiens
ttcccaccagctcc

SEQ ID NO: 1743440 - DNA, 17 bp, Homo sapiens
ttcccacctactgcact

SEQ ID NO: 1743441 - DNA, 11 bp, Homo sapiens
ttcccactccc

SEQ ID NO: 1743442 - DNA, 12 bp, Homo sapiens
ttcccactcccg

SEQ ID NO: 1743443 - DNA, 11 bp, Homo sapiens
ttcccactgca

SEQ ID NO: 1743444 - DNA, 20 bp, Homo sapiens
ttcccactgcactccagcct

SEQ ID NO: 1743445 - DNA, 21 bp, Homo sapiens
ttcccactgcactccagcctg

SEQ ID NO: 1743446 - DNA, 17 bp, Homo sapiens
ttcccactttcccaccc

SEQ ID NO: 1743447 - DNA, 11 bp, Homo sapiens
ttcccagacca

SEQ ID NO: 1743448 - DNA, 21 bp, Homo sapiens
ttcccagaccaggaaaggctt

SEQ ID NO: 1743449 - DNA, 18 bp, Homo sapiens
ttcccagagcaaaataat

SEQ ID NO: 1743450 - DNA, 23 bp, Homo sapiens
ttcccagcagggccactcccggc

SEQ ID NO: 1743451 - DNA, 14 bp, Homo sapiens
ttcccagctccccc

SEQ ID NO: 1743452 - DNA, 17 bp, Homo sapiens
agagtctagattcaaag

SEQ ID NO: 1743453 - DNA, 23 bp, Homo sapiens
agagtctagattcaaaggttcta

SEQ ID NO: 1743454 - DNA, 17 bp, Homo sapiens
agagtctgaacagctgt

SEQ ID NO: 1743455 - DNA, 14 bp, Homo sapiens
agagtctgagcccc

SEQ ID NO: 1743456 - DNA, 18 bp, Homo sapiens
agagtctggtgaagctca

SEQ ID NO: 1743457 - DNA, 16 bp, Homo sapiens
agagtgaaaattgtct

SEQ ID NO: 1743458 - DNA, 23 bp, Homo sapiens
agagtgaagcgtttttctttttc

SEQ ID NO: 1743459 - DNA, 15 bp, Homo sapiens
agagtgagaccctgt

SEQ ID NO: 1743460 - DNA, 12 bp, Homo sapiens
agagtgagactc

SEQ ID NO: 1743461 - DNA, 14 bp, Homo sapiens
agagtgagctctgg

SEQ ID NO: 1743462 - DNA, 14 bp, Homo sapiens
agagtgcacagctg

SEQ ID NO: 1743463 - DNA, 18 bp, Homo sapiens
agagtgcattgtgagggt

SEQ ID NO: 1743464 - DNA, 12 bp, Homo sapiens
agagtgcccaga

SEQ ID NO: 1743465 - DNA, 15 bp, Homo sapiens
agagtggaggaggag

SEQ ID NO: 1743466 - DNA, 16 bp, Homo sapiens
agagtggagtctgagt

SEQ ID NO: 1743467 - DNA, 17 bp, Homo sapiens
agagtggagtctgagtc

SEQ ID NO: 1743468 - DNA, 14 bp, Homo sapiens
agagtggagttgaa

SEQ ID NO: 1743469 - DNA, 23 bp, Homo sapiens
agagtggcaggtgggctgcctgc

SEQ ID NO: 1743470 - DNA, 18 bp, Homo sapiens
agagtggcctccctgctg

SEQ ID NO: 1743471 - DNA, 12 bp, Homo sapiens
agagtggctcct

SEQ ID NO: 1743472 - DNA, 13 bp, Homo sapiens
agagtggctcctc

SEQ ID NO: 1743473 - DNA, 15 bp, Homo sapiens
agagtggctcctccc

SEQ ID NO: 1743474 - DNA, 17 bp, Homo sapiens
agagtgggccccgggct

SEQ ID NO: 1743475 - DNA, 22 bp, Homo sapiens
agagtgggccccgggctggaga

SEQ ID NO: 1743476 - DNA, 16 bp, Homo sapiens
agagtgggtttcacaa

SEQ ID NO: 1743477 - DNA, 19 bp, Homo sapiens
agagtggttgttgccaact

SEQ ID NO: 1743478 - DNA, 21 bp, Homo sapiens
agagtgtagcctaaagggcag

SEQ ID NO: 1743479 - DNA, 22 bp, Homo sapiens
agagtgtagcctaaagggcagg

SEQ ID NO: 1743480 - DNA, 19 bp, Homo sapiens
agagtgtagctgtaagggc

SEQ ID NO: 1743481 - DNA, 20 bp, Homo sapiens
agagtgtagtttacagaaaa

SEQ ID NO: 1743482 - DNA, 16 bp, Homo sapiens
agagtgtcactgagct

SEQ ID NO: 1743483 - DNA, 19 bp, Homo sapiens
agagtgtcactgagctgtg

SEQ ID NO: 1743484 - DNA, 19 bp, Homo sapiens
agagtgtgaaatagacatt

SEQ ID NO: 1743485 - DNA, 18 bp, Homo sapiens
agagtgtgagagagactg

SEQ ID NO: 1743486 - DNA, 15 bp, Homo sapiens
agagtgtgtgggcag

SEQ ID NO: 1743487 - DNA, 16 bp, Homo sapiens
agagtgtgtgggcagg

SEQ ID NO: 1743488 - DNA, 15 bp, Homo sapiens
tcaccatcaatcctg

SEQ ID NO: 1743489 - DNA, 19 bp, Homo sapiens
tcaccatcaatcctgattc

SEQ ID NO: 1743490 - DNA, 20 bp, Homo sapiens
tcaccatcaatcctgattcc

SEQ ID NO: 1743491 - DNA, 17 bp, Homo sapiens
tcaccatccagtgggcc

SEQ ID NO: 1743492 - DNA, 18 bp, Homo sapiens
tcaccatccagtgggccc

SEQ ID NO: 1743493 - DNA, 15 bp, Homo sapiens
tcaccatgatgtgaa

SEQ ID NO: 1743494 - DNA, 13 bp, Homo sapiens
tcaccatgtattt

SEQ ID NO: 1743495 - DNA, 16 bp, Homo sapiens
tcaccatgttgcccag

SEQ ID NO: 1743496 - DNA, 15 bp, Homo sapiens
tcaccatgttggcca

SEQ ID NO: 1743497 - DNA, 13 bp, Homo sapiens
tcaccattcccag

SEQ ID NO: 1743498 - DNA, 15 bp, Homo sapiens
tcaccatttcctcct

SEQ ID NO: 1743499 - DNA, 14 bp, Homo sapiens
tcaccatttcttgg

SEQ ID NO: 1743500 - DNA, 19 bp, Homo sapiens
tcacccaaacacttctgct

SEQ ID NO: 1743501 - DNA, 21 bp, Homo sapiens
tcacccaaacacttctgcttt

SEQ ID NO: 1743502 - DNA, 19 bp, Homo sapiens
tcacccaagccacaagctg

SEQ ID NO: 1743503 - DNA, 11 bp, Homo sapiens
tcacccacagg

SEQ ID NO: 1743504 - DNA, 14 bp, Homo sapiens
tcacccacagggct

SEQ ID NO: 1743505 - DNA, 15 bp, Homo sapiens
tcacccacagggcta

SEQ ID NO: 1743506 - DNA, 22 bp, Homo sapiens
tcacccacagggctaagagcta

SEQ ID NO: 1743507 - DNA, 14 bp, Homo sapiens
tcacccacccctgc

SEQ ID NO: 1743508 - DNA, 15 bp, Homo sapiens
tcacccacgcatata

SEQ ID NO: 1743509 - DNA, 19 bp, Homo sapiens
tcacccaggctggagtgca

SEQ ID NO: 1743510 - DNA, 19 bp, Homo sapiens
tcacccaggttggagtgca

SEQ ID NO: 1743511 - DNA, 16 bp, Homo sapiens
tcacccagtccccacc

SEQ ID NO: 1743512 - DNA, 23 bp, Homo sapiens
tcacccagtccccacccgcctgc

SEQ ID NO: 1743513 - DNA, 15 bp, Homo sapiens
tcacccattatctgg

SEQ ID NO: 1743514 - DNA, 13 bp, Homo sapiens
tcacccccagctt

SEQ ID NO: 1743515 - DNA, 12 bp, Homo sapiens
tcacccccatcc

SEQ ID NO: 1743516 - DNA, 14 bp, Homo sapiens
tcacccccatggcc

SEQ ID NO: 1743517 - DNA, 23 bp, Homo sapiens
tcacccctaaaagaaaccctgca

SEQ ID NO: 1743518 - DNA, 14 bp, Homo sapiens
tcacccctagccct

SEQ ID NO: 1743519 - DNA, 20 bp, Homo sapiens
tcacccctagccctggttag

SEQ ID NO: 1743520 - DNA, 17 bp, Homo sapiens
tcacccctgccctggga

SEQ ID NO: 1743521 - DNA, 19 bp, Homo sapiens
tcacccctggttctcatct

SEQ ID NO: 1743522 - DNA, 14 bp, Homo sapiens
tcaccctccacttc

SEQ ID NO: 1743523 - DNA, 12 bp, Homo sapiens
tcaccctgcagg

SEQ ID NO: 1743524 - DNA, 14 bp, Homo sapiens
tcaccctgcccgct

SEQ ID NO: 1743525 - DNA, 13 bp, Homo sapiens
tcaccctgtccaa

SEQ ID NO: 1743526 - DNA, 21 bp, Homo sapiens
tcaccctgtccaaactgccta

SEQ ID NO: 1743527 - DNA, 15 bp, Homo sapiens
tcaccctttgctgtg

SEQ ID NO: 1743528 - DNA, 19 bp, Homo sapiens
tcaccgacagcggccttga

SEQ ID NO: 1743529 - DNA, 16 bp, Homo sapiens
tcaccgagtgggggca

SEQ ID NO: 1743530 - DNA, 13 bp, Homo sapiens
tcaccgcccatca

SEQ ID NO: 1743531 - DNA, 23 bp, Homo sapiens
tcaccggagctttcaaagaagga

SEQ ID NO: 1743532 - DNA, 21 bp, Homo sapiens
tcaccgtggctaccattgtca

SEQ ID NO: 1743533 - DNA, 18 bp, Homo sapiens
tcaccgtgttagccagga

SEQ ID NO: 1743534 - DNA, 14 bp, Homo sapiens
tcacctaatgttta

SEQ ID NO: 1743535 - DNA, 15 bp, Homo sapiens
tcacctagaaattga

SEQ ID NO: 1743536 - DNA, 17 bp, Homo sapiens
tcacctagaacgtgcat

SEQ ID NO: 1743537 - DNA, 17 bp, Homo sapiens
tcacctagcatgtgtaa

SEQ ID NO: 1743538 - DNA, 14 bp, Homo sapiens
tcacctatttaatg

SEQ ID NO: 1743539 - DNA, 22 bp, Homo sapiens
tcacctcagagtggagttgaaa

SEQ ID NO: 1743540 - DNA, 14 bp, Homo sapiens
tcacctcagctgat

SEQ ID NO: 1743541 - DNA, 15 bp, Homo sapiens
tcacctcattctgaa

SEQ ID NO: 1743542 - DNA, 14 bp, Homo sapiens
tcacctcctccact

SEQ ID NO: 1743543 - DNA, 16 bp, Homo sapiens
tcacctcctccactca

SEQ ID NO: 1743544 - DNA, 22 bp, Homo sapiens
tcacctcctcgaacccactccg

SEQ ID NO: 1743545 - DNA, 19 bp, Homo sapiens
tcacctcctctgtgatttc

SEQ ID NO: 1743546 - DNA, 16 bp, Homo sapiens
tcacctcgtctccctg

SEQ ID NO: 1743547 - DNA, 17 bp, Homo sapiens
tcacctcgtctccctgg

SEQ ID NO: 1743548 - DNA, 22 bp, Homo sapiens
tcacctcgtctccctggtgcct

SEQ ID NO: 1743549 - DNA, 16 bp, Homo sapiens
tcacctctcttcagcc

SEQ ID NO: 1743550 - DNA, 16 bp, Homo sapiens
tcacctctgaggacag

SEQ ID NO: 1743551 - DNA, 18 bp, Homo sapiens
tcacctctggactggcta

SEQ ID NO: 1743552 - DNA, 19 bp, Homo sapiens
tcacctctggactggctag

SEQ ID NO: 1743553 - DNA, 14 bp, Homo sapiens
tcacctgaacccca

SEQ ID NO: 1743554 - DNA, 15 bp, Homo sapiens
tcacctgagacctcc

SEQ ID NO: 1743555 - DNA, 20 bp, Homo sapiens
tcacctgagacctccactcc

SEQ ID NO: 1743556 - DNA, 15 bp, Homo sapiens
tcacctgaggtcggg

SEQ ID NO: 1743557 - DNA, 19 bp, Homo sapiens
tcacctgagtcaccctacc

SEQ ID NO: 1743558 - DNA, 14 bp, Homo sapiens
tcacctgcaagccc

SEQ ID NO: 1743559 - DNA, 16 bp, Homo sapiens
tcacctgcaagcccca

SEQ ID NO: 1743560 - DNA, 17 bp, Homo sapiens
tcacctgcaagccccag

SEQ ID NO: 1743561 - DNA, 19 bp, Homo sapiens
tcacctgcaagccccaggg

SEQ ID NO: 1743562 - DNA, 22 bp, Homo sapiens
tcacctgcaagccccagggcct

SEQ ID NO: 1743563 - DNA, 19 bp, Homo sapiens
tcacctggccctgcttcct

SEQ ID NO: 1743564 - DNA, 12 bp, Homo sapiens
tcacctgtcatc

SEQ ID NO: 1743565 - DNA, 17 bp, Homo sapiens
tcacctgtgacaaagga

SEQ ID NO: 1743566 - DNA, 17 bp, Homo sapiens
tcacctgtgtgcccagc

SEQ ID NO: 1743567 - DNA, 18 bp, Homo sapiens
tcacctgtgtgcccagca

SEQ ID NO: 1743568 - DNA, 19 bp, Homo sapiens
tcacctgtttttaagctgt

SEQ ID NO: 1743569 - DNA, 21 bp, Homo sapiens
tcacctgtttttaagctgttt

SEQ ID NO: 1743570 - DNA, 23 bp, Homo sapiens
tcaccttagggtggctttaattg

SEQ ID NO: 1743571 - DNA, 17 bp, Homo sapiens
tcaccttcgagtagaga

SEQ ID NO: 1743572 - DNA, 20 bp, Homo sapiens
tcaccttctagtcttggcca

SEQ ID NO: 1743573 - DNA, 23 bp, Homo sapiens
tcaccttggcaccagacacccag

SEQ ID NO: 1743574 - DNA, 17 bp, Homo sapiens
tcacctttccctaaaga

SEQ ID NO: 1743575 - DNA, 23 bp, Homo sapiens
tcacgagcctttgtttttctcca

SEQ ID NO: 1743576 - DNA, 13 bp, Homo sapiens
tcacgatttgcag

SEQ ID NO: 1743577 - DNA, 21 bp, Homo sapiens
tcacgcaggctgagtccagag

SEQ ID NO: 1743578 - DNA, 14 bp, Homo sapiens
tcacgccactgcac

SEQ ID NO: 1743579 - DNA, 16 bp, Homo sapiens
tcacgccactgcactc

SEQ ID NO: 1743580 - DNA, 22 bp, Homo sapiens
tcacgccactgcactccagcct

SEQ ID NO: 1743581 - DNA, 17 bp, Homo sapiens
ccacactgggcctggag

SEQ ID NO: 1743582 - DNA, 18 bp, Homo sapiens
ccacactgggcctggagc

SEQ ID NO: 1743583 - DNA, 22 bp, Homo sapiens
ccacactgggtgcgtctccagt

SEQ ID NO: 1743584 - DNA, 16 bp, Homo sapiens
ccacacttcaggctct

SEQ ID NO: 1743585 - DNA, 23 bp, Homo sapiens
ccacacttgaagcctaaatttgt

SEQ ID NO: 1743586 - DNA, 20 bp, Homo sapiens
ccacacttgttccagctctt

SEQ ID NO: 1743587 - DNA, 19 bp, Homo sapiens
ccacactttgaagcaaata

SEQ ID NO: 1743588 - DNA, 20 bp, Homo sapiens
ccacactttgaagcaaatac

SEQ ID NO: 1743589 - DNA, 12 bp, Homo sapiens
ccacagacacac

SEQ ID NO: 1743590 - DNA, 13 bp, Homo sapiens
ccacagacacaca

SEQ ID NO: 1743591 - DNA, 21 bp, Homo sapiens
ccacagacacacacacgcacg

SEQ ID NO: 1743592 - DNA, 16 bp, Homo sapiens
ccacagaccacctgct

SEQ ID NO: 1743593 - DNA, 14 bp, Homo sapiens
ccacagacccctgg

SEQ ID NO: 1743594 - DNA, 16 bp, Homo sapiens
ccacagacccctggga

SEQ ID NO: 1743595 - DNA, 16 bp, Homo sapiens
ccacagacttgcactg

SEQ ID NO: 1743596 - DNA, 20 bp, Homo sapiens
ccacagagaagtttgtagcc

SEQ ID NO: 1743597 - DNA, 21 bp, Homo sapiens
ccacagagaagtttgtagcca

SEQ ID NO: 1743598 - DNA, 17 bp, Homo sapiens
ccacagagtgagccagt

SEQ ID NO: 1743599 - DNA, 22 bp, Homo sapiens
ccacagatggctttcagggcag

SEQ ID NO: 1743600 - DNA, 17 bp, Homo sapiens
ccacagcacaaacacac

SEQ ID NO: 1743601 - DNA, 14 bp, Homo sapiens
ccacagcaggatcg

SEQ ID NO: 1743602 - DNA, 14 bp, Homo sapiens
ccacagcaggtcct

SEQ ID NO: 1743603 - DNA, 13 bp, Homo sapiens
ccacccactgacc

SEQ ID NO: 1743604 - DNA, 12 bp, Homo sapiens
ccacccaggctg

SEQ ID NO: 1743605 - DNA, 22 bp, Homo sapiens
ccacccaggctgcactgcagtg

SEQ ID NO: 1743606 - DNA, 12 bp, Homo sapiens
ccacccagtcca

SEQ ID NO: 1743607 - DNA, 12 bp, Homo sapiens
ccacccagtgct

SEQ ID NO: 1743608 - DNA, 13 bp, Homo sapiens
ccacccagtgctg

SEQ ID NO: 1743609 - DNA, 14 bp, Homo sapiens
ccacccagtgctgc

SEQ ID NO: 1743610 - DNA, 15 bp, Homo sapiens
ccacccagtgctgcc

SEQ ID NO: 1743611 - DNA, 21 bp, Homo sapiens
ccacccagtgctgccatgcca

SEQ ID NO: 1743612 - DNA, 21 bp, Homo sapiens
ccacccatcgtccaccccagt

SEQ ID NO: 1743613 - DNA, 15 bp, Homo sapiens
ccacccatcttcctg

SEQ ID NO: 1743614 - DNA, 20 bp, Homo sapiens
ccacccatcttcctgctgct

SEQ ID NO: 1743615 - DNA, 22 bp, Homo sapiens
ccacccatcttcctgctgctgt

SEQ ID NO: 1743616 - DNA, 19 bp, Homo sapiens
ccacccatgatactccact

SEQ ID NO: 1743617 - DNA, 16 bp, Homo sapiens
ccacccatgcagctgc

SEQ ID NO: 1743618 - DNA, 23 bp, Homo sapiens
ccacccatgcagctgctccccag

SEQ ID NO: 1743619 - DNA, 17 bp, Homo sapiens
ccaccccaagagaactc

SEQ ID NO: 1743620 - DNA, 19 bp, Homo sapiens
ccaccccaagagaactcgc

SEQ ID NO: 1743621 - DNA, 11 bp, Homo sapiens
ccaccccaccc

SEQ ID NO: 1743622 - DNA, 14 bp, Homo sapiens
ccaccccaccccct

SEQ ID NO: 1743623 - DNA, 17 bp, Homo sapiens
ccaccccactccagccc

SEQ ID NO: 1743624 - DNA, 16 bp, Homo sapiens
ccaccccatccagcca

SEQ ID NO: 1743625 - DNA, 18 bp, Homo sapiens
ccaccccatccagttcat

SEQ ID NO: 1743626 - DNA, 15 bp, Homo sapiens
ccacccccaccccca

SEQ ID NO: 1743627 - DNA, 13 bp, Homo sapiens
ccacccccagttc

SEQ ID NO: 1743628 - DNA, 12 bp, Homo sapiens
ccacccccatct

SEQ ID NO: 1743629 - DNA, 17 bp, Homo sapiens
ccaccccccacgtctgt

SEQ ID NO: 1743630 - DNA, 21 bp, Homo sapiens
ccaccccccagaacctgtcct

SEQ ID NO: 1743631 - DNA, 13 bp, Homo sapiens
ccacccccctccc

SEQ ID NO: 1743632 - DNA, 14 bp, Homo sapiens
ccaccccctgccct

SEQ ID NO: 1743633 - DNA, 18 bp, Homo sapiens
ccaccccctgccctgcac

SEQ ID NO: 1743634 - DNA, 12 bp, Homo sapiens
ccacccccttca

SEQ ID NO: 1743635 - DNA, 17 bp, Homo sapiens
ccacccccttcagtgcc

SEQ ID NO: 1743636 - DNA, 20 bp, Homo sapiens
ccacccccttcagtgcccac

SEQ ID NO: 1743637 - DNA, 22 bp, Homo sapiens
ccacccccttcagtgcccacca

SEQ ID NO: 1743638 - DNA, 18 bp, Homo sapiens
ccacccccttccctggga

SEQ ID NO: 1743639 - DNA, 19 bp, Homo sapiens
ccacccccttccctgggag

SEQ ID NO: 1743640 - DNA, 20 bp, Homo sapiens
ccacccccttccctgggagg

SEQ ID NO: 1743641 - DNA, 13 bp, Homo sapiens
ccacccccttctc

SEQ ID NO: 1743642 - DNA, 19 bp, Homo sapiens
ccacccccttctctgctcc

SEQ ID NO: 1743643 - DNA, 16 bp, Homo sapiens
ccaccccgctgatgga

SEQ ID NO: 1743644 - DNA, 17 bp, Homo sapiens
ccaccccggcctccact

SEQ ID NO: 1743645 - DNA, 20 bp, Homo sapiens
ccaccccgggctctctgctg

SEQ ID NO: 1743646 - DNA, 19 bp, Homo sapiens
ccaccccggggaccctgtg

SEQ ID NO: 1743647 - DNA, 17 bp, Homo sapiens
ccaccccgtgccacccg

SEQ ID NO: 1743648 - DNA, 14 bp, Homo sapiens
ccacccctaagtgc

SEQ ID NO: 1743649 - DNA, 19 bp, Homo sapiens
ccacccctaagtgcccaaa

SEQ ID NO: 1743650 - DNA, 13 bp, Homo sapiens
ccacccctcactc

SEQ ID NO: 1743651 - DNA, 23 bp, Homo sapiens
ccacccctcactccccagggagc

SEQ ID NO: 1743652 - DNA, 14 bp, Homo sapiens
ccacccctccacgt

SEQ ID NO: 1743653 - DNA, 13 bp, Homo sapiens
ccacccctccaga

SEQ ID NO: 1743654 - DNA, 12 bp, Homo sapiens
ccacccctgtgc

SEQ ID NO: 1743655 - DNA, 18 bp, Homo sapiens
ccaccccttccccaggcc

SEQ ID NO: 1743656 - DNA, 19 bp, Homo sapiens
ccaccccttggaggagaga

SEQ ID NO: 1743657 - DNA, 19 bp, Homo sapiens
ccacccgcagatgacacgc

SEQ ID NO: 1743658 - DNA, 15 bp, Homo sapiens
ccacccgcccgaggg

SEQ ID NO: 1743659 - DNA, 18 bp, Homo sapiens
ccacccggccacagctgc

SEQ ID NO: 1743660 - DNA, 20 bp, Homo sapiens
ccacccgggggagcccagtg

SEQ ID NO: 1743661 - DNA, 23 bp, Homo sapiens
ccacccgtaggcagcctctctgc

SEQ ID NO: 1743662 - DNA, 21 bp, Homo sapiens
ccacccgtcttcaatctctgt

SEQ ID NO: 1743663 - DNA, 20 bp, Homo sapiens
ccacccgtggggtgctgccc

SEQ ID NO: 1743664 - DNA, 21 bp, Homo sapiens
ccacccgtggggtgctgccct

SEQ ID NO: 1743665 - DNA, 13 bp, Homo sapiens
ccaccctcagcac

SEQ ID NO: 1743666 - DNA, 19 bp, Homo sapiens
ccaccctcatttctgccag

SEQ ID NO: 1743667 - DNA, 20 bp, Homo sapiens
ccaccctcatttctgccagc

SEQ ID NO: 1743668 - DNA, 19 bp, Homo sapiens
ccaccctccaccttccatt

SEQ ID NO: 1743669 - DNA, 21 bp, Homo sapiens
ccaccctcccctctcttgcac

SEQ ID NO: 1743670 - DNA, 22 bp, Homo sapiens
ccaccctgagccggccccaggc

SEQ ID NO: 1743671 - DNA, 18 bp, Homo sapiens
ccaccctgcattttcctc

SEQ ID NO: 1743672 - DNA, 13 bp, Homo sapiens
ccaccctgccaag

SEQ ID NO: 1743673 - DNA, 21 bp, Homo sapiens
ccaccctgccccccctaagag

SEQ ID NO: 1743674 - DNA, 12 bp, Homo sapiens
ccaccctggccc

SEQ ID NO: 1743675 - DNA, 15 bp, Homo sapiens
ccaccctggcccgcc

SEQ ID NO: 1743676 - DNA, 13 bp, Homo sapiens
ccaccctgggctc

SEQ ID NO: 1743677 - DNA, 14 bp, Homo sapiens
ccaccctgggctcc

SEQ ID NO: 1743678 - DNA, 16 bp, Homo sapiens
ccaccctgtcccccag

SEQ ID NO: 1743679 - DNA, 21 bp, Homo sapiens
ccaccctgtcccccagctctg

SEQ ID NO: 1743680 - DNA, 11 bp, Homo sapiens
ccacccttcca

SEQ ID NO: 1743681 - DNA, 17 bp, Homo sapiens
ccacccttggcctgtct

SEQ ID NO: 1743682 - DNA, 19 bp, Homo sapiens
ccacccttggcctgtctca

SEQ ID NO: 1743683 - DNA, 13 bp, Homo sapiens
ccaccgcctctgg

SEQ ID NO: 1743684 - DNA, 16 bp, Homo sapiens
ccaccgctgccagcac

SEQ ID NO: 1743685 - DNA, 14 bp, Homo sapiens
ccaccgctgcctaa

SEQ ID NO: 1743686 - DNA, 15 bp, Homo sapiens
ccaccgctgcctaag

SEQ ID NO: 1743687 - DNA, 17 bp, Homo sapiens
ccaccgggacagacctg

SEQ ID NO: 1743688 - DNA, 22 bp, Homo sapiens
ccaccgggttctgcagcggcag

SEQ ID NO: 1743689 - DNA, 17 bp, Homo sapiens
ccaccggtccagctggc

SEQ ID NO: 1743690 - DNA, 19 bp, Homo sapiens
ccaccgtccgccctgctcc

SEQ ID NO: 1743691 - DNA, 16 bp, Homo sapiens
ccaccgtggaggagga

SEQ ID NO: 1743692 - DNA, 14 bp, Homo sapiens
ccaccgtttcttcc

SEQ ID NO: 1743693 - DNA, 14 bp, Homo sapiens
ccacctacacccct

SEQ ID NO: 1743694 - DNA, 18 bp, Homo sapiens
ccacctaggccactcctc

SEQ ID NO: 1743695 - DNA, 14 bp, Homo sapiens
ccacctagtctgta

SEQ ID NO: 1743696 - DNA, 15 bp, Homo sapiens
ccacctcagaaagga

SEQ ID NO: 1743697 - DNA, 15 bp, Homo sapiens
ccacctcagcctcct

SEQ ID NO: 1743698 - DNA, 15 bp, Homo sapiens
ccacctcagccttgg

SEQ ID NO: 1743699 - DNA, 17 bp, Homo sapiens
ccacctcatcactggac

SEQ ID NO: 1743700 - DNA, 19 bp, Homo sapiens
ccacctcatcactggactg

SEQ ID NO: 1743701 - DNA, 12 bp, Homo sapiens
tcactgtcctgt

SEQ ID NO: 1743702 - DNA, 16 bp, Homo sapiens
tcactgtctttgactg

SEQ ID NO: 1743703 - DNA, 23 bp, Homo sapiens
tcactgtgaaccaacccccatct

SEQ ID NO: 1743704 - DNA, 14 bp, Homo sapiens
tcactgtgctcagc

SEQ ID NO: 1743705 - DNA, 15 bp, Homo sapiens
tcactgtgctcagcc

SEQ ID NO: 1743706 - DNA, 15 bp, Homo sapiens
tcactgttccctctg

SEQ ID NO: 1743707 - DNA, 22 bp, Homo sapiens
tcactgtttttttcccaggtgt

SEQ ID NO: 1743708 - DNA, 15 bp, Homo sapiens
tcacttaaagggtct

SEQ ID NO: 1743709 - DNA, 13 bp, Homo sapiens
tcacttaatcttt

SEQ ID NO: 1743710 - DNA, 23 bp, Homo sapiens
tcacttactatccatttcttcat

SEQ ID NO: 1743711 - DNA, 19 bp, Homo sapiens
tcacttagaacctttctgt

SEQ ID NO: 1743712 - DNA, 17 bp, Homo sapiens
tcacttagtcctttatc

SEQ ID NO: 1743713 - DNA, 14 bp, Homo sapiens
tcacttcattgttt

SEQ ID NO: 1743714 - DNA, 22 bp, Homo sapiens
tcacttccagtgttggctgtgt

SEQ ID NO: 1743715 - DNA, 20 bp, Homo sapiens
tcacttcccgtagctgccag

SEQ ID NO: 1743716 - DNA, 18 bp, Homo sapiens
tcacttctagatctcagc

SEQ ID NO: 1743717 - DNA, 17 bp, Homo sapiens
tcacttctccccgcagc

SEQ ID NO: 1743718 - DNA, 12 bp, Homo sapiens
ccacctctccaa

SEQ ID NO: 1743719 - DNA, 15 bp, Homo sapiens
ccacctctccaaggg

SEQ ID NO: 1743720 - DNA, 12 bp, Homo sapiens
ccacctctcctg

SEQ ID NO: 1743721 - DNA, 13 bp, Homo sapiens
ccacctctgcctc

SEQ ID NO: 1743722 - DNA, 15 bp, Homo sapiens
ccacctctgcctcta

SEQ ID NO: 1743723 - DNA, 20 bp, Homo sapiens
ccacctctgcctctagtccc

SEQ ID NO: 1743724 - DNA, 21 bp, Homo sapiens
ccacctctggtggctcctcct

SEQ ID NO: 1743725 - DNA, 13 bp, Homo sapiens
ccacctctgtggg

SEQ ID NO: 1743726 - DNA, 23 bp, Homo sapiens
ccacctctgtgggcactggtggg

SEQ ID NO: 1743727 - DNA, 18 bp, Homo sapiens
ccacctgacaatggcagc

SEQ ID NO: 1743728 - DNA, 19 bp, Homo sapiens
ccacctgacaatggcagct

SEQ ID NO: 1743729 - DNA, 17 bp, Homo sapiens
ccacctgacacaccagg

SEQ ID NO: 1743730 - DNA, 20 bp, Homo sapiens
ccacctgaggaactgtctcg

SEQ ID NO: 1743731 - DNA, 14 bp, Homo sapiens
ccacctgaggtggg

SEQ ID NO: 1743732 - DNA, 21 bp, Homo sapiens
ccacctgaggtgggcccagga

SEQ ID NO: 1743733 - DNA, 18 bp, Homo sapiens
ccacctgcatctggggcc

SEQ ID NO: 1743734 - DNA, 15 bp, Homo sapiens
ccacctgcccatcac

SEQ ID NO: 1743735 - DNA, 16 bp, Homo sapiens
ccacctgccttccatt

SEQ ID NO: 1743736 - DNA, 12 bp, Homo sapiens
ccacctgctctt

SEQ ID NO: 1743737 - DNA, 12 bp, Homo sapiens
ccacctggagag

SEQ ID NO: 1743738 - DNA, 22 bp, Homo sapiens
ccacctggcaaaggacccttga

SEQ ID NO: 1743739 - DNA, 23 bp, Homo sapiens
ccacctggcaaaggacccttgag

SEQ ID NO: 1743740 - DNA, 12 bp, Homo sapiens
ccacctggccac

SEQ ID NO: 1743741 - DNA, 13 bp, Homo sapiens
ccacctggccacc

SEQ ID NO: 1743742 - DNA, 12 bp, Homo sapiens
ccacctggcccc

SEQ ID NO: 1743743 - DNA, 21 bp, Homo sapiens
ccacctggccccatgtctctc

SEQ ID NO: 1743744 - DNA, 22 bp, Homo sapiens
ccacctggccccatgtctctca

SEQ ID NO: 1743745 - DNA, 15 bp, Homo sapiens
ccacctgtctcagcc

SEQ ID NO: 1743746 - DNA, 18 bp, Homo sapiens
ccacctgtctcagcctcc

SEQ ID NO: 1743747 - DNA, 18 bp, Homo sapiens
ccaccttcaattcctggg

SEQ ID NO: 1743748 - DNA, 16 bp, Homo sapiens
ccaccttcccagctct

SEQ ID NO: 1743749 - DNA, 14 bp, Homo sapiens
ccaccttggcctcc

SEQ ID NO: 1743750 - DNA, 20 bp, Homo sapiens
ccaccttgttggagcctgca

SEQ ID NO: 1743751 - DNA, 22 bp, Homo sapiens
ccaccttgttggagcctgcagg

SEQ ID NO: 1743752 - DNA, 13 bp, Homo sapiens
ccacctttactgt

SEQ ID NO: 1743753 - DNA, 24 bp, Homo sapiens
ccacctttggaaagctctgaccac

SEQ ID NO: 1743754 - DNA, 15 bp, Homo sapiens
ccacgactgccatgt

SEQ ID NO: 1743755 - DNA, 15 bp, Homo sapiens
ccacgagggctggct

SEQ ID NO: 1743756 - DNA, 22 bp, Homo sapiens
ccacgagggctggctggcctca

SEQ ID NO: 1743757 - DNA, 16 bp, Homo sapiens
ccacgagtcacctgca

SEQ ID NO: 1743758 - DNA, 18 bp, Homo sapiens
ccacgagtcacctgcaag

SEQ ID NO: 1743759 - DNA, 20 bp, Homo sapiens
ccacgcacgacgtcagcctc

SEQ ID NO: 1743760 - DNA, 21 bp, Homo sapiens
ccacgcacgacgtcagcctct

SEQ ID NO: 1743761 - DNA, 13 bp, Homo sapiens
ccacgcagccagg

SEQ ID NO: 1743762 - DNA, 16 bp, Homo sapiens
ccacgcagccaggaca

SEQ ID NO: 1743763 - DNA, 20 bp, Homo sapiens
ccacgcagggccatccactg

SEQ ID NO: 1743764 - DNA, 21 bp, Homo sapiens
ccacgcagggccatccactgt

SEQ ID NO: 1743765 - DNA, 20 bp, Homo sapiens
ccacgcccgtcctgcctgtg

SEQ ID NO: 1743766 - DNA, 21 bp, Homo sapiens
ccacgcccgtcctgcctgtgg

SEQ ID NO: 1743767 - DNA, 22 bp, Homo sapiens
ccacgcccgtcctgcctgtggc

SEQ ID NO: 1743768 - DNA, 19 bp, Homo sapiens
ccacgccctccctctccca

SEQ ID NO: 1743769 - DNA, 12 bp, Homo sapiens
ccacgcctcacc

SEQ ID NO: 1743770 - DNA, 13 bp, Homo sapiens
ccacgcctggaag

SEQ ID NO: 1743771 - DNA, 23 bp, Homo sapiens
ccacgctcttgaggaagcccagg

SEQ ID NO: 1743772 - DNA, 21 bp, Homo sapiens
ccacgctgaccatgcgtcagg

SEQ ID NO: 1743773 - DNA, 18 bp, Homo sapiens
ccacggacgtttccatca

SEQ ID NO: 1743774 - DNA, 19 bp, Homo sapiens
ccacggacgtttccatcag

SEQ ID NO: 1743775 - DNA, 19 bp, Homo sapiens
ccacggaggagggatgctg

SEQ ID NO: 1743776 - DNA, 14 bp, Homo sapiens
ccacggccaccctc

SEQ ID NO: 1743777 - DNA, 15 bp, Homo sapiens
ccacggccaccctcc

SEQ ID NO: 1743778 - DNA, 16 bp, Homo sapiens
ccacggccaccctcct

SEQ ID NO: 1743779 - DNA, 22 bp, Homo sapiens
ccacggccaccctccttcccgc

SEQ ID NO: 1743780 - DNA, 17 bp, Homo sapiens
ccacggccccgggtcca

SEQ ID NO: 1743781 - DNA, 15 bp, Homo sapiens
ccacggcctggctgg

SEQ ID NO: 1743782 - DNA, 23 bp, Homo sapiens
ccacggcctggctggtgggaagg

SEQ ID NO: 1743783 - DNA, 15 bp, Homo sapiens
ccacggtctggaggc

SEQ ID NO: 1743784 - DNA, 20 bp, Homo sapiens
ccacggtgcgtggctgtggc

SEQ ID NO: 1743785 - DNA, 12 bp, Homo sapiens
ccacgtcccagc

SEQ ID NO: 1743786 - DNA, 13 bp, Homo sapiens
ccacgtcccagca

SEQ ID NO: 1743787 - DNA, 15 bp, Homo sapiens
ccacgtccccctggg

SEQ ID NO: 1743788 - DNA, 22 bp, Homo sapiens
ccacgtccccctggggcttctc

SEQ ID NO: 1743789 - DNA, 15 bp, Homo sapiens
ccacgtctgccaggc

SEQ ID NO: 1743790 - DNA, 22 bp, Homo sapiens
ccacgtctgccaggcccatctc

SEQ ID NO: 1743791 - DNA, 12 bp, Homo sapiens
ccacgtctggct

SEQ ID NO: 1743792 - DNA, 17 bp, Homo sapiens
ccacgtctggctccctg

SEQ ID NO: 1743793 - DNA, 23 bp, Homo sapiens
ccacgtgagagaatctgcctgtg

SEQ ID NO: 1743794 - DNA, 14 bp, Homo sapiens
ccacgtgccaggcc

SEQ ID NO: 1743795 - DNA, 23 bp, Homo sapiens
ccacgtgccaggcccggggctgg

SEQ ID NO: 1743796 - DNA, 14 bp, Homo sapiens
ccacgtgtatagta

SEQ ID NO: 1743797 - DNA, 12 bp, Homo sapiens
ccacgtgtccgt

SEQ ID NO: 1743798 - DNA, 18 bp, Homo sapiens
ccacgtgtccgtccaccc

SEQ ID NO: 1743799 - DNA, 23 bp, Homo sapiens
ccacgtgtccgtccacccttcca

SEQ ID NO: 1743800 - DNA, 17 bp, Homo sapiens
ccacgttctcacaccca

SEQ ID NO: 1743801 - DNA, 23 bp, Homo sapiens
ccacgttctctctgcctgtgagc

SEQ ID NO: 1743802 - DNA, 21 bp, Homo sapiens
ccacgttggagaagcccgtgt

SEQ ID NO: 1743803 - DNA, 13 bp, Homo sapiens
ccactaaagcttc

SEQ ID NO: 1743804 - DNA, 21 bp, Homo sapiens
ccactaagaattcaaactggg

SEQ ID NO: 1743805 - DNA, 17 bp, Homo sapiens
ccactacacctggctga

SEQ ID NO: 1743806 - DNA, 14 bp, Homo sapiens
ccactacactccag

SEQ ID NO: 1743807 - DNA, 16 bp, Homo sapiens
ccactaccagccagcc

SEQ ID NO: 1743808 - DNA, 19 bp, Homo sapiens
ccactaccagccagcctca

SEQ ID NO: 1743809 - DNA, 20 bp, Homo sapiens
ccactaccagccagcctcag

SEQ ID NO: 1743810 - DNA, 13 bp, Homo sapiens
ccactagagggcc

SEQ ID NO: 1743811 - DNA, 19 bp, Homo sapiens
ccactaggaatcccagagg

SEQ ID NO: 1743812 - DNA, 23 bp, Homo sapiens
ccactaggaatcccagaggtggg

SEQ ID NO: 1743813 - DNA, 16 bp, Homo sapiens
ccactaggactctgag

SEQ ID NO: 1743814 - DNA, 18 bp, Homo sapiens
ccactaggactctgaggc

SEQ ID NO: 1743815 - DNA, 18 bp, Homo sapiens
ccactaggatcccactgg

SEQ ID NO: 1743816 - DNA, 12 bp, Homo sapiens
ccactattttca

SEQ ID NO: 1743817 - DNA, 22 bp, Homo sapiens
ccactcaatgtcttaggtcagg

SEQ ID NO: 1743818 - DNA, 15 bp, Homo sapiens
ccactcaccagccct

SEQ ID NO: 1743819 - DNA, 22 bp, Homo sapiens
tcagacctgacaccgtccctca

SEQ ID NO: 1743820 - DNA, 20 bp, Homo sapiens
tcagacctgtcttccaagga

SEQ ID NO: 1743821 - DNA, 22 bp, Homo sapiens
tcagacctgtcttccaaggaga

SEQ ID NO: 1743822 - DNA, 23 bp, Homo sapiens
tcagacctgtcttccaaggagac

SEQ ID NO: 1743823 - DNA, 13 bp, Homo sapiens
tcagacggcggcc

SEQ ID NO: 1743824 - DNA, 18 bp, Homo sapiens
tcagacggcggccaggca

SEQ ID NO: 1743825 - DNA, 18 bp, Homo sapiens
tcagactaaaaatacacc

SEQ ID NO: 1743826 - DNA, 19 bp, Homo sapiens
tcagactcccattcctgaa

SEQ ID NO: 1743827 - DNA, 14 bp, Homo sapiens
tcagactgcatgta

SEQ ID NO: 1743828 - DNA, 16 bp, Homo sapiens
tcagactgctgggact

SEQ ID NO: 1743829 - DNA, 21 bp, Homo sapiens
tcagactgctgggactggcca

SEQ ID NO: 1743830 - DNA, 13 bp, Homo sapiens
tcagactggctgg

SEQ ID NO: 1743831 - DNA, 20 bp, Homo sapiens
tcagactggctggctgcagt

SEQ ID NO: 1743832 - DNA, 15 bp, Homo sapiens
ccactccccggcatg

SEQ ID NO: 1743833 - DNA, 13 bp, Homo sapiens
ccactccctgagc

SEQ ID NO: 1743834 - DNA, 18 bp, Homo sapiens
ccactcccttgctggccc

SEQ ID NO: 1743835 - DNA, 13 bp, Homo sapiens
ccactcccttggt

SEQ ID NO: 1743836 - DNA, 20 bp, Homo sapiens
ccactccgagaggtgggcca

SEQ ID NO: 1743837 - DNA, 23 bp, Homo sapiens
ccactccgagaggtgggccagtc

SEQ ID NO: 1743838 - DNA, 14 bp, Homo sapiens
ccactcctccctcc

SEQ ID NO: 1743839 - DNA, 13 bp, Homo sapiens
ccactcctgtccc

SEQ ID NO: 1743840 - DNA, 20 bp, Homo sapiens
ccactcctgtcccgccttcc

SEQ ID NO: 1743841 - DNA, 17 bp, Homo sapiens
ccactccttctctcact

SEQ ID NO: 1743842 - DNA, 11 bp, Homo sapiens
ccactccttgt

SEQ ID NO: 1743843 - DNA, 23 bp, Homo sapiens
ccactcgacccagaatggagcct

SEQ ID NO: 1743844 - DNA, 17 bp, Homo sapiens
ccactcgcagtcgcagg

SEQ ID NO: 1743845 - DNA, 22 bp, Homo sapiens
ccactcgtccaagggacagccc

SEQ ID NO: 1743846 - DNA, 17 bp, Homo sapiens
ccactctagttctagat

SEQ ID NO: 1743847 - DNA, 14 bp, Homo sapiens
ccactctcattccc

SEQ ID NO: 1743848 - DNA, 13 bp, Homo sapiens
ccactctccccac

SEQ ID NO: 1743849 - DNA, 15 bp, Homo sapiens
ccactctccccacac

SEQ ID NO: 1743850 - DNA, 17 bp, Homo sapiens
ccactctccccacacta

SEQ ID NO: 1743851 - DNA, 18 bp, Homo sapiens
ccactctcggggcccttg

SEQ ID NO: 1743852 - DNA, 20 bp, Homo sapiens
ccactctctgggactctcct

SEQ ID NO: 1743853 - DNA, 14 bp, Homo sapiens
ccactctgcctctg

SEQ ID NO: 1743854 - DNA, 14 bp, Homo sapiens
ccactctgcctgcc

SEQ ID NO: 1743855 - DNA, 15 bp, Homo sapiens
ccactctgcctgcct

SEQ ID NO: 1743856 - DNA, 13 bp, Homo sapiens
ccactctgcttct

SEQ ID NO: 1743857 - DNA, 11 bp, Homo sapiens
ccactctggaa

SEQ ID NO: 1743858 - DNA, 17 bp, Homo sapiens
ccactcttgatctctct

SEQ ID NO: 1743859 - DNA, 17 bp, Homo sapiens
ccactgaaaaaatatat

SEQ ID NO: 1743860 - DNA, 19 bp, Homo sapiens
ccactgaaaaaatatatgt

SEQ ID NO: 1743861 - DNA, 23 bp, Homo sapiens
ccactgaaaacatttcaaagctg

SEQ ID NO: 1743862 - DNA, 17 bp, Homo sapiens
ccactgaaatgaccaag

SEQ ID NO: 1743863 - DNA, 17 bp, Homo sapiens
ccactgaacaaaaccta

SEQ ID NO: 1743864 - DNA, 14 bp, Homo sapiens
ccactgaagctggg

SEQ ID NO: 1743865 - DNA, 15 bp, Homo sapiens
ccactgaagctggga

SEQ ID NO: 1743866 - DNA, 21 bp, Homo sapiens
ccactgaattcactccagtca

SEQ ID NO: 1743867 - DNA, 24 bp, Homo sapiens
ccactgaattcactccagtcaaca

SEQ ID NO: 1743868 - DNA, 19 bp, Homo sapiens
ccactgacagcctcccacc

SEQ ID NO: 1743869 - DNA, 15 bp, Homo sapiens
ccactgacttgctgt

SEQ ID NO: 1743870 - DNA, 20 bp, Homo sapiens
ccactgagactttcccctct

SEQ ID NO: 1743871 - DNA, 13 bp, Homo sapiens
ccactgagcctgg

SEQ ID NO: 1743872 - DNA, 21 bp, Homo sapiens
ccactgaggagacagaaagcc

SEQ ID NO: 1743873 - DNA, 23 bp, Homo sapiens
ccactgaggagacagaaagcctc

SEQ ID NO: 1743874 - DNA, 16 bp, Homo sapiens
ccactgcactccagcc

SEQ ID NO: 1743875 - DNA, 17 bp, Homo sapiens
ccactgcactccagcct

SEQ ID NO: 1743876 - DNA, 19 bp, Homo sapiens
ccactgcactccagcctga

SEQ ID NO: 1743877 - DNA, 23 bp, Homo sapiens
ccactgcactccagcctgagtga

SEQ ID NO: 1743878 - DNA, 20 bp, Homo sapiens
ccactgcactccagcctggc

SEQ ID NO: 1743879 - DNA, 20 bp, Homo sapiens
ccactgcagtccgcagtctg

SEQ ID NO: 1743880 - DNA, 14 bp, Homo sapiens
ccactgccagcagc

SEQ ID NO: 1743881 - DNA, 23 bp, Homo sapiens
ccactgccagcagcagcaggtga

SEQ ID NO: 1743882 - DNA, 12 bp, Homo sapiens
ccactgccaggc

SEQ ID NO: 1743883 - DNA, 14 bp, Homo sapiens
ccactgccaggcac

SEQ ID NO: 1743884 - DNA, 15 bp, Homo sapiens
ccactgccaggcacc

SEQ ID NO: 1743885 - DNA, 22 bp, Homo sapiens
ccactgccaggcacctggcctg

SEQ ID NO: 1743886 - DNA, 20 bp, Homo sapiens
ccactgccattacccagtgc

SEQ ID NO: 1743887 - DNA, 21 bp, Homo sapiens
ccactgccattacccagtgcc

SEQ ID NO: 1743888 - DNA, 19 bp, Homo sapiens
ccactgccccctgctgcca

SEQ ID NO: 1743889 - DNA, 21 bp, Homo sapiens
ccactgccctgcctgcccact

SEQ ID NO: 1743890 - DNA, 13 bp, Homo sapiens
ccactgccctggc

SEQ ID NO: 1743891 - DNA, 19 bp, Homo sapiens
ccactgccctggcagcagc

SEQ ID NO: 1743892 - DNA, 22 bp, Homo sapiens
ccactgccgcctactggacgct

SEQ ID NO: 1743893 - DNA, 20 bp, Homo sapiens
ccactgcctctggaattgct

SEQ ID NO: 1743894 - DNA, 16 bp, Homo sapiens
ccactgccttcgcttc

SEQ ID NO: 1743895 - DNA, 22 bp, Homo sapiens
ccactgccttcgcttcttgcct

SEQ ID NO: 1743896 - DNA, 21 bp, Homo sapiens
ccactgctcgtggactgtgct

SEQ ID NO: 1743897 - DNA, 14 bp, Homo sapiens
ccactgctctcagc

SEQ ID NO: 1743898 - DNA, 14 bp, Homo sapiens
ccactgctggctgc

SEQ ID NO: 1743899 - DNA, 17 bp, Homo sapiens
ccactgcttcccactgg

SEQ ID NO: 1743900 - DNA, 20 bp, Homo sapiens
ccactgcttcccactggggc

SEQ ID NO: 1743901 - DNA, 21 bp, Homo sapiens
ccactgcttcccactggggcc

SEQ ID NO: 1743902 - DNA, 13 bp, Homo sapiens
ccactgcttctct

SEQ ID NO: 1743903 - DNA, 18 bp, Homo sapiens
ccactgctttccagcctg

SEQ ID NO: 1743904 - DNA, 14 bp, Homo sapiens
ccactgcttttccc

SEQ ID NO: 1743905 - DNA, 14 bp, Homo sapiens
ccactggaaggagc

SEQ ID NO: 1743906 - DNA, 15 bp, Homo sapiens
ccactggaaggagca

SEQ ID NO: 1743907 - DNA, 18 bp, Homo sapiens
ccactggaaggagcacat

SEQ ID NO: 1743908 - DNA, 16 bp, Homo sapiens
ccactggacttgagct

SEQ ID NO: 1743909 - DNA, 18 bp, Homo sapiens
ccactggccaccaggctg

SEQ ID NO: 1743910 - DNA, 20 bp, Homo sapiens
ccactggccaccaggctggc

SEQ ID NO: 1743911 - DNA, 16 bp, Homo sapiens
ccactgggaccaaccc

SEQ ID NO: 1743912 - DNA, 18 bp, Homo sapiens
ccactgggaccaaccctg

SEQ ID NO: 1743913 - DNA, 23 bp, Homo sapiens
ccactgggaccaaccctggggaa

SEQ ID NO: 1743914 - DNA, 11 bp, Homo sapiens
ccactgggcac

SEQ ID NO: 1743915 - DNA, 16 bp, Homo sapiens
ccactgggcacctgcg

SEQ ID NO: 1743916 - DNA, 17 bp, Homo sapiens
ccactgggcacctgcgc

SEQ ID NO: 1743917 - DNA, 19 bp, Homo sapiens
ccactgggcacctgcgcac

SEQ ID NO: 1743918 - DNA, 22 bp, Homo sapiens
ccactgggcacctgcgcacagg

SEQ ID NO: 1743919 - DNA, 17 bp, Homo sapiens
ccactgggccagccctg

SEQ ID NO: 1743920 - DNA, 16 bp, Homo sapiens
ccactgggtctcactc

SEQ ID NO: 1743921 - DNA, 19 bp, Homo sapiens
ccactgggtctcactcctg

SEQ ID NO: 1743922 - DNA, 15 bp, Homo sapiens
ccactgggtgagaga

SEQ ID NO: 1743923 - DNA, 17 bp, Homo sapiens
ccactggtttctcagaa

SEQ ID NO: 1743924 - DNA, 22 bp, Homo sapiens
ccactgtaatacgtagctctct

SEQ ID NO: 1743925 - DNA, 12 bp, Homo sapiens
ccactgtcctgg

SEQ ID NO: 1743926 - DNA, 14 bp, Homo sapiens
ccactgtcctgggc

SEQ ID NO: 1743927 - DNA, 19 bp, Homo sapiens
ccactgtcctgggcctgca

SEQ ID NO: 1743928 - DNA, 21 bp, Homo sapiens
ccactgtcctgggcctgcaga

SEQ ID NO: 1743929 - DNA, 15 bp, Homo sapiens
ccactgtcctgggcg

SEQ ID NO: 1743930 - DNA, 22 bp, Homo sapiens
ccactgtcctgggcgccctgga

SEQ ID NO: 1743931 - DNA, 20 bp, Homo sapiens
ccactgtctgtccctgaact

SEQ ID NO: 1743932 - DNA, 17 bp, Homo sapiens
ccactgtcttgtgtttt

SEQ ID NO: 1743933 - DNA, 22 bp, Homo sapiens
ccactgtgacgtcggccgacca

SEQ ID NO: 1743934 - DNA, 16 bp, Homo sapiens
ccactgtgcctcagag

SEQ ID NO: 1743935 - DNA, 19 bp, Homo sapiens
ccactgtgcctcagagacc

SEQ ID NO: 1743936 - DNA, 22 bp, Homo sapiens
ccactgtgcctcagagaccagg

SEQ ID NO: 1743937 - DNA, 18 bp, Homo sapiens
tcagcatctgaccatctg

SEQ ID NO: 1743938 - DNA, 20 bp, Homo sapiens
tcagcatctgaccatctgtg

SEQ ID NO: 1743939 - DNA, 21 bp, Homo sapiens
tcagcatctgaccatctgtga

SEQ ID NO: 1743940 - DNA, 15 bp, Homo sapiens
tcagcatctggctgt

SEQ ID NO: 1743941 - DNA, 22 bp, Homo sapiens
tcagcatgtccaacatggtaat

SEQ ID NO: 1743942 - DNA, 16 bp, Homo sapiens
tcagcatgtctattca

SEQ ID NO: 1743943 - DNA, 18 bp, Homo sapiens
tcagcattaggcttttaa

SEQ ID NO: 1743944 - DNA, 16 bp, Homo sapiens
tcagcattcaaaatag

SEQ ID NO: 1743945 - DNA, 17 bp, Homo sapiens
tcagcattctcactcct

SEQ ID NO: 1743946 - DNA, 14 bp, Homo sapiens
ttcaggagcgcaag

SEQ ID NO: 1743947 - DNA, 17 bp, Homo sapiens
ttcaggagcgcaagata

SEQ ID NO: 1743948 - DNA, 19 bp, Homo sapiens
ttcaggagcgcaagataga

SEQ ID NO: 1743949 - DNA, 21 bp, Homo sapiens
ttcaggatactctgtcagatg

SEQ ID NO: 1743950 - DNA, 22 bp, Homo sapiens
ttcaggcagcagtgtctgtacc

SEQ ID NO: 1743951 - DNA, 15 bp, Homo sapiens
ttcaggcattttgtt

SEQ ID NO: 1743952 - DNA, 14 bp, Homo sapiens
ttcaggccagccca

SEQ ID NO: 1743953 - DNA, 20 bp, Homo sapiens
ttcaggcgattctcctgcct

SEQ ID NO: 1743954 - DNA, 18 bp, Homo sapiens
ttcagggaatttcaggaa

SEQ ID NO: 1743955 - DNA, 18 bp, Homo sapiens
ttcagggcagggctctga

SEQ ID NO: 1743956 - DNA, 13 bp, Homo sapiens
ttcagggccagaa

SEQ ID NO: 1743957 - DNA, 16 bp, Homo sapiens
ttcagggccagaagga

SEQ ID NO: 1743958 - DNA, 19 bp, Homo sapiens
ttcaggggactcagccctg

SEQ ID NO: 1743959 - DNA, 14 bp, Homo sapiens
ttcagggtaaatag

SEQ ID NO: 1743960 - DNA, 15 bp, Homo sapiens
ttcagggtttaatag

SEQ ID NO: 1743961 - DNA, 11 bp, Homo sapiens
ttcaggtacag

SEQ ID NO: 1743962 - DNA, 13 bp, Homo sapiens
ttcaggtaggccc

SEQ ID NO: 1743963 - DNA, 15 bp, Homo sapiens
ttcaggtaggccctt

SEQ ID NO: 1743964 - DNA, 16 bp, Homo sapiens
ttcaggtatgttgcct

SEQ ID NO: 1743965 - DNA, 16 bp, Homo sapiens
ctcactcacagagtca

SEQ ID NO: 1743966 - DNA, 16 bp, Homo sapiens
ctcactcactcattcc

SEQ ID NO: 1743967 - DNA, 18 bp, Homo sapiens
ctcactcagccaccctga

SEQ ID NO: 1743968 - DNA, 18 bp, Homo sapiens
ctcactcagtaaaacata

SEQ ID NO: 1743969 - DNA, 12 bp, Homo sapiens
ctcactccacca

SEQ ID NO: 1743970 - DNA, 17 bp, Homo sapiens
ctcactccaccacccaa

SEQ ID NO: 1743971 - DNA, 12 bp, Homo sapiens
ctcactccccag

SEQ ID NO: 1743972 - DNA, 13 bp, Homo sapiens
ctcactccccagc

SEQ ID NO: 1743973 - DNA, 22 bp, Homo sapiens
ctcactccccagggagctctgg

SEQ ID NO: 1743974 - DNA, 17 bp, Homo sapiens
ctcactccctctgcaga

SEQ ID NO: 1743975 - DNA, 13 bp, Homo sapiens
ctcactcctacct

SEQ ID NO: 1743976 - DNA, 13 bp, Homo sapiens
ctcactgaactcc

SEQ ID NO: 1743977 - DNA, 17 bp, Homo sapiens
ctcactgaactccaccg

SEQ ID NO: 1743978 - DNA, 12 bp, Homo sapiens
ctcactgagagg

SEQ ID NO: 1743979 - DNA, 18 bp, Homo sapiens
ctcactgcaaccttcacc

SEQ ID NO: 1743980 - DNA, 14 bp, Homo sapiens
ctcactgcagcctc

SEQ ID NO: 1743981 - DNA, 18 bp, Homo sapiens
ctcactgcagcctcagcg

SEQ ID NO: 1743982 - DNA, 12 bp, Homo sapiens
ctcactgccagg

SEQ ID NO: 1743983 - DNA, 14 bp, Homo sapiens
ctcactgccaggcc

SEQ ID NO: 1743984 - DNA, 15 bp, Homo sapiens
ctcactgccaggcca

SEQ ID NO: 1743985 - DNA, 21 bp, Homo sapiens
ctcactgccaggccagcctcc

SEQ ID NO: 1743986 - DNA, 12 bp, Homo sapiens
ctcactgcctag

SEQ ID NO: 1743987 - DNA, 19 bp, Homo sapiens
ctcactgcctaggaggctg

SEQ ID NO: 1743988 - DNA, 19 bp, Homo sapiens
ctcactgctcaagaagaca

SEQ ID NO: 1743989 - DNA, 21 bp, Homo sapiens
ctcactgctcaagaagacatg

SEQ ID NO: 1743990 - DNA, 14 bp, Homo sapiens
ctcactggaggagc

SEQ ID NO: 1743991 - DNA, 22 bp, Homo sapiens
ctcactggaggagcagcttcct

SEQ ID NO: 1743992 - DNA, 16 bp, Homo sapiens
ctcactggcaggtgtg

SEQ ID NO: 1743993 - DNA, 17 bp, Homo sapiens
ctcactggcaggtgtgg

SEQ ID NO: 1743994 - DNA, 14 bp, Homo sapiens
ctcactggctgggg

SEQ ID NO: 1743995 - DNA, 12 bp, Homo sapiens
ctcactgggtgg

SEQ ID NO: 1743996 - DNA, 13 bp, Homo sapiens
ctcactgggtggg

SEQ ID NO: 1743997 - DNA, 21 bp, Homo sapiens
ctcactgtcgcccaggctgga

SEQ ID NO: 1743998 - DNA, 17 bp, Homo sapiens
ctcactgtgttactgct

SEQ ID NO: 1743999 - DNA, 21 bp, Homo sapiens
ctcactgtttgtttttattta

SEQ ID NO: 1744000 - DNA, 14 bp, Homo sapiens
ctcacttagtcctt

SEQ ID NO: 1744001 - DNA, 21 bp, Homo sapiens
ctcacttctagatctcagcca

SEQ ID NO: 1744002 - DNA, 18 bp, Homo sapiens
ctcacttctgtctcctgt

SEQ ID NO: 1744003 - DNA, 23 bp, Homo sapiens
ctcacttgatgtttcctggaagc

SEQ ID NO: 1744004 - DNA, 16 bp, Homo sapiens
ctcacttggctgtctg

SEQ ID NO: 1744005 - DNA, 18 bp, Homo sapiens
ctcagaaactccatgatg

SEQ ID NO: 1744006 - DNA, 10 bp, Homo sapiens
ctcagaaagt

SEQ ID NO: 1744007 - DNA, 17 bp, Homo sapiens
ctcagaaagtgcctgac

SEQ ID NO: 1744008 - DNA, 14 bp, Homo sapiens
ctcagaacatactg

SEQ ID NO: 1744009 - DNA, 18 bp, Homo sapiens
ctcagaactctccaggga

SEQ ID NO: 1744010 - DNA, 11 bp, Homo sapiens
ctcagaagaaa

SEQ ID NO: 1744011 - DNA, 22 bp, Homo sapiens
ctcagaagaggttgggcttcca

SEQ ID NO: 1744012 - DNA, 13 bp, Homo sapiens
ctcagaagcacag

SEQ ID NO: 1744013 - DNA, 13 bp, Homo sapiens
ctcagaagcctga

SEQ ID NO: 1744014 - DNA, 14 bp, Homo sapiens
ctcagaagcctgag

SEQ ID NO: 1744015 - DNA, 20 bp, Homo sapiens
ctcagaaggccccagagaga

SEQ ID NO: 1744016 - DNA, 17 bp, Homo sapiens
ctcagaaggtctgtttt

SEQ ID NO: 1744017 - DNA, 16 bp, Homo sapiens
ctcagaataactacct

SEQ ID NO: 1744018 - DNA, 17 bp, Homo sapiens
ctcagaataactacctc

SEQ ID NO: 1744019 - DNA, 19 bp, Homo sapiens
ctcagaataactacctcct

SEQ ID NO: 1744020 - DNA, 12 bp, Homo sapiens
ctcagaatattg

SEQ ID NO: 1744021 - DNA, 21 bp, Homo sapiens
ctcagaatctaaacgtggtca

SEQ ID NO: 1744022 - DNA, 17 bp, Homo sapiens
ctcagaatctcaaataa

SEQ ID NO: 1744023 - DNA, 23 bp, Homo sapiens
ctcagaattcggtgtgctgccaa

SEQ ID NO: 1744024 - DNA, 19 bp, Homo sapiens
ctcagacatgttttccgtg

SEQ ID NO: 1744025 - DNA, 17 bp, Homo sapiens
ctcagacattggcacct

SEQ ID NO: 1744026 - DNA, 22 bp, Homo sapiens
ctcagacattttctttttttaa

SEQ ID NO: 1744027 - DNA, 16 bp, Homo sapiens
ctcagacggcggccag

SEQ ID NO: 1744028 - DNA, 19 bp, Homo sapiens
ctcagacggcggccaggca

SEQ ID NO: 1744029 - DNA, 21 bp, Homo sapiens
ctcagacggcggccaggcaca

SEQ ID NO: 1744030 - DNA, 23 bp, Homo sapiens
ctcagacggcggccaggcacagg

SEQ ID NO: 1744031 - DNA, 19 bp, Homo sapiens
ctcagacgtgtgacctcca

SEQ ID NO: 1744032 - DNA, 20 bp, Homo sapiens
ctcagagaaggaaaagactg

SEQ ID NO: 1744033 - DNA, 23 bp, Homo sapiens
ctcagagacaccaaactgccaaa

SEQ ID NO: 1744034 - DNA, 19 bp, Homo sapiens
ctcagagacaggtggccta

SEQ ID NO: 1744035 - DNA, 22 bp, Homo sapiens
ctcagagacaggtggcctagca

SEQ ID NO: 1744036 - DNA, 21 bp, Homo sapiens
ctcagagaccagcactcagcc

SEQ ID NO: 1744037 - DNA, 24 bp, Homo sapiens
ctcagagaccagcactcagcctca

SEQ ID NO: 1744038 - DNA, 16 bp, Homo sapiens
ctcagagcagggccaa

SEQ ID NO: 1744039 - DNA, 19 bp, Homo sapiens
ctcagagcagggccaaagc

SEQ ID NO: 1744040 - DNA, 12 bp, Homo sapiens
ctcagaggccca

SEQ ID NO: 1744041 - DNA, 16 bp, Homo sapiens
ctcagagtcccaggac

SEQ ID NO: 1744042 - DNA, 15 bp, Homo sapiens
ctcagatataagaga

SEQ ID NO: 1744043 - DNA, 16 bp, Homo sapiens
ctcagatataagagaa

SEQ ID NO: 1744044 - DNA, 20 bp, Homo sapiens
ctcagatccaggcaggagca

SEQ ID NO: 1744045 - DNA, 15 bp, Homo sapiens
ctcagatccagggac

SEQ ID NO: 1744046 - DNA, 17 bp, Homo sapiens
ctcagatccagggacag

SEQ ID NO: 1744047 - DNA, 18 bp, Homo sapiens
ctcagatccagggacaga

SEQ ID NO: 1744048 - DNA, 16 bp, Homo sapiens
ctcagatctggtttct

SEQ ID NO: 1744049 - DNA, 12 bp, Homo sapiens
ctcagattcttc

SEQ ID NO: 1744050 - DNA, 16 bp, Homo sapiens
ctcagattcttcattg

SEQ ID NO: 1744051 - DNA, 23 bp, Homo sapiens
ctcagattcttcattgaggattg

SEQ ID NO: 1744052 - DNA, 20 bp, Homo sapiens
ctcagcaagtgcccagtgga

SEQ ID NO: 1744053 - DNA, 21 bp, Homo sapiens
ctcagcacaatctgtaaattt

SEQ ID NO: 1744054 - DNA, 16 bp, Homo sapiens
ctcagcaccaagagca

SEQ ID NO: 1744055 - DNA, 12 bp, Homo sapiens
ctcagcagccct

SEQ ID NO: 1744056 - DNA, 14 bp, Homo sapiens
ctcagcagccctcc

SEQ ID NO: 1744057 - DNA, 15 bp, Homo sapiens
ctcagcagccctcct

SEQ ID NO: 1744058 - DNA, 23 bp, Homo sapiens
ctcagcagccgccttaagctgat

SEQ ID NO: 1744059 - DNA, 20 bp, Homo sapiens
ctcagcatttgattaacatt

SEQ ID NO: 1744060 - DNA, 17 bp, Homo sapiens
ctcagccacacccaggc

SEQ ID NO: 1744061 - DNA, 22 bp, Homo sapiens
ttcatcttgcagcatttactat

SEQ ID NO: 1744062 - DNA, 22 bp, Homo sapiens
ttcatgaaaaagctgcttctta

SEQ ID NO: 1744063 - DNA, 15 bp, Homo sapiens
ttcatgaatgtgctg

SEQ ID NO: 1744064 - DNA, 16 bp, Homo sapiens
ttcatgacagcctcca

SEQ ID NO: 1744065 - DNA, 16 bp, Homo sapiens
ttcatgatgtgtgagt

SEQ ID NO: 1744066 - DNA, 23 bp, Homo sapiens
ttcatgattatagcaactaatgt

SEQ ID NO: 1744067 - DNA, 15 bp, Homo sapiens
ttcatgcaagagttt

SEQ ID NO: 1744068 - DNA, 21 bp, Homo sapiens
ttcatgcaatgacatcttcaa

SEQ ID NO: 1744069 - DNA, 21 bp, Homo sapiens
ttcatgcagacaaagccctgt

SEQ ID NO: 1744070 - DNA, 15 bp, Homo sapiens
ttcatgcagctgtgg

SEQ ID NO: 1744071 - DNA, 19 bp, Homo sapiens
ttcatgccaccatggccag

SEQ ID NO: 1744072 - DNA, 22 bp, Homo sapiens
ttcatgccaccatggccagcca

SEQ ID NO: 1744073 - DNA, 16 bp, Homo sapiens
ttcatgcccttctgat

SEQ ID NO: 1744074 - DNA, 18 bp, Homo sapiens
ttcatgctatctctgtgt

SEQ ID NO: 1744075 - DNA, 13 bp, Homo sapiens
ttcatgcttgaca

SEQ ID NO: 1744076 - DNA, 16 bp, Homo sapiens
ttcatgcttgacatac

SEQ ID NO: 1744077 - DNA, 20 bp, Homo sapiens
ttcatggacactttgaaatg

SEQ ID NO: 1744078 - DNA, 15 bp, Homo sapiens
ttcatggtctctgca

SEQ ID NO: 1744079 - DNA, 21 bp, Homo sapiens
ttcatgtaattttattttaaa

SEQ ID NO: 1744080 - DNA, 15 bp, Homo sapiens
ttcatgtagaactca

SEQ ID NO: 1744081 - DNA, 19 bp, Homo sapiens
ttcatgtctgaaacagaga

SEQ ID NO: 1744082 - DNA, 20 bp, Homo sapiens
ttcatgtctgaaacagagaa

SEQ ID NO: 1744083 - DNA, 23 bp, Homo sapiens
ttcatgtgttgcaaattattcta

SEQ ID NO: 1744084 - DNA, 19 bp, Homo sapiens
aaaaatatatttaatgata

SEQ ID NO: 1744085 - DNA, 22 bp, Homo sapiens
aaaaatatgaacctattttcat

SEQ ID NO: 1744086 - DNA, 14 bp, Homo sapiens
aaaaatatgtaatt

SEQ ID NO: 1744087 - DNA, 15 bp, Homo sapiens
aaaaatatttaatgt

SEQ ID NO: 1744088 - DNA, 13 bp, Homo sapiens
aaaaatattttct

SEQ ID NO: 1744089 - DNA, 16 bp, Homo sapiens
aaaaatcatgtttgct

SEQ ID NO: 1744090 - DNA, 21 bp, Homo sapiens
aaaaatccattttacacagca

SEQ ID NO: 1744091 - DNA, 23 bp, Homo sapiens
aaaaatcgatgagcgccacctct

SEQ ID NO: 1744092 - DNA, 23 bp, Homo sapiens
aaaaatctagtgggttgaccttt

SEQ ID NO: 1744093 - DNA, 12 bp, Homo sapiens
aaaaatctagtt

SEQ ID NO: 1744094 - DNA, 16 bp, Homo sapiens
aaaaatctagtttttt

SEQ ID NO: 1744095 - DNA, 12 bp, Homo sapiens
aaaaatgaaagc

SEQ ID NO: 1744096 - DNA, 13 bp, Homo sapiens
aaaaatgacaaca

SEQ ID NO: 1744097 - DNA, 20 bp, Homo sapiens
aaaaatgactaaaaatatta

SEQ ID NO: 1744098 - DNA, 22 bp, Homo sapiens
aaaaatgagcttgattaaatca

SEQ ID NO: 1744099 - DNA, 22 bp, Homo sapiens
aaaaatgagttgtcacagaaat

SEQ ID NO: 1744100 - DNA, 17 bp, Homo sapiens
aaaaatgcattgaacat

SEQ ID NO: 1744101 - DNA, 12 bp, Homo sapiens
aaaaatgctgct

SEQ ID NO: 1744102 - DNA, 22 bp, Homo sapiens
aaaaatgggagacagcctctta

SEQ ID NO: 1744103 - DNA, 16 bp, Homo sapiens
aaaaatgggagccagg

SEQ ID NO: 1744104 - DNA, 15 bp, Homo sapiens
aaaaatggtataaaa

SEQ ID NO: 1744105 - DNA, 22 bp, Homo sapiens
aaaaatggttgatggaaaataa

SEQ ID NO: 1744106 - DNA, 13 bp, Homo sapiens
aaaaatgtaacat

SEQ ID NO: 1744107 - DNA, 19 bp, Homo sapiens
aaaaatgtacttaaagggt

SEQ ID NO: 1744108 - DNA, 16 bp, Homo sapiens
aaaaatgtttccactg

SEQ ID NO: 1744109 - DNA, 18 bp, Homo sapiens
aaaaattactaattttac

SEQ ID NO: 1744110 - DNA, 15 bp, Homo sapiens
aaaaattatcaaaaa

SEQ ID NO: 1744111 - DNA, 23 bp, Homo sapiens
aaaaattgtattgaaaacactta

SEQ ID NO: 1744112 - DNA, 18 bp, Homo sapiens
aaaaatttttataaatta

SEQ ID NO: 1744113 - DNA, 14 bp, Homo sapiens
aaaaatttttatgt

SEQ ID NO: 1744114 - DNA, 15 bp, Homo sapiens
aaaaatttttgcaaa

SEQ ID NO: 1744115 - DNA, 11 bp, Homo sapiens
aaaacaaaaag

SEQ ID NO: 1744116 - DNA, 15 bp, Homo sapiens
aaaacaaaaagatgt

SEQ ID NO: 1744117 - DNA, 19 bp, Homo sapiens
aaaacaaaagggtgtatag

SEQ ID NO: 1744118 - DNA, 12 bp, Homo sapiens
aaaacaaaattt

SEQ ID NO: 1744119 - DNA, 19 bp, Homo sapiens
aaaacaaagcagctttaaa

SEQ ID NO: 1744120 - DNA, 15 bp, Homo sapiens
aaaacaaatcactgt

SEQ ID NO: 1744121 - DNA, 20 bp, Homo sapiens
aaaacaactttcacttcttc

SEQ ID NO: 1744122 - DNA, 21 bp, Homo sapiens
aaaacaactttcacttcttcc

SEQ ID NO: 1744123 - DNA, 22 bp, Homo sapiens
aaaacaactttcacttcttcct

SEQ ID NO: 1744124 - DNA, 20 bp, Homo sapiens
aaaacaagtcatttttgtat

SEQ ID NO: 1744125 - DNA, 22 bp, Homo sapiens
aaaacaagtcatttttgtattt

SEQ ID NO: 1744126 - DNA, 18 bp, Homo sapiens
aaaacaatattgtttcta

SEQ ID NO: 1744127 - DNA, 19 bp, Homo sapiens
aaaacaatctggaagaaaa

SEQ ID NO: 1744128 - DNA, 21 bp, Homo sapiens
aaaacaatgccatgaacaaat

SEQ ID NO: 1744129 - DNA, 20 bp, Homo sapiens
aaaacaattttctgtaatct

SEQ ID NO: 1744130 - DNA, 16 bp, Homo sapiens
aaaacacacctcgtgg

SEQ ID NO: 1744131 - DNA, 21 bp, Homo sapiens
aaaacaccgcttctgcctttt

SEQ ID NO: 1744132 - DNA, 22 bp, Homo sapiens
aaaacaccgcttctgccttttc

SEQ ID NO: 1744133 - DNA, 22 bp, Homo sapiens
aaaacacctagctttattcttc

SEQ ID NO: 1744134 - DNA, 18 bp, Homo sapiens
aaaacactgccatcttag

SEQ ID NO: 1744135 - DNA, 18 bp, Homo sapiens
aaaacacttggcatacaa

SEQ ID NO: 1744136 - DNA, 15 bp, Homo sapiens
aaaacagaatcttct

SEQ ID NO: 1744137 - DNA, 17 bp, Homo sapiens
aaaacagaatttgagaa

SEQ ID NO: 1744138 - DNA, 17 bp, Homo sapiens
aaaacagacactggcat

SEQ ID NO: 1744139 - DNA, 15 bp, Homo sapiens
aaaacagacgggtct

SEQ ID NO: 1744140 - DNA, 12 bp, Homo sapiens
aaaacagatatt

SEQ ID NO: 1744141 - DNA, 16 bp, Homo sapiens
aaaacagcattgcttt

SEQ ID NO: 1744142 - DNA, 20 bp, Homo sapiens
aaaacagcattgctttctga

SEQ ID NO: 1744143 - DNA, 21 bp, Homo sapiens
aaaacagccaccgtttcttcc

SEQ ID NO: 1744144 - DNA, 18 bp, Homo sapiens
aaaacaggcaaagtttta

SEQ ID NO: 1744145 - DNA, 15 bp, Homo sapiens
aaaacataacataaa

SEQ ID NO: 1744146 - DNA, 17 bp, Homo sapiens
aaaacataatcttctgc

SEQ ID NO: 1744147 - DNA, 24 bp, Homo sapiens
aaaacataatcttctgccttctca

SEQ ID NO: 1744148 - DNA, 21 bp, Homo sapiens
aaaacatccagatacacccaa

SEQ ID NO: 1744149 - DNA, 21 bp, Homo sapiens
aaaacatctattctctccaaa

SEQ ID NO: 1744150 - DNA, 14 bp, Homo sapiens
aaaacatggtagaa

SEQ ID NO: 1744151 - DNA, 19 bp, Homo sapiens
aaaacatgtaatataaaga

SEQ ID NO: 1744152 - DNA, 13 bp, Homo sapiens
aaaacatgtatgt

SEQ ID NO: 1744153 - DNA, 23 bp, Homo sapiens
aaaacattgcaaatttattttat

SEQ ID NO: 1744154 - DNA, 11 bp, Homo sapiens
aaaacatttct

SEQ ID NO: 1744155 - DNA, 18 bp, Homo sapiens
aaaacattttgaaggaaa

SEQ ID NO: 1744156 - DNA, 22 bp, Homo sapiens
aaaaccaaagagggcttcctct

SEQ ID NO: 1744157 - DNA, 12 bp, Homo sapiens
aaaaccacacaa

SEQ ID NO: 1744158 - DNA, 11 bp, Homo sapiens
aaaaccacagc

SEQ ID NO: 1744159 - DNA, 16 bp, Homo sapiens
aaaaccacagctgggc

SEQ ID NO: 1744160 - DNA, 14 bp, Homo sapiens
aaaaccacagtcag

SEQ ID NO: 1744161 - DNA, 19 bp, Homo sapiens
aaaaccacagtcagtggag

SEQ ID NO: 1744162 - DNA, 16 bp, Homo sapiens
aaaaccactagaactc

SEQ ID NO: 1744163 - DNA, 22 bp, Homo sapiens
aaaaccagctgctactcataag

SEQ ID NO: 1744164 - DNA, 20 bp, Homo sapiens
aaaaccatcaaaaatattcc

SEQ ID NO: 1744165 - DNA, 22 bp, Homo sapiens
aaaacccaccttgttggagcct

SEQ ID NO: 1744166 - DNA, 18 bp, Homo sapiens
aaaacccagactgtctcc

SEQ ID NO: 1744167 - DNA, 21 bp, Homo sapiens
aaaacccagcaacagaaaaat

SEQ ID NO: 1744168 - DNA, 21 bp, Homo sapiens
aaaaccctcagcactgttaca

SEQ ID NO: 1744169 - DNA, 15 bp, Homo sapiens
aaaaccctgaagcca

SEQ ID NO: 1744170 - DNA, 20 bp, Homo sapiens
aaaacctaagtcctttatgt

SEQ ID NO: 1744171 - DNA, 20 bp, Homo sapiens
aaaacctacacacatacctt

SEQ ID NO: 1744172 - DNA, 20 bp, Homo sapiens
aaaacctacgcacatacctt

SEQ ID NO: 1744173 - DNA, 20 bp, Homo sapiens
aaaacctcatgacagccaga

SEQ ID NO: 1744174 - DNA, 12 bp, Homo sapiens
aaaaccttcctt

SEQ ID NO: 1744175 - DNA, 13 bp, Homo sapiens
aaaaccttgtaaa

SEQ ID NO: 1744176 - DNA, 20 bp, Homo sapiens
aaaactaaggatttttcaag

SEQ ID NO: 1744177 - DNA, 14 bp, Homo sapiens
aaaactaatttcat

SEQ ID NO: 1744178 - DNA, 17 bp, Homo sapiens
aaaactaatttcatact

SEQ ID NO: 1744179 - DNA, 17 bp, Homo sapiens
aaaactacttctttttt

SEQ ID NO: 1744180 - DNA, 13 bp, Homo sapiens
aaaactagcatta

SEQ ID NO: 1744181 - DNA, 22 bp, Homo sapiens
aaaactagggctcattttcctg

SEQ ID NO: 1744182 - DNA, 19 bp, Homo sapiens
aaaactatcggttcaagtt

SEQ ID NO: 1744183 - DNA, 18 bp, Homo sapiens
aaaactcagttaaaatgt

SEQ ID NO: 1744184 - DNA, 16 bp, Homo sapiens
aaaactccaccttccc

SEQ ID NO: 1744185 - DNA, 12 bp, Homo sapiens
aaaactctactt

SEQ ID NO: 1744186 - DNA, 18 bp, Homo sapiens
aaaactctacttaatcca

SEQ ID NO: 1744187 - DNA, 21 bp, Homo sapiens
aaaactctacttaatccaatg

SEQ ID NO: 1744188 - DNA, 15 bp, Homo sapiens
aaaactctctcccag

SEQ ID NO: 1744189 - DNA, 17 bp, Homo sapiens
aaaactctctcccagga

SEQ ID NO: 1744190 - DNA, 16 bp, Homo sapiens
aaaactgactccttag

SEQ ID NO: 1744191 - DNA, 18 bp, Homo sapiens
aaaactgcgaggacatca

SEQ ID NO: 1744192 - DNA, 23 bp, Homo sapiens
aaaactgcttttttttttccagc

SEQ ID NO: 1744193 - DNA, 21 bp, Homo sapiens
aaaactgtaaataaaatgtgt

SEQ ID NO: 1744194 - DNA, 17 bp, Homo sapiens
aaaacttaaaaattaat

SEQ ID NO: 1744195 - DNA, 18 bp, Homo sapiens
aaaacttaaaaattaata

SEQ ID NO: 1744196 - DNA, 22 bp, Homo sapiens
aaaacttcattctaaaccaaaa

SEQ ID NO: 1744197 - DNA, 19 bp, Homo sapiens
aaaacttggttttatggtt

SEQ ID NO: 1744198 - DNA, 17 bp, Homo sapiens
aaaatgtgatgttctaa

SEQ ID NO: 1744199 - DNA, 19 bp, Homo sapiens
aaaatgtgatgttctaagg

SEQ ID NO: 1744200 - DNA, 18 bp, Homo sapiens
aaaatgtgatttttctga

SEQ ID NO: 1744201 - DNA, 21 bp, Homo sapiens
aaaatgtgggattatgggtca

SEQ ID NO: 1744202 - DNA, 20 bp, Homo sapiens
aaaatgtgtatttttcaagg

SEQ ID NO: 1744203 - DNA, 11 bp, Homo sapiens
aaaatgtgttc

SEQ ID NO: 1744204 - DNA, 22 bp, Homo sapiens
aaaatgttatcttctcaagttc

SEQ ID NO: 1744205 - DNA, 18 bp, Homo sapiens
aaaatgttctatttaaca

SEQ ID NO: 1744206 - DNA, 12 bp, Homo sapiens
aaaatgtttact

SEQ ID NO: 1744207 - DNA, 21 bp, Homo sapiens
aaaatgtttcattatgcactt

SEQ ID NO: 1744208 - DNA, 16 bp, Homo sapiens
aaaatgtttggtttca

SEQ ID NO: 1744209 - DNA, 14 bp, Homo sapiens
aaaatgttttctgg

SEQ ID NO: 1744210 - DNA, 24 bp, Homo sapiens
aaaattaaaccaatgaagaagaca

SEQ ID NO: 1744211 - DNA, 14 bp, Homo sapiens
aaaattaaatgcct

SEQ ID NO: 1744212 - DNA, 14 bp, Homo sapiens
aaaattaagtagaa

SEQ ID NO: 1744213 - DNA, 18 bp, Homo sapiens
aaaattaagtagaacaaa

SEQ ID NO: 1744214 - DNA, 14 bp, Homo sapiens
aaaattaagttgaa

SEQ ID NO: 1744215 - DNA, 19 bp, Homo sapiens
aaaattacctttaatttta

SEQ ID NO: 1744216 - DNA, 20 bp, Homo sapiens
aaaattacctttaattttaa

SEQ ID NO: 1744217 - DNA, 20 bp, Homo sapiens
aaaattagaaaggacaacag

SEQ ID NO: 1744218 - DNA, 17 bp, Homo sapiens
aaaattagtcttttgta

SEQ ID NO: 1744219 - DNA, 16 bp, Homo sapiens
aaaattatcaaaaagc

SEQ ID NO: 1744220 - DNA, 15 bp, Homo sapiens
aaaattatttgctat

SEQ ID NO: 1744221 - DNA, 17 bp, Homo sapiens
aaaattatttgctatgg

SEQ ID NO: 1744222 - DNA, 18 bp, Homo sapiens
aaaattcaaaagtattga

SEQ ID NO: 1744223 - DNA, 22 bp, Homo sapiens
aaaattcaaagcatggacattt

SEQ ID NO: 1744224 - DNA, 19 bp, Homo sapiens
aaaattcactaatcttgaa

SEQ ID NO: 1744225 - DNA, 16 bp, Homo sapiens
aaaattcagcaaacca

SEQ ID NO: 1744226 - DNA, 20 bp, Homo sapiens
aaaattcatagtaagattga

SEQ ID NO: 1744227 - DNA, 13 bp, Homo sapiens
aaaattcattttt

SEQ ID NO: 1744228 - DNA, 20 bp, Homo sapiens
aaaattccagaaaggatatt

SEQ ID NO: 1744229 - DNA, 21 bp, Homo sapiens
aaaattccatcccatcatctt

SEQ ID NO: 1744230 - DNA, 22 bp, Homo sapiens
aaaattcctttgtgtttctatt

SEQ ID NO: 1744231 - DNA, 16 bp, Homo sapiens
aaaattcgctttctaa

SEQ ID NO: 1744232 - DNA, 16 bp, Homo sapiens
aaaattctagctgtat

SEQ ID NO: 1744233 - DNA, 19 bp, Homo sapiens
aaaattctagctgtatgat

SEQ ID NO: 1744234 - DNA, 13 bp, Homo sapiens
aaaattctagtct

SEQ ID NO: 1744235 - DNA, 20 bp, Homo sapiens
aaaattctagtctctgattt

SEQ ID NO: 1744236 - DNA, 20 bp, Homo sapiens
aaaattctcataggaattaa

SEQ ID NO: 1744237 - DNA, 14 bp, Homo sapiens
aaaattctgatgtt

SEQ ID NO: 1744238 - DNA, 21 bp, Homo sapiens
aaaattctgatgtttctgtga

SEQ ID NO: 1744239 - DNA, 22 bp, Homo sapiens
aaaattctgatgtttctgtgaa

SEQ ID NO: 1744240 - DNA, 14 bp, Homo sapiens
aaaattctgttgtt

SEQ ID NO: 1744241 - DNA, 15 bp, Homo sapiens
aaaattgatattata

SEQ ID NO: 1744242 - DNA, 19 bp, Homo sapiens
aaaattgatattatattaa

SEQ ID NO: 1744243 - DNA, 21 bp, Homo sapiens
aaaattgatatttttatacaa

SEQ ID NO: 1744244 - DNA, 13 bp, Homo sapiens
aaaattgctatgt

SEQ ID NO: 1744245 - DNA, 21 bp, Homo sapiens
aaaattgctgtgcctcccaaa

SEQ ID NO: 1744246 - DNA, 20 bp, Homo sapiens
aaaattgcttctaaaacaat

SEQ ID NO: 1744247 - DNA, 22 bp, Homo sapiens
aaaattgcttttgagagaacat

SEQ ID NO: 1744248 - DNA, 22 bp, Homo sapiens
aaaattgtattgaaaacactta

SEQ ID NO: 1744249 - DNA, 16 bp, Homo sapiens
aaaattgtgatgtgtc

SEQ ID NO: 1744250 - DNA, 17 bp, Homo sapiens
aaaattgttaatatgca

SEQ ID NO: 1744251 - DNA, 20 bp, Homo sapiens
aaaattgttttcacttgtat

SEQ ID NO: 1744252 - DNA, 21 bp, Homo sapiens
aaaattgttttgagctttcca

SEQ ID NO: 1744253 - DNA, 14 bp, Homo sapiens
aaaatttaaaatta

SEQ ID NO: 1744254 - DNA, 22 bp, Homo sapiens
aaaatttaaagggtgtacttat

SEQ ID NO: 1744255 - DNA, 19 bp, Homo sapiens
aaaatttaaatggcttttg

SEQ ID NO: 1744256 - DNA, 20 bp, Homo sapiens
aaaatttaaatggcttttgc

SEQ ID NO: 1744257 - DNA, 22 bp, Homo sapiens
aaaatttacatttaatacagat

SEQ ID NO: 1744258 - DNA, 20 bp, Homo sapiens
aaaatttattttataagaaa

SEQ ID NO: 1744259 - DNA, 23 bp, Homo sapiens
aaaatttcgttgtccaatttgta

SEQ ID NO: 1744260 - DNA, 15 bp, Homo sapiens
aaaatttctattaaa

SEQ ID NO: 1744261 - DNA, 12 bp, Homo sapiens
aaaatttgaagt

SEQ ID NO: 1744262 - DNA, 16 bp, Homo sapiens
aaaatttgtaatattt

SEQ ID NO: 1744263 - DNA, 13 bp, Homo sapiens
aaaatttgtattt

SEQ ID NO: 1744264 - DNA, 19 bp, Homo sapiens
aaaatttgttcttgtattt

SEQ ID NO: 1744265 - DNA, 22 bp, Homo sapiens
aaaatttgttttgacggatgat

SEQ ID NO: 1744266 - DNA, 21 bp, Homo sapiens
aaaattttataaaattaagca

SEQ ID NO: 1744267 - DNA, 14 bp, Homo sapiens
aaaattttatagct

SEQ ID NO: 1744268 - DNA, 21 bp, Homo sapiens
aaaattttgtaaaacaatgcc

SEQ ID NO: 1744269 - DNA, 23 bp, Homo sapiens
aaaattttgtaaaacaatgccat

SEQ ID NO: 1744270 - DNA, 23 bp, Homo sapiens
aaaattttgtattaatttctgat

SEQ ID NO: 1744271 - DNA, 15 bp, Homo sapiens
aaaatttttacattc

SEQ ID NO: 1744272 - DNA, 17 bp, Homo sapiens
aaaatttttataaatta

SEQ ID NO: 1744273 - DNA, 16 bp, Homo sapiens
aaaatttttatgtaaa

SEQ ID NO: 1744274 - DNA, 9 bp, Homo sapiens
aaacaaaaa

SEQ ID NO: 1744275 - DNA, 18 bp, Homo sapiens
aaacaaaaacaaaaccag

SEQ ID NO: 1744276 - DNA, 19 bp, Homo sapiens
aaacaaaaacagaatttga

SEQ ID NO: 1744277 - DNA, 9 bp, Homo sapiens
aaacaaaac

SEQ ID NO: 1744278 - DNA, 13 bp, Homo sapiens
aaacaaaaccaaa

SEQ ID NO: 1744279 - DNA, 14 bp, Homo sapiens
aaacaaaaccaagc

SEQ ID NO: 1744280 - DNA, 19 bp, Homo sapiens
aaacaaaagctgaacacat

SEQ ID NO: 1744281 - DNA, 21 bp, Homo sapiens
aaacaaaagggtgtatagtgt

SEQ ID NO: 1744282 - DNA, 12 bp, Homo sapiens
aaacaaagatgt

SEQ ID NO: 1744283 - DNA, 16 bp, Homo sapiens
aaacaaagtactcttt

SEQ ID NO: 1744284 - DNA, 19 bp, Homo sapiens
aaacaaagtttcagagtat

SEQ ID NO: 1744285 - DNA, 15 bp, Homo sapiens
aaacaaataatcaca

SEQ ID NO: 1744286 - DNA, 17 bp, Homo sapiens
aaacaaataatcacatt

SEQ ID NO: 1744287 - DNA, 17 bp, Homo sapiens
aaacaaatatgcaaaag

SEQ ID NO: 1744288 - DNA, 21 bp, Homo sapiens
aaacaaattcatattctgtct

SEQ ID NO: 1744289 - DNA, 18 bp, Homo sapiens
aaacaacatcattccaaa

SEQ ID NO: 1744290 - DNA, 17 bp, Homo sapiens
aaacaacatttatatgt

SEQ ID NO: 1744291 - DNA, 15 bp, Homo sapiens
aaacaaccatgtcat

SEQ ID NO: 1744292 - DNA, 22 bp, Homo sapiens
aaacaacgtgtatagtgcctaa

SEQ ID NO: 1744293 - DNA, 19 bp, Homo sapiens
aaacaagatgctggatgtc

SEQ ID NO: 1744294 - DNA, 15 bp, Homo sapiens
aaacaagattttaaa

SEQ ID NO: 1744295 - DNA, 16 bp, Homo sapiens
aaacaagccaacatat

SEQ ID NO: 1744296 - DNA, 13 bp, Homo sapiens
aaacaagctgtgc

SEQ ID NO: 1744297 - DNA, 13 bp, Homo sapiens
aaacaataatgca

SEQ ID NO: 1744298 - DNA, 17 bp, Homo sapiens
aaacaatattgtttcta

SEQ ID NO: 1744299 - DNA, 21 bp, Homo sapiens
aaacaatccttttgataaatt

SEQ ID NO: 1744300 - DNA, 13 bp, Homo sapiens
aaacaatcttatt

SEQ ID NO: 1744301 - DNA, 21 bp, Homo sapiens
aaacaatgaagaattatgtaa

SEQ ID NO: 1744302 - DNA, 17 bp, Homo sapiens
aaacaatgccatgaaca

SEQ ID NO: 1744303 - DNA, 18 bp, Homo sapiens
aaacaatgccatgaacaa

SEQ ID NO: 1744304 - DNA, 19 bp, Homo sapiens
aaacaatgccatgaacaaa

SEQ ID NO: 1744305 - DNA, 15 bp, Homo sapiens
aaacaatgtataaag

SEQ ID NO: 1744306 - DNA, 17 bp, Homo sapiens
aaacaatgtataaagat

SEQ ID NO: 1744307 - DNA, 16 bp, Homo sapiens
aaacaatgttgtccaa

SEQ ID NO: 1744308 - DNA, 22 bp, Homo sapiens
aaacacaagaaggaatcctgga

SEQ ID NO: 1744309 - DNA, 14 bp, Homo sapiens
aaacacagcaaggg

SEQ ID NO: 1744310 - DNA, 11 bp, Homo sapiens
aaacacagctg

SEQ ID NO: 1744311 - DNA, 13 bp, Homo sapiens
aaacacagttaca

SEQ ID NO: 1744312 - DNA, 14 bp, Homo sapiens
aaagagaatgagtc

SEQ ID NO: 1744313 - DNA, 21 bp, Homo sapiens
aaagagaattgggggcttagg

SEQ ID NO: 1744314 - DNA, 14 bp, Homo sapiens
aaagagagaagcca

SEQ ID NO: 1744315 - DNA, 18 bp, Homo sapiens
aaagagagaatgtagata

SEQ ID NO: 1744316 - DNA, 20 bp, Homo sapiens
aaagagagagagagaaaaaa

SEQ ID NO: 1744317 - DNA, 15 bp, Homo sapiens
aaagagatttaaact

SEQ ID NO: 1744318 - DNA, 14 bp, Homo sapiens
aaagagatttcaag

SEQ ID NO: 1744319 - DNA, 14 bp, Homo sapiens
aaagaggagtgctt

SEQ ID NO: 1744320 - DNA, 19 bp, Homo sapiens
aaagaggcaccaggaagcc

SEQ ID NO: 1744321 - DNA, 15 bp, Homo sapiens
aaagaggcagcttga

SEQ ID NO: 1744322 - DNA, 20 bp, Homo sapiens
aaagaggcgtctgtatattt

SEQ ID NO: 1744323 - DNA, 20 bp, Homo sapiens
aaagaggctgaaagaggcca

SEQ ID NO: 1744324 - DNA, 12 bp, Homo sapiens
aaagaggctgag

SEQ ID NO: 1744325 - DNA, 19 bp, Homo sapiens
aaagaggctgaggcctgga

SEQ ID NO: 1744326 - DNA, 20 bp, Homo sapiens
aaagaggctgaggcctggac

SEQ ID NO: 1744327 - DNA, 23 bp, Homo sapiens
aaagaggctgcccctctcaccaa

SEQ ID NO: 1744328 - DNA, 12 bp, Homo sapiens
aaagagggacag

SEQ ID NO: 1744329 - DNA, 15 bp, Homo sapiens
aaagaggtgaacatt

SEQ ID NO: 1744330 - DNA, 16 bp, Homo sapiens
aaagagtaatttcatt

SEQ ID NO: 1744331 - DNA, 23 bp, Homo sapiens
aaagagtaatttcatttaaatat

SEQ ID NO: 1744332 - DNA, 14 bp, Homo sapiens
aaagagtctagatt

SEQ ID NO: 1744333 - DNA, 22 bp, Homo sapiens
aaagagtgaatgccatttagaa

SEQ ID NO: 1744334 - DNA, 13 bp, Homo sapiens
aaagataaagatg

SEQ ID NO: 1744335 - DNA, 22 bp, Homo sapiens
aaagatagagattgtttttaga

SEQ ID NO: 1744336 - DNA, 18 bp, Homo sapiens
aaagatataaggggaaag

SEQ ID NO: 1744337 - DNA, 21 bp, Homo sapiens
aaagatataaggggaaagata

SEQ ID NO: 1744338 - DNA, 14 bp, Homo sapiens
aaagatatttccaa

SEQ ID NO: 1744339 - DNA, 15 bp, Homo sapiens
aaagatatttccaag

SEQ ID NO: 1744340 - DNA, 17 bp, Homo sapiens
aaagatccagggatgga

SEQ ID NO: 1744341 - DNA, 19 bp, Homo sapiens
aaagatctgtcctcagcct

SEQ ID NO: 1744342 - DNA, 20 bp, Homo sapiens
aaagatctgtcctcagcctt

SEQ ID NO: 1744343 - DNA, 16 bp, Homo sapiens
aaagatgaaaatattt

SEQ ID NO: 1744344 - DNA, 15 bp, Homo sapiens
aaagatgagtaattt

SEQ ID NO: 1744345 - DNA, 13 bp, Homo sapiens
aaagatgatttaa

SEQ ID NO: 1744346 - DNA, 19 bp, Homo sapiens
aaagatgcagtcctcagga

SEQ ID NO: 1744347 - DNA, 22 bp, Homo sapiens
aaagatgccgggttttatattt

SEQ ID NO: 1744348 - DNA, 23 bp, Homo sapiens
aaagatggaaattctgaaaactg

SEQ ID NO: 1744349 - DNA, 19 bp, Homo sapiens
aaagatggagtttctaagg

SEQ ID NO: 1744350 - DNA, 13 bp, Homo sapiens
aaagatggataaa

SEQ ID NO: 1744351 - DNA, 12 bp, Homo sapiens
aaagatggcctt

SEQ ID NO: 1744352 - DNA, 18 bp, Homo sapiens
aaagatgggaaactgctt

SEQ ID NO: 1744353 - DNA, 18 bp, Homo sapiens
aaagatggtaaaaagaag

SEQ ID NO: 1744354 - DNA, 20 bp, Homo sapiens
aaagatggttgtagcattta

SEQ ID NO: 1744355 - DNA, 24 bp, Homo sapiens
aaagatggtttatgcatgtatatg

SEQ ID NO: 1744356 - DNA, 13 bp, Homo sapiens
aaagatgtgaaaa

SEQ ID NO: 1744357 - DNA, 19 bp, Homo sapiens
aaagattacttagaggaaa

SEQ ID NO: 1744358 - DNA, 23 bp, Homo sapiens
aaagattatgatgcatacagttt

SEQ ID NO: 1744359 - DNA, 22 bp, Homo sapiens
aaagattattgtgacttcactg

SEQ ID NO: 1744360 - DNA, 15 bp, Homo sapiens
aaagattcatgattt

SEQ ID NO: 1744361 - DNA, 12 bp, Homo sapiens
aaagattctata

SEQ ID NO: 1744362 - DNA, 16 bp, Homo sapiens
aaagattgtgtggtgt

SEQ ID NO: 1744363 - DNA, 16 bp, Homo sapiens
aaagatttacattcca

SEQ ID NO: 1744364 - DNA, 22 bp, Homo sapiens
aaagatttgtgaactggaagaa

SEQ ID NO: 1744365 - DNA, 17 bp, Homo sapiens
aaagatttgttactgta

SEQ ID NO: 1744366 - DNA, 22 bp, Homo sapiens
aaagatttgttactgtattttt

SEQ ID NO: 1744367 - DNA, 15 bp, Homo sapiens
aaagatttgttgaca

SEQ ID NO: 1744368 - DNA, 13 bp, Homo sapiens
aaagattttcaga

SEQ ID NO: 1744369 - DNA, 22 bp, Homo sapiens
aaagattttgatctcacatttt

SEQ ID NO: 1744370 - DNA, 14 bp, Homo sapiens
aaagattttgtttt

SEQ ID NO: 1744371 - DNA, 14 bp, Homo sapiens
aaagatttttacta

SEQ ID NO: 1744372 - DNA, 21 bp, Homo sapiens
aaagatttttactaatatata

SEQ ID NO: 1744373 - DNA, 19 bp, Homo sapiens
aaagcaaaacatctctgca

SEQ ID NO: 1744374 - DNA, 14 bp, Homo sapiens
aaagcaaaagagaa

SEQ ID NO: 1744375 - DNA, 16 bp, Homo sapiens
aaagcaaaagagaaat

SEQ ID NO: 1744376 - DNA, 12 bp, Homo sapiens
aaagcaaaatac

SEQ ID NO: 1744377 - DNA, 13 bp, Homo sapiens
aaagcaaagaaaa

SEQ ID NO: 1744378 - DNA, 14 bp, Homo sapiens
aaagcaaatcattt

SEQ ID NO: 1744379 - DNA, 15 bp, Homo sapiens
aaagcaagaaacagt

SEQ ID NO: 1744380 - DNA, 15 bp, Homo sapiens
aaagcaagggagaaa

SEQ ID NO: 1744381 - DNA, 18 bp, Homo sapiens
aaagcaagggagaaaaga

SEQ ID NO: 1744382 - DNA, 20 bp, Homo sapiens
aaagcaagggctccagcatc

SEQ ID NO: 1744383 - DNA, 17 bp, Homo sapiens
aaagcaataaatgaatg

SEQ ID NO: 1744384 - DNA, 14 bp, Homo sapiens
aaagcaataatggt

SEQ ID NO: 1744385 - DNA, 17 bp, Homo sapiens
aaagcaattgccctgta

SEQ ID NO: 1744386 - DNA, 17 bp, Homo sapiens
aaagcactgacttctaa

SEQ ID NO: 1744387 - DNA, 14 bp, Homo sapiens
aaagcagaatttta

SEQ ID NO: 1744388 - DNA, 16 bp, Homo sapiens
aaagcagaattttaat

SEQ ID NO: 1744389 - DNA, 20 bp, Homo sapiens
aaagcagcagctaggactga

SEQ ID NO: 1744390 - DNA, 21 bp, Homo sapiens
aaagcagcagctaggactgag

SEQ ID NO: 1744391 - DNA, 17 bp, Homo sapiens
aaagcagcctggccaac

SEQ ID NO: 1744392 - DNA, 22 bp, Homo sapiens
aaagcaggatgaattttctgca

SEQ ID NO: 1744393 - DNA, 21 bp, Homo sapiens
aaagcagtcctcttattccta

SEQ ID NO: 1744394 - DNA, 21 bp, Homo sapiens
aaagcataaagctcaaatgaa

SEQ ID NO: 1744395 - DNA, 22 bp, Homo sapiens
aaagcataaagctcaaatgaaa

SEQ ID NO: 1744396 - DNA, 13 bp, Homo sapiens
aaagcatcctcct

SEQ ID NO: 1744397 - DNA, 15 bp, Homo sapiens
aaagcatcctcctcc

SEQ ID NO: 1744398 - DNA, 17 bp, Homo sapiens
aaagcatcctcctcctg

SEQ ID NO: 1744399 - DNA, 17 bp, Homo sapiens
aaagcatgaaatgtgaa

SEQ ID NO: 1744400 - DNA, 13 bp, Homo sapiens
aaagcatgaatgg

SEQ ID NO: 1744401 - DNA, 18 bp, Homo sapiens
aaagcatgatgggaaaat

SEQ ID NO: 1744402 - DNA, 23 bp, Homo sapiens
aaagcatgatgggaaaatatttc

SEQ ID NO: 1744403 - DNA, 13 bp, Homo sapiens
aaagcattactct

SEQ ID NO: 1744404 - DNA, 17 bp, Homo sapiens
aaagcattgtaaatgtg

SEQ ID NO: 1744405 - DNA, 14 bp, Homo sapiens
aaagcatttaggag

SEQ ID NO: 1744406 - DNA, 15 bp, Homo sapiens
aaagcatttaggaga

SEQ ID NO: 1744407 - DNA, 16 bp, Homo sapiens
aaagcatttaggagaa

SEQ ID NO: 1744408 - DNA, 23 bp, Homo sapiens
aaagcatttaggagaatagcaga

SEQ ID NO: 1744409 - DNA, 13 bp, Homo sapiens
aaagcatttccta

SEQ ID NO: 1744410 - DNA, 12 bp, Homo sapiens
aaagcattttca

SEQ ID NO: 1744411 - DNA, 13 bp, Homo sapiens
aaagcatttttca

SEQ ID NO: 1744412 - DNA, 19 bp, Homo sapiens
aaagccaacaactctgcct

SEQ ID NO: 1744413 - DNA, 23 bp, Homo sapiens
aaagccaacagtcaaaacagaga

SEQ ID NO: 1744414 - DNA, 20 bp, Homo sapiens
aaagccacattatttctagt

SEQ ID NO: 1744415 - DNA, 12 bp, Homo sapiens
aaagccacccca

SEQ ID NO: 1744416 - DNA, 18 bp, Homo sapiens
aaagccacgttccttact

SEQ ID NO: 1744417 - DNA, 14 bp, Homo sapiens
aaagccactggaag

SEQ ID NO: 1744418 - DNA, 14 bp, Homo sapiens
aaagccaggcctga

SEQ ID NO: 1744419 - DNA, 13 bp, Homo sapiens
aaagccattttgg

SEQ ID NO: 1744420 - DNA, 15 bp, Homo sapiens
aaagccctgcctctg

SEQ ID NO: 1744421 - DNA, 17 bp, Homo sapiens
aaagccctgcctctgtg

SEQ ID NO: 1744422 - DNA, 12 bp, Homo sapiens
aaagccctgtcc

SEQ ID NO: 1744423 - DNA, 22 bp, Homo sapiens
aaagcccttggaacaccctgga

SEQ ID NO: 1744424 - DNA, 16 bp, Homo sapiens
aaagcctaatcacagt

SEQ ID NO: 1744425 - DNA, 15 bp, Homo sapiens
aaagcctcagaaagg

SEQ ID NO: 1744426 - DNA, 22 bp, Homo sapiens
aaagcctcatttgaatgtgtga

SEQ ID NO: 1744427 - DNA, 17 bp, Homo sapiens
aaataggtaaatgtatt

SEQ ID NO: 1744428 - DNA, 18 bp, Homo sapiens
aaatagtagacatttgtg

SEQ ID NO: 1744429 - DNA, 13 bp, Homo sapiens
aaatagtatacat

SEQ ID NO: 1744430 - DNA, 14 bp, Homo sapiens
aaatagtatttgag

SEQ ID NO: 1744431 - DNA, 15 bp, Homo sapiens
aaatagtatttgcat

SEQ ID NO: 1744432 - DNA, 15 bp, Homo sapiens
aaatagtctgatttt

SEQ ID NO: 1744433 - DNA, 21 bp, Homo sapiens
aaatagtgacataatatattc

SEQ ID NO: 1744434 - DNA, 12 bp, Homo sapiens
aaatagtgtaag

SEQ ID NO: 1744435 - DNA, 13 bp, Homo sapiens
aaatagtgtgaaa

SEQ ID NO: 1744436 - DNA, 15 bp, Homo sapiens
aaatagtgtgaaata

SEQ ID NO: 1744437 - DNA, 20 bp, Homo sapiens
aaatagttagatctttgtaa

SEQ ID NO: 1744438 - DNA, 16 bp, Homo sapiens
aaatagttctgtgact

SEQ ID NO: 1744439 - DNA, 23 bp, Homo sapiens
aaatagttgcatagcagtatatg

SEQ ID NO: 1744440 - DNA, 21 bp, Homo sapiens
aaatagtttcaaatgagttta

SEQ ID NO: 1744441 - DNA, 19 bp, Homo sapiens
aaatataagctgggaaaaa

SEQ ID NO: 1744442 - DNA, 13 bp, Homo sapiens
aaatataattctg

SEQ ID NO: 1744443 - DNA, 13 bp, Homo sapiens
aaatatacatctg

SEQ ID NO: 1744444 - DNA, 20 bp, Homo sapiens
aaatatacatgtttatgtaa

SEQ ID NO: 1744445 - DNA, 18 bp, Homo sapiens
aaatatacattttctaaa

SEQ ID NO: 1744446 - DNA, 19 bp, Homo sapiens
aaatatacattttctaaat

SEQ ID NO: 1744447 - DNA, 20 bp, Homo sapiens
aaatatacattttctaaata

SEQ ID NO: 1744448 - DNA, 17 bp, Homo sapiens
aaatatactctcccaga

SEQ ID NO: 1744449 - DNA, 18 bp, Homo sapiens
aaatatacttaaatggaa

SEQ ID NO: 1744450 - DNA, 13 bp, Homo sapiens
aaatatatacatt

SEQ ID NO: 1744451 - DNA, 15 bp, Homo sapiens
aaatatatatacata

SEQ ID NO: 1744452 - DNA, 16 bp, Homo sapiens
aaatatatatagatat

SEQ ID NO: 1744453 - DNA, 19 bp, Homo sapiens
aaatatatctgttggagaa

SEQ ID NO: 1744454 - DNA, 13 bp, Homo sapiens
aaatatattgctg

SEQ ID NO: 1744455 - DNA, 15 bp, Homo sapiens
aaatatatttaatga

SEQ ID NO: 1744456 - DNA, 18 bp, Homo sapiens
aaatatcagttactcagc

SEQ ID NO: 1744457 - DNA, 15 bp, Homo sapiens
aaatatcataaagca

SEQ ID NO: 1744458 - DNA, 13 bp, Homo sapiens
aaatatcatgtta

SEQ ID NO: 1744459 - DNA, 18 bp, Homo sapiens
aaatatcatgttaaatta

SEQ ID NO: 1744460 - DNA, 18 bp, Homo sapiens
aaatatcatttatttttt

SEQ ID NO: 1744461 - DNA, 19 bp, Homo sapiens
aaatatccatttatctttt

SEQ ID NO: 1744462 - DNA, 17 bp, Homo sapiens
aaatatccttgatgtac

SEQ ID NO: 1744463 - DNA, 20 bp, Homo sapiens
aaatatcgctgatgcagaca

SEQ ID NO: 1744464 - DNA, 21 bp, Homo sapiens
aaatatctagtaatatattta

SEQ ID NO: 1744465 - DNA, 18 bp, Homo sapiens
aaatatctgaaaatgtat

SEQ ID NO: 1744466 - DNA, 21 bp, Homo sapiens
aaatatctgaaaatgtatgtg

SEQ ID NO: 1744467 - DNA, 14 bp, Homo sapiens
aaatatcttggcct

SEQ ID NO: 1744468 - DNA, 16 bp, Homo sapiens
aaatatgaacctattt

SEQ ID NO: 1744469 - DNA, 17 bp, Homo sapiens
aaatatgaagaactgag

SEQ ID NO: 1744470 - DNA, 19 bp, Homo sapiens
aaatatgattttatttgac

SEQ ID NO: 1744471 - DNA, 10 bp, Homo sapiens
aaatatgcaa

SEQ ID NO: 1744472 - DNA, 16 bp, Homo sapiens
aaatatgcaaagcact

SEQ ID NO: 1744473 - DNA, 19 bp, Homo sapiens
aaatatggctataaatata

SEQ ID NO: 1744474 - DNA, 15 bp, Homo sapiens
aaatatgtaaaacta

SEQ ID NO: 1744475 - DNA, 15 bp, Homo sapiens
aaatatgtaatataa

SEQ ID NO: 1744476 - DNA, 21 bp, Homo sapiens
aaatatgtaatataaatttaa

SEQ ID NO: 1744477 - DNA, 23 bp, Homo sapiens
aaatatgtaatataaatttaagc

SEQ ID NO: 1744478 - DNA, 12 bp, Homo sapiens
aaatatgtaatt

SEQ ID NO: 1744479 - DNA, 17 bp, Homo sapiens
aaatatgtaatttcaaa

SEQ ID NO: 1744480 - DNA, 13 bp, Homo sapiens
aaatatgtattaa

SEQ ID NO: 1744481 - DNA, 18 bp, Homo sapiens
aaatatgtcccagaaatg

SEQ ID NO: 1744482 - DNA, 15 bp, Homo sapiens
aaatatgtcgtagaa

SEQ ID NO: 1744483 - DNA, 17 bp, Homo sapiens
aaatatgtcgtagaatt

SEQ ID NO: 1744484 - DNA, 20 bp, Homo sapiens
aaatatgttagcaaagagtt

SEQ ID NO: 1744485 - DNA, 14 bp, Homo sapiens
aaatatgtttgtgc

SEQ ID NO: 1744486 - DNA, 14 bp, Homo sapiens
aaatattaaaattg

SEQ ID NO: 1744487 - DNA, 16 bp, Homo sapiens
aaatattaacattctt

SEQ ID NO: 1744488 - DNA, 19 bp, Homo sapiens
aaatattaagaaagactat

SEQ ID NO: 1744489 - DNA, 14 bp, Homo sapiens
aaatattaagcatg

SEQ ID NO: 1744490 - DNA, 14 bp, Homo sapiens
aaatattatgtgtt

SEQ ID NO: 1744491 - DNA, 16 bp, Homo sapiens
aaatattcacatcttc

SEQ ID NO: 1744492 - DNA, 22 bp, Homo sapiens
aaatattctacacatgtaaaat

SEQ ID NO: 1744493 - DNA, 18 bp, Homo sapiens
aaatattctatatgaatt

SEQ ID NO: 1744494 - DNA, 17 bp, Homo sapiens
aaatattctttctcata

SEQ ID NO: 1744495 - DNA, 22 bp, Homo sapiens
aaatattctttctcataaaact

SEQ ID NO: 1744496 - DNA, 19 bp, Homo sapiens
aaatattgaagttgtttat

SEQ ID NO: 1744497 - DNA, 22 bp, Homo sapiens
aaatattgaagttgtttatcaa

SEQ ID NO: 1744498 - DNA, 15 bp, Homo sapiens
aaatattgatgaaaa

SEQ ID NO: 1744499 - DNA, 13 bp, Homo sapiens
aaatatttatgaa

SEQ ID NO: 1744500 - DNA, 13 bp, Homo sapiens
aaatatttcaaga

SEQ ID NO: 1744501 - DNA, 14 bp, Homo sapiens
aaatatttcaagac

SEQ ID NO: 1744502 - DNA, 16 bp, Homo sapiens
aaatatttcagcaaac

SEQ ID NO: 1744503 - DNA, 13 bp, Homo sapiens
aaatatttcctga

SEQ ID NO: 1744504 - DNA, 21 bp, Homo sapiens
aaatatttcctgacttgagtg

SEQ ID NO: 1744505 - DNA, 13 bp, Homo sapiens
aaatatttctaag

SEQ ID NO: 1744506 - DNA, 12 bp, Homo sapiens
aaatatttctga

SEQ ID NO: 1744507 - DNA, 15 bp, Homo sapiens
aaatatttctgttgt

SEQ ID NO: 1744508 - DNA, 17 bp, Homo sapiens
aaatatttgactattct

SEQ ID NO: 1744509 - DNA, 22 bp, Homo sapiens
aaatatttgtacatagttattt

SEQ ID NO: 1744510 - DNA, 20 bp, Homo sapiens
aaatatttgtctttaaacag

SEQ ID NO: 1744511 - DNA, 20 bp, Homo sapiens
aaatattttaatttttaaat

SEQ ID NO: 1744512 - DNA, 12 bp, Homo sapiens
aaatattttcta

SEQ ID NO: 1744513 - DNA, 19 bp, Homo sapiens
aaatattttctattttaag

SEQ ID NO: 1744514 - DNA, 14 bp, Homo sapiens
aaatattttgctaa

SEQ ID NO: 1744515 - DNA, 18 bp, Homo sapiens
aaatattttgctaactgg

SEQ ID NO: 1744516 - DNA, 23 bp, Homo sapiens
aaatatttttttctagctataac

SEQ ID NO: 1744517 - DNA, 22 bp, Homo sapiens
aaatatttttttctttctttgt

SEQ ID NO: 1744518 - DNA, 13 bp, Homo sapiens
aaatcaaagaaca

SEQ ID NO: 1744519 - DNA, 16 bp, Homo sapiens
aaatcaaagaacagat

SEQ ID NO: 1744520 - DNA, 12 bp, Homo sapiens
aaatcaaatatg

SEQ ID NO: 1744521 - DNA, 16 bp, Homo sapiens
aaatcaaatatgcaaa

SEQ ID NO: 1744522 - DNA, 15 bp, Homo sapiens
aaatcaaatgtaaat

SEQ ID NO: 1744523 - DNA, 15 bp, Homo sapiens
aaatcaaatgtatgt

SEQ ID NO: 1744524 - DNA, 18 bp, Homo sapiens
aaatcaaatgtatgtatc

SEQ ID NO: 1744525 - DNA, 16 bp, Homo sapiens
aaatcaacttaacatg

SEQ ID NO: 1744526 - DNA, 19 bp, Homo sapiens
aaatcaacttgtgtactga

SEQ ID NO: 1744527 - DNA, 16 bp, Homo sapiens
aaatcaaggaaaggct

SEQ ID NO: 1744528 - DNA, 23 bp, Homo sapiens
aaatcaagtattataaacaagaa

SEQ ID NO: 1744529 - DNA, 17 bp, Homo sapiens
aaatcaatagttgaatt

SEQ ID NO: 1744530 - DNA, 18 bp, Homo sapiens
aaatcactatctttctga

SEQ ID NO: 1744531 - DNA, 15 bp, Homo sapiens
aaatcactgtattta

SEQ ID NO: 1744532 - DNA, 23 bp, Homo sapiens
aaatcactttacctgcaggctcc

SEQ ID NO: 1744533 - DNA, 13 bp, Homo sapiens
aaatcagaaagta

SEQ ID NO: 1744534 - DNA, 17 bp, Homo sapiens
aaatcagaaagtaacaa

SEQ ID NO: 1744535 - DNA, 21 bp, Homo sapiens
aaatcagaagtcatcttgcta

SEQ ID NO: 1744536 - DNA, 16 bp, Homo sapiens
aaatcagctgctacta

SEQ ID NO: 1744537 - DNA, 13 bp, Homo sapiens
aaatcagtaagag

SEQ ID NO: 1744538 - DNA, 16 bp, Homo sapiens
aaatcagtaagaggtg

SEQ ID NO: 1744539 - DNA, 19 bp, Homo sapiens
aaatcagtaagaggtgtta

SEQ ID NO: 1744540 - DNA, 22 bp, Homo sapiens
aaatcagtcagtgcaaatgtca

SEQ ID NO: 1744541 - DNA, 16 bp, Homo sapiens
aaatcagtgatctatg

SEQ ID NO: 1744542 - DNA, 16 bp, Homo sapiens
aaatcagttactaaga

SEQ ID NO: 1744543 - DNA, 22 bp, Homo sapiens
aaatcagttgtgaatacattct

SEQ ID NO: 1744544 - DNA, 11 bp, Homo sapiens
aaatcatcaag

SEQ ID NO: 1744545 - DNA, 15 bp, Homo sapiens
aaatcatcctcatgt

SEQ ID NO: 1744546 - DNA, 18 bp, Homo sapiens
aaatcatcctcatgtcct

SEQ ID NO: 1744547 - DNA, 15 bp, Homo sapiens
aaatcattgtagaaa

SEQ ID NO: 1744548 - DNA, 20 bp, Homo sapiens
aaatcattgtagaaacacag

SEQ ID NO: 1744549 - DNA, 12 bp, Homo sapiens
aaatcatttctg

SEQ ID NO: 1744550 - DNA, 22 bp, Homo sapiens
aaatcatttctgcatcagctgc

SEQ ID NO: 1744551 - DNA, 12 bp, Homo sapiens
aaatcatttgtt

SEQ ID NO: 1744552 - DNA, 15 bp, Homo sapiens
aaatccaaaacttct

SEQ ID NO: 1744553 - DNA, 11 bp, Homo sapiens
aaatccaaaga

SEQ ID NO: 1744554 - DNA, 14 bp, Homo sapiens
aaatccaaatattg

SEQ ID NO: 1744555 - DNA, 18 bp, Homo sapiens
aaatccaaatattgttaa

SEQ ID NO: 1744556 - DNA, 15 bp, Homo sapiens
aaatccaatattgta

SEQ ID NO: 1744557 - DNA, 15 bp, Homo sapiens
aaatccagaaagaaa

SEQ ID NO: 1744558 - DNA, 12 bp, Homo sapiens
aaatccagtggt

SEQ ID NO: 1744559 - DNA, 13 bp, Homo sapiens
aaatccagtggtg

SEQ ID NO: 1744560 - DNA, 19 bp, Homo sapiens
aaatccagtggtgggtaat

SEQ ID NO: 1744561 - DNA, 20 bp, Homo sapiens
aaatccagtgtgcacccctc

SEQ ID NO: 1744562 - DNA, 20 bp, Homo sapiens
aaatccataaactaagagaa

SEQ ID NO: 1744563 - DNA, 23 bp, Homo sapiens
aaatccataaactaagagaaact

SEQ ID NO: 1744564 - DNA, 15 bp, Homo sapiens
aaatccgacttgaat

SEQ ID NO: 1744565 - DNA, 15 bp, Homo sapiens
aaatcctactgaatg

SEQ ID NO: 1744566 - DNA, 20 bp, Homo sapiens
aaatcctcaacactattgta

SEQ ID NO: 1744567 - DNA, 12 bp, Homo sapiens
aaatcctcacca

SEQ ID NO: 1744568 - DNA, 17 bp, Homo sapiens
aaatcctcatgttactc

SEQ ID NO: 1744569 - DNA, 22 bp, Homo sapiens
aaatcctggaaggacacagtga

SEQ ID NO: 1744570 - DNA, 21 bp, Homo sapiens
aaatccttttaaccattttaa

SEQ ID NO: 1744571 - DNA, 20 bp, Homo sapiens
aaatcgaggcagaaagatac

SEQ ID NO: 1744572 - DNA, 21 bp, Homo sapiens
aaatcgatgagcgccacctct

SEQ ID NO: 1744573 - DNA, 16 bp, Homo sapiens
aaatctaaatctattt

SEQ ID NO: 1744574 - DNA, 14 bp, Homo sapiens
aaatctaatctctt

SEQ ID NO: 1744575 - DNA, 17 bp, Homo sapiens
aaatctaatctcttatt

SEQ ID NO: 1744576 - DNA, 17 bp, Homo sapiens
aaatctaccactgtatg

SEQ ID NO: 1744577 - DNA, 17 bp, Homo sapiens
aaatctagccagagccc

SEQ ID NO: 1744578 - DNA, 16 bp, Homo sapiens
aaatctatttattaat

SEQ ID NO: 1744579 - DNA, 12 bp, Homo sapiens
aaatctccatta

SEQ ID NO: 1744580 - DNA, 15 bp, Homo sapiens
aaatctcctaacaaa

SEQ ID NO: 1744581 - DNA, 14 bp, Homo sapiens
aaatctcctggctt

SEQ ID NO: 1744582 - DNA, 17 bp, Homo sapiens
aaatctcttctttgctg

SEQ ID NO: 1744583 - DNA, 13 bp, Homo sapiens
aaatctgaacatt

SEQ ID NO: 1744584 - DNA, 16 bp, Homo sapiens
aaatctgaacattctc

SEQ ID NO: 1744585 - DNA, 11 bp, Homo sapiens
aaatctgaaga

SEQ ID NO: 1744586 - DNA, 13 bp, Homo sapiens
aaatctgaagacc

SEQ ID NO: 1744587 - DNA, 15 bp, Homo sapiens
aaatctgaagattgc

SEQ ID NO: 1744588 - DNA, 15 bp, Homo sapiens
aaatctgaattttgc

SEQ ID NO: 1744589 - DNA, 16 bp, Homo sapiens
aaatctgaattttgca

SEQ ID NO: 1744590 - DNA, 18 bp, Homo sapiens
aaatctgacccagtgccc

SEQ ID NO: 1744591 - DNA, 17 bp, Homo sapiens
aaatctgcaaagcatgt

SEQ ID NO: 1744592 - DNA, 16 bp, Homo sapiens
aaatctgctagaaagt

SEQ ID NO: 1744593 - DNA, 17 bp, Homo sapiens
aaatctgctagaaagtt

SEQ ID NO: 1744594 - DNA, 22 bp, Homo sapiens
aaatctgctttagtttcacatt

SEQ ID NO: 1744595 - DNA, 22 bp, Homo sapiens
aaatctgggatgtactgtttgc

SEQ ID NO: 1744596 - DNA, 17 bp, Homo sapiens
aaatctgtaattgataa

SEQ ID NO: 1744597 - DNA, 22 bp, Homo sapiens
aaatctgtatatgttgtaataa

SEQ ID NO: 1744598 - DNA, 14 bp, Homo sapiens
aaatctgtcctctg

SEQ ID NO: 1744599 - DNA, 19 bp, Homo sapiens
aaatctgtcctctgtagta

SEQ ID NO: 1744600 - DNA, 15 bp, Homo sapiens
aaatctgtctgattc

SEQ ID NO: 1744601 - DNA, 15 bp, Homo sapiens
aaatctgtgaattaa

SEQ ID NO: 1744602 - DNA, 20 bp, Homo sapiens
aaatctgtgaattaaaaaag

SEQ ID NO: 1744603 - DNA, 17 bp, Homo sapiens
aaatctgtttttctcat

SEQ ID NO: 1744604 - DNA, 15 bp, Homo sapiens
aaatcttaaacaatg

SEQ ID NO: 1744605 - DNA, 17 bp, Homo sapiens
aaatcttaaacaatgta

SEQ ID NO: 1744606 - DNA, 14 bp, Homo sapiens
aaatcttaacttga

SEQ ID NO: 1744607 - DNA, 13 bp, Homo sapiens
aaatcttaagaaa

SEQ ID NO: 1744608 - DNA, 14 bp, Homo sapiens
aaatcttaagaaat

SEQ ID NO: 1744609 - DNA, 18 bp, Homo sapiens
aaatcttatagttctagg

SEQ ID NO: 1744610 - DNA, 20 bp, Homo sapiens
aaatcttatagttctaggca

SEQ ID NO: 1744611 - DNA, 17 bp, Homo sapiens
aaatcttggcacagaaa

SEQ ID NO: 1744612 - DNA, 14 bp, Homo sapiens
aaatcttgtcatgt

SEQ ID NO: 1744613 - DNA, 16 bp, Homo sapiens
aaatcttgttaatgtc

SEQ ID NO: 1744614 - DNA, 19 bp, Homo sapiens
aaatcttgttaatgtcatt

SEQ ID NO: 1744615 - DNA, 17 bp, Homo sapiens
aaatctttttgcttcta

SEQ ID NO: 1744616 - DNA, 23 bp, Homo sapiens
aaatctttttgcttctactttca

SEQ ID NO: 1744617 - DNA, 13 bp, Homo sapiens
aaatgaaagattt

SEQ ID NO: 1744618 - DNA, 14 bp, Homo sapiens
aaatgaaagatttt

SEQ ID NO: 1744619 - DNA, 18 bp, Homo sapiens
aaatgaaagcatgtctca

SEQ ID NO: 1744620 - DNA, 12 bp, Homo sapiens
aaatgaaaggga

SEQ ID NO: 1744621 - DNA, 15 bp, Homo sapiens
aaatgaaagggaaac

SEQ ID NO: 1744622 - DNA, 15 bp, Homo sapiens
aaatgaaatgtatgc

SEQ ID NO: 1744623 - DNA, 22 bp, Homo sapiens
aaatgaaattactacaaaattt

SEQ ID NO: 1744624 - DNA, 19 bp, Homo sapiens
aaatgaacgatatgtagca

SEQ ID NO: 1744625 - DNA, 16 bp, Homo sapiens
aaatgaagaaagtcaa

SEQ ID NO: 1744626 - DNA, 17 bp, Homo sapiens
aaatgaataatttccca

SEQ ID NO: 1744627 - DNA, 18 bp, Homo sapiens
aaatgaataatttcccaa

SEQ ID NO: 1744628 - DNA, 18 bp, Homo sapiens
aaatgaatatctattaat

SEQ ID NO: 1744629 - DNA, 19 bp, Homo sapiens
aaatgaatatctattaata

SEQ ID NO: 1744630 - DNA, 17 bp, Homo sapiens
aaatgacatgcactgac

SEQ ID NO: 1744631 - DNA, 15 bp, Homo sapiens
aaatgaccaaagatg

SEQ ID NO: 1744632 - DNA, 12 bp, Homo sapiens
aaatgacggtgt

SEQ ID NO: 1744633 - DNA, 21 bp, Homo sapiens
aaatgacggtgttaattttgc

SEQ ID NO: 1744634 - DNA, 22 bp, Homo sapiens
aaatgacggtgttaattttgct

SEQ ID NO: 1744635 - DNA, 23 bp, Homo sapiens
aaatgacggtgttaattttgcta

SEQ ID NO: 1744636 - DNA, 13 bp, Homo sapiens
aaatgacttattt

SEQ ID NO: 1744637 - DNA, 16 bp, Homo sapiens
aaatgacttatttctg

SEQ ID NO: 1744638 - DNA, 17 bp, Homo sapiens
aaatgacttatttctgc

SEQ ID NO: 1744639 - DNA, 17 bp, Homo sapiens
aaatgacttttcttaag

SEQ ID NO: 1744640 - DNA, 21 bp, Homo sapiens
aaatgagaattttatattcta

SEQ ID NO: 1744641 - DNA, 18 bp, Homo sapiens
aaatgagcttgattaaat

SEQ ID NO: 1744642 - DNA, 15 bp, Homo sapiens
aaatgaggaatagca

SEQ ID NO: 1744643 - DNA, 19 bp, Homo sapiens
aaatgaggaatagcaaaat

SEQ ID NO: 1744644 - DNA, 21 bp, Homo sapiens
aaatgaggaatagcaaaattc

SEQ ID NO: 1744645 - DNA, 23 bp, Homo sapiens
aaatgaggtactctcctggaaat

SEQ ID NO: 1744646 - DNA, 15 bp, Homo sapiens
aaatgagtaacattt

SEQ ID NO: 1744647 - DNA, 16 bp, Homo sapiens
aaatgagtttaaaaaa

SEQ ID NO: 1744648 - DNA, 19 bp, Homo sapiens
aaatgatctgagtcccagg

SEQ ID NO: 1744649 - DNA, 19 bp, Homo sapiens
aaatgatgatgtggaagaa

SEQ ID NO: 1744650 - DNA, 22 bp, Homo sapiens
aaatgatgatgtggaagaactt

SEQ ID NO: 1744651 - DNA, 21 bp, Homo sapiens
aaatgatggatcaccattata

SEQ ID NO: 1744652 - DNA, 15 bp, Homo sapiens
aaatgattcttagtg

SEQ ID NO: 1744653 - DNA, 23 bp, Homo sapiens
aaatgattgtttcttcttcatgc

SEQ ID NO: 1744654 - DNA, 16 bp, Homo sapiens
aaatgatttgtggaaa

SEQ ID NO: 1744655 - DNA, 20 bp, Homo sapiens
aaatgcaaaaaatcttaata

SEQ ID NO: 1744656 - DNA, 17 bp, Homo sapiens
aaatgcaaacacacaaa

SEQ ID NO: 1744657 - DNA, 15 bp, Homo sapiens
aaatgcagggagggg

SEQ ID NO: 1744658 - DNA, 17 bp, Homo sapiens
aacaataataaagatgt

SEQ ID NO: 1744659 - DNA, 16 bp, Homo sapiens
aacaataatgagagca

SEQ ID NO: 1744660 - DNA, 22 bp, Homo sapiens
aacaatagttcttagctttgaa

SEQ ID NO: 1744661 - DNA, 16 bp, Homo sapiens
aacaatattgtctgaa

SEQ ID NO: 1744662 - DNA, 16 bp, Homo sapiens
aacaatattgtttcta

SEQ ID NO: 1744663 - DNA, 13 bp, Homo sapiens
aacaatcctgtta

SEQ ID NO: 1744664 - DNA, 21 bp, Homo sapiens
aacaatcctgttactctgtcc

SEQ ID NO: 1744665 - DNA, 16 bp, Homo sapiens
aacaatcttattccga

SEQ ID NO: 1744666 - DNA, 17 bp, Homo sapiens
aacaatcttattccgag

SEQ ID NO: 1744667 - DNA, 18 bp, Homo sapiens
aacaatcttattccgagc

SEQ ID NO: 1744668 - DNA, 24 bp, Homo sapiens
aacaatcttattccgagcattcca

SEQ ID NO: 1744669 - DNA, 13 bp, Homo sapiens
aacaatctttgct

SEQ ID NO: 1744670 - DNA, 16 bp, Homo sapiens
aacaatgacaagatgt

SEQ ID NO: 1744671 - DNA, 15 bp, Homo sapiens
aacaatgatatatgg

SEQ ID NO: 1744672 - DNA, 15 bp, Homo sapiens
aacaatgccatgaac

SEQ ID NO: 1744673 - DNA, 17 bp, Homo sapiens
aacaatgccatgaacaa

SEQ ID NO: 1744674 - DNA, 19 bp, Homo sapiens
aacaatgccatgaacaaat

SEQ ID NO: 1744675 - DNA, 22 bp, Homo sapiens
aacaatgccatgaacaaattct

SEQ ID NO: 1744676 - DNA, 16 bp, Homo sapiens
aacaatggaaactgaa

SEQ ID NO: 1744677 - DNA, 18 bp, Homo sapiens
aacaatggaaactgaatg

SEQ ID NO: 1744678 - DNA, 20 bp, Homo sapiens
aacaatgtataaagattgta

SEQ ID NO: 1744679 - DNA, 14 bp, Homo sapiens
aacaatgtatttta

SEQ ID NO: 1744680 - DNA, 16 bp, Homo sapiens
aacaatgtattttaat

SEQ ID NO: 1744681 - DNA, 23 bp, Homo sapiens
aacaatgttgtccaacaataaac

SEQ ID NO: 1744682 - DNA, 20 bp, Homo sapiens
aacaattgtgtagccttttt

SEQ ID NO: 1744683 - DNA, 16 bp, Homo sapiens
aacaatttatgaattg

SEQ ID NO: 1744684 - DNA, 18 bp, Homo sapiens
aacaatttttgaaaaaga

SEQ ID NO: 1744685 - DNA, 16 bp, Homo sapiens
aacacaaaacttgaaa

SEQ ID NO: 1744686 - DNA, 18 bp, Homo sapiens
aacacaaaacttgaaaga

SEQ ID NO: 1744687 - DNA, 16 bp, Homo sapiens
aacacaagcaaaaaaa

SEQ ID NO: 1744688 - DNA, 19 bp, Homo sapiens
aacacaagggatataaaat

SEQ ID NO: 1744689 - DNA, 20 bp, Homo sapiens
aacacaagggatataaaatg

SEQ ID NO: 1744690 - DNA, 22 bp, Homo sapiens
aacacaagggatataaaatgaa

SEQ ID NO: 1744691 - DNA, 16 bp, Homo sapiens
aacacacagactttct

SEQ ID NO: 1744692 - DNA, 20 bp, Homo sapiens
aacacacagatacacacaca

SEQ ID NO: 1744693 - DNA, 20 bp, Homo sapiens
aacacagcaagggtgatggg

SEQ ID NO: 1744694 - DNA, 16 bp, Homo sapiens
aacacagcatgtgtat

SEQ ID NO: 1744695 - DNA, 13 bp, Homo sapiens
aacacagcctggg

SEQ ID NO: 1744696 - DNA, 19 bp, Homo sapiens
aacacagcgagactccgtc

SEQ ID NO: 1744697 - DNA, 15 bp, Homo sapiens
aacacagggttttgt

SEQ ID NO: 1744698 - DNA, 20 bp, Homo sapiens
aacacagtccagactcaaac

SEQ ID NO: 1744699 - DNA, 19 bp, Homo sapiens
aacacagtgccttcaataa

SEQ ID NO: 1744700 - DNA, 15 bp, Homo sapiens
aacacagtgtctgtt

SEQ ID NO: 1744701 - DNA, 13 bp, Homo sapiens
aacacagtttagt

SEQ ID NO: 1744702 - DNA, 14 bp, Homo sapiens
aacacagttttgaa

SEQ ID NO: 1744703 - DNA, 13 bp, Homo sapiens
aacacataacaaa

SEQ ID NO: 1744704 - DNA, 15 bp, Homo sapiens
aacacatttcttttt

SEQ ID NO: 1744705 - DNA, 14 bp, Homo sapiens
aacaccacagacac

SEQ ID NO: 1744706 - DNA, 18 bp, Homo sapiens
aacaccacagacacacac

SEQ ID NO: 1744707 - DNA, 17 bp, Homo sapiens
aacaccagcagcactgg

SEQ ID NO: 1744708 - DNA, 12 bp, Homo sapiens
aacaccaggact

SEQ ID NO: 1744709 - DNA, 19 bp, Homo sapiens
aacaccattgaaggcttaa

SEQ ID NO: 1744710 - DNA, 13 bp, Homo sapiens
aacacccctctgt

SEQ ID NO: 1744711 - DNA, 20 bp, Homo sapiens
aacacccttagaaaatgtgt

SEQ ID NO: 1744712 - DNA, 13 bp, Homo sapiens
aacaccggcagaa

SEQ ID NO: 1744713 - DNA, 13 bp, Homo sapiens
aacacctcccagg

SEQ ID NO: 1744714 - DNA, 21 bp, Homo sapiens
aacacctgcctaggtttttcc

SEQ ID NO: 1744715 - DNA, 22 bp, Homo sapiens
aacaccttcagaggctgaggtg

SEQ ID NO: 1744716 - DNA, 21 bp, Homo sapiens
aacacgccttgttcctgctct

SEQ ID NO: 1744717 - DNA, 14 bp, Homo sapiens
aacacgttgccagg

SEQ ID NO: 1744718 - DNA, 15 bp, Homo sapiens
aacactaaaaataaa

SEQ ID NO: 1744719 - DNA, 19 bp, Homo sapiens
aacactaactcaccagccc

SEQ ID NO: 1744720 - DNA, 23 bp, Homo sapiens
aacactaatatatttaaaaataa

SEQ ID NO: 1744721 - DNA, 18 bp, Homo sapiens
aacactacctcttttgag

SEQ ID NO: 1744722 - DNA, 14 bp, Homo sapiens
aacactagccagac

SEQ ID NO: 1744723 - DNA, 15 bp, Homo sapiens
aacactgcaagaagt

SEQ ID NO: 1744724 - DNA, 20 bp, Homo sapiens
aacactgccatattgtgtaa

SEQ ID NO: 1744725 - DNA, 21 bp, Homo sapiens
aacactgccatattgtgtaat

SEQ ID NO: 1744726 - DNA, 14 bp, Homo sapiens
aacactgccttttt

SEQ ID NO: 1744727 - DNA, 14 bp, Homo sapiens
aacactgctgtcca

SEQ ID NO: 1744728 - DNA, 19 bp, Homo sapiens
aacactggcaacaacaaag

SEQ ID NO: 1744729 - DNA, 23 bp, Homo sapiens
aacactggtggaggatggaaagg

SEQ ID NO: 1744730 - DNA, 16 bp, Homo sapiens
aacactgtaatcttaa

SEQ ID NO: 1744731 - DNA, 20 bp, Homo sapiens
aacactgtccttccctgcca

SEQ ID NO: 1744732 - DNA, 14 bp, Homo sapiens
aacactgtgaccag

SEQ ID NO: 1744733 - DNA, 18 bp, Homo sapiens
aacactgtgccctggtgg

SEQ ID NO: 1744734 - DNA, 18 bp, Homo sapiens
aacactgttatcattttt

SEQ ID NO: 1744735 - DNA, 15 bp, Homo sapiens
aacactgttttatag

SEQ ID NO: 1744736 - DNA, 22 bp, Homo sapiens
aacacttaagggttttagaaaa

SEQ ID NO: 1744737 - DNA, 22 bp, Homo sapiens
aacacttaggactagaagatta

SEQ ID NO: 1744738 - DNA, 12 bp, Homo sapiens
aacacttagtat

SEQ ID NO: 1744739 - DNA, 15 bp, Homo sapiens
aacacttattttctg

SEQ ID NO: 1744740 - DNA, 21 bp, Homo sapiens
aacacttattttctgaattca

SEQ ID NO: 1744741 - DNA, 23 bp, Homo sapiens
aacacttggcatacaaaatattt

SEQ ID NO: 1744742 - DNA, 23 bp, Homo sapiens
aacacttgtgacttttgctttaa

SEQ ID NO: 1744743 - DNA, 13 bp, Homo sapiens
aacactttgtatt

SEQ ID NO: 1744744 - DNA, 15 bp, Homo sapiens
aacactttgtattac

SEQ ID NO: 1744745 - DNA, 15 bp, Homo sapiens
aacagaaaacaagaa

SEQ ID NO: 1744746 - DNA, 16 bp, Homo sapiens
aacagaaacaaaaaca

SEQ ID NO: 1744747 - DNA, 12 bp, Homo sapiens
aacagaaagttg

SEQ ID NO: 1744748 - DNA, 22 bp, Homo sapiens
aacagaaatattggttgaaagt

SEQ ID NO: 1744749 - DNA, 15 bp, Homo sapiens
aacagaaattgtata

SEQ ID NO: 1744750 - DNA, 12 bp, Homo sapiens
aacagaacactt

SEQ ID NO: 1744751 - DNA, 16 bp, Homo sapiens
aacagaagcttccatt

SEQ ID NO: 1744752 - DNA, 15 bp, Homo sapiens
aacagacaaaaacaa

SEQ ID NO: 1744753 - DNA, 18 bp, Homo sapiens
aacagacaacagaagtca

SEQ ID NO: 1744754 - DNA, 11 bp, Homo sapiens
aacagacagga

SEQ ID NO: 1744755 - DNA, 16 bp, Homo sapiens
aacagagaaggcagga

SEQ ID NO: 1744756 - DNA, 19 bp, Homo sapiens
aacagagacaggcccaaga

SEQ ID NO: 1744757 - DNA, 14 bp, Homo sapiens
aacagagagaatga

SEQ ID NO: 1744758 - DNA, 18 bp, Homo sapiens
aacagagaggaccaacat

SEQ ID NO: 1744759 - DNA, 17 bp, Homo sapiens
aacagaggcctccccca

SEQ ID NO: 1744760 - DNA, 18 bp, Homo sapiens
aacagagtggattgggct

SEQ ID NO: 1744761 - DNA, 15 bp, Homo sapiens
aacagagtggcctcc

SEQ ID NO: 1744762 - DNA, 21 bp, Homo sapiens
aacagagtggcctccctgctg

SEQ ID NO: 1744763 - DNA, 18 bp, Homo sapiens
aacagataagcaagagag

SEQ ID NO: 1744764 - DNA, 13 bp, Homo sapiens
aacagataatcag

SEQ ID NO: 1744765 - DNA, 22 bp, Homo sapiens
aacagatgcaatgtgctactga

SEQ ID NO: 1744766 - DNA, 21 bp, Homo sapiens
aacagatggggtctgtgactg

SEQ ID NO: 1744767 - DNA, 20 bp, Homo sapiens
aacagattcagaatgagaat

SEQ ID NO: 1744768 - DNA, 17 bp, Homo sapiens
aacagattcaggccagc

SEQ ID NO: 1744769 - DNA, 18 bp, Homo sapiens
aacagattcaggccagcc

SEQ ID NO: 1744770 - DNA, 21 bp, Homo sapiens
aacagattcaggccagcccag

SEQ ID NO: 1744771 - DNA, 18 bp, Homo sapiens
aacagcacacctgtgtcc

SEQ ID NO: 1744772 - DNA, 17 bp, Homo sapiens
aacagcacttttcctct

SEQ ID NO: 1744773 - DNA, 11 bp, Homo sapiens
aaccatttata

SEQ ID NO: 1744774 - DNA, 15 bp, Homo sapiens
aaccatttatcttga

SEQ ID NO: 1744775 - DNA, 21 bp, Homo sapiens
aaccatttcaagacagattgt

SEQ ID NO: 1744776 - DNA, 21 bp, Homo sapiens
aaccattttcccatcatcctt

SEQ ID NO: 1744777 - DNA, 20 bp, Homo sapiens
aaccatttttgctgaattca

SEQ ID NO: 1744778 - DNA, 22 bp, Homo sapiens
aacccaaaaaagaacaagctca

SEQ ID NO: 1744779 - DNA, 15 bp, Homo sapiens
aacccaagcttagaa

SEQ ID NO: 1744780 - DNA, 16 bp, Homo sapiens
aacccaagcttagaac

SEQ ID NO: 1744781 - DNA, 14 bp, Homo sapiens
aacccaagtgcctc

SEQ ID NO: 1744782 - DNA, 16 bp, Homo sapiens
aacccaagtgggggca

SEQ ID NO: 1744783 - DNA, 19 bp, Homo sapiens
aacccaatgacttccctgc

SEQ ID NO: 1744784 - DNA, 11 bp, Homo sapiens
aacccacagct

SEQ ID NO: 1744785 - DNA, 12 bp, Homo sapiens
aacccacagctc

SEQ ID NO: 1744786 - DNA, 20 bp, Homo sapiens
aacccacagctcagctgccc

SEQ ID NO: 1744787 - DNA, 22 bp, Homo sapiens
aacccacataaaagccccagct

SEQ ID NO: 1744788 - DNA, 22 bp, Homo sapiens
aacccacatggggttcctggtt

SEQ ID NO: 1744789 - DNA, 20 bp, Homo sapiens
aacccacctctcctgccctg

SEQ ID NO: 1744790 - DNA, 11 bp, Homo sapiens
aacccactccg

SEQ ID NO: 1744791 - DNA, 12 bp, Homo sapiens
aacccagactca

SEQ ID NO: 1744792 - DNA, 14 bp, Homo sapiens
aacccagactcaga

SEQ ID NO: 1744793 - DNA, 12 bp, Homo sapiens
aacccagggcaa

SEQ ID NO: 1744794 - DNA, 15 bp, Homo sapiens
aacccatacaatgta

SEQ ID NO: 1744795 - DNA, 18 bp, Homo sapiens
aacccatacaatgtatgt

SEQ ID NO: 1744796 - DNA, 19 bp, Homo sapiens
aacccatcagaaggagaag

SEQ ID NO: 1744797 - DNA, 21 bp, Homo sapiens
aacccatcggtaggcaaagga

SEQ ID NO: 1744798 - DNA, 17 bp, Homo sapiens
aacccattcactacagg

SEQ ID NO: 1744799 - DNA, 23 bp, Homo sapiens
aacccattccagtacagtattct

SEQ ID NO: 1744800 - DNA, 17 bp, Homo sapiens
aaccccaacgcacagga

SEQ ID NO: 1744801 - DNA, 13 bp, Homo sapiens
aaccccatgggct

SEQ ID NO: 1744802 - DNA, 15 bp, Homo sapiens
aacccccaccccaca

SEQ ID NO: 1744803 - DNA, 18 bp, Homo sapiens
aacccccaccccacactt

SEQ ID NO: 1744804 - DNA, 19 bp, Homo sapiens
aacccccaccccacacttg

SEQ ID NO: 1744805 - DNA, 14 bp, Homo sapiens
aaccccccagcact

SEQ ID NO: 1744806 - DNA, 19 bp, Homo sapiens
aaccccccagcactgagga

SEQ ID NO: 1744807 - DNA, 12 bp, Homo sapiens
aacccccctcct

SEQ ID NO: 1744808 - DNA, 17 bp, Homo sapiens
aacccccctcctgctcc

SEQ ID NO: 1744809 - DNA, 22 bp, Homo sapiens
aaccccgcggtgctctggcggc

SEQ ID NO: 1744810 - DNA, 21 bp, Homo sapiens
aacccctacatgaaacagaaa

SEQ ID NO: 1744811 - DNA, 15 bp, Homo sapiens
aacccctcctggctg

SEQ ID NO: 1744812 - DNA, 22 bp, Homo sapiens
aacccctgacctaccccagcca

SEQ ID NO: 1744813 - DNA, 21 bp, Homo sapiens
aacccctggccagctctgagg

SEQ ID NO: 1744814 - DNA, 12 bp, Homo sapiens
aacccctgtgtc

SEQ ID NO: 1744815 - DNA, 11 bp, Homo sapiens
aacccctttcc

SEQ ID NO: 1744816 - DNA, 15 bp, Homo sapiens
aacccgggggacaga

SEQ ID NO: 1744817 - DNA, 15 bp, Homo sapiens
aacccgtctggccca

SEQ ID NO: 1744818 - DNA, 16 bp, Homo sapiens
aacccgtttcccggtt

SEQ ID NO: 1744819 - DNA, 13 bp, Homo sapiens
aaccctaccctgg

SEQ ID NO: 1744820 - DNA, 19 bp, Homo sapiens
aaccctagccttgcttgtt

SEQ ID NO: 1744821 - DNA, 14 bp, Homo sapiens
aaccctagctgtgt

SEQ ID NO: 1744822 - DNA, 22 bp, Homo sapiens
aaccctatctcctgacagaagg

SEQ ID NO: 1744823 - DNA, 23 bp, Homo sapiens
aaccctatctcctgacagaaggt

SEQ ID NO: 1744824 - DNA, 12 bp, Homo sapiens
aaccctcagagc

SEQ ID NO: 1744825 - DNA, 13 bp, Homo sapiens
aaccctcccagaa

SEQ ID NO: 1744826 - DNA, 19 bp, Homo sapiens
aaccctcctgggcccaagt

SEQ ID NO: 1744827 - DNA, 19 bp, Homo sapiens
aaccctgatctctcagccc

SEQ ID NO: 1744828 - DNA, 22 bp, Homo sapiens
aaccctgctgaacacagtgtct

SEQ ID NO: 1744829 - DNA, 15 bp, Homo sapiens
aaccctgcttctgct

SEQ ID NO: 1744830 - DNA, 19 bp, Homo sapiens
aaccctgggctattgctgc

SEQ ID NO: 1744831 - DNA, 20 bp, Homo sapiens
aaccctggggaaggagccag

SEQ ID NO: 1744832 - DNA, 21 bp, Homo sapiens
aaccctggggaaggagccagt

SEQ ID NO: 1744833 - DNA, 20 bp, Homo sapiens
aaccctggggcctgactgct

SEQ ID NO: 1744834 - DNA, 19 bp, Homo sapiens
aaccctgtgctggtgtcct

SEQ ID NO: 1744835 - DNA, 15 bp, Homo sapiens
aaccctgttttatac

SEQ ID NO: 1744836 - DNA, 23 bp, Homo sapiens
aaccctgttttatactgtactta

SEQ ID NO: 1744837 - DNA, 21 bp, Homo sapiens
aacccttggagccaatggaga

SEQ ID NO: 1744838 - DNA, 20 bp, Homo sapiens
aacccttgggccagaagtac

SEQ ID NO: 1744839 - DNA, 14 bp, Homo sapiens
aaccgcacagctca

SEQ ID NO: 1744840 - DNA, 22 bp, Homo sapiens
aaccggaaggaggccaaccagc

SEQ ID NO: 1744841 - DNA, 19 bp, Homo sapiens
aaccgtaacccacccccaa

SEQ ID NO: 1744842 - DNA, 18 bp, Homo sapiens
aaccgtagactaggaagt

SEQ ID NO: 1744843 - DNA, 19 bp, Homo sapiens
aaccgtagactaggaagta

SEQ ID NO: 1744844 - DNA, 22 bp, Homo sapiens
aaccgtctgttatgctgtgaca

SEQ ID NO: 1744845 - DNA, 16 bp, Homo sapiens
aaccgtggtatgtctg

SEQ ID NO: 1744846 - DNA, 14 bp, Homo sapiens
aacctaaaaatttt

SEQ ID NO: 1744847 - DNA, 16 bp, Homo sapiens
aacctaatatcactta

SEQ ID NO: 1744848 - DNA, 21 bp, Homo sapiens
aacctaatcaccatgtaagca

SEQ ID NO: 1744849 - DNA, 14 bp, Homo sapiens
aacctaattaatat

SEQ ID NO: 1744850 - DNA, 20 bp, Homo sapiens
aacctacagttttaactgtg

SEQ ID NO: 1744851 - DNA, 16 bp, Homo sapiens
aacctacgcacatacc

SEQ ID NO: 1744852 - DNA, 22 bp, Homo sapiens
aacctactgtctaagcagtttt

SEQ ID NO: 1744853 - DNA, 16 bp, Homo sapiens
aacctagaatgtcaga

SEQ ID NO: 1744854 - DNA, 13 bp, Homo sapiens
aacctagtactct

SEQ ID NO: 1744855 - DNA, 14 bp, Homo sapiens
aacctatccttcca

SEQ ID NO: 1744856 - DNA, 12 bp, Homo sapiens
aacctcaaacca

SEQ ID NO: 1744857 - DNA, 16 bp, Homo sapiens
aacctcaatgccctgc

SEQ ID NO: 1744858 - DNA, 20 bp, Homo sapiens
aacctcagcctggccagaca

SEQ ID NO: 1744859 - DNA, 18 bp, Homo sapiens
aacctcaggcttccttgg

SEQ ID NO: 1744860 - DNA, 20 bp, Homo sapiens
aacctcatgacagccagagc

SEQ ID NO: 1744861 - DNA, 19 bp, Homo sapiens
aacctcattgctaccacag

SEQ ID NO: 1744862 - DNA, 19 bp, Homo sapiens
aacctccagcctccctgtc

SEQ ID NO: 1744863 - DNA, 18 bp, Homo sapiens
aacctcccatcccacccc

SEQ ID NO: 1744864 - DNA, 16 bp, Homo sapiens
aacctcctgctctggg

SEQ ID NO: 1744865 - DNA, 16 bp, Homo sapiens
aacctcgggcctgctg

SEQ ID NO: 1744866 - DNA, 18 bp, Homo sapiens
aacctctagaattttaag

SEQ ID NO: 1744867 - DNA, 14 bp, Homo sapiens
aacctctcacagtt

SEQ ID NO: 1744868 - DNA, 17 bp, Homo sapiens
aacctctcctttctgtg

SEQ ID NO: 1744869 - DNA, 13 bp, Homo sapiens
aacctctgcctcc

SEQ ID NO: 1744870 - DNA, 21 bp, Homo sapiens
aacctctgtattagtttttga

SEQ ID NO: 1744871 - DNA, 23 bp, Homo sapiens
aacctgacagatgtcagccgagc

SEQ ID NO: 1744872 - DNA, 16 bp, Homo sapiens
aacctgacccctgctc

SEQ ID NO: 1744873 - DNA, 17 bp, Homo sapiens
aacctgacccctgctca

SEQ ID NO: 1744874 - DNA, 22 bp, Homo sapiens
aacctgactcaattatttgcat

SEQ ID NO: 1744875 - DNA, 15 bp, Homo sapiens
aacctgcacacagga

SEQ ID NO: 1744876 - DNA, 20 bp, Homo sapiens
aacctgcacacaggacagcg

SEQ ID NO: 1744877 - DNA, 11 bp, Homo sapiens
aacctgccctg

SEQ ID NO: 1744878 - DNA, 13 bp, Homo sapiens
aacctgccctgcc

SEQ ID NO: 1744879 - DNA, 16 bp, Homo sapiens
aacctgccctgcctga

SEQ ID NO: 1744880 - DNA, 13 bp, Homo sapiens
aacctgcttcctt

SEQ ID NO: 1744881 - DNA, 16 bp, Homo sapiens
aacctggatccagcac

SEQ ID NO: 1744882 - DNA, 22 bp, Homo sapiens
aacctggttcatatttatactt

SEQ ID NO: 1744883 - DNA, 23 bp, Homo sapiens
aacctgtacttcaagttaaagtg

SEQ ID NO: 1744884 - DNA, 23 bp, Homo sapiens
aacctgtcctaaggaaccttcct

SEQ ID NO: 1744885 - DNA, 11 bp, Homo sapiens
aacctgtcctt

SEQ ID NO: 1744886 - DNA, 15 bp, Homo sapiens
aacctgtccttgcac

SEQ ID NO: 1744887 - DNA, 19 bp, Homo sapiens
aacctgtcttggggccact

SEQ ID NO: 1744888 - DNA, 19 bp, Homo sapiens
aactggaaatactagattt

SEQ ID NO: 1744889 - DNA, 20 bp, Homo sapiens
aactggaagcatgtaggaga

SEQ ID NO: 1744890 - DNA, 14 bp, Homo sapiens
aactggaaggcctt

SEQ ID NO: 1744891 - DNA, 15 bp, Homo sapiens
aactggacatgaagg

SEQ ID NO: 1744892 - DNA, 18 bp, Homo sapiens
aactggacatgaaggaaa

SEQ ID NO: 1744893 - DNA, 13 bp, Homo sapiens
aactggactcagg

SEQ ID NO: 1744894 - DNA, 15 bp, Homo sapiens
aactggagggtgggt

SEQ ID NO: 1744895 - DNA, 16 bp, Homo sapiens
aactggagttccttat

SEQ ID NO: 1744896 - DNA, 23 bp, Homo sapiens
aactggctgaaaggttaattctc

SEQ ID NO: 1744897 - DNA, 15 bp, Homo sapiens
aactggcttctgtgc

SEQ ID NO: 1744898 - DNA, 15 bp, Homo sapiens
aactggcttgtacat

SEQ ID NO: 1744899 - DNA, 17 bp, Homo sapiens
aactggcttgtacattt

SEQ ID NO: 1744900 - DNA, 21 bp, Homo sapiens
aactggcttgtacatttttaa

SEQ ID NO: 1744901 - DNA, 16 bp, Homo sapiens
aactgggcatttcaat

SEQ ID NO: 1744902 - DNA, 21 bp, Homo sapiens
aactggggttcaagcccaggc

SEQ ID NO: 1744903 - DNA, 17 bp, Homo sapiens
aactgggttaaatattt

SEQ ID NO: 1744904 - DNA, 15 bp, Homo sapiens
aactgggtttctcat

SEQ ID NO: 1744905 - DNA, 20 bp, Homo sapiens
aactggtaaaaagatccagg

SEQ ID NO: 1744906 - DNA, 24 bp, Homo sapiens
aactggtaaaaagatccagggatg

SEQ ID NO: 1744907 - DNA, 20 bp, Homo sapiens
aactggtaagcgatttgaaa

SEQ ID NO: 1744908 - DNA, 13 bp, Homo sapiens
aactggtatttta

SEQ ID NO: 1744909 - DNA, 21 bp, Homo sapiens
aactggttaaacattaatatt

SEQ ID NO: 1744910 - DNA, 18 bp, Homo sapiens
aactgtaaataaaatgtg

SEQ ID NO: 1744911 - DNA, 23 bp, Homo sapiens
aactgtaaatatttttttaacct

SEQ ID NO: 1744912 - DNA, 12 bp, Homo sapiens
aactgtaaatca

SEQ ID NO: 1744913 - DNA, 14 bp, Homo sapiens
aactgtacattgtg

SEQ ID NO: 1744914 - DNA, 14 bp, Homo sapiens
aactgtacatttaa

SEQ ID NO: 1744915 - DNA, 13 bp, Homo sapiens
aactgtacttcac

SEQ ID NO: 1744916 - DNA, 15 bp, Homo sapiens
aactgtacttcactg

SEQ ID NO: 1744917 - DNA, 17 bp, Homo sapiens
aactgtagaaatgatga

SEQ ID NO: 1744918 - DNA, 14 bp, Homo sapiens
aactgtagatgaag

SEQ ID NO: 1744919 - DNA, 17 bp, Homo sapiens
aactgtatcaaatctgt

SEQ ID NO: 1744920 - DNA, 13 bp, Homo sapiens
aactgtatttgaa

SEQ ID NO: 1744921 - DNA, 14 bp, Homo sapiens
aactgtcccagcta

SEQ ID NO: 1744922 - DNA, 13 bp, Homo sapiens
aactgtcttctgg

SEQ ID NO: 1744923 - DNA, 13 bp, Homo sapiens
aactgtcttgttt

SEQ ID NO: 1744924 - DNA, 20 bp, Homo sapiens
aactgtcttgtttcagtgag

SEQ ID NO: 1744925 - DNA, 17 bp, Homo sapiens
aactgtgaaaaatcaga

SEQ ID NO: 1744926 - DNA, 17 bp, Homo sapiens
aactgtgaagtttacat

SEQ ID NO: 1744927 - DNA, 19 bp, Homo sapiens
aactgtgaagtttacattg

SEQ ID NO: 1744928 - DNA, 15 bp, Homo sapiens
aactgtgactaggca

SEQ ID NO: 1744929 - DNA, 13 bp, Homo sapiens
aactgtgataaaa

SEQ ID NO: 1744930 - DNA, 14 bp, Homo sapiens
aactgtgataaaaa

SEQ ID NO: 1744931 - DNA, 16 bp, Homo sapiens
aactgtgatttcagga

SEQ ID NO: 1744932 - DNA, 22 bp, Homo sapiens
aactgtgcatcaaccaggaaga

SEQ ID NO: 1744933 - DNA, 15 bp, Homo sapiens
aactgtgccacaatg

SEQ ID NO: 1744934 - DNA, 13 bp, Homo sapiens
aactgtggatatt

SEQ ID NO: 1744935 - DNA, 14 bp, Homo sapiens
aactgtggatattg

SEQ ID NO: 1744936 - DNA, 13 bp, Homo sapiens
aactgtgtatgta

SEQ ID NO: 1744937 - DNA, 15 bp, Homo sapiens
aactgtgtgattaaa

SEQ ID NO: 1744938 - DNA, 23 bp, Homo sapiens
aactgtgttttagtgtaaaattg

SEQ ID NO: 1744939 - DNA, 20 bp, Homo sapiens
aactgttacaacttgtattt

SEQ ID NO: 1744940 - DNA, 14 bp, Homo sapiens
aactgttagaatgt

SEQ ID NO: 1744941 - DNA, 14 bp, Homo sapiens
aactgttcccttat

SEQ ID NO: 1744942 - DNA, 19 bp, Homo sapiens
aactgttctctttaaaata

SEQ ID NO: 1744943 - DNA, 19 bp, Homo sapiens
aactgttggaatggatttt

SEQ ID NO: 1744944 - DNA, 15 bp, Homo sapiens
aactgttggagcccg

SEQ ID NO: 1744945 - DNA, 22 bp, Homo sapiens
aactgttgtcaccattgcacaa

SEQ ID NO: 1744946 - DNA, 17 bp, Homo sapiens
aactgtttccctgctga

SEQ ID NO: 1744947 - DNA, 13 bp, Homo sapiens
aactgttttcatg

SEQ ID NO: 1744948 - DNA, 18 bp, Homo sapiens
aacttaaaaatgtaaata

SEQ ID NO: 1744949 - DNA, 21 bp, Homo sapiens
aacttaaaaatgtaaatattc

SEQ ID NO: 1744950 - DNA, 18 bp, Homo sapiens
aacttaaatgcccccctc

SEQ ID NO: 1744951 - DNA, 15 bp, Homo sapiens
aacttaagaaacact

SEQ ID NO: 1744952 - DNA, 21 bp, Homo sapiens
aacttaagttggtcctttaca

SEQ ID NO: 1744953 - DNA, 23 bp, Homo sapiens
aacttacattgtgaaacttctgt

SEQ ID NO: 1744954 - DNA, 14 bp, Homo sapiens
aacttacccagatg

SEQ ID NO: 1744955 - DNA, 15 bp, Homo sapiens
aacttacccagatgt

SEQ ID NO: 1744956 - DNA, 20 bp, Homo sapiens
aacttagactctagtattta

SEQ ID NO: 1744957 - DNA, 16 bp, Homo sapiens
aacttagcatgtgttg

SEQ ID NO: 1744958 - DNA, 20 bp, Homo sapiens
aacttagtgacaaaatagac

SEQ ID NO: 1744959 - DNA, 12 bp, Homo sapiens
aacttagttttg

SEQ ID NO: 1744960 - DNA, 16 bp, Homo sapiens
aacttagttttgcata

SEQ ID NO: 1744961 - DNA, 15 bp, Homo sapiens
aacttatccatcttt

SEQ ID NO: 1744962 - DNA, 12 bp, Homo sapiens
aacttatgtttt

SEQ ID NO: 1744963 - DNA, 13 bp, Homo sapiens
aacttattccaag

SEQ ID NO: 1744964 - DNA, 18 bp, Homo sapiens
aacttatttaaaaatatt

SEQ ID NO: 1744965 - DNA, 21 bp, Homo sapiens
aacttatttaaaaatatttca

SEQ ID NO: 1744966 - DNA, 13 bp, Homo sapiens
aacttatttagag

SEQ ID NO: 1744967 - DNA, 13 bp, Homo sapiens
aacttattttgct

SEQ ID NO: 1744968 - DNA, 14 bp, Homo sapiens
aacttcaacattta

SEQ ID NO: 1744969 - DNA, 19 bp, Homo sapiens
aacttcaacatttacatgt

SEQ ID NO: 1744970 - DNA, 20 bp, Homo sapiens
aacttcaagggacaagtatt

SEQ ID NO: 1744971 - DNA, 15 bp, Homo sapiens
aacttcagacacaaa

SEQ ID NO: 1744972 - DNA, 14 bp, Homo sapiens
aacttcatgtaatt

SEQ ID NO: 1744973 - DNA, 17 bp, Homo sapiens
aacttcattctaaacca

SEQ ID NO: 1744974 - DNA, 21 bp, Homo sapiens
aacttcattctaaaccaaaac

SEQ ID NO: 1744975 - DNA, 22 bp, Homo sapiens
aacttcatttgacacaaagctt

SEQ ID NO: 1744976 - DNA, 13 bp, Homo sapiens
aacttccaaagaa

SEQ ID NO: 1744977 - DNA, 18 bp, Homo sapiens
aacttcccatctggctca

SEQ ID NO: 1744978 - DNA, 22 bp, Homo sapiens
aacttcccgtcccatatcctgc

SEQ ID NO: 1744979 - DNA, 23 bp, Homo sapiens
aacttcccgtcccatatcctgcc

SEQ ID NO: 1744980 - DNA, 15 bp, Homo sapiens
aacttccgctgaggg

SEQ ID NO: 1744981 - DNA, 11 bp, Homo sapiens
aacttcctgct

SEQ ID NO: 1744982 - DNA, 18 bp, Homo sapiens
aacttctatattttaata

SEQ ID NO: 1744983 - DNA, 22 bp, Homo sapiens
aacttctatattttaatagaaa

SEQ ID NO: 1744984 - DNA, 19 bp, Homo sapiens
aacttctgcaacaagcatg

SEQ ID NO: 1744985 - DNA, 16 bp, Homo sapiens
aacttcttaaaccatt

SEQ ID NO: 1744986 - DNA, 19 bp, Homo sapiens
aacttcttgcttctttcta

SEQ ID NO: 1744987 - DNA, 12 bp, Homo sapiens
aacttgaaatat

SEQ ID NO: 1744988 - DNA, 14 bp, Homo sapiens
aacttgaaatatat

SEQ ID NO: 1744989 - DNA, 15 bp, Homo sapiens
aacttgaaatatata

SEQ ID NO: 1744990 - DNA, 16 bp, Homo sapiens
aacttgaaatatataa

SEQ ID NO: 1744991 - DNA, 15 bp, Homo sapiens
aacttgagatgtatg

SEQ ID NO: 1744992 - DNA, 19 bp, Homo sapiens
aacttgagtggctgtctta

SEQ ID NO: 1744993 - DNA, 19 bp, Homo sapiens
aacttgattaactcctcct

SEQ ID NO: 1744994 - DNA, 14 bp, Homo sapiens
aacttgccacatgt

SEQ ID NO: 1744995 - DNA, 14 bp, Homo sapiens
aacttgctcttttt

SEQ ID NO: 1744996 - DNA, 16 bp, Homo sapiens
aacttgctgctgcctt

SEQ ID NO: 1744997 - DNA, 14 bp, Homo sapiens
aacttgcttaaatt

SEQ ID NO: 1744998 - DNA, 21 bp, Homo sapiens
aacttgcttaaatttcttatg

SEQ ID NO: 1744999 - DNA, 22 bp, Homo sapiens
aacttgcttagtatggttctca

SEQ ID NO: 1745000 - DNA, 16 bp, Homo sapiens
aacttggcatttctat

SEQ ID NO: 1745001 - DNA, 23 bp, Homo sapiens
aacttgggagtgtggtttctttt

SEQ ID NO: 1745002 - DNA, 23 bp, Homo sapiens
aacttggggagttaagacctggc

SEQ ID NO: 1745003 - DNA, 14 bp, Homo sapiens
aacttggtcagagc

SEQ ID NO: 1745004 - DNA, 21 bp, Homo sapiens
aagaccaagacttttgtctga

SEQ ID NO: 1745005 - DNA, 21 bp, Homo sapiens
aagaccagggcttttcccagg

SEQ ID NO: 1745006 - DNA, 14 bp, Homo sapiens
aagaccccatctct

SEQ ID NO: 1745007 - DNA, 13 bp, Homo sapiens
aagacccccagca

SEQ ID NO: 1745008 - DNA, 14 bp, Homo sapiens
aagacccctgtctt

SEQ ID NO: 1745009 - DNA, 18 bp, Homo sapiens
aagaccctaaacatccat

SEQ ID NO: 1745010 - DNA, 15 bp, Homo sapiens
aagaccctcccatgg

SEQ ID NO: 1745011 - DNA, 13 bp, Homo sapiens
aagaccctccccg

SEQ ID NO: 1745012 - DNA, 14 bp, Homo sapiens
aagaccctgagact

SEQ ID NO: 1745013 - DNA, 19 bp, Homo sapiens
aagaccgccccagggctat

SEQ ID NO: 1745014 - DNA, 17 bp, Homo sapiens
aagacctactgttctaa

SEQ ID NO: 1745015 - DNA, 21 bp, Homo sapiens
aagacctactgttctaaagct

SEQ ID NO: 1745016 - DNA, 19 bp, Homo sapiens
aagacctcatctgtggagc

SEQ ID NO: 1745017 - DNA, 15 bp, Homo sapiens
aagacctgagtattt

SEQ ID NO: 1745018 - DNA, 20 bp, Homo sapiens
aagaccttctccccattctg

SEQ ID NO: 1745019 - DNA, 22 bp, Homo sapiens
aagacctttattcacccctgcc

SEQ ID NO: 1745020 - DNA, 22 bp, Homo sapiens
aagacgaagaagcaagggagga

SEQ ID NO: 1745021 - DNA, 20 bp, Homo sapiens
aagacgaggggcagggaagg

SEQ ID NO: 1745022 - DNA, 23 bp, Homo sapiens
aagacgaggggcagggaaggaca

SEQ ID NO: 1745023 - DNA, 21 bp, Homo sapiens
aagacgcccattcggactgct

SEQ ID NO: 1745024 - DNA, 21 bp, Homo sapiens
aagacgggtattgttgggaaa

SEQ ID NO: 1745025 - DNA, 23 bp, Homo sapiens
aagacgggtattgttgggaaagg

SEQ ID NO: 1745026 - DNA, 23 bp, Homo sapiens
aagacggtattaaaatggagcga

SEQ ID NO: 1745027 - DNA, 12 bp, Homo sapiens
aagactacctgg

SEQ ID NO: 1745028 - DNA, 21 bp, Homo sapiens
aagactatatatataaatgta

SEQ ID NO: 1745029 - DNA, 22 bp, Homo sapiens
aagactatatatataaatgtat

SEQ ID NO: 1745030 - DNA, 17 bp, Homo sapiens
aagactatctaaatgtt

SEQ ID NO: 1745031 - DNA, 16 bp, Homo sapiens
aagactcaaatgttct

SEQ ID NO: 1745032 - DNA, 19 bp, Homo sapiens
aagactcaaatgttctaag

SEQ ID NO: 1745033 - DNA, 15 bp, Homo sapiens
aagactcaggagtct

SEQ ID NO: 1745034 - DNA, 16 bp, Homo sapiens
aagactccaaagaaat

SEQ ID NO: 1745035 - DNA, 13 bp, Homo sapiens
aagactctagagt

SEQ ID NO: 1745036 - DNA, 23 bp, Homo sapiens
aagactctttgggtccattcaga

SEQ ID NO: 1745037 - DNA, 14 bp, Homo sapiens
aagactgaacatgt

SEQ ID NO: 1745038 - DNA, 13 bp, Homo sapiens
aagactgcagaac

SEQ ID NO: 1745039 - DNA, 14 bp, Homo sapiens
aagactgcagctgc

SEQ ID NO: 1745040 - DNA, 16 bp, Homo sapiens
aagactgcagctgctg

SEQ ID NO: 1745041 - DNA, 17 bp, Homo sapiens
aagactgcagctgctga

SEQ ID NO: 1745042 - DNA, 16 bp, Homo sapiens
aagactgtagatatgt

SEQ ID NO: 1745043 - DNA, 16 bp, Homo sapiens
aagactgtcattgccc

SEQ ID NO: 1745044 - DNA, 21 bp, Homo sapiens
aagactgtgaacagcttgctg

SEQ ID NO: 1745045 - DNA, 12 bp, Homo sapiens
aagactgtggct

SEQ ID NO: 1745046 - DNA, 15 bp, Homo sapiens
aagactgtggctgct

SEQ ID NO: 1745047 - DNA, 16 bp, Homo sapiens
aagactgttgctcaaa

SEQ ID NO: 1745048 - DNA, 17 bp, Homo sapiens
aagactgttgctcaaat

SEQ ID NO: 1745049 - DNA, 22 bp, Homo sapiens
aagacttaaagggcccaatgaa

SEQ ID NO: 1745050 - DNA, 20 bp, Homo sapiens
aagacttactctaagatctt

SEQ ID NO: 1745051 - DNA, 14 bp, Homo sapiens
aagacttcccagct

SEQ ID NO: 1745052 - DNA, 23 bp, Homo sapiens
aagacttggttggtagggtggga

SEQ ID NO: 1745053 - DNA, 12 bp, Homo sapiens
aagacttgtttt

SEQ ID NO: 1745054 - DNA, 20 bp, Homo sapiens
aagacttttggtagagaagg

SEQ ID NO: 1745055 - DNA, 18 bp, Homo sapiens
aagagaaaaagaaatgca

SEQ ID NO: 1745056 - DNA, 14 bp, Homo sapiens
aagagaaaatatta

SEQ ID NO: 1745057 - DNA, 16 bp, Homo sapiens
aagagaaaatattact

SEQ ID NO: 1745058 - DNA, 17 bp, Homo sapiens
aagagaaaatgtaaata

SEQ ID NO: 1745059 - DNA, 17 bp, Homo sapiens
aagagaaaattcctaga

SEQ ID NO: 1745060 - DNA, 21 bp, Homo sapiens
aagagaaaccgggagaaggca

SEQ ID NO: 1745061 - DNA, 16 bp, Homo sapiens
aagagaaactgtgtat

SEQ ID NO: 1745062 - DNA, 11 bp, Homo sapiens
aagagaaactt

SEQ ID NO: 1745063 - DNA, 15 bp, Homo sapiens
aagagaaagaggcca

SEQ ID NO: 1745064 - DNA, 15 bp, Homo sapiens
aagagaagctgctga

SEQ ID NO: 1745065 - DNA, 18 bp, Homo sapiens
aagagaagctgctgacca

SEQ ID NO: 1745066 - DNA, 21 bp, Homo sapiens
aagagaagttgtaaagtatgt

SEQ ID NO: 1745067 - DNA, 20 bp, Homo sapiens
aagagaatattagctttact

SEQ ID NO: 1745068 - DNA, 19 bp, Homo sapiens
aagagaatctgatcaattt

SEQ ID NO: 1745069 - DNA, 15 bp, Homo sapiens
aagagaatgttccta

SEQ ID NO: 1745070 - DNA, 13 bp, Homo sapiens
aagagaattcagt

SEQ ID NO: 1745071 - DNA, 19 bp, Homo sapiens
aagagacaaacacctccca

SEQ ID NO: 1745072 - DNA, 13 bp, Homo sapiens
aagagacactcca

SEQ ID NO: 1745073 - DNA, 15 bp, Homo sapiens
aagagacagcccagg

SEQ ID NO: 1745074 - DNA, 18 bp, Homo sapiens
aagagactgcgttctgca

SEQ ID NO: 1745075 - DNA, 14 bp, Homo sapiens
aagagagaagccag

SEQ ID NO: 1745076 - DNA, 20 bp, Homo sapiens
aagagagaagccagccacag

SEQ ID NO: 1745077 - DNA, 13 bp, Homo sapiens
aagagagaatgta

SEQ ID NO: 1745078 - DNA, 16 bp, Homo sapiens
aagagagccttggttc

SEQ ID NO: 1745079 - DNA, 22 bp, Homo sapiens
aagagagccttggttcatcagt

SEQ ID NO: 1745080 - DNA, 15 bp, Homo sapiens
aagagaggacacaaa

SEQ ID NO: 1745081 - DNA, 15 bp, Homo sapiens
aagagagggacaggc

SEQ ID NO: 1745082 - DNA, 18 bp, Homo sapiens
aagagagggacaggcact

SEQ ID NO: 1745083 - DNA, 17 bp, Homo sapiens
aagagataaacgaccaa

SEQ ID NO: 1745084 - DNA, 17 bp, Homo sapiens
aagagatctacacatgt

SEQ ID NO: 1745085 - DNA, 20 bp, Homo sapiens
aagagatctacacatgttgc

SEQ ID NO: 1745086 - DNA, 15 bp, Homo sapiens
aagagatctgtgtgg

SEQ ID NO: 1745087 - DNA, 20 bp, Homo sapiens
aagagatctgtgtggctcct

SEQ ID NO: 1745088 - DNA, 23 bp, Homo sapiens
aagagatggcttacaaaaagaaa

SEQ ID NO: 1745089 - DNA, 18 bp, Homo sapiens
aagagatgggcttgtttt

SEQ ID NO: 1745090 - DNA, 14 bp, Homo sapiens
aagagatgtggcaa

SEQ ID NO: 1745091 - DNA, 21 bp, Homo sapiens
aagagattcgaatgacggtaa

SEQ ID NO: 1745092 - DNA, 17 bp, Homo sapiens
aagagattgttgtttgc

SEQ ID NO: 1745093 - DNA, 14 bp, Homo sapiens
aagagatttaatta

SEQ ID NO: 1745094 - DNA, 14 bp, Homo sapiens
aagagatttcaaga

SEQ ID NO: 1745095 - DNA, 21 bp, Homo sapiens
aagagcacactgcacagggaa

SEQ ID NO: 1745096 - DNA, 11 bp, Homo sapiens
aagagcagcct

SEQ ID NO: 1745097 - DNA, 14 bp, Homo sapiens
aagagcagcctgat

SEQ ID NO: 1745098 - DNA, 14 bp, Homo sapiens
aagagcagcctgtg

SEQ ID NO: 1745099 - DNA, 16 bp, Homo sapiens
aagagcagcctgtggc

SEQ ID NO: 1745100 - DNA, 18 bp, Homo sapiens
aagagcagcctgtggcat

SEQ ID NO: 1745101 - DNA, 19 bp, Homo sapiens
aagagcagcctgtggcatc

SEQ ID NO: 1745102 - DNA, 18 bp, Homo sapiens
aagagcaggccagcccgg

SEQ ID NO: 1745103 - DNA, 12 bp, Homo sapiens
aagagcaggtga

SEQ ID NO: 1745104 - DNA, 21 bp, Homo sapiens
aagagccactttcaagctgca

SEQ ID NO: 1745105 - DNA, 19 bp, Homo sapiens
aagagccctgtggccgcca

SEQ ID NO: 1745106 - DNA, 14 bp, Homo sapiens
aagagcccttgcct

SEQ ID NO: 1745107 - DNA, 16 bp, Homo sapiens
aagagcccttgcctcc

SEQ ID NO: 1745108 - DNA, 22 bp, Homo sapiens
aagagccttggtgtccacctgg

SEQ ID NO: 1745109 - DNA, 21 bp, Homo sapiens
aagagcgagagatcaaagatg

SEQ ID NO: 1745110 - DNA, 22 bp, Homo sapiens
aagagctagaaaaataaaatgt

SEQ ID NO: 1745111 - DNA, 20 bp, Homo sapiens
aagagctagcgctgccgcac

SEQ ID NO: 1745112 - DNA, 14 bp, Homo sapiens
aagagctgcctgga

SEQ ID NO: 1745113 - DNA, 15 bp, Homo sapiens
aagagctgcctggat

SEQ ID NO: 1745114 - DNA, 18 bp, Homo sapiens
aagagctgcctggatgag

SEQ ID NO: 1745115 - DNA, 11 bp, Homo sapiens
aagagctgctg

SEQ ID NO: 1745116 - DNA, 17 bp, Homo sapiens
aagagctgctgtccttt

SEQ ID NO: 1745117 - DNA, 18 bp, Homo sapiens
aagagctgttcacagcca

SEQ ID NO: 1745118 - DNA, 14 bp, Homo sapiens
aagagcttgctcca

SEQ ID NO: 1745119 - DNA, 15 bp, Homo sapiens
aagcccccagggcct

SEQ ID NO: 1745120 - DNA, 20 bp, Homo sapiens
aagcccccagggcctccagg

SEQ ID NO: 1745121 - DNA, 12 bp, Homo sapiens
aagcccctcagc

SEQ ID NO: 1745122 - DNA, 14 bp, Homo sapiens
aagcccctgggccc

SEQ ID NO: 1745123 - DNA, 13 bp, Homo sapiens
aagccccttggag

SEQ ID NO: 1745124 - DNA, 15 bp, Homo sapiens
aagcccgacttgctg

SEQ ID NO: 1745125 - DNA, 17 bp, Homo sapiens
aagccctacagagctgt

SEQ ID NO: 1745126 - DNA, 13 bp, Homo sapiens
aagccctccttcc

SEQ ID NO: 1745127 - DNA, 14 bp, Homo sapiens
aagccctccttcca

SEQ ID NO: 1745128 - DNA, 11 bp, Homo sapiens
aagccctggca

SEQ ID NO: 1745129 - DNA, 13 bp, Homo sapiens
aagccctgttctc

SEQ ID NO: 1745130 - DNA, 20 bp, Homo sapiens
aagcccttggaacaccctgg

SEQ ID NO: 1745131 - DNA, 14 bp, Homo sapiens
aagccctttgctct

SEQ ID NO: 1745132 - DNA, 18 bp, Homo sapiens
aagccgactctggccctg

SEQ ID NO: 1745133 - DNA, 13 bp, Homo sapiens
aagccgaggaggc

SEQ ID NO: 1745134 - DNA, 18 bp, Homo sapiens
aagccggacagctgccca

SEQ ID NO: 1745135 - DNA, 12 bp, Homo sapiens
aagccggcggcc

SEQ ID NO: 1745136 - DNA, 13 bp, Homo sapiens
aagccggcggccc

SEQ ID NO: 1745137 - DNA, 14 bp, Homo sapiens
aagccggcggccca

SEQ ID NO: 1745138 - DNA, 14 bp, Homo sapiens
aagccgtctgactc

SEQ ID NO: 1745139 - DNA, 14 bp, Homo sapiens
aagccgtggcttcc

SEQ ID NO: 1745140 - DNA, 12 bp, Homo sapiens
aagcctaaagat

SEQ ID NO: 1745141 - DNA, 17 bp, Homo sapiens
aagcctaagggatcctg

SEQ ID NO: 1745142 - DNA, 22 bp, Homo sapiens
aagcctaagggatcctgcctgc

SEQ ID NO: 1745143 - DNA, 22 bp, Homo sapiens
aagcctaatcacagtttttcct

SEQ ID NO: 1745144 - DNA, 20 bp, Homo sapiens
aagcctagacaacctttctg

SEQ ID NO: 1745145 - DNA, 16 bp, Homo sapiens
aagcctaggccgccct

SEQ ID NO: 1745146 - DNA, 22 bp, Homo sapiens
aagcctcaaagagagaaagttt

SEQ ID NO: 1745147 - DNA, 23 bp, Homo sapiens
aagcctcacgtatttcacagagc

SEQ ID NO: 1745148 - DNA, 13 bp, Homo sapiens
aagcctccaaggg

SEQ ID NO: 1745149 - DNA, 20 bp, Homo sapiens
aagcctccacaccagctgct

SEQ ID NO: 1745150 - DNA, 22 bp, Homo sapiens
aagcctccacaccagctgctgc

SEQ ID NO: 1745151 - DNA, 12 bp, Homo sapiens
aagcctccacag

SEQ ID NO: 1745152 - DNA, 13 bp, Homo sapiens
aagcctccacagc

SEQ ID NO: 1745153 - DNA, 19 bp, Homo sapiens
aagcctccatttagttctt

SEQ ID NO: 1745154 - DNA, 20 bp, Homo sapiens
aagcctccatttagttcttt

SEQ ID NO: 1745155 - DNA, 22 bp, Homo sapiens
aagcctccatttagttctttgt

SEQ ID NO: 1745156 - DNA, 16 bp, Homo sapiens
aagcctccgctgggct

SEQ ID NO: 1745157 - DNA, 17 bp, Homo sapiens
aagcctccgctgggctt

SEQ ID NO: 1745158 - DNA, 18 bp, Homo sapiens
aagcctccgctgggcttc

SEQ ID NO: 1745159 - DNA, 14 bp, Homo sapiens
aagcctctctcctt

SEQ ID NO: 1745160 - DNA, 12 bp, Homo sapiens
aagcctctctct

SEQ ID NO: 1745161 - DNA, 15 bp, Homo sapiens
aagcctctctctccc

SEQ ID NO: 1745162 - DNA, 12 bp, Homo sapiens
aagcctctgtcc

SEQ ID NO: 1745163 - DNA, 21 bp, Homo sapiens
aagcctcttattccaggagaa

SEQ ID NO: 1745164 - DNA, 15 bp, Homo sapiens
aagcctgaactattt

SEQ ID NO: 1745165 - DNA, 16 bp, Homo sapiens
aagcctgaactattta

SEQ ID NO: 1745166 - DNA, 23 bp, Homo sapiens
aagcctgaactgaggccttgtgt

SEQ ID NO: 1745167 - DNA, 15 bp, Homo sapiens
aagcctgcaggagaa

SEQ ID NO: 1745168 - DNA, 14 bp, Homo sapiens
aagcctgcaggagt

SEQ ID NO: 1745169 - DNA, 15 bp, Homo sapiens
aagcctgcctcccaa

SEQ ID NO: 1745170 - DNA, 22 bp, Homo sapiens
aagcctgctggctgcggccccc

SEQ ID NO: 1745171 - DNA, 12 bp, Homo sapiens
aagcctggccta

SEQ ID NO: 1745172 - DNA, 17 bp, Homo sapiens
aagcctgggattgacag

SEQ ID NO: 1745173 - DNA, 17 bp, Homo sapiens
aagcctgtaacactcct

SEQ ID NO: 1745174 - DNA, 21 bp, Homo sapiens
aagcctgtaacactcctctgc

SEQ ID NO: 1745175 - DNA, 18 bp, Homo sapiens
aagccttaatttgcacag

SEQ ID NO: 1745176 - DNA, 15 bp, Homo sapiens
aagccttacaaaggg

SEQ ID NO: 1745177 - DNA, 14 bp, Homo sapiens
aagccttagggaag

SEQ ID NO: 1745178 - DNA, 13 bp, Homo sapiens
aagccttcaaaac

SEQ ID NO: 1745179 - DNA, 17 bp, Homo sapiens
aagccttcagctccagg

SEQ ID NO: 1745180 - DNA, 17 bp, Homo sapiens
aagcctttatggctgct

SEQ ID NO: 1745181 - DNA, 17 bp, Homo sapiens
aagcgaagatgatttca

SEQ ID NO: 1745182 - DNA, 22 bp, Homo sapiens
aagcgaagatgatttcagttca

SEQ ID NO: 1745183 - DNA, 18 bp, Homo sapiens
aagcgaggtcaacagaga

SEQ ID NO: 1745184 - DNA, 20 bp, Homo sapiens
aagcgatgaatttggagact

SEQ ID NO: 1745185 - DNA, 23 bp, Homo sapiens
aagcgattctcctgtctcagcct

SEQ ID NO: 1745186 - DNA, 17 bp, Homo sapiens
aagcgatttgaaacact

SEQ ID NO: 1745187 - DNA, 15 bp, Homo sapiens
aagcgcccacccagg

SEQ ID NO: 1745188 - DNA, 18 bp, Homo sapiens
aagcgcccctcactcctg

SEQ ID NO: 1745189 - DNA, 15 bp, Homo sapiens
aagcggagagagcca

SEQ ID NO: 1745190 - DNA, 16 bp, Homo sapiens
aagcggagagagccaa

SEQ ID NO: 1745191 - DNA, 21 bp, Homo sapiens
aagcggagttcctaacaggat

SEQ ID NO: 1745192 - DNA, 21 bp, Homo sapiens
aagcggccctaagggagtgtc

SEQ ID NO: 1745193 - DNA, 14 bp, Homo sapiens
aagcgtatttaatg

SEQ ID NO: 1745194 - DNA, 19 bp, Homo sapiens
aagcgttcctggccttctg

SEQ ID NO: 1745195 - DNA, 13 bp, Homo sapiens
aagctaaaatgtt

SEQ ID NO: 1745196 - DNA, 15 bp, Homo sapiens
aagctaaattacata

SEQ ID NO: 1745197 - DNA, 18 bp, Homo sapiens
aagctaataattcttcac

SEQ ID NO: 1745198 - DNA, 23 bp, Homo sapiens
aagctaattgtactaatctgaga

SEQ ID NO: 1745199 - DNA, 17 bp, Homo sapiens
aagctacaatctgttca

SEQ ID NO: 1745200 - DNA, 18 bp, Homo sapiens
aagctagacacatgaagg

SEQ ID NO: 1745201 - DNA, 20 bp, Homo sapiens
aagctaggccccagaggccc

SEQ ID NO: 1745202 - DNA, 23 bp, Homo sapiens
aagctaggccccagaggccctgg

SEQ ID NO: 1745203 - DNA, 19 bp, Homo sapiens
aagctagtggcttcaaaat

SEQ ID NO: 1745204 - DNA, 20 bp, Homo sapiens
aagctagtgtacctcctctc

SEQ ID NO: 1745205 - DNA, 21 bp, Homo sapiens
aagctagtgtacctcctctca

SEQ ID NO: 1745206 - DNA, 17 bp, Homo sapiens
aagctatattagctgaa

SEQ ID NO: 1745207 - DNA, 20 bp, Homo sapiens
aagctatattagctgaaaca

SEQ ID NO: 1745208 - DNA, 21 bp, Homo sapiens
aagctatattagctgaaacaa

SEQ ID NO: 1745209 - DNA, 13 bp, Homo sapiens
aagctatttaaag

SEQ ID NO: 1745210 - DNA, 18 bp, Homo sapiens
aagctatttatgggcccc

SEQ ID NO: 1745211 - DNA, 22 bp, Homo sapiens
aagctatttatgggcccctggc

SEQ ID NO: 1745212 - DNA, 22 bp, Homo sapiens
aagctcaaaggtttggaaggag

SEQ ID NO: 1745213 - DNA, 19 bp, Homo sapiens
aagctcacagttcctcgcc

SEQ ID NO: 1745214 - DNA, 20 bp, Homo sapiens
aagctcacagttcctcgccc

SEQ ID NO: 1745215 - DNA, 17 bp, Homo sapiens
aagctcacgtcctgaga

SEQ ID NO: 1745216 - DNA, 14 bp, Homo sapiens
aagctcagaataga

SEQ ID NO: 1745217 - DNA, 23 bp, Homo sapiens
aagctcaggagggtgacgcccag

SEQ ID NO: 1745218 - DNA, 19 bp, Homo sapiens
aagctcatctatttggaac

SEQ ID NO: 1745219 - DNA, 23 bp, Homo sapiens
aagctcatggctgtgtccactgc

SEQ ID NO: 1745220 - DNA, 21 bp, Homo sapiens
aagctccacggtgcgtggctg

SEQ ID NO: 1745221 - DNA, 18 bp, Homo sapiens
aagctcctctccccagcc

SEQ ID NO: 1745222 - DNA, 19 bp, Homo sapiens
aagctcctctccccagccc

SEQ ID NO: 1745223 - DNA, 22 bp, Homo sapiens
aagctcctctccccagcccaga

SEQ ID NO: 1745224 - DNA, 14 bp, Homo sapiens
aagctcctgctact

SEQ ID NO: 1745225 - DNA, 19 bp, Homo sapiens
aagctcctggtcttgagat

SEQ ID NO: 1745226 - DNA, 14 bp, Homo sapiens
aagctccttccaga

SEQ ID NO: 1745227 - DNA, 22 bp, Homo sapiens
aagctctcagcaagtgcccagt

SEQ ID NO: 1745228 - DNA, 20 bp, Homo sapiens
aagctctccgagctctggtg

SEQ ID NO: 1745229 - DNA, 23 bp, Homo sapiens
aagctctggctgaaccctgtgct

SEQ ID NO: 1745230 - DNA, 16 bp, Homo sapiens
aagctctttgagaact

SEQ ID NO: 1745231 - DNA, 13 bp, Homo sapiens
aagctgaaatttt

SEQ ID NO: 1745232 - DNA, 17 bp, Homo sapiens
aagctgaagaggttgaa

SEQ ID NO: 1745233 - DNA, 23 bp, Homo sapiens
aagctgaagaggttgaagctaaa

SEQ ID NO: 1745234 - DNA, 17 bp, Homo sapiens
aaggccaaaatcaagag

SEQ ID NO: 1745235 - DNA, 19 bp, Homo sapiens
aaggccacctctgcctcta

SEQ ID NO: 1745236 - DNA, 23 bp, Homo sapiens
aaggccagagtggcctggccagg

SEQ ID NO: 1745237 - DNA, 20 bp, Homo sapiens
aaggccaggacgggccacac

SEQ ID NO: 1745238 - DNA, 11 bp, Homo sapiens
aaggccagggc

SEQ ID NO: 1745239 - DNA, 15 bp, Homo sapiens
aaggcccactgtaat

SEQ ID NO: 1745240 - DNA, 12 bp, Homo sapiens
aaggccccttcc

SEQ ID NO: 1745241 - DNA, 22 bp, Homo sapiens
aaggccctgctttttttcttaa

SEQ ID NO: 1745242 - DNA, 19 bp, Homo sapiens
aaggccgaagctctggctg

SEQ ID NO: 1745243 - DNA, 14 bp, Homo sapiens
aaggccgctgcccc

SEQ ID NO: 1745244 - DNA, 20 bp, Homo sapiens
aaggccgctgccccagcccc

SEQ ID NO: 1745245 - DNA, 22 bp, Homo sapiens
aaggccgctgttcacccacagg

SEQ ID NO: 1745246 - DNA, 22 bp, Homo sapiens
aaggccggcagcgggcggaggg

SEQ ID NO: 1745247 - DNA, 19 bp, Homo sapiens
aaggcctccctagccagca

SEQ ID NO: 1745248 - DNA, 15 bp, Homo sapiens
aaggcctctctctgc

SEQ ID NO: 1745249 - DNA, 14 bp, Homo sapiens
aaggcctctggact

SEQ ID NO: 1745250 - DNA, 13 bp, Homo sapiens
aaggcctgaatca

SEQ ID NO: 1745251 - DNA, 20 bp, Homo sapiens
aaggcctgtggggagccgag

SEQ ID NO: 1745252 - DNA, 15 bp, Homo sapiens
aaggccttaatatgt

SEQ ID NO: 1745253 - DNA, 21 bp, Homo sapiens
aaggccttcagtttatttcca

SEQ ID NO: 1745254 - DNA, 16 bp, Homo sapiens
aaggccttgcctggcc

SEQ ID NO: 1745255 - DNA, 19 bp, Homo sapiens
aaggccttgcctggcctga

SEQ ID NO: 1745256 - DNA, 23 bp, Homo sapiens
aaggccttggtggagcagccaga

SEQ ID NO: 1745257 - DNA, 16 bp, Homo sapiens
aaggcctttcttctgt

SEQ ID NO: 1745258 - DNA, 18 bp, Homo sapiens
aaggcgggagcatctctt

SEQ ID NO: 1745259 - DNA, 21 bp, Homo sapiens
aaggcggggtattcccactca

SEQ ID NO: 1745260 - DNA, 15 bp, Homo sapiens
aaggcgggtggatca

SEQ ID NO: 1745261 - DNA, 13 bp, Homo sapiens
aaggctaaaaagt

SEQ ID NO: 1745262 - DNA, 16 bp, Homo sapiens
aaggctaaaacttaac

SEQ ID NO: 1745263 - DNA, 15 bp, Homo sapiens
aaggctatacttgtc

SEQ ID NO: 1745264 - DNA, 21 bp, Homo sapiens
aaggctcagaaggaatggtgc

SEQ ID NO: 1745265 - DNA, 14 bp, Homo sapiens
aaggctcatttaaa

SEQ ID NO: 1745266 - DNA, 15 bp, Homo sapiens
aaggctcatttaaaa

SEQ ID NO: 1745267 - DNA, 11 bp, Homo sapiens
aaggctctaga

SEQ ID NO: 1745268 - DNA, 14 bp, Homo sapiens
aaggctctcacccc

SEQ ID NO: 1745269 - DNA, 13 bp, Homo sapiens
aaggctctgagag

SEQ ID NO: 1745270 - DNA, 14 bp, Homo sapiens
aaggctctgagagt

SEQ ID NO: 1745271 - DNA, 20 bp, Homo sapiens
aaggctctgagagtctagat

SEQ ID NO: 1745272 - DNA, 16 bp, Homo sapiens
aaggctctgtgccttg

SEQ ID NO: 1745273 - DNA, 23 bp, Homo sapiens
aaggctctgtgccttggtctctc

SEQ ID NO: 1745274 - DNA, 17 bp, Homo sapiens
aaggctgaactcttcag

SEQ ID NO: 1745275 - DNA, 19 bp, Homo sapiens
aaggctgaccaagagagaa

SEQ ID NO: 1745276 - DNA, 16 bp, Homo sapiens
aaggctggctgggcat

SEQ ID NO: 1745277 - DNA, 16 bp, Homo sapiens
aaggctggggtcttgg

SEQ ID NO: 1745278 - DNA, 12 bp, Homo sapiens
aaggcttgcagt

SEQ ID NO: 1745279 - DNA, 15 bp, Homo sapiens
aaggctttatctcag

SEQ ID NO: 1745280 - DNA, 13 bp, Homo sapiens
aagggaaaaatca

SEQ ID NO: 1745281 - DNA, 20 bp, Homo sapiens
aagggaaaaatcaagtatta

SEQ ID NO: 1745282 - DNA, 17 bp, Homo sapiens
aagggaaactgggaaac

SEQ ID NO: 1745283 - DNA, 14 bp, Homo sapiens
aagggaaagcctct

SEQ ID NO: 1745284 - DNA, 18 bp, Homo sapiens
aagggaaagcctctggcc

SEQ ID NO: 1745285 - DNA, 16 bp, Homo sapiens
aagggaaaggcaagct

SEQ ID NO: 1745286 - DNA, 15 bp, Homo sapiens
aagggaaagtttttt

SEQ ID NO: 1745287 - DNA, 15 bp, Homo sapiens
aagggaaatatcatt

SEQ ID NO: 1745288 - DNA, 21 bp, Homo sapiens
aagggaactagataacatact

SEQ ID NO: 1745289 - DNA, 12 bp, Homo sapiens
aagggaagtggg

SEQ ID NO: 1745290 - DNA, 14 bp, Homo sapiens
aagggaagtgggga

SEQ ID NO: 1745291 - DNA, 21 bp, Homo sapiens
aagggaatagaaatgtttgct

SEQ ID NO: 1745292 - DNA, 13 bp, Homo sapiens
aagggacagccca

SEQ ID NO: 1745293 - DNA, 13 bp, Homo sapiens
aagggaccccccc

SEQ ID NO: 1745294 - DNA, 18 bp, Homo sapiens
aagggacttaacttgttt

SEQ ID NO: 1745295 - DNA, 18 bp, Homo sapiens
aagggagaaaagagaaac

SEQ ID NO: 1745296 - DNA, 16 bp, Homo sapiens
aagggagaagaaaggt

SEQ ID NO: 1745297 - DNA, 20 bp, Homo sapiens
aagggagaataaaattccta

SEQ ID NO: 1745298 - DNA, 19 bp, Homo sapiens
aagggagagaaaagctgga

SEQ ID NO: 1745299 - DNA, 20 bp, Homo sapiens
aagggagagaaaagctggac

SEQ ID NO: 1745300 - DNA, 14 bp, Homo sapiens
aagggagagctgag

SEQ ID NO: 1745301 - DNA, 22 bp, Homo sapiens
aagggagagggcctctgcctgg

SEQ ID NO: 1745302 - DNA, 17 bp, Homo sapiens
aagggagcagaactgaa

SEQ ID NO: 1745303 - DNA, 14 bp, Homo sapiens
aagggagcccctcc

SEQ ID NO: 1745304 - DNA, 21 bp, Homo sapiens
aagggaggaaggcctttcttc

SEQ ID NO: 1745305 - DNA, 13 bp, Homo sapiens
aagggaggcagtg

SEQ ID NO: 1745306 - DNA, 18 bp, Homo sapiens
aagggagggtgcagccct

SEQ ID NO: 1745307 - DNA, 16 bp, Homo sapiens
aagggagtaggctgta

SEQ ID NO: 1745308 - DNA, 14 bp, Homo sapiens
aagggatccctaac

SEQ ID NO: 1745309 - DNA, 16 bp, Homo sapiens
aagggatcctgcctgc

SEQ ID NO: 1745310 - DNA, 16 bp, Homo sapiens
aagggatctgagaaca

SEQ ID NO: 1745311 - DNA, 22 bp, Homo sapiens
aagggatggacttgtgattggc

SEQ ID NO: 1745312 - DNA, 17 bp, Homo sapiens
aagggatggcaagatgt

SEQ ID NO: 1745313 - DNA, 14 bp, Homo sapiens
aagggattctggga

SEQ ID NO: 1745314 - DNA, 22 bp, Homo sapiens
aagggattgaggagttgcctga

SEQ ID NO: 1745315 - DNA, 16 bp, Homo sapiens
aagggcacattgccca

SEQ ID NO: 1745316 - DNA, 14 bp, Homo sapiens
aagggcactcccaa

SEQ ID NO: 1745317 - DNA, 19 bp, Homo sapiens
aagggcagagaatggctgg

SEQ ID NO: 1745318 - DNA, 15 bp, Homo sapiens
aagggcagccctcca

SEQ ID NO: 1745319 - DNA, 22 bp, Homo sapiens
aagggcagggcatctcctgtgc

SEQ ID NO: 1745320 - DNA, 16 bp, Homo sapiens
aagggcagggcccacg

SEQ ID NO: 1745321 - DNA, 22 bp, Homo sapiens
aagggcagggcccacgtgtata

SEQ ID NO: 1745322 - DNA, 11 bp, Homo sapiens
aagggcagtgc

SEQ ID NO: 1745323 - DNA, 16 bp, Homo sapiens
aagggcatcaggcact

SEQ ID NO: 1745324 - DNA, 19 bp, Homo sapiens
aagggcatgcacgggcatg

SEQ ID NO: 1745325 - DNA, 17 bp, Homo sapiens
aagggccagaaaaattt

SEQ ID NO: 1745326 - DNA, 14 bp, Homo sapiens
aagggccagagcca

SEQ ID NO: 1745327 - DNA, 22 bp, Homo sapiens
aagggccagtcctgcctggcca

SEQ ID NO: 1745328 - DNA, 18 bp, Homo sapiens
aagggccagtctgggctg

SEQ ID NO: 1745329 - DNA, 16 bp, Homo sapiens
aagggcccacacctgg

SEQ ID NO: 1745330 - DNA, 19 bp, Homo sapiens
aagggcccacacctggtgg

SEQ ID NO: 1745331 - DNA, 15 bp, Homo sapiens
aagggcccagaccct

SEQ ID NO: 1745332 - DNA, 12 bp, Homo sapiens
aagggccccagg

SEQ ID NO: 1745333 - DNA, 16 bp, Homo sapiens
aagggccctggcaccc

SEQ ID NO: 1745334 - DNA, 18 bp, Homo sapiens
aagggcccttctctactg

SEQ ID NO: 1745335 - DNA, 20 bp, Homo sapiens
aagggccggggatggatctt

SEQ ID NO: 1745336 - DNA, 21 bp, Homo sapiens
aagggcctcctcacccaccct

SEQ ID NO: 1745337 - DNA, 23 bp, Homo sapiens
aagggcctcctcacccaccctgt

SEQ ID NO: 1745338 - DNA, 14 bp, Homo sapiens
aagggcctggccag

SEQ ID NO: 1745339 - DNA, 17 bp, Homo sapiens
aagggcctggccagtcc

SEQ ID NO: 1745340 - DNA, 20 bp, Homo sapiens
aagggcctggccagtcctgg

SEQ ID NO: 1745341 - DNA, 15 bp, Homo sapiens
aagggcggaagagtt

SEQ ID NO: 1745342 - DNA, 16 bp, Homo sapiens
aagggcggaagagtta

SEQ ID NO: 1745343 - DNA, 17 bp, Homo sapiens
aagggcggaagagttac

SEQ ID NO: 1745344 - DNA, 17 bp, Homo sapiens
aagggctgacctgcctc

SEQ ID NO: 1745345 - DNA, 20 bp, Homo sapiens
aagggctgcatgatgtttgc

SEQ ID NO: 1745346 - DNA, 15 bp, Homo sapiens
aagggcttactattt

SEQ ID NO: 1745347 - DNA, 17 bp, Homo sapiens
aagggcttctgcaccct

SEQ ID NO: 1745348 - DNA, 18 bp, Homo sapiens
aagggcttctgcaccctc

SEQ ID NO: 1745349 - DNA, 13 bp, Homo sapiens
aagtcatcttgct

SEQ ID NO: 1745350 - DNA, 23 bp, Homo sapiens
aagtcatcttgctaccagtattt

SEQ ID NO: 1745351 - DNA, 23 bp, Homo sapiens
aagtcatgaagcccaagtgaaat

SEQ ID NO: 1745352 - DNA, 20 bp, Homo sapiens
aagtcatggcaggtacagta

SEQ ID NO: 1745353 - DNA, 16 bp, Homo sapiens
aagtcattttaacttt

SEQ ID NO: 1745354 - DNA, 18 bp, Homo sapiens
aagtcattttaactttat

SEQ ID NO: 1745355 - DNA, 20 bp, Homo sapiens
aagtcattttaactttatca

SEQ ID NO: 1745356 - DNA, 22 bp, Homo sapiens
aagtcattttaactttatcaca

SEQ ID NO: 1745357 - DNA, 17 bp, Homo sapiens
aagtcatttttgtattt

SEQ ID NO: 1745358 - DNA, 12 bp, Homo sapiens
aagtccaaagtc

SEQ ID NO: 1745359 - DNA, 23 bp, Homo sapiens
aagtccattatgtaatagtgaca

SEQ ID NO: 1745360 - DNA, 20 bp, Homo sapiens
aagtcccaccctcttcccat

SEQ ID NO: 1745361 - DNA, 21 bp, Homo sapiens
aagtccccttctgtgtttctg

SEQ ID NO: 1745362 - DNA, 21 bp, Homo sapiens
aagtccctgttttctgagccc

SEQ ID NO: 1745363 - DNA, 21 bp, Homo sapiens
aagtcccttcagactggccct

SEQ ID NO: 1745364 - DNA, 18 bp, Homo sapiens
aagtcctccctcctgcag

SEQ ID NO: 1745365 - DNA, 22 bp, Homo sapiens
aagtcctccctcctgcaggctg

SEQ ID NO: 1745366 - DNA, 11 bp, Homo sapiens
aagtcctctgc

SEQ ID NO: 1745367 - DNA, 12 bp, Homo sapiens
aagtcctctgct

SEQ ID NO: 1745368 - DNA, 19 bp, Homo sapiens
aagtcctggctacatccca

SEQ ID NO: 1745369 - DNA, 17 bp, Homo sapiens
aagtccttccacctgcc

SEQ ID NO: 1745370 - DNA, 14 bp, Homo sapiens
aagtcgaggctgca

SEQ ID NO: 1745371 - DNA, 18 bp, Homo sapiens
aagtcgggtcaaaaataa

SEQ ID NO: 1745372 - DNA, 15 bp, Homo sapiens
aagtctaatgaagag

SEQ ID NO: 1745373 - DNA, 14 bp, Homo sapiens
aagtctattttatt

SEQ ID NO: 1745374 - DNA, 21 bp, Homo sapiens
aagtctcacccattatctgga

SEQ ID NO: 1745375 - DNA, 21 bp, Homo sapiens
aagtctcactggctgtcagta

SEQ ID NO: 1745376 - DNA, 13 bp, Homo sapiens
aagtctcagaaga

SEQ ID NO: 1745377 - DNA, 15 bp, Homo sapiens
aagtctcagaagagg

SEQ ID NO: 1745378 - DNA, 12 bp, Homo sapiens
aagtctcagcta

SEQ ID NO: 1745379 - DNA, 21 bp, Homo sapiens
aagtctcataggttaaaaaaa

SEQ ID NO: 1745380 - DNA, 20 bp, Homo sapiens
aagtctcattcgcctttgtc

SEQ ID NO: 1745381 - DNA, 12 bp, Homo sapiens
aagtctccagcc

SEQ ID NO: 1745382 - DNA, 15 bp, Homo sapiens
aagtctccctgcaca

SEQ ID NO: 1745383 - DNA, 13 bp, Homo sapiens
aagtctcctgtct

SEQ ID NO: 1745384 - DNA, 23 bp, Homo sapiens
aagtctcctgtcttatggtccag

SEQ ID NO: 1745385 - DNA, 15 bp, Homo sapiens
aagtctgatccatat

SEQ ID NO: 1745386 - DNA, 20 bp, Homo sapiens
aagtctggaaaaaaacaaaa

SEQ ID NO: 1745387 - DNA, 16 bp, Homo sapiens
aagtcttagatgtata

SEQ ID NO: 1745388 - DNA, 14 bp, Homo sapiens
aagtcttccttaaa

SEQ ID NO: 1745389 - DNA, 20 bp, Homo sapiens
aagtcttggttttatcttaa

SEQ ID NO: 1745390 - DNA, 18 bp, Homo sapiens
aagtctttaataaataac

SEQ ID NO: 1745391 - DNA, 15 bp, Homo sapiens
aagtcttttctgtca

SEQ ID NO: 1745392 - DNA, 22 bp, Homo sapiens
aagtcttttctgtcaccaaatt

SEQ ID NO: 1745393 - DNA, 15 bp, Homo sapiens
aagtcttttttttcc

SEQ ID NO: 1745394 - DNA, 14 bp, Homo sapiens
aagtgaaaatggtc

SEQ ID NO: 1745395 - DNA, 16 bp, Homo sapiens
aagtgaaatcaaaggt

SEQ ID NO: 1745396 - DNA, 13 bp, Homo sapiens
aagtgaaattaag

SEQ ID NO: 1745397 - DNA, 18 bp, Homo sapiens
aagtgaaattaagcattt

SEQ ID NO: 1745398 - DNA, 16 bp, Homo sapiens
aagtgaacactagcca

SEQ ID NO: 1745399 - DNA, 11 bp, Homo sapiens
aagtgaagaat

SEQ ID NO: 1745400 - DNA, 18 bp, Homo sapiens
aagtgaatctgattgcac

SEQ ID NO: 1745401 - DNA, 15 bp, Homo sapiens
aagtgaattgaagtt

SEQ ID NO: 1745402 - DNA, 16 bp, Homo sapiens
aagtgaattgaagttt

SEQ ID NO: 1745403 - DNA, 21 bp, Homo sapiens
aagtgaattgaagtttcaagt

SEQ ID NO: 1745404 - DNA, 17 bp, Homo sapiens
aagtgaatttgaatact

SEQ ID NO: 1745405 - DNA, 17 bp, Homo sapiens
aagtgaatttttctcta

SEQ ID NO: 1745406 - DNA, 13 bp, Homo sapiens
aagtgacacagac

SEQ ID NO: 1745407 - DNA, 19 bp, Homo sapiens
aagtgacacattaatgata

SEQ ID NO: 1745408 - DNA, 13 bp, Homo sapiens
aagtgacaccaat

SEQ ID NO: 1745409 - DNA, 20 bp, Homo sapiens
aagtgacaccaataaatgtt

SEQ ID NO: 1745410 - DNA, 18 bp, Homo sapiens
aagtgaccatcatttcac

SEQ ID NO: 1745411 - DNA, 16 bp, Homo sapiens
aagtgactgtatctgt

SEQ ID NO: 1745412 - DNA, 18 bp, Homo sapiens
aagtgactgtatctgtgt

SEQ ID NO: 1745413 - DNA, 15 bp, Homo sapiens
aagtgagaagatggt

SEQ ID NO: 1745414 - DNA, 15 bp, Homo sapiens
aagtgagcagaacag

SEQ ID NO: 1745415 - DNA, 17 bp, Homo sapiens
aagtgagcagaacaggt

SEQ ID NO: 1745416 - DNA, 15 bp, Homo sapiens
aagtgagcagtgttg

SEQ ID NO: 1745417 - DNA, 17 bp, Homo sapiens
aagtgagctttgctgct

SEQ ID NO: 1745418 - DNA, 21 bp, Homo sapiens
aagtgagctttgctgctacag

SEQ ID NO: 1745419 - DNA, 13 bp, Homo sapiens
aagtgaggcccaa

SEQ ID NO: 1745420 - DNA, 19 bp, Homo sapiens
aagtgaggcccaaggagct

SEQ ID NO: 1745421 - DNA, 20 bp, Homo sapiens
aagtgaggcccaaggagctt

SEQ ID NO: 1745422 - DNA, 21 bp, Homo sapiens
aagtgagggctcactcagcca

SEQ ID NO: 1745423 - DNA, 16 bp, Homo sapiens
aagtgagtttgtaaat

SEQ ID NO: 1745424 - DNA, 13 bp, Homo sapiens
aagtgataagtgc

SEQ ID NO: 1745425 - DNA, 22 bp, Homo sapiens
aagtgatatggtgaagggaagt

SEQ ID NO: 1745426 - DNA, 21 bp, Homo sapiens
aagtgatcaaactacatattg

SEQ ID NO: 1745427 - DNA, 14 bp, Homo sapiens
aagtgatcaataaa

SEQ ID NO: 1745428 - DNA, 18 bp, Homo sapiens
aagtgatccttccacctc

SEQ ID NO: 1745429 - DNA, 20 bp, Homo sapiens
aagtgatccttccacctcag

SEQ ID NO: 1745430 - DNA, 23 bp, Homo sapiens
aagtgatctaaaatttgtaatat

SEQ ID NO: 1745431 - DNA, 22 bp, Homo sapiens
aagtgatctacatgaggaactg

SEQ ID NO: 1745432 - DNA, 21 bp, Homo sapiens
aagtgattaaacgtgcagact

SEQ ID NO: 1745433 - DNA, 17 bp, Homo sapiens
aagtgattatctctttg

SEQ ID NO: 1745434 - DNA, 21 bp, Homo sapiens
aagtgattctcctgcctcagc

SEQ ID NO: 1745435 - DNA, 16 bp, Homo sapiens
aagtgcactttctaat

SEQ ID NO: 1745436 - DNA, 14 bp, Homo sapiens
aagtgccagaggtg

SEQ ID NO: 1745437 - DNA, 20 bp, Homo sapiens
aagtgccagaggtgggcagg

SEQ ID NO: 1745438 - DNA, 18 bp, Homo sapiens
aagtgcccacatttgatg

SEQ ID NO: 1745439 - DNA, 19 bp, Homo sapiens
aagtgcccagcccctgccc

SEQ ID NO: 1745440 - DNA, 18 bp, Homo sapiens
aagtgcctagactgttac

SEQ ID NO: 1745441 - DNA, 14 bp, Homo sapiens
aagtgcctgagctg

SEQ ID NO: 1745442 - DNA, 19 bp, Homo sapiens
aagtgccttggatgagaag

SEQ ID NO: 1745443 - DNA, 14 bp, Homo sapiens
aagtgcgctttgca

SEQ ID NO: 1745444 - DNA, 18 bp, Homo sapiens
aagtgcgtggtataatct

SEQ ID NO: 1745445 - DNA, 16 bp, Homo sapiens
aagtgctaaggttcta

SEQ ID NO: 1745446 - DNA, 14 bp, Homo sapiens
aagtgctcagtgaa

SEQ ID NO: 1745447 - DNA, 12 bp, Homo sapiens
aagtgctccctg

SEQ ID NO: 1745448 - DNA, 14 bp, Homo sapiens
aagtgctgagatta

SEQ ID NO: 1745449 - DNA, 11 bp, Homo sapiens
aagtgctggga

SEQ ID NO: 1745450 - DNA, 12 bp, Homo sapiens
aagtgctgggat

SEQ ID NO: 1745451 - DNA, 22 bp, Homo sapiens
aagtgctgtacccttccacctc

SEQ ID NO: 1745452 - DNA, 17 bp, Homo sapiens
aagtgctgtttattaat

SEQ ID NO: 1745453 - DNA, 18 bp, Homo sapiens
aagtgctgtttattaatc

SEQ ID NO: 1745454 - DNA, 21 bp, Homo sapiens
aagtgctgtttattaatctta

SEQ ID NO: 1745455 - DNA, 19 bp, Homo sapiens
aagtgcttattacatttta

SEQ ID NO: 1745456 - DNA, 17 bp, Homo sapiens
aagtggagctgggaggt

SEQ ID NO: 1745457 - DNA, 13 bp, Homo sapiens
aagtggatgggaa

SEQ ID NO: 1745458 - DNA, 21 bp, Homo sapiens
aagtggatgggaatttgtcag

SEQ ID NO: 1745459 - DNA, 16 bp, Homo sapiens
aagtggattggctttg

SEQ ID NO: 1745460 - DNA, 17 bp, Homo sapiens
aagtggcatgtgctgtg

SEQ ID NO: 1745461 - DNA, 20 bp, Homo sapiens
aagtggcgtgggagccagcc

SEQ ID NO: 1745462 - DNA, 14 bp, Homo sapiens
aagtggctgctgac

SEQ ID NO: 1745463 - DNA, 17 bp, Homo sapiens
aagtggctggtagaaaa

SEQ ID NO: 1745464 - DNA, 15 bp, Homo sapiens
aataaattttaaaaa

SEQ ID NO: 1745465 - DNA, 14 bp, Homo sapiens
aataaattttgttt

SEQ ID NO: 1745466 - DNA, 19 bp, Homo sapiens
aataacaactaacttgttt

SEQ ID NO: 1745467 - DNA, 21 bp, Homo sapiens
aataacactgcagccctctcc

SEQ ID NO: 1745468 - DNA, 22 bp, Homo sapiens
aataacactgtattttaatgta

SEQ ID NO: 1745469 - DNA, 21 bp, Homo sapiens
aataacaggcatttgttcact

SEQ ID NO: 1745470 - DNA, 18 bp, Homo sapiens
aataacatatctaaagtc

SEQ ID NO: 1745471 - DNA, 14 bp, Homo sapiens
aataacatattctt

SEQ ID NO: 1745472 - DNA, 15 bp, Homo sapiens
aataacatctgaaaa

SEQ ID NO: 1745473 - DNA, 19 bp, Homo sapiens
aataacatctgaaaagaaa

SEQ ID NO: 1745474 - DNA, 12 bp, Homo sapiens
aataacatgtaa

SEQ ID NO: 1745475 - DNA, 18 bp, Homo sapiens
aataacccataattgaag

SEQ ID NO: 1745476 - DNA, 16 bp, Homo sapiens
aataaccgcttggttt

SEQ ID NO: 1745477 - DNA, 21 bp, Homo sapiens
aataactaatgctaagaaatg

SEQ ID NO: 1745478 - DNA, 19 bp, Homo sapiens
aataactctgtggcattat

SEQ ID NO: 1745479 - DNA, 15 bp, Homo sapiens
aataactgaatttgg

SEQ ID NO: 1745480 - DNA, 21 bp, Homo sapiens
aataactgattagtaagtctt

SEQ ID NO: 1745481 - DNA, 15 bp, Homo sapiens
aataactgtaattat

SEQ ID NO: 1745482 - DNA, 22 bp, Homo sapiens
aataactgtaattatttgaatg

SEQ ID NO: 1745483 - DNA, 12 bp, Homo sapiens
aataactgtgta

SEQ ID NO: 1745484 - DNA, 21 bp, Homo sapiens
aataacttctatattttaata

SEQ ID NO: 1745485 - DNA, 13 bp, Homo sapiens
aataacttgcatc

SEQ ID NO: 1745486 - DNA, 11 bp, Homo sapiens
aataagaaagt

SEQ ID NO: 1745487 - DNA, 13 bp, Homo sapiens
aataagacaagag

SEQ ID NO: 1745488 - DNA, 20 bp, Homo sapiens
aataagacaagagatctaca

SEQ ID NO: 1745489 - DNA, 14 bp, Homo sapiens
aataagaggacaga

SEQ ID NO: 1745490 - DNA, 14 bp, Homo sapiens
aataagattctaac

SEQ ID NO: 1745491 - DNA, 18 bp, Homo sapiens
aataagcaggtggatcta

SEQ ID NO: 1745492 - DNA, 14 bp, Homo sapiens
aataagctctagtt

SEQ ID NO: 1745493 - DNA, 16 bp, Homo sapiens
aataaggacagcagct

SEQ ID NO: 1745494 - DNA, 15 bp, Homo sapiens
aataaggaggaggag

SEQ ID NO: 1745495 - DNA, 20 bp, Homo sapiens
aataaggaggaggagggaga

SEQ ID NO: 1745496 - DNA, 18 bp, Homo sapiens
aataaggcacccatctgt

SEQ ID NO: 1745497 - DNA, 17 bp, Homo sapiens
aataagtgaagaataca

SEQ ID NO: 1745498 - DNA, 20 bp, Homo sapiens
aataagtgaagaatacatca

SEQ ID NO: 1745499 - DNA, 13 bp, Homo sapiens
aataagttttttt

SEQ ID NO: 1745500 - DNA, 19 bp, Homo sapiens
aataataaagatgctcttt

SEQ ID NO: 1745501 - DNA, 11 bp, Homo sapiens
aataataaatc

SEQ ID NO: 1745502 - DNA, 20 bp, Homo sapiens
aataataagtgatgtgctga

SEQ ID NO: 1745503 - DNA, 11 bp, Homo sapiens
aataataatta

SEQ ID NO: 1745504 - DNA, 21 bp, Homo sapiens
aataataattatccagagttt

SEQ ID NO: 1745505 - DNA, 15 bp, Homo sapiens
aataataccttagaa

SEQ ID NO: 1745506 - DNA, 14 bp, Homo sapiens
aataatagggaaaa

SEQ ID NO: 1745507 - DNA, 12 bp, Homo sapiens
aataatatgcat

SEQ ID NO: 1745508 - DNA, 20 bp, Homo sapiens
aataatcatgtgaaatgttt

SEQ ID NO: 1745509 - DNA, 22 bp, Homo sapiens
aataatgaatggactcaaactg

SEQ ID NO: 1745510 - DNA, 16 bp, Homo sapiens
aataatgagagcaaat

SEQ ID NO: 1745511 - DNA, 16 bp, Homo sapiens
aataatgctttaaaat

SEQ ID NO: 1745512 - DNA, 18 bp, Homo sapiens
aataatggaaaaatagta

SEQ ID NO: 1745513 - DNA, 22 bp, Homo sapiens
aataatggaaaaatagtaaaca

SEQ ID NO: 1745514 - DNA, 21 bp, Homo sapiens
aataatggtcccatccaggca

SEQ ID NO: 1745515 - DNA, 22 bp, Homo sapiens
aataatgtactcacatataaca

SEQ ID NO: 1745516 - DNA, 13 bp, Homo sapiens
aataatgtctctg

SEQ ID NO: 1745517 - DNA, 19 bp, Homo sapiens
aataattacagtgcctaaa

SEQ ID NO: 1745518 - DNA, 22 bp, Homo sapiens
aataattctgagttttgtgttt

SEQ ID NO: 1745519 - DNA, 18 bp, Homo sapiens
aataattgtttccaactt

SEQ ID NO: 1745520 - DNA, 22 bp, Homo sapiens
aataattgtttccaacttgtct

SEQ ID NO: 1745521 - DNA, 20 bp, Homo sapiens
aataatttacaggttcttag

SEQ ID NO: 1745522 - DNA, 22 bp, Homo sapiens
aataatttgaatgtatttgatt

SEQ ID NO: 1745523 - DNA, 16 bp, Homo sapiens
aataattttaaacaaa

SEQ ID NO: 1745524 - DNA, 21 bp, Homo sapiens
aataattttaagaaatcaaag

SEQ ID NO: 1745525 - DNA, 22 bp, Homo sapiens
aataattttccaagtaaagtga

SEQ ID NO: 1745526 - DNA, 22 bp, Homo sapiens
aataatttttacctaatctcca

SEQ ID NO: 1745527 - DNA, 16 bp, Homo sapiens
aatacaaaaatgaata

SEQ ID NO: 1745528 - DNA, 12 bp, Homo sapiens
aatacaaatgga

SEQ ID NO: 1745529 - DNA, 20 bp, Homo sapiens
aatacaaccagcccaaccat

SEQ ID NO: 1745530 - DNA, 13 bp, Homo sapiens
aatacaaggtata

SEQ ID NO: 1745531 - DNA, 11 bp, Homo sapiens
aatacaataaa

SEQ ID NO: 1745532 - DNA, 13 bp, Homo sapiens
aatacaataaact

SEQ ID NO: 1745533 - DNA, 12 bp, Homo sapiens
aatacaatgtac

SEQ ID NO: 1745534 - DNA, 15 bp, Homo sapiens
aatacaatgtacaat

SEQ ID NO: 1745535 - DNA, 16 bp, Homo sapiens
aatacaatgtacaatt

SEQ ID NO: 1745536 - DNA, 16 bp, Homo sapiens
aatacacaaaatcaaa

SEQ ID NO: 1745537 - DNA, 17 bp, Homo sapiens
aatacacaagtaaacat

SEQ ID NO: 1745538 - DNA, 14 bp, Homo sapiens
aatacacagtactt

SEQ ID NO: 1745539 - DNA, 21 bp, Homo sapiens
aatacacagtactttattgta

SEQ ID NO: 1745540 - DNA, 14 bp, Homo sapiens
aatacacatttgct

SEQ ID NO: 1745541 - DNA, 21 bp, Homo sapiens
aatacaccacctcactcctgt

SEQ ID NO: 1745542 - DNA, 22 bp, Homo sapiens
aatacaccgtttagaaaaaaca

SEQ ID NO: 1745543 - DNA, 16 bp, Homo sapiens
aatacactagttgttt

SEQ ID NO: 1745544 - DNA, 19 bp, Homo sapiens
aatacagaaattagccggg

SEQ ID NO: 1745545 - DNA, 21 bp, Homo sapiens
aatacagataattcatttgta

SEQ ID NO: 1745546 - DNA, 15 bp, Homo sapiens
aatacagatcatctt

SEQ ID NO: 1745547 - DNA, 16 bp, Homo sapiens
aatacaggaaacagtt

SEQ ID NO: 1745548 - DNA, 18 bp, Homo sapiens
aatacaggaaacagttgc

SEQ ID NO: 1745549 - DNA, 12 bp, Homo sapiens
aatacaggaaat

SEQ ID NO: 1745550 - DNA, 23 bp, Homo sapiens
aatacagggcatgcattttgcag

SEQ ID NO: 1745551 - DNA, 16 bp, Homo sapiens
aatacagggcattttg

SEQ ID NO: 1745552 - DNA, 21 bp, Homo sapiens
aatacagtaagctgctctatt

SEQ ID NO: 1745553 - DNA, 12 bp, Homo sapiens
aatacagtgtta

SEQ ID NO: 1745554 - DNA, 18 bp, Homo sapiens
aatacagttgttggcctc

SEQ ID NO: 1745555 - DNA, 14 bp, Homo sapiens
aatacatagtgaaa

SEQ ID NO: 1745556 - DNA, 14 bp, Homo sapiens
aatacatattccat

SEQ ID NO: 1745557 - DNA, 13 bp, Homo sapiens
aatacatcagaaa

SEQ ID NO: 1745558 - DNA, 18 bp, Homo sapiens
aatacatcagaaaataaa

SEQ ID NO: 1745559 - DNA, 19 bp, Homo sapiens
aatacattaacggtgctaa

SEQ ID NO: 1745560 - DNA, 13 bp, Homo sapiens
aatacatttgtat

SEQ ID NO: 1745561 - DNA, 15 bp, Homo sapiens
aatacatttgtattt

SEQ ID NO: 1745562 - DNA, 19 bp, Homo sapiens
aataccactggttaaaata

SEQ ID NO: 1745563 - DNA, 20 bp, Homo sapiens
aataccagagccttcaagtg

SEQ ID NO: 1745564 - DNA, 22 bp, Homo sapiens
aataccagagccttcaagtgcc

SEQ ID NO: 1745565 - DNA, 18 bp, Homo sapiens
aataccatgccatttaaa

SEQ ID NO: 1745566 - DNA, 15 bp, Homo sapiens
aataccgctcagtat

SEQ ID NO: 1745567 - DNA, 18 bp, Homo sapiens
aatacctctaataaacac

SEQ ID NO: 1745568 - DNA, 14 bp, Homo sapiens
aatacctctgtgtg

SEQ ID NO: 1745569 - DNA, 13 bp, Homo sapiens
aataccttagaag

SEQ ID NO: 1745570 - DNA, 20 bp, Homo sapiens
aatacgtgatctctgttaca

SEQ ID NO: 1745571 - DNA, 23 bp, Homo sapiens
aatacgtgatctctgttacaaaa

SEQ ID NO: 1745572 - DNA, 18 bp, Homo sapiens
aatacgtgccagatataa

SEQ ID NO: 1745573 - DNA, 18 bp, Homo sapiens
aatactcaccaaaatata

SEQ ID NO: 1745574 - DNA, 22 bp, Homo sapiens
aatactcaccaaaatatagtta

SEQ ID NO: 1745575 - DNA, 16 bp, Homo sapiens
aatactcatttttcat

SEQ ID NO: 1745576 - DNA, 15 bp, Homo sapiens
aatactccagagaca

SEQ ID NO: 1745577 - DNA, 13 bp, Homo sapiens
aatactcttgaaa

SEQ ID NO: 1745578 - DNA, 17 bp, Homo sapiens
aatactcttgaaatgta

SEQ ID NO: 1745579 - DNA, 12 bp, Homo sapiens
aatttaaatgaa

SEQ ID NO: 1745580 - DNA, 16 bp, Homo sapiens
aatttaaatgaaagaa

SEQ ID NO: 1745581 - DNA, 18 bp, Homo sapiens
aatttaaatgaaagaaaa

SEQ ID NO: 1745582 - DNA, 19 bp, Homo sapiens
aatttaaatgaaagaaaat

SEQ ID NO: 1745583 - DNA, 18 bp, Homo sapiens
aatttaactgcatataga

SEQ ID NO: 1745584 - DNA, 16 bp, Homo sapiens
aatttaagcaaacgtc

SEQ ID NO: 1745585 - DNA, 15 bp, Homo sapiens
aatttaagcttaagc

SEQ ID NO: 1745586 - DNA, 21 bp, Homo sapiens
aatttaaggtctgtttgctgt

SEQ ID NO: 1745587 - DNA, 20 bp, Homo sapiens
aatttaagtgacacagacat

SEQ ID NO: 1745588 - DNA, 20 bp, Homo sapiens
aatttaataccagatacctt

SEQ ID NO: 1745589 - DNA, 16 bp, Homo sapiens
aatttaatatactgca

SEQ ID NO: 1745590 - DNA, 22 bp, Homo sapiens
aatttacaagatattattaatt

SEQ ID NO: 1745591 - DNA, 14 bp, Homo sapiens
aatttacatttaat

SEQ ID NO: 1745592 - DNA, 22 bp, Homo sapiens
aatttacatttaatacagataa

SEQ ID NO: 1745593 - DNA, 16 bp, Homo sapiens
aatttaccatcatctc

SEQ ID NO: 1745594 - DNA, 14 bp, Homo sapiens
aatttacctaagat

SEQ ID NO: 1745595 - DNA, 17 bp, Homo sapiens
aatttacctaagattac

SEQ ID NO: 1745596 - DNA, 21 bp, Homo sapiens
aatttacctaagattacaaat

SEQ ID NO: 1745597 - DNA, 13 bp, Homo sapiens
aatttacttgttt

SEQ ID NO: 1745598 - DNA, 17 bp, Homo sapiens
aatttagaaatataatt

SEQ ID NO: 1745599 - DNA, 21 bp, Homo sapiens
aatttagtggatggaatatca

SEQ ID NO: 1745600 - DNA, 19 bp, Homo sapiens
aatttataaagaaaaatag

SEQ ID NO: 1745601 - DNA, 15 bp, Homo sapiens
aatttataaagtacc

SEQ ID NO: 1745602 - DNA, 16 bp, Homo sapiens
aatttatacaggtcat

SEQ ID NO: 1745603 - DNA, 16 bp, Homo sapiens
aatttatatttagtaa

SEQ ID NO: 1745604 - DNA, 23 bp, Homo sapiens
aatttatcctgaaatttcagatt

SEQ ID NO: 1745605 - DNA, 20 bp, Homo sapiens
aatttatcttgtctctgggc

SEQ ID NO: 1745606 - DNA, 14 bp, Homo sapiens
aatttatctttacc

SEQ ID NO: 1745607 - DNA, 23 bp, Homo sapiens
aatttatgaattgaattatcttg

SEQ ID NO: 1745608 - DNA, 22 bp, Homo sapiens
aatttatgcatttcattcaaat

SEQ ID NO: 1745609 - DNA, 15 bp, Homo sapiens
aatttatgtgaaatg

SEQ ID NO: 1745610 - DNA, 14 bp, Homo sapiens
aatttatgtgatgg

SEQ ID NO: 1745611 - DNA, 12 bp, Homo sapiens
aatttattcaat

SEQ ID NO: 1745612 - DNA, 19 bp, Homo sapiens
aatttattgtctgtctaca

SEQ ID NO: 1745613 - DNA, 15 bp, Homo sapiens
aatttcaaaaatata

SEQ ID NO: 1745614 - DNA, 17 bp, Homo sapiens
aatttcaaaaatataac

SEQ ID NO: 1745615 - DNA, 23 bp, Homo sapiens
aatttcaacgcctgcctttggca

SEQ ID NO: 1745616 - DNA, 17 bp, Homo sapiens
aatttcaacgtatgtgt

SEQ ID NO: 1745617 - DNA, 14 bp, Homo sapiens
aatttcaaggaact

SEQ ID NO: 1745618 - DNA, 15 bp, Homo sapiens
aatttcaaggttcta

SEQ ID NO: 1745619 - DNA, 16 bp, Homo sapiens
aatttcaaggttctaa

SEQ ID NO: 1745620 - DNA, 21 bp, Homo sapiens
aatttcaataaaagataaatt

SEQ ID NO: 1745621 - DNA, 16 bp, Homo sapiens
aatttcacctgtaaac

SEQ ID NO: 1745622 - DNA, 19 bp, Homo sapiens
aatttcacctgtaaacctg

SEQ ID NO: 1745623 - DNA, 22 bp, Homo sapiens
aatttcactactagattgacta

SEQ ID NO: 1745624 - DNA, 13 bp, Homo sapiens
aatttcagactcc

SEQ ID NO: 1745625 - DNA, 12 bp, Homo sapiens
aatttcaggaaa

SEQ ID NO: 1745626 - DNA, 13 bp, Homo sapiens
aatttcagtgtaa

SEQ ID NO: 1745627 - DNA, 21 bp, Homo sapiens
aatttcatagctgtacttctt

SEQ ID NO: 1745628 - DNA, 16 bp, Homo sapiens
aatttcatatgctgta

SEQ ID NO: 1745629 - DNA, 15 bp, Homo sapiens
aatttcatttccagc

SEQ ID NO: 1745630 - DNA, 19 bp, Homo sapiens
aatttcatttccagcattt

SEQ ID NO: 1745631 - DNA, 21 bp, Homo sapiens
aatttccacaaaatctgtcca

SEQ ID NO: 1745632 - DNA, 19 bp, Homo sapiens
aatttcccaattaggaagt

SEQ ID NO: 1745633 - DNA, 15 bp, Homo sapiens
aatttcccaggaccc

SEQ ID NO: 1745634 - DNA, 16 bp, Homo sapiens
aatttcccaggaccct

SEQ ID NO: 1745635 - DNA, 18 bp, Homo sapiens
aatttcccagttaaagat

SEQ ID NO: 1745636 - DNA, 19 bp, Homo sapiens
aatttcccagttaaagatt

SEQ ID NO: 1745637 - DNA, 13 bp, Homo sapiens
aatttcctctatt

SEQ ID NO: 1745638 - DNA, 22 bp, Homo sapiens
aatttcctgtttgaaatatcat

SEQ ID NO: 1745639 - DNA, 19 bp, Homo sapiens
aatttcctttttgacactg

SEQ ID NO: 1745640 - DNA, 22 bp, Homo sapiens
aatttcctttttgacactgaaa

SEQ ID NO: 1745641 - DNA, 21 bp, Homo sapiens
aatttcgccgttgaagaggaa

SEQ ID NO: 1745642 - DNA, 23 bp, Homo sapiens
aatttcgccttaaactctggaca

SEQ ID NO: 1745643 - DNA, 20 bp, Homo sapiens
aatttcgttgtccaatttgt

SEQ ID NO: 1745644 - DNA, 16 bp, Homo sapiens
aatttctaccatttca

SEQ ID NO: 1745645 - DNA, 22 bp, Homo sapiens
aatttctgataaagttccttaa

SEQ ID NO: 1745646 - DNA, 14 bp, Homo sapiens
aatttctggaagat

SEQ ID NO: 1745647 - DNA, 21 bp, Homo sapiens
aatttcttactaaacattttg

SEQ ID NO: 1745648 - DNA, 14 bp, Homo sapiens
aatttcttatgtga

SEQ ID NO: 1745649 - DNA, 19 bp, Homo sapiens
aatttcttcccccaaagcc

SEQ ID NO: 1745650 - DNA, 20 bp, Homo sapiens
aatttgaaatggttgtcacc

SEQ ID NO: 1745651 - DNA, 21 bp, Homo sapiens
aatttgaagtaacttatttga

SEQ ID NO: 1745652 - DNA, 19 bp, Homo sapiens
aatttgaataaactctccc

SEQ ID NO: 1745653 - DNA, 17 bp, Homo sapiens
aatttgactaattttac

SEQ ID NO: 1745654 - DNA, 19 bp, Homo sapiens
aatttgacttttctgtaat

SEQ ID NO: 1745655 - DNA, 18 bp, Homo sapiens
aatttgagagaaatatga

SEQ ID NO: 1745656 - DNA, 13 bp, Homo sapiens
aatttgaggacaa

SEQ ID NO: 1745657 - DNA, 16 bp, Homo sapiens
aatttgatgaaagctg

SEQ ID NO: 1745658 - DNA, 17 bp, Homo sapiens
aatttgatgatgttaaa

SEQ ID NO: 1745659 - DNA, 12 bp, Homo sapiens
aatttgatttcc

SEQ ID NO: 1745660 - DNA, 17 bp, Homo sapiens
aatttgcaccatcatgt

SEQ ID NO: 1745661 - DNA, 20 bp, Homo sapiens
aatttgcattgtgtcagaaa

SEQ ID NO: 1745662 - DNA, 20 bp, Homo sapiens
aatttggagcacaaaattca

SEQ ID NO: 1745663 - DNA, 17 bp, Homo sapiens
aatttggagtaaatata

SEQ ID NO: 1745664 - DNA, 14 bp, Homo sapiens
aatttggcattgat

SEQ ID NO: 1745665 - DNA, 18 bp, Homo sapiens
aatttggccttaagaact

SEQ ID NO: 1745666 - DNA, 22 bp, Homo sapiens
aatttgggaaggtttgtgtttt

SEQ ID NO: 1745667 - DNA, 16 bp, Homo sapiens
aatttgggagatatat

SEQ ID NO: 1745668 - DNA, 21 bp, Homo sapiens
aatttggtaaaaatgctgctc

SEQ ID NO: 1745669 - DNA, 22 bp, Homo sapiens
aatttggttctaatagaactca

SEQ ID NO: 1745670 - DNA, 22 bp, Homo sapiens
aatttgtaaaaacagcattgct

SEQ ID NO: 1745671 - DNA, 12 bp, Homo sapiens
aatttgtaatat

SEQ ID NO: 1745672 - DNA, 19 bp, Homo sapiens
aatttgtaattgcttacat

SEQ ID NO: 1745673 - DNA, 19 bp, Homo sapiens
aatttgtacaggactgtaa

SEQ ID NO: 1745674 - DNA, 19 bp, Homo sapiens
aatttgtactatttaactg

SEQ ID NO: 1745675 - DNA, 18 bp, Homo sapiens
aatttgtacttcttattg

SEQ ID NO: 1745676 - DNA, 19 bp, Homo sapiens
aatttgtattaaaaagcct

SEQ ID NO: 1745677 - DNA, 16 bp, Homo sapiens
aatttgtcagcgttct

SEQ ID NO: 1745678 - DNA, 15 bp, Homo sapiens
aatttgttcttgtat

SEQ ID NO: 1745679 - DNA, 15 bp, Homo sapiens
aatttgtttaaagaa

SEQ ID NO: 1745680 - DNA, 17 bp, Homo sapiens
aatttgtttgaaatctt

SEQ ID NO: 1745681 - DNA, 17 bp, Homo sapiens
aatttgttttggatata

SEQ ID NO: 1745682 - DNA, 23 bp, Homo sapiens
aattttaaaaaagggagtttttg

SEQ ID NO: 1745683 - DNA, 14 bp, Homo sapiens
aattttaaaaaata

SEQ ID NO: 1745684 - DNA, 13 bp, Homo sapiens
aattttaaagcca

SEQ ID NO: 1745685 - DNA, 12 bp, Homo sapiens
aattttaaagta

SEQ ID NO: 1745686 - DNA, 14 bp, Homo sapiens
aattttaaagtatg

SEQ ID NO: 1745687 - DNA, 17 bp, Homo sapiens
aattttaaagtgcaaaa

SEQ ID NO: 1745688 - DNA, 12 bp, Homo sapiens
aattttaaagtt

SEQ ID NO: 1745689 - DNA, 17 bp, Homo sapiens
aattttaaataaaagtg

SEQ ID NO: 1745690 - DNA, 20 bp, Homo sapiens
aattttaagcctttgttgaa

SEQ ID NO: 1745691 - DNA, 14 bp, Homo sapiens
aattttaatgctgt

SEQ ID NO: 1745692 - DNA, 22 bp, Homo sapiens
aattttaatgctgtttctaaga

SEQ ID NO: 1745693 - DNA, 22 bp, Homo sapiens
acaaccaacagaaaacatccca

SEQ ID NO: 1745694 - DNA, 16 bp, Homo sapiens
acaaccatagaactgt

SEQ ID NO: 1745695 - DNA, 18 bp, Homo sapiens
acaaccattaaagtcaga

SEQ ID NO: 1745696 - DNA, 23 bp, Homo sapiens
acaacccctgatgtttgaagagt

SEQ ID NO: 1745697 - DNA, 18 bp, Homo sapiens
acaaccttcggctccggg

SEQ ID NO: 1745698 - DNA, 18 bp, Homo sapiens
acaaccttttacattgtg

SEQ ID NO: 1745699 - DNA, 14 bp, Homo sapiens
acaacggagtcaaa

SEQ ID NO: 1745700 - DNA, 20 bp, Homo sapiens
acaacgggcagaaatcgaga

SEQ ID NO: 1745701 - DNA, 19 bp, Homo sapiens
acaacgtgtatagtgccta

SEQ ID NO: 1745702 - DNA, 14 bp, Homo sapiens
acaactctattttt

SEQ ID NO: 1745703 - DNA, 12 bp, Homo sapiens
acaactgacaca

SEQ ID NO: 1745704 - DNA, 15 bp, Homo sapiens
acaactgacacagga

SEQ ID NO: 1745705 - DNA, 21 bp, Homo sapiens
acaactgctcttacttttcca

SEQ ID NO: 1745706 - DNA, 11 bp, Homo sapiens
acaactgtgac

SEQ ID NO: 1745707 - DNA, 15 bp, Homo sapiens
acaacttaaataata

SEQ ID NO: 1745708 - DNA, 14 bp, Homo sapiens
acaacttagctcag

SEQ ID NO: 1745709 - DNA, 15 bp, Homo sapiens
acaacttagctcagg

SEQ ID NO: 1745710 - DNA, 22 bp, Homo sapiens
acaacttataggtgaatgagta

SEQ ID NO: 1745711 - DNA, 21 bp, Homo sapiens
acaacttatttaaaaatattt

SEQ ID NO: 1745712 - DNA, 22 bp, Homo sapiens
acaacttatttaaaaatatttc

SEQ ID NO: 1745713 - DNA, 23 bp, Homo sapiens
acaacttatttaaaaatatttca

SEQ ID NO: 1745714 - DNA, 17 bp, Homo sapiens
acaacttcaatatccaa

SEQ ID NO: 1745715 - DNA, 14 bp, Homo sapiens
acaacttgtagcag

SEQ ID NO: 1745716 - DNA, 18 bp, Homo sapiens
acaacttgtagcagctat

SEQ ID NO: 1745717 - DNA, 15 bp, Homo sapiens
acaacttgtatttcc

SEQ ID NO: 1745718 - DNA, 15 bp, Homo sapiens
acaactttcacttct

SEQ ID NO: 1745719 - DNA, 16 bp, Homo sapiens
acaacttttaaagaaa

SEQ ID NO: 1745720 - DNA, 12 bp, Homo sapiens
acaagaaaacat

SEQ ID NO: 1745721 - DNA, 14 bp, Homo sapiens
acaagaaagaaatg

SEQ ID NO: 1745722 - DNA, 14 bp, Homo sapiens
acaagaagaagggc

SEQ ID NO: 1745723 - DNA, 14 bp, Homo sapiens
acaagaagaccccg

SEQ ID NO: 1745724 - DNA, 13 bp, Homo sapiens
acaagaagagtaa

SEQ ID NO: 1745725 - DNA, 15 bp, Homo sapiens
acaagaaggaacaat

SEQ ID NO: 1745726 - DNA, 23 bp, Homo sapiens
acaagaagggttttccaccctgg

SEQ ID NO: 1745727 - DNA, 17 bp, Homo sapiens
acaagaataattttgga

SEQ ID NO: 1745728 - DNA, 15 bp, Homo sapiens
acaagaatgaaggtt

SEQ ID NO: 1745729 - DNA, 23 bp, Homo sapiens
acaagaatgaaggtttttgtaaa

SEQ ID NO: 1745730 - DNA, 19 bp, Homo sapiens
acaagaccaccacttcgaa

SEQ ID NO: 1745731 - DNA, 19 bp, Homo sapiens
acaagaccccgtctcaaaa

SEQ ID NO: 1745732 - DNA, 16 bp, Homo sapiens
acaagactgccaggtg

SEQ ID NO: 1745733 - DNA, 15 bp, Homo sapiens
acaagagatctacac

SEQ ID NO: 1745734 - DNA, 20 bp, Homo sapiens
acaagagcaaaactccgtct

SEQ ID NO: 1745735 - DNA, 13 bp, Homo sapiens
acaagagcccagc

SEQ ID NO: 1745736 - DNA, 17 bp, Homo sapiens
acaagagcgaaactccg

SEQ ID NO: 1745737 - DNA, 13 bp, Homo sapiens
acaagagctgctg

SEQ ID NO: 1745738 - DNA, 17 bp, Homo sapiens
acaagagctgctgtcct

SEQ ID NO: 1745739 - DNA, 16 bp, Homo sapiens
acaagaggaagagaga

SEQ ID NO: 1745740 - DNA, 21 bp, Homo sapiens
acaagagtgagactccacctc

SEQ ID NO: 1745741 - DNA, 13 bp, Homo sapiens
acaagatattatt

SEQ ID NO: 1745742 - DNA, 15 bp, Homo sapiens
acaagatattgtaca

SEQ ID NO: 1745743 - DNA, 17 bp, Homo sapiens
acaagatattgtacata

SEQ ID NO: 1745744 - DNA, 19 bp, Homo sapiens
acaagatattgtacataaa

SEQ ID NO: 1745745 - DNA, 22 bp, Homo sapiens
acaagatattgtacataaaaga

SEQ ID NO: 1745746 - DNA, 16 bp, Homo sapiens
acaagatgggacagca

SEQ ID NO: 1745747 - DNA, 21 bp, Homo sapiens
acaagcaatgatgacccacta

SEQ ID NO: 1745748 - DNA, 20 bp, Homo sapiens
acaagcagagtgcacagctg

SEQ ID NO: 1745749 - DNA, 21 bp, Homo sapiens
acaagcatgtctctctgccaa

SEQ ID NO: 1745750 - DNA, 15 bp, Homo sapiens
acaagccagctggag

SEQ ID NO: 1745751 - DNA, 15 bp, Homo sapiens
acaagccagggtgtg

SEQ ID NO: 1745752 - DNA, 22 bp, Homo sapiens
acaagcccgttagccccaggga

SEQ ID NO: 1745753 - DNA, 13 bp, Homo sapiens
acaagccctggca

SEQ ID NO: 1745754 - DNA, 13 bp, Homo sapiens
acaagctgcactg

SEQ ID NO: 1745755 - DNA, 14 bp, Homo sapiens
acaagctgcactgt

SEQ ID NO: 1745756 - DNA, 17 bp, Homo sapiens
acaagctgtccctgcag

SEQ ID NO: 1745757 - DNA, 18 bp, Homo sapiens
acaagctgtccctgcagg

SEQ ID NO: 1745758 - DNA, 13 bp, Homo sapiens
acaagctgtgcag

SEQ ID NO: 1745759 - DNA, 13 bp, Homo sapiens
acaaggaaaagga

SEQ ID NO: 1745760 - DNA, 11 bp, Homo sapiens
acaaggaaaat

SEQ ID NO: 1745761 - DNA, 18 bp, Homo sapiens
acaaggaaggaaaagaaa

SEQ ID NO: 1745762 - DNA, 9 bp, Homo sapiens
acaaggact

SEQ ID NO: 1745763 - DNA, 17 bp, Homo sapiens
acaaggatagatgctgg

SEQ ID NO: 1745764 - DNA, 18 bp, Homo sapiens
acaaggatagatgctggc

SEQ ID NO: 1745765 - DNA, 13 bp, Homo sapiens
acaaggcccagga

SEQ ID NO: 1745766 - DNA, 18 bp, Homo sapiens
acaaggctgaccaagaga

SEQ ID NO: 1745767 - DNA, 23 bp, Homo sapiens
acaagggaaaaatttttatgtaa

SEQ ID NO: 1745768 - DNA, 17 bp, Homo sapiens
acaagggattctgggaa

SEQ ID NO: 1745769 - DNA, 21 bp, Homo sapiens
acaagggctgacctgcctctc

SEQ ID NO: 1745770 - DNA, 18 bp, Homo sapiens
acaagggctgcaatgccc

SEQ ID NO: 1745771 - DNA, 18 bp, Homo sapiens
acaagggtctagggagag

SEQ ID NO: 1745772 - DNA, 19 bp, Homo sapiens
acaagggtctagggagaga

SEQ ID NO: 1745773 - DNA, 14 bp, Homo sapiens
acaaggtaattgtt

SEQ ID NO: 1745774 - DNA, 22 bp, Homo sapiens
acaaggtaattgttttttaaag

SEQ ID NO: 1745775 - DNA, 21 bp, Homo sapiens
acaaggtacccctttctggct

SEQ ID NO: 1745776 - DNA, 20 bp, Homo sapiens
acaaggtcaagagatagaga

SEQ ID NO: 1745777 - DNA, 20 bp, Homo sapiens
acaaggtctcttccttaccc

SEQ ID NO: 1745778 - DNA, 12 bp, Homo sapiens
acaaggtgctaa

SEQ ID NO: 1745779 - DNA, 13 bp, Homo sapiens
acaaggttcttcc

SEQ ID NO: 1745780 - DNA, 15 bp, Homo sapiens
acaagtaagaaaaat

SEQ ID NO: 1745781 - DNA, 21 bp, Homo sapiens
acaagtatgaataaagacacc

SEQ ID NO: 1745782 - DNA, 22 bp, Homo sapiens
acaagtatgaatattactctca

SEQ ID NO: 1745783 - DNA, 14 bp, Homo sapiens
acaagtcacagctg

SEQ ID NO: 1745784 - DNA, 17 bp, Homo sapiens
acaagtcacagctgcag

SEQ ID NO: 1745785 - DNA, 18 bp, Homo sapiens
acaagtcatttttgtatt

SEQ ID NO: 1745786 - DNA, 13 bp, Homo sapiens
acaagtcttccag

SEQ ID NO: 1745787 - DNA, 16 bp, Homo sapiens
acaagtgaagaacact

SEQ ID NO: 1745788 - DNA, 19 bp, Homo sapiens
acaagtgagacaaaaagca

SEQ ID NO: 1745789 - DNA, 21 bp, Homo sapiens
acaagtggtaatttttgtaca

SEQ ID NO: 1745790 - DNA, 23 bp, Homo sapiens
acaagtggtaatttttgtacatt

SEQ ID NO: 1745791 - DNA, 21 bp, Homo sapiens
acaagtgtaggccaccattat

SEQ ID NO: 1745792 - DNA, 21 bp, Homo sapiens
acaagtgttcttaggtttact

SEQ ID NO: 1745793 - DNA, 22 bp, Homo sapiens
acaagtgttcttaggtttactg

SEQ ID NO: 1745794 - DNA, 23 bp, Homo sapiens
acaagtgttcttaggtttactgt

SEQ ID NO: 1745795 - DNA, 15 bp, Homo sapiens
acaagttccaacatg

SEQ ID NO: 1745796 - DNA, 17 bp, Homo sapiens
acaagttccaacatgca

SEQ ID NO: 1745797 - DNA, 18 bp, Homo sapiens
acaagttgcttttacctg

SEQ ID NO: 1745798 - DNA, 14 bp, Homo sapiens
acaagttgtgtttg

SEQ ID NO: 1745799 - DNA, 13 bp, Homo sapiens
acaagttgttaaa

SEQ ID NO: 1745800 - DNA, 17 bp, Homo sapiens
acaagttgttaaaacat

SEQ ID NO: 1745801 - DNA, 21 bp, Homo sapiens
acaagttgttaaaacatttaa

SEQ ID NO: 1745802 - DNA, 23 bp, Homo sapiens
acaagttgttaaaacatttaata

SEQ ID NO: 1745803 - DNA, 16 bp, Homo sapiens
acaagtttatatatat

SEQ ID NO: 1745804 - DNA, 12 bp, Homo sapiens
acaagtttcaga

SEQ ID NO: 1745805 - DNA, 17 bp, Homo sapiens
acaagtttcagacaggg

SEQ ID NO: 1745806 - DNA, 14 bp, Homo sapiens
acaagttttaaata

SEQ ID NO: 1745807 - DNA, 12 bp, Homo sapiens
acaagttttgta

SEQ ID NO: 1745808 - DNA, 14 bp, Homo sapiens
acacgacagcacac

SEQ ID NO: 1745809 - DNA, 19 bp, Homo sapiens
acacgacagcacacacagt

SEQ ID NO: 1745810 - DNA, 13 bp, Homo sapiens
acacgagcaaacc

SEQ ID NO: 1745811 - DNA, 20 bp, Homo sapiens
acacgagcaaacccagaggt

SEQ ID NO: 1745812 - DNA, 14 bp, Homo sapiens
acacgagcaggcta

SEQ ID NO: 1745813 - DNA, 18 bp, Homo sapiens
acacgagccacaagctgc

SEQ ID NO: 1745814 - DNA, 19 bp, Homo sapiens
acacgagccacaagctgca

SEQ ID NO: 1745815 - DNA, 19 bp, Homo sapiens
acacgatgcatttaataaa

SEQ ID NO: 1745816 - DNA, 23 bp, Homo sapiens
acacgatgttgtcaaggatggtt

SEQ ID NO: 1745817 - DNA, 16 bp, Homo sapiens
acacgcaagggcatca

SEQ ID NO: 1745818 - DNA, 21 bp, Homo sapiens
acacgcaagggcatcaggcac

SEQ ID NO: 1745819 - DNA, 24 bp, Homo sapiens
acacgcaagggcatcaggcactgg

SEQ ID NO: 1745820 - DNA, 15 bp, Homo sapiens
acacgcacgcacaca

SEQ ID NO: 1745821 - DNA, 19 bp, Homo sapiens
acacgccttgttcctgctc

SEQ ID NO: 1745822 - DNA, 16 bp, Homo sapiens
acacgctcgcgggcag

SEQ ID NO: 1745823 - DNA, 17 bp, Homo sapiens
acacggaggcatctgca

SEQ ID NO: 1745824 - DNA, 20 bp, Homo sapiens
acacggctggtcactctgcc

SEQ ID NO: 1745825 - DNA, 22 bp, Homo sapiens
acacggctggtcactctgccct

SEQ ID NO: 1745826 - DNA, 23 bp, Homo sapiens
acacggctggtcactctgccctc

SEQ ID NO: 1745827 - DNA, 14 bp, Homo sapiens
acacggcttcactg

SEQ ID NO: 1745828 - DNA, 24 bp, Homo sapiens
acacggcttcactgaccagcggct

SEQ ID NO: 1745829 - DNA, 18 bp, Homo sapiens
acacgtaccttcatgtga

SEQ ID NO: 1745830 - DNA, 23 bp, Homo sapiens
acacgtacttaaatgaaagcatg

SEQ ID NO: 1745831 - DNA, 21 bp, Homo sapiens
acacgtatttatatttggaaa

SEQ ID NO: 1745832 - DNA, 14 bp, Homo sapiens
acacgtggcctgca

SEQ ID NO: 1745833 - DNA, 12 bp, Homo sapiens
acacgtgtcctg

SEQ ID NO: 1745834 - DNA, 17 bp, Homo sapiens
acactaaagatccaaga

SEQ ID NO: 1745835 - DNA, 18 bp, Homo sapiens
acactaaaggtggaaata

SEQ ID NO: 1745836 - DNA, 23 bp, Homo sapiens
acactaaccaagctgagtttcct

SEQ ID NO: 1745837 - DNA, 21 bp, Homo sapiens
acactaagctctctgggcctg

SEQ ID NO: 1745838 - DNA, 21 bp, Homo sapiens
acactaatatatttaaaaata

SEQ ID NO: 1745839 - DNA, 23 bp, Homo sapiens
acactagttttgtgccagccgtg

SEQ ID NO: 1745840 - DNA, 13 bp, Homo sapiens
acactatatctgt

SEQ ID NO: 1745841 - DNA, 15 bp, Homo sapiens
acactatatctgtat

SEQ ID NO: 1745842 - DNA, 21 bp, Homo sapiens
acactatatctgtatataaaa

SEQ ID NO: 1745843 - DNA, 22 bp, Homo sapiens
acactatggtatttgagtgttt

SEQ ID NO: 1745844 - DNA, 13 bp, Homo sapiens
acactcaaatcaa

SEQ ID NO: 1745845 - DNA, 18 bp, Homo sapiens
acactcaaatcaagaaac

SEQ ID NO: 1745846 - DNA, 19 bp, Homo sapiens
acactcaaatcaagaaact

SEQ ID NO: 1745847 - DNA, 18 bp, Homo sapiens
acactcagtccactgttg

SEQ ID NO: 1745848 - DNA, 15 bp, Homo sapiens
acactcccctgcact

SEQ ID NO: 1745849 - DNA, 12 bp, Homo sapiens
acactcctctgc

SEQ ID NO: 1745850 - DNA, 13 bp, Homo sapiens
acactcttcagtg

SEQ ID NO: 1745851 - DNA, 19 bp, Homo sapiens
acactcttcagtgactcct

SEQ ID NO: 1745852 - DNA, 23 bp, Homo sapiens
acactcttcagtgactcctgctg

SEQ ID NO: 1745853 - DNA, 15 bp, Homo sapiens
acactgaccaagtgc

SEQ ID NO: 1745854 - DNA, 20 bp, Homo sapiens
acactgagaatgtaagaact

SEQ ID NO: 1745855 - DNA, 21 bp, Homo sapiens
acactgagcaagatcttgtct

SEQ ID NO: 1745856 - DNA, 13 bp, Homo sapiens
acactgaggactg

SEQ ID NO: 1745857 - DNA, 22 bp, Homo sapiens
acactgatggctcaagacaagg

SEQ ID NO: 1745858 - DNA, 17 bp, Homo sapiens
acactgcagtttcctgg

SEQ ID NO: 1745859 - DNA, 20 bp, Homo sapiens
acactgcctttttatttata

SEQ ID NO: 1745860 - DNA, 22 bp, Homo sapiens
acactgcctttttatttatatg

SEQ ID NO: 1745861 - DNA, 20 bp, Homo sapiens
acactgcgcaggtctcttct

SEQ ID NO: 1745862 - DNA, 23 bp, Homo sapiens
acactgcgcaggtctcttctggg

SEQ ID NO: 1745863 - DNA, 14 bp, Homo sapiens
acactgctctaaca

SEQ ID NO: 1745864 - DNA, 14 bp, Homo sapiens
acactgctgcacca

SEQ ID NO: 1745865 - DNA, 13 bp, Homo sapiens
acactgctgtcca

SEQ ID NO: 1745866 - DNA, 14 bp, Homo sapiens
acactgctgttaaa

SEQ ID NO: 1745867 - DNA, 23 bp, Homo sapiens
acactggaatataaaacagtcat

SEQ ID NO: 1745868 - DNA, 22 bp, Homo sapiens
acactggaccaggtcctgctcc

SEQ ID NO: 1745869 - DNA, 23 bp, Homo sapiens
acactggaccaggtcctgctccg

SEQ ID NO: 1745870 - DNA, 11 bp, Homo sapiens
acactggatat

SEQ ID NO: 1745871 - DNA, 14 bp, Homo sapiens
acactggcccctca

SEQ ID NO: 1745872 - DNA, 12 bp, Homo sapiens
acactgggcctg

SEQ ID NO: 1745873 - DNA, 14 bp, Homo sapiens
acactgggctgggt

SEQ ID NO: 1745874 - DNA, 13 bp, Homo sapiens
acactgggtggtg

SEQ ID NO: 1745875 - DNA, 23 bp, Homo sapiens
acactgggtggtggcctggtccc

SEQ ID NO: 1745876 - DNA, 11 bp, Homo sapiens
acactggtcta

SEQ ID NO: 1745877 - DNA, 22 bp, Homo sapiens
acactgtagtttttgaaaatta

SEQ ID NO: 1745878 - DNA, 23 bp, Homo sapiens
acactgtatctaaaaaataactg

SEQ ID NO: 1745879 - DNA, 17 bp, Homo sapiens
acactgtccttccctgc

SEQ ID NO: 1745880 - DNA, 15 bp, Homo sapiens
acactgtctgcccct

SEQ ID NO: 1745881 - DNA, 15 bp, Homo sapiens
acactgtcttcccga

SEQ ID NO: 1745882 - DNA, 22 bp, Homo sapiens
acactgtgaagagctggactcc

SEQ ID NO: 1745883 - DNA, 12 bp, Homo sapiens
acactgtgccct

SEQ ID NO: 1745884 - DNA, 17 bp, Homo sapiens
acactgtgccctggtgg

SEQ ID NO: 1745885 - DNA, 20 bp, Homo sapiens
acactgtggtaggtgtttga

SEQ ID NO: 1745886 - DNA, 18 bp, Homo sapiens
acactgtgtcctggtgct

SEQ ID NO: 1745887 - DNA, 21 bp, Homo sapiens
acactgtgtcctggtgctctc

SEQ ID NO: 1745888 - DNA, 18 bp, Homo sapiens
acactgttactccacagc

SEQ ID NO: 1745889 - DNA, 22 bp, Homo sapiens
acactgttactccacagcggag

SEQ ID NO: 1745890 - DNA, 15 bp, Homo sapiens
acacttaaatttctt

SEQ ID NO: 1745891 - DNA, 13 bp, Homo sapiens
acacttaacagat

SEQ ID NO: 1745892 - DNA, 14 bp, Homo sapiens
acacttaacagatg

SEQ ID NO: 1745893 - DNA, 16 bp, Homo sapiens
acacttacactttatg

SEQ ID NO: 1745894 - DNA, 21 bp, Homo sapiens
acacttacactttatgcacaa

SEQ ID NO: 1745895 - DNA, 19 bp, Homo sapiens
acacttagggtttggagct

SEQ ID NO: 1745896 - DNA, 15 bp, Homo sapiens
acacttataaaataa

SEQ ID NO: 1745897 - DNA, 21 bp, Homo sapiens
acacttataaaataacttgca

SEQ ID NO: 1745898 - DNA, 22 bp, Homo sapiens
acacttataaaataacttgcat

SEQ ID NO: 1745899 - DNA, 14 bp, Homo sapiens
acacttataagtga

SEQ ID NO: 1745900 - DNA, 19 bp, Homo sapiens
acacttatcttctggatta

SEQ ID NO: 1745901 - DNA, 15 bp, Homo sapiens
acacttatttgtcaa

SEQ ID NO: 1745902 - DNA, 14 bp, Homo sapiens
acacttattttctg

SEQ ID NO: 1745903 - DNA, 15 bp, Homo sapiens
acacttattttctga

SEQ ID NO: 1745904 - DNA, 19 bp, Homo sapiens
acacttcagatctgaggtt

SEQ ID NO: 1745905 - DNA, 21 bp, Homo sapiens
acacttccaccagcctgcact

SEQ ID NO: 1745906 - DNA, 24 bp, Homo sapiens
acacttccacccttttttctaagt

SEQ ID NO: 1745907 - DNA, 17 bp, Homo sapiens
acacttccccatctttg

SEQ ID NO: 1745908 - DNA, 13 bp, Homo sapiens
acacttctattta

SEQ ID NO: 1745909 - DNA, 20 bp, Homo sapiens
acacttctcatcatattgta

SEQ ID NO: 1745910 - DNA, 12 bp, Homo sapiens
acacttctgctt

SEQ ID NO: 1745911 - DNA, 23 bp, Homo sapiens
acacttctgtgagacccccacac

SEQ ID NO: 1745912 - DNA, 23 bp, Homo sapiens
acacttgatggagtgtgagccac

SEQ ID NO: 1745913 - DNA, 20 bp, Homo sapiens
acacttgccttcttcaccca

SEQ ID NO: 1745914 - DNA, 14 bp, Homo sapiens
acacttgctcccaa

SEQ ID NO: 1745915 - DNA, 17 bp, Homo sapiens
acacttggagcccgtgc

SEQ ID NO: 1745916 - DNA, 18 bp, Homo sapiens
acacttggagcccgtgca

SEQ ID NO: 1745917 - DNA, 23 bp, Homo sapiens
acactttatgccggatgtgcttt

SEQ ID NO: 1745918 - DNA, 21 bp, Homo sapiens
acactttccatctctgcctgt

SEQ ID NO: 1745919 - DNA, 13 bp, Homo sapiens
acactttctggca

SEQ ID NO: 1745920 - DNA, 17 bp, Homo sapiens
acactttgaaatgtgtt

SEQ ID NO: 1745921 - DNA, 20 bp, Homo sapiens
acactttgaaatgtgtttct

SEQ ID NO: 1745922 - DNA, 19 bp, Homo sapiens
acagctacaaccctaccct

SEQ ID NO: 1745923 - DNA, 14 bp, Homo sapiens
acagctaccaccct

SEQ ID NO: 1745924 - DNA, 16 bp, Homo sapiens
acagctaccaccctta

SEQ ID NO: 1745925 - DNA, 22 bp, Homo sapiens
acagctactctccccacgaggg

SEQ ID NO: 1745926 - DNA, 16 bp, Homo sapiens
acagctacttctggga

SEQ ID NO: 1745927 - DNA, 21 bp, Homo sapiens
acagctacttggtttgtgttc

SEQ ID NO: 1745928 - DNA, 15 bp, Homo sapiens
acagctatatttgat

SEQ ID NO: 1745929 - DNA, 15 bp, Homo sapiens
acagctcagctgccc

SEQ ID NO: 1745930 - DNA, 19 bp, Homo sapiens
acagctcaggaggcgccct

SEQ ID NO: 1745931 - DNA, 16 bp, Homo sapiens
acagctcattaaactt

SEQ ID NO: 1745932 - DNA, 16 bp, Homo sapiens
acagctcccaccccac

SEQ ID NO: 1745933 - DNA, 18 bp, Homo sapiens
acagctcccaccccaccc

SEQ ID NO: 1745934 - DNA, 16 bp, Homo sapiens
acagctccctctgcct

SEQ ID NO: 1745935 - DNA, 13 bp, Homo sapiens
acagctcctgcca

SEQ ID NO: 1745936 - DNA, 18 bp, Homo sapiens
acagctccttactctgag

SEQ ID NO: 1745937 - DNA, 12 bp, Homo sapiens
acagctcttcat

SEQ ID NO: 1745938 - DNA, 19 bp, Homo sapiens
acagctcttctcagtgtct

SEQ ID NO: 1745939 - DNA, 13 bp, Homo sapiens
acagctcttcttg

SEQ ID NO: 1745940 - DNA, 22 bp, Homo sapiens
acagctgaagtcaaaatatgta

SEQ ID NO: 1745941 - DNA, 19 bp, Homo sapiens
acagctgagttatgatgta

SEQ ID NO: 1745942 - DNA, 12 bp, Homo sapiens
acagctgcagct

SEQ ID NO: 1745943 - DNA, 13 bp, Homo sapiens
acagctgcagctg

SEQ ID NO: 1745944 - DNA, 14 bp, Homo sapiens
acagctgcagctgg

SEQ ID NO: 1745945 - DNA, 20 bp, Homo sapiens
acagctgcattagaaaaaga

SEQ ID NO: 1745946 - DNA, 10 bp, Homo sapiens
acagctgccc

SEQ ID NO: 1745947 - DNA, 13 bp, Homo sapiens
acagctgcccaga

SEQ ID NO: 1745948 - DNA, 15 bp, Homo sapiens
acagctgccctggct

SEQ ID NO: 1745949 - DNA, 16 bp, Homo sapiens
acagctgctggccagg

SEQ ID NO: 1745950 - DNA, 12 bp, Homo sapiens
acagctgctggg

SEQ ID NO: 1745951 - DNA, 18 bp, Homo sapiens
acagctgcttgtcctgct

SEQ ID NO: 1745952 - DNA, 19 bp, Homo sapiens
acagctggctctgacaaga

SEQ ID NO: 1745953 - DNA, 16 bp, Homo sapiens
acagctggctgggcct

SEQ ID NO: 1745954 - DNA, 19 bp, Homo sapiens
acagctggctgggccttca

SEQ ID NO: 1745955 - DNA, 22 bp, Homo sapiens
acagctggtgcaaattcagaac

SEQ ID NO: 1745956 - DNA, 18 bp, Homo sapiens
acagctgtccctgtcacc

SEQ ID NO: 1745957 - DNA, 16 bp, Homo sapiens
acagctgtgtctgcca

SEQ ID NO: 1745958 - DNA, 16 bp, Homo sapiens
acagctgttcttctgt

SEQ ID NO: 1745959 - DNA, 21 bp, Homo sapiens
acagctgttcttctgttctgc

SEQ ID NO: 1745960 - DNA, 18 bp, Homo sapiens
acagcttcagccaggagc

SEQ ID NO: 1745961 - DNA, 22 bp, Homo sapiens
acagcttcagccaggagctggg

SEQ ID NO: 1745962 - DNA, 15 bp, Homo sapiens
acagcttcagtccat

SEQ ID NO: 1745963 - DNA, 17 bp, Homo sapiens
acagcttcatgcctttg

SEQ ID NO: 1745964 - DNA, 19 bp, Homo sapiens
acagcttcatgcctttgta

SEQ ID NO: 1745965 - DNA, 20 bp, Homo sapiens
acagcttcatgcctttgtaa

SEQ ID NO: 1745966 - DNA, 11 bp, Homo sapiens
acagcttcctc

SEQ ID NO: 1745967 - DNA, 18 bp, Homo sapiens
acagcttcctttcctgtg

SEQ ID NO: 1745968 - DNA, 20 bp, Homo sapiens
acagcttctggagcagaact

SEQ ID NO: 1745969 - DNA, 21 bp, Homo sapiens
acagcttctggagcagaactt

SEQ ID NO: 1745970 - DNA, 15 bp, Homo sapiens
acagcttgacctgag

SEQ ID NO: 1745971 - DNA, 21 bp, Homo sapiens
acagcttgagccgggcccctg

SEQ ID NO: 1745972 - DNA, 13 bp, Homo sapiens
acagctttctggg

SEQ ID NO: 1745973 - DNA, 16 bp, Homo sapiens
acagctttgctccgct

SEQ ID NO: 1745974 - DNA, 13 bp, Homo sapiens
acagcttttgcaa

SEQ ID NO: 1745975 - DNA, 22 bp, Homo sapiens
acagcttttgcaacttaatact

SEQ ID NO: 1745976 - DNA, 14 bp, Homo sapiens
acaggaaaaacaaa

SEQ ID NO: 1745977 - DNA, 16 bp, Homo sapiens
acaggaaaatcctctg

SEQ ID NO: 1745978 - DNA, 20 bp, Homo sapiens
acaggaaaattttaaaaata

SEQ ID NO: 1745979 - DNA, 14 bp, Homo sapiens
acaggaagaaagca

SEQ ID NO: 1745980 - DNA, 16 bp, Homo sapiens
acaggaagagaagaat

SEQ ID NO: 1745981 - DNA, 20 bp, Homo sapiens
acaggaagcaccccatgcca

SEQ ID NO: 1745982 - DNA, 16 bp, Homo sapiens
acaggaagctcagcct

SEQ ID NO: 1745983 - DNA, 16 bp, Homo sapiens
acaggaaggcaggagg

SEQ ID NO: 1745984 - DNA, 13 bp, Homo sapiens
acaggaatcctta

SEQ ID NO: 1745985 - DNA, 17 bp, Homo sapiens
acaggaatccttactga

SEQ ID NO: 1745986 - DNA, 17 bp, Homo sapiens
acaggaatctcagagac

SEQ ID NO: 1745987 - DNA, 14 bp, Homo sapiens
acaggaattttatt

SEQ ID NO: 1745988 - DNA, 15 bp, Homo sapiens
acaggacacctggcc

SEQ ID NO: 1745989 - DNA, 14 bp, Homo sapiens
acaggacagaatgt

SEQ ID NO: 1745990 - DNA, 15 bp, Homo sapiens
acaggacatggatga

SEQ ID NO: 1745991 - DNA, 15 bp, Homo sapiens
acaggaccctcagga

SEQ ID NO: 1745992 - DNA, 16 bp, Homo sapiens
acaggaccctcaggaa

SEQ ID NO: 1745993 - DNA, 17 bp, Homo sapiens
acaggaccctcaggaat

SEQ ID NO: 1745994 - DNA, 16 bp, Homo sapiens
acaggactgattctgg

SEQ ID NO: 1745995 - DNA, 14 bp, Homo sapiens
acaggagactccaa

SEQ ID NO: 1745996 - DNA, 15 bp, Homo sapiens
acaggagaggcagca

SEQ ID NO: 1745997 - DNA, 22 bp, Homo sapiens
acaggagaggcagcatgcttgg

SEQ ID NO: 1745998 - DNA, 14 bp, Homo sapiens
acaggaggaggtga

SEQ ID NO: 1745999 - DNA, 21 bp, Homo sapiens
acaggaggcggcccggccagc

SEQ ID NO: 1746000 - DNA, 19 bp, Homo sapiens
acaggagtcttcagaccca

SEQ ID NO: 1746001 - DNA, 22 bp, Homo sapiens
acaggagtcttcagacccagag

SEQ ID NO: 1746002 - DNA, 14 bp, Homo sapiens
acaggatgaggaca

SEQ ID NO: 1746003 - DNA, 20 bp, Homo sapiens
acaggatggggttctggaaa

SEQ ID NO: 1746004 - DNA, 21 bp, Homo sapiens
acaggatggtgggcaggatct

SEQ ID NO: 1746005 - DNA, 23 bp, Homo sapiens
acaggattgatcattcttttata

SEQ ID NO: 1746006 - DNA, 19 bp, Homo sapiens
acaggcaaaacaggaaggg

SEQ ID NO: 1746007 - DNA, 16 bp, Homo sapiens
acaggcaactgaggca

SEQ ID NO: 1746008 - DNA, 19 bp, Homo sapiens
acaggcaactgaggcagac

SEQ ID NO: 1746009 - DNA, 22 bp, Homo sapiens
acaggcaactgaggcagacagc

SEQ ID NO: 1746010 - DNA, 17 bp, Homo sapiens
acaggcacacaccacca

SEQ ID NO: 1746011 - DNA, 17 bp, Homo sapiens
acaggcagtgcatgtga

SEQ ID NO: 1746012 - DNA, 18 bp, Homo sapiens
acaggcagtgcatgtgaa

SEQ ID NO: 1746013 - DNA, 21 bp, Homo sapiens
acaggcagtgcatgtgaagca

SEQ ID NO: 1746014 - DNA, 21 bp, Homo sapiens
acaggcataaaatagagtaaa

SEQ ID NO: 1746015 - DNA, 15 bp, Homo sapiens
acaggcatcaggaat

SEQ ID NO: 1746016 - DNA, 22 bp, Homo sapiens
acaggcatgggtgcaaggaaaa

SEQ ID NO: 1746017 - DNA, 16 bp, Homo sapiens
acaggcatgtgtcacc

SEQ ID NO: 1746018 - DNA, 17 bp, Homo sapiens
acaggcatttgttcact

SEQ ID NO: 1746019 - DNA, 11 bp, Homo sapiens
acaggcccagc

SEQ ID NO: 1746020 - DNA, 23 bp, Homo sapiens
acaggcccagcattgctggttct

SEQ ID NO: 1746021 - DNA, 19 bp, Homo sapiens
acaggcccagcgcggccag

SEQ ID NO: 1746022 - DNA, 19 bp, Homo sapiens
acaggccccccgcagcacc

SEQ ID NO: 1746023 - DNA, 21 bp, Homo sapiens
acaggccccccgcagcaccct

SEQ ID NO: 1746024 - DNA, 22 bp, Homo sapiens
acaggcccggcgcggtggctca

SEQ ID NO: 1746025 - DNA, 13 bp, Homo sapiens
acaggccctagct

SEQ ID NO: 1746026 - DNA, 15 bp, Homo sapiens
acaggcccttcctct

SEQ ID NO: 1746027 - DNA, 13 bp, Homo sapiens
acaggcctctgcc

SEQ ID NO: 1746028 - DNA, 15 bp, Homo sapiens
acaggcctgagattt

SEQ ID NO: 1746029 - DNA, 12 bp, Homo sapiens
acaggccttgct

SEQ ID NO: 1746030 - DNA, 13 bp, Homo sapiens
acaggctcttagc

SEQ ID NO: 1746031 - DNA, 12 bp, Homo sapiens
acaggctgaaga

SEQ ID NO: 1746032 - DNA, 14 bp, Homo sapiens
acaggctggcgggg

SEQ ID NO: 1746033 - DNA, 14 bp, Homo sapiens
acaggctgtcctta

SEQ ID NO: 1746034 - DNA, 22 bp, Homo sapiens
acaggcttggagggaagggaga

SEQ ID NO: 1746035 - DNA, 20 bp, Homo sapiens
acaggcttttatttccaggt

SEQ ID NO: 1746036 - DNA, 17 bp, Homo sapiens
acagggactttgctggt

SEQ ID NO: 1746037 - DNA, 23 bp, Homo sapiens
acatattgttagggtcagccatt

SEQ ID NO: 1746038 - DNA, 14 bp, Homo sapiens
acatattttaaaat

SEQ ID NO: 1746039 - DNA, 19 bp, Homo sapiens
acatatttttatactttat

SEQ ID NO: 1746040 - DNA, 21 bp, Homo sapiens
acatatttttatactttattg

SEQ ID NO: 1746041 - DNA, 18 bp, Homo sapiens
acatcaaagcctggccta

SEQ ID NO: 1746042 - DNA, 13 bp, Homo sapiens
acatcaaataaga

SEQ ID NO: 1746043 - DNA, 18 bp, Homo sapiens
acatcaacatcttggtca

SEQ ID NO: 1746044 - DNA, 22 bp, Homo sapiens
acatcaagtccatctgacaaaa

SEQ ID NO: 1746045 - DNA, 18 bp, Homo sapiens
acatcacacccatttaaa

SEQ ID NO: 1746046 - DNA, 13 bp, Homo sapiens
acatcacaggaca

SEQ ID NO: 1746047 - DNA, 16 bp, Homo sapiens
acatcacttgtacaaa

SEQ ID NO: 1746048 - DNA, 19 bp, Homo sapiens
acatcacttgtacaaaata

SEQ ID NO: 1746049 - DNA, 17 bp, Homo sapiens
acatcagcaatttcaga

SEQ ID NO: 1746050 - DNA, 17 bp, Homo sapiens
acatcagtgaggaggga

SEQ ID NO: 1746051 - DNA, 15 bp, Homo sapiens
acatcagttactctg

SEQ ID NO: 1746052 - DNA, 18 bp, Homo sapiens
acatcagttactctgaag

SEQ ID NO: 1746053 - DNA, 15 bp, Homo sapiens
acatcataattacat

SEQ ID NO: 1746054 - DNA, 17 bp, Homo sapiens
acatcattccaaaaaga

SEQ ID NO: 1746055 - DNA, 14 bp, Homo sapiens
acatccaagccaga

SEQ ID NO: 1746056 - DNA, 13 bp, Homo sapiens
acatccaaggaga

SEQ ID NO: 1746057 - DNA, 18 bp, Homo sapiens
acatccatcagcacccca

SEQ ID NO: 1746058 - DNA, 14 bp, Homo sapiens
acatcccacagtgg

SEQ ID NO: 1746059 - DNA, 16 bp, Homo sapiens
acatcccactgactgt

SEQ ID NO: 1746060 - DNA, 14 bp, Homo sapiens
acatcccagcctgt

SEQ ID NO: 1746061 - DNA, 17 bp, Homo sapiens
acatcccattgccctgg

SEQ ID NO: 1746062 - DNA, 18 bp, Homo sapiens
acatcccattgccctggt

SEQ ID NO: 1746063 - DNA, 21 bp, Homo sapiens
acatccccagaatccataaat

SEQ ID NO: 1746064 - DNA, 18 bp, Homo sapiens
acatccccagagcccagc

SEQ ID NO: 1746065 - DNA, 20 bp, Homo sapiens
acatccccagagcccagctc

SEQ ID NO: 1746066 - DNA, 15 bp, Homo sapiens
acatcccggcctctt

SEQ ID NO: 1746067 - DNA, 18 bp, Homo sapiens
acatcccttcctggaaac

SEQ ID NO: 1746068 - DNA, 21 bp, Homo sapiens
acatcccttcctggaaacagc

SEQ ID NO: 1746069 - DNA, 17 bp, Homo sapiens
acatccgcgtgtgcctg

SEQ ID NO: 1746070 - DNA, 23 bp, Homo sapiens
acatccgcgtgtgcctgtgtgcg

SEQ ID NO: 1746071 - DNA, 18 bp, Homo sapiens
acatcctaagacagagga

SEQ ID NO: 1746072 - DNA, 14 bp, Homo sapiens
acatcctccgtcca

SEQ ID NO: 1746073 - DNA, 15 bp, Homo sapiens
acatcctcctcccac

SEQ ID NO: 1746074 - DNA, 14 bp, Homo sapiens
acatcctgtgtttc

SEQ ID NO: 1746075 - DNA, 16 bp, Homo sapiens
acatcctgtgtttcta

SEQ ID NO: 1746076 - DNA, 13 bp, Homo sapiens
acatcctttctaa

SEQ ID NO: 1746077 - DNA, 15 bp, Homo sapiens
acatcgcactgtgga

SEQ ID NO: 1746078 - DNA, 14 bp, Homo sapiens
acatcggaaaaata

SEQ ID NO: 1746079 - DNA, 15 bp, Homo sapiens
acatcgtaggcagcc

SEQ ID NO: 1746080 - DNA, 14 bp, Homo sapiens
acatcgtgggtcac

SEQ ID NO: 1746081 - DNA, 18 bp, Homo sapiens
acatctaataagtatata

SEQ ID NO: 1746082 - DNA, 16 bp, Homo sapiens
acatctaattaaatgt

SEQ ID NO: 1746083 - DNA, 13 bp, Homo sapiens
acatctctgcagt

SEQ ID NO: 1746084 - DNA, 18 bp, Homo sapiens
acatctctggcccagaaa

SEQ ID NO: 1746085 - DNA, 22 bp, Homo sapiens
acatctctggcccagaaagcct

SEQ ID NO: 1746086 - DNA, 21 bp, Homo sapiens
acatctcttgaaacctgttaa

SEQ ID NO: 1746087 - DNA, 11 bp, Homo sapiens
acatctgaaaa

SEQ ID NO: 1746088 - DNA, 23 bp, Homo sapiens
acatctgaggttttatttcattt

SEQ ID NO: 1746089 - DNA, 23 bp, Homo sapiens
acatctgccttaaaaccaaagag

SEQ ID NO: 1746090 - DNA, 12 bp, Homo sapiens
acatctggccct

SEQ ID NO: 1746091 - DNA, 13 bp, Homo sapiens
acatctggccctg

SEQ ID NO: 1746092 - DNA, 13 bp, Homo sapiens
acatctgtgtatt

SEQ ID NO: 1746093 - DNA, 16 bp, Homo sapiens
acatctgttttaaatt

SEQ ID NO: 1746094 - DNA, 17 bp, Homo sapiens
acatctttatctgttct

SEQ ID NO: 1746095 - DNA, 16 bp, Homo sapiens
acatctttattgaaat

SEQ ID NO: 1746096 - DNA, 18 bp, Homo sapiens
acatctttattgaaattc

SEQ ID NO: 1746097 - DNA, 18 bp, Homo sapiens
acatctttcctcaagtat

SEQ ID NO: 1746098 - DNA, 14 bp, Homo sapiens
acatcttttcctga

SEQ ID NO: 1746099 - DNA, 21 bp, Homo sapiens
acatcttttcctgatggctgg

SEQ ID NO: 1746100 - DNA, 21 bp, Homo sapiens
acatcttttctaatcacagtg

SEQ ID NO: 1746101 - DNA, 18 bp, Homo sapiens
acatgaaaacaagaaaga

SEQ ID NO: 1746102 - DNA, 23 bp, Homo sapiens
acatgaaacctacacactgtcat

SEQ ID NO: 1746103 - DNA, 24 bp, Homo sapiens
acatgaaacggaggcagatggaga

SEQ ID NO: 1746104 - DNA, 21 bp, Homo sapiens
acatgaagcaattagtctgaa

SEQ ID NO: 1746105 - DNA, 23 bp, Homo sapiens
acatgaagcaattagtctgaaac

SEQ ID NO: 1746106 - DNA, 11 bp, Homo sapiens
acatgaaggaa

SEQ ID NO: 1746107 - DNA, 22 bp, Homo sapiens
acatgaaggtaaataaaaagaa

SEQ ID NO: 1746108 - DNA, 18 bp, Homo sapiens
acatgaattgcattttac

SEQ ID NO: 1746109 - DNA, 13 bp, Homo sapiens
acatgacactgac

SEQ ID NO: 1746110 - DNA, 14 bp, Homo sapiens
acatgacactgacc

SEQ ID NO: 1746111 - DNA, 16 bp, Homo sapiens
acatgacactgacctt

SEQ ID NO: 1746112 - DNA, 17 bp, Homo sapiens
acatgacattcttagct

SEQ ID NO: 1746113 - DNA, 16 bp, Homo sapiens
acatgacccagcctga

SEQ ID NO: 1746114 - DNA, 13 bp, Homo sapiens
acatgacctccat

SEQ ID NO: 1746115 - DNA, 18 bp, Homo sapiens
acatgagatgtgtggact

SEQ ID NO: 1746116 - DNA, 20 bp, Homo sapiens
acatgagatgtgtggactgt

SEQ ID NO: 1746117 - DNA, 12 bp, Homo sapiens
acatgagccagt

SEQ ID NO: 1746118 - DNA, 19 bp, Homo sapiens
acatgaggccatctcagga

SEQ ID NO: 1746119 - DNA, 18 bp, Homo sapiens
acatgagtcaaaacaaag

SEQ ID NO: 1746120 - DNA, 19 bp, Homo sapiens
acatgatgaaaaattatag

SEQ ID NO: 1746121 - DNA, 13 bp, Homo sapiens
acatgatggggaa

SEQ ID NO: 1746122 - DNA, 14 bp, Homo sapiens
acatgcaataaaat

SEQ ID NO: 1746123 - DNA, 18 bp, Homo sapiens
acatgcaataaaatttaa

SEQ ID NO: 1746124 - DNA, 15 bp, Homo sapiens
acatgcacacacttg

SEQ ID NO: 1746125 - DNA, 15 bp, Homo sapiens
acatgcacactcatg

SEQ ID NO: 1746126 - DNA, 19 bp, Homo sapiens
acatgcacatttatatata

SEQ ID NO: 1746127 - DNA, 15 bp, Homo sapiens
acatgcacattttgt

SEQ ID NO: 1746128 - DNA, 12 bp, Homo sapiens
acatgcactgac

SEQ ID NO: 1746129 - DNA, 14 bp, Homo sapiens
acatgcactgaccc

SEQ ID NO: 1746130 - DNA, 18 bp, Homo sapiens
acatgcactgacccttcc

SEQ ID NO: 1746131 - DNA, 15 bp, Homo sapiens
acatgcagcccatgc

SEQ ID NO: 1746132 - DNA, 21 bp, Homo sapiens
acatgcatttgaggtcaagta

SEQ ID NO: 1746133 - DNA, 15 bp, Homo sapiens
acatgccacctggca

SEQ ID NO: 1746134 - DNA, 17 bp, Homo sapiens
acatgccctgtgtggct

SEQ ID NO: 1746135 - DNA, 21 bp, Homo sapiens
acatgccgcgggcggccaggc

SEQ ID NO: 1746136 - DNA, 22 bp, Homo sapiens
acatgccgcgggcggccaggca

SEQ ID NO: 1746137 - DNA, 20 bp, Homo sapiens
acatgccgcgtccctgcccc

SEQ ID NO: 1746138 - DNA, 15 bp, Homo sapiens
acatgcctgccccaa

SEQ ID NO: 1746139 - DNA, 14 bp, Homo sapiens
acatgcgaccccga

SEQ ID NO: 1746140 - DNA, 17 bp, Homo sapiens
acatgcgggctcgccca

SEQ ID NO: 1746141 - DNA, 15 bp, Homo sapiens
acatgctatgttctg

SEQ ID NO: 1746142 - DNA, 22 bp, Homo sapiens
acatgctatgttctgtcttccc

SEQ ID NO: 1746143 - DNA, 15 bp, Homo sapiens
acatgctcacacatt

SEQ ID NO: 1746144 - DNA, 16 bp, Homo sapiens
acatgctccagattag

SEQ ID NO: 1746145 - DNA, 21 bp, Homo sapiens
acatgctgtatatgcaatgtc

SEQ ID NO: 1746146 - DNA, 14 bp, Homo sapiens
acatgctgtctggc

SEQ ID NO: 1746147 - DNA, 18 bp, Homo sapiens
acatgctgtctggccctg

SEQ ID NO: 1746148 - DNA, 14 bp, Homo sapiens
acatgcttgaataa

SEQ ID NO: 1746149 - DNA, 15 bp, Homo sapiens
acatgcttttacttt

SEQ ID NO: 1746150 - DNA, 18 bp, Homo sapiens
acatgcttttactttatt

SEQ ID NO: 1746151 - DNA, 20 bp, Homo sapiens
acatggaataacatgtaatt

SEQ ID NO: 1746152 - DNA, 20 bp, Homo sapiens
acatttttatacctgtttaa

SEQ ID NO: 1746153 - DNA, 21 bp, Homo sapiens
acatttttatacctgtttaaa

SEQ ID NO: 1746154 - DNA, 21 bp, Homo sapiens
acatttttatttagttgaaaa

SEQ ID NO: 1746155 - DNA, 16 bp, Homo sapiens
acattttttaactttc

SEQ ID NO: 1746156 - DNA, 17 bp, Homo sapiens
acattttttaactttct

SEQ ID NO: 1746157 - DNA, 17 bp, Homo sapiens
acattttttaagaaaac

SEQ ID NO: 1746158 - DNA, 19 bp, Homo sapiens
acattttttagtctgtaat

SEQ ID NO: 1746159 - DNA, 14 bp, Homo sapiens
acattttttcttct

SEQ ID NO: 1746160 - DNA, 21 bp, Homo sapiens
acattttttcttctgaagatt

SEQ ID NO: 1746161 - DNA, 14 bp, Homo sapiens
acattttttgaaat

SEQ ID NO: 1746162 - DNA, 20 bp, Homo sapiens
acattttttgaaatgctgaa

SEQ ID NO: 1746163 - DNA, 14 bp, Homo sapiens
acattttttgctat

SEQ ID NO: 1746164 - DNA, 22 bp, Homo sapiens
acatttttttatgctcttgaaa

SEQ ID NO: 1746165 - DNA, 23 bp, Homo sapiens
acatttttttgcatgcatgcaaa

SEQ ID NO: 1746166 - DNA, 19 bp, Homo sapiens
acatttttttttctccata

SEQ ID NO: 1746167 - DNA, 22 bp, Homo sapiens
accaaaaaccatgttgcgttca

SEQ ID NO: 1746168 - DNA, 14 bp, Homo sapiens
accaaaaatagaaa

SEQ ID NO: 1746169 - DNA, 14 bp, Homo sapiens
accaaaactgctcc

SEQ ID NO: 1746170 - DNA, 17 bp, Homo sapiens
accaaaactgtgcagag

SEQ ID NO: 1746171 - DNA, 22 bp, Homo sapiens
accaaaagttattaaaattgtt

SEQ ID NO: 1746172 - DNA, 16 bp, Homo sapiens
accaaaatgacaatga

SEQ ID NO: 1746173 - DNA, 18 bp, Homo sapiens
accaaaattttaaaaaag

SEQ ID NO: 1746174 - DNA, 23 bp, Homo sapiens
accaaaccgccagcgaacttgac

SEQ ID NO: 1746175 - DNA, 13 bp, Homo sapiens
accaaagaagagt

SEQ ID NO: 1746176 - DNA, 16 bp, Homo sapiens
accaaagaagagttta

SEQ ID NO: 1746177 - DNA, 17 bp, Homo sapiens
accaaagacatcagtct

SEQ ID NO: 1746178 - DNA, 18 bp, Homo sapiens
accaaagactgcagaacc

SEQ ID NO: 1746179 - DNA, 15 bp, Homo sapiens
accaaagagggcttc

SEQ ID NO: 1746180 - DNA, 20 bp, Homo sapiens
accaaagcaccttagctggc

SEQ ID NO: 1746181 - DNA, 14 bp, Homo sapiens
accaaagctgccca

SEQ ID NO: 1746182 - DNA, 18 bp, Homo sapiens
accaaagtatttttttat

SEQ ID NO: 1746183 - DNA, 23 bp, Homo sapiens
accaaagtgtcttttgacatttt

SEQ ID NO: 1746184 - DNA, 15 bp, Homo sapiens
accaaagttctaata

SEQ ID NO: 1746185 - DNA, 18 bp, Homo sapiens
accaaataaaaatattgt

SEQ ID NO: 1746186 - DNA, 13 bp, Homo sapiens
accaaataagact

SEQ ID NO: 1746187 - DNA, 16 bp, Homo sapiens
accaaatagtgtgaaa

SEQ ID NO: 1746188 - DNA, 13 bp, Homo sapiens
accaaatctcagt

SEQ ID NO: 1746189 - DNA, 13 bp, Homo sapiens
accaaatctggaa

SEQ ID NO: 1746190 - DNA, 15 bp, Homo sapiens
accaaatgatgccac

SEQ ID NO: 1746191 - DNA, 19 bp, Homo sapiens
accaacacgagcaggctac

SEQ ID NO: 1746192 - DNA, 17 bp, Homo sapiens
accaacagaaacctttt

SEQ ID NO: 1746193 - DNA, 21 bp, Homo sapiens
accaacagaaaccttttattt

SEQ ID NO: 1746194 - DNA, 22 bp, Homo sapiens
accaacaggctgttctgcactg

SEQ ID NO: 1746195 - DNA, 21 bp, Homo sapiens
accaacatcccattgccctgg

SEQ ID NO: 1746196 - DNA, 23 bp, Homo sapiens
accaacatggagaaaccctgtct

SEQ ID NO: 1746197 - DNA, 14 bp, Homo sapiens
accaaccaggcctt

SEQ ID NO: 1746198 - DNA, 15 bp, Homo sapiens
accaaccctcagagc

SEQ ID NO: 1746199 - DNA, 13 bp, Homo sapiens
accaacctgacca

SEQ ID NO: 1746200 - DNA, 20 bp, Homo sapiens
accaactgccctaagccccc

SEQ ID NO: 1746201 - DNA, 13 bp, Homo sapiens
accaacttgccac

SEQ ID NO: 1746202 - DNA, 20 bp, Homo sapiens
accaacttggttctgcttca

SEQ ID NO: 1746203 - DNA, 14 bp, Homo sapiens
accaagaaagcagg

SEQ ID NO: 1746204 - DNA, 15 bp, Homo sapiens
accaagaactgaagg

SEQ ID NO: 1746205 - DNA, 14 bp, Homo sapiens
accaagaactgcat

SEQ ID NO: 1746206 - DNA, 21 bp, Homo sapiens
accaagacaggttcaggtagg

SEQ ID NO: 1746207 - DNA, 23 bp, Homo sapiens
accaagacttttgtctgatcaag

SEQ ID NO: 1746208 - DNA, 13 bp, Homo sapiens
accaagagagaaa

SEQ ID NO: 1746209 - DNA, 19 bp, Homo sapiens
accaagctcacagttcctc

SEQ ID NO: 1746210 - DNA, 14 bp, Homo sapiens
accaagctctctgc

SEQ ID NO: 1746211 - DNA, 17 bp, Homo sapiens
accaagctgagtttcct

SEQ ID NO: 1746212 - DNA, 19 bp, Homo sapiens
accaagctgagtttcctat

SEQ ID NO: 1746213 - DNA, 13 bp, Homo sapiens
accaagcttcaga

SEQ ID NO: 1746214 - DNA, 20 bp, Homo sapiens
accaagcttcagagcctagc

SEQ ID NO: 1746215 - DNA, 24 bp, Homo sapiens
accaagcttcagagcctagccacc

SEQ ID NO: 1746216 - DNA, 11 bp, Homo sapiens
accaaggaaac

SEQ ID NO: 1746217 - DNA, 22 bp, Homo sapiens
accaaggatgaattctttcaat

SEQ ID NO: 1746218 - DNA, 20 bp, Homo sapiens
accaaggcaaggcaggtgcc

SEQ ID NO: 1746219 - DNA, 20 bp, Homo sapiens
accaaggcagcctccagagc

SEQ ID NO: 1746220 - DNA, 23 bp, Homo sapiens
accaaggcagcctccagagccag

SEQ ID NO: 1746221 - DNA, 24 bp, Homo sapiens
accaaggcagcctccagagccagc

SEQ ID NO: 1746222 - DNA, 19 bp, Homo sapiens
accaaggggtggccgggca

SEQ ID NO: 1746223 - DNA, 17 bp, Homo sapiens
accaagggtatctgctg

SEQ ID NO: 1746224 - DNA, 20 bp, Homo sapiens
accaaggtaccgatttctgc

SEQ ID NO: 1746225 - DNA, 22 bp, Homo sapiens
accaaggtttatgccaccaggt

SEQ ID NO: 1746226 - DNA, 12 bp, Homo sapiens
accaagtcacac

SEQ ID NO: 1746227 - DNA, 20 bp, Homo sapiens
accaagtccccttctgtgtt

SEQ ID NO: 1746228 - DNA, 13 bp, Homo sapiens
accaagtcctggc

SEQ ID NO: 1746229 - DNA, 21 bp, Homo sapiens
accaagttgtgcttttctgtt

SEQ ID NO: 1746230 - DNA, 12 bp, Homo sapiens
accaataaagtg

SEQ ID NO: 1746231 - DNA, 17 bp, Homo sapiens
accaataaagtgaccct

SEQ ID NO: 1746232 - DNA, 13 bp, Homo sapiens
accaatacatttg

SEQ ID NO: 1746233 - DNA, 15 bp, Homo sapiens
accaatacatttgta

SEQ ID NO: 1746234 - DNA, 17 bp, Homo sapiens
accaatacatttgtatt

SEQ ID NO: 1746235 - DNA, 22 bp, Homo sapiens
accaatattaacacgctgcctg

SEQ ID NO: 1746236 - DNA, 20 bp, Homo sapiens
accaatcaacagcatgtcta

SEQ ID NO: 1746237 - DNA, 15 bp, Homo sapiens
accaatctctaagcc

SEQ ID NO: 1746238 - DNA, 22 bp, Homo sapiens
accaatgaaaacatgtactaca

SEQ ID NO: 1746239 - DNA, 12 bp, Homo sapiens
accaatgaagaa

SEQ ID NO: 1746240 - DNA, 16 bp, Homo sapiens
accaatgcctttttag

SEQ ID NO: 1746241 - DNA, 13 bp, Homo sapiens
accaattacccat

SEQ ID NO: 1746242 - DNA, 22 bp, Homo sapiens
accaattgactctcacactgaa

SEQ ID NO: 1746243 - DNA, 18 bp, Homo sapiens
accaattgtcaaattacc

SEQ ID NO: 1746244 - DNA, 17 bp, Homo sapiens
accaattgtgctgccat

SEQ ID NO: 1746245 - DNA, 21 bp, Homo sapiens
accaatttggtaaaaatgctg

SEQ ID NO: 1746246 - DNA, 20 bp, Homo sapiens
accacaaacggagcccctga

SEQ ID NO: 1746247 - DNA, 13 bp, Homo sapiens
accacaactgaca

SEQ ID NO: 1746248 - DNA, 19 bp, Homo sapiens
accacaactgacacaggaa

SEQ ID NO: 1746249 - DNA, 15 bp, Homo sapiens
accacaagcctgaga

SEQ ID NO: 1746250 - DNA, 12 bp, Homo sapiens
accacaaggaaa

SEQ ID NO: 1746251 - DNA, 18 bp, Homo sapiens
accacaatgtttcttcat

SEQ ID NO: 1746252 - DNA, 11 bp, Homo sapiens
accacacaaag

SEQ ID NO: 1746253 - DNA, 18 bp, Homo sapiens
accacacccggctaattt

SEQ ID NO: 1746254 - DNA, 16 bp, Homo sapiens
accacaccgcagaagc

SEQ ID NO: 1746255 - DNA, 22 bp, Homo sapiens
accacactgggtgcgtctccag

SEQ ID NO: 1746256 - DNA, 15 bp, Homo sapiens
accacagacttgcac

SEQ ID NO: 1746257 - DNA, 15 bp, Homo sapiens
accacagagctgtca

SEQ ID NO: 1746258 - DNA, 11 bp, Homo sapiens
accacagcagc

SEQ ID NO: 1746259 - DNA, 12 bp, Homo sapiens
accacagcatcg

SEQ ID NO: 1746260 - DNA, 17 bp, Homo sapiens
accacagccagcacctg

SEQ ID NO: 1746261 - DNA, 19 bp, Homo sapiens
accacagccagcacctggc

SEQ ID NO: 1746262 - DNA, 20 bp, Homo sapiens
accacagcccgctctctggc

SEQ ID NO: 1746263 - DNA, 23 bp, Homo sapiens
accacagggttcaaaatgtctgt

SEQ ID NO: 1746264 - DNA, 10 bp, Homo sapiens
accacagtca

SEQ ID NO: 1746265 - DNA, 14 bp, Homo sapiens
accacatcctccgt

SEQ ID NO: 1746266 - DNA, 22 bp, Homo sapiens
accacatcctccgtccagccgc

SEQ ID NO: 1746267 - DNA, 19 bp, Homo sapiens
accatccccagctggtggc

SEQ ID NO: 1746268 - DNA, 12 bp, Homo sapiens
accatcctgagc

SEQ ID NO: 1746269 - DNA, 17 bp, Homo sapiens
accatcctgcagcctcc

SEQ ID NO: 1746270 - DNA, 17 bp, Homo sapiens
accatcctggcccctcc

SEQ ID NO: 1746271 - DNA, 12 bp, Homo sapiens
accatcctggct

SEQ ID NO: 1746272 - DNA, 13 bp, Homo sapiens
accatcctggcta

SEQ ID NO: 1746273 - DNA, 20 bp, Homo sapiens
accatcctggctaacacggt

SEQ ID NO: 1746274 - DNA, 16 bp, Homo sapiens
accatctgatgtttca

SEQ ID NO: 1746275 - DNA, 13 bp, Homo sapiens
accatctgcatgg

SEQ ID NO: 1746276 - DNA, 13 bp, Homo sapiens
accatctgctgcc

SEQ ID NO: 1746277 - DNA, 14 bp, Homo sapiens
accatctgctgccc

SEQ ID NO: 1746278 - DNA, 19 bp, Homo sapiens
accatctgtcttgccagcc

SEQ ID NO: 1746279 - DNA, 21 bp, Homo sapiens
accatctgtcttgccagccag

SEQ ID NO: 1746280 - DNA, 21 bp, Homo sapiens
accatctgtgactataaagct

SEQ ID NO: 1746281 - DNA, 22 bp, Homo sapiens
accatctgtgactataaagctg

SEQ ID NO: 1746282 - DNA, 18 bp, Homo sapiens
accatgaacagaaaacat

SEQ ID NO: 1746283 - DNA, 20 bp, Homo sapiens
accatgaagtaaattatgta

SEQ ID NO: 1746284 - DNA, 20 bp, Homo sapiens
accatgaatatttatttaaa

SEQ ID NO: 1746285 - DNA, 18 bp, Homo sapiens
accatgagaagagggcct

SEQ ID NO: 1746286 - DNA, 12 bp, Homo sapiens
accatgcactca

SEQ ID NO: 1746287 - DNA, 19 bp, Homo sapiens
accatgcctggtattttca

SEQ ID NO: 1746288 - DNA, 17 bp, Homo sapiens
accatgcgtcaggggcc

SEQ ID NO: 1746289 - DNA, 18 bp, Homo sapiens
accatgctgctggggaag

SEQ ID NO: 1746290 - DNA, 19 bp, Homo sapiens
accatgctgctggggaaga

SEQ ID NO: 1746291 - DNA, 12 bp, Homo sapiens
accatgctgctt

SEQ ID NO: 1746292 - DNA, 21 bp, Homo sapiens
accatgctgctttttggcaca

SEQ ID NO: 1746293 - DNA, 17 bp, Homo sapiens
accatggagatgaaatg

SEQ ID NO: 1746294 - DNA, 20 bp, Homo sapiens
accatggagatgaaatgcct

SEQ ID NO: 1746295 - DNA, 14 bp, Homo sapiens
accatgggccaaga

SEQ ID NO: 1746296 - DNA, 15 bp, Homo sapiens
accatggtttgatat

SEQ ID NO: 1746297 - DNA, 16 bp, Homo sapiens
accatgtcatcttttt

SEQ ID NO: 1746298 - DNA, 15 bp, Homo sapiens
accatgtcatttcag

SEQ ID NO: 1746299 - DNA, 19 bp, Homo sapiens
accatgtgagctcttccta

SEQ ID NO: 1746300 - DNA, 15 bp, Homo sapiens
accatgttgcccagg

SEQ ID NO: 1746301 - DNA, 20 bp, Homo sapiens
accattaaaactgctttttt

SEQ ID NO: 1746302 - DNA, 13 bp, Homo sapiens
accattaattaca

SEQ ID NO: 1746303 - DNA, 14 bp, Homo sapiens
accattaattacat

SEQ ID NO: 1746304 - DNA, 22 bp, Homo sapiens
accattaattacatacagattt

SEQ ID NO: 1746305 - DNA, 21 bp, Homo sapiens
accattagataaacacaggca

SEQ ID NO: 1746306 - DNA, 14 bp, Homo sapiens
accattcaattagt

SEQ ID NO: 1746307 - DNA, 22 bp, Homo sapiens
accattcacatttgatgtacat

SEQ ID NO: 1746308 - DNA, 23 bp, Homo sapiens
accattcagatcactgaatttat

SEQ ID NO: 1746309 - DNA, 19 bp, Homo sapiens
accattcctgcctttaagc

SEQ ID NO: 1746310 - DNA, 13 bp, Homo sapiens
accattctcaccc

SEQ ID NO: 1746311 - DNA, 13 bp, Homo sapiens
accattctcctgc

SEQ ID NO: 1746312 - DNA, 14 bp, Homo sapiens
accattctcctgcc

SEQ ID NO: 1746313 - DNA, 13 bp, Homo sapiens
accattctgactc

SEQ ID NO: 1746314 - DNA, 21 bp, Homo sapiens
accattctgactcggtttctc

SEQ ID NO: 1746315 - DNA, 18 bp, Homo sapiens
accattgaaggaaagcta

SEQ ID NO: 1746316 - DNA, 23 bp, Homo sapiens
accattgaaggaaagctatatct

SEQ ID NO: 1746317 - DNA, 18 bp, Homo sapiens
accattgacctcagctgc

SEQ ID NO: 1746318 - DNA, 19 bp, Homo sapiens
accattgacctcagctgca

SEQ ID NO: 1746319 - DNA, 22 bp, Homo sapiens
accattgacctcagctgcacat

SEQ ID NO: 1746320 - DNA, 24 bp, Homo sapiens
accattgacctcagctgcacattc

SEQ ID NO: 1746321 - DNA, 15 bp, Homo sapiens
accattgcaacaaaa

SEQ ID NO: 1746322 - DNA, 12 bp, Homo sapiens
accatttataat

SEQ ID NO: 1746323 - DNA, 20 bp, Homo sapiens
accatttcagagaggccttt

SEQ ID NO: 1746324 - DNA, 16 bp, Homo sapiens
accatttcttggcatt

SEQ ID NO: 1746325 - DNA, 20 bp, Homo sapiens
accatttcttggcattggaa

SEQ ID NO: 1746326 - DNA, 22 bp, Homo sapiens
accattttaacctagatgttta

SEQ ID NO: 1746327 - DNA, 23 bp, Homo sapiens
accattttcccatcatcctttgt

SEQ ID NO: 1746328 - DNA, 23 bp, Homo sapiens
accattttgttattgactaacag

SEQ ID NO: 1746329 - DNA, 22 bp, Homo sapiens
accatttttaaagtagaagagg

SEQ ID NO: 1746330 - DNA, 19 bp, Homo sapiens
accatttttgctgaattca

SEQ ID NO: 1746331 - DNA, 18 bp, Homo sapiens
acccaaaaccctgaagcc

SEQ ID NO: 1746332 - DNA, 19 bp, Homo sapiens
acccaaaaccctgaagcca

SEQ ID NO: 1746333 - DNA, 23 bp, Homo sapiens
acccaaaagtcaaaaggtgcctg

SEQ ID NO: 1746334 - DNA, 14 bp, Homo sapiens
acccaaacccccaa

SEQ ID NO: 1746335 - DNA, 16 bp, Homo sapiens
acccaaagcatggact

SEQ ID NO: 1746336 - DNA, 19 bp, Homo sapiens
acccaaatgtgtacacctg

SEQ ID NO: 1746337 - DNA, 20 bp, Homo sapiens
acccaaattgagtttaacaa

SEQ ID NO: 1746338 - DNA, 19 bp, Homo sapiens
acccaactgatcctgctcc

SEQ ID NO: 1746339 - DNA, 20 bp, Homo sapiens
acccaagataaaagaatggc

SEQ ID NO: 1746340 - DNA, 22 bp, Homo sapiens
acccaagcctcatattttctgt

SEQ ID NO: 1746341 - DNA, 19 bp, Homo sapiens
acccaagcctgctggctgc

SEQ ID NO: 1746342 - DNA, 15 bp, Homo sapiens
acccaaggaggaaaa

SEQ ID NO: 1746343 - DNA, 18 bp, Homo sapiens
acccaagtggggcctcct

SEQ ID NO: 1746344 - DNA, 16 bp, Homo sapiens
acccaagtgggggcag

SEQ ID NO: 1746345 - DNA, 23 bp, Homo sapiens
acccaattggcccaacactgtct

SEQ ID NO: 1746346 - DNA, 22 bp, Homo sapiens
acccaattttaaaaaataacat

SEQ ID NO: 1746347 - DNA, 16 bp, Homo sapiens
acccacacagctgccc

SEQ ID NO: 1746348 - DNA, 18 bp, Homo sapiens
acccacacagctgcccta

SEQ ID NO: 1746349 - DNA, 20 bp, Homo sapiens
acccacacagctgccctagc

SEQ ID NO: 1746350 - DNA, 11 bp, Homo sapiens
acccacactgc

SEQ ID NO: 1746351 - DNA, 15 bp, Homo sapiens
acccacagccataga

SEQ ID NO: 1746352 - DNA, 11 bp, Homo sapiens
acccacagctc

SEQ ID NO: 1746353 - DNA, 15 bp, Homo sapiens
acccacagctcagct

SEQ ID NO: 1746354 - DNA, 13 bp, Homo sapiens
acccacagggcta

SEQ ID NO: 1746355 - DNA, 23 bp, Homo sapiens
acccacataaaagccccagcttg

SEQ ID NO: 1746356 - DNA, 14 bp, Homo sapiens
acccacatgctcca

SEQ ID NO: 1746357 - DNA, 12 bp, Homo sapiens
acccaccagcct

SEQ ID NO: 1746358 - DNA, 15 bp, Homo sapiens
acccaccagcctaag

SEQ ID NO: 1746359 - DNA, 21 bp, Homo sapiens
acccaccagcctaagaagctc

SEQ ID NO: 1746360 - DNA, 14 bp, Homo sapiens
acccaccagtgcct

SEQ ID NO: 1746361 - DNA, 15 bp, Homo sapiens
acccaccagtgcctt

SEQ ID NO: 1746362 - DNA, 12 bp, Homo sapiens
acccacccagaa

SEQ ID NO: 1746363 - DNA, 22 bp, Homo sapiens
acccacccatcttcctgctgct

SEQ ID NO: 1746364 - DNA, 15 bp, Homo sapiens
acccaccccacacct

SEQ ID NO: 1746365 - DNA, 22 bp, Homo sapiens
acccaccccacacctgcagtgc

SEQ ID NO: 1746366 - DNA, 16 bp, Homo sapiens
acccaccccctttggt

SEQ ID NO: 1746367 - DNA, 15 bp, Homo sapiens
acccacccctgccca

SEQ ID NO: 1746368 - DNA, 12 bp, Homo sapiens
acccacccctgt

SEQ ID NO: 1746369 - DNA, 13 bp, Homo sapiens
acccacccctgtg

SEQ ID NO: 1746370 - DNA, 14 bp, Homo sapiens
acccacccctgtgc

SEQ ID NO: 1746371 - DNA, 15 bp, Homo sapiens
acccacccctgtgct

SEQ ID NO: 1746372 - DNA, 13 bp, Homo sapiens
acccacctagaac

SEQ ID NO: 1746373 - DNA, 12 bp, Homo sapiens
acccacctccac

SEQ ID NO: 1746374 - DNA, 16 bp, Homo sapiens
acccacctccaccccc

SEQ ID NO: 1746375 - DNA, 11 bp, Homo sapiens
acccacctccc

SEQ ID NO: 1746376 - DNA, 18 bp, Homo sapiens
acccacctccccctcccc

SEQ ID NO: 1746377 - DNA, 21 bp, Homo sapiens
acccacctccccctccccggc

SEQ ID NO: 1746378 - DNA, 20 bp, Homo sapiens
acccacctggtactgaccca

SEQ ID NO: 1746379 - DNA, 16 bp, Homo sapiens
acccacctgttttctg

SEQ ID NO: 1746380 - DNA, 22 bp, Homo sapiens
acccaccttgttggagcctgca

SEQ ID NO: 1746381 - DNA, 21 bp, Homo sapiens
acccacctttgccacaaagct

SEQ ID NO: 1746382 - DNA, 14 bp, Homo sapiens
accccttagcctcc

SEQ ID NO: 1746383 - DNA, 20 bp, Homo sapiens
accccttattaaggccccag

SEQ ID NO: 1746384 - DNA, 21 bp, Homo sapiens
accccttccagatcactgcca

SEQ ID NO: 1746385 - DNA, 20 bp, Homo sapiens
accccttccccaggcccacc

SEQ ID NO: 1746386 - DNA, 18 bp, Homo sapiens
accccttggaaatgtctg

SEQ ID NO: 1746387 - DNA, 21 bp, Homo sapiens
accccttggaaatgtctgctg

SEQ ID NO: 1746388 - DNA, 20 bp, Homo sapiens
accccttggaggagagagac

SEQ ID NO: 1746389 - DNA, 14 bp, Homo sapiens
accccttgtttctg

SEQ ID NO: 1746390 - DNA, 17 bp, Homo sapiens
acccctttctggctctc

SEQ ID NO: 1746391 - DNA, 23 bp, Homo sapiens
acccgaccccccgtgggctcccg

SEQ ID NO: 1746392 - DNA, 22 bp, Homo sapiens
acccgagcccagctacattcct

SEQ ID NO: 1746393 - DNA, 14 bp, Homo sapiens
acccgaggcccgca

SEQ ID NO: 1746394 - DNA, 23 bp, Homo sapiens
acccgagttcctctgggtttcta

SEQ ID NO: 1746395 - DNA, 12 bp, Homo sapiens
acccgatgctgc

SEQ ID NO: 1746396 - DNA, 23 bp, Homo sapiens
acccgatgctgctttcccctgtg

SEQ ID NO: 1746397 - DNA, 12 bp, Homo sapiens
acccgccagccc

SEQ ID NO: 1746398 - DNA, 16 bp, Homo sapiens
acccgccagccccgct

SEQ ID NO: 1746399 - DNA, 21 bp, Homo sapiens
acccgcctcgacctccccacc

SEQ ID NO: 1746400 - DNA, 23 bp, Homo sapiens
acccgcctctcccgtcagggccc

SEQ ID NO: 1746401 - DNA, 24 bp, Homo sapiens
acccgcctctcccgtcagggccca

SEQ ID NO: 1746402 - DNA, 16 bp, Homo sapiens
acccgctttcttgctg

SEQ ID NO: 1746403 - DNA, 18 bp, Homo sapiens
acccggaggggcctggca

SEQ ID NO: 1746404 - DNA, 14 bp, Homo sapiens
acccggccacagct

SEQ ID NO: 1746405 - DNA, 15 bp, Homo sapiens
acccggcggccctgc

SEQ ID NO: 1746406 - DNA, 13 bp, Homo sapiens
acccggctaattt

SEQ ID NO: 1746407 - DNA, 21 bp, Homo sapiens
acccgggaccacagctgctgg

SEQ ID NO: 1746408 - DNA, 13 bp, Homo sapiens
acccgggggagcc

SEQ ID NO: 1746409 - DNA, 16 bp, Homo sapiens
acccgggggagcccag

SEQ ID NO: 1746410 - DNA, 17 bp, Homo sapiens
acccgggggagcccagt

SEQ ID NO: 1746411 - DNA, 20 bp, Homo sapiens
acccgggggagcccagtgaa

SEQ ID NO: 1746412 - DNA, 19 bp, Homo sapiens
acccggggtctcctggacc

SEQ ID NO: 1746413 - DNA, 20 bp, Homo sapiens
acccgggtctggtgctgagg

SEQ ID NO: 1746414 - DNA, 17 bp, Homo sapiens
acccggtgctccctctg

SEQ ID NO: 1746415 - DNA, 18 bp, Homo sapiens
acccggtgctccctctgt

SEQ ID NO: 1746416 - DNA, 21 bp, Homo sapiens
acccgtaggcagcctctctgc

SEQ ID NO: 1746417 - DNA, 19 bp, Homo sapiens
acccgtcttcaatctctgt

SEQ ID NO: 1746418 - DNA, 18 bp, Homo sapiens
acccgttctgctggcctg

SEQ ID NO: 1746419 - DNA, 20 bp, Homo sapiens
acccgtttcccggttcagga

SEQ ID NO: 1746420 - DNA, 18 bp, Homo sapiens
accctaaaaagagaagaa

SEQ ID NO: 1746421 - DNA, 15 bp, Homo sapiens
accctaaatctgagg

SEQ ID NO: 1746422 - DNA, 13 bp, Homo sapiens
accctaaccaagt

SEQ ID NO: 1746423 - DNA, 16 bp, Homo sapiens
accctacataaggctg

SEQ ID NO: 1746424 - DNA, 16 bp, Homo sapiens
accctaccctggcagg

SEQ ID NO: 1746425 - DNA, 13 bp, Homo sapiens
accctacctgtgc

SEQ ID NO: 1746426 - DNA, 16 bp, Homo sapiens
accctacctgtgcctg

SEQ ID NO: 1746427 - DNA, 19 bp, Homo sapiens
accctactgaagtggctgg

SEQ ID NO: 1746428 - DNA, 19 bp, Homo sapiens
accctagccaatgtctcct

SEQ ID NO: 1746429 - DNA, 19 bp, Homo sapiens
accctagccattcctggta

SEQ ID NO: 1746430 - DNA, 17 bp, Homo sapiens
accctagccttgcttgt

SEQ ID NO: 1746431 - DNA, 15 bp, Homo sapiens
accctagctgtgtca

SEQ ID NO: 1746432 - DNA, 22 bp, Homo sapiens
accctagtcccttcccctccct

SEQ ID NO: 1746433 - DNA, 16 bp, Homo sapiens
accctagtttccctga

SEQ ID NO: 1746434 - DNA, 15 bp, Homo sapiens
accctatctcctgac

SEQ ID NO: 1746435 - DNA, 23 bp, Homo sapiens
accctatcttctcattgtttgtt

SEQ ID NO: 1746436 - DNA, 16 bp, Homo sapiens
accctatgggtctagg

SEQ ID NO: 1746437 - DNA, 19 bp, Homo sapiens
accctatgggtctaggaca

SEQ ID NO: 1746438 - DNA, 23 bp, Homo sapiens
accctatgggtctaggacacagt

SEQ ID NO: 1746439 - DNA, 19 bp, Homo sapiens
accctattctatccatctc

SEQ ID NO: 1746440 - DNA, 21 bp, Homo sapiens
accctattctatccatctcct

SEQ ID NO: 1746441 - DNA, 22 bp, Homo sapiens
accctattctatccatctcctg

SEQ ID NO: 1746442 - DNA, 15 bp, Homo sapiens
accctatttaaaact

SEQ ID NO: 1746443 - DNA, 19 bp, Homo sapiens
accctcagcaccccttcca

SEQ ID NO: 1746444 - DNA, 22 bp, Homo sapiens
accctcagcaccccttccatgt

SEQ ID NO: 1746445 - DNA, 14 bp, Homo sapiens
accctcagccttga

SEQ ID NO: 1746446 - DNA, 23 bp, Homo sapiens
accctcaggcataggcctgggtg

SEQ ID NO: 1746447 - DNA, 19 bp, Homo sapiens
accctcatggcccccaggg

SEQ ID NO: 1746448 - DNA, 17 bp, Homo sapiens
accctcattgtgtttct

SEQ ID NO: 1746449 - DNA, 13 bp, Homo sapiens
accctccaccctg

SEQ ID NO: 1746450 - DNA, 15 bp, Homo sapiens
accctccaccctgtc

SEQ ID NO: 1746451 - DNA, 12 bp, Homo sapiens
accctccacctt

SEQ ID NO: 1746452 - DNA, 16 bp, Homo sapiens
accctccacttcccgt

SEQ ID NO: 1746453 - DNA, 20 bp, Homo sapiens
accctccagtgctggatttg

SEQ ID NO: 1746454 - DNA, 18 bp, Homo sapiens
accctcccaccactcccc

SEQ ID NO: 1746455 - DNA, 23 bp, Homo sapiens
accctcccacccccttctctgct

SEQ ID NO: 1746456 - DNA, 21 bp, Homo sapiens
accctccccacagtgccaccc

SEQ ID NO: 1746457 - DNA, 22 bp, Homo sapiens
accctccccacagtgccaccca

SEQ ID NO: 1746458 - DNA, 12 bp, Homo sapiens
accctcccctct

SEQ ID NO: 1746459 - DNA, 18 bp, Homo sapiens
accctcccctctcttgca

SEQ ID NO: 1746460 - DNA, 19 bp, Homo sapiens
accctccccttttttcttc

SEQ ID NO: 1746461 - DNA, 22 bp, Homo sapiens
accctccgccttcactccggtg

SEQ ID NO: 1746462 - DNA, 20 bp, Homo sapiens
accctccggcgggtgacagc

SEQ ID NO: 1746463 - DNA, 16 bp, Homo sapiens
accctcgggcccacct

SEQ ID NO: 1746464 - DNA, 17 bp, Homo sapiens
accctcgggcccacctg

SEQ ID NO: 1746465 - DNA, 22 bp, Homo sapiens
accctcgggcccacctggccac

SEQ ID NO: 1746466 - DNA, 14 bp, Homo sapiens
accctctcccagga

SEQ ID NO: 1746467 - DNA, 15 bp, Homo sapiens
accctctgggggtcc

SEQ ID NO: 1746468 - DNA, 19 bp, Homo sapiens
accctctgggggtcctctc

SEQ ID NO: 1746469 - DNA, 22 bp, Homo sapiens
accctcttgcccatcctgactg

SEQ ID NO: 1746470 - DNA, 19 bp, Homo sapiens
accctctttcttgtttgtc

SEQ ID NO: 1746471 - DNA, 21 bp, Homo sapiens
accctctttcttgtttgtcag

SEQ ID NO: 1746472 - DNA, 17 bp, Homo sapiens
accctgaaggggccatg

SEQ ID NO: 1746473 - DNA, 18 bp, Homo sapiens
accctgaaggggccatga

SEQ ID NO: 1746474 - DNA, 20 bp, Homo sapiens
accctgacctccgcccctgc

SEQ ID NO: 1746475 - DNA, 21 bp, Homo sapiens
accctgacctccgcccctgcc

SEQ ID NO: 1746476 - DNA, 15 bp, Homo sapiens
accctgagactccag

SEQ ID NO: 1746477 - DNA, 21 bp, Homo sapiens
accctgagatacttcccaaag

SEQ ID NO: 1746478 - DNA, 22 bp, Homo sapiens
accctgagatctgcacagtcag

SEQ ID NO: 1746479 - DNA, 21 bp, Homo sapiens
accctgagcagggtccacagc

SEQ ID NO: 1746480 - DNA, 12 bp, Homo sapiens
accctgagccgg

SEQ ID NO: 1746481 - DNA, 18 bp, Homo sapiens
accctgaggtcactgcta

SEQ ID NO: 1746482 - DNA, 15 bp, Homo sapiens
accctgattcttgat

SEQ ID NO: 1746483 - DNA, 17 bp, Homo sapiens
accctgcaatgtaattg

SEQ ID NO: 1746484 - DNA, 14 bp, Homo sapiens
accctgcacctgct

SEQ ID NO: 1746485 - DNA, 14 bp, Homo sapiens
accctgcaggactt

SEQ ID NO: 1746486 - DNA, 21 bp, Homo sapiens
accctgcattttcctcttgtc

SEQ ID NO: 1746487 - DNA, 10 bp, Homo sapiens
accctgcccc

SEQ ID NO: 1746488 - DNA, 22 bp, Homo sapiens
accctgccccccctaagagaca

SEQ ID NO: 1746489 - DNA, 12 bp, Homo sapiens
accctgcccgct

SEQ ID NO: 1746490 - DNA, 13 bp, Homo sapiens
accctgcccgctc

SEQ ID NO: 1746491 - DNA, 19 bp, Homo sapiens
accctgcccgctcccaacc

SEQ ID NO: 1746492 - DNA, 19 bp, Homo sapiens
accctgcctgagcccagga

SEQ ID NO: 1746493 - DNA, 20 bp, Homo sapiens
accctgcgaaggggccctgg

SEQ ID NO: 1746494 - DNA, 14 bp, Homo sapiens
accctgcgcctcca

SEQ ID NO: 1746495 - DNA, 14 bp, Homo sapiens
accctgctgaacac

SEQ ID NO: 1746496 - DNA, 15 bp, Homo sapiens
acctcatgcccagct

SEQ ID NO: 1746497 - DNA, 17 bp, Homo sapiens
acctcatgcccagctct

SEQ ID NO: 1746498 - DNA, 17 bp, Homo sapiens
acctcattgctaccaca

SEQ ID NO: 1746499 - DNA, 17 bp, Homo sapiens
acctccaagcatttcat

SEQ ID NO: 1746500 - DNA, 18 bp, Homo sapiens
acctccaagcatttcatg

SEQ ID NO: 1746501 - DNA, 13 bp, Homo sapiens
acctccaccctgc

SEQ ID NO: 1746502 - DNA, 21 bp, Homo sapiens
acctccaccctgcattttcct

SEQ ID NO: 1746503 - DNA, 15 bp, Homo sapiens
acctccaggcctgtt

SEQ ID NO: 1746504 - DNA, 22 bp, Homo sapiens
acctccatgtggacttaggaag

SEQ ID NO: 1746505 - DNA, 13 bp, Homo sapiens
acctcccacccca

SEQ ID NO: 1746506 - DNA, 17 bp, Homo sapiens
acctcccactcctgctg

SEQ ID NO: 1746507 - DNA, 12 bp, Homo sapiens
acctcccagccc

SEQ ID NO: 1746508 - DNA, 16 bp, Homo sapiens
acctcccagcccctgc

SEQ ID NO: 1746509 - DNA, 19 bp, Homo sapiens
acctcccccaaaccctgct

SEQ ID NO: 1746510 - DNA, 23 bp, Homo sapiens
acctcccccaaaccctgcttctg

SEQ ID NO: 1746511 - DNA, 17 bp, Homo sapiens
acctccccccactgcag

SEQ ID NO: 1746512 - DNA, 18 bp, Homo sapiens
acctccccccactgcagg

SEQ ID NO: 1746513 - DNA, 15 bp, Homo sapiens
acctccccctccccg

SEQ ID NO: 1746514 - DNA, 19 bp, Homo sapiens
acctccccctccccggcca

SEQ ID NO: 1746515 - DNA, 21 bp, Homo sapiens
acctccccctccccggccaca

SEQ ID NO: 1746516 - DNA, 22 bp, Homo sapiens
acctccccctttcacactggat

SEQ ID NO: 1746517 - DNA, 19 bp, Homo sapiens
acctccccgctctccctgt

SEQ ID NO: 1746518 - DNA, 22 bp, Homo sapiens
acctccccgctctccctgtcac

SEQ ID NO: 1746519 - DNA, 20 bp, Homo sapiens
acctccccggcctctctctt

SEQ ID NO: 1746520 - DNA, 20 bp, Homo sapiens
acctcccctatccacccagc

SEQ ID NO: 1746521 - DNA, 15 bp, Homo sapiens
acctccctgtctccc

SEQ ID NO: 1746522 - DNA, 12 bp, Homo sapiens
acctcccttccc

SEQ ID NO: 1746523 - DNA, 13 bp, Homo sapiens
acctcccttccca

SEQ ID NO: 1746524 - DNA, 15 bp, Homo sapiens
acctccgcccctgcc

SEQ ID NO: 1746525 - DNA, 20 bp, Homo sapiens
acctcctccactcactccag

SEQ ID NO: 1746526 - DNA, 17 bp, Homo sapiens
acctcctccccctgttc

SEQ ID NO: 1746527 - DNA, 18 bp, Homo sapiens
acctcctccccctgttct

SEQ ID NO: 1746528 - DNA, 12 bp, Homo sapiens
acctcctctcag

SEQ ID NO: 1746529 - DNA, 16 bp, Homo sapiens
acctcctctcagtgtt

SEQ ID NO: 1746530 - DNA, 21 bp, Homo sapiens
acctcctctgtgatttctttc

SEQ ID NO: 1746531 - DNA, 16 bp, Homo sapiens
acctcctgcaataaaa

SEQ ID NO: 1746532 - DNA, 14 bp, Homo sapiens
acctcctgcccagg

SEQ ID NO: 1746533 - DNA, 12 bp, Homo sapiens
acctcctgctct

SEQ ID NO: 1746534 - DNA, 19 bp, Homo sapiens
acctccttagccctgtctg

SEQ ID NO: 1746535 - DNA, 19 bp, Homo sapiens
acctcgcccttcagcccac

SEQ ID NO: 1746536 - DNA, 14 bp, Homo sapiens
acctcgctgagggc

SEQ ID NO: 1746537 - DNA, 22 bp, Homo sapiens
acctcggagggatggagaaaga

SEQ ID NO: 1746538 - DNA, 13 bp, Homo sapiens
acctcggcctccc

SEQ ID NO: 1746539 - DNA, 20 bp, Homo sapiens
acctcggggacaccagagct

SEQ ID NO: 1746540 - DNA, 19 bp, Homo sapiens
acctcgtcaagagcatgca

SEQ ID NO: 1746541 - DNA, 14 bp, Homo sapiens
acctcgtcctcccc

SEQ ID NO: 1746542 - DNA, 18 bp, Homo sapiens
acctcgtcctccccctgc

SEQ ID NO: 1746543 - DNA, 20 bp, Homo sapiens
acctcgtcctccccctgcca

SEQ ID NO: 1746544 - DNA, 15 bp, Homo sapiens
acctcgtctccctgg

SEQ ID NO: 1746545 - DNA, 23 bp, Homo sapiens
acctcgtctccctggtgcctctg

SEQ ID NO: 1746546 - DNA, 17 bp, Homo sapiens
acctcgtgatccacccg

SEQ ID NO: 1746547 - DNA, 17 bp, Homo sapiens
acctctaataaacactg

SEQ ID NO: 1746548 - DNA, 23 bp, Homo sapiens
acctctactaaaaagaaggaaaa

SEQ ID NO: 1746549 - DNA, 12 bp, Homo sapiens
acctctagaatt

SEQ ID NO: 1746550 - DNA, 19 bp, Homo sapiens
acctctagaattttaagcc

SEQ ID NO: 1746551 - DNA, 17 bp, Homo sapiens
acctctcctgacccctg

SEQ ID NO: 1746552 - DNA, 14 bp, Homo sapiens
acctctcctgccct

SEQ ID NO: 1746553 - DNA, 13 bp, Homo sapiens
acctctctctgag

SEQ ID NO: 1746554 - DNA, 17 bp, Homo sapiens
acctctctctgaggaca

SEQ ID NO: 1746555 - DNA, 19 bp, Homo sapiens
acctctctgtagtttatgg

SEQ ID NO: 1746556 - DNA, 15 bp, Homo sapiens
acctctctgtccctt

SEQ ID NO: 1746557 - DNA, 22 bp, Homo sapiens
acctctctgtcccttgctgtat

SEQ ID NO: 1746558 - DNA, 22 bp, Homo sapiens
acctctcttatagaatatttat

SEQ ID NO: 1746559 - DNA, 13 bp, Homo sapiens
acctctgagaaga

SEQ ID NO: 1746560 - DNA, 23 bp, Homo sapiens
acctctggactggctagagtcct

SEQ ID NO: 1746561 - DNA, 13 bp, Homo sapiens
acctctggagtgc

SEQ ID NO: 1746562 - DNA, 17 bp, Homo sapiens
acctctggagtgccccc

SEQ ID NO: 1746563 - DNA, 18 bp, Homo sapiens
acctctggctagagccga

SEQ ID NO: 1746564 - DNA, 20 bp, Homo sapiens
acctctgtgggcactggtgg

SEQ ID NO: 1746565 - DNA, 20 bp, Homo sapiens
acctctgttgtcctcccctt

SEQ ID NO: 1746566 - DNA, 16 bp, Homo sapiens
acctcttactttgctt

SEQ ID NO: 1746567 - DNA, 19 bp, Homo sapiens
acctcttccctctgggcct

SEQ ID NO: 1746568 - DNA, 23 bp, Homo sapiens
acctcttctatgcaagccttgct

SEQ ID NO: 1746569 - DNA, 11 bp, Homo sapiens
acctcttctgg

SEQ ID NO: 1746570 - DNA, 19 bp, Homo sapiens
acctctttactctctccga

SEQ ID NO: 1746571 - DNA, 22 bp, Homo sapiens
acctcttttgcttgccaaagta

SEQ ID NO: 1746572 - DNA, 22 bp, Homo sapiens
acctgaaataatatatttcttc

SEQ ID NO: 1746573 - DNA, 21 bp, Homo sapiens
acctgaaccccagaggcagag

SEQ ID NO: 1746574 - DNA, 18 bp, Homo sapiens
acctgaaccccatgggct

SEQ ID NO: 1746575 - DNA, 21 bp, Homo sapiens
acctgaagtttttttgctgct

SEQ ID NO: 1746576 - DNA, 16 bp, Homo sapiens
acctgacaatggcagc

SEQ ID NO: 1746577 - DNA, 19 bp, Homo sapiens
acctgacaatggcagctag

SEQ ID NO: 1746578 - DNA, 22 bp, Homo sapiens
acctgacaatggcagctagact

SEQ ID NO: 1746579 - DNA, 17 bp, Homo sapiens
acctgaccccattcctg

SEQ ID NO: 1746580 - DNA, 18 bp, Homo sapiens
acctgaccccattcctga

SEQ ID NO: 1746581 - DNA, 20 bp, Homo sapiens
acctgactattgaagttgca

SEQ ID NO: 1746582 - DNA, 16 bp, Homo sapiens
acctgactctgaaatc

SEQ ID NO: 1746583 - DNA, 17 bp, Homo sapiens
acctgactctgaaatct

SEQ ID NO: 1746584 - DNA, 18 bp, Homo sapiens
acctgactctgaaatctg

SEQ ID NO: 1746585 - DNA, 12 bp, Homo sapiens
acctgagacctc

SEQ ID NO: 1746586 - DNA, 23 bp, Homo sapiens
acctgagacctccactccacatc

SEQ ID NO: 1746587 - DNA, 19 bp, Homo sapiens
acctgagagcatctcagga

SEQ ID NO: 1746588 - DNA, 14 bp, Homo sapiens
acctgagatgtgtg

SEQ ID NO: 1746589 - DNA, 15 bp, Homo sapiens
acctgaggtcaggag

SEQ ID NO: 1746590 - DNA, 17 bp, Homo sapiens
acctgaggtgggcccag

SEQ ID NO: 1746591 - DNA, 18 bp, Homo sapiens
acctgaggtgggcccagg

SEQ ID NO: 1746592 - DNA, 19 bp, Homo sapiens
acctgaggtgggcccagga

SEQ ID NO: 1746593 - DNA, 22 bp, Homo sapiens
acctgaggtgggcccaggacca

SEQ ID NO: 1746594 - DNA, 15 bp, Homo sapiens
acctgaggtgggctg

SEQ ID NO: 1746595 - DNA, 20 bp, Homo sapiens
acctgaggtgggctggggct

SEQ ID NO: 1746596 - DNA, 16 bp, Homo sapiens
acctgagttgaagagg

SEQ ID NO: 1746597 - DNA, 13 bp, Homo sapiens
acctgatcctgga

SEQ ID NO: 1746598 - DNA, 22 bp, Homo sapiens
acctgatcctggaggcccagtt

SEQ ID NO: 1746599 - DNA, 17 bp, Homo sapiens
acctgattgatcacaca

SEQ ID NO: 1746600 - DNA, 17 bp, Homo sapiens
acctgattttttttcct

SEQ ID NO: 1746601 - DNA, 12 bp, Homo sapiens
acctgcaagccc

SEQ ID NO: 1746602 - DNA, 18 bp, Homo sapiens
acctgcacacaggacagc

SEQ ID NO: 1746603 - DNA, 20 bp, Homo sapiens
acctgcacacaggacagcgg

SEQ ID NO: 1746604 - DNA, 17 bp, Homo sapiens
acctgcactaacagagt

SEQ ID NO: 1746605 - DNA, 18 bp, Homo sapiens
acctgcactaacagagtg

SEQ ID NO: 1746606 - DNA, 19 bp, Homo sapiens
acctgcagcccctcctcct

SEQ ID NO: 1746607 - DNA, 12 bp, Homo sapiens
acctgcaggctc

SEQ ID NO: 1746608 - DNA, 19 bp, Homo sapiens
acctgcaggctccatgcac

SEQ ID NO: 1746609 - DNA, 21 bp, Homo sapiens
acctgcaggctccatgcacct

SEQ ID NO: 1746610 - DNA, 20 bp, Homo sapiens
accttaggctttgtatgaca

SEQ ID NO: 1746611 - DNA, 21 bp, Homo sapiens
accttagggtggctttaattg

SEQ ID NO: 1746612 - DNA, 22 bp, Homo sapiens
accttagggtggctttaattgt

SEQ ID NO: 1746613 - DNA, 12 bp, Homo sapiens
accttatagtta

SEQ ID NO: 1746614 - DNA, 14 bp, Homo sapiens
accttatagttact

SEQ ID NO: 1746615 - DNA, 17 bp, Homo sapiens
accttattgtacctctc

SEQ ID NO: 1746616 - DNA, 18 bp, Homo sapiens
accttattgtacctctct

SEQ ID NO: 1746617 - DNA, 19 bp, Homo sapiens
accttatttatttttgtgt

SEQ ID NO: 1746618 - DNA, 21 bp, Homo sapiens
accttcaaaatgttctattta

SEQ ID NO: 1746619 - DNA, 16 bp, Homo sapiens
accttcaacccagtgg

SEQ ID NO: 1746620 - DNA, 16 bp, Homo sapiens
accttcaattcctggg

SEQ ID NO: 1746621 - DNA, 16 bp, Homo sapiens
accttcatgcccttct

SEQ ID NO: 1746622 - DNA, 14 bp, Homo sapiens
accttccacccagt

SEQ ID NO: 1746623 - DNA, 19 bp, Homo sapiens
accttccatggctcttttt

SEQ ID NO: 1746624 - DNA, 19 bp, Homo sapiens
accttcccaaacgcctccc

SEQ ID NO: 1746625 - DNA, 21 bp, Homo sapiens
accttcccaaacgcctcccct

SEQ ID NO: 1746626 - DNA, 18 bp, Homo sapiens
accttcccaccccttcat

SEQ ID NO: 1746627 - DNA, 13 bp, Homo sapiens
accttcccagctc

SEQ ID NO: 1746628 - DNA, 12 bp, Homo sapiens
accttccccaga

SEQ ID NO: 1746629 - DNA, 13 bp, Homo sapiens
accttccccagac

SEQ ID NO: 1746630 - DNA, 14 bp, Homo sapiens
accttccccagact

SEQ ID NO: 1746631 - DNA, 16 bp, Homo sapiens
accttccccagacttg

SEQ ID NO: 1746632 - DNA, 18 bp, Homo sapiens
accttccccagacttgca

SEQ ID NO: 1746633 - DNA, 20 bp, Homo sapiens
accttcctcctccccgctcc

SEQ ID NO: 1746634 - DNA, 17 bp, Homo sapiens
accttccttaagccagg

SEQ ID NO: 1746635 - DNA, 13 bp, Homo sapiens
accttccttccct

SEQ ID NO: 1746636 - DNA, 14 bp, Homo sapiens
accttccttccctg

SEQ ID NO: 1746637 - DNA, 22 bp, Homo sapiens
accttctaaaagtactgcattt

SEQ ID NO: 1746638 - DNA, 18 bp, Homo sapiens
accttctttattctgtgt

SEQ ID NO: 1746639 - DNA, 21 bp, Homo sapiens
accttgaacactgggggaggg

SEQ ID NO: 1746640 - DNA, 20 bp, Homo sapiens
accttgaataaggcccactg

SEQ ID NO: 1746641 - DNA, 22 bp, Homo sapiens
accttgaataaggcccactgta

SEQ ID NO: 1746642 - DNA, 13 bp, Homo sapiens
accttgaatgctg

SEQ ID NO: 1746643 - DNA, 16 bp, Homo sapiens
accttgaatgctgcca

SEQ ID NO: 1746644 - DNA, 13 bp, Homo sapiens
accttgcctcctt

SEQ ID NO: 1746645 - DNA, 14 bp, Homo sapiens
accttgctctcctc

SEQ ID NO: 1746646 - DNA, 15 bp, Homo sapiens
accttgctctcctca

SEQ ID NO: 1746647 - DNA, 23 bp, Homo sapiens
accttgctgcaagcacagccctt

SEQ ID NO: 1746648 - DNA, 22 bp, Homo sapiens
accttgcttcttactgataatt

SEQ ID NO: 1746649 - DNA, 11 bp, Homo sapiens
accttggaagg

SEQ ID NO: 1746650 - DNA, 18 bp, Homo sapiens
accttggacatcctcctc

SEQ ID NO: 1746651 - DNA, 23 bp, Homo sapiens
accttggaccactcctgtccctg

SEQ ID NO: 1746652 - DNA, 18 bp, Homo sapiens
accttggagagctcagga

SEQ ID NO: 1746653 - DNA, 16 bp, Homo sapiens
accttggagaggagag

SEQ ID NO: 1746654 - DNA, 21 bp, Homo sapiens
accttggaggccttccctggc

SEQ ID NO: 1746655 - DNA, 14 bp, Homo sapiens
accttggcaccaga

SEQ ID NO: 1746656 - DNA, 17 bp, Homo sapiens
accttggcaccagacac

SEQ ID NO: 1746657 - DNA, 22 bp, Homo sapiens
accttggcaccagacacccagg

SEQ ID NO: 1746658 - DNA, 17 bp, Homo sapiens
accttggcataagacag

SEQ ID NO: 1746659 - DNA, 14 bp, Homo sapiens
accttggcccagga

SEQ ID NO: 1746660 - DNA, 16 bp, Homo sapiens
accttggcccaggagc

SEQ ID NO: 1746661 - DNA, 17 bp, Homo sapiens
accttggcccaggagct

SEQ ID NO: 1746662 - DNA, 20 bp, Homo sapiens
accttggcccaggagctctg

SEQ ID NO: 1746663 - DNA, 17 bp, Homo sapiens
accttgtaaaaaaagca

SEQ ID NO: 1746664 - DNA, 23 bp, Homo sapiens
accttgtaaaaaaagcaaaaatg

SEQ ID NO: 1746665 - DNA, 18 bp, Homo sapiens
accttgtattctctttac

SEQ ID NO: 1746666 - DNA, 14 bp, Homo sapiens
accttgtgcctggg

SEQ ID NO: 1746667 - DNA, 15 bp, Homo sapiens
accttgtgggaccag

SEQ ID NO: 1746668 - DNA, 16 bp, Homo sapiens
accttgttacttctga

SEQ ID NO: 1746669 - DNA, 17 bp, Homo sapiens
accttgttacttctgag

SEQ ID NO: 1746670 - DNA, 17 bp, Homo sapiens
accttgttggagcctgc

SEQ ID NO: 1746671 - DNA, 19 bp, Homo sapiens
accttgttggagcctgcag

SEQ ID NO: 1746672 - DNA, 15 bp, Homo sapiens
accttgttgtgtttc

SEQ ID NO: 1746673 - DNA, 15 bp, Homo sapiens
acctttagggcagct

SEQ ID NO: 1746674 - DNA, 14 bp, Homo sapiens
acctttaggttctt

SEQ ID NO: 1746675 - DNA, 14 bp, Homo sapiens
acctttattaaaat

SEQ ID NO: 1746676 - DNA, 18 bp, Homo sapiens
acctttattaaaatctta

SEQ ID NO: 1746677 - DNA, 20 bp, Homo sapiens
acctttattaaaatcttaaa

SEQ ID NO: 1746678 - DNA, 16 bp, Homo sapiens
acctttattcacccct

SEQ ID NO: 1746679 - DNA, 19 bp, Homo sapiens
acctttattcacccctgcc

SEQ ID NO: 1746680 - DNA, 12 bp, Homo sapiens
acctttcacaaa

SEQ ID NO: 1746681 - DNA, 17 bp, Homo sapiens
acctttctccactgggt

SEQ ID NO: 1746682 - DNA, 17 bp, Homo sapiens
acctttggaaagctctg

SEQ ID NO: 1746683 - DNA, 17 bp, Homo sapiens
acctttgggttctttct

SEQ ID NO: 1746684 - DNA, 12 bp, Homo sapiens
acctttggtgca

SEQ ID NO: 1746685 - DNA, 15 bp, Homo sapiens
acctttggtgcagag

SEQ ID NO: 1746686 - DNA, 19 bp, Homo sapiens
acctttgtaagacatttgt

SEQ ID NO: 1746687 - DNA, 20 bp, Homo sapiens
acctttgtaagacatttgta

SEQ ID NO: 1746688 - DNA, 16 bp, Homo sapiens
acctttgttttttgtt

SEQ ID NO: 1746689 - DNA, 14 bp, Homo sapiens
accttttaactcac

SEQ ID NO: 1746690 - DNA, 21 bp, Homo sapiens
accttttaattaatgaaatat

SEQ ID NO: 1746691 - DNA, 23 bp, Homo sapiens
accttttatttttatttctgact

SEQ ID NO: 1746692 - DNA, 16 bp, Homo sapiens
accttttcaggaaaat

SEQ ID NO: 1746693 - DNA, 12 bp, Homo sapiens
accttttccctt

SEQ ID NO: 1746694 - DNA, 17 bp, Homo sapiens
accttttctcacaaaaa

SEQ ID NO: 1746695 - DNA, 21 bp, Homo sapiens
accttttgaggagccccagct

SEQ ID NO: 1746696 - DNA, 11 bp, Homo sapiens
accttttgtag

SEQ ID NO: 1746697 - DNA, 15 bp, Homo sapiens
accttttttgttcca

SEQ ID NO: 1746698 - DNA, 19 bp, Homo sapiens
acgaaaaagagcatatact

SEQ ID NO: 1746699 - DNA, 21 bp, Homo sapiens
acgaaattgttacaatagaat

SEQ ID NO: 1746700 - DNA, 15 bp, Homo sapiens
acgaacccacctgct

SEQ ID NO: 1746701 - DNA, 12 bp, Homo sapiens
acgaagaaaaaa

SEQ ID NO: 1746702 - DNA, 22 bp, Homo sapiens
acgaagagtatttttgacagaa

SEQ ID NO: 1746703 - DNA, 21 bp, Homo sapiens
acgaaggtaaaaagtattttt

SEQ ID NO: 1746704 - DNA, 21 bp, Homo sapiens
acgaatgaaaataactgaatt

SEQ ID NO: 1746705 - DNA, 19 bp, Homo sapiens
acgacacatatacatatga

SEQ ID NO: 1746706 - DNA, 14 bp, Homo sapiens
acgacttcagggca

SEQ ID NO: 1746707 - DNA, 22 bp, Homo sapiens
acgacttcagggcagggctctg

SEQ ID NO: 1746708 - DNA, 17 bp, Homo sapiens
acgagacacattgcctt

SEQ ID NO: 1746709 - DNA, 19 bp, Homo sapiens
acgagacacattgccttct

SEQ ID NO: 1746710 - DNA, 21 bp, Homo sapiens
acgagacccccatccagcctc

SEQ ID NO: 1746711 - DNA, 23 bp, Homo sapiens
acgagacccccatccagcctcca

SEQ ID NO: 1746712 - DNA, 24 bp, Homo sapiens
acgagacccccatccagcctccag

SEQ ID NO: 1746713 - DNA, 14 bp, Homo sapiens
acgagaccccggct

SEQ ID NO: 1746714 - DNA, 20 bp, Homo sapiens
acgagaccctacaggagagg

SEQ ID NO: 1746715 - DNA, 17 bp, Homo sapiens
acgagagcagaggtctc

SEQ ID NO: 1746716 - DNA, 19 bp, Homo sapiens
acgagcactggccagagag

SEQ ID NO: 1746717 - DNA, 20 bp, Homo sapiens
acgagcaggctactgtcagc

SEQ ID NO: 1746718 - DNA, 19 bp, Homo sapiens
acgagccccacagagcagg

SEQ ID NO: 1746719 - DNA, 23 bp, Homo sapiens
acgagccccacagagcaggaagc

SEQ ID NO: 1746720 - DNA, 22 bp, Homo sapiens
acgaggaatctgtgggtctggg

SEQ ID NO: 1746721 - DNA, 19 bp, Homo sapiens
acgaggcaggggctctgct

SEQ ID NO: 1746722 - DNA, 14 bp, Homo sapiens
acgagggcaacagg

SEQ ID NO: 1746723 - DNA, 19 bp, Homo sapiens
acgaggggcagggaaggac

SEQ ID NO: 1746724 - DNA, 16 bp, Homo sapiens
acgttttcttctttcc

SEQ ID NO: 1746725 - DNA, 21 bp, Homo sapiens
acgttttcttctttccctgga

SEQ ID NO: 1746726 - DNA, 22 bp, Homo sapiens
acgttttcttctttccctggac

SEQ ID NO: 1746727 - DNA, 23 bp, Homo sapiens
acgttttcttctttccctggaca

SEQ ID NO: 1746728 - DNA, 18 bp, Homo sapiens
acgttttttcctcagtgc

SEQ ID NO: 1746729 - DNA, 16 bp, Homo sapiens
actaaaaaaaaaaagg

SEQ ID NO: 1746730 - DNA, 17 bp, Homo sapiens
actaaaaaaaaaaaggc

SEQ ID NO: 1746731 - DNA, 16 bp, Homo sapiens
actaaaaaaaagatga

SEQ ID NO: 1746732 - DNA, 17 bp, Homo sapiens
actaaaaagaaggaaaa

SEQ ID NO: 1746733 - DNA, 13 bp, Homo sapiens
actaaaaatatta

SEQ ID NO: 1746734 - DNA, 12 bp, Homo sapiens
actaaaagatcg

SEQ ID NO: 1746735 - DNA, 12 bp, Homo sapiens
actaaaattcaa

SEQ ID NO: 1746736 - DNA, 18 bp, Homo sapiens
actaaaattcaacaaatg

SEQ ID NO: 1746737 - DNA, 20 bp, Homo sapiens
actaaactacattgttctta

SEQ ID NO: 1746738 - DNA, 12 bp, Homo sapiens
actaaactcatt

SEQ ID NO: 1746739 - DNA, 14 bp, Homo sapiens
actaaactcattta

SEQ ID NO: 1746740 - DNA, 18 bp, Homo sapiens
actaaactttttttctgt

SEQ ID NO: 1746741 - DNA, 22 bp, Homo sapiens
actaaagatatcagagctctta

SEQ ID NO: 1746742 - DNA, 12 bp, Homo sapiens
actaaagcatga

SEQ ID NO: 1746743 - DNA, 15 bp, Homo sapiens
actaaagcatgaaat

SEQ ID NO: 1746744 - DNA, 13 bp, Homo sapiens
actaaagccaagg

SEQ ID NO: 1746745 - DNA, 21 bp, Homo sapiens
actaaagctatgttacatgga

SEQ ID NO: 1746746 - DNA, 14 bp, Homo sapiens
actaaagcttcaga

SEQ ID NO: 1746747 - DNA, 20 bp, Homo sapiens
actaaagcttcagactcaag

SEQ ID NO: 1746748 - DNA, 23 bp, Homo sapiens
actaaaggaaaaaactttgactt

SEQ ID NO: 1746749 - DNA, 22 bp, Homo sapiens
actaaagttgtactttaaaaat

SEQ ID NO: 1746750 - DNA, 15 bp, Homo sapiens
actaaatcagagaca

SEQ ID NO: 1746751 - DNA, 21 bp, Homo sapiens
actaaatcagagacaaaatat

SEQ ID NO: 1746752 - DNA, 15 bp, Homo sapiens
actaaatgagctcct

SEQ ID NO: 1746753 - DNA, 12 bp, Homo sapiens
actaaatgataa

SEQ ID NO: 1746754 - DNA, 17 bp, Homo sapiens
actaaatgataaatgta

SEQ ID NO: 1746755 - DNA, 19 bp, Homo sapiens
actaaattattagcatttg

SEQ ID NO: 1746756 - DNA, 21 bp, Homo sapiens
actaaattgtatacattttgt

SEQ ID NO: 1746757 - DNA, 16 bp, Homo sapiens
actaacagataagcaa

SEQ ID NO: 1746758 - DNA, 17 bp, Homo sapiens
actaacagataagcaag

SEQ ID NO: 1746759 - DNA, 17 bp, Homo sapiens
actaacaggatatttaa

SEQ ID NO: 1746760 - DNA, 18 bp, Homo sapiens
actaacataaaatctgtg

SEQ ID NO: 1746761 - DNA, 23 bp, Homo sapiens
actaaccagggaagctgtccctc

SEQ ID NO: 1746762 - DNA, 20 bp, Homo sapiens
actaaccatccccaactcca

SEQ ID NO: 1746763 - DNA, 21 bp, Homo sapiens
actaacctggtattttaagag

SEQ ID NO: 1746764 - DNA, 20 bp, Homo sapiens
actaactagacaccaaagtt

SEQ ID NO: 1746765 - DNA, 22 bp, Homo sapiens
actaactagacaccaaagttct

SEQ ID NO: 1746766 - DNA, 17 bp, Homo sapiens
actaactatcaaataga

SEQ ID NO: 1746767 - DNA, 22 bp, Homo sapiens
actaactcaaatacacatttgc

SEQ ID NO: 1746768 - DNA, 22 bp, Homo sapiens
actaactcaccagccccactgc

SEQ ID NO: 1746769 - DNA, 20 bp, Homo sapiens
actaactgctggtttttaaa

SEQ ID NO: 1746770 - DNA, 14 bp, Homo sapiens
actaagaataaata

SEQ ID NO: 1746771 - DNA, 13 bp, Homo sapiens
actaagaatgtcc

SEQ ID NO: 1746772 - DNA, 16 bp, Homo sapiens
actaagaattcaaact

SEQ ID NO: 1746773 - DNA, 18 bp, Homo sapiens
actaagaccctggtctga

SEQ ID NO: 1746774 - DNA, 17 bp, Homo sapiens
actaagagaagttgtaa

SEQ ID NO: 1746775 - DNA, 19 bp, Homo sapiens
actaagagacagttctctg

SEQ ID NO: 1746776 - DNA, 20 bp, Homo sapiens
actaagagacagttctctgt

SEQ ID NO: 1746777 - DNA, 12 bp, Homo sapiens
actaagcatttc

SEQ ID NO: 1746778 - DNA, 16 bp, Homo sapiens
actaagctctttgaga

SEQ ID NO: 1746779 - DNA, 21 bp, Homo sapiens
actaaggatttttcaagagat

SEQ ID NO: 1746780 - DNA, 21 bp, Homo sapiens
actaagtcaggagtgtagttg

SEQ ID NO: 1746781 - DNA, 17 bp, Homo sapiens
actaagttatagtatat

SEQ ID NO: 1746782 - DNA, 22 bp, Homo sapiens
actaataaaagcataaatgcaa

SEQ ID NO: 1746783 - DNA, 23 bp, Homo sapiens
actaatacgtgccagatataact

SEQ ID NO: 1746784 - DNA, 20 bp, Homo sapiens
actaatagaataaaggcagt

SEQ ID NO: 1746785 - DNA, 15 bp, Homo sapiens
actaatatatatttt

SEQ ID NO: 1746786 - DNA, 19 bp, Homo sapiens
actaatatatattttaagg

SEQ ID NO: 1746787 - DNA, 17 bp, Homo sapiens
actaatatatttaaaaa

SEQ ID NO: 1746788 - DNA, 19 bp, Homo sapiens
actaatattttatgtgaga

SEQ ID NO: 1746789 - DNA, 19 bp, Homo sapiens
actaatcgaactatgaact

SEQ ID NO: 1746790 - DNA, 17 bp, Homo sapiens
actaatcttgaatgttt

SEQ ID NO: 1746791 - DNA, 22 bp, Homo sapiens
actaatgaccacacctgcctct

SEQ ID NO: 1746792 - DNA, 23 bp, Homo sapiens
actaatgccttactcttcttgaa

SEQ ID NO: 1746793 - DNA, 18 bp, Homo sapiens
actaattcataatcactc

SEQ ID NO: 1746794 - DNA, 20 bp, Homo sapiens
actaattggcctctttaaga

SEQ ID NO: 1746795 - DNA, 17 bp, Homo sapiens
actaatttgatgtttac

SEQ ID NO: 1746796 - DNA, 16 bp, Homo sapiens
actaatttgtggtaaa

SEQ ID NO: 1746797 - DNA, 15 bp, Homo sapiens
actaattttacatgt

SEQ ID NO: 1746798 - DNA, 16 bp, Homo sapiens
actaattttgttgaaa

SEQ ID NO: 1746799 - DNA, 14 bp, Homo sapiens
actacaaaatttga

SEQ ID NO: 1746800 - DNA, 18 bp, Homo sapiens
actacaaacaaaatttct

SEQ ID NO: 1746801 - DNA, 20 bp, Homo sapiens
actacaaacaaaatttctat

SEQ ID NO: 1746802 - DNA, 17 bp, Homo sapiens
actacaaagtaaaatga

SEQ ID NO: 1746803 - DNA, 13 bp, Homo sapiens
actacaagtcagc

SEQ ID NO: 1746804 - DNA, 13 bp, Homo sapiens
actacaatatgta

SEQ ID NO: 1746805 - DNA, 16 bp, Homo sapiens
actacaatatgtacat

SEQ ID NO: 1746806 - DNA, 20 bp, Homo sapiens
actacaatatgtacatttct

SEQ ID NO: 1746807 - DNA, 17 bp, Homo sapiens
actacacatttgaaaca

SEQ ID NO: 1746808 - DNA, 14 bp, Homo sapiens
actacacctggctg

SEQ ID NO: 1746809 - DNA, 21 bp, Homo sapiens
actacaccttgccttgctgtt

SEQ ID NO: 1746810 - DNA, 17 bp, Homo sapiens
actacactccagcctga

SEQ ID NO: 1746811 - DNA, 19 bp, Homo sapiens
actacactccagcctgagc

SEQ ID NO: 1746812 - DNA, 15 bp, Homo sapiens
actacagaagtggaa

SEQ ID NO: 1746813 - DNA, 16 bp, Homo sapiens
actacagctatatttg

SEQ ID NO: 1746814 - DNA, 14 bp, Homo sapiens
actacataaaaata

SEQ ID NO: 1746815 - DNA, 20 bp, Homo sapiens
actacatgaaataatgcact

SEQ ID NO: 1746816 - DNA, 20 bp, Homo sapiens
actacatgcagcccatgccc

SEQ ID NO: 1746817 - DNA, 16 bp, Homo sapiens
actacattttaaaaac

SEQ ID NO: 1746818 - DNA, 16 bp, Homo sapiens
actacattttgaggtt

SEQ ID NO: 1746819 - DNA, 14 bp, Homo sapiens
actaccacaaggaa

SEQ ID NO: 1746820 - DNA, 15 bp, Homo sapiens
actaccacaaggaaa

SEQ ID NO: 1746821 - DNA, 13 bp, Homo sapiens
actacccagctct

SEQ ID NO: 1746822 - DNA, 15 bp, Homo sapiens
actacccagctctgt

SEQ ID NO: 1746823 - DNA, 13 bp, Homo sapiens
actacccttctcc

SEQ ID NO: 1746824 - DNA, 13 bp, Homo sapiens
actaccgcaggcc

SEQ ID NO: 1746825 - DNA, 14 bp, Homo sapiens
actaccgcaggccc

SEQ ID NO: 1746826 - DNA, 22 bp, Homo sapiens
actacctagaagtaagaagagg

SEQ ID NO: 1746827 - DNA, 23 bp, Homo sapiens
actacctctggacagttgtgttg

SEQ ID NO: 1746828 - DNA, 14 bp, Homo sapiens
actactaagaataa

SEQ ID NO: 1746829 - DNA, 18 bp, Homo sapiens
actactacagaaattctg

SEQ ID NO: 1746830 - DNA, 14 bp, Homo sapiens
actactagattgac

SEQ ID NO: 1746831 - DNA, 16 bp, Homo sapiens
actactcaaagcaaaa

SEQ ID NO: 1746832 - DNA, 18 bp, Homo sapiens
actactcaaagcaaaagt

SEQ ID NO: 1746833 - DNA, 15 bp, Homo sapiens
actactcctaattat

SEQ ID NO: 1746834 - DNA, 14 bp, Homo sapiens
actactcctctgca

SEQ ID NO: 1746835 - DNA, 19 bp, Homo sapiens
actactcctctgcagtgcc

SEQ ID NO: 1746836 - DNA, 15 bp, Homo sapiens
actactcgagcccac

SEQ ID NO: 1746837 - DNA, 13 bp, Homo sapiens
actactctgtgcc

SEQ ID NO: 1746838 - DNA, 16 bp, Homo sapiens
actactgaataatgct

SEQ ID NO: 1746839 - DNA, 22 bp, Homo sapiens
actccctctgcagaatcccttt

SEQ ID NO: 1746840 - DNA, 15 bp, Homo sapiens
actccctctgccttc

SEQ ID NO: 1746841 - DNA, 16 bp, Homo sapiens
actccctctgccttca

SEQ ID NO: 1746842 - DNA, 23 bp, Homo sapiens
actccctctgccttcaggcttct

SEQ ID NO: 1746843 - DNA, 12 bp, Homo sapiens
actccctggcct

SEQ ID NO: 1746844 - DNA, 13 bp, Homo sapiens
actccctggcctt

SEQ ID NO: 1746845 - DNA, 19 bp, Homo sapiens
actcccttgctggccccag

SEQ ID NO: 1746846 - DNA, 21 bp, Homo sapiens
actcccttgctggccccagcc

SEQ ID NO: 1746847 - DNA, 22 bp, Homo sapiens
actcccttgctggccccagccc

SEQ ID NO: 1746848 - DNA, 21 bp, Homo sapiens
actccgagagcagtgggcagg

SEQ ID NO: 1746849 - DNA, 17 bp, Homo sapiens
actccgccctcctcggg

SEQ ID NO: 1746850 - DNA, 21 bp, Homo sapiens
actccgccctcctcgggccga

SEQ ID NO: 1746851 - DNA, 18 bp, Homo sapiens
actccgcgccgatgccac

SEQ ID NO: 1746852 - DNA, 22 bp, Homo sapiens
actccgcgccgatgccaccggc

SEQ ID NO: 1746853 - DNA, 17 bp, Homo sapiens
actccggggagcgcccg

SEQ ID NO: 1746854 - DNA, 21 bp, Homo sapiens
actccggtgtgcctgcagccc

SEQ ID NO: 1746855 - DNA, 15 bp, Homo sapiens
actccgtctcaagga

SEQ ID NO: 1746856 - DNA, 18 bp, Homo sapiens
actccgttggccactccg

SEQ ID NO: 1746857 - DNA, 21 bp, Homo sapiens
actcctaattttaaataattt

SEQ ID NO: 1746858 - DNA, 22 bp, Homo sapiens
actcctaattttaaataatttc

SEQ ID NO: 1746859 - DNA, 20 bp, Homo sapiens
actcctacaagatttagaaa

SEQ ID NO: 1746860 - DNA, 14 bp, Homo sapiens
actcctacctcagc

SEQ ID NO: 1746861 - DNA, 14 bp, Homo sapiens
actcctagaagaac

SEQ ID NO: 1746862 - DNA, 20 bp, Homo sapiens
actcctagaagaaccaaata

SEQ ID NO: 1746863 - DNA, 23 bp, Homo sapiens
actcctagaagaaccaaatacct

SEQ ID NO: 1746864 - DNA, 22 bp, Homo sapiens
actcctatccccaggccaggtc

SEQ ID NO: 1746865 - DNA, 20 bp, Homo sapiens
actcctcaaaagcaaatgag

SEQ ID NO: 1746866 - DNA, 21 bp, Homo sapiens
actcctcaaaagcaaatgaga

SEQ ID NO: 1746867 - DNA, 18 bp, Homo sapiens
actcctcagatctgaaca

SEQ ID NO: 1746868 - DNA, 16 bp, Homo sapiens
actcctcaggagagac

SEQ ID NO: 1746869 - DNA, 13 bp, Homo sapiens
actcctccctccg

SEQ ID NO: 1746870 - DNA, 18 bp, Homo sapiens
actcctcggtactcccat

SEQ ID NO: 1746871 - DNA, 23 bp, Homo sapiens
actcctctactcttacagagcct

SEQ ID NO: 1746872 - DNA, 17 bp, Homo sapiens
actcctctgcagtgcct

SEQ ID NO: 1746873 - DNA, 20 bp, Homo sapiens
actcctctgcagtgccttgg

SEQ ID NO: 1746874 - DNA, 20 bp, Homo sapiens
actcctctgcgtctatcctg

SEQ ID NO: 1746875 - DNA, 21 bp, Homo sapiens
actcctgaccataatcctagc

SEQ ID NO: 1746876 - DNA, 17 bp, Homo sapiens
actcctgagtggggcca

SEQ ID NO: 1746877 - DNA, 21 bp, Homo sapiens
actcctgattttgtagttaat

SEQ ID NO: 1746878 - DNA, 19 bp, Homo sapiens
actcctgccattcttctgg

SEQ ID NO: 1746879 - DNA, 14 bp, Homo sapiens
actcctgccctgtt

SEQ ID NO: 1746880 - DNA, 13 bp, Homo sapiens
actcctgctggta

SEQ ID NO: 1746881 - DNA, 16 bp, Homo sapiens
actcctgctggtacct

SEQ ID NO: 1746882 - DNA, 12 bp, Homo sapiens
actcctggaaat

SEQ ID NO: 1746883 - DNA, 16 bp, Homo sapiens
actcctggaagctgtg

SEQ ID NO: 1746884 - DNA, 12 bp, Homo sapiens
actcctggcctc

SEQ ID NO: 1746885 - DNA, 22 bp, Homo sapiens
actcctgggctcaagcagtcct

SEQ ID NO: 1746886 - DNA, 23 bp, Homo sapiens
actcctgggtgggtggggtacag

SEQ ID NO: 1746887 - DNA, 15 bp, Homo sapiens
actcctgtaattcct

SEQ ID NO: 1746888 - DNA, 17 bp, Homo sapiens
actcctgtacactgaat

SEQ ID NO: 1746889 - DNA, 16 bp, Homo sapiens
actcctgtccctgtag

SEQ ID NO: 1746890 - DNA, 22 bp, Homo sapiens
actcctgtgctctggaggctgc

SEQ ID NO: 1746891 - DNA, 22 bp, Homo sapiens
actcctgttccttgctagccct

SEQ ID NO: 1746892 - DNA, 14 bp, Homo sapiens
actcctgtttctcc

SEQ ID NO: 1746893 - DNA, 22 bp, Homo sapiens
actccttaccaatagcctgaat

SEQ ID NO: 1746894 - DNA, 17 bp, Homo sapiens
actccttcctggcctga

SEQ ID NO: 1746895 - DNA, 19 bp, Homo sapiens
actccttcctggcctgaga

SEQ ID NO: 1746896 - DNA, 14 bp, Homo sapiens
actccttctctcac

SEQ ID NO: 1746897 - DNA, 12 bp, Homo sapiens
actcctttctgc

SEQ ID NO: 1746898 - DNA, 13 bp, Homo sapiens
actcgagaacttt

SEQ ID NO: 1746899 - DNA, 17 bp, Homo sapiens
actcgagaactttcatt

SEQ ID NO: 1746900 - DNA, 18 bp, Homo sapiens
actcgatcaaaaccttcc

SEQ ID NO: 1746901 - DNA, 19 bp, Homo sapiens
actcgatcaaaaccttcct

SEQ ID NO: 1746902 - DNA, 20 bp, Homo sapiens
actcgatgagataatatgag

SEQ ID NO: 1746903 - DNA, 14 bp, Homo sapiens
actcgcccgcccac

SEQ ID NO: 1746904 - DNA, 17 bp, Homo sapiens
actcgcccgcccactgt

SEQ ID NO: 1746905 - DNA, 19 bp, Homo sapiens
actcgcccgcccactgtcc

SEQ ID NO: 1746906 - DNA, 20 bp, Homo sapiens
actcgcccgcccactgtcct

SEQ ID NO: 1746907 - DNA, 12 bp, Homo sapiens
actcgcctcagc

SEQ ID NO: 1746908 - DNA, 12 bp, Homo sapiens
actcggtttctc

SEQ ID NO: 1746909 - DNA, 16 bp, Homo sapiens
actcggtttctccaaa

SEQ ID NO: 1746910 - DNA, 20 bp, Homo sapiens
actcgtccaagggacagccc

SEQ ID NO: 1746911 - DNA, 22 bp, Homo sapiens
actcgtgcattaaaatttctta

SEQ ID NO: 1746912 - DNA, 22 bp, Homo sapiens
actcgttcacctccaagcattt

SEQ ID NO: 1746913 - DNA, 13 bp, Homo sapiens
actctaaagaaaa

SEQ ID NO: 1746914 - DNA, 15 bp, Homo sapiens
actctaaagaaaaat

SEQ ID NO: 1746915 - DNA, 16 bp, Homo sapiens
actctaaatgcagttt

SEQ ID NO: 1746916 - DNA, 21 bp, Homo sapiens
actctaaatgcagttttaaga

SEQ ID NO: 1746917 - DNA, 22 bp, Homo sapiens
actctaaatgcagttttaagaa

SEQ ID NO: 1746918 - DNA, 17 bp, Homo sapiens
actctaaccagtgtaca

SEQ ID NO: 1746919 - DNA, 13 bp, Homo sapiens
actctaagatctt

SEQ ID NO: 1746920 - DNA, 23 bp, Homo sapiens
actctaagttttagggtacatgt

SEQ ID NO: 1746921 - DNA, 21 bp, Homo sapiens
actctaatagtgcttaaaaat

SEQ ID NO: 1746922 - DNA, 22 bp, Homo sapiens
actctaattcccattttgcaaa

SEQ ID NO: 1746923 - DNA, 17 bp, Homo sapiens
actctacccatattaca

SEQ ID NO: 1746924 - DNA, 18 bp, Homo sapiens
actctactattaagtttg

SEQ ID NO: 1746925 - DNA, 20 bp, Homo sapiens
actctacttagcatgtccct

SEQ ID NO: 1746926 - DNA, 18 bp, Homo sapiens
actctagaaaaaagggct

SEQ ID NO: 1746927 - DNA, 21 bp, Homo sapiens
actctagacaagatattgtac

SEQ ID NO: 1746928 - DNA, 19 bp, Homo sapiens
actctagagtccaaggttt

SEQ ID NO: 1746929 - DNA, 20 bp, Homo sapiens
actctagagtccaaggttta

SEQ ID NO: 1746930 - DNA, 19 bp, Homo sapiens
actctagcaaggctcatct

SEQ ID NO: 1746931 - DNA, 14 bp, Homo sapiens
actctagttctaga

SEQ ID NO: 1746932 - DNA, 16 bp, Homo sapiens
actctagttctagatg

SEQ ID NO: 1746933 - DNA, 15 bp, Homo sapiens
actctatagactcta

SEQ ID NO: 1746934 - DNA, 15 bp, Homo sapiens
actctatatgtagtg

SEQ ID NO: 1746935 - DNA, 18 bp, Homo sapiens
actctcaaaatctttgta

SEQ ID NO: 1746936 - DNA, 19 bp, Homo sapiens
actctcacactgaatcagc

SEQ ID NO: 1746937 - DNA, 18 bp, Homo sapiens
actctcaggatcaagaaa

SEQ ID NO: 1746938 - DNA, 19 bp, Homo sapiens
actctcattctttgaacat

SEQ ID NO: 1746939 - DNA, 19 bp, Homo sapiens
actctccaacctggacaac

SEQ ID NO: 1746940 - DNA, 21 bp, Homo sapiens
actctcccaaagggcacaccc

SEQ ID NO: 1746941 - DNA, 10 bp, Homo sapiens
actctcccca

SEQ ID NO: 1746942 - DNA, 12 bp, Homo sapiens
actctccccaca

SEQ ID NO: 1746943 - DNA, 15 bp, Homo sapiens
actctccccacacta

SEQ ID NO: 1746944 - DNA, 11 bp, Homo sapiens
actctccccag

SEQ ID NO: 1746945 - DNA, 18 bp, Homo sapiens
actctccccagtgcctgc

SEQ ID NO: 1746946 - DNA, 19 bp, Homo sapiens
actctccccgctcaggggc

SEQ ID NO: 1746947 - DNA, 15 bp, Homo sapiens
actctcccctttctt

SEQ ID NO: 1746948 - DNA, 14 bp, Homo sapiens
actctcctcctccc

SEQ ID NO: 1746949 - DNA, 16 bp, Homo sapiens
actctcctcctcccct

SEQ ID NO: 1746950 - DNA, 18 bp, Homo sapiens
actctcctcctcccctcc

SEQ ID NO: 1746951 - DNA, 22 bp, Homo sapiens
actctcctcggccccctccatc

SEQ ID NO: 1746952 - DNA, 18 bp, Homo sapiens
actctccttcgtgtctct

SEQ ID NO: 1746953 - DNA, 17 bp, Homo sapiens
actgcgggagctctgta

SEQ ID NO: 1746954 - DNA, 20 bp, Homo sapiens
actgctaagtatttcccagc

SEQ ID NO: 1746955 - DNA, 16 bp, Homo sapiens
actgctacagcaattt

SEQ ID NO: 1746956 - DNA, 18 bp, Homo sapiens
actgctagagacgctgat

SEQ ID NO: 1746957 - DNA, 13 bp, Homo sapiens
actgctataaata

SEQ ID NO: 1746958 - DNA, 16 bp, Homo sapiens
actgctcaagaagaca

SEQ ID NO: 1746959 - DNA, 17 bp, Homo sapiens
actgctcagctctggtc

SEQ ID NO: 1746960 - DNA, 20 bp, Homo sapiens
actgctcatctgtacatact

SEQ ID NO: 1746961 - DNA, 20 bp, Homo sapiens
actgctcgtggactgtgctg

SEQ ID NO: 1746962 - DNA, 22 bp, Homo sapiens
actgctcgtggactgtgctggt

SEQ ID NO: 1746963 - DNA, 18 bp, Homo sapiens
actgctctaacagccctc

SEQ ID NO: 1746964 - DNA, 21 bp, Homo sapiens
actgctctcctccacctcaac

SEQ ID NO: 1746965 - DNA, 19 bp, Homo sapiens
actgctctgaatattttgt

SEQ ID NO: 1746966 - DNA, 22 bp, Homo sapiens
actgctctttattgcagaatgt

SEQ ID NO: 1746967 - DNA, 13 bp, Homo sapiens
actgctgagccac

SEQ ID NO: 1746968 - DNA, 13 bp, Homo sapiens
actgctgattctt

SEQ ID NO: 1746969 - DNA, 12 bp, Homo sapiens
actgctgcaaag

SEQ ID NO: 1746970 - DNA, 22 bp, Homo sapiens
actgctgcaaggtggcctctgc

SEQ ID NO: 1746971 - DNA, 19 bp, Homo sapiens
actgctgcagattagttct

SEQ ID NO: 1746972 - DNA, 14 bp, Homo sapiens
actgctgctgctgc

SEQ ID NO: 1746973 - DNA, 23 bp, Homo sapiens
actgctgctgctgctgccgccgc

SEQ ID NO: 1746974 - DNA, 17 bp, Homo sapiens
actgctggacatgagat

SEQ ID NO: 1746975 - DNA, 15 bp, Homo sapiens
actgctggctgcctt

SEQ ID NO: 1746976 - DNA, 19 bp, Homo sapiens
actgctgggactggccagg

SEQ ID NO: 1746977 - DNA, 17 bp, Homo sapiens
actgctggggagtccct

SEQ ID NO: 1746978 - DNA, 22 bp, Homo sapiens
actgctgtgaaccctggggcct

SEQ ID NO: 1746979 - DNA, 20 bp, Homo sapiens
actgctgttcctgctccatg

SEQ ID NO: 1746980 - DNA, 13 bp, Homo sapiens
actgctgttttat

SEQ ID NO: 1746981 - DNA, 19 bp, Homo sapiens
actgctgttttatgtcata

SEQ ID NO: 1746982 - DNA, 17 bp, Homo sapiens
actgcttaaattccaag

SEQ ID NO: 1746983 - DNA, 13 bp, Homo sapiens
actgcttctcttt

SEQ ID NO: 1746984 - DNA, 16 bp, Homo sapiens
actgcttctcttttga

SEQ ID NO: 1746985 - DNA, 16 bp, Homo sapiens
actgcttcttggagct

SEQ ID NO: 1746986 - DNA, 17 bp, Homo sapiens
actgctttccagcctgg

SEQ ID NO: 1746987 - DNA, 16 bp, Homo sapiens
actgctttgcaaagac

SEQ ID NO: 1746988 - DNA, 21 bp, Homo sapiens
actgcttttccacaaggaatc

SEQ ID NO: 1746989 - DNA, 19 bp, Homo sapiens
actgcttttcctcaagcaa

SEQ ID NO: 1746990 - DNA, 19 bp, Homo sapiens
actgcttttttttttccag

SEQ ID NO: 1746991 - DNA, 17 bp, Homo sapiens
actggaaaacagaacac

SEQ ID NO: 1746992 - DNA, 19 bp, Homo sapiens
actggaaaacagaacactt

SEQ ID NO: 1746993 - DNA, 23 bp, Homo sapiens
actggaaaggatctgtgattggc

SEQ ID NO: 1746994 - DNA, 21 bp, Homo sapiens
actggaaaggggagagcctgc

SEQ ID NO: 1746995 - DNA, 15 bp, Homo sapiens
actggaacatggcta

SEQ ID NO: 1746996 - DNA, 14 bp, Homo sapiens
actggaagaaagca

SEQ ID NO: 1746997 - DNA, 18 bp, Homo sapiens
actggaagacacttcaga

SEQ ID NO: 1746998 - DNA, 19 bp, Homo sapiens
actggaagacacttcagat

SEQ ID NO: 1746999 - DNA, 21 bp, Homo sapiens
actggaagcatgtaggagaat

SEQ ID NO: 1747000 - DNA, 15 bp, Homo sapiens
actggaaggagcaca

SEQ ID NO: 1747001 - DNA, 16 bp, Homo sapiens
actggaaggagcacat

SEQ ID NO: 1747002 - DNA, 19 bp, Homo sapiens
actggaatataaaacagtc

SEQ ID NO: 1747003 - DNA, 15 bp, Homo sapiens
actggacatgaagga

SEQ ID NO: 1747004 - DNA, 16 bp, Homo sapiens
actggacatgaaggaa

SEQ ID NO: 1747005 - DNA, 16 bp, Homo sapiens
actggaccactgggca

SEQ ID NO: 1747006 - DNA, 18 bp, Homo sapiens
actggactcaggaacttt

SEQ ID NO: 1747007 - DNA, 21 bp, Homo sapiens
actggactcaggatgcccagg

SEQ ID NO: 1747008 - DNA, 23 bp, Homo sapiens
actggactcaggatgcccagggc

SEQ ID NO: 1747009 - DNA, 12 bp, Homo sapiens
actggactgcat

SEQ ID NO: 1747010 - DNA, 22 bp, Homo sapiens
actggacttgagcttggcagct

SEQ ID NO: 1747011 - DNA, 18 bp, Homo sapiens
actggagaaaacccctcc

SEQ ID NO: 1747012 - DNA, 19 bp, Homo sapiens
actggagaaaacccctccc

SEQ ID NO: 1747013 - DNA, 23 bp, Homo sapiens
actggagaccgcttcacccctgc

SEQ ID NO: 1747014 - DNA, 16 bp, Homo sapiens
actggagcaccaggca

SEQ ID NO: 1747015 - DNA, 19 bp, Homo sapiens
actggagcaccaggcacga

SEQ ID NO: 1747016 - DNA, 18 bp, Homo sapiens
actggaggagcagcttcc

SEQ ID NO: 1747017 - DNA, 19 bp, Homo sapiens
actggaggagcagcttcct

SEQ ID NO: 1747018 - DNA, 15 bp, Homo sapiens
actggaggcccctgg

SEQ ID NO: 1747019 - DNA, 15 bp, Homo sapiens
actggaggggcccac

SEQ ID NO: 1747020 - DNA, 18 bp, Homo sapiens
actggaggggcccaccca

SEQ ID NO: 1747021 - DNA, 22 bp, Homo sapiens
actggagtgaggcttccaggct

SEQ ID NO: 1747022 - DNA, 13 bp, Homo sapiens
actggagtgcagg

SEQ ID NO: 1747023 - DNA, 17 bp, Homo sapiens
actggagtgcagggagg

SEQ ID NO: 1747024 - DNA, 23 bp, Homo sapiens
actggagttccttatccctctct

SEQ ID NO: 1747025 - DNA, 13 bp, Homo sapiens
actggagttctat

SEQ ID NO: 1747026 - DNA, 15 bp, Homo sapiens
actggagttctatgc

SEQ ID NO: 1747027 - DNA, 14 bp, Homo sapiens
actggatagcatga

SEQ ID NO: 1747028 - DNA, 12 bp, Homo sapiens
actggatatgtt

SEQ ID NO: 1747029 - DNA, 15 bp, Homo sapiens
actggatatttcaat

SEQ ID NO: 1747030 - DNA, 17 bp, Homo sapiens
actggatatttcaatct

SEQ ID NO: 1747031 - DNA, 21 bp, Homo sapiens
actggatatttcaatctttta

SEQ ID NO: 1747032 - DNA, 19 bp, Homo sapiens
actggatcccaacaccaaa

SEQ ID NO: 1747033 - DNA, 10 bp, Homo sapiens
actggatctt

SEQ ID NO: 1747034 - DNA, 14 bp, Homo sapiens
actggatcttctat

SEQ ID NO: 1747035 - DNA, 16 bp, Homo sapiens
actggatcttctatca

SEQ ID NO: 1747036 - DNA, 13 bp, Homo sapiens
actggattgcaga

SEQ ID NO: 1747037 - DNA, 13 bp, Homo sapiens
actggattggcca

SEQ ID NO: 1747038 - DNA, 14 bp, Homo sapiens
actggattggccaa

SEQ ID NO: 1747039 - DNA, 21 bp, Homo sapiens
actggcaataagatacacagc

SEQ ID NO: 1747040 - DNA, 16 bp, Homo sapiens
actggcactgaattaa

SEQ ID NO: 1747041 - DNA, 20 bp, Homo sapiens
actggcactgaattaatcat

SEQ ID NO: 1747042 - DNA, 14 bp, Homo sapiens
actggcagaagcat

SEQ ID NO: 1747043 - DNA, 14 bp, Homo sapiens
actggcagcctgca

SEQ ID NO: 1747044 - DNA, 17 bp, Homo sapiens
actggcagcctgcacct

SEQ ID NO: 1747045 - DNA, 21 bp, Homo sapiens
actggcaggggagacaggagc

SEQ ID NO: 1747046 - DNA, 13 bp, Homo sapiens
actggcaggtgca

SEQ ID NO: 1747047 - DNA, 14 bp, Homo sapiens
actggcaggtgcag

SEQ ID NO: 1747048 - DNA, 23 bp, Homo sapiens
actggcaggtgcagatgggctgt

SEQ ID NO: 1747049 - DNA, 13 bp, Homo sapiens
actggcaggtgtg

SEQ ID NO: 1747050 - DNA, 16 bp, Homo sapiens
actggcagttttccat

SEQ ID NO: 1747051 - DNA, 14 bp, Homo sapiens
actggccaccaggc

SEQ ID NO: 1747052 - DNA, 18 bp, Homo sapiens
actggccaccaggctggc

SEQ ID NO: 1747053 - DNA, 21 bp, Homo sapiens
actggccaccaggctggcgca

SEQ ID NO: 1747054 - DNA, 22 bp, Homo sapiens
actggccaccaggctggcgcag

SEQ ID NO: 1747055 - DNA, 12 bp, Homo sapiens
actggccagaga

SEQ ID NO: 1747056 - DNA, 21 bp, Homo sapiens
actggcccctactttgtggca

SEQ ID NO: 1747057 - DNA, 13 bp, Homo sapiens
actggcgccttct

SEQ ID NO: 1747058 - DNA, 14 bp, Homo sapiens
actggcgccttctc

SEQ ID NO: 1747059 - DNA, 15 bp, Homo sapiens
actggctctccaagt

SEQ ID NO: 1747060 - DNA, 15 bp, Homo sapiens
actggctggcctgag

SEQ ID NO: 1747061 - DNA, 16 bp, Homo sapiens
actggctggcctgagc

SEQ ID NO: 1747062 - DNA, 11 bp, Homo sapiens
actggctgggg

SEQ ID NO: 1747063 - DNA, 13 bp, Homo sapiens
actggctggggca

SEQ ID NO: 1747064 - DNA, 16 bp, Homo sapiens
actggctggggcagag

SEQ ID NO: 1747065 - DNA, 17 bp, Homo sapiens
actggctggggcagagg

SEQ ID NO: 1747066 - DNA, 17 bp, Homo sapiens
actggctgtctgcctgt

SEQ ID NO: 1747067 - DNA, 18 bp, Homo sapiens
actggctgtctgcctgta

SEQ ID NO: 1747068 - DNA, 20 bp, Homo sapiens
acttcatcgacttagcctga

SEQ ID NO: 1747069 - DNA, 14 bp, Homo sapiens
acttcatggaccaa

SEQ ID NO: 1747070 - DNA, 18 bp, Homo sapiens
acttcatggaccaagaat

SEQ ID NO: 1747071 - DNA, 18 bp, Homo sapiens
acttcattctaaaccaaa

SEQ ID NO: 1747072 - DNA, 14 bp, Homo sapiens
acttcattcttgaa

SEQ ID NO: 1747073 - DNA, 21 bp, Homo sapiens
acttcattcttgaaagctgtg

SEQ ID NO: 1747074 - DNA, 21 bp, Homo sapiens
acttcattgagagttttgtct

SEQ ID NO: 1747075 - DNA, 16 bp, Homo sapiens
acttcattgtaaatca

SEQ ID NO: 1747076 - DNA, 17 bp, Homo sapiens
acttccaaagaaagttc

SEQ ID NO: 1747077 - DNA, 24 bp, Homo sapiens
acttccaaagactccctccatagc

SEQ ID NO: 1747078 - DNA, 15 bp, Homo sapiens
acttccaagaaaaat

SEQ ID NO: 1747079 - DNA, 14 bp, Homo sapiens
acttccaccagcct

SEQ ID NO: 1747080 - DNA, 20 bp, Homo sapiens
acttccaggggaacctgcca

SEQ ID NO: 1747081 - DNA, 21 bp, Homo sapiens
acttccaggggaacctgccat

SEQ ID NO: 1747082 - DNA, 19 bp, Homo sapiens
acttccaggttccatccac

SEQ ID NO: 1747083 - DNA, 23 bp, Homo sapiens
acttccaggttccatccaccacc

SEQ ID NO: 1747084 - DNA, 14 bp, Homo sapiens
acttccatgcctta

SEQ ID NO: 1747085 - DNA, 13 bp, Homo sapiens
acttcccaccctg

SEQ ID NO: 1747086 - DNA, 23 bp, Homo sapiens
acttcccaggatctgctccaaca

SEQ ID NO: 1747087 - DNA, 18 bp, Homo sapiens
acttcccatctggctcag

SEQ ID NO: 1747088 - DNA, 22 bp, Homo sapiens
acttccccaatatcttgcttga

SEQ ID NO: 1747089 - DNA, 13 bp, Homo sapiens
acttccccatccc

SEQ ID NO: 1747090 - DNA, 14 bp, Homo sapiens
acttcccctgggca

SEQ ID NO: 1747091 - DNA, 18 bp, Homo sapiens
acttcccgggccagggct

SEQ ID NO: 1747092 - DNA, 20 bp, Homo sapiens
acttcccgggccagggctgc

SEQ ID NO: 1747093 - DNA, 18 bp, Homo sapiens
acttcccgtagctgccag

SEQ ID NO: 1747094 - DNA, 17 bp, Homo sapiens
acttcccgtctcagaat

SEQ ID NO: 1747095 - DNA, 19 bp, Homo sapiens
acttcccgtctcagaatct

SEQ ID NO: 1747096 - DNA, 14 bp, Homo sapiens
acttccctctgttt

SEQ ID NO: 1747097 - DNA, 14 bp, Homo sapiens
acttccgcctcctg

SEQ ID NO: 1747098 - DNA, 16 bp, Homo sapiens
acttccgcctcctgtg

SEQ ID NO: 1747099 - DNA, 22 bp, Homo sapiens
acttccgctgaggggtctcgga

SEQ ID NO: 1747100 - DNA, 18 bp, Homo sapiens
acttcctagggatctgaa

SEQ ID NO: 1747101 - DNA, 19 bp, Homo sapiens
acttcctagggatctgaaa

SEQ ID NO: 1747102 - DNA, 21 bp, Homo sapiens
acttcctagggatctgaaatc

SEQ ID NO: 1747103 - DNA, 22 bp, Homo sapiens
acttcctagggatctgaaatcc

SEQ ID NO: 1747104 - DNA, 14 bp, Homo sapiens
acttcctcaataaa

SEQ ID NO: 1747105 - DNA, 15 bp, Homo sapiens
acttcctcctcccca

SEQ ID NO: 1747106 - DNA, 18 bp, Homo sapiens
acttcctcctccccactt

SEQ ID NO: 1747107 - DNA, 20 bp, Homo sapiens
acttcctcctgatggccaag

SEQ ID NO: 1747108 - DNA, 23 bp, Homo sapiens
acttcctcctgatggccaagagc

SEQ ID NO: 1747109 - DNA, 18 bp, Homo sapiens
acttcctctcgcggccct

SEQ ID NO: 1747110 - DNA, 22 bp, Homo sapiens
acttcctctcgcggccctcagt

SEQ ID NO: 1747111 - DNA, 16 bp, Homo sapiens
acttcctgactctcac

SEQ ID NO: 1747112 - DNA, 11 bp, Homo sapiens
acttcctgagg

SEQ ID NO: 1747113 - DNA, 13 bp, Homo sapiens
acttcctgctgca

SEQ ID NO: 1747114 - DNA, 23 bp, Homo sapiens
acttcctggggatgtcatagcca

SEQ ID NO: 1747115 - DNA, 13 bp, Homo sapiens
acttcctggggcc

SEQ ID NO: 1747116 - DNA, 18 bp, Homo sapiens
acttcctgtccagctcca

SEQ ID NO: 1747117 - DNA, 14 bp, Homo sapiens
acttccttgagaca

SEQ ID NO: 1747118 - DNA, 14 bp, Homo sapiens
acttcctttataat

SEQ ID NO: 1747119 - DNA, 18 bp, Homo sapiens
acttcctttataatattt

SEQ ID NO: 1747120 - DNA, 23 bp, Homo sapiens
acttcgccaaggttgtagcatgg

SEQ ID NO: 1747121 - DNA, 19 bp, Homo sapiens
acttcgtcttctaatttca

SEQ ID NO: 1747122 - DNA, 18 bp, Homo sapiens
acttctagatctcagcca

SEQ ID NO: 1747123 - DNA, 23 bp, Homo sapiens
acttctatattttaatagaaata

SEQ ID NO: 1747124 - DNA, 17 bp, Homo sapiens
acttctatttaatgctt

SEQ ID NO: 1747125 - DNA, 16 bp, Homo sapiens
acttctcactcaccac

SEQ ID NO: 1747126 - DNA, 23 bp, Homo sapiens
acttctcatcatattgtatgtaa

SEQ ID NO: 1747127 - DNA, 16 bp, Homo sapiens
acttctccccgcagcc

SEQ ID NO: 1747128 - DNA, 13 bp, Homo sapiens
acttctcccctgc

SEQ ID NO: 1747129 - DNA, 16 bp, Homo sapiens
acttctcccctgggtc

SEQ ID NO: 1747130 - DNA, 16 bp, Homo sapiens
acttctctctaaggag

SEQ ID NO: 1747131 - DNA, 22 bp, Homo sapiens
acttctctgtgtgcacacccat

SEQ ID NO: 1747132 - DNA, 20 bp, Homo sapiens
acttctgacaaaggtggtaa

SEQ ID NO: 1747133 - DNA, 14 bp, Homo sapiens
acttctgactttac

SEQ ID NO: 1747134 - DNA, 18 bp, Homo sapiens
acttctgcaacaagcatg

SEQ ID NO: 1747135 - DNA, 12 bp, Homo sapiens
acttctgcctga

SEQ ID NO: 1747136 - DNA, 16 bp, Homo sapiens
acttctgcctggagac

SEQ ID NO: 1747137 - DNA, 21 bp, Homo sapiens
acttctggaaggctggctgag

SEQ ID NO: 1747138 - DNA, 20 bp, Homo sapiens
acttctggcataactaaaat

SEQ ID NO: 1747139 - DNA, 17 bp, Homo sapiens
acttctgggcttcatct

SEQ ID NO: 1747140 - DNA, 19 bp, Homo sapiens
acttctgggcttcatctgg

SEQ ID NO: 1747141 - DNA, 16 bp, Homo sapiens
acttctggtataattg

SEQ ID NO: 1747142 - DNA, 22 bp, Homo sapiens
acttctggttgtatttctatat

SEQ ID NO: 1747143 - DNA, 23 bp, Homo sapiens
acttctggttgtatttctatatt

SEQ ID NO: 1747144 - DNA, 21 bp, Homo sapiens
acttctgtttgatcactgtga

SEQ ID NO: 1747145 - DNA, 16 bp, Homo sapiens
acttcttaaaggcctg

SEQ ID NO: 1747146 - DNA, 18 bp, Homo sapiens
acttcttaaaggcctgga

SEQ ID NO: 1747147 - DNA, 21 bp, Homo sapiens
acttcttaaaggcctggaacc

SEQ ID NO: 1747148 - DNA, 17 bp, Homo sapiens
acttcttacgcaatgct

SEQ ID NO: 1747149 - DNA, 13 bp, Homo sapiens
acttcttcacctc

SEQ ID NO: 1747150 - DNA, 15 bp, Homo sapiens
acttcttcacctctt

SEQ ID NO: 1747151 - DNA, 11 bp, Homo sapiens
acttcttcctg

SEQ ID NO: 1747152 - DNA, 18 bp, Homo sapiens
acttcttcctgtgaagtt

SEQ ID NO: 1747153 - DNA, 17 bp, Homo sapiens
acttcttctccatccct

SEQ ID NO: 1747154 - DNA, 18 bp, Homo sapiens
acttcttctcttagattc

SEQ ID NO: 1747155 - DNA, 13 bp, Homo sapiens
acttcttgaaggt

SEQ ID NO: 1747156 - DNA, 23 bp, Homo sapiens
acttcttgaatataaaaaatcat

SEQ ID NO: 1747157 - DNA, 18 bp, Homo sapiens
acttcttgcttctttcta

SEQ ID NO: 1747158 - DNA, 20 bp, Homo sapiens
acttcttgcttctttctaga

SEQ ID NO: 1747159 - DNA, 19 bp, Homo sapiens
acttcttggtttggggaga

SEQ ID NO: 1747160 - DNA, 22 bp, Homo sapiens
acttcttggtttggggagaaat

SEQ ID NO: 1747161 - DNA, 22 bp, Homo sapiens
acttctttagcatttttatgca

SEQ ID NO: 1747162 - DNA, 20 bp, Homo sapiens
acttctttctgttgagagaa

SEQ ID NO: 1747163 - DNA, 19 bp, Homo sapiens
acttcttttgctcttagct

SEQ ID NO: 1747164 - DNA, 22 bp, Homo sapiens
acttcttttttcaaaagaaagt

SEQ ID NO: 1747165 - DNA, 16 bp, Homo sapiens
acttgaaaagaaagaa

SEQ ID NO: 1747166 - DNA, 12 bp, Homo sapiens
acttgaaagaaa

SEQ ID NO: 1747167 - DNA, 19 bp, Homo sapiens
acttgaaagattttattgt

SEQ ID NO: 1747168 - DNA, 20 bp, Homo sapiens
acttgaaatatataatattc

SEQ ID NO: 1747169 - DNA, 22 bp, Homo sapiens
acttgaaatatataatattcag

SEQ ID NO: 1747170 - DNA, 23 bp, Homo sapiens
acttgaacccgggggacagaggt

SEQ ID NO: 1747171 - DNA, 23 bp, Homo sapiens
acttgaagaaacagagtggcctc

SEQ ID NO: 1747172 - DNA, 14 bp, Homo sapiens
acttgaagggccag

SEQ ID NO: 1747173 - DNA, 18 bp, Homo sapiens
acttgaagggccagagcc

SEQ ID NO: 1747174 - DNA, 22 bp, Homo sapiens
acttgaagtctaaaagcagaaa

SEQ ID NO: 1747175 - DNA, 22 bp, Homo sapiens
acttgaagttgcttttttgact

SEQ ID NO: 1747176 - DNA, 19 bp, Homo sapiens
acttgaataaaaaaaatat

SEQ ID NO: 1747177 - DNA, 15 bp, Homo sapiens
acttgaatttctgga

SEQ ID NO: 1747178 - DNA, 22 bp, Homo sapiens
acttgacaacatcccacagtgg

SEQ ID NO: 1747179 - DNA, 13 bp, Homo sapiens
acttgacaccact

SEQ ID NO: 1747180 - DNA, 19 bp, Homo sapiens
acttgacccccttgagggt

SEQ ID NO: 1747181 - DNA, 22 bp, Homo sapiens
acttgaccccgacgccacagcc

SEQ ID NO: 1747182 - DNA, 22 bp, Homo sapiens
agaaacttatttctcatatcaa

SEQ ID NO: 1747183 - DNA, 13 bp, Homo sapiens
agaaacttgtgaa

SEQ ID NO: 1747184 - DNA, 22 bp, Homo sapiens
agaaactttgagtacagatact

SEQ ID NO: 1747185 - DNA, 22 bp, Homo sapiens
agaaacttttatctattctgag

SEQ ID NO: 1747186 - DNA, 17 bp, Homo sapiens
agaaacttttttatttt

SEQ ID NO: 1747187 - DNA, 16 bp, Homo sapiens
agaaagaaaatgaaga

SEQ ID NO: 1747188 - DNA, 21 bp, Homo sapiens
agaaagaactttaaagctcag

SEQ ID NO: 1747189 - DNA, 12 bp, Homo sapiens
agaaagaagccc

SEQ ID NO: 1747190 - DNA, 14 bp, Homo sapiens
agaaagaaggaagt

SEQ ID NO: 1747191 - DNA, 15 bp, Homo sapiens
agaaagaagtggaga

SEQ ID NO: 1747192 - DNA, 22 bp, Homo sapiens
agaaagaataggggctgaagac

SEQ ID NO: 1747193 - DNA, 19 bp, Homo sapiens
agaaagactattcaaacag

SEQ ID NO: 1747194 - DNA, 20 bp, Homo sapiens
agaaagactattcaaacagt

SEQ ID NO: 1747195 - DNA, 12 bp, Homo sapiens
agaaagacttgg

SEQ ID NO: 1747196 - DNA, 22 bp, Homo sapiens
agaaagacttggttggtagggt

SEQ ID NO: 1747197 - DNA, 15 bp, Homo sapiens
agaaagagctacctg

SEQ ID NO: 1747198 - DNA, 15 bp, Homo sapiens
agaaagagctgcctg

SEQ ID NO: 1747199 - DNA, 20 bp, Homo sapiens
agaaagagctgcctggatga

SEQ ID NO: 1747200 - DNA, 21 bp, Homo sapiens
agaaagatacagacattcaat

SEQ ID NO: 1747201 - DNA, 17 bp, Homo sapiens
agaaagatcattgaaat

SEQ ID NO: 1747202 - DNA, 18 bp, Homo sapiens
agaaagatcattgaaatt

SEQ ID NO: 1747203 - DNA, 16 bp, Homo sapiens
agaaagatgaaactga

SEQ ID NO: 1747204 - DNA, 17 bp, Homo sapiens
agaaagatgaaactgaa

SEQ ID NO: 1747205 - DNA, 21 bp, Homo sapiens
agaaagatgttccagtgagga

SEQ ID NO: 1747206 - DNA, 21 bp, Homo sapiens
agaaagcaatacgtttgtgca

SEQ ID NO: 1747207 - DNA, 22 bp, Homo sapiens
agaaagcaatacgtttgtgcag

SEQ ID NO: 1747208 - DNA, 22 bp, Homo sapiens
agaaagcatccctcacccatcc

SEQ ID NO: 1747209 - DNA, 17 bp, Homo sapiens
agaaagcattttgggat

SEQ ID NO: 1747210 - DNA, 18 bp, Homo sapiens
agaaagcctaaaattgag

SEQ ID NO: 1747211 - DNA, 18 bp, Homo sapiens
agaaagcctctctctccc

SEQ ID NO: 1747212 - DNA, 17 bp, Homo sapiens
agaaagctccttccaga

SEQ ID NO: 1747213 - DNA, 18 bp, Homo sapiens
agaaagctctacatttgc

SEQ ID NO: 1747214 - DNA, 15 bp, Homo sapiens
agaaagctggactga

SEQ ID NO: 1747215 - DNA, 11 bp, Homo sapiens
agaaaggagac

SEQ ID NO: 1747216 - DNA, 14 bp, Homo sapiens
agaaaggatattta

SEQ ID NO: 1747217 - DNA, 18 bp, Homo sapiens
agaaaggcaaagtacatt

SEQ ID NO: 1747218 - DNA, 17 bp, Homo sapiens
agaaaggctctattcca

SEQ ID NO: 1747219 - DNA, 16 bp, Homo sapiens
agaaaggctgttaaat

SEQ ID NO: 1747220 - DNA, 22 bp, Homo sapiens
agaaaggctgttaaatacagga

SEQ ID NO: 1747221 - DNA, 19 bp, Homo sapiens
agaaagggattgctgaggc

SEQ ID NO: 1747222 - DNA, 20 bp, Homo sapiens
agaaagggattgctgaggca

SEQ ID NO: 1747223 - DNA, 15 bp, Homo sapiens
agaaagggattgctt

SEQ ID NO: 1747224 - DNA, 14 bp, Homo sapiens
agaaagggcaaatt

SEQ ID NO: 1747225 - DNA, 17 bp, Homo sapiens
agaaagggcaaattatt

SEQ ID NO: 1747226 - DNA, 16 bp, Homo sapiens
agaaaggggagcccac

SEQ ID NO: 1747227 - DNA, 17 bp, Homo sapiens
agaaaggggagcccact

SEQ ID NO: 1747228 - DNA, 14 bp, Homo sapiens
agaaaggtctctgg

SEQ ID NO: 1747229 - DNA, 22 bp, Homo sapiens
agaaaggtgagtttgagctgcc

SEQ ID NO: 1747230 - DNA, 17 bp, Homo sapiens
agaaagtaaataaaagg

SEQ ID NO: 1747231 - DNA, 15 bp, Homo sapiens
agaaagtctatgctt

SEQ ID NO: 1747232 - DNA, 23 bp, Homo sapiens
agaaagtgaagcaaatcagaaac

SEQ ID NO: 1747233 - DNA, 19 bp, Homo sapiens
agaaagtgggaggtcagga

SEQ ID NO: 1747234 - DNA, 17 bp, Homo sapiens
agaaagtgtatttggaa

SEQ ID NO: 1747235 - DNA, 22 bp, Homo sapiens
agaaagttagggggttcttatt

SEQ ID NO: 1747236 - DNA, 23 bp, Homo sapiens
agaaagttattgataagttcata

SEQ ID NO: 1747237 - DNA, 17 bp, Homo sapiens
agaaataaattcctaaa

SEQ ID NO: 1747238 - DNA, 22 bp, Homo sapiens
agaaataaattttgtttcagaa

SEQ ID NO: 1747239 - DNA, 20 bp, Homo sapiens
agaaatacaaaaaattagct

SEQ ID NO: 1747240 - DNA, 17 bp, Homo sapiens
agaaatacagtactgtt

SEQ ID NO: 1747241 - DNA, 15 bp, Homo sapiens
agaaatactgctctg

SEQ ID NO: 1747242 - DNA, 14 bp, Homo sapiens
agaaatagacaaaa

SEQ ID NO: 1747243 - DNA, 22 bp, Homo sapiens
agaaatagacaaaaagtatatt

SEQ ID NO: 1747244 - DNA, 18 bp, Homo sapiens
agaaatagacagtatatt

SEQ ID NO: 1747245 - DNA, 17 bp, Homo sapiens
agaaatagacttaataa

SEQ ID NO: 1747246 - DNA, 11 bp, Homo sapiens
agaaatagcag

SEQ ID NO: 1747247 - DNA, 18 bp, Homo sapiens
agaaatataacacatttt

SEQ ID NO: 1747248 - DNA, 20 bp, Homo sapiens
agaaatatcgctgatgcaga

SEQ ID NO: 1747249 - DNA, 15 bp, Homo sapiens
agaaatatctttctc

SEQ ID NO: 1747250 - DNA, 20 bp, Homo sapiens
agaaatatctttctcttacc

SEQ ID NO: 1747251 - DNA, 13 bp, Homo sapiens
agaaatatgattt

SEQ ID NO: 1747252 - DNA, 14 bp, Homo sapiens
agaaatatgtggtt

SEQ ID NO: 1747253 - DNA, 20 bp, Homo sapiens
agaaatattggttgaaagtt

SEQ ID NO: 1747254 - DNA, 17 bp, Homo sapiens
agaaatattttaaaatc

SEQ ID NO: 1747255 - DNA, 19 bp, Homo sapiens
agaaatattttaaaatcag

SEQ ID NO: 1747256 - DNA, 23 bp, Homo sapiens
agaaatattttaatttttaaatg

SEQ ID NO: 1747257 - DNA, 17 bp, Homo sapiens
agaaatcaaagagagaa

SEQ ID NO: 1747258 - DNA, 19 bp, Homo sapiens
agaaatcacaggggcgggg

SEQ ID NO: 1747259 - DNA, 18 bp, Homo sapiens
agaaatcagtaatattta

SEQ ID NO: 1747260 - DNA, 23 bp, Homo sapiens
agaaatccagtttgtgtttttct

SEQ ID NO: 1747261 - DNA, 21 bp, Homo sapiens
agaaatccatatcttaaagaa

SEQ ID NO: 1747262 - DNA, 20 bp, Homo sapiens
agaaatctactgaattggct

SEQ ID NO: 1747263 - DNA, 23 bp, Homo sapiens
agaaatctagtatttcatgctgg

SEQ ID NO: 1747264 - DNA, 20 bp, Homo sapiens
agaaatctcctaacaaaaga

SEQ ID NO: 1747265 - DNA, 21 bp, Homo sapiens
agaaatctcctaacaaaagaa

SEQ ID NO: 1747266 - DNA, 16 bp, Homo sapiens
agaaatctttctccct

SEQ ID NO: 1747267 - DNA, 12 bp, Homo sapiens
agaaatgaataa

SEQ ID NO: 1747268 - DNA, 19 bp, Homo sapiens
agaaatgaataatttccca

SEQ ID NO: 1747269 - DNA, 16 bp, Homo sapiens
agaaatgcatattgta

SEQ ID NO: 1747270 - DNA, 18 bp, Homo sapiens
agaaatgcatattgtatt

SEQ ID NO: 1747271 - DNA, 15 bp, Homo sapiens
agaaatgcatatttg

SEQ ID NO: 1747272 - DNA, 22 bp, Homo sapiens
agaaatgctaatgtaatcattt

SEQ ID NO: 1747273 - DNA, 14 bp, Homo sapiens
agaaatgctgctgg

SEQ ID NO: 1747274 - DNA, 17 bp, Homo sapiens
agaaatggcttttctta

SEQ ID NO: 1747275 - DNA, 18 bp, Homo sapiens
agaaatggtttcctctgg

SEQ ID NO: 1747276 - DNA, 15 bp, Homo sapiens
agaaatgtcataaat

SEQ ID NO: 1747277 - DNA, 22 bp, Homo sapiens
agaaatgtcataaattactgtt

SEQ ID NO: 1747278 - DNA, 21 bp, Homo sapiens
agaaatgtgtagctgcaaaaa

SEQ ID NO: 1747279 - DNA, 22 bp, Homo sapiens
agaaatgttgagtctgtactaa

SEQ ID NO: 1747280 - DNA, 21 bp, Homo sapiens
agaaattagaaaaaaattact

SEQ ID NO: 1747281 - DNA, 13 bp, Homo sapiens
agaaattagattt

SEQ ID NO: 1747282 - DNA, 14 bp, Homo sapiens
agaaattagccggg

SEQ ID NO: 1747283 - DNA, 21 bp, Homo sapiens
agaaattatgatcctctattt

SEQ ID NO: 1747284 - DNA, 11 bp, Homo sapiens
agaaattcagg

SEQ ID NO: 1747285 - DNA, 14 bp, Homo sapiens
agaaattcaggtac

SEQ ID NO: 1747286 - DNA, 21 bp, Homo sapiens
agaaattccatacttctctca

SEQ ID NO: 1747287 - DNA, 22 bp, Homo sapiens
agaaattctgcaagtttctgtt

SEQ ID NO: 1747288 - DNA, 16 bp, Homo sapiens
agaaattctggcccag

SEQ ID NO: 1747289 - DNA, 19 bp, Homo sapiens
agaaattctggcccagcca

SEQ ID NO: 1747290 - DNA, 21 bp, Homo sapiens
agaaattctgtcatagaaagt

SEQ ID NO: 1747291 - DNA, 17 bp, Homo sapiens
agaaattgcatttcctg

SEQ ID NO: 1747292 - DNA, 21 bp, Homo sapiens
agaaattgtatattgtaattt

SEQ ID NO: 1747293 - DNA, 16 bp, Homo sapiens
agaaattgtgtgtgca

SEQ ID NO: 1747294 - DNA, 14 bp, Homo sapiens
agaaatttggcatt

SEQ ID NO: 1747295 - DNA, 17 bp, Homo sapiens
agaaattttgtaagaag

SEQ ID NO: 1747296 - DNA, 14 bp, Homo sapiens
agaagtattcctgt

SEQ ID NO: 1747297 - DNA, 24 bp, Homo sapiens
agaagtattcctgttgctgtcttc

SEQ ID NO: 1747298 - DNA, 20 bp, Homo sapiens
agaagtcactcacactggcc

SEQ ID NO: 1747299 - DNA, 17 bp, Homo sapiens
agaagtcactgaacaaa

SEQ ID NO: 1747300 - DNA, 20 bp, Homo sapiens
agaagtcatacctttttctt

SEQ ID NO: 1747301 - DNA, 13 bp, Homo sapiens
agaagtctcattc

SEQ ID NO: 1747302 - DNA, 14 bp, Homo sapiens
agaagtctcattcg

SEQ ID NO: 1747303 - DNA, 14 bp, Homo sapiens
agaagtcttgaagt

SEQ ID NO: 1747304 - DNA, 16 bp, Homo sapiens
agaagtgaatgctggg

SEQ ID NO: 1747305 - DNA, 14 bp, Homo sapiens
agaagtgagcaaaa

SEQ ID NO: 1747306 - DNA, 23 bp, Homo sapiens
agaagtgagtttgtaaatattct

SEQ ID NO: 1747307 - DNA, 17 bp, Homo sapiens
agaagtgatatggtgaa

SEQ ID NO: 1747308 - DNA, 15 bp, Homo sapiens
agaagtgctccctgg

SEQ ID NO: 1747309 - DNA, 22 bp, Homo sapiens
agaagtgctctttgtggcagtg

SEQ ID NO: 1747310 - DNA, 17 bp, Homo sapiens
agaagtggaccaggaca

SEQ ID NO: 1747311 - DNA, 18 bp, Homo sapiens
agaagtgttgtaaaagat

SEQ ID NO: 1747312 - DNA, 16 bp, Homo sapiens
agaagttaaaaaacag

SEQ ID NO: 1747313 - DNA, 14 bp, Homo sapiens
agaagttctcagaa

SEQ ID NO: 1747314 - DNA, 13 bp, Homo sapiens
agaagttgctaag

SEQ ID NO: 1747315 - DNA, 14 bp, Homo sapiens
agaagttgtttgtc

SEQ ID NO: 1747316 - DNA, 12 bp, Homo sapiens
agaagtttaaat

SEQ ID NO: 1747317 - DNA, 22 bp, Homo sapiens
agaagtttggctgctgtcataa

SEQ ID NO: 1747318 - DNA, 15 bp, Homo sapiens
agaagtttgtcaagt

SEQ ID NO: 1747319 - DNA, 12 bp, Homo sapiens
agaagtttttct

SEQ ID NO: 1747320 - DNA, 16 bp, Homo sapiens
agaagtttttctttgt

SEQ ID NO: 1747321 - DNA, 19 bp, Homo sapiens
agaataaaattcctatctc

SEQ ID NO: 1747322 - DNA, 13 bp, Homo sapiens
agaataaaggcag

SEQ ID NO: 1747323 - DNA, 14 bp, Homo sapiens
agaataaaggcagt

SEQ ID NO: 1747324 - DNA, 14 bp, Homo sapiens
agaataaataaaga

SEQ ID NO: 1747325 - DNA, 20 bp, Homo sapiens
agaataaataaagaagaaaa

SEQ ID NO: 1747326 - DNA, 18 bp, Homo sapiens
agaataaattggattatt

SEQ ID NO: 1747327 - DNA, 19 bp, Homo sapiens
agaataaattggattattt

SEQ ID NO: 1747328 - DNA, 15 bp, Homo sapiens
agaataaatttggga

SEQ ID NO: 1747329 - DNA, 17 bp, Homo sapiens
agaataactacctcctc

SEQ ID NO: 1747330 - DNA, 19 bp, Homo sapiens
agaataactacctcctcac

SEQ ID NO: 1747331 - DNA, 23 bp, Homo sapiens
agaataagacaagagatctacac

SEQ ID NO: 1747332 - DNA, 13 bp, Homo sapiens
agaataaggagga

SEQ ID NO: 1747333 - DNA, 14 bp, Homo sapiens
agaataaggaggag

SEQ ID NO: 1747334 - DNA, 16 bp, Homo sapiens
agaataaggaggagga

SEQ ID NO: 1747335 - DNA, 16 bp, Homo sapiens
agaataagttcataca

SEQ ID NO: 1747336 - DNA, 21 bp, Homo sapiens
agaataatcacgctttcctga

SEQ ID NO: 1747337 - DNA, 14 bp, Homo sapiens
agaataatctatta

SEQ ID NO: 1747338 - DNA, 15 bp, Homo sapiens
agaataatgaatgga

SEQ ID NO: 1747339 - DNA, 19 bp, Homo sapiens
agaataattcttttctgag

SEQ ID NO: 1747340 - DNA, 12 bp, Homo sapiens
agaatacagaaa

SEQ ID NO: 1747341 - DNA, 18 bp, Homo sapiens
agaatacagtaagctgct

SEQ ID NO: 1747342 - DNA, 18 bp, Homo sapiens
agaataccacatcaaata

SEQ ID NO: 1747343 - DNA, 16 bp, Homo sapiens
agaatacggaagagca

SEQ ID NO: 1747344 - DNA, 21 bp, Homo sapiens
agaatacggaagagcaggtga

SEQ ID NO: 1747345 - DNA, 23 bp, Homo sapiens
agaatacgggtccctctaaccca

SEQ ID NO: 1747346 - DNA, 16 bp, Homo sapiens
agaatactggtctcag

SEQ ID NO: 1747347 - DNA, 18 bp, Homo sapiens
agaatacttgactcattt

SEQ ID NO: 1747348 - DNA, 14 bp, Homo sapiens
agaatactttttaa

SEQ ID NO: 1747349 - DNA, 14 bp, Homo sapiens
agaatagaaacgta

SEQ ID NO: 1747350 - DNA, 21 bp, Homo sapiens
agaatagaacaacatatacaa

SEQ ID NO: 1747351 - DNA, 16 bp, Homo sapiens
agaatagagctgccac

SEQ ID NO: 1747352 - DNA, 18 bp, Homo sapiens
agaatagagctgccactg

SEQ ID NO: 1747353 - DNA, 14 bp, Homo sapiens
agaatagcacagcc

SEQ ID NO: 1747354 - DNA, 18 bp, Homo sapiens
agaatagcacagccagac

SEQ ID NO: 1747355 - DNA, 12 bp, Homo sapiens
agaatagctttt

SEQ ID NO: 1747356 - DNA, 19 bp, Homo sapiens
agaataggcattaacacaa

SEQ ID NO: 1747357 - DNA, 15 bp, Homo sapiens
agaatataattatcg

SEQ ID NO: 1747358 - DNA, 17 bp, Homo sapiens
agaatataattatcgga

SEQ ID NO: 1747359 - DNA, 12 bp, Homo sapiens
agaatatacctt

SEQ ID NO: 1747360 - DNA, 13 bp, Homo sapiens
agaatatatacat

SEQ ID NO: 1747361 - DNA, 14 bp, Homo sapiens
agaatatcatcttt

SEQ ID NO: 1747362 - DNA, 15 bp, Homo sapiens
agaatatcatctttt

SEQ ID NO: 1747363 - DNA, 19 bp, Homo sapiens
agaatatcctatactggtt

SEQ ID NO: 1747364 - DNA, 13 bp, Homo sapiens
agaatatgacaat

SEQ ID NO: 1747365 - DNA, 16 bp, Homo sapiens
agaatatgacttttta

SEQ ID NO: 1747366 - DNA, 18 bp, Homo sapiens
agaatatgtttcaaactt

SEQ ID NO: 1747367 - DNA, 20 bp, Homo sapiens
agaatattagctttactgtt

SEQ ID NO: 1747368 - DNA, 12 bp, Homo sapiens
agaatattgtcc

SEQ ID NO: 1747369 - DNA, 22 bp, Homo sapiens
agaatatttattacctctgata

SEQ ID NO: 1747370 - DNA, 13 bp, Homo sapiens
agaatatttctat

SEQ ID NO: 1747371 - DNA, 19 bp, Homo sapiens
agaatatttctattgaatt

SEQ ID NO: 1747372 - DNA, 23 bp, Homo sapiens
agaatatttttatatttccttta

SEQ ID NO: 1747373 - DNA, 20 bp, Homo sapiens
agaatcacggtggtaaagaa

SEQ ID NO: 1747374 - DNA, 16 bp, Homo sapiens
agaatcagaagatagt

SEQ ID NO: 1747375 - DNA, 17 bp, Homo sapiens
agaatcatatgattctg

SEQ ID NO: 1747376 - DNA, 21 bp, Homo sapiens
agaatcatatgattctgcttt

SEQ ID NO: 1747377 - DNA, 16 bp, Homo sapiens
agaatcatgtttcttt

SEQ ID NO: 1747378 - DNA, 18 bp, Homo sapiens
agaatcatgtttctttga

SEQ ID NO: 1747379 - DNA, 12 bp, Homo sapiens
agaatccaaaga

SEQ ID NO: 1747380 - DNA, 18 bp, Homo sapiens
agaatccaagtgaacact

SEQ ID NO: 1747381 - DNA, 14 bp, Homo sapiens
agaatccacaagga

SEQ ID NO: 1747382 - DNA, 15 bp, Homo sapiens
agaatccacaaggac

SEQ ID NO: 1747383 - DNA, 18 bp, Homo sapiens
agaatccacatttctaaa

SEQ ID NO: 1747384 - DNA, 19 bp, Homo sapiens
agaatccacatttctaaaa

SEQ ID NO: 1747385 - DNA, 17 bp, Homo sapiens
agaatccagtttctttc

SEQ ID NO: 1747386 - DNA, 19 bp, Homo sapiens
agaatccataaatgtgttc

SEQ ID NO: 1747387 - DNA, 17 bp, Homo sapiens
agaatcccagcagcaga

SEQ ID NO: 1747388 - DNA, 18 bp, Homo sapiens
agaatccctggcaaaggg

SEQ ID NO: 1747389 - DNA, 21 bp, Homo sapiens
agaatcctcagttggaatcat

SEQ ID NO: 1747390 - DNA, 15 bp, Homo sapiens
agaatcctcccttcc

SEQ ID NO: 1747391 - DNA, 21 bp, Homo sapiens
agaatcctcccttcccaggag

SEQ ID NO: 1747392 - DNA, 21 bp, Homo sapiens
agaatcctctcctttcttatt

SEQ ID NO: 1747393 - DNA, 17 bp, Homo sapiens
agaatccttatctataa

SEQ ID NO: 1747394 - DNA, 21 bp, Homo sapiens
agaatccttatctataaaagg

SEQ ID NO: 1747395 - DNA, 21 bp, Homo sapiens
agaatcctttacattcaactt

SEQ ID NO: 1747396 - DNA, 10 bp, Homo sapiens
agaatctaaa

SEQ ID NO: 1747397 - DNA, 16 bp, Homo sapiens
agaatctaaagccagt

SEQ ID NO: 1747398 - DNA, 15 bp, Homo sapiens
agaatctaatgaatg

SEQ ID NO: 1747399 - DNA, 13 bp, Homo sapiens
agaatctagaaat

SEQ ID NO: 1747400 - DNA, 16 bp, Homo sapiens
agaatctagaagatgt

SEQ ID NO: 1747401 - DNA, 18 bp, Homo sapiens
agaatctatatttaacaa

SEQ ID NO: 1747402 - DNA, 17 bp, Homo sapiens
agaatctcaaataacta

SEQ ID NO: 1747403 - DNA, 18 bp, Homo sapiens
agaatctcaacatgtctc

SEQ ID NO: 1747404 - DNA, 23 bp, Homo sapiens
agaatctcttcatgcttgacata

SEQ ID NO: 1747405 - DNA, 17 bp, Homo sapiens
agaatctgctgttgcca

SEQ ID NO: 1747406 - DNA, 20 bp, Homo sapiens
agaatctgctgttgccatag

SEQ ID NO: 1747407 - DNA, 17 bp, Homo sapiens
agaatcttaatgcttgt

SEQ ID NO: 1747408 - DNA, 18 bp, Homo sapiens
agaatcttaatgcttgta

SEQ ID NO: 1747409 - DNA, 19 bp, Homo sapiens
agaatcttgttttgaaaat

SEQ ID NO: 1747410 - DNA, 22 bp, Homo sapiens
agaatcttgttttgaaaataac

SEQ ID NO: 1747411 - DNA, 19 bp, Homo sapiens
agactagaggccagggcag

SEQ ID NO: 1747412 - DNA, 13 bp, Homo sapiens
agactagatgtag

SEQ ID NO: 1747413 - DNA, 19 bp, Homo sapiens
agactagatgtagtatttt

SEQ ID NO: 1747414 - DNA, 19 bp, Homo sapiens
agactagattgcctttgtt

SEQ ID NO: 1747415 - DNA, 23 bp, Homo sapiens
agactagcaatctcttcattatt

SEQ ID NO: 1747416 - DNA, 21 bp, Homo sapiens
agactattcaaacagtctcag

SEQ ID NO: 1747417 - DNA, 14 bp, Homo sapiens
agactatttcaaaa

SEQ ID NO: 1747418 - DNA, 12 bp, Homo sapiens
agactatttctt

SEQ ID NO: 1747419 - DNA, 13 bp, Homo sapiens
agactatttcttt

SEQ ID NO: 1747420 - DNA, 16 bp, Homo sapiens
agactatttcttttta

SEQ ID NO: 1747421 - DNA, 12 bp, Homo sapiens
agactatttgct

SEQ ID NO: 1747422 - DNA, 18 bp, Homo sapiens
agactatttgctaatgta

SEQ ID NO: 1747423 - DNA, 18 bp, Homo sapiens
agactcaaaacctggaga

SEQ ID NO: 1747424 - DNA, 21 bp, Homo sapiens
agactcaagagaatttatgtg

SEQ ID NO: 1747425 - DNA, 22 bp, Homo sapiens
agactcaaggtggtcagtaaat

SEQ ID NO: 1747426 - DNA, 14 bp, Homo sapiens
agactcacctctgc

SEQ ID NO: 1747427 - DNA, 17 bp, Homo sapiens
agactcacctctgcctc

SEQ ID NO: 1747428 - DNA, 13 bp, Homo sapiens
agactcagctgct

SEQ ID NO: 1747429 - DNA, 15 bp, Homo sapiens
agactcagctgctat

SEQ ID NO: 1747430 - DNA, 19 bp, Homo sapiens
agactcaggagtctgccac

SEQ ID NO: 1747431 - DNA, 20 bp, Homo sapiens
agactcaggagtctgccact

SEQ ID NO: 1747432 - DNA, 20 bp, Homo sapiens
agactcagggccccagcact

SEQ ID NO: 1747433 - DNA, 23 bp, Homo sapiens
agactcagtatgctttccctgag

SEQ ID NO: 1747434 - DNA, 19 bp, Homo sapiens
agactcatttcacagcctt

SEQ ID NO: 1747435 - DNA, 13 bp, Homo sapiens
agactccaaagaa

SEQ ID NO: 1747436 - DNA, 14 bp, Homo sapiens
agactccaaagaaa

SEQ ID NO: 1747437 - DNA, 15 bp, Homo sapiens
agactccaaggagct

SEQ ID NO: 1747438 - DNA, 19 bp, Homo sapiens
agactccaaggagctactg

SEQ ID NO: 1747439 - DNA, 18 bp, Homo sapiens
agactccaatggggccag

SEQ ID NO: 1747440 - DNA, 19 bp, Homo sapiens
agactccaatggggccagc

SEQ ID NO: 1747441 - DNA, 23 bp, Homo sapiens
agactccaatggggccagcactg

SEQ ID NO: 1747442 - DNA, 14 bp, Homo sapiens
agactccacctcaa

SEQ ID NO: 1747443 - DNA, 14 bp, Homo sapiens
agactccagaatct

SEQ ID NO: 1747444 - DNA, 24 bp, Homo sapiens
agactccagaatctgctgttgcca

SEQ ID NO: 1747445 - DNA, 13 bp, Homo sapiens
agactccatctct

SEQ ID NO: 1747446 - DNA, 21 bp, Homo sapiens
agactccatctctttaaaaac

SEQ ID NO: 1747447 - DNA, 17 bp, Homo sapiens
agactccctgatcccag

SEQ ID NO: 1747448 - DNA, 20 bp, Homo sapiens
agactccctgatcccagacc

SEQ ID NO: 1747449 - DNA, 17 bp, Homo sapiens
agactcctggtctgtga

SEQ ID NO: 1747450 - DNA, 17 bp, Homo sapiens
agactcgactctgtgcc

SEQ ID NO: 1747451 - DNA, 17 bp, Homo sapiens
agactctagagtccaag

SEQ ID NO: 1747452 - DNA, 19 bp, Homo sapiens
agactctagagtccaaggt

SEQ ID NO: 1747453 - DNA, 21 bp, Homo sapiens
agactctagagtccaaggttt

SEQ ID NO: 1747454 - DNA, 16 bp, Homo sapiens
agactctgtggggcct

SEQ ID NO: 1747455 - DNA, 22 bp, Homo sapiens
agactcttgcctgtttcccagg

SEQ ID NO: 1747456 - DNA, 23 bp, Homo sapiens
agactctttgggtccattcagat

SEQ ID NO: 1747457 - DNA, 23 bp, Homo sapiens
agactctttttttgagtgacagc

SEQ ID NO: 1747458 - DNA, 21 bp, Homo sapiens
agactgaaagcagcagctagg

SEQ ID NO: 1747459 - DNA, 19 bp, Homo sapiens
agactgaacatgtttacag

SEQ ID NO: 1747460 - DNA, 17 bp, Homo sapiens
agactgaactcgcaggg

SEQ ID NO: 1747461 - DNA, 22 bp, Homo sapiens
agactgacagtttacagacgct

SEQ ID NO: 1747462 - DNA, 14 bp, Homo sapiens
agactgaccccaga

SEQ ID NO: 1747463 - DNA, 14 bp, Homo sapiens
agactgagtcagat

SEQ ID NO: 1747464 - DNA, 14 bp, Homo sapiens
agactgcagagggg

SEQ ID NO: 1747465 - DNA, 11 bp, Homo sapiens
agactgcagct

SEQ ID NO: 1747466 - DNA, 17 bp, Homo sapiens
agactgcagctgctgaa

SEQ ID NO: 1747467 - DNA, 23 bp, Homo sapiens
agactgcgatttgtcccaggtcc

SEQ ID NO: 1747468 - DNA, 23 bp, Homo sapiens
agactgcgggatggtcctggggc

SEQ ID NO: 1747469 - DNA, 14 bp, Homo sapiens
agactgctgcaaag

SEQ ID NO: 1747470 - DNA, 19 bp, Homo sapiens
agactgctgggactggcca

SEQ ID NO: 1747471 - DNA, 21 bp, Homo sapiens
agactgcttcccatcctaccc

SEQ ID NO: 1747472 - DNA, 23 bp, Homo sapiens
agactggagaaaacccctcccac

SEQ ID NO: 1747473 - DNA, 19 bp, Homo sapiens
agactggagtgaggcttcc

SEQ ID NO: 1747474 - DNA, 23 bp, Homo sapiens
agactggagtgaggcttccaggc

SEQ ID NO: 1747475 - DNA, 18 bp, Homo sapiens
agactggcacagttttct

SEQ ID NO: 1747476 - DNA, 17 bp, Homo sapiens
agactgggagccacttc

SEQ ID NO: 1747477 - DNA, 22 bp, Homo sapiens
agactgggagccacttctcccc

SEQ ID NO: 1747478 - DNA, 17 bp, Homo sapiens
agactgggcccaggcag

SEQ ID NO: 1747479 - DNA, 18 bp, Homo sapiens
agactgggcccaggcagg

SEQ ID NO: 1747480 - DNA, 19 bp, Homo sapiens
agactgggcccaggcaggt

SEQ ID NO: 1747481 - DNA, 18 bp, Homo sapiens
agactgggctctggctct

SEQ ID NO: 1747482 - DNA, 15 bp, Homo sapiens
agactgggtttctag

SEQ ID NO: 1747483 - DNA, 17 bp, Homo sapiens
agactgtagatatgtat

SEQ ID NO: 1747484 - DNA, 22 bp, Homo sapiens
agactgtagattgcttctgtag

SEQ ID NO: 1747485 - DNA, 18 bp, Homo sapiens
agactgtagcctggatat

SEQ ID NO: 1747486 - DNA, 18 bp, Homo sapiens
agactgtaggattcaagt

SEQ ID NO: 1747487 - DNA, 21 bp, Homo sapiens
agactgtcagcttccaaacat

SEQ ID NO: 1747488 - DNA, 20 bp, Homo sapiens
agactgtgaacagcttgctg

SEQ ID NO: 1747489 - DNA, 22 bp, Homo sapiens
agactgtgaacttgactgggtg

SEQ ID NO: 1747490 - DNA, 18 bp, Homo sapiens
agactgtgaggcggcagc

SEQ ID NO: 1747491 - DNA, 11 bp, Homo sapiens
agactgtggct

SEQ ID NO: 1747492 - DNA, 19 bp, Homo sapiens
agactgtggctagtgacaa

SEQ ID NO: 1747493 - DNA, 21 bp, Homo sapiens
agactgtgtttggtcctgtag

SEQ ID NO: 1747494 - DNA, 14 bp, Homo sapiens
agactgttgctcaa

SEQ ID NO: 1747495 - DNA, 23 bp, Homo sapiens
agactgttgctcaaatctattca

SEQ ID NO: 1747496 - DNA, 19 bp, Homo sapiens
agactgttttactgtttta

SEQ ID NO: 1747497 - DNA, 23 bp, Homo sapiens
agactgtttttcagggaggtggc

SEQ ID NO: 1747498 - DNA, 22 bp, Homo sapiens
agacttaaaacatggtgcctat

SEQ ID NO: 1747499 - DNA, 18 bp, Homo sapiens
agacttactctaagatct

SEQ ID NO: 1747500 - DNA, 16 bp, Homo sapiens
agacttagggcaccag

SEQ ID NO: 1747501 - DNA, 18 bp, Homo sapiens
agacttagtatattttct

SEQ ID NO: 1747502 - DNA, 19 bp, Homo sapiens
agacttcacagcgtctgct

SEQ ID NO: 1747503 - DNA, 21 bp, Homo sapiens
agacttcacagcgtctgctca

SEQ ID NO: 1747504 - DNA, 20 bp, Homo sapiens
agacttccaaatcctggaag

SEQ ID NO: 1747505 - DNA, 22 bp, Homo sapiens
agacttcccactgttctgaaag

SEQ ID NO: 1747506 - DNA, 15 bp, Homo sapiens
agacttcccagcttc

SEQ ID NO: 1747507 - DNA, 19 bp, Homo sapiens
agacttctggaaggctggc

SEQ ID NO: 1747508 - DNA, 20 bp, Homo sapiens
agacttctggttgtatttct

SEQ ID NO: 1747509 - DNA, 22 bp, Homo sapiens
agacttctggttgtatttctat

SEQ ID NO: 1747510 - DNA, 19 bp, Homo sapiens
agacttgacaacatcccac

SEQ ID NO: 1747511 - DNA, 23 bp, Homo sapiens
agacttgacaacatcccacagtg

SEQ ID NO: 1747512 - DNA, 15 bp, Homo sapiens
agacttgagccatcc

SEQ ID NO: 1747513 - DNA, 16 bp, Homo sapiens
agacttgagccatcca

SEQ ID NO: 1747514 - DNA, 14 bp, Homo sapiens
agacttggagctgt

SEQ ID NO: 1747515 - DNA, 17 bp, Homo sapiens
agacttggagctgtcct

SEQ ID NO: 1747516 - DNA, 16 bp, Homo sapiens
agacttgttctagaga

SEQ ID NO: 1747517 - DNA, 16 bp, Homo sapiens
agactttagaaataaa

SEQ ID NO: 1747518 - DNA, 15 bp, Homo sapiens
agactttcacaccat

SEQ ID NO: 1747519 - DNA, 14 bp, Homo sapiens
agactttcccctct

SEQ ID NO: 1747520 - DNA, 17 bp, Homo sapiens
agactttcccctctcgc

SEQ ID NO: 1747521 - DNA, 12 bp, Homo sapiens
agactttctgtt

SEQ ID NO: 1747522 - DNA, 22 bp, Homo sapiens
agacttttttttttcatgttat

SEQ ID NO: 1747523 - DNA, 17 bp, Homo sapiens
agagaaaaaggctgaaa

SEQ ID NO: 1747524 - DNA, 20 bp, Homo sapiens
agagccctgctgtgggagag

SEQ ID NO: 1747525 - DNA, 12 bp, Homo sapiens
agagccctgtgg

SEQ ID NO: 1747526 - DNA, 14 bp, Homo sapiens
agagccctgtggcc

SEQ ID NO: 1747527 - DNA, 18 bp, Homo sapiens
agagcccttcactgccat

SEQ ID NO: 1747528 - DNA, 18 bp, Homo sapiens
agagccgaggggagagag

SEQ ID NO: 1747529 - DNA, 16 bp, Homo sapiens
agagccgggaagcgat

SEQ ID NO: 1747530 - DNA, 23 bp, Homo sapiens
agagccgggaggaaaaggcccct

SEQ ID NO: 1747531 - DNA, 16 bp, Homo sapiens
agagccgtggtccctg

SEQ ID NO: 1747532 - DNA, 21 bp, Homo sapiens
agagccgtggtccctgaggat

SEQ ID NO: 1747533 - DNA, 20 bp, Homo sapiens
agagcctagccacctcccac

SEQ ID NO: 1747534 - DNA, 22 bp, Homo sapiens
agagcctagccacctcccaccc

SEQ ID NO: 1747535 - DNA, 16 bp, Homo sapiens
agagcctgctccccca

SEQ ID NO: 1747536 - DNA, 12 bp, Homo sapiens
agagcctgctgg

SEQ ID NO: 1747537 - DNA, 19 bp, Homo sapiens
agagcctgctggcacccac

SEQ ID NO: 1747538 - DNA, 15 bp, Homo sapiens
agagcctgtcaccag

SEQ ID NO: 1747539 - DNA, 18 bp, Homo sapiens
agagcctgtcaccagagc

SEQ ID NO: 1747540 - DNA, 22 bp, Homo sapiens
agagcctgtcaccagagcttct

SEQ ID NO: 1747541 - DNA, 21 bp, Homo sapiens
agagcctgtctttcagcattc

SEQ ID NO: 1747542 - DNA, 22 bp, Homo sapiens
agagcctgtctttcagcattca

SEQ ID NO: 1747543 - DNA, 19 bp, Homo sapiens
agagccttcaagtgccaaa

SEQ ID NO: 1747544 - DNA, 19 bp, Homo sapiens
agagccttctcagaagcac

SEQ ID NO: 1747545 - DNA, 23 bp, Homo sapiens
agagccttggtgtccacctggcc

SEQ ID NO: 1747546 - DNA, 21 bp, Homo sapiens
agagcgaggaaaggattttac

SEQ ID NO: 1747547 - DNA, 23 bp, Homo sapiens
agagcgaggctgagcctacagat

SEQ ID NO: 1747548 - DNA, 15 bp, Homo sapiens
agagcgccagctcct

SEQ ID NO: 1747549 - DNA, 14 bp, Homo sapiens
agagcggctggaga

SEQ ID NO: 1747550 - DNA, 17 bp, Homo sapiens
agagcgggactctgtcc

SEQ ID NO: 1747551 - DNA, 19 bp, Homo sapiens
agagcggggtcccctctgt

SEQ ID NO: 1747552 - DNA, 18 bp, Homo sapiens
agagcgtccttccccctg

SEQ ID NO: 1747553 - DNA, 16 bp, Homo sapiens
agagctagaaaaataa

SEQ ID NO: 1747554 - DNA, 20 bp, Homo sapiens
agagctagaaaaataaaatg

SEQ ID NO: 1747555 - DNA, 13 bp, Homo sapiens
agagctagcgctg

SEQ ID NO: 1747556 - DNA, 13 bp, Homo sapiens
agagctcagacat

SEQ ID NO: 1747557 - DNA, 20 bp, Homo sapiens
agagctcatcccccctgctg

SEQ ID NO: 1747558 - DNA, 17 bp, Homo sapiens
agagctctggccccgct

SEQ ID NO: 1747559 - DNA, 20 bp, Homo sapiens
agagctcttcggtttctgag

SEQ ID NO: 1747560 - DNA, 14 bp, Homo sapiens
agagctgatccaga

SEQ ID NO: 1747561 - DNA, 18 bp, Homo sapiens
agagctgatccagagcac

SEQ ID NO: 1747562 - DNA, 23 bp, Homo sapiens
agagctgattgcagaaaggagag

SEQ ID NO: 1747563 - DNA, 12 bp, Homo sapiens
agagctgccact

SEQ ID NO: 1747564 - DNA, 13 bp, Homo sapiens
agagctgccactg

SEQ ID NO: 1747565 - DNA, 16 bp, Homo sapiens
agagctgccactgggc

SEQ ID NO: 1747566 - DNA, 17 bp, Homo sapiens
agagctgccactgggca

SEQ ID NO: 1747567 - DNA, 13 bp, Homo sapiens
agagctgcctgga

SEQ ID NO: 1747568 - DNA, 15 bp, Homo sapiens
agagctgcctggatg

SEQ ID NO: 1747569 - DNA, 17 bp, Homo sapiens
agagctgcctggatgag

SEQ ID NO: 1747570 - DNA, 14 bp, Homo sapiens
agagctggaaggca

SEQ ID NO: 1747571 - DNA, 17 bp, Homo sapiens
agagctggaaggcaggg

SEQ ID NO: 1747572 - DNA, 12 bp, Homo sapiens
agagctggctct

SEQ ID NO: 1747573 - DNA, 16 bp, Homo sapiens
agagctggctctgagc

SEQ ID NO: 1747574 - DNA, 15 bp, Homo sapiens
agagctggtgcccgg

SEQ ID NO: 1747575 - DNA, 15 bp, Homo sapiens
agagctggtgtctga

SEQ ID NO: 1747576 - DNA, 16 bp, Homo sapiens
agagctgtctgaactc

SEQ ID NO: 1747577 - DNA, 17 bp, Homo sapiens
agagctgtctgaactca

SEQ ID NO: 1747578 - DNA, 10 bp, Homo sapiens
agagctgtgc

SEQ ID NO: 1747579 - DNA, 17 bp, Homo sapiens
agagctgtgcctgctca

SEQ ID NO: 1747580 - DNA, 24 bp, Homo sapiens
agagctgtgcctgctcagcagcca

SEQ ID NO: 1747581 - DNA, 21 bp, Homo sapiens
agagctgttcacagccagact

SEQ ID NO: 1747582 - DNA, 14 bp, Homo sapiens
agagcttagaaact

SEQ ID NO: 1747583 - DNA, 17 bp, Homo sapiens
agagcttattggccact

SEQ ID NO: 1747584 - DNA, 12 bp, Homo sapiens
agagcttccaaa

SEQ ID NO: 1747585 - DNA, 16 bp, Homo sapiens
agagcttctctgggct

SEQ ID NO: 1747586 - DNA, 17 bp, Homo sapiens
agagcttctctgggctg

SEQ ID NO: 1747587 - DNA, 13 bp, Homo sapiens
agagcttgctcca

SEQ ID NO: 1747588 - DNA, 17 bp, Homo sapiens
agagcttggactacaca

SEQ ID NO: 1747589 - DNA, 15 bp, Homo sapiens
agagcttgtgtcctg

SEQ ID NO: 1747590 - DNA, 12 bp, Homo sapiens
agagctttcttt

SEQ ID NO: 1747591 - DNA, 20 bp, Homo sapiens
agagctttgtgcttgtcatt

SEQ ID NO: 1747592 - DNA, 16 bp, Homo sapiens
agagcttttaaaaatg

SEQ ID NO: 1747593 - DNA, 16 bp, Homo sapiens
agaggaaaaaaatgac

SEQ ID NO: 1747594 - DNA, 13 bp, Homo sapiens
agaggaaaatgag

SEQ ID NO: 1747595 - DNA, 22 bp, Homo sapiens
agaggaaataagaaaaatcatg

SEQ ID NO: 1747596 - DNA, 15 bp, Homo sapiens
agaggaacagtgtgg

SEQ ID NO: 1747597 - DNA, 10 bp, Homo sapiens
agaggaaggc

SEQ ID NO: 1747598 - DNA, 15 bp, Homo sapiens
agaggaatcctggca

SEQ ID NO: 1747599 - DNA, 12 bp, Homo sapiens
agaggaatctgt

SEQ ID NO: 1747600 - DNA, 22 bp, Homo sapiens
agaggaatctgtttctctgctg

SEQ ID NO: 1747601 - DNA, 23 bp, Homo sapiens
agaggaatctgtttctctgctgt

SEQ ID NO: 1747602 - DNA, 21 bp, Homo sapiens
agaggaatgtagggcctgcat

SEQ ID NO: 1747603 - DNA, 16 bp, Homo sapiens
agaggacagtctggag

SEQ ID NO: 1747604 - DNA, 20 bp, Homo sapiens
agaggacagtctggagaagg

SEQ ID NO: 1747605 - DNA, 22 bp, Homo sapiens
agaggacgtgttacccactgcc

SEQ ID NO: 1747606 - DNA, 22 bp, Homo sapiens
agaggagaaatgcaataactct

SEQ ID NO: 1747607 - DNA, 15 bp, Homo sapiens
agaggagaagagaca

SEQ ID NO: 1747608 - DNA, 13 bp, Homo sapiens
agaggagaccctg

SEQ ID NO: 1747609 - DNA, 19 bp, Homo sapiens
agaggagagtggcaggtgg

SEQ ID NO: 1747610 - DNA, 13 bp, Homo sapiens
agaggagcacctg

SEQ ID NO: 1747611 - DNA, 18 bp, Homo sapiens
agaggagcagagggcagg

SEQ ID NO: 1747612 - DNA, 20 bp, Homo sapiens
agaggagcagagggcagggg

SEQ ID NO: 1747613 - DNA, 13 bp, Homo sapiens
agaggagcctcag

SEQ ID NO: 1747614 - DNA, 15 bp, Homo sapiens
agaggagcctcagaa

SEQ ID NO: 1747615 - DNA, 17 bp, Homo sapiens
agaggagcctcagaaga

SEQ ID NO: 1747616 - DNA, 14 bp, Homo sapiens
agaggagccttttt

SEQ ID NO: 1747617 - DNA, 22 bp, Homo sapiens
agaggagcctttttaaaacaca

SEQ ID NO: 1747618 - DNA, 23 bp, Homo sapiens
agaggagggcagcagaagggggt

SEQ ID NO: 1747619 - DNA, 21 bp, Homo sapiens
agaggagggcgtgactcaccc

SEQ ID NO: 1747620 - DNA, 19 bp, Homo sapiens
agaggaggtttgcctgtga

SEQ ID NO: 1747621 - DNA, 14 bp, Homo sapiens
agaggatacattta

SEQ ID NO: 1747622 - DNA, 14 bp, Homo sapiens
agaggatgagcaga

SEQ ID NO: 1747623 - DNA, 20 bp, Homo sapiens
agaggatgctctttcccagg

SEQ ID NO: 1747624 - DNA, 22 bp, Homo sapiens
agaggattaggttccatccttt

SEQ ID NO: 1747625 - DNA, 15 bp, Homo sapiens
agaggcaacaggatt

SEQ ID NO: 1747626 - DNA, 22 bp, Homo sapiens
agaggcaagctgaaattttaga

SEQ ID NO: 1747627 - DNA, 14 bp, Homo sapiens
agaggcaccaggaa

SEQ ID NO: 1747628 - DNA, 17 bp, Homo sapiens
agaggcaccaggaagcc

SEQ ID NO: 1747629 - DNA, 18 bp, Homo sapiens
agaggcagaaaattgcac

SEQ ID NO: 1747630 - DNA, 20 bp, Homo sapiens
agaggcagaaaattgcacaa

SEQ ID NO: 1747631 - DNA, 12 bp, Homo sapiens
agaggcagaggt

SEQ ID NO: 1747632 - DNA, 13 bp, Homo sapiens
agaggcagcaagg

SEQ ID NO: 1747633 - DNA, 16 bp, Homo sapiens
agaggcagcccgcaca

SEQ ID NO: 1747634 - DNA, 21 bp, Homo sapiens
agaggccaagtctaatgaaga

SEQ ID NO: 1747635 - DNA, 12 bp, Homo sapiens
agaggccaccta

SEQ ID NO: 1747636 - DNA, 16 bp, Homo sapiens
agaggccagccccacc

SEQ ID NO: 1747637 - DNA, 17 bp, Homo sapiens
agaggccagccccaccc

SEQ ID NO: 1747638 - DNA, 21 bp, Homo sapiens
agaggccagccccacccagga

SEQ ID NO: 1747639 - DNA, 20 bp, Homo sapiens
agataatattgtttggtaaa

SEQ ID NO: 1747640 - DNA, 14 bp, Homo sapiens
agataatatttttg

SEQ ID NO: 1747641 - DNA, 16 bp, Homo sapiens
agataatctagaacac

SEQ ID NO: 1747642 - DNA, 23 bp, Homo sapiens
agataatctagaacacaggcaaa

SEQ ID NO: 1747643 - DNA, 17 bp, Homo sapiens
agataatgatacttaac

SEQ ID NO: 1747644 - DNA, 17 bp, Homo sapiens
agataatgttctttaat

SEQ ID NO: 1747645 - DNA, 20 bp, Homo sapiens
agataatgttctttaatgtt

SEQ ID NO: 1747646 - DNA, 19 bp, Homo sapiens
agataattactgccttgaa

SEQ ID NO: 1747647 - DNA, 20 bp, Homo sapiens
agataattatccaggatgtg

SEQ ID NO: 1747648 - DNA, 13 bp, Homo sapiens
agataattcattt

SEQ ID NO: 1747649 - DNA, 14 bp, Homo sapiens
agataattcatttg

SEQ ID NO: 1747650 - DNA, 19 bp, Homo sapiens
agataatttacaagatatt

SEQ ID NO: 1747651 - DNA, 14 bp, Homo sapiens
agatacaaaacctt

SEQ ID NO: 1747652 - DNA, 18 bp, Homo sapiens
agatacaaattaatttta

SEQ ID NO: 1747653 - DNA, 15 bp, Homo sapiens
agatacaagtttcag

SEQ ID NO: 1747654 - DNA, 20 bp, Homo sapiens
agatacaagtttcagacagg

SEQ ID NO: 1747655 - DNA, 16 bp, Homo sapiens
agatacaatgtattta

SEQ ID NO: 1747656 - DNA, 23 bp, Homo sapiens
agatacaatgtatttatttaaaa

SEQ ID NO: 1747657 - DNA, 12 bp, Homo sapiens
agatacacagct

SEQ ID NO: 1747658 - DNA, 19 bp, Homo sapiens
agataccaggttgaaagac

SEQ ID NO: 1747659 - DNA, 16 bp, Homo sapiens
agataccctgtttctg

SEQ ID NO: 1747660 - DNA, 17 bp, Homo sapiens
agatactctcagcacca

SEQ ID NO: 1747661 - DNA, 20 bp, Homo sapiens
agatactggaagttttgcat

SEQ ID NO: 1747662 - DNA, 18 bp, Homo sapiens
agatacttatttttctga

SEQ ID NO: 1747663 - DNA, 14 bp, Homo sapiens
agatagaaagcatt

SEQ ID NO: 1747664 - DNA, 19 bp, Homo sapiens
agatagaaagctggactga

SEQ ID NO: 1747665 - DNA, 22 bp, Homo sapiens
agatagaaagctggactgacca

SEQ ID NO: 1747666 - DNA, 14 bp, Homo sapiens
agatagacaggtcc

SEQ ID NO: 1747667 - DNA, 20 bp, Homo sapiens
agatagacgggttgaaagac

SEQ ID NO: 1747668 - DNA, 23 bp, Homo sapiens
agatagacgggttgaaagacatc

SEQ ID NO: 1747669 - DNA, 20 bp, Homo sapiens
agatagagaaatagtgacaa

SEQ ID NO: 1747670 - DNA, 14 bp, Homo sapiens
agatagcgcatata

SEQ ID NO: 1747671 - DNA, 14 bp, Homo sapiens
agataggaaactga

SEQ ID NO: 1747672 - DNA, 17 bp, Homo sapiens
agatagtagcatacatt

SEQ ID NO: 1747673 - DNA, 21 bp, Homo sapiens
agatagtcttggaagctgttt

SEQ ID NO: 1747674 - DNA, 19 bp, Homo sapiens
agatagtgtaacttgctta

SEQ ID NO: 1747675 - DNA, 21 bp, Homo sapiens
agatagttaaaagactgcagc

SEQ ID NO: 1747676 - DNA, 16 bp, Homo sapiens
agatataactgtcttg

SEQ ID NO: 1747677 - DNA, 21 bp, Homo sapiens
agatatacttgtttttgtaaa

SEQ ID NO: 1747678 - DNA, 23 bp, Homo sapiens
agatatacttgtttttgtaaaga

SEQ ID NO: 1747679 - DNA, 20 bp, Homo sapiens
agatatataaataatcacac

SEQ ID NO: 1747680 - DNA, 21 bp, Homo sapiens
agatatatttttaagataata

SEQ ID NO: 1747681 - DNA, 14 bp, Homo sapiens
agatatatttttca

SEQ ID NO: 1747682 - DNA, 15 bp, Homo sapiens
agatatatttttcac

SEQ ID NO: 1747683 - DNA, 13 bp, Homo sapiens
agatatcaaaatt

SEQ ID NO: 1747684 - DNA, 15 bp, Homo sapiens
agatatcaaaattct

SEQ ID NO: 1747685 - DNA, 16 bp, Homo sapiens
agatatcagagctctt

SEQ ID NO: 1747686 - DNA, 17 bp, Homo sapiens
agatatcagtgtctccc

SEQ ID NO: 1747687 - DNA, 13 bp, Homo sapiens
agatatccatctt

SEQ ID NO: 1747688 - DNA, 15 bp, Homo sapiens
agatatccatctttt

SEQ ID NO: 1747689 - DNA, 14 bp, Homo sapiens
agatatctgcatgt

SEQ ID NO: 1747690 - DNA, 16 bp, Homo sapiens
agatatctgcatgtgt

SEQ ID NO: 1747691 - DNA, 15 bp, Homo sapiens
agatatgagttgttt

SEQ ID NO: 1747692 - DNA, 17 bp, Homo sapiens
agatatggcagcgaaag

SEQ ID NO: 1747693 - DNA, 15 bp, Homo sapiens
agatatgtattcttt

SEQ ID NO: 1747694 - DNA, 19 bp, Homo sapiens
agatattataagggagagc

SEQ ID NO: 1747695 - DNA, 18 bp, Homo sapiens
agatattattaattttta

SEQ ID NO: 1747696 - DNA, 16 bp, Homo sapiens
agatattcttatttca

SEQ ID NO: 1747697 - DNA, 18 bp, Homo sapiens
agatattgtacataaaag

SEQ ID NO: 1747698 - DNA, 12 bp, Homo sapiens
agatatttccaa

SEQ ID NO: 1747699 - DNA, 23 bp, Homo sapiens
agatatttccatttcttcctcac

SEQ ID NO: 1747700 - DNA, 12 bp, Homo sapiens
agatatttctta

SEQ ID NO: 1747701 - DNA, 13 bp, Homo sapiens
agatatttcttat

SEQ ID NO: 1747702 - DNA, 16 bp, Homo sapiens
agatattttatatgta

SEQ ID NO: 1747703 - DNA, 20 bp, Homo sapiens
agatatttttatctttatat

SEQ ID NO: 1747704 - DNA, 16 bp, Homo sapiens
agatatttttcataaa

SEQ ID NO: 1747705 - DNA, 14 bp, Homo sapiens
agatcaaatagttg

SEQ ID NO: 1747706 - DNA, 22 bp, Homo sapiens
agatcaacaacactacttccct

SEQ ID NO: 1747707 - DNA, 17 bp, Homo sapiens
agatcaacgcctcactg

SEQ ID NO: 1747708 - DNA, 18 bp, Homo sapiens
agatcaagaaaaaaaggg

SEQ ID NO: 1747709 - DNA, 15 bp, Homo sapiens
agatcaagagatcaa

SEQ ID NO: 1747710 - DNA, 16 bp, Homo sapiens
agatcaaggagcccag

SEQ ID NO: 1747711 - DNA, 19 bp, Homo sapiens
agatcaaggagcccagaaa

SEQ ID NO: 1747712 - DNA, 18 bp, Homo sapiens
agatcacatcttaaattc

SEQ ID NO: 1747713 - DNA, 20 bp, Homo sapiens
agatcacatcttaaattcat

SEQ ID NO: 1747714 - DNA, 22 bp, Homo sapiens
agatcacgccactgcactccag

SEQ ID NO: 1747715 - DNA, 14 bp, Homo sapiens
agatcactgccaca

SEQ ID NO: 1747716 - DNA, 22 bp, Homo sapiens
agatcactgtagtttagttctg

SEQ ID NO: 1747717 - DNA, 11 bp, Homo sapiens
agatcactttc

SEQ ID NO: 1747718 - DNA, 19 bp, Homo sapiens
agatcactttctcagtttt

SEQ ID NO: 1747719 - DNA, 18 bp, Homo sapiens
agatcagaaagtgacatt

SEQ ID NO: 1747720 - DNA, 21 bp, Homo sapiens
agatcagaacattcagctctg

SEQ ID NO: 1747721 - DNA, 23 bp, Homo sapiens
agatcagatgctccaagattcta

SEQ ID NO: 1747722 - DNA, 16 bp, Homo sapiens
agatcagcattcaaaa

SEQ ID NO: 1747723 - DNA, 17 bp, Homo sapiens
agatcagcattcaaaat

SEQ ID NO: 1747724 - DNA, 18 bp, Homo sapiens
agatcagcattcaaaata

SEQ ID NO: 1747725 - DNA, 20 bp, Homo sapiens
agatcaggaattctaaataa

SEQ ID NO: 1747726 - DNA, 21 bp, Homo sapiens
agatcatccagaagttcctca

SEQ ID NO: 1747727 - DNA, 11 bp, Homo sapiens
agatcatgggt

SEQ ID NO: 1747728 - DNA, 14 bp, Homo sapiens
agatccacacacag

SEQ ID NO: 1747729 - DNA, 15 bp, Homo sapiens
agatccacacacaga

SEQ ID NO: 1747730 - DNA, 16 bp, Homo sapiens
agatccacacacagag

SEQ ID NO: 1747731 - DNA, 16 bp, Homo sapiens
agatccaggcaggagc

SEQ ID NO: 1747732 - DNA, 19 bp, Homo sapiens
agatccagggatggagatg

SEQ ID NO: 1747733 - DNA, 19 bp, Homo sapiens
agatccatttccattgctt

SEQ ID NO: 1747734 - DNA, 23 bp, Homo sapiens
agatcccatgggttgtgtgttta

SEQ ID NO: 1747735 - DNA, 13 bp, Homo sapiens
agatccccctccc

SEQ ID NO: 1747736 - DNA, 23 bp, Homo sapiens
agatccgcaatgtggagcagcag

SEQ ID NO: 1747737 - DNA, 14 bp, Homo sapiens
agatcctaagatgt

SEQ ID NO: 1747738 - DNA, 18 bp, Homo sapiens
agatcctagatcctaagg

SEQ ID NO: 1747739 - DNA, 12 bp, Homo sapiens
agatcctcctgc

SEQ ID NO: 1747740 - DNA, 22 bp, Homo sapiens
agatcctgaagcagttcagaag

SEQ ID NO: 1747741 - DNA, 13 bp, Homo sapiens
agatcctgcaccc

SEQ ID NO: 1747742 - DNA, 17 bp, Homo sapiens
agatcctgcgggtgggg

SEQ ID NO: 1747743 - DNA, 20 bp, Homo sapiens
agatcgagaccatcctggct

SEQ ID NO: 1747744 - DNA, 21 bp, Homo sapiens
agatcgagaccatcctggcta

SEQ ID NO: 1747745 - DNA, 18 bp, Homo sapiens
agatcgaggctacagtga

SEQ ID NO: 1747746 - DNA, 20 bp, Homo sapiens
agatcgcaccactgcactcc

SEQ ID NO: 1747747 - DNA, 17 bp, Homo sapiens
agatcgcgccactgcac

SEQ ID NO: 1747748 - DNA, 16 bp, Homo sapiens
agatcggccacagggc

SEQ ID NO: 1747749 - DNA, 21 bp, Homo sapiens
agatcgtgccgttactctcca

SEQ ID NO: 1747750 - DNA, 14 bp, Homo sapiens
agatcgtgtattga

SEQ ID NO: 1747751 - DNA, 23 bp, Homo sapiens
agatcgtgtattgagatttctta

SEQ ID NO: 1747752 - DNA, 20 bp, Homo sapiens
agatctaaacagttatttct

SEQ ID NO: 1747753 - DNA, 22 bp, Homo sapiens
agattctgtgatcttttaaagt

SEQ ID NO: 1747754 - DNA, 13 bp, Homo sapiens
agattctgtgtca

SEQ ID NO: 1747755 - DNA, 12 bp, Homo sapiens
agattcttcagc

SEQ ID NO: 1747756 - DNA, 16 bp, Homo sapiens
agattcttctgtgttt

SEQ ID NO: 1747757 - DNA, 13 bp, Homo sapiens
agattctttaagg

SEQ ID NO: 1747758 - DNA, 17 bp, Homo sapiens
agattctttaaggagat

SEQ ID NO: 1747759 - DNA, 18 bp, Homo sapiens
agattctttaaggagata

SEQ ID NO: 1747760 - DNA, 20 bp, Homo sapiens
agattctttcagttctttgg

SEQ ID NO: 1747761 - DNA, 20 bp, Homo sapiens
agattgaaaacttttctcag

SEQ ID NO: 1747762 - DNA, 18 bp, Homo sapiens
agattgagagaagagaca

SEQ ID NO: 1747763 - DNA, 17 bp, Homo sapiens
agattgagctctctgcc

SEQ ID NO: 1747764 - DNA, 17 bp, Homo sapiens
agattgatagaaaatcc

SEQ ID NO: 1747765 - DNA, 23 bp, Homo sapiens
agattgatagaaaatccttcagc

SEQ ID NO: 1747766 - DNA, 21 bp, Homo sapiens
agattgatatctataaaatag

SEQ ID NO: 1747767 - DNA, 22 bp, Homo sapiens
agattgatatctataaaataga

SEQ ID NO: 1747768 - DNA, 21 bp, Homo sapiens
agattgcgccattgcactcca

SEQ ID NO: 1747769 - DNA, 14 bp, Homo sapiens
agattgctgaaatt

SEQ ID NO: 1747770 - DNA, 12 bp, Homo sapiens
agattggaaatg

SEQ ID NO: 1747771 - DNA, 23 bp, Homo sapiens
agattggcatggctttatttgtt

SEQ ID NO: 1747772 - DNA, 15 bp, Homo sapiens
agattgtgtaacaat

SEQ ID NO: 1747773 - DNA, 15 bp, Homo sapiens
agattgtgtacatag

SEQ ID NO: 1747774 - DNA, 22 bp, Homo sapiens
agattgttgataggaactgtct

SEQ ID NO: 1747775 - DNA, 21 bp, Homo sapiens
agatttaaactctgaatttat

SEQ ID NO: 1747776 - DNA, 18 bp, Homo sapiens
agatttaagccttacaaa

SEQ ID NO: 1747777 - DNA, 20 bp, Homo sapiens
agatttaatctgccaagggc

SEQ ID NO: 1747778 - DNA, 13 bp, Homo sapiens
agatttaattaat

SEQ ID NO: 1747779 - DNA, 14 bp, Homo sapiens
agatttagctattt

SEQ ID NO: 1747780 - DNA, 18 bp, Homo sapiens
agatttagctatttattg

SEQ ID NO: 1747781 - DNA, 18 bp, Homo sapiens
agatttagtgaaagctag

SEQ ID NO: 1747782 - DNA, 20 bp, Homo sapiens
agatttatgaacagaaatat

SEQ ID NO: 1747783 - DNA, 19 bp, Homo sapiens
agatttattttttggactt

SEQ ID NO: 1747784 - DNA, 14 bp, Homo sapiens
agatttcaagagat

SEQ ID NO: 1747785 - DNA, 13 bp, Homo sapiens
agatttcatctgc

SEQ ID NO: 1747786 - DNA, 18 bp, Homo sapiens
agatttcatctgctctcc

SEQ ID NO: 1747787 - DNA, 20 bp, Homo sapiens
agatttcatctgctctcctt

SEQ ID NO: 1747788 - DNA, 15 bp, Homo sapiens
agatttccatttgtc

SEQ ID NO: 1747789 - DNA, 16 bp, Homo sapiens
agatttctcattgact

SEQ ID NO: 1747790 - DNA, 12 bp, Homo sapiens
agatttgggaga

SEQ ID NO: 1747791 - DNA, 23 bp, Homo sapiens
agatttgtccttttatttctcca

SEQ ID NO: 1747792 - DNA, 16 bp, Homo sapiens
agatttgtgaactgga

SEQ ID NO: 1747793 - DNA, 20 bp, Homo sapiens
agatttgttactgtattttt

SEQ ID NO: 1747794 - DNA, 17 bp, Homo sapiens
agatttgttttgcattc

SEQ ID NO: 1747795 - DNA, 13 bp, Homo sapiens
agattttaaattc

SEQ ID NO: 1747796 - DNA, 20 bp, Homo sapiens
agattttaaattttatgtca

SEQ ID NO: 1747797 - DNA, 19 bp, Homo sapiens
agattttacaaaagatgta

SEQ ID NO: 1747798 - DNA, 20 bp, Homo sapiens
agattttacaaaagatgtat

SEQ ID NO: 1747799 - DNA, 13 bp, Homo sapiens
agattttatttgt

SEQ ID NO: 1747800 - DNA, 14 bp, Homo sapiens
agattttatttgta

SEQ ID NO: 1747801 - DNA, 21 bp, Homo sapiens
agattttatttgtaattttaa

SEQ ID NO: 1747802 - DNA, 14 bp, Homo sapiens
agattttattttac

SEQ ID NO: 1747803 - DNA, 17 bp, Homo sapiens
agattttcagaaaatat

SEQ ID NO: 1747804 - DNA, 19 bp, Homo sapiens
agattttcagcaaactctt

SEQ ID NO: 1747805 - DNA, 19 bp, Homo sapiens
agattttcctccattttta

SEQ ID NO: 1747806 - DNA, 12 bp, Homo sapiens
agattttctggt

SEQ ID NO: 1747807 - DNA, 18 bp, Homo sapiens
agattttctggttctaac

SEQ ID NO: 1747808 - DNA, 14 bp, Homo sapiens
agattttgaatgct

SEQ ID NO: 1747809 - DNA, 16 bp, Homo sapiens
agattttgcttttcca

SEQ ID NO: 1747810 - DNA, 18 bp, Homo sapiens
agattttgtgtttattct

SEQ ID NO: 1747811 - DNA, 20 bp, Homo sapiens
agattttgtgtttattcttg

SEQ ID NO: 1747812 - DNA, 22 bp, Homo sapiens
agattttgtgtttattcttgat

SEQ ID NO: 1747813 - DNA, 19 bp, Homo sapiens
agatttttaaaaaatattt

SEQ ID NO: 1747814 - DNA, 18 bp, Homo sapiens
agatttttatttatgagt

SEQ ID NO: 1747815 - DNA, 12 bp, Homo sapiens
agatttttgaat

SEQ ID NO: 1747816 - DNA, 14 bp, Homo sapiens
agatttttttcctg

SEQ ID NO: 1747817 - DNA, 14 bp, Homo sapiens
agcaaaaacatgta

SEQ ID NO: 1747818 - DNA, 17 bp, Homo sapiens
agcaaaacatctctgca

SEQ ID NO: 1747819 - DNA, 21 bp, Homo sapiens
agcaaaacatcttttcctgat

SEQ ID NO: 1747820 - DNA, 13 bp, Homo sapiens
agcaaaagaaaaa

SEQ ID NO: 1747821 - DNA, 18 bp, Homo sapiens
agcaaaagagaaatacat

SEQ ID NO: 1747822 - DNA, 18 bp, Homo sapiens
agcaaaaggctgagaagg

SEQ ID NO: 1747823 - DNA, 13 bp, Homo sapiens
agcaaaatcaaga

SEQ ID NO: 1747824 - DNA, 13 bp, Homo sapiens
agcaaaattgatg

SEQ ID NO: 1747825 - DNA, 17 bp, Homo sapiens
agcaaacaagcttgatt

SEQ ID NO: 1747826 - DNA, 17 bp, Homo sapiens
agcaaaccatttttaaa

SEQ ID NO: 1747827 - DNA, 19 bp, Homo sapiens
agcaaacccagaggtggat

SEQ ID NO: 1747828 - DNA, 18 bp, Homo sapiens
agcaaaccgccctgcagc

SEQ ID NO: 1747829 - DNA, 19 bp, Homo sapiens
agcaaactaacttgacttt

SEQ ID NO: 1747830 - DNA, 17 bp, Homo sapiens
agcaaactcttttccca

SEQ ID NO: 1747831 - DNA, 22 bp, Homo sapiens
agcaaagaaggccagcaacatt

SEQ ID NO: 1747832 - DNA, 10 bp, Homo sapiens
agcaaagatg

SEQ ID NO: 1747833 - DNA, 20 bp, Homo sapiens
agcaaagcgcccacccaggt

SEQ ID NO: 1747834 - DNA, 20 bp, Homo sapiens
agcaaagcgggttataatga

SEQ ID NO: 1747835 - DNA, 22 bp, Homo sapiens
agcaaagcgggttataatgaat

SEQ ID NO: 1747836 - DNA, 21 bp, Homo sapiens
agcaaagctgatgacaacttc

SEQ ID NO: 1747837 - DNA, 17 bp, Homo sapiens
agcaaagggaaggactg

SEQ ID NO: 1747838 - DNA, 18 bp, Homo sapiens
agcaaagtcacttctcca

SEQ ID NO: 1747839 - DNA, 19 bp, Homo sapiens
agcaaataaactaggaaat

SEQ ID NO: 1747840 - DNA, 22 bp, Homo sapiens
agcaaatacaattcacagcaca

SEQ ID NO: 1747841 - DNA, 19 bp, Homo sapiens
agcaaatcatttgtttaaa

SEQ ID NO: 1747842 - DNA, 13 bp, Homo sapiens
agcaaatgcaaaa

SEQ ID NO: 1747843 - DNA, 15 bp, Homo sapiens
agcaaatgtgacctg

SEQ ID NO: 1747844 - DNA, 15 bp, Homo sapiens
agcaaatttctatca

SEQ ID NO: 1747845 - DNA, 15 bp, Homo sapiens
agcaaattttcagca

SEQ ID NO: 1747846 - DNA, 20 bp, Homo sapiens
agcaacaaagattgagaagc

SEQ ID NO: 1747847 - DNA, 17 bp, Homo sapiens
agcaacaagactgccag

SEQ ID NO: 1747848 - DNA, 18 bp, Homo sapiens
agcaacaagactgccagg

SEQ ID NO: 1747849 - DNA, 21 bp, Homo sapiens
agcaacacagcctgggcccca

SEQ ID NO: 1747850 - DNA, 13 bp, Homo sapiens
agcaacagaaaaa

SEQ ID NO: 1747851 - DNA, 16 bp, Homo sapiens
agcaacagaaaaatgg

SEQ ID NO: 1747852 - DNA, 14 bp, Homo sapiens
agcaacaggaaaaa

SEQ ID NO: 1747853 - DNA, 17 bp, Homo sapiens
agcaacaggaatctcag

SEQ ID NO: 1747854 - DNA, 18 bp, Homo sapiens
agcaacaggaatctcaga

SEQ ID NO: 1747855 - DNA, 18 bp, Homo sapiens
agcaacaggttttataat

SEQ ID NO: 1747856 - DNA, 23 bp, Homo sapiens
agcaacattggcacatgccacct

SEQ ID NO: 1747857 - DNA, 20 bp, Homo sapiens
agcaacccctgtacccagct

SEQ ID NO: 1747858 - DNA, 21 bp, Homo sapiens
agcaacccctgtacccagctc

SEQ ID NO: 1747859 - DNA, 23 bp, Homo sapiens
agcaacccctgtacccagctcct

SEQ ID NO: 1747860 - DNA, 19 bp, Homo sapiens
agcaacccttcctgctgct

SEQ ID NO: 1747861 - DNA, 13 bp, Homo sapiens
agcaacctgggca

SEQ ID NO: 1747862 - DNA, 23 bp, Homo sapiens
agcaacgcaggcccccaggtgcc

SEQ ID NO: 1747863 - DNA, 20 bp, Homo sapiens
agcaacgcccctccaaacct

SEQ ID NO: 1747864 - DNA, 14 bp, Homo sapiens
agcaacgcttgtag

SEQ ID NO: 1747865 - DNA, 19 bp, Homo sapiens
agcaactcattggtggtag

SEQ ID NO: 1747866 - DNA, 23 bp, Homo sapiens
agcaactgcccttccaggtgggt

SEQ ID NO: 1747867 - DNA, 22 bp, Homo sapiens
agcagcactggaaccacctgga

SEQ ID NO: 1747868 - DNA, 12 bp, Homo sapiens
agcagcagcagg

SEQ ID NO: 1747869 - DNA, 16 bp, Homo sapiens
agcagcagcaggtgat

SEQ ID NO: 1747870 - DNA, 18 bp, Homo sapiens
agcagcagccactgcaca

SEQ ID NO: 1747871 - DNA, 15 bp, Homo sapiens
agcagcagccagcac

SEQ ID NO: 1747872 - DNA, 22 bp, Homo sapiens
agcagcagctaggactgaggag

SEQ ID NO: 1747873 - DNA, 21 bp, Homo sapiens
agcagcatagaacaggacctc

SEQ ID NO: 1747874 - DNA, 18 bp, Homo sapiens
agcagcatctgctaataa

SEQ ID NO: 1747875 - DNA, 15 bp, Homo sapiens
agcagcatcttctgg

SEQ ID NO: 1747876 - DNA, 15 bp, Homo sapiens
agcagcatggaaaaa

SEQ ID NO: 1747877 - DNA, 22 bp, Homo sapiens
agcagcatggaaaaatggttga

SEQ ID NO: 1747878 - DNA, 17 bp, Homo sapiens
agcagcatggcatagcc

SEQ ID NO: 1747879 - DNA, 22 bp, Homo sapiens
agcagcattctggaggggagag

SEQ ID NO: 1747880 - DNA, 17 bp, Homo sapiens
agcagccagagctgtgc

SEQ ID NO: 1747881 - DNA, 10 bp, Homo sapiens
agcagccagc

SEQ ID NO: 1747882 - DNA, 13 bp, Homo sapiens
agcagccagcacc

SEQ ID NO: 1747883 - DNA, 14 bp, Homo sapiens
agcagccagcacca

SEQ ID NO: 1747884 - DNA, 15 bp, Homo sapiens
agcagccagcaccac

SEQ ID NO: 1747885 - DNA, 21 bp, Homo sapiens
agcagccagccagtcttgcct

SEQ ID NO: 1747886 - DNA, 13 bp, Homo sapiens
agcagccagctct

SEQ ID NO: 1747887 - DNA, 17 bp, Homo sapiens
agcagccagctctcagc

SEQ ID NO: 1747888 - DNA, 19 bp, Homo sapiens
agcagccagggacccccag

SEQ ID NO: 1747889 - DNA, 15 bp, Homo sapiens
agcagccagtctcag

SEQ ID NO: 1747890 - DNA, 21 bp, Homo sapiens
agcagccagtctcagagacca

SEQ ID NO: 1747891 - DNA, 13 bp, Homo sapiens
agcagcccaccct

SEQ ID NO: 1747892 - DNA, 12 bp, Homo sapiens
agcagcccagct

SEQ ID NO: 1747893 - DNA, 17 bp, Homo sapiens
agcagcccagcttcctg

SEQ ID NO: 1747894 - DNA, 11 bp, Homo sapiens
agcagcccagg

SEQ ID NO: 1747895 - DNA, 21 bp, Homo sapiens
agcagccccccttgccccacc

SEQ ID NO: 1747896 - DNA, 16 bp, Homo sapiens
agcagcccggggagga

SEQ ID NO: 1747897 - DNA, 14 bp, Homo sapiens
agcagccctcctca

SEQ ID NO: 1747898 - DNA, 16 bp, Homo sapiens
agcagccctcctcacc

SEQ ID NO: 1747899 - DNA, 23 bp, Homo sapiens
agcagccctcctcaccccgtctg

SEQ ID NO: 1747900 - DNA, 13 bp, Homo sapiens
agcagcccttgct

SEQ ID NO: 1747901 - DNA, 19 bp, Homo sapiens
agcagccgccagctgggag

SEQ ID NO: 1747902 - DNA, 14 bp, Homo sapiens
agcagcctccctgt

SEQ ID NO: 1747903 - DNA, 15 bp, Homo sapiens
agcagcctctcccca

SEQ ID NO: 1747904 - DNA, 18 bp, Homo sapiens
agcagcctctccccaggt

SEQ ID NO: 1747905 - DNA, 20 bp, Homo sapiens
agcagcctctccccaggtcc

SEQ ID NO: 1747906 - DNA, 17 bp, Homo sapiens
agcagcctctgccaggc

SEQ ID NO: 1747907 - DNA, 13 bp, Homo sapiens
agcagcctgatgg

SEQ ID NO: 1747908 - DNA, 12 bp, Homo sapiens
agcagcctgggg

SEQ ID NO: 1747909 - DNA, 14 bp, Homo sapiens
agcagcctgtggca

SEQ ID NO: 1747910 - DNA, 18 bp, Homo sapiens
agcagcgaccgccccctc

SEQ ID NO: 1747911 - DNA, 23 bp, Homo sapiens
agcagcgaccgccccctcctcta

SEQ ID NO: 1747912 - DNA, 22 bp, Homo sapiens
agcagcggtttggggagcagag

SEQ ID NO: 1747913 - DNA, 16 bp, Homo sapiens
agcagctaactccgag

SEQ ID NO: 1747914 - DNA, 20 bp, Homo sapiens
agcagctaactccgagagca

SEQ ID NO: 1747915 - DNA, 22 bp, Homo sapiens
agcagctaggactgaggagtgg

SEQ ID NO: 1747916 - DNA, 17 bp, Homo sapiens
agcagctatctctcagt

SEQ ID NO: 1747917 - DNA, 19 bp, Homo sapiens
agcagctatctctcagtga

SEQ ID NO: 1747918 - DNA, 18 bp, Homo sapiens
agcagctcaacctaccct

SEQ ID NO: 1747919 - DNA, 20 bp, Homo sapiens
agcagctcacaccctacctt

SEQ ID NO: 1747920 - DNA, 14 bp, Homo sapiens
agcagctcaggcac

SEQ ID NO: 1747921 - DNA, 23 bp, Homo sapiens
agcagctcatagaattttgagta

SEQ ID NO: 1747922 - DNA, 12 bp, Homo sapiens
agcagctgcggg

SEQ ID NO: 1747923 - DNA, 21 bp, Homo sapiens
agcagctgcgggtctgaagga

SEQ ID NO: 1747924 - DNA, 22 bp, Homo sapiens
agcagctggtaatcttgctctg

SEQ ID NO: 1747925 - DNA, 18 bp, Homo sapiens
agcagcttcaccagagca

SEQ ID NO: 1747926 - DNA, 15 bp, Homo sapiens
agcagcttccttctg

SEQ ID NO: 1747927 - DNA, 18 bp, Homo sapiens
agcagcttccttctggga

SEQ ID NO: 1747928 - DNA, 13 bp, Homo sapiens
agcagctttaaaa

SEQ ID NO: 1747929 - DNA, 16 bp, Homo sapiens
agcagctttaaacaaa

SEQ ID NO: 1747930 - DNA, 17 bp, Homo sapiens
agcagctttaaacaaat

SEQ ID NO: 1747931 - DNA, 14 bp, Homo sapiens
agcaggaattatgt

SEQ ID NO: 1747932 - DNA, 15 bp, Homo sapiens
agcaggactccaggc

SEQ ID NO: 1747933 - DNA, 18 bp, Homo sapiens
agcaggactccaggccca

SEQ ID NO: 1747934 - DNA, 22 bp, Homo sapiens
agcaggactccaggcccaaggc

SEQ ID NO: 1747935 - DNA, 23 bp, Homo sapiens
agcaggactgaattgtccccagt

SEQ ID NO: 1747936 - DNA, 12 bp, Homo sapiens
agcaggactgag

SEQ ID NO: 1747937 - DNA, 22 bp, Homo sapiens
agcaggacttgctaaagcactt

SEQ ID NO: 1747938 - DNA, 16 bp, Homo sapiens
agcaggagcagctgtg

SEQ ID NO: 1747939 - DNA, 19 bp, Homo sapiens
agcaggagccccgccacag

SEQ ID NO: 1747940 - DNA, 14 bp, Homo sapiens
agcaggagcccctg

SEQ ID NO: 1747941 - DNA, 15 bp, Homo sapiens
agcaggaggagtgga

SEQ ID NO: 1747942 - DNA, 22 bp, Homo sapiens
agcaggaggttctgggcctctg

SEQ ID NO: 1747943 - DNA, 19 bp, Homo sapiens
agcaggatcgaagggtttt

SEQ ID NO: 1747944 - DNA, 20 bp, Homo sapiens
agcaggatcgaagggttttt

SEQ ID NO: 1747945 - DNA, 21 bp, Homo sapiens
agcaggatcgaagggttttta

SEQ ID NO: 1747946 - DNA, 21 bp, Homo sapiens
agcaggatgaattttctgcag

SEQ ID NO: 1747947 - DNA, 13 bp, Homo sapiens
agcaggcacagga

SEQ ID NO: 1747948 - DNA, 23 bp, Homo sapiens
agcaggcaccgccacgtcccagc

SEQ ID NO: 1747949 - DNA, 17 bp, Homo sapiens
agcaggcaggtggactg

SEQ ID NO: 1747950 - DNA, 17 bp, Homo sapiens
agcaggccagcccggac

SEQ ID NO: 1747951 - DNA, 13 bp, Homo sapiens
agcaggcccagca

SEQ ID NO: 1747952 - DNA, 14 bp, Homo sapiens
agcaggcccagcat

SEQ ID NO: 1747953 - DNA, 20 bp, Homo sapiens
agcaggcctaagacatgtga

SEQ ID NO: 1747954 - DNA, 17 bp, Homo sapiens
agcaggctactgtcagc

SEQ ID NO: 1747955 - DNA, 19 bp, Homo sapiens
agcaggctactgtcagctc

SEQ ID NO: 1747956 - DNA, 20 bp, Homo sapiens
agcaggctcctggctgtgcc

SEQ ID NO: 1747957 - DNA, 17 bp, Homo sapiens
agcagggaaagctccac

SEQ ID NO: 1747958 - DNA, 19 bp, Homo sapiens
agcagggccaaagcacagc

SEQ ID NO: 1747959 - DNA, 21 bp, Homo sapiens
agcaggggaattccctccccc

SEQ ID NO: 1747960 - DNA, 22 bp, Homo sapiens
agcaggggaattccctccccct

SEQ ID NO: 1747961 - DNA, 15 bp, Homo sapiens
agcaggggcaccttc

SEQ ID NO: 1747962 - DNA, 20 bp, Homo sapiens
agcaggggggctgtgccaac

SEQ ID NO: 1747963 - DNA, 21 bp, Homo sapiens
agcaggggtgtgatgtaccag

SEQ ID NO: 1747964 - DNA, 21 bp, Homo sapiens
agcagggtagtctggtttcta

SEQ ID NO: 1747965 - DNA, 18 bp, Homo sapiens
agcagggtcgggaaaggc

SEQ ID NO: 1747966 - DNA, 15 bp, Homo sapiens
agcaggtcacactgg

SEQ ID NO: 1747967 - DNA, 19 bp, Homo sapiens
agcaggtgactgtgctgtg

SEQ ID NO: 1747968 - DNA, 19 bp, Homo sapiens
agcaggtgattggaccagg

SEQ ID NO: 1747969 - DNA, 15 bp, Homo sapiens
agcaggtgctgggct

SEQ ID NO: 1747970 - DNA, 16 bp, Homo sapiens
agcaggttccccaagg

SEQ ID NO: 1747971 - DNA, 22 bp, Homo sapiens
agcaggttccccaagggccctg

SEQ ID NO: 1747972 - DNA, 16 bp, Homo sapiens
agcaggttcttgatgt

SEQ ID NO: 1747973 - DNA, 11 bp, Homo sapiens
agcagtacatg

SEQ ID NO: 1747974 - DNA, 15 bp, Homo sapiens
agcagtacatgggaa

SEQ ID NO: 1747975 - DNA, 23 bp, Homo sapiens
agcagtacgtggcttcagaggcc

SEQ ID NO: 1747976 - DNA, 12 bp, Homo sapiens
agcagtattttt

SEQ ID NO: 1747977 - DNA, 20 bp, Homo sapiens
agcagtcacactgttactcc

SEQ ID NO: 1747978 - DNA, 14 bp, Homo sapiens
agcagtcagccctt

SEQ ID NO: 1747979 - DNA, 15 bp, Homo sapiens
agcagtcagccctta

SEQ ID NO: 1747980 - DNA, 18 bp, Homo sapiens
agcagtcagggtgggaag

SEQ ID NO: 1747981 - DNA, 23 bp, Homo sapiens
agcagtcctcccaccttggcctc

SEQ ID NO: 1747982 - DNA, 20 bp, Homo sapiens
agccactcgcagtcgcagga

SEQ ID NO: 1747983 - DNA, 12 bp, Homo sapiens
agccactgaagc

SEQ ID NO: 1747984 - DNA, 15 bp, Homo sapiens
agccactggaaggag

SEQ ID NO: 1747985 - DNA, 23 bp, Homo sapiens
agccactggaaggagcacatact

SEQ ID NO: 1747986 - DNA, 21 bp, Homo sapiens
agccactgggacccgaggatt

SEQ ID NO: 1747987 - DNA, 19 bp, Homo sapiens
agccactggtttctcagaa

SEQ ID NO: 1747988 - DNA, 15 bp, Homo sapiens
agccacttctcccca

SEQ ID NO: 1747989 - DNA, 14 bp, Homo sapiens
agccagaaagcact

SEQ ID NO: 1747990 - DNA, 18 bp, Homo sapiens
agccagaagcctctgcct

SEQ ID NO: 1747991 - DNA, 19 bp, Homo sapiens
agccagacactctgctctg

SEQ ID NO: 1747992 - DNA, 17 bp, Homo sapiens
agccagagaggagcacc

SEQ ID NO: 1747993 - DNA, 18 bp, Homo sapiens
agccagagaggagcacct

SEQ ID NO: 1747994 - DNA, 14 bp, Homo sapiens
agccagagctgtgc

SEQ ID NO: 1747995 - DNA, 16 bp, Homo sapiens
agccagagctgtgcct

SEQ ID NO: 1747996 - DNA, 22 bp, Homo sapiens
agccagagctgtgcctgctcag

SEQ ID NO: 1747997 - DNA, 14 bp, Homo sapiens
agccagaggctggg

SEQ ID NO: 1747998 - DNA, 15 bp, Homo sapiens
agccagaggctgggt

SEQ ID NO: 1747999 - DNA, 18 bp, Homo sapiens
agccagaggctgggttca

SEQ ID NO: 1748000 - DNA, 10 bp, Homo sapiens
agccagaggt

SEQ ID NO: 1748001 - DNA, 13 bp, Homo sapiens
agccagaggtctg

SEQ ID NO: 1748002 - DNA, 22 bp, Homo sapiens
agccagagtttttaaagccttc

SEQ ID NO: 1748003 - DNA, 16 bp, Homo sapiens
agccagatgcaggaca

SEQ ID NO: 1748004 - DNA, 17 bp, Homo sapiens
agccagatgcaggacag

SEQ ID NO: 1748005 - DNA, 17 bp, Homo sapiens
agccagattctcttgaa

SEQ ID NO: 1748006 - DNA, 14 bp, Homo sapiens
agccagcacctggc

SEQ ID NO: 1748007 - DNA, 15 bp, Homo sapiens
agccagcacctggca

SEQ ID NO: 1748008 - DNA, 18 bp, Homo sapiens
agccagcagcagcccaag

SEQ ID NO: 1748009 - DNA, 11 bp, Homo sapiens
agccagcagcc

SEQ ID NO: 1748010 - DNA, 14 bp, Homo sapiens
agccagcagccagc

SEQ ID NO: 1748011 - DNA, 20 bp, Homo sapiens
agccagcagccagctctcag

SEQ ID NO: 1748012 - DNA, 13 bp, Homo sapiens
agccagcagggct

SEQ ID NO: 1748013 - DNA, 14 bp, Homo sapiens
agccagcagggctg

SEQ ID NO: 1748014 - DNA, 17 bp, Homo sapiens
agccagcattcagcaca

SEQ ID NO: 1748015 - DNA, 19 bp, Homo sapiens
agccagccaagctttaaat

SEQ ID NO: 1748016 - DNA, 11 bp, Homo sapiens
agccagccaca

SEQ ID NO: 1748017 - DNA, 22 bp, Homo sapiens
agccagccacagacccctggga

SEQ ID NO: 1748018 - DNA, 12 bp, Homo sapiens
agccagcccagc

SEQ ID NO: 1748019 - DNA, 16 bp, Homo sapiens
agccagcccagcccag

SEQ ID NO: 1748020 - DNA, 18 bp, Homo sapiens
agccagcccagcccagct

SEQ ID NO: 1748021 - DNA, 14 bp, Homo sapiens
agccagccccctcc

SEQ ID NO: 1748022 - DNA, 19 bp, Homo sapiens
agccagccccctccagctc

SEQ ID NO: 1748023 - DNA, 22 bp, Homo sapiens
agccagccccctccagctcatg

SEQ ID NO: 1748024 - DNA, 13 bp, Homo sapiens
agccagccctccc

SEQ ID NO: 1748025 - DNA, 22 bp, Homo sapiens
agccagccctccctgtcctcct

SEQ ID NO: 1748026 - DNA, 23 bp, Homo sapiens
agccagccctccctgtcctcctc

SEQ ID NO: 1748027 - DNA, 15 bp, Homo sapiens
agccagccggtgcct

SEQ ID NO: 1748028 - DNA, 17 bp, Homo sapiens
agccagccggtgcctgg

SEQ ID NO: 1748029 - DNA, 16 bp, Homo sapiens
agccagcctcagaagg

SEQ ID NO: 1748030 - DNA, 19 bp, Homo sapiens
agccagcctggctctgccc

SEQ ID NO: 1748031 - DNA, 23 bp, Homo sapiens
agccagcctgggactcccagtga

SEQ ID NO: 1748032 - DNA, 15 bp, Homo sapiens
agccagctccctcta

SEQ ID NO: 1748033 - DNA, 17 bp, Homo sapiens
agccagctccctctatt

SEQ ID NO: 1748034 - DNA, 17 bp, Homo sapiens
agccagctcctgggcag

SEQ ID NO: 1748035 - DNA, 14 bp, Homo sapiens
agccagctctcagc

SEQ ID NO: 1748036 - DNA, 16 bp, Homo sapiens
agccagctctcagcca

SEQ ID NO: 1748037 - DNA, 12 bp, Homo sapiens
agccagcttggt

SEQ ID NO: 1748038 - DNA, 22 bp, Homo sapiens
agccagctttccctgcctctca

SEQ ID NO: 1748039 - DNA, 20 bp, Homo sapiens
agccaggaagtacttccacc

SEQ ID NO: 1748040 - DNA, 20 bp, Homo sapiens
agccaggaatttcccaggac

SEQ ID NO: 1748041 - DNA, 21 bp, Homo sapiens
agccaggaatttcccaggacc

SEQ ID NO: 1748042 - DNA, 23 bp, Homo sapiens
agccaggaatttcccaggaccct

SEQ ID NO: 1748043 - DNA, 22 bp, Homo sapiens
agccaggacaccgggcagggcc

SEQ ID NO: 1748044 - DNA, 14 bp, Homo sapiens
agccaggagaagct

SEQ ID NO: 1748045 - DNA, 14 bp, Homo sapiens
agccaggagctggg

SEQ ID NO: 1748046 - DNA, 14 bp, Homo sapiens
agccaggagctgtc

SEQ ID NO: 1748047 - DNA, 17 bp, Homo sapiens
agccaggagctgtcacc

SEQ ID NO: 1748048 - DNA, 14 bp, Homo sapiens
agccaggagtctgt

SEQ ID NO: 1748049 - DNA, 18 bp, Homo sapiens
agccaggagtctgtgctc

SEQ ID NO: 1748050 - DNA, 18 bp, Homo sapiens
agccaggatgcccagatg

SEQ ID NO: 1748051 - DNA, 19 bp, Homo sapiens
agccaggatgcccagatga

SEQ ID NO: 1748052 - DNA, 18 bp, Homo sapiens
agccaggccaacagcacc

SEQ ID NO: 1748053 - DNA, 15 bp, Homo sapiens
agccaggctcactca

SEQ ID NO: 1748054 - DNA, 15 bp, Homo sapiens
agccaggctgagtga

SEQ ID NO: 1748055 - DNA, 13 bp, Homo sapiens
agccagggaacag

SEQ ID NO: 1748056 - DNA, 20 bp, Homo sapiens
agccagggaacagccccagg

SEQ ID NO: 1748057 - DNA, 22 bp, Homo sapiens
agccagggaacagccccagggt

SEQ ID NO: 1748058 - DNA, 19 bp, Homo sapiens
agccagggagactttctga

SEQ ID NO: 1748059 - DNA, 17 bp, Homo sapiens
agccagggcagaggaat

SEQ ID NO: 1748060 - DNA, 17 bp, Homo sapiens
agccaggtacaggagag

SEQ ID NO: 1748061 - DNA, 19 bp, Homo sapiens
agccaggtacaggagaggc

SEQ ID NO: 1748062 - DNA, 20 bp, Homo sapiens
agccaggtacaggagaggca

SEQ ID NO: 1748063 - DNA, 22 bp, Homo sapiens
agccaggtacaggagaggcagc

SEQ ID NO: 1748064 - DNA, 21 bp, Homo sapiens
agccaggttctcattaggttt

SEQ ID NO: 1748065 - DNA, 12 bp, Homo sapiens
agccagtctcag

SEQ ID NO: 1748066 - DNA, 20 bp, Homo sapiens
agccagtctcagagaccagc

SEQ ID NO: 1748067 - DNA, 21 bp, Homo sapiens
agccagtctcagagaccagca

SEQ ID NO: 1748068 - DNA, 19 bp, Homo sapiens
agccagtcttgcctaggcc

SEQ ID NO: 1748069 - DNA, 18 bp, Homo sapiens
agccagtgaaggagccac

SEQ ID NO: 1748070 - DNA, 21 bp, Homo sapiens
agccatataagtttgaaggaa

SEQ ID NO: 1748071 - DNA, 23 bp, Homo sapiens
agccatatgacaagcctttgtgc

SEQ ID NO: 1748072 - DNA, 20 bp, Homo sapiens
agccatcaagcacttcccag

SEQ ID NO: 1748073 - DNA, 20 bp, Homo sapiens
agccatcactagaagaaaag

SEQ ID NO: 1748074 - DNA, 18 bp, Homo sapiens
agccatcacttctccccg

SEQ ID NO: 1748075 - DNA, 22 bp, Homo sapiens
agccatcggtgaaactaacaga

SEQ ID NO: 1748076 - DNA, 19 bp, Homo sapiens
agccatctaatgcttgttt

SEQ ID NO: 1748077 - DNA, 23 bp, Homo sapiens
agccatctaatgcttgtttatga

SEQ ID NO: 1748078 - DNA, 22 bp, Homo sapiens
agccatctctctactcctacct

SEQ ID NO: 1748079 - DNA, 18 bp, Homo sapiens
agccatctgcccaggggt

SEQ ID NO: 1748080 - DNA, 19 bp, Homo sapiens
agccatctgcccaggggtg

SEQ ID NO: 1748081 - DNA, 22 bp, Homo sapiens
agccatgaaatcaactcagtgg

SEQ ID NO: 1748082 - DNA, 12 bp, Homo sapiens
agccatgaggag

SEQ ID NO: 1748083 - DNA, 23 bp, Homo sapiens
agccatgaggagcgtggactctg

SEQ ID NO: 1748084 - DNA, 18 bp, Homo sapiens
agccatgaggagttgctg

SEQ ID NO: 1748085 - DNA, 23 bp, Homo sapiens
agccatgagttccagaaagtaaa

SEQ ID NO: 1748086 - DNA, 18 bp, Homo sapiens
agccatgatttcccactg

SEQ ID NO: 1748087 - DNA, 22 bp, Homo sapiens
agccatgatttcccactgcact

SEQ ID NO: 1748088 - DNA, 20 bp, Homo sapiens
agccatgatttgtcccagcc

SEQ ID NO: 1748089 - DNA, 15 bp, Homo sapiens
agccatgcctcatgc

SEQ ID NO: 1748090 - DNA, 17 bp, Homo sapiens
agccatgcctcatgcca

SEQ ID NO: 1748091 - DNA, 23 bp, Homo sapiens
agccatgcgccccctccgccctg

SEQ ID NO: 1748092 - DNA, 12 bp, Homo sapiens
agccatggctca

SEQ ID NO: 1748093 - DNA, 20 bp, Homo sapiens
agccatggctcaggcaagcc

SEQ ID NO: 1748094 - DNA, 22 bp, Homo sapiens
agccatggctcaggcaagcccc

SEQ ID NO: 1748095 - DNA, 13 bp, Homo sapiens
agccatgggcctg

SEQ ID NO: 1748096 - DNA, 16 bp, Homo sapiens
agccccctcttcctcc

SEQ ID NO: 1748097 - DNA, 20 bp, Homo sapiens
agccccctggatgtcccctg

SEQ ID NO: 1748098 - DNA, 16 bp, Homo sapiens
agccccctggcctctg

SEQ ID NO: 1748099 - DNA, 20 bp, Homo sapiens
agccccgagacaccatcctg

SEQ ID NO: 1748100 - DNA, 14 bp, Homo sapiens
agccccgctcccac

SEQ ID NO: 1748101 - DNA, 16 bp, Homo sapiens
agccccgctcccacct

SEQ ID NO: 1748102 - DNA, 22 bp, Homo sapiens
agccccgctcccacctagtgcc

SEQ ID NO: 1748103 - DNA, 16 bp, Homo sapiens
agcccctcaaagactt

SEQ ID NO: 1748104 - DNA, 14 bp, Homo sapiens
agcccctcagccct

SEQ ID NO: 1748105 - DNA, 18 bp, Homo sapiens
agcccctcagcccttgcc

SEQ ID NO: 1748106 - DNA, 13 bp, Homo sapiens
agcccctcctcca

SEQ ID NO: 1748107 - DNA, 22 bp, Homo sapiens
agcccctcctccagcccctgtc

SEQ ID NO: 1748108 - DNA, 14 bp, Homo sapiens
agcccctcctctgc

SEQ ID NO: 1748109 - DNA, 15 bp, Homo sapiens
agcccctcctctgcc

SEQ ID NO: 1748110 - DNA, 16 bp, Homo sapiens
agcccctctggtcgct

SEQ ID NO: 1748111 - DNA, 12 bp, Homo sapiens
agcccctcttcc

SEQ ID NO: 1748112 - DNA, 13 bp, Homo sapiens
agcccctcttccc

SEQ ID NO: 1748113 - DNA, 15 bp, Homo sapiens
agcccctcttggaga

SEQ ID NO: 1748114 - DNA, 18 bp, Homo sapiens
agcccctcttggagaagt

SEQ ID NO: 1748115 - DNA, 18 bp, Homo sapiens
agcccctgaaagcctcac

SEQ ID NO: 1748116 - DNA, 19 bp, Homo sapiens
agcccctgcccctcatgcc

SEQ ID NO: 1748117 - DNA, 16 bp, Homo sapiens
agcccctgggcccagt

SEQ ID NO: 1748118 - DNA, 12 bp, Homo sapiens
agcccctgtccc

SEQ ID NO: 1748119 - DNA, 22 bp, Homo sapiens
agccccttactatgatctcagg

SEQ ID NO: 1748120 - DNA, 21 bp, Homo sapiens
agccccttcatccgcctgtgg

SEQ ID NO: 1748121 - DNA, 22 bp, Homo sapiens
agccccttctggccggtgctgg

SEQ ID NO: 1748122 - DNA, 14 bp, Homo sapiens
agcccgaacaccat

SEQ ID NO: 1748123 - DNA, 21 bp, Homo sapiens
agcccgacagtgccatcccca

SEQ ID NO: 1748124 - DNA, 16 bp, Homo sapiens
agcccgatattctccc

SEQ ID NO: 1748125 - DNA, 17 bp, Homo sapiens
agcccgcactgtcccag

SEQ ID NO: 1748126 - DNA, 19 bp, Homo sapiens
agcccgcactgtcccagta

SEQ ID NO: 1748127 - DNA, 14 bp, Homo sapiens
agcccgcagggcca

SEQ ID NO: 1748128 - DNA, 20 bp, Homo sapiens
agcccgcctgccgtgcatgg

SEQ ID NO: 1748129 - DNA, 15 bp, Homo sapiens
agcccgcgtgctgga

SEQ ID NO: 1748130 - DNA, 16 bp, Homo sapiens
agcccgcgtgctggag

SEQ ID NO: 1748131 - DNA, 17 bp, Homo sapiens
agcccgcgtgctggaga

SEQ ID NO: 1748132 - DNA, 16 bp, Homo sapiens
agcccgctctctggct

SEQ ID NO: 1748133 - DNA, 13 bp, Homo sapiens
agcccgcttggcc

SEQ ID NO: 1748134 - DNA, 14 bp, Homo sapiens
agcccgcttggcca

SEQ ID NO: 1748135 - DNA, 16 bp, Homo sapiens
agcccgcttggccacc

SEQ ID NO: 1748136 - DNA, 21 bp, Homo sapiens
agcccgcttttgttcttcccc

SEQ ID NO: 1748137 - DNA, 19 bp, Homo sapiens
agcccggcctgctcccagc

SEQ ID NO: 1748138 - DNA, 22 bp, Homo sapiens
agcccggcctgctcccagcagc

SEQ ID NO: 1748139 - DNA, 16 bp, Homo sapiens
agcccggcgcccctgc

SEQ ID NO: 1748140 - DNA, 15 bp, Homo sapiens
agcccggctggtttt

SEQ ID NO: 1748141 - DNA, 13 bp, Homo sapiens
agcccgggctgcc

SEQ ID NO: 1748142 - DNA, 14 bp, Homo sapiens
agcccgggctgcct

SEQ ID NO: 1748143 - DNA, 15 bp, Homo sapiens
agcccgggctgcctg

SEQ ID NO: 1748144 - DNA, 17 bp, Homo sapiens
agcccgggctgcctggg

SEQ ID NO: 1748145 - DNA, 19 bp, Homo sapiens
agcccgtcgcgctggacag

SEQ ID NO: 1748146 - DNA, 14 bp, Homo sapiens
agcccgtctcagtg

SEQ ID NO: 1748147 - DNA, 21 bp, Homo sapiens
agccctaaccccttccagatc

SEQ ID NO: 1748148 - DNA, 16 bp, Homo sapiens
agccctaagtggctgc

SEQ ID NO: 1748149 - DNA, 19 bp, Homo sapiens
agccctaagtggctgcctt

SEQ ID NO: 1748150 - DNA, 20 bp, Homo sapiens
agccctaagtggctgccttc

SEQ ID NO: 1748151 - DNA, 13 bp, Homo sapiens
agccctactccct

SEQ ID NO: 1748152 - DNA, 16 bp, Homo sapiens
agccctactccctgca

SEQ ID NO: 1748153 - DNA, 24 bp, Homo sapiens
agccctactccctgcagatgccac

SEQ ID NO: 1748154 - DNA, 16 bp, Homo sapiens
agccctagctgtccca

SEQ ID NO: 1748155 - DNA, 20 bp, Homo sapiens
agccctcaaagaagtcggaa

SEQ ID NO: 1748156 - DNA, 15 bp, Homo sapiens
agccctcagaagaaa

SEQ ID NO: 1748157 - DNA, 23 bp, Homo sapiens
agccctcagtcagttcccggagc

SEQ ID NO: 1748158 - DNA, 20 bp, Homo sapiens
agccctccacttctggtata

SEQ ID NO: 1748159 - DNA, 13 bp, Homo sapiens
agccctccaggcc

SEQ ID NO: 1748160 - DNA, 14 bp, Homo sapiens
agccctccaggcct

SEQ ID NO: 1748161 - DNA, 15 bp, Homo sapiens
agccctccaggcctg

SEQ ID NO: 1748162 - DNA, 17 bp, Homo sapiens
agccctccaggcctgca

SEQ ID NO: 1748163 - DNA, 17 bp, Homo sapiens
agccctccctgcccctc

SEQ ID NO: 1748164 - DNA, 23 bp, Homo sapiens
agccctccctgcccctcccttca

SEQ ID NO: 1748165 - DNA, 18 bp, Homo sapiens
agccctccctggctgtga

SEQ ID NO: 1748166 - DNA, 17 bp, Homo sapiens
agccctccctgtcctcc

SEQ ID NO: 1748167 - DNA, 19 bp, Homo sapiens
agccctccctgtcctcctc

SEQ ID NO: 1748168 - DNA, 20 bp, Homo sapiens
agccctccctgtcctcctcg

SEQ ID NO: 1748169 - DNA, 21 bp, Homo sapiens
agccctccctgtcctcctcgg

SEQ ID NO: 1748170 - DNA, 14 bp, Homo sapiens
agccctcctgagca

SEQ ID NO: 1748171 - DNA, 15 bp, Homo sapiens
agccctcctgagcac

SEQ ID NO: 1748172 - DNA, 12 bp, Homo sapiens
agccctccttcc

SEQ ID NO: 1748173 - DNA, 16 bp, Homo sapiens
agccctcggcctccga

SEQ ID NO: 1748174 - DNA, 19 bp, Homo sapiens
agccctgaggacctctcag

SEQ ID NO: 1748175 - DNA, 17 bp, Homo sapiens
agccctgagtgtcccaa

SEQ ID NO: 1748176 - DNA, 18 bp, Homo sapiens
agccctgagtgtcccaag

SEQ ID NO: 1748177 - DNA, 16 bp, Homo sapiens
agccctgattgtgcca

SEQ ID NO: 1748178 - DNA, 12 bp, Homo sapiens
agccctgcagcc

SEQ ID NO: 1748179 - DNA, 13 bp, Homo sapiens
agccctgcagccc

SEQ ID NO: 1748180 - DNA, 14 bp, Homo sapiens
agccctgcctctgt

SEQ ID NO: 1748181 - DNA, 17 bp, Homo sapiens
agccctgcggagccggc

SEQ ID NO: 1748182 - DNA, 19 bp, Homo sapiens
agccctgcggagccggcac

SEQ ID NO: 1748183 - DNA, 19 bp, Homo sapiens
agccctgctggggatcccc

SEQ ID NO: 1748184 - DNA, 17 bp, Homo sapiens
agccctgctttgggctg

SEQ ID NO: 1748185 - DNA, 20 bp, Homo sapiens
agccctgctttgggctgccc

SEQ ID NO: 1748186 - DNA, 21 bp, Homo sapiens
agccctgctttgggctgccct

SEQ ID NO: 1748187 - DNA, 23 bp, Homo sapiens
agccctgctttgggctgccctgg

SEQ ID NO: 1748188 - DNA, 18 bp, Homo sapiens
agccctggagagccccat

SEQ ID NO: 1748189 - DNA, 12 bp, Homo sapiens
agccctggccct

SEQ ID NO: 1748190 - DNA, 20 bp, Homo sapiens
agccctggccctgcccagcc

SEQ ID NO: 1748191 - DNA, 15 bp, Homo sapiens
agccctgggaaccac

SEQ ID NO: 1748192 - DNA, 19 bp, Homo sapiens
agccctgggaaccactccc

SEQ ID NO: 1748193 - DNA, 20 bp, Homo sapiens
agccctgggaaccactccca

SEQ ID NO: 1748194 - DNA, 16 bp, Homo sapiens
agccctgggccccacc

SEQ ID NO: 1748195 - DNA, 21 bp, Homo sapiens
agccctgggccccaccaccta

SEQ ID NO: 1748196 - DNA, 20 bp, Homo sapiens
agccctgggtaccctgagcc

SEQ ID NO: 1748197 - DNA, 17 bp, Homo sapiens
agccctgtcgagacact

SEQ ID NO: 1748198 - DNA, 21 bp, Homo sapiens
agccctgtggccgccacctga

SEQ ID NO: 1748199 - DNA, 19 bp, Homo sapiens
agccctgttctcctgtccc

SEQ ID NO: 1748200 - DNA, 18 bp, Homo sapiens
agcccttcactgccatga

SEQ ID NO: 1748201 - DNA, 18 bp, Homo sapiens
agcccttcctacctctgg

SEQ ID NO: 1748202 - DNA, 20 bp, Homo sapiens
agcccttctatacccaccca

SEQ ID NO: 1748203 - DNA, 18 bp, Homo sapiens
agcccttctgcctttctc

SEQ ID NO: 1748204 - DNA, 19 bp, Homo sapiens
agcccttgcccccatccct

SEQ ID NO: 1748205 - DNA, 22 bp, Homo sapiens
agcccttgcccccatccctcgg

SEQ ID NO: 1748206 - DNA, 13 bp, Homo sapiens
agcccttgcctcc

SEQ ID NO: 1748207 - DNA, 16 bp, Homo sapiens
agcccttgcctcccca

SEQ ID NO: 1748208 - DNA, 18 bp, Homo sapiens
agcccttggaacaccctg

SEQ ID NO: 1748209 - DNA, 20 bp, Homo sapiens
agcccttggaacaccctgga

SEQ ID NO: 1748210 - DNA, 22 bp, Homo sapiens
agcccttggaacaccctggatg

SEQ ID NO: 1748211 - DNA, 19 bp, Homo sapiens
agccttcctctgcagctga

SEQ ID NO: 1748212 - DNA, 23 bp, Homo sapiens
agccttcctctgcagctgacctc

SEQ ID NO: 1748213 - DNA, 13 bp, Homo sapiens
agccttcctttct

SEQ ID NO: 1748214 - DNA, 22 bp, Homo sapiens
agccttctaaatgagtcactga

SEQ ID NO: 1748215 - DNA, 16 bp, Homo sapiens
agccttctccctagct

SEQ ID NO: 1748216 - DNA, 16 bp, Homo sapiens
agccttctcctcccaa

SEQ ID NO: 1748217 - DNA, 17 bp, Homo sapiens
agccttctggatccatg

SEQ ID NO: 1748218 - DNA, 16 bp, Homo sapiens
agccttgagagaccca

SEQ ID NO: 1748219 - DNA, 17 bp, Homo sapiens
agccttgagagacccag

SEQ ID NO: 1748220 - DNA, 16 bp, Homo sapiens
agccttgagccctggc

SEQ ID NO: 1748221 - DNA, 19 bp, Homo sapiens
agccttgagccctggctgt

SEQ ID NO: 1748222 - DNA, 20 bp, Homo sapiens
agccttgcagatatctgcat

SEQ ID NO: 1748223 - DNA, 21 bp, Homo sapiens
agccttgcccggattctggga

SEQ ID NO: 1748224 - DNA, 13 bp, Homo sapiens
agccttgctgctc

SEQ ID NO: 1748225 - DNA, 14 bp, Homo sapiens
agccttgctgctct

SEQ ID NO: 1748226 - DNA, 15 bp, Homo sapiens
agccttgctgctctg

SEQ ID NO: 1748227 - DNA, 16 bp, Homo sapiens
agccttgctgctctgc

SEQ ID NO: 1748228 - DNA, 17 bp, Homo sapiens
agccttgctgctctgcg

SEQ ID NO: 1748229 - DNA, 18 bp, Homo sapiens
agccttgctgctctgcgt

SEQ ID NO: 1748230 - DNA, 17 bp, Homo sapiens
agccttgctgggccagg

SEQ ID NO: 1748231 - DNA, 19 bp, Homo sapiens
agccttggataatgctgtt

SEQ ID NO: 1748232 - DNA, 17 bp, Homo sapiens
agccttggcctcagagg

SEQ ID NO: 1748233 - DNA, 17 bp, Homo sapiens
agccttggctcgttctc

SEQ ID NO: 1748234 - DNA, 13 bp, Homo sapiens
agccttggggcat

SEQ ID NO: 1748235 - DNA, 21 bp, Homo sapiens
agccttggtgtccacctggcc

SEQ ID NO: 1748236 - DNA, 13 bp, Homo sapiens
agccttgtgagat

SEQ ID NO: 1748237 - DNA, 13 bp, Homo sapiens
agccttgtgccct

SEQ ID NO: 1748238 - DNA, 17 bp, Homo sapiens
agccttgtgccctgccc

SEQ ID NO: 1748239 - DNA, 18 bp, Homo sapiens
agcctttacctgtgaagt

SEQ ID NO: 1748240 - DNA, 19 bp, Homo sapiens
agcctttaccttttatgca

SEQ ID NO: 1748241 - DNA, 16 bp, Homo sapiens
agcctttactgtttga

SEQ ID NO: 1748242 - DNA, 20 bp, Homo sapiens
agcctttactgtttgatata

SEQ ID NO: 1748243 - DNA, 22 bp, Homo sapiens
agcctttatggctgctgggctg

SEQ ID NO: 1748244 - DNA, 14 bp, Homo sapiens
agcctttccataag

SEQ ID NO: 1748245 - DNA, 23 bp, Homo sapiens
agcctttccataaggaatgtagc

SEQ ID NO: 1748246 - DNA, 15 bp, Homo sapiens
agcctttctctcttt

SEQ ID NO: 1748247 - DNA, 13 bp, Homo sapiens
agcctttcttgta

SEQ ID NO: 1748248 - DNA, 20 bp, Homo sapiens
agcctttgcccaaaactgtc

SEQ ID NO: 1748249 - DNA, 16 bp, Homo sapiens
agcctttgcctccccg

SEQ ID NO: 1748250 - DNA, 18 bp, Homo sapiens
agcctttgggtcctgggc

SEQ ID NO: 1748251 - DNA, 19 bp, Homo sapiens
agcctttgggtcctgggca

SEQ ID NO: 1748252 - DNA, 21 bp, Homo sapiens
agcctttgttgaactgttaga

SEQ ID NO: 1748253 - DNA, 23 bp, Homo sapiens
agccttttccctctttggctccc

SEQ ID NO: 1748254 - DNA, 21 bp, Homo sapiens
agcctttttaaaacacatgtt

SEQ ID NO: 1748255 - DNA, 12 bp, Homo sapiens
agcctttttcac

SEQ ID NO: 1748256 - DNA, 23 bp, Homo sapiens
agcgaacttcacataggaaggga

SEQ ID NO: 1748257 - DNA, 16 bp, Homo sapiens
agcgaacttgacaatt

SEQ ID NO: 1748258 - DNA, 16 bp, Homo sapiens
agcgaaggaacctctc

SEQ ID NO: 1748259 - DNA, 20 bp, Homo sapiens
agcgacaccctttctgtttg

SEQ ID NO: 1748260 - DNA, 14 bp, Homo sapiens
agcgaccccaggac

SEQ ID NO: 1748261 - DNA, 17 bp, Homo sapiens
agcgaccgccccctcct

SEQ ID NO: 1748262 - DNA, 19 bp, Homo sapiens
agcgacctcaagtgtcctg

SEQ ID NO: 1748263 - DNA, 22 bp, Homo sapiens
agcgaccttcctcatccacccc

SEQ ID NO: 1748264 - DNA, 19 bp, Homo sapiens
agcgactccgttggccact

SEQ ID NO: 1748265 - DNA, 15 bp, Homo sapiens
agcgagagagtttca

SEQ ID NO: 1748266 - DNA, 15 bp, Homo sapiens
agcgagaggcagcaa

SEQ ID NO: 1748267 - DNA, 16 bp, Homo sapiens
agcgagagtctgtctc

SEQ ID NO: 1748268 - DNA, 15 bp, Homo sapiens
agcgagcatccccca

SEQ ID NO: 1748269 - DNA, 14 bp, Homo sapiens
agcgagggcagctg

SEQ ID NO: 1748270 - DNA, 19 bp, Homo sapiens
agcgatctctcctggccta

SEQ ID NO: 1748271 - DNA, 18 bp, Homo sapiens
agcgatgaatttggagac

SEQ ID NO: 1748272 - DNA, 19 bp, Homo sapiens
agcgatgggcccctggccc

SEQ ID NO: 1748273 - DNA, 15 bp, Homo sapiens
agcgatgtgcaggaa

SEQ ID NO: 1748274 - DNA, 20 bp, Homo sapiens
agcgatgtgcaggaagaaaa

SEQ ID NO: 1748275 - DNA, 21 bp, Homo sapiens
agcgattctcccgcctcagcc

SEQ ID NO: 1748276 - DNA, 22 bp, Homo sapiens
agcgattctcccgcctcagcct

SEQ ID NO: 1748277 - DNA, 16 bp, Homo sapiens
agcgattctcctgtct

SEQ ID NO: 1748278 - DNA, 18 bp, Homo sapiens
agcgcacctgccccctgg

SEQ ID NO: 1748279 - DNA, 14 bp, Homo sapiens
agcgcatgtgtgca

SEQ ID NO: 1748280 - DNA, 20 bp, Homo sapiens
agcgcatgtgtgcatgtgct

SEQ ID NO: 1748281 - DNA, 21 bp, Homo sapiens
agcgcatgtgtgcatgtgctg

SEQ ID NO: 1748282 - DNA, 15 bp, Homo sapiens
agcgccagctccttg

SEQ ID NO: 1748283 - DNA, 14 bp, Homo sapiens
agcgcccacccagg

SEQ ID NO: 1748284 - DNA, 15 bp, Homo sapiens
agcgcccacccaggt

SEQ ID NO: 1748285 - DNA, 16 bp, Homo sapiens
agcgcccacccaggtc

SEQ ID NO: 1748286 - DNA, 15 bp, Homo sapiens
agcgccccgccccca

SEQ ID NO: 1748287 - DNA, 20 bp, Homo sapiens
agcgcccctcactcctgcgc

SEQ ID NO: 1748288 - DNA, 14 bp, Homo sapiens
agcgcccgctgggc

SEQ ID NO: 1748289 - DNA, 15 bp, Homo sapiens
agcgcccgctgggct

SEQ ID NO: 1748290 - DNA, 19 bp, Homo sapiens
agcgcccgctgggctgagc

SEQ ID NO: 1748291 - DNA, 14 bp, Homo sapiens
agcgcccggtgctc

SEQ ID NO: 1748292 - DNA, 21 bp, Homo sapiens
agcgcctagtggggtctccct

SEQ ID NO: 1748293 - DNA, 18 bp, Homo sapiens
agcgcctattgtttgtaa

SEQ ID NO: 1748294 - DNA, 20 bp, Homo sapiens
agcgcctccatccaaggcca

SEQ ID NO: 1748295 - DNA, 22 bp, Homo sapiens
agcgcctccatccaaggccagg

SEQ ID NO: 1748296 - DNA, 19 bp, Homo sapiens
agcgctcatgttgagccag

SEQ ID NO: 1748297 - DNA, 14 bp, Homo sapiens
agcgctctcctgga

SEQ ID NO: 1748298 - DNA, 17 bp, Homo sapiens
agcgctgccgcacccca

SEQ ID NO: 1748299 - DNA, 19 bp, Homo sapiens
agcgctgccgcaccccaga

SEQ ID NO: 1748300 - DNA, 20 bp, Homo sapiens
agcgctgccgcaccccagag

SEQ ID NO: 1748301 - DNA, 21 bp, Homo sapiens
agcgctgccgcaccccagagt

SEQ ID NO: 1748302 - DNA, 22 bp, Homo sapiens
agcgctggctccctgggcagtg

SEQ ID NO: 1748303 - DNA, 18 bp, Homo sapiens
agcgctgtggactgtcct

SEQ ID NO: 1748304 - DNA, 19 bp, Homo sapiens
agcgcttcagttcagcttt

SEQ ID NO: 1748305 - DNA, 19 bp, Homo sapiens
agcgctttgggaggcggag

SEQ ID NO: 1748306 - DNA, 22 bp, Homo sapiens
agcggaacaaggagtcagacat

SEQ ID NO: 1748307 - DNA, 14 bp, Homo sapiens
agcggagagagcca

SEQ ID NO: 1748308 - DNA, 15 bp, Homo sapiens
agcggagcccagcct

SEQ ID NO: 1748309 - DNA, 16 bp, Homo sapiens
agcggagcccagcctg

SEQ ID NO: 1748310 - DNA, 22 bp, Homo sapiens
agcggagcccgatattctccct

SEQ ID NO: 1748311 - DNA, 15 bp, Homo sapiens
agcggaggagaccag

SEQ ID NO: 1748312 - DNA, 14 bp, Homo sapiens
agcggaggtgtgga

SEQ ID NO: 1748313 - DNA, 17 bp, Homo sapiens
agcggagtctgtcctgt

SEQ ID NO: 1748314 - DNA, 16 bp, Homo sapiens
agcggattgctctgga

SEQ ID NO: 1748315 - DNA, 22 bp, Homo sapiens
agcggattgctctggagcagcc

SEQ ID NO: 1748316 - DNA, 21 bp, Homo sapiens
agcggcagagcaattccaggc

SEQ ID NO: 1748317 - DNA, 14 bp, Homo sapiens
agcggctacaaagc

SEQ ID NO: 1748318 - DNA, 19 bp, Homo sapiens
agcggctgagtcatgatct

SEQ ID NO: 1748319 - DNA, 17 bp, Homo sapiens
agcggctggtgcagggc

SEQ ID NO: 1748320 - DNA, 19 bp, Homo sapiens
agcggctggtgcagggcct

SEQ ID NO: 1748321 - DNA, 17 bp, Homo sapiens
agcgggagacctgtgct

SEQ ID NO: 1748322 - DNA, 15 bp, Homo sapiens
agcgggcacagggca

SEQ ID NO: 1748323 - DNA, 16 bp, Homo sapiens
agcgggcacagggcac

SEQ ID NO: 1748324 - DNA, 13 bp, Homo sapiens
agcgggccaggcc

SEQ ID NO: 1748325 - DNA, 21 bp, Homo sapiens
agctcacagttcctcgccctg

SEQ ID NO: 1748326 - DNA, 23 bp, Homo sapiens
agctcacagttcctcgccctggg

SEQ ID NO: 1748327 - DNA, 20 bp, Homo sapiens
agctcacatccagccttgga

SEQ ID NO: 1748328 - DNA, 15 bp, Homo sapiens
agctcaccaggcctg

SEQ ID NO: 1748329 - DNA, 22 bp, Homo sapiens
agctcaccaggcctggcctctg

SEQ ID NO: 1748330 - DNA, 21 bp, Homo sapiens
agctcaccctgcccgctccca

SEQ ID NO: 1748331 - DNA, 22 bp, Homo sapiens
agctcaccctgcccgctcccaa

SEQ ID NO: 1748332 - DNA, 16 bp, Homo sapiens
agctcacgtcacactt

SEQ ID NO: 1748333 - DNA, 20 bp, Homo sapiens
agctcacgtcctgagaaagc

SEQ ID NO: 1748334 - DNA, 19 bp, Homo sapiens
agctcactgcaacctccac

SEQ ID NO: 1748335 - DNA, 17 bp, Homo sapiens
agctcactgctgctgcc

SEQ ID NO: 1748336 - DNA, 22 bp, Homo sapiens
agctcactgctgctgcctctga

SEQ ID NO: 1748337 - DNA, 13 bp, Homo sapiens
agctcacttctgg

SEQ ID NO: 1748338 - DNA, 23 bp, Homo sapiens
agctcacttctgggcttcatctg

SEQ ID NO: 1748339 - DNA, 15 bp, Homo sapiens
agctcagaggcccag

SEQ ID NO: 1748340 - DNA, 15 bp, Homo sapiens
agctcagctgcccat

SEQ ID NO: 1748341 - DNA, 18 bp, Homo sapiens
agctcaggacagatgcca

SEQ ID NO: 1748342 - DNA, 22 bp, Homo sapiens
agctcaggagggtgacgcccag

SEQ ID NO: 1748343 - DNA, 21 bp, Homo sapiens
agctcaggcatttgaggctgt

SEQ ID NO: 1748344 - DNA, 15 bp, Homo sapiens
agctcaggtgcctta

SEQ ID NO: 1748345 - DNA, 20 bp, Homo sapiens
agctcaggtttgtcctggtc

SEQ ID NO: 1748346 - DNA, 20 bp, Homo sapiens
agctcagtaacataactgct

SEQ ID NO: 1748347 - DNA, 13 bp, Homo sapiens
agctcagtcccat

SEQ ID NO: 1748348 - DNA, 21 bp, Homo sapiens
agctcataaactgccaagagc

SEQ ID NO: 1748349 - DNA, 23 bp, Homo sapiens
agctcatagaattttgagtattc

SEQ ID NO: 1748350 - DNA, 21 bp, Homo sapiens
agctcatagaggtgagaaaac

SEQ ID NO: 1748351 - DNA, 18 bp, Homo sapiens
agctcatctatttggaac

SEQ ID NO: 1748352 - DNA, 21 bp, Homo sapiens
agctcattaaacttttttaac

SEQ ID NO: 1748353 - DNA, 14 bp, Homo sapiens
agctcattcccaac

SEQ ID NO: 1748354 - DNA, 13 bp, Homo sapiens
agctccaacctgc

SEQ ID NO: 1748355 - DNA, 22 bp, Homo sapiens
agctccaacctgcaaagatctg

SEQ ID NO: 1748356 - DNA, 21 bp, Homo sapiens
agctccacaccctctcccagg

SEQ ID NO: 1748357 - DNA, 12 bp, Homo sapiens
agctccacctct

SEQ ID NO: 1748358 - DNA, 13 bp, Homo sapiens
agctccacctctg

SEQ ID NO: 1748359 - DNA, 11 bp, Homo sapiens
agctccactct

SEQ ID NO: 1748360 - DNA, 23 bp, Homo sapiens
agctccactctgcttctctgact

SEQ ID NO: 1748361 - DNA, 24 bp, Homo sapiens
agctccactctgcttctctgactt

SEQ ID NO: 1748362 - DNA, 20 bp, Homo sapiens
agctccagcgatggtgctgc

SEQ ID NO: 1748363 - DNA, 24 bp, Homo sapiens
agctccagcgatggtgctgcccag

SEQ ID NO: 1748364 - DNA, 21 bp, Homo sapiens
agctccagggaatccaagcct

SEQ ID NO: 1748365 - DNA, 13 bp, Homo sapiens
agctcccacctcc

SEQ ID NO: 1748366 - DNA, 18 bp, Homo sapiens
agctcccacctcccttcc

SEQ ID NO: 1748367 - DNA, 12 bp, Homo sapiens
agctcccaggcc

SEQ ID NO: 1748368 - DNA, 12 bp, Homo sapiens
agctccccagga

SEQ ID NO: 1748369 - DNA, 13 bp, Homo sapiens
agctccccaggac

SEQ ID NO: 1748370 - DNA, 19 bp, Homo sapiens
agctccccccgcccaccca

SEQ ID NO: 1748371 - DNA, 17 bp, Homo sapiens
agctcccctccacagct

SEQ ID NO: 1748372 - DNA, 18 bp, Homo sapiens
agctcccctccacagctg

SEQ ID NO: 1748373 - DNA, 20 bp, Homo sapiens
agctcccctggagccagcag

SEQ ID NO: 1748374 - DNA, 23 bp, Homo sapiens
agctcccctggagccagcagggc

SEQ ID NO: 1748375 - DNA, 15 bp, Homo sapiens
agctccctaggagac

SEQ ID NO: 1748376 - DNA, 11 bp, Homo sapiens
agctccctcct

SEQ ID NO: 1748377 - DNA, 13 bp, Homo sapiens
agctccctcctcc

SEQ ID NO: 1748378 - DNA, 16 bp, Homo sapiens
agctccctcctcccat

SEQ ID NO: 1748379 - DNA, 12 bp, Homo sapiens
agctccctcctg

SEQ ID NO: 1748380 - DNA, 13 bp, Homo sapiens
agctccctcctgc

SEQ ID NO: 1748381 - DNA, 22 bp, Homo sapiens
agctccctcctgcacacagaat

SEQ ID NO: 1748382 - DNA, 22 bp, Homo sapiens
agctccctcgtcttcagctgca

SEQ ID NO: 1748383 - DNA, 18 bp, Homo sapiens
agctccctgtggggcagg

SEQ ID NO: 1748384 - DNA, 23 bp, Homo sapiens
agctccctgtggggcaggagtgc

SEQ ID NO: 1748385 - DNA, 22 bp, Homo sapiens
agctccgagctgtaggagagtc

SEQ ID NO: 1748386 - DNA, 19 bp, Homo sapiens
agctcctataaagggccca

SEQ ID NO: 1748387 - DNA, 13 bp, Homo sapiens
agctcctcccctt

SEQ ID NO: 1748388 - DNA, 21 bp, Homo sapiens
agctcctcctcttggagctga

SEQ ID NO: 1748389 - DNA, 23 bp, Homo sapiens
agctcctctccccagcccagaga

SEQ ID NO: 1748390 - DNA, 18 bp, Homo sapiens
agctcctctccttgggct

SEQ ID NO: 1748391 - DNA, 20 bp, Homo sapiens
agctcctctccttgggctcc

SEQ ID NO: 1748392 - DNA, 21 bp, Homo sapiens
agctcctctccttgggctcct

SEQ ID NO: 1748393 - DNA, 23 bp, Homo sapiens
agctcctctccttgggctcctgg

SEQ ID NO: 1748394 - DNA, 20 bp, Homo sapiens
agctcctcttaccgtagcct

SEQ ID NO: 1748395 - DNA, 13 bp, Homo sapiens
agctcctcttcca

SEQ ID NO: 1748396 - DNA, 14 bp, Homo sapiens
agctcctgctgcgg

SEQ ID NO: 1748397 - DNA, 18 bp, Homo sapiens
agctcctgctgcggagga

SEQ ID NO: 1748398 - DNA, 13 bp, Homo sapiens
agctcctgtggcc

SEQ ID NO: 1748399 - DNA, 15 bp, Homo sapiens
agctcctgtggcccc

SEQ ID NO: 1748400 - DNA, 19 bp, Homo sapiens
agctcctgtggccccaccc

SEQ ID NO: 1748401 - DNA, 18 bp, Homo sapiens
agctccttactctgagga

SEQ ID NO: 1748402 - DNA, 19 bp, Homo sapiens
agctccttactctgaggaa

SEQ ID NO: 1748403 - DNA, 21 bp, Homo sapiens
agctccttattggaaggtatt

SEQ ID NO: 1748404 - DNA, 19 bp, Homo sapiens
agctccttcctagccttgc

SEQ ID NO: 1748405 - DNA, 19 bp, Homo sapiens
agctccttgagtaaaaagg

SEQ ID NO: 1748406 - DNA, 21 bp, Homo sapiens
agctccttggggcagggcctg

SEQ ID NO: 1748407 - DNA, 23 bp, Homo sapiens
agctccttttgtccccagggccc

SEQ ID NO: 1748408 - DNA, 18 bp, Homo sapiens
agctcgctggctttctct

SEQ ID NO: 1748409 - DNA, 16 bp, Homo sapiens
agctcggggagcctta

SEQ ID NO: 1748410 - DNA, 17 bp, Homo sapiens
agctcggggggctctgc

SEQ ID NO: 1748411 - DNA, 17 bp, Homo sapiens
agctcggtggacccagg

SEQ ID NO: 1748412 - DNA, 17 bp, Homo sapiens
agctcgtgtatcctggg

SEQ ID NO: 1748413 - DNA, 18 bp, Homo sapiens
agctcgtgtatcctgggg

SEQ ID NO: 1748414 - DNA, 22 bp, Homo sapiens
agctctaaagtagcaactgctg

SEQ ID NO: 1748415 - DNA, 19 bp, Homo sapiens
agctctactgccctcccct

SEQ ID NO: 1748416 - DNA, 13 bp, Homo sapiens
agctctagaatct

SEQ ID NO: 1748417 - DNA, 19 bp, Homo sapiens
agctctagttttcagcctt

SEQ ID NO: 1748418 - DNA, 20 bp, Homo sapiens
agctctagttttcagccttg

SEQ ID NO: 1748419 - DNA, 22 bp, Homo sapiens
agctctatgtttacaaatggac

SEQ ID NO: 1748420 - DNA, 13 bp, Homo sapiens
agctctcagcaag

SEQ ID NO: 1748421 - DNA, 12 bp, Homo sapiens
agctctcagcca

SEQ ID NO: 1748422 - DNA, 13 bp, Homo sapiens
agctctcagccaa

SEQ ID NO: 1748423 - DNA, 12 bp, Homo sapiens
agctctccaggc

SEQ ID NO: 1748424 - DNA, 15 bp, Homo sapiens
agctctccaggccag

SEQ ID NO: 1748425 - DNA, 15 bp, Homo sapiens
agctctcccctcctg

SEQ ID NO: 1748426 - DNA, 23 bp, Homo sapiens
agctctcccctcctgctgggcgt

SEQ ID NO: 1748427 - DNA, 15 bp, Homo sapiens
agctctccctctggc

SEQ ID NO: 1748428 - DNA, 22 bp, Homo sapiens
agctctccctctggccctgcct

SEQ ID NO: 1748429 - DNA, 16 bp, Homo sapiens
agctctccgagctctg

SEQ ID NO: 1748430 - DNA, 20 bp, Homo sapiens
agctctccgagctctggtgc

SEQ ID NO: 1748431 - DNA, 13 bp, Homo sapiens
agctctctaggcc

SEQ ID NO: 1748432 - DNA, 17 bp, Homo sapiens
agctctctaggcctctc

SEQ ID NO: 1748433 - DNA, 21 bp, Homo sapiens
agctctctgacgcttgtgaca

SEQ ID NO: 1748434 - DNA, 13 bp, Homo sapiens
agctctctgggcc

SEQ ID NO: 1748435 - DNA, 17 bp, Homo sapiens
agctctctgggcctggg

SEQ ID NO: 1748436 - DNA, 16 bp, Homo sapiens
agctctgaaatcttcc

SEQ ID NO: 1748437 - DNA, 18 bp, Homo sapiens
agctctgacatcccttcc

SEQ ID NO: 1748438 - DNA, 21 bp, Homo sapiens
agctctgacatcccttcctgg

SEQ ID NO: 1748439 - DNA, 16 bp, Homo sapiens
agctgccatttccctt

SEQ ID NO: 1748440 - DNA, 12 bp, Homo sapiens
agctgcccagac

SEQ ID NO: 1748441 - DNA, 13 bp, Homo sapiens
agctgcccagaca

SEQ ID NO: 1748442 - DNA, 14 bp, Homo sapiens
agctgcccagagtt

SEQ ID NO: 1748443 - DNA, 18 bp, Homo sapiens
agctgcccagagttgctg

SEQ ID NO: 1748444 - DNA, 18 bp, Homo sapiens
agctgcccatcccagtcc

SEQ ID NO: 1748445 - DNA, 22 bp, Homo sapiens
agctgcccatcccagtccctcg

SEQ ID NO: 1748446 - DNA, 15 bp, Homo sapiens
agctgccctagctga

SEQ ID NO: 1748447 - DNA, 19 bp, Homo sapiens
agctgccctagctgacccc

SEQ ID NO: 1748448 - DNA, 19 bp, Homo sapiens
agctgccctggctgtgatg

SEQ ID NO: 1748449 - DNA, 17 bp, Homo sapiens
agctgccgaccagagcc

SEQ ID NO: 1748450 - DNA, 20 bp, Homo sapiens
agctgcctcccctctccttc

SEQ ID NO: 1748451 - DNA, 23 bp, Homo sapiens
agctgcctcccctctccttcctg

SEQ ID NO: 1748452 - DNA, 12 bp, Homo sapiens
agctgcctctgc

SEQ ID NO: 1748453 - DNA, 17 bp, Homo sapiens
agctgcctctgctccct

SEQ ID NO: 1748454 - DNA, 16 bp, Homo sapiens
agctgcctctgggcca

SEQ ID NO: 1748455 - DNA, 17 bp, Homo sapiens
agctgcctgggcccgga

SEQ ID NO: 1748456 - DNA, 14 bp, Homo sapiens
agctgccttcaagg

SEQ ID NO: 1748457 - DNA, 12 bp, Homo sapiens
agctgccttccc

SEQ ID NO: 1748458 - DNA, 16 bp, Homo sapiens
agctgccttccctagc

SEQ ID NO: 1748459 - DNA, 18 bp, Homo sapiens
agctgccttccctagctt

SEQ ID NO: 1748460 - DNA, 18 bp, Homo sapiens
agctgccttcctcatccc

SEQ ID NO: 1748461 - DNA, 21 bp, Homo sapiens
agctgcgccggacagagtggg

SEQ ID NO: 1748462 - DNA, 17 bp, Homo sapiens
agctgcgcttgcttttc

SEQ ID NO: 1748463 - DNA, 18 bp, Homo sapiens
agctgcgcttgcttttct

SEQ ID NO: 1748464 - DNA, 18 bp, Homo sapiens
agctgcgggtctgaagga

SEQ ID NO: 1748465 - DNA, 19 bp, Homo sapiens
agctgctacctaaaaaaag

SEQ ID NO: 1748466 - DNA, 22 bp, Homo sapiens
agctgctcattacagttctttc

SEQ ID NO: 1748467 - DNA, 13 bp, Homo sapiens
agctgctccccag

SEQ ID NO: 1748468 - DNA, 19 bp, Homo sapiens
agctgctccccaggccacc

SEQ ID NO: 1748469 - DNA, 17 bp, Homo sapiens
agctgctccctggcatt

SEQ ID NO: 1748470 - DNA, 18 bp, Homo sapiens
agctgctcctttaccctc

SEQ ID NO: 1748471 - DNA, 16 bp, Homo sapiens
agctgctctgagccac

SEQ ID NO: 1748472 - DNA, 21 bp, Homo sapiens
agctgctcttagtgcccgcct

SEQ ID NO: 1748473 - DNA, 18 bp, Homo sapiens
agctgctgaagttctgag

SEQ ID NO: 1748474 - DNA, 16 bp, Homo sapiens
agctgctgcagccctg

SEQ ID NO: 1748475 - DNA, 12 bp, Homo sapiens
agctgctggcca

SEQ ID NO: 1748476 - DNA, 12 bp, Homo sapiens
agctgctgtctt

SEQ ID NO: 1748477 - DNA, 16 bp, Homo sapiens
agctgctgtgccccac

SEQ ID NO: 1748478 - DNA, 16 bp, Homo sapiens
agctgcttgacctagc

SEQ ID NO: 1748479 - DNA, 19 bp, Homo sapiens
agctgcttgacctagctct

SEQ ID NO: 1748480 - DNA, 19 bp, Homo sapiens
agctgcttgtcctgctctc

SEQ ID NO: 1748481 - DNA, 21 bp, Homo sapiens
agctggaaagttgggcccctg

SEQ ID NO: 1748482 - DNA, 14 bp, Homo sapiens
agctggaacatttg

SEQ ID NO: 1748483 - DNA, 21 bp, Homo sapiens
agctggaagactgtgcagaag

SEQ ID NO: 1748484 - DNA, 22 bp, Homo sapiens
agctggaagactgtgcagaaga

SEQ ID NO: 1748485 - DNA, 13 bp, Homo sapiens
agctggaagcctg

SEQ ID NO: 1748486 - DNA, 12 bp, Homo sapiens
agctggaaggca

SEQ ID NO: 1748487 - DNA, 16 bp, Homo sapiens
agctggaaggcagggc

SEQ ID NO: 1748488 - DNA, 17 bp, Homo sapiens
agctggaaggcagggca

SEQ ID NO: 1748489 - DNA, 19 bp, Homo sapiens
agctggaaggcagggcaga

SEQ ID NO: 1748490 - DNA, 22 bp, Homo sapiens
agctggaaggcagggcagaggg

SEQ ID NO: 1748491 - DNA, 18 bp, Homo sapiens
agctggaaggggccacgt

SEQ ID NO: 1748492 - DNA, 11 bp, Homo sapiens
agctggactga

SEQ ID NO: 1748493 - DNA, 15 bp, Homo sapiens
agctggagaagaccc

SEQ ID NO: 1748494 - DNA, 14 bp, Homo sapiens
agctggagcagcgg

SEQ ID NO: 1748495 - DNA, 15 bp, Homo sapiens
agctggagcagcgga

SEQ ID NO: 1748496 - DNA, 17 bp, Homo sapiens
agctggaggggtgggga

SEQ ID NO: 1748497 - DNA, 18 bp, Homo sapiens
agctggaggggtggggag

SEQ ID NO: 1748498 - DNA, 20 bp, Homo sapiens
agctggatagacttgggatg

SEQ ID NO: 1748499 - DNA, 21 bp, Homo sapiens
agctggatagacttgggatgg

SEQ ID NO: 1748500 - DNA, 16 bp, Homo sapiens
agctggcaaccagcca

SEQ ID NO: 1748501 - DNA, 17 bp, Homo sapiens
agctggcaaccagccag

SEQ ID NO: 1748502 - DNA, 18 bp, Homo sapiens
agctggcaaccagccagc

SEQ ID NO: 1748503 - DNA, 17 bp, Homo sapiens
agctggcaggacacatc

SEQ ID NO: 1748504 - DNA, 21 bp, Homo sapiens
agctggccaaagagcctttcc

SEQ ID NO: 1748505 - DNA, 19 bp, Homo sapiens
agctggcccactgctggct

SEQ ID NO: 1748506 - DNA, 21 bp, Homo sapiens
agctggccgagggtcctggct

SEQ ID NO: 1748507 - DNA, 12 bp, Homo sapiens
agctggcctgtg

SEQ ID NO: 1748508 - DNA, 16 bp, Homo sapiens
agctggcctgtggcac

SEQ ID NO: 1748509 - DNA, 21 bp, Homo sapiens
agctggcctgtggcacagccc

SEQ ID NO: 1748510 - DNA, 13 bp, Homo sapiens
agctggctctgag

SEQ ID NO: 1748511 - DNA, 23 bp, Homo sapiens
agctggctctgagcgcctccatc

SEQ ID NO: 1748512 - DNA, 18 bp, Homo sapiens
agctggctctgtgagggt

SEQ ID NO: 1748513 - DNA, 20 bp, Homo sapiens
agctggctctgtgagggtgc

SEQ ID NO: 1748514 - DNA, 16 bp, Homo sapiens
agctggctggcaggtg

SEQ ID NO: 1748515 - DNA, 17 bp, Homo sapiens
agctggctggcaggtgt

SEQ ID NO: 1748516 - DNA, 20 bp, Homo sapiens
agctggctggcaggtgttgg

SEQ ID NO: 1748517 - DNA, 12 bp, Homo sapiens
agctggctgggc

SEQ ID NO: 1748518 - DNA, 14 bp, Homo sapiens
agctggctgggctg

SEQ ID NO: 1748519 - DNA, 20 bp, Homo sapiens
agctgggaaaaaagttttga

SEQ ID NO: 1748520 - DNA, 15 bp, Homo sapiens
agctgggaaagcata

SEQ ID NO: 1748521 - DNA, 18 bp, Homo sapiens
agctgggaagctgtactc

SEQ ID NO: 1748522 - DNA, 19 bp, Homo sapiens
agctgggactacaggcgcc

SEQ ID NO: 1748523 - DNA, 13 bp, Homo sapiens
agctgggagacaa

SEQ ID NO: 1748524 - DNA, 14 bp, Homo sapiens
agctgggagacaaa

SEQ ID NO: 1748525 - DNA, 21 bp, Homo sapiens
agctgggagaccctccccaca

SEQ ID NO: 1748526 - DNA, 15 bp, Homo sapiens
agctgggagccgggc

SEQ ID NO: 1748527 - DNA, 12 bp, Homo sapiens
agctgggaggaa

SEQ ID NO: 1748528 - DNA, 15 bp, Homo sapiens
agctgggaggaaaag

SEQ ID NO: 1748529 - DNA, 16 bp, Homo sapiens
agctgggcagaaggcc

SEQ ID NO: 1748530 - DNA, 18 bp, Homo sapiens
agctgggcagaaggccaa

SEQ ID NO: 1748531 - DNA, 20 bp, Homo sapiens
agctgggcatgccatgtctg

SEQ ID NO: 1748532 - DNA, 13 bp, Homo sapiens
agctgggcccagc

SEQ ID NO: 1748533 - DNA, 14 bp, Homo sapiens
agctgggcccagca

SEQ ID NO: 1748534 - DNA, 21 bp, Homo sapiens
agctgggccccatgctctgcc

SEQ ID NO: 1748535 - DNA, 16 bp, Homo sapiens
agctgggcccgacatg

SEQ ID NO: 1748536 - DNA, 21 bp, Homo sapiens
agctgggcccgacatggctcc

SEQ ID NO: 1748537 - DNA, 22 bp, Homo sapiens
agctgggcccgacatggctccg

SEQ ID NO: 1748538 - DNA, 16 bp, Homo sapiens
agctgggcctcctgcc

SEQ ID NO: 1748539 - DNA, 17 bp, Homo sapiens
agctgggcctcctgcct

SEQ ID NO: 1748540 - DNA, 18 bp, Homo sapiens
agctgggcctcctgcctc

SEQ ID NO: 1748541 - DNA, 21 bp, Homo sapiens
agctgggcctcctgcctccgg

SEQ ID NO: 1748542 - DNA, 17 bp, Homo sapiens
agctgggctaagtaaat

SEQ ID NO: 1748543 - DNA, 15 bp, Homo sapiens
agctgggctctgcca

SEQ ID NO: 1748544 - DNA, 17 bp, Homo sapiens
agctggggactcaggga

SEQ ID NO: 1748545 - DNA, 16 bp, Homo sapiens
agctggggcgtgggga

SEQ ID NO: 1748546 - DNA, 20 bp, Homo sapiens
agctgggtcacatccatccc

SEQ ID NO: 1748547 - DNA, 17 bp, Homo sapiens
agctgggtgagccaagg

SEQ ID NO: 1748548 - DNA, 13 bp, Homo sapiens
agctggtcagtct

SEQ ID NO: 1748549 - DNA, 14 bp, Homo sapiens
agctggtcagtctt

SEQ ID NO: 1748550 - DNA, 14 bp, Homo sapiens
agctggtgcccgga

SEQ ID NO: 1748551 - DNA, 20 bp, Homo sapiens
agctggtgcccttcctcaca

SEQ ID NO: 1748552 - DNA, 20 bp, Homo sapiens
agctggtggccctgtgcctg

SEQ ID NO: 1748553 - DNA, 15 bp, Homo sapiens
agctggtgggaagcg

SEQ ID NO: 1748554 - DNA, 20 bp, Homo sapiens
agcttcggagggcccctgcg

SEQ ID NO: 1748555 - DNA, 18 bp, Homo sapiens
agcttcggggcctcctca

SEQ ID NO: 1748556 - DNA, 22 bp, Homo sapiens
agcttcgttagaatgtctgcct

SEQ ID NO: 1748557 - DNA, 18 bp, Homo sapiens
agcttctatcccaggagg

SEQ ID NO: 1748558 - DNA, 15 bp, Homo sapiens
agcttctccaagcat

SEQ ID NO: 1748559 - DNA, 16 bp, Homo sapiens
agcttctccaagcatc

SEQ ID NO: 1748560 - DNA, 15 bp, Homo sapiens
agcttctcccagtgt

SEQ ID NO: 1748561 - DNA, 17 bp, Homo sapiens
agcttctctctccaggg

SEQ ID NO: 1748562 - DNA, 13 bp, Homo sapiens
agcttctctgggc

SEQ ID NO: 1748563 - DNA, 13 bp, Homo sapiens
agcttctctgtga

SEQ ID NO: 1748564 - DNA, 12 bp, Homo sapiens
agcttctgcttt

SEQ ID NO: 1748565 - DNA, 23 bp, Homo sapiens
agcttctgcttttctgccctggc

SEQ ID NO: 1748566 - DNA, 19 bp, Homo sapiens
agcttctggagcagaactt

SEQ ID NO: 1748567 - DNA, 19 bp, Homo sapiens
agcttctgggagatttttt

SEQ ID NO: 1748568 - DNA, 15 bp, Homo sapiens
agcttctgtgtgtga

SEQ ID NO: 1748569 - DNA, 13 bp, Homo sapiens
agcttcttcacag

SEQ ID NO: 1748570 - DNA, 18 bp, Homo sapiens
agcttcttcagagtgaag

SEQ ID NO: 1748571 - DNA, 16 bp, Homo sapiens
agcttcttgtttcctt

SEQ ID NO: 1748572 - DNA, 19 bp, Homo sapiens
agcttcttgtttccttgtt

SEQ ID NO: 1748573 - DNA, 17 bp, Homo sapiens
agcttgaaactgagatg

SEQ ID NO: 1748574 - DNA, 16 bp, Homo sapiens
agcttgaaagttttca

SEQ ID NO: 1748575 - DNA, 11 bp, Homo sapiens
agcttgaatgt

SEQ ID NO: 1748576 - DNA, 12 bp, Homo sapiens
agcttgaatgtc

SEQ ID NO: 1748577 - DNA, 14 bp, Homo sapiens
agcttgacctgagg

SEQ ID NO: 1748578 - DNA, 16 bp, Homo sapiens
agcttgacctgaggct

SEQ ID NO: 1748579 - DNA, 20 bp, Homo sapiens
agcttgacctgaggctgtgg

SEQ ID NO: 1748580 - DNA, 15 bp, Homo sapiens
agcttgactcccaag

SEQ ID NO: 1748581 - DNA, 23 bp, Homo sapiens
agcttgactgcttttaaatgacc

SEQ ID NO: 1748582 - DNA, 14 bp, Homo sapiens
agcttgagcctccc

SEQ ID NO: 1748583 - DNA, 21 bp, Homo sapiens
agcttgagcctcccccaaagc

SEQ ID NO: 1748584 - DNA, 20 bp, Homo sapiens
agcttgagctcccctggagc

SEQ ID NO: 1748585 - DNA, 20 bp, Homo sapiens
agcttgaggccaagatggct

SEQ ID NO: 1748586 - DNA, 23 bp, Homo sapiens
agcttgaggccaagatggctgct

SEQ ID NO: 1748587 - DNA, 12 bp, Homo sapiens
agcttgcacagc

SEQ ID NO: 1748588 - DNA, 15 bp, Homo sapiens
agcttgcacagccaa

SEQ ID NO: 1748589 - DNA, 14 bp, Homo sapiens
agcttgcacatttg

SEQ ID NO: 1748590 - DNA, 15 bp, Homo sapiens
agcttgcacatttgg

SEQ ID NO: 1748591 - DNA, 20 bp, Homo sapiens
agcttgccagggatgggcag

SEQ ID NO: 1748592 - DNA, 21 bp, Homo sapiens
agcttgccagggatgggcagc

SEQ ID NO: 1748593 - DNA, 16 bp, Homo sapiens
agcttgccctgttaaa

SEQ ID NO: 1748594 - DNA, 23 bp, Homo sapiens
agcttgctccagattctgatgca

SEQ ID NO: 1748595 - DNA, 19 bp, Homo sapiens
agcttgctgtcacttcttc

SEQ ID NO: 1748596 - DNA, 17 bp, Homo sapiens
agcttggaaaggaccag

SEQ ID NO: 1748597 - DNA, 17 bp, Homo sapiens
agcttggactacacaat

SEQ ID NO: 1748598 - DNA, 18 bp, Homo sapiens
agcttggactacacaata

SEQ ID NO: 1748599 - DNA, 23 bp, Homo sapiens
agcttggactacacaatacagta

SEQ ID NO: 1748600 - DNA, 13 bp, Homo sapiens
agcttggcagccg

SEQ ID NO: 1748601 - DNA, 21 bp, Homo sapiens
agcttggctcacaaggcccag

SEQ ID NO: 1748602 - DNA, 23 bp, Homo sapiens
agcttggcttcctcttcttgttg

SEQ ID NO: 1748603 - DNA, 23 bp, Homo sapiens
agcttgggcccagctgggctctg

SEQ ID NO: 1748604 - DNA, 16 bp, Homo sapiens
agcttgggtccaccat

SEQ ID NO: 1748605 - DNA, 15 bp, Homo sapiens
agcttgtcaaagatg

SEQ ID NO: 1748606 - DNA, 23 bp, Homo sapiens
agcttgtccaacccgaggcccgc

SEQ ID NO: 1748607 - DNA, 19 bp, Homo sapiens
agcttgtgcacaattctgt

SEQ ID NO: 1748608 - DNA, 23 bp, Homo sapiens
agcttgtgctcctcttgattcct

SEQ ID NO: 1748609 - DNA, 23 bp, Homo sapiens
agcttgtggccccttttactttt

SEQ ID NO: 1748610 - DNA, 20 bp, Homo sapiens
agcttgtggtgttcctgaag

SEQ ID NO: 1748611 - DNA, 11 bp, Homo sapiens
agcttgttgaa

SEQ ID NO: 1748612 - DNA, 13 bp, Homo sapiens
agcttgtttctat

SEQ ID NO: 1748613 - DNA, 17 bp, Homo sapiens
agcttgtttctatactg

SEQ ID NO: 1748614 - DNA, 16 bp, Homo sapiens
agctttaaaggccagg

SEQ ID NO: 1748615 - DNA, 12 bp, Homo sapiens
agctttaaatta

SEQ ID NO: 1748616 - DNA, 16 bp, Homo sapiens
agctttaatcaatcat

SEQ ID NO: 1748617 - DNA, 13 bp, Homo sapiens
agctttaccctca

SEQ ID NO: 1748618 - DNA, 20 bp, Homo sapiens
agctttaccctcaggcatag

SEQ ID NO: 1748619 - DNA, 21 bp, Homo sapiens
agctttaccttctaaaagtac

SEQ ID NO: 1748620 - DNA, 22 bp, Homo sapiens
agctttactactgtggaaagac

SEQ ID NO: 1748621 - DNA, 15 bp, Homo sapiens
agctttactgtttgt

SEQ ID NO: 1748622 - DNA, 16 bp, Homo sapiens
agctttagaccctggg

SEQ ID NO: 1748623 - DNA, 22 bp, Homo sapiens
agctttaggcagagccataatg

SEQ ID NO: 1748624 - DNA, 17 bp, Homo sapiens
agctttatacagttgaa

SEQ ID NO: 1748625 - DNA, 22 bp, Homo sapiens
agctttattttttaagtattta

SEQ ID NO: 1748626 - DNA, 17 bp, Homo sapiens
agctttcaaagaaggaa

SEQ ID NO: 1748627 - DNA, 15 bp, Homo sapiens
agctttcaaagcatt

SEQ ID NO: 1748628 - DNA, 17 bp, Homo sapiens
agctttcaagtgccttt

SEQ ID NO: 1748629 - DNA, 17 bp, Homo sapiens
agctttcagagccagtg

SEQ ID NO: 1748630 - DNA, 17 bp, Homo sapiens
agctttccatgttgctg

SEQ ID NO: 1748631 - DNA, 12 bp, Homo sapiens
agctttcctgcc

SEQ ID NO: 1748632 - DNA, 21 bp, Homo sapiens
agctttcctgccccaggcctg

SEQ ID NO: 1748633 - DNA, 18 bp, Homo sapiens
agctttcctggtccctca

SEQ ID NO: 1748634 - DNA, 20 bp, Homo sapiens
agctttcctggtccctcacc

SEQ ID NO: 1748635 - DNA, 21 bp, Homo sapiens
agctttctaagagaagcaatt

SEQ ID NO: 1748636 - DNA, 12 bp, Homo sapiens
agctttctcaat

SEQ ID NO: 1748637 - DNA, 14 bp, Homo sapiens
agctttctcaatgt

SEQ ID NO: 1748638 - DNA, 23 bp, Homo sapiens
agctttctcagggggtcagcaga

SEQ ID NO: 1748639 - DNA, 21 bp, Homo sapiens
agctttctctccgacttcccc

SEQ ID NO: 1748640 - DNA, 22 bp, Homo sapiens
agctttgaaactccatgcaaac

SEQ ID NO: 1748641 - DNA, 19 bp, Homo sapiens
agctttgagaagccttcag

SEQ ID NO: 1748642 - DNA, 10 bp, Homo sapiens
agctttgcta

SEQ ID NO: 1748643 - DNA, 18 bp, Homo sapiens
agctttgctacaaattta

SEQ ID NO: 1748644 - DNA, 18 bp, Homo sapiens
agctttgctctttggtag

SEQ ID NO: 1748645 - DNA, 21 bp, Homo sapiens
agctttgctctttggtagaaa

SEQ ID NO: 1748646 - DNA, 23 bp, Homo sapiens
agctttgctctttggtagaaaag

SEQ ID NO: 1748647 - DNA, 12 bp, Homo sapiens
agctttgctgct

SEQ ID NO: 1748648 - DNA, 22 bp, Homo sapiens
agctttggctgagacctgggat

SEQ ID NO: 1748649 - DNA, 16 bp, Homo sapiens
agctttgggtgaccag

SEQ ID NO: 1748650 - DNA, 16 bp, Homo sapiens
agctttgggtgccttt

SEQ ID NO: 1748651 - DNA, 14 bp, Homo sapiens
agctttgtgcttgt

SEQ ID NO: 1748652 - DNA, 18 bp, Homo sapiens
agctttgttttatatatt

SEQ ID NO: 1748653 - DNA, 18 bp, Homo sapiens
agcttttaaaaatgtttg

SEQ ID NO: 1748654 - DNA, 23 bp, Homo sapiens
agcttttacagatccagaattta

SEQ ID NO: 1748655 - DNA, 14 bp, Homo sapiens
agcttttactgttt

SEQ ID NO: 1748656 - DNA, 18 bp, Homo sapiens
agcttttctttttctgta

SEQ ID NO: 1748657 - DNA, 19 bp, Homo sapiens
agcttttgccagtattatg

SEQ ID NO: 1748658 - DNA, 22 bp, Homo sapiens
agcttttgccagtattatgcat

SEQ ID NO: 1748659 - DNA, 21 bp, Homo sapiens
agcttttgcctgcaagagaat

SEQ ID NO: 1748660 - DNA, 15 bp, Homo sapiens
agcttttgttctaga

SEQ ID NO: 1748661 - DNA, 16 bp, Homo sapiens
agcttttgttctagac

SEQ ID NO: 1748662 - DNA, 15 bp, Homo sapiens
agctttttaatagca

SEQ ID NO: 1748663 - DNA, 17 bp, Homo sapiens
agctttttaatagcact

SEQ ID NO: 1748664 - DNA, 14 bp, Homo sapiens
agctttttggtttg

SEQ ID NO: 1748665 - DNA, 14 bp, Homo sapiens
agctttttgtatta

SEQ ID NO: 1748666 - DNA, 14 bp, Homo sapiens
aggaaaaaaatgac

SEQ ID NO: 1748667 - DNA, 13 bp, Homo sapiens
aggaaaaaagaac

SEQ ID NO: 1748668 - DNA, 17 bp, Homo sapiens
aggaaaaaatggtataa

SEQ ID NO: 1748669 - DNA, 22 bp, Homo sapiens
aggaatctgtgggtctgggagt

SEQ ID NO: 1748670 - DNA, 18 bp, Homo sapiens
aggaatctgtttctctgc

SEQ ID NO: 1748671 - DNA, 23 bp, Homo sapiens
aggaatgaaatcctgcttcagtg

SEQ ID NO: 1748672 - DNA, 24 bp, Homo sapiens
aggaatgcctcctccctgggcaga

SEQ ID NO: 1748673 - DNA, 15 bp, Homo sapiens
aggaatgcctgtgcc

SEQ ID NO: 1748674 - DNA, 16 bp, Homo sapiens
aggaatgcctgtgtga

SEQ ID NO: 1748675 - DNA, 15 bp, Homo sapiens
aggaatggacatttc

SEQ ID NO: 1748676 - DNA, 17 bp, Homo sapiens
aggaatggacatttcta

SEQ ID NO: 1748677 - DNA, 21 bp, Homo sapiens
aggaatggggggcgggccagg

SEQ ID NO: 1748678 - DNA, 15 bp, Homo sapiens
aggaatgtagggcct

SEQ ID NO: 1748679 - DNA, 16 bp, Homo sapiens
aggaatgtcagggcca

SEQ ID NO: 1748680 - DNA, 16 bp, Homo sapiens
aggaatgtgtggcctg

SEQ ID NO: 1748681 - DNA, 14 bp, Homo sapiens
aggaatgttaaagt

SEQ ID NO: 1748682 - DNA, 22 bp, Homo sapiens
aggaatgttaaagtcagtggga

SEQ ID NO: 1748683 - DNA, 23 bp, Homo sapiens
aggaattcccagcccaaagctgt

SEQ ID NO: 1748684 - DNA, 18 bp, Homo sapiens
aggaattggtaaggcctc

SEQ ID NO: 1748685 - DNA, 14 bp, Homo sapiens
aggaatttaaaatt

SEQ ID NO: 1748686 - DNA, 19 bp, Homo sapiens
aggaatttaaaattaagta

SEQ ID NO: 1748687 - DNA, 22 bp, Homo sapiens
aggaatttactttcttcaccaa

SEQ ID NO: 1748688 - DNA, 22 bp, Homo sapiens
aggaatttcacctgtaaacctg

SEQ ID NO: 1748689 - DNA, 19 bp, Homo sapiens
aggaatttcccaggaccct

SEQ ID NO: 1748690 - DNA, 22 bp, Homo sapiens
aggacaatcagtcccctcccat

SEQ ID NO: 1748691 - DNA, 23 bp, Homo sapiens
aggacaatcagtcccctcccatc

SEQ ID NO: 1748692 - DNA, 16 bp, Homo sapiens
aggacaattactgtac

SEQ ID NO: 1748693 - DNA, 12 bp, Homo sapiens
aggacacagcac

SEQ ID NO: 1748694 - DNA, 21 bp, Homo sapiens
aggacacagttcctgggaaca

SEQ ID NO: 1748695 - DNA, 19 bp, Homo sapiens
aggacaccagtgaaagaag

SEQ ID NO: 1748696 - DNA, 22 bp, Homo sapiens
aggacaccagtgaaagaagcca

SEQ ID NO: 1748697 - DNA, 15 bp, Homo sapiens
aggacacgtggcctg

SEQ ID NO: 1748698 - DNA, 17 bp, Homo sapiens
aggacactaccctgaga

SEQ ID NO: 1748699 - DNA, 14 bp, Homo sapiens
aggacacttccgta

SEQ ID NO: 1748700 - DNA, 15 bp, Homo sapiens
aggacacttcctgcc

SEQ ID NO: 1748701 - DNA, 18 bp, Homo sapiens
aggacagaaggactggtg

SEQ ID NO: 1748702 - DNA, 17 bp, Homo sapiens
aggacagaatgtgttct

SEQ ID NO: 1748703 - DNA, 22 bp, Homo sapiens
aggacagagcttgaagcctcca

SEQ ID NO: 1748704 - DNA, 15 bp, Homo sapiens
aggacagaggccggg

SEQ ID NO: 1748705 - DNA, 16 bp, Homo sapiens
aggacagagggcacat

SEQ ID NO: 1748706 - DNA, 23 bp, Homo sapiens
aggacagcagctggtgccccacc

SEQ ID NO: 1748707 - DNA, 22 bp, Homo sapiens
aggacagcctgtggcggtgcct

SEQ ID NO: 1748708 - DNA, 18 bp, Homo sapiens
aggacaggaagctggcag

SEQ ID NO: 1748709 - DNA, 18 bp, Homo sapiens
aggacaggaccctcagga

SEQ ID NO: 1748710 - DNA, 19 bp, Homo sapiens
aggacaggaccctcaggaa

SEQ ID NO: 1748711 - DNA, 20 bp, Homo sapiens
aggacaggaccctcaggaat

SEQ ID NO: 1748712 - DNA, 12 bp, Homo sapiens
aggacaggaggc

SEQ ID NO: 1748713 - DNA, 15 bp, Homo sapiens
aggacaggctggtgc

SEQ ID NO: 1748714 - DNA, 18 bp, Homo sapiens
aggacagtctggagaagg

SEQ ID NO: 1748715 - DNA, 18 bp, Homo sapiens
aggacagtgcttcagcct

SEQ ID NO: 1748716 - DNA, 20 bp, Homo sapiens
aggacagtgcttcagcctga

SEQ ID NO: 1748717 - DNA, 17 bp, Homo sapiens
aggacatactgcatgta

SEQ ID NO: 1748718 - DNA, 23 bp, Homo sapiens
aggacatcttaaatctaaacaaa

SEQ ID NO: 1748719 - DNA, 17 bp, Homo sapiens
aggaccaactggcttct

SEQ ID NO: 1748720 - DNA, 22 bp, Homo sapiens
aggaccaccagcaggcaggtgg

SEQ ID NO: 1748721 - DNA, 12 bp, Homo sapiens
aggaccactcct

SEQ ID NO: 1748722 - DNA, 16 bp, Homo sapiens
aggaccactcctgtac

SEQ ID NO: 1748723 - DNA, 22 bp, Homo sapiens
aggaccactcctgtacactgaa

SEQ ID NO: 1748724 - DNA, 18 bp, Homo sapiens
aggaccaggactccctcc

SEQ ID NO: 1748725 - DNA, 16 bp, Homo sapiens
aggacccacccatctt

SEQ ID NO: 1748726 - DNA, 20 bp, Homo sapiens
aggacccacccatcttcctg

SEQ ID NO: 1748727 - DNA, 12 bp, Homo sapiens
aggacccaggcc

SEQ ID NO: 1748728 - DNA, 16 bp, Homo sapiens
aggacccaggccctcc

SEQ ID NO: 1748729 - DNA, 17 bp, Homo sapiens
aggacccaggccctcca

SEQ ID NO: 1748730 - DNA, 20 bp, Homo sapiens
aggacccatcacgcctgtgc

SEQ ID NO: 1748731 - DNA, 18 bp, Homo sapiens
aggacccgccagccccgc

SEQ ID NO: 1748732 - DNA, 19 bp, Homo sapiens
aggacccgccagccccgct

SEQ ID NO: 1748733 - DNA, 21 bp, Homo sapiens
aggacccgccagccccgctcc

SEQ ID NO: 1748734 - DNA, 17 bp, Homo sapiens
aggacccggaggggcct

SEQ ID NO: 1748735 - DNA, 18 bp, Homo sapiens
aggacccggaggggcctg

SEQ ID NO: 1748736 - DNA, 17 bp, Homo sapiens
aggaccctcaggaattc

SEQ ID NO: 1748737 - DNA, 15 bp, Homo sapiens
aggaccctgaagggg

SEQ ID NO: 1748738 - DNA, 19 bp, Homo sapiens
aggaccctgaaggggccat

SEQ ID NO: 1748739 - DNA, 13 bp, Homo sapiens
aggacccttccct

SEQ ID NO: 1748740 - DNA, 22 bp, Homo sapiens
aggacccttcccttgagccctc

SEQ ID NO: 1748741 - DNA, 17 bp, Homo sapiens
aggaccgctgataagca

SEQ ID NO: 1748742 - DNA, 17 bp, Homo sapiens
aggaccgtggccctgcc

SEQ ID NO: 1748743 - DNA, 23 bp, Homo sapiens
aggacctccctgtctcccggctc

SEQ ID NO: 1748744 - DNA, 22 bp, Homo sapiens
aggacctcggatgaccatactc

SEQ ID NO: 1748745 - DNA, 20 bp, Homo sapiens
aggacctctttactctctcc

SEQ ID NO: 1748746 - DNA, 17 bp, Homo sapiens
aggacctgaaattccaa

SEQ ID NO: 1748747 - DNA, 18 bp, Homo sapiens
aggacctgaaattccaaa

SEQ ID NO: 1748748 - DNA, 13 bp, Homo sapiens
aggacctgcatcc

SEQ ID NO: 1748749 - DNA, 19 bp, Homo sapiens
aggacctgcatccttcctg

SEQ ID NO: 1748750 - DNA, 20 bp, Homo sapiens
aggacgaacatccaaccttc

SEQ ID NO: 1748751 - DNA, 19 bp, Homo sapiens
aggacgagacccccatcca

SEQ ID NO: 1748752 - DNA, 20 bp, Homo sapiens
aggacgagacccccatccag

SEQ ID NO: 1748753 - DNA, 21 bp, Homo sapiens
aggacggaaaatgcttaaaaa

SEQ ID NO: 1748754 - DNA, 19 bp, Homo sapiens
aggacggtgccaagggccc

SEQ ID NO: 1748755 - DNA, 16 bp, Homo sapiens
aggacgtatttataat

SEQ ID NO: 1748756 - DNA, 22 bp, Homo sapiens
aggacgtatttataataggtat

SEQ ID NO: 1748757 - DNA, 14 bp, Homo sapiens
aggactaccgcagg

SEQ ID NO: 1748758 - DNA, 16 bp, Homo sapiens
aggactaccgcaggcc

SEQ ID NO: 1748759 - DNA, 22 bp, Homo sapiens
aggactaccgcaggcccggact

SEQ ID NO: 1748760 - DNA, 13 bp, Homo sapiens
aggactagaagat

SEQ ID NO: 1748761 - DNA, 21 bp, Homo sapiens
aggactccattggatctgcaa

SEQ ID NO: 1748762 - DNA, 17 bp, Homo sapiens
aggactcccaaccctgg

SEQ ID NO: 1748763 - DNA, 19 bp, Homo sapiens
aggactcccaaccctggct

SEQ ID NO: 1748764 - DNA, 14 bp, Homo sapiens
aggactccctcctc

SEQ ID NO: 1748765 - DNA, 19 bp, Homo sapiens
aggactccctcctcacctc

SEQ ID NO: 1748766 - DNA, 14 bp, Homo sapiens
aggactctgaggct

SEQ ID NO: 1748767 - DNA, 14 bp, Homo sapiens
aggactgaactcca

SEQ ID NO: 1748768 - DNA, 15 bp, Homo sapiens
aggactgagactggc

SEQ ID NO: 1748769 - DNA, 14 bp, Homo sapiens
aggactgaggagtg

SEQ ID NO: 1748770 - DNA, 11 bp, Homo sapiens
aggactgaggg

SEQ ID NO: 1748771 - DNA, 15 bp, Homo sapiens
aggactgagggcagt

SEQ ID NO: 1748772 - DNA, 16 bp, Homo sapiens
aggactggagaccgct

SEQ ID NO: 1748773 - DNA, 22 bp, Homo sapiens
aggactggagaccgcttcaccc

SEQ ID NO: 1748774 - DNA, 17 bp, Homo sapiens
aggactggattggccaa

SEQ ID NO: 1748775 - DNA, 15 bp, Homo sapiens
aggactgggccactt

SEQ ID NO: 1748776 - DNA, 18 bp, Homo sapiens
aggactgggtctgacctg

SEQ ID NO: 1748777 - DNA, 13 bp, Homo sapiens
aggactgttgtgg

SEQ ID NO: 1748778 - DNA, 14 bp, Homo sapiens
aggactgtttcagt

SEQ ID NO: 1748779 - DNA, 15 bp, Homo sapiens
aggacttaaaattag

SEQ ID NO: 1748780 - DNA, 20 bp, Homo sapiens
aggacttaacggctccagga

SEQ ID NO: 1748781 - DNA, 23 bp, Homo sapiens
aggacttaagacaaatgggactg

SEQ ID NO: 1748782 - DNA, 19 bp, Homo sapiens
aggacttcaggaacaagta

SEQ ID NO: 1748783 - DNA, 17 bp, Homo sapiens
aggagcttacccaagct

SEQ ID NO: 1748784 - DNA, 19 bp, Homo sapiens
aggagcttacccaagctgt

SEQ ID NO: 1748785 - DNA, 22 bp, Homo sapiens
aggagcttacccaagctgtggc

SEQ ID NO: 1748786 - DNA, 15 bp, Homo sapiens
aggagctttctcaat

SEQ ID NO: 1748787 - DNA, 13 bp, Homo sapiens
aggaggaaaagga

SEQ ID NO: 1748788 - DNA, 16 bp, Homo sapiens
aggaggaaaaggaaaa

SEQ ID NO: 1748789 - DNA, 13 bp, Homo sapiens
aggaggaaacagt

SEQ ID NO: 1748790 - DNA, 17 bp, Homo sapiens
aggaggaatgctggact

SEQ ID NO: 1748791 - DNA, 17 bp, Homo sapiens
aggaggacacagcacaa

SEQ ID NO: 1748792 - DNA, 23 bp, Homo sapiens
aggaggagccttgctgggccagg

SEQ ID NO: 1748793 - DNA, 13 bp, Homo sapiens
aggaggagctctc

SEQ ID NO: 1748794 - DNA, 21 bp, Homo sapiens
aggaggagctctcaattttat

SEQ ID NO: 1748795 - DNA, 17 bp, Homo sapiens
aggaggaggacacagca

SEQ ID NO: 1748796 - DNA, 16 bp, Homo sapiens
aggaggaggagggaga

SEQ ID NO: 1748797 - DNA, 13 bp, Homo sapiens
aggaggagggaga

SEQ ID NO: 1748798 - DNA, 14 bp, Homo sapiens
aggaggagggaggc

SEQ ID NO: 1748799 - DNA, 18 bp, Homo sapiens
aggaggattcgagcatca

SEQ ID NO: 1748800 - DNA, 14 bp, Homo sapiens
aggaggcaggacct

SEQ ID NO: 1748801 - DNA, 22 bp, Homo sapiens
aggaggcaggcatggccctggg

SEQ ID NO: 1748802 - DNA, 15 bp, Homo sapiens
aggaggccacctctc

SEQ ID NO: 1748803 - DNA, 19 bp, Homo sapiens
aggaggccacctctccaag

SEQ ID NO: 1748804 - DNA, 16 bp, Homo sapiens
aggaggccaggctcag

SEQ ID NO: 1748805 - DNA, 12 bp, Homo sapiens
aggaggcccctg

SEQ ID NO: 1748806 - DNA, 18 bp, Homo sapiens
aggaggcccctggcccag

SEQ ID NO: 1748807 - DNA, 19 bp, Homo sapiens
aggaggccctgttccctgg

SEQ ID NO: 1748808 - DNA, 20 bp, Homo sapiens
aggaggcccttgtcgtggga

SEQ ID NO: 1748809 - DNA, 16 bp, Homo sapiens
aggaggctgaggcaga

SEQ ID NO: 1748810 - DNA, 17 bp, Homo sapiens
aggaggctgaggcagaa

SEQ ID NO: 1748811 - DNA, 17 bp, Homo sapiens
aggaggctgaggcagga

SEQ ID NO: 1748812 - DNA, 20 bp, Homo sapiens
aggaggctgcatgctctgga

SEQ ID NO: 1748813 - DNA, 20 bp, Homo sapiens
aggaggcttggaaagcatca

SEQ ID NO: 1748814 - DNA, 14 bp, Homo sapiens
aggagggagactgt

SEQ ID NO: 1748815 - DNA, 14 bp, Homo sapiens
aggagggagaggga

SEQ ID NO: 1748816 - DNA, 16 bp, Homo sapiens
aggagggagccttgtg

SEQ ID NO: 1748817 - DNA, 17 bp, Homo sapiens
aggagggagccttgtga

SEQ ID NO: 1748818 - DNA, 13 bp, Homo sapiens
aggagggagctgc

SEQ ID NO: 1748819 - DNA, 15 bp, Homo sapiens
aggagggatgctgct

SEQ ID NO: 1748820 - DNA, 12 bp, Homo sapiens
aggagggatgtg

SEQ ID NO: 1748821 - DNA, 17 bp, Homo sapiens
aggagggcgtgactcac

SEQ ID NO: 1748822 - DNA, 15 bp, Homo sapiens
aggaggggaagaggc

SEQ ID NO: 1748823 - DNA, 18 bp, Homo sapiens
aggaggggaagaggcctg

SEQ ID NO: 1748824 - DNA, 18 bp, Homo sapiens
aggaggggaaggggctga

SEQ ID NO: 1748825 - DNA, 19 bp, Homo sapiens
aggagggggccgggcgcgg

SEQ ID NO: 1748826 - DNA, 16 bp, Homo sapiens
aggagggtggaggaag

SEQ ID NO: 1748827 - DNA, 21 bp, Homo sapiens
aggagggtggaggaaggtgct

SEQ ID NO: 1748828 - DNA, 15 bp, Homo sapiens
aggagggtgggaagg

SEQ ID NO: 1748829 - DNA, 18 bp, Homo sapiens
aggaggtccttaggcctc

SEQ ID NO: 1748830 - DNA, 23 bp, Homo sapiens
aggaggtccttaggcctctgaga

SEQ ID NO: 1748831 - DNA, 13 bp, Homo sapiens
aggaggtgcttga

SEQ ID NO: 1748832 - DNA, 14 bp, Homo sapiens
aggaggtggcagcc

SEQ ID NO: 1748833 - DNA, 21 bp, Homo sapiens
aggaggtggcagccctgtagg

SEQ ID NO: 1748834 - DNA, 22 bp, Homo sapiens
aggaggtgtctggggtgaggga

SEQ ID NO: 1748835 - DNA, 18 bp, Homo sapiens
aggaggttctgggcctct

SEQ ID NO: 1748836 - DNA, 19 bp, Homo sapiens
aggaggttctgggcctctg

SEQ ID NO: 1748837 - DNA, 20 bp, Homo sapiens
aggaggttctgggcctctga

SEQ ID NO: 1748838 - DNA, 19 bp, Homo sapiens
aggaggttggtgactgaaa

SEQ ID NO: 1748839 - DNA, 11 bp, Homo sapiens
aggagtaacaa

SEQ ID NO: 1748840 - DNA, 19 bp, Homo sapiens
aggagtaacaatacaaatg

SEQ ID NO: 1748841 - DNA, 17 bp, Homo sapiens
aggagtaagacaagtgg

SEQ ID NO: 1748842 - DNA, 16 bp, Homo sapiens
aggagtacaaaacaat

SEQ ID NO: 1748843 - DNA, 20 bp, Homo sapiens
aggagtccactttgtttcgt

SEQ ID NO: 1748844 - DNA, 14 bp, Homo sapiens
aggagtcccaagga

SEQ ID NO: 1748845 - DNA, 21 bp, Homo sapiens
aggagtccctgccatcatgtt

SEQ ID NO: 1748846 - DNA, 14 bp, Homo sapiens
aggagtctgccact

SEQ ID NO: 1748847 - DNA, 14 bp, Homo sapiens
aggagtctgtgctc

SEQ ID NO: 1748848 - DNA, 16 bp, Homo sapiens
aggagtctgtgctctt

SEQ ID NO: 1748849 - DNA, 20 bp, Homo sapiens
aggagtcttcagacccagag

SEQ ID NO: 1748850 - DNA, 13 bp, Homo sapiens
aggagtgccagga

SEQ ID NO: 1748851 - DNA, 18 bp, Homo sapiens
aggagtgccaggaccagc

SEQ ID NO: 1748852 - DNA, 19 bp, Homo sapiens
aggagtgccaggaccagcc

SEQ ID NO: 1748853 - DNA, 21 bp, Homo sapiens
aggagtgccgtgtgttgcatg

SEQ ID NO: 1748854 - DNA, 21 bp, Homo sapiens
aggagtgggaaaacactgcca

SEQ ID NO: 1748855 - DNA, 12 bp, Homo sapiens
aggagtggttct

SEQ ID NO: 1748856 - DNA, 16 bp, Homo sapiens
aggagttaatgatcgt

SEQ ID NO: 1748857 - DNA, 18 bp, Homo sapiens
aggagttacagggaagtg

SEQ ID NO: 1748858 - DNA, 21 bp, Homo sapiens
aggagttcgagaccagcctgg

SEQ ID NO: 1748859 - DNA, 16 bp, Homo sapiens
aggagttgcctgactc

SEQ ID NO: 1748860 - DNA, 21 bp, Homo sapiens
aggagttgctgtttgtttgac

SEQ ID NO: 1748861 - DNA, 18 bp, Homo sapiens
aggagttgtttctgaccc

SEQ ID NO: 1748862 - DNA, 22 bp, Homo sapiens
aggagttgtttctgacccactg

SEQ ID NO: 1748863 - DNA, 21 bp, Homo sapiens
aggagtttaagaccagcctgg

SEQ ID NO: 1748864 - DNA, 20 bp, Homo sapiens
aggagtttattacaatgtat

SEQ ID NO: 1748865 - DNA, 24 bp, Homo sapiens
aggagtttgagacaagccctggca

SEQ ID NO: 1748866 - DNA, 19 bp, Homo sapiens
aggagtttgagaccagcct

SEQ ID NO: 1748867 - DNA, 22 bp, Homo sapiens
aggagtttgagaccaggctggg

SEQ ID NO: 1748868 - DNA, 14 bp, Homo sapiens
aggagtttggagga

SEQ ID NO: 1748869 - DNA, 21 bp, Homo sapiens
aggagttttctccatatcaaa

SEQ ID NO: 1748870 - DNA, 21 bp, Homo sapiens
aggagttttgttccagaggag

SEQ ID NO: 1748871 - DNA, 22 bp, Homo sapiens
aggagttttgttccagaggagc

SEQ ID NO: 1748872 - DNA, 15 bp, Homo sapiens
aggatacagaggaga

SEQ ID NO: 1748873 - DNA, 12 bp, Homo sapiens
aggatacagctc

SEQ ID NO: 1748874 - DNA, 14 bp, Homo sapiens
aggatacagctctt

SEQ ID NO: 1748875 - DNA, 21 bp, Homo sapiens
aggatacagctcttctcagtg

SEQ ID NO: 1748876 - DNA, 16 bp, Homo sapiens
aggataccttcttatt

SEQ ID NO: 1748877 - DNA, 16 bp, Homo sapiens
aggatactctgtcaga

SEQ ID NO: 1748878 - DNA, 19 bp, Homo sapiens
aggatagatgctggcccag

SEQ ID NO: 1748879 - DNA, 23 bp, Homo sapiens
aggatagctaactgtaaatcatg

SEQ ID NO: 1748880 - DNA, 14 bp, Homo sapiens
aggatatattttca

SEQ ID NO: 1748881 - DNA, 16 bp, Homo sapiens
aggatatctgaaaata

SEQ ID NO: 1748882 - DNA, 13 bp, Homo sapiens
aggatatgattaa

SEQ ID NO: 1748883 - DNA, 19 bp, Homo sapiens
aggatatgattaatattat

SEQ ID NO: 1748884 - DNA, 18 bp, Homo sapiens
aggatatggacactggtg

SEQ ID NO: 1748885 - DNA, 21 bp, Homo sapiens
aggatattagttaatgagcca

SEQ ID NO: 1748886 - DNA, 17 bp, Homo sapiens
aggatcaattgtaatat

SEQ ID NO: 1748887 - DNA, 14 bp, Homo sapiens
aggatcacctgagg

SEQ ID NO: 1748888 - DNA, 18 bp, Homo sapiens
aggatcacctgaggtcag

SEQ ID NO: 1748889 - DNA, 19 bp, Homo sapiens
aggatcactggagcccagg

SEQ ID NO: 1748890 - DNA, 13 bp, Homo sapiens
aggatcagatgac

SEQ ID NO: 1748891 - DNA, 20 bp, Homo sapiens
aggatcagatgactctctcc

SEQ ID NO: 1748892 - DNA, 14 bp, Homo sapiens
aggatcccactggc

SEQ ID NO: 1748893 - DNA, 15 bp, Homo sapiens
aggatccctcctgag

SEQ ID NO: 1748894 - DNA, 16 bp, Homo sapiens
aggatccctcctgagc

SEQ ID NO: 1748895 - DNA, 17 bp, Homo sapiens
aggatccctcctgagct

SEQ ID NO: 1748896 - DNA, 12 bp, Homo sapiens
aggatccgctgc

SEQ ID NO: 1748897 - DNA, 14 bp, Homo sapiens
aggatccgctgcca

SEQ ID NO: 1748898 - DNA, 14 bp, Homo sapiens
aggcaccggcgctg

SEQ ID NO: 1748899 - DNA, 18 bp, Homo sapiens
aggcaccggcgctgcagg

SEQ ID NO: 1748900 - DNA, 21 bp, Homo sapiens
aggcacctacactcacctgca

SEQ ID NO: 1748901 - DNA, 22 bp, Homo sapiens
aggcacctccaggcaggccagg

SEQ ID NO: 1748902 - DNA, 22 bp, Homo sapiens
aggcacctccccgctctccctg

SEQ ID NO: 1748903 - DNA, 23 bp, Homo sapiens
aggcacctccccgctctccctgt

SEQ ID NO: 1748904 - DNA, 16 bp, Homo sapiens
aggcacctggcctgct

SEQ ID NO: 1748905 - DNA, 19 bp, Homo sapiens
aggcacctggcctgctggg

SEQ ID NO: 1748906 - DNA, 14 bp, Homo sapiens
aggcacgaacccac

SEQ ID NO: 1748907 - DNA, 17 bp, Homo sapiens
aggcacgaacccacctg

SEQ ID NO: 1748908 - DNA, 14 bp, Homo sapiens
aggcacgcaccact

SEQ ID NO: 1748909 - DNA, 15 bp, Homo sapiens
aggcacgcaccactg

SEQ ID NO: 1748910 - DNA, 16 bp, Homo sapiens
aggcacgcaccactgc

SEQ ID NO: 1748911 - DNA, 17 bp, Homo sapiens
aggcacgggtggtcccc

SEQ ID NO: 1748912 - DNA, 15 bp, Homo sapiens
aggcactagtcaccg

SEQ ID NO: 1748913 - DNA, 19 bp, Homo sapiens
aggcactcatgggtaataa

SEQ ID NO: 1748914 - DNA, 23 bp, Homo sapiens
aggcactcgctgttatcaaatag

SEQ ID NO: 1748915 - DNA, 15 bp, Homo sapiens
aggcactctagattc

SEQ ID NO: 1748916 - DNA, 16 bp, Homo sapiens
aggcactctgttattt

SEQ ID NO: 1748917 - DNA, 17 bp, Homo sapiens
aggcactgaagtgctta

SEQ ID NO: 1748918 - DNA, 15 bp, Homo sapiens
aggcagaaagataca

SEQ ID NO: 1748919 - DNA, 20 bp, Homo sapiens
aggcagaaagatacagacat

SEQ ID NO: 1748920 - DNA, 22 bp, Homo sapiens
aggcagaaagatacagacattc

SEQ ID NO: 1748921 - DNA, 15 bp, Homo sapiens
aggcagaagaattga

SEQ ID NO: 1748922 - DNA, 14 bp, Homo sapiens
aggcagacaagagc

SEQ ID NO: 1748923 - DNA, 22 bp, Homo sapiens
aggcagacacaccgcggccagg

SEQ ID NO: 1748924 - DNA, 13 bp, Homo sapiens
aggcagacagcag

SEQ ID NO: 1748925 - DNA, 18 bp, Homo sapiens
aggcagacagcagctcag

SEQ ID NO: 1748926 - DNA, 22 bp, Homo sapiens
aggcagagaatcatacttagca

SEQ ID NO: 1748927 - DNA, 16 bp, Homo sapiens
aggcagatccaggact

SEQ ID NO: 1748928 - DNA, 17 bp, Homo sapiens
aggcagatggagcccat

SEQ ID NO: 1748929 - DNA, 15 bp, Homo sapiens
aggcagattgaaaag

SEQ ID NO: 1748930 - DNA, 13 bp, Homo sapiens
aggcagcaccaca

SEQ ID NO: 1748931 - DNA, 21 bp, Homo sapiens
aggcagcaccacactgggtgc

SEQ ID NO: 1748932 - DNA, 13 bp, Homo sapiens
aggcagcagagag

SEQ ID NO: 1748933 - DNA, 14 bp, Homo sapiens
aggcagcagtgtct

SEQ ID NO: 1748934 - DNA, 19 bp, Homo sapiens
aggcagccaacctaagcaa

SEQ ID NO: 1748935 - DNA, 15 bp, Homo sapiens
aggcagccacggccc

SEQ ID NO: 1748936 - DNA, 22 bp, Homo sapiens
aggcagccacggccccgggtcc

SEQ ID NO: 1748937 - DNA, 15 bp, Homo sapiens
aggcagccgaggcct

SEQ ID NO: 1748938 - DNA, 18 bp, Homo sapiens
aggcagccgaggcctggc

SEQ ID NO: 1748939 - DNA, 20 bp, Homo sapiens
aggcagccgaggcctggcca

SEQ ID NO: 1748940 - DNA, 21 bp, Homo sapiens
aggcagcctccagagccagcc

SEQ ID NO: 1748941 - DNA, 22 bp, Homo sapiens
aggcagcctccagagccagcct

SEQ ID NO: 1748942 - DNA, 16 bp, Homo sapiens
aggcagcctgaacact

SEQ ID NO: 1748943 - DNA, 16 bp, Homo sapiens
aggcagcgaccccagg

SEQ ID NO: 1748944 - DNA, 23 bp, Homo sapiens
aggcagcgacctcaagtgtcctg

SEQ ID NO: 1748945 - DNA, 18 bp, Homo sapiens
aggcagcgttagggctgc

SEQ ID NO: 1748946 - DNA, 17 bp, Homo sapiens
aggcagctaagatagaa

SEQ ID NO: 1748947 - DNA, 13 bp, Homo sapiens
aggcagctgcctc

SEQ ID NO: 1748948 - DNA, 15 bp, Homo sapiens
aggcagctgcctctg

SEQ ID NO: 1748949 - DNA, 17 bp, Homo sapiens
aggcagctgcctctgct

SEQ ID NO: 1748950 - DNA, 14 bp, Homo sapiens
aggcagctgctctt

SEQ ID NO: 1748951 - DNA, 13 bp, Homo sapiens
aggcaggaagccc

SEQ ID NO: 1748952 - DNA, 21 bp, Homo sapiens
aggcaggaccttcgggctgtg

SEQ ID NO: 1748953 - DNA, 22 bp, Homo sapiens
aggcaggaccttcgggctgtgc

SEQ ID NO: 1748954 - DNA, 21 bp, Homo sapiens
aggcaggagaatcactcgaac

SEQ ID NO: 1748955 - DNA, 16 bp, Homo sapiens
aggcaggattgaaaat

SEQ ID NO: 1748956 - DNA, 18 bp, Homo sapiens
aggcaggcatggccctgg

SEQ ID NO: 1748957 - DNA, 19 bp, Homo sapiens
aggcaggccaggctgcctc

SEQ ID NO: 1748958 - DNA, 20 bp, Homo sapiens
aggcaggccaggctgcctcg

SEQ ID NO: 1748959 - DNA, 13 bp, Homo sapiens
aggcagggagggg

SEQ ID NO: 1748960 - DNA, 16 bp, Homo sapiens
aggcagggcaaatgac

SEQ ID NO: 1748961 - DNA, 18 bp, Homo sapiens
aggcagggcaaatgacat

SEQ ID NO: 1748962 - DNA, 23 bp, Homo sapiens
aggcagggggaaggtggggtcct

SEQ ID NO: 1748963 - DNA, 18 bp, Homo sapiens
aggcagggggccctgccc

SEQ ID NO: 1748964 - DNA, 18 bp, Homo sapiens
aggcaggggtcctgcagg

SEQ ID NO: 1748965 - DNA, 21 bp, Homo sapiens
aggcaggggtcctgcaggtcc

SEQ ID NO: 1748966 - DNA, 22 bp, Homo sapiens
aggcaggggtgggggtggaggc

SEQ ID NO: 1748967 - DNA, 17 bp, Homo sapiens
aggcagggtcaggagag

SEQ ID NO: 1748968 - DNA, 19 bp, Homo sapiens
aggcagggtcaggagaggg

SEQ ID NO: 1748969 - DNA, 20 bp, Homo sapiens
aggcagggtcaggagagggg

SEQ ID NO: 1748970 - DNA, 20 bp, Homo sapiens
aggcaggtgagaacccagag

SEQ ID NO: 1748971 - DNA, 15 bp, Homo sapiens
aggcaggtgcctcca

SEQ ID NO: 1748972 - DNA, 20 bp, Homo sapiens
aggcaggtgcctccaggtgt

SEQ ID NO: 1748973 - DNA, 15 bp, Homo sapiens
aggcagtagttttca

SEQ ID NO: 1748974 - DNA, 19 bp, Homo sapiens
aggcagtcgggggctggcc

SEQ ID NO: 1748975 - DNA, 23 bp, Homo sapiens
aggcagtctctatattatgtctt

SEQ ID NO: 1748976 - DNA, 14 bp, Homo sapiens
aggcagtctgaacc

SEQ ID NO: 1748977 - DNA, 20 bp, Homo sapiens
aggcagtgatgacttgctgt

SEQ ID NO: 1748978 - DNA, 19 bp, Homo sapiens
aggcagtgcatgtgaagca

SEQ ID NO: 1748979 - DNA, 22 bp, Homo sapiens
aggcagtgcatgtgaagcatgc

SEQ ID NO: 1748980 - DNA, 18 bp, Homo sapiens
aggcagtggcaggggagc

SEQ ID NO: 1748981 - DNA, 16 bp, Homo sapiens
aggcagttaggtgctg

SEQ ID NO: 1748982 - DNA, 14 bp, Homo sapiens
aggcagttttctaa

SEQ ID NO: 1748983 - DNA, 17 bp, Homo sapiens
aggcatacactgtagtt

SEQ ID NO: 1748984 - DNA, 21 bp, Homo sapiens
aggcatacgagagcagaggtc

SEQ ID NO: 1748985 - DNA, 13 bp, Homo sapiens
aggcatactagta

SEQ ID NO: 1748986 - DNA, 15 bp, Homo sapiens
aggcatagaggcttc

SEQ ID NO: 1748987 - DNA, 13 bp, Homo sapiens
aggcataggcctg

SEQ ID NO: 1748988 - DNA, 15 bp, Homo sapiens
aggcataggcctggg

SEQ ID NO: 1748989 - DNA, 17 bp, Homo sapiens
aggcataggcctgggtg

SEQ ID NO: 1748990 - DNA, 20 bp, Homo sapiens
aggcataggcctgggtgctg

SEQ ID NO: 1748991 - DNA, 21 bp, Homo sapiens
aggcatcatggaaagactggg

SEQ ID NO: 1748992 - DNA, 18 bp, Homo sapiens
aggcatcccaggggacca

SEQ ID NO: 1748993 - DNA, 15 bp, Homo sapiens
aggcatccttgtctt

SEQ ID NO: 1748994 - DNA, 20 bp, Homo sapiens
aggcatccttgtcttttgag

SEQ ID NO: 1748995 - DNA, 22 bp, Homo sapiens
aggcatccttgtcttttgagct

SEQ ID NO: 1748996 - DNA, 18 bp, Homo sapiens
aggcatctacacagcctg

SEQ ID NO: 1748997 - DNA, 23 bp, Homo sapiens
aggcatctacacagcctggactt

SEQ ID NO: 1748998 - DNA, 13 bp, Homo sapiens
aggcatctatctg

SEQ ID NO: 1748999 - DNA, 19 bp, Homo sapiens
aggcatctgtgggcatggt

SEQ ID NO: 1749000 - DNA, 19 bp, Homo sapiens
aggcatgaaattcttccta

SEQ ID NO: 1749001 - DNA, 20 bp, Homo sapiens
aggcatgaaattcttcctaa

SEQ ID NO: 1749002 - DNA, 22 bp, Homo sapiens
aggcatgagccactgagcctgg

SEQ ID NO: 1749003 - DNA, 13 bp, Homo sapiens
aggcatgcctctg

SEQ ID NO: 1749004 - DNA, 17 bp, Homo sapiens
aggcatgcctctgatat

SEQ ID NO: 1749005 - DNA, 21 bp, Homo sapiens
aggcatgcctctgatatggga

SEQ ID NO: 1749006 - DNA, 12 bp, Homo sapiens
aggcatggccct

SEQ ID NO: 1749007 - DNA, 14 bp, Homo sapiens
aggcatggccctgg

SEQ ID NO: 1749008 - DNA, 13 bp, Homo sapiens
aggcatggctggg

SEQ ID NO: 1749009 - DNA, 20 bp, Homo sapiens
aggcatgggtgcaaggaaaa

SEQ ID NO: 1749010 - DNA, 17 bp, Homo sapiens
aggcatgtcccacccac

SEQ ID NO: 1749011 - DNA, 12 bp, Homo sapiens
aggcatgtcctg

SEQ ID NO: 1749012 - DNA, 16 bp, Homo sapiens
aggccctttggcttct

SEQ ID NO: 1749013 - DNA, 20 bp, Homo sapiens
aggccgaggaccaccagcag

SEQ ID NO: 1749014 - DNA, 18 bp, Homo sapiens
aggccgagtggctgccgg

SEQ ID NO: 1749015 - DNA, 12 bp, Homo sapiens
aggccgccagcg

SEQ ID NO: 1749016 - DNA, 16 bp, Homo sapiens
aggccgccagcgtgtg

SEQ ID NO: 1749017 - DNA, 16 bp, Homo sapiens
aggccgcgcccagcag

SEQ ID NO: 1749018 - DNA, 17 bp, Homo sapiens
aggccgcgcccagcaga

SEQ ID NO: 1749019 - DNA, 13 bp, Homo sapiens
aggccgctgcccc

SEQ ID NO: 1749020 - DNA, 13 bp, Homo sapiens
aggccggagccca

SEQ ID NO: 1749021 - DNA, 20 bp, Homo sapiens
aggccgggagaggatgtctt

SEQ ID NO: 1749022 - DNA, 17 bp, Homo sapiens
aggccgggcttgggccc

SEQ ID NO: 1749023 - DNA, 15 bp, Homo sapiens
aggccggggtccagg

SEQ ID NO: 1749024 - DNA, 22 bp, Homo sapiens
aggccgtcctcccgggccctcc

SEQ ID NO: 1749025 - DNA, 21 bp, Homo sapiens
aggccgttccccttggcttcc

SEQ ID NO: 1749026 - DNA, 13 bp, Homo sapiens
aggcctaagacat

SEQ ID NO: 1749027 - DNA, 14 bp, Homo sapiens
aggcctagactctg

SEQ ID NO: 1749028 - DNA, 17 bp, Homo sapiens
aggcctagactctgtct

SEQ ID NO: 1749029 - DNA, 11 bp, Homo sapiens
aggcctatcaa

SEQ ID NO: 1749030 - DNA, 14 bp, Homo sapiens
aggcctatcaacct

SEQ ID NO: 1749031 - DNA, 22 bp, Homo sapiens
aggcctcactactcgagcccac

SEQ ID NO: 1749032 - DNA, 14 bp, Homo sapiens
aggcctcaggtgct

SEQ ID NO: 1749033 - DNA, 21 bp, Homo sapiens
aggcctcagtttctccatcag

SEQ ID NO: 1749034 - DNA, 15 bp, Homo sapiens
aggcctcatccctcg

SEQ ID NO: 1749035 - DNA, 18 bp, Homo sapiens
aggcctccagcctctccc

SEQ ID NO: 1749036 - DNA, 22 bp, Homo sapiens
aggcctccagcctctcccggct

SEQ ID NO: 1749037 - DNA, 19 bp, Homo sapiens
aggcctcccccagccagga

SEQ ID NO: 1749038 - DNA, 15 bp, Homo sapiens
aggcctccctagcca

SEQ ID NO: 1749039 - DNA, 15 bp, Homo sapiens
aggcctccctgcaga

SEQ ID NO: 1749040 - DNA, 21 bp, Homo sapiens
aggcctctccagtttgcacct

SEQ ID NO: 1749041 - DNA, 21 bp, Homo sapiens
aggcctctcggtgctccatct

SEQ ID NO: 1749042 - DNA, 15 bp, Homo sapiens
aggcctctctctgcc

SEQ ID NO: 1749043 - DNA, 12 bp, Homo sapiens
aggcctctgcag

SEQ ID NO: 1749044 - DNA, 16 bp, Homo sapiens
aggcctctgcagaagc

SEQ ID NO: 1749045 - DNA, 19 bp, Homo sapiens
aggcctctggaaagcaaag

SEQ ID NO: 1749046 - DNA, 13 bp, Homo sapiens
aggcctctggact

SEQ ID NO: 1749047 - DNA, 20 bp, Homo sapiens
aggcctctggactggcctgt

SEQ ID NO: 1749048 - DNA, 14 bp, Homo sapiens
aggcctcttgtgct

SEQ ID NO: 1749049 - DNA, 17 bp, Homo sapiens
aggcctgaaagaggctg

SEQ ID NO: 1749050 - DNA, 21 bp, Homo sapiens
aggcctgaaagaggctgaggc

SEQ ID NO: 1749051 - DNA, 16 bp, Homo sapiens
aggcctgactctcagc

SEQ ID NO: 1749052 - DNA, 16 bp, Homo sapiens
aggcctgacttctgct

SEQ ID NO: 1749053 - DNA, 17 bp, Homo sapiens
aggcctgacttctgctg

SEQ ID NO: 1749054 - DNA, 12 bp, Homo sapiens
aggcctgagaat

SEQ ID NO: 1749055 - DNA, 17 bp, Homo sapiens
aggcctgagatttcatc

SEQ ID NO: 1749056 - DNA, 23 bp, Homo sapiens
aggcctgagatttcatctgctct

SEQ ID NO: 1749057 - DNA, 22 bp, Homo sapiens
aggcctgagcgctcctgccgca

SEQ ID NO: 1749058 - DNA, 16 bp, Homo sapiens
aggcctgaggatgagc

SEQ ID NO: 1749059 - DNA, 17 bp, Homo sapiens
aggcctgaggatgagct

SEQ ID NO: 1749060 - DNA, 19 bp, Homo sapiens
aggcctgaggatgagctgg

SEQ ID NO: 1749061 - DNA, 16 bp, Homo sapiens
aggcctgatctgccca

SEQ ID NO: 1749062 - DNA, 19 bp, Homo sapiens
aggcctgcctccagggctg

SEQ ID NO: 1749063 - DNA, 20 bp, Homo sapiens
aggcctgcctccagggctgg

SEQ ID NO: 1749064 - DNA, 17 bp, Homo sapiens
aggcctgcgaccctggg

SEQ ID NO: 1749065 - DNA, 18 bp, Homo sapiens
aggcctgcgtgcgctggt

SEQ ID NO: 1749066 - DNA, 23 bp, Homo sapiens
aggcctgctccctgtagggtcca

SEQ ID NO: 1749067 - DNA, 20 bp, Homo sapiens
aggcctggaaccagggagga

SEQ ID NO: 1749068 - DNA, 19 bp, Homo sapiens
aggcctggactttcctgca

SEQ ID NO: 1749069 - DNA, 17 bp, Homo sapiens
aggcctggcatcttctg

SEQ ID NO: 1749070 - DNA, 20 bp, Homo sapiens
aggcctggcatcttctggag

SEQ ID NO: 1749071 - DNA, 21 bp, Homo sapiens
aggcctggcatcttctggaga

SEQ ID NO: 1749072 - DNA, 22 bp, Homo sapiens
aggcctggcatcttctggagaa

SEQ ID NO: 1749073 - DNA, 15 bp, Homo sapiens
aggcctggccaatgc

SEQ ID NO: 1749074 - DNA, 11 bp, Homo sapiens
aggcctggcct

SEQ ID NO: 1749075 - DNA, 14 bp, Homo sapiens
aggcctggcctctg

SEQ ID NO: 1749076 - DNA, 16 bp, Homo sapiens
aggcctggcctctggg

SEQ ID NO: 1749077 - DNA, 15 bp, Homo sapiens
aggcctgggacccag

SEQ ID NO: 1749078 - DNA, 17 bp, Homo sapiens
aggcctgggacccagct

SEQ ID NO: 1749079 - DNA, 19 bp, Homo sapiens
aggcctgggacccagctac

SEQ ID NO: 1749080 - DNA, 23 bp, Homo sapiens
aggcctgggacccagctactctg

SEQ ID NO: 1749081 - DNA, 23 bp, Homo sapiens
aggcctgggtgctggctgcccag

SEQ ID NO: 1749082 - DNA, 18 bp, Homo sapiens
aggcctgtccaccctgcc

SEQ ID NO: 1749083 - DNA, 17 bp, Homo sapiens
aggcctgtcccttgcct

SEQ ID NO: 1749084 - DNA, 22 bp, Homo sapiens
aggcctgtcctgacctgtctca

SEQ ID NO: 1749085 - DNA, 16 bp, Homo sapiens
aggcctgtttggcctc

SEQ ID NO: 1749086 - DNA, 21 bp, Homo sapiens
aggccttaactatttcacatg

SEQ ID NO: 1749087 - DNA, 20 bp, Homo sapiens
aggccttatcattcattctt

SEQ ID NO: 1749088 - DNA, 15 bp, Homo sapiens
aggccttcagacaca

SEQ ID NO: 1749089 - DNA, 16 bp, Homo sapiens
aggccttcagacacat

SEQ ID NO: 1749090 - DNA, 14 bp, Homo sapiens
aggccttcagttta

SEQ ID NO: 1749091 - DNA, 11 bp, Homo sapiens
aggccttcatc

SEQ ID NO: 1749092 - DNA, 22 bp, Homo sapiens
aggccttctcctccccacccgc

SEQ ID NO: 1749093 - DNA, 18 bp, Homo sapiens
aggccttgcctggcctga

SEQ ID NO: 1749094 - DNA, 20 bp, Homo sapiens
aggccttgtgtgtcaggccc

SEQ ID NO: 1749095 - DNA, 13 bp, Homo sapiens
aggcctttcttct

SEQ ID NO: 1749096 - DNA, 18 bp, Homo sapiens
aggcgacaaaatctcctg

SEQ ID NO: 1749097 - DNA, 23 bp, Homo sapiens
aggcgatccacctgtctcagcct

SEQ ID NO: 1749098 - DNA, 15 bp, Homo sapiens
aggcgatgccagcct

SEQ ID NO: 1749099 - DNA, 17 bp, Homo sapiens
aggcgattttgtctacc

SEQ ID NO: 1749100 - DNA, 21 bp, Homo sapiens
aggcgcagtgcttctctacag

SEQ ID NO: 1749101 - DNA, 18 bp, Homo sapiens
aggcgcctataatcccag

SEQ ID NO: 1749102 - DNA, 20 bp, Homo sapiens
aggcgcctataatcccagct

SEQ ID NO: 1749103 - DNA, 15 bp, Homo sapiens
aggcggcagctgggg

SEQ ID NO: 1749104 - DNA, 15 bp, Homo sapiens
aggcggcccggccag

SEQ ID NO: 1749105 - DNA, 15 bp, Homo sapiens
aggcgggaaggaggg

SEQ ID NO: 1749106 - DNA, 14 bp, Homo sapiens
aggcgggccagcca

SEQ ID NO: 1749107 - DNA, 16 bp, Homo sapiens
aggcgggccagccagg

SEQ ID NO: 1749108 - DNA, 19 bp, Homo sapiens
aggcggtcatgtgtgcatg

SEQ ID NO: 1749109 - DNA, 22 bp, Homo sapiens
aggcggtcatgtgtgcatgtga

SEQ ID NO: 1749110 - DNA, 20 bp, Homo sapiens
aggcgtactacccagctctg

SEQ ID NO: 1749111 - DNA, 19 bp, Homo sapiens
aggcgtcaccatccacctt

SEQ ID NO: 1749112 - DNA, 21 bp, Homo sapiens
aggcgtccgcgcgccagcaca

SEQ ID NO: 1749113 - DNA, 13 bp, Homo sapiens
aggcgtgcccccc

SEQ ID NO: 1749114 - DNA, 20 bp, Homo sapiens
aggcgtgcccccctcctcca

SEQ ID NO: 1749115 - DNA, 23 bp, Homo sapiens
aggcgtgcccccctcctccagta

SEQ ID NO: 1749116 - DNA, 19 bp, Homo sapiens
aggcgttagtgggcaggtg

SEQ ID NO: 1749117 - DNA, 18 bp, Homo sapiens
aggcgttcttcgaggtgg

SEQ ID NO: 1749118 - DNA, 16 bp, Homo sapiens
aggctaagaatagtgg

SEQ ID NO: 1749119 - DNA, 19 bp, Homo sapiens
aggctaagcatggcctgga

SEQ ID NO: 1749120 - DNA, 18 bp, Homo sapiens
aggctaagttcagttctg

SEQ ID NO: 1749121 - DNA, 17 bp, Homo sapiens
aggctacctcacctggg

SEQ ID NO: 1749122 - DNA, 13 bp, Homo sapiens
aggctagaggcat

SEQ ID NO: 1749123 - DNA, 15 bp, Homo sapiens
aggctagcttctgct

SEQ ID NO: 1749124 - DNA, 17 bp, Homo sapiens
aggctagcttctgcttt

SEQ ID NO: 1749125 - DNA, 14 bp, Homo sapiens
aggctagttccttt

SEQ ID NO: 1749126 - DNA, 17 bp, Homo sapiens
aggctatgaagggacag

SEQ ID NO: 1749127 - DNA, 23 bp, Homo sapiens
agggagaatcctcccttcccagg

SEQ ID NO: 1749128 - DNA, 18 bp, Homo sapiens
agggagactgcatctcaa

SEQ ID NO: 1749129 - DNA, 20 bp, Homo sapiens
agggagacttgttctagaga

SEQ ID NO: 1749130 - DNA, 14 bp, Homo sapiens
agggagagaagata

SEQ ID NO: 1749131 - DNA, 23 bp, Homo sapiens
agggagagagagagagagaggac

SEQ ID NO: 1749132 - DNA, 16 bp, Homo sapiens
agggagagcggggcag

SEQ ID NO: 1749133 - DNA, 19 bp, Homo sapiens
agggagcagggaaggcctg

SEQ ID NO: 1749134 - DNA, 17 bp, Homo sapiens
agggagcccctcctctg

SEQ ID NO: 1749135 - DNA, 17 bp, Homo sapiens
agggagcccctttgatg

SEQ ID NO: 1749136 - DNA, 19 bp, Homo sapiens
agggagccggcggcctctc

SEQ ID NO: 1749137 - DNA, 18 bp, Homo sapiens
agggagcctttggttctg

SEQ ID NO: 1749138 - DNA, 19 bp, Homo sapiens
agggaggaagaaggcagtg

SEQ ID NO: 1749139 - DNA, 14 bp, Homo sapiens
agggaggaaggcct

SEQ ID NO: 1749140 - DNA, 15 bp, Homo sapiens
agggaggaaggcctt

SEQ ID NO: 1749141 - DNA, 16 bp, Homo sapiens
agggaggaaggccttt

SEQ ID NO: 1749142 - DNA, 23 bp, Homo sapiens
agggaggagaggaaatgctattg

SEQ ID NO: 1749143 - DNA, 23 bp, Homo sapiens
agggaggaggccacctctccaag

SEQ ID NO: 1749144 - DNA, 15 bp, Homo sapiens
agggaggagtggagg

SEQ ID NO: 1749145 - DNA, 15 bp, Homo sapiens
agggaggcagtggct

SEQ ID NO: 1749146 - DNA, 17 bp, Homo sapiens
agggaggccaggcgggc

SEQ ID NO: 1749147 - DNA, 13 bp, Homo sapiens
agggaggccgggc

SEQ ID NO: 1749148 - DNA, 13 bp, Homo sapiens
agggaggggaggc

SEQ ID NO: 1749149 - DNA, 17 bp, Homo sapiens
agggaggggccggccct

SEQ ID NO: 1749150 - DNA, 23 bp, Homo sapiens
agggaggggccggccctgtgtgc

SEQ ID NO: 1749151 - DNA, 13 bp, Homo sapiens
agggaggggctgt

SEQ ID NO: 1749152 - DNA, 15 bp, Homo sapiens
agggagggtgcagcc

SEQ ID NO: 1749153 - DNA, 18 bp, Homo sapiens
agggagggtggccagcac

SEQ ID NO: 1749154 - DNA, 21 bp, Homo sapiens
agggaggtcactggaaagggg

SEQ ID NO: 1749155 - DNA, 16 bp, Homo sapiens
agggagtcccctcccc

SEQ ID NO: 1749156 - DNA, 22 bp, Homo sapiens
agggagtcccctccccggccct

SEQ ID NO: 1749157 - DNA, 14 bp, Homo sapiens
agggagttcatctg

SEQ ID NO: 1749158 - DNA, 21 bp, Homo sapiens
agggataaagaaaaaaatact

SEQ ID NO: 1749159 - DNA, 23 bp, Homo sapiens
agggataaagaaaaaaatactat

SEQ ID NO: 1749160 - DNA, 19 bp, Homo sapiens
agggatagtactaagcatt

SEQ ID NO: 1749161 - DNA, 16 bp, Homo sapiens
agggatataaaatgaa

SEQ ID NO: 1749162 - DNA, 21 bp, Homo sapiens
agggatatctactgtggtctg

SEQ ID NO: 1749163 - DNA, 15 bp, Homo sapiens
agggatattgcctta

SEQ ID NO: 1749164 - DNA, 13 bp, Homo sapiens
agggatccctaac

SEQ ID NO: 1749165 - DNA, 20 bp, Homo sapiens
agggatctctctacaagagc

SEQ ID NO: 1749166 - DNA, 20 bp, Homo sapiens
agggatctgccattgggacc

SEQ ID NO: 1749167 - DNA, 14 bp, Homo sapiens
agggatgaactttt

SEQ ID NO: 1749168 - DNA, 19 bp, Homo sapiens
agggatgatggcagagcca

SEQ ID NO: 1749169 - DNA, 18 bp, Homo sapiens
agggatgcggatcctgct

SEQ ID NO: 1749170 - DNA, 20 bp, Homo sapiens
agggatgcggatcctgctgg

SEQ ID NO: 1749171 - DNA, 17 bp, Homo sapiens
agggatgctgcctgagt

SEQ ID NO: 1749172 - DNA, 18 bp, Homo sapiens
agggatgctgcctgagtc

SEQ ID NO: 1749173 - DNA, 13 bp, Homo sapiens
agggatgctgggc

SEQ ID NO: 1749174 - DNA, 20 bp, Homo sapiens
agggatggacttgtgattgg

SEQ ID NO: 1749175 - DNA, 17 bp, Homo sapiens
agggatgtttggaaaaa

SEQ ID NO: 1749176 - DNA, 15 bp, Homo sapiens
agggattagggagag

SEQ ID NO: 1749177 - DNA, 14 bp, Homo sapiens
agggattcaggctg

SEQ ID NO: 1749178 - DNA, 15 bp, Homo sapiens
agggattcaggctgc

SEQ ID NO: 1749179 - DNA, 18 bp, Homo sapiens
agggattcaggctgcttg

SEQ ID NO: 1749180 - DNA, 20 bp, Homo sapiens
agggattctgggcttggggt

SEQ ID NO: 1749181 - DNA, 16 bp, Homo sapiens
agggattgaggagttg

SEQ ID NO: 1749182 - DNA, 22 bp, Homo sapiens
agggattgaggagttgcctgac

SEQ ID NO: 1749183 - DNA, 17 bp, Homo sapiens
agggattgattttaaaa

SEQ ID NO: 1749184 - DNA, 20 bp, Homo sapiens
agggcaaatgacatgcactg

SEQ ID NO: 1749185 - DNA, 14 bp, Homo sapiens
agggcaaattattt

SEQ ID NO: 1749186 - DNA, 14 bp, Homo sapiens
agggcaagaaatgg

SEQ ID NO: 1749187 - DNA, 13 bp, Homo sapiens
agggcaagtgcat

SEQ ID NO: 1749188 - DNA, 19 bp, Homo sapiens
agggcaagtggatgggaat

SEQ ID NO: 1749189 - DNA, 21 bp, Homo sapiens
agggcaagtggatgggaattt

SEQ ID NO: 1749190 - DNA, 20 bp, Homo sapiens
agggcacaagtcctggatgt

SEQ ID NO: 1749191 - DNA, 22 bp, Homo sapiens
agggcacacccctggggctgag

SEQ ID NO: 1749192 - DNA, 21 bp, Homo sapiens
agggcacattaactccctcca

SEQ ID NO: 1749193 - DNA, 22 bp, Homo sapiens
agggcacattaactccctccac

SEQ ID NO: 1749194 - DNA, 14 bp, Homo sapiens
agggcaccaggggt

SEQ ID NO: 1749195 - DNA, 23 bp, Homo sapiens
agggcaccccttgtttctgttgt

SEQ ID NO: 1749196 - DNA, 16 bp, Homo sapiens
agggcactgggctgtt

SEQ ID NO: 1749197 - DNA, 21 bp, Homo sapiens
agggcagacaatagtatagaa

SEQ ID NO: 1749198 - DNA, 20 bp, Homo sapiens
agggcagactggggcatcct

SEQ ID NO: 1749199 - DNA, 15 bp, Homo sapiens
agggcagagaatggc

SEQ ID NO: 1749200 - DNA, 12 bp, Homo sapiens
agggcagagcca

SEQ ID NO: 1749201 - DNA, 13 bp, Homo sapiens
agggcagagccat

SEQ ID NO: 1749202 - DNA, 21 bp, Homo sapiens
agggcagagccatgggcctgg

SEQ ID NO: 1749203 - DNA, 23 bp, Homo sapiens
agggcagagccatgggcctgggc

SEQ ID NO: 1749204 - DNA, 22 bp, Homo sapiens
agggcagaggaatgtagggcct

SEQ ID NO: 1749205 - DNA, 20 bp, Homo sapiens
agggcagaggctggaggcag

SEQ ID NO: 1749206 - DNA, 13 bp, Homo sapiens
agggcagagggaa

SEQ ID NO: 1749207 - DNA, 23 bp, Homo sapiens
agggcagagggaatgttccctgc

SEQ ID NO: 1749208 - DNA, 14 bp, Homo sapiens
agggcagcaaggga

SEQ ID NO: 1749209 - DNA, 17 bp, Homo sapiens
agggcagcctggatccc

SEQ ID NO: 1749210 - DNA, 19 bp, Homo sapiens
agggcagcctggatccctg

SEQ ID NO: 1749211 - DNA, 21 bp, Homo sapiens
agggcaggaaggagagcctgc

SEQ ID NO: 1749212 - DNA, 23 bp, Homo sapiens
agggcaggaaggagagcctgctg

SEQ ID NO: 1749213 - DNA, 22 bp, Homo sapiens
agggcaggcttggggaaaatgg

SEQ ID NO: 1749214 - DNA, 17 bp, Homo sapiens
agggcagggacaggata

SEQ ID NO: 1749215 - DNA, 22 bp, Homo sapiens
agggcagggaccacaccctgta

SEQ ID NO: 1749216 - DNA, 18 bp, Homo sapiens
agggcagggcccacgtgt

SEQ ID NO: 1749217 - DNA, 13 bp, Homo sapiens
agggcagtgccct

SEQ ID NO: 1749218 - DNA, 13 bp, Homo sapiens
agggcagtgtttc

SEQ ID NO: 1749219 - DNA, 15 bp, Homo sapiens
agggcagtgtttcct

SEQ ID NO: 1749220 - DNA, 16 bp, Homo sapiens
agggcagtgtttcctt

SEQ ID NO: 1749221 - DNA, 22 bp, Homo sapiens
agggcatgccacgtgggctcat

SEQ ID NO: 1749222 - DNA, 17 bp, Homo sapiens
agggcatggccaggtgg

SEQ ID NO: 1749223 - DNA, 16 bp, Homo sapiens
agggcattcaaatggg

SEQ ID NO: 1749224 - DNA, 17 bp, Homo sapiens
agggcattgctcagccc

SEQ ID NO: 1749225 - DNA, 18 bp, Homo sapiens
agggcattgctcagcccg

SEQ ID NO: 1749226 - DNA, 19 bp, Homo sapiens
agggccaagagatctgtgt

SEQ ID NO: 1749227 - DNA, 18 bp, Homo sapiens
agggccacatagatgctg

SEQ ID NO: 1749228 - DNA, 15 bp, Homo sapiens
agggccacgctccag

SEQ ID NO: 1749229 - DNA, 16 bp, Homo sapiens
agggccacgtgccagg

SEQ ID NO: 1749230 - DNA, 19 bp, Homo sapiens
agggccacgtgccaggccc

SEQ ID NO: 1749231 - DNA, 23 bp, Homo sapiens
agggccactcaacagagaggacc

SEQ ID NO: 1749232 - DNA, 14 bp, Homo sapiens
agggccactctgcc

SEQ ID NO: 1749233 - DNA, 15 bp, Homo sapiens
agggccactctgcct

SEQ ID NO: 1749234 - DNA, 23 bp, Homo sapiens
agggccactggtccccaacaatg

SEQ ID NO: 1749235 - DNA, 19 bp, Homo sapiens
agggccactttttttttat

SEQ ID NO: 1749236 - DNA, 17 bp, Homo sapiens
agggccagaaaaatttg

SEQ ID NO: 1749237 - DNA, 18 bp, Homo sapiens
agggccagaaggagggca

SEQ ID NO: 1749238 - DNA, 20 bp, Homo sapiens
agggccagaaggagggcaga

SEQ ID NO: 1749239 - DNA, 11 bp, Homo sapiens
agggccagagc

SEQ ID NO: 1749240 - DNA, 16 bp, Homo sapiens
agggccagagccaggg

SEQ ID NO: 1749241 - DNA, 12 bp, Homo sapiens
agggggccctgc

SEQ ID NO: 1749242 - DNA, 16 bp, Homo sapiens
agggggccctgcccca

SEQ ID NO: 1749243 - DNA, 17 bp, Homo sapiens
agggggccctgccccac

SEQ ID NO: 1749244 - DNA, 15 bp, Homo sapiens
agggggccctgctac

SEQ ID NO: 1749245 - DNA, 22 bp, Homo sapiens
agggggcctggagcatggacag

SEQ ID NO: 1749246 - DNA, 18 bp, Homo sapiens
agggggcgctcaggaccc

SEQ ID NO: 1749247 - DNA, 23 bp, Homo sapiens
agggggcgctcaggacccaggcc

SEQ ID NO: 1749248 - DNA, 14 bp, Homo sapiens
agggggctctgccc

SEQ ID NO: 1749249 - DNA, 22 bp, Homo sapiens
agggggctctgccccaggccct

SEQ ID NO: 1749250 - DNA, 16 bp, Homo sapiens
agggggcttgaagcca

SEQ ID NO: 1749251 - DNA, 17 bp, Homo sapiens
aggggggagggggaggg

SEQ ID NO: 1749252 - DNA, 16 bp, Homo sapiens
aggggggctgtgccaa

SEQ ID NO: 1749253 - DNA, 21 bp, Homo sapiens
agggggtcatttcagagccct

SEQ ID NO: 1749254 - DNA, 19 bp, Homo sapiens
agggggtgtcatctgagga

SEQ ID NO: 1749255 - DNA, 15 bp, Homo sapiens
aggggtatgtcttta

SEQ ID NO: 1749256 - DNA, 23 bp, Homo sapiens
aggggtatgttccctcttgtccc

SEQ ID NO: 1749257 - DNA, 15 bp, Homo sapiens
aggggtcaggctcca

SEQ ID NO: 1749258 - DNA, 20 bp, Homo sapiens
aggggtcagtgcagcagagg

SEQ ID NO: 1749259 - DNA, 22 bp, Homo sapiens
aggggtccgatgtttgaggagg

SEQ ID NO: 1749260 - DNA, 15 bp, Homo sapiens
aggggtcggctgacc

SEQ ID NO: 1749261 - DNA, 21 bp, Homo sapiens
aggggtcggctgaccatgctc

SEQ ID NO: 1749262 - DNA, 11 bp, Homo sapiens
aggggtgcccc

SEQ ID NO: 1749263 - DNA, 22 bp, Homo sapiens
aggggtgctgtggacatgtggg

SEQ ID NO: 1749264 - DNA, 15 bp, Homo sapiens
aggggtggaatgccg

SEQ ID NO: 1749265 - DNA, 15 bp, Homo sapiens
aggggtggagactgc

SEQ ID NO: 1749266 - DNA, 22 bp, Homo sapiens
aggggtgggggtgccgctctct

SEQ ID NO: 1749267 - DNA, 21 bp, Homo sapiens
aggggtgggttcctcttcccc

SEQ ID NO: 1749268 - DNA, 15 bp, Homo sapiens
aggggtggtcctgac

SEQ ID NO: 1749269 - DNA, 15 bp, Homo sapiens
aggggtgtgggtcaa

SEQ ID NO: 1749270 - DNA, 15 bp, Homo sapiens
aggggttcattctcc

SEQ ID NO: 1749271 - DNA, 20 bp, Homo sapiens
aggggttggtcaaggccacc

SEQ ID NO: 1749272 - DNA, 20 bp, Homo sapiens
aggggttggttgaggtggaa

SEQ ID NO: 1749273 - DNA, 23 bp, Homo sapiens
aggggtttcagaattttgcattg

SEQ ID NO: 1749274 - DNA, 22 bp, Homo sapiens
agggtaaataaaccactgtgcg

SEQ ID NO: 1749275 - DNA, 12 bp, Homo sapiens
agggtacatgtg

SEQ ID NO: 1749276 - DNA, 23 bp, Homo sapiens
agggtaccttgaacactggggga

SEQ ID NO: 1749277 - DNA, 19 bp, Homo sapiens
agggtagaatgattaatca

SEQ ID NO: 1749278 - DNA, 22 bp, Homo sapiens
agggtagaattcaatcagagct

SEQ ID NO: 1749279 - DNA, 17 bp, Homo sapiens
agggtagtctggtttct

SEQ ID NO: 1749280 - DNA, 23 bp, Homo sapiens
agggtatctgctgcctctgaaaa

SEQ ID NO: 1749281 - DNA, 19 bp, Homo sapiens
agggtcaaagacagaatgg

SEQ ID NO: 1749282 - DNA, 23 bp, Homo sapiens
agggtcaaagacagaatggtgga

SEQ ID NO: 1749283 - DNA, 20 bp, Homo sapiens
agggtcaacatcttttacat

SEQ ID NO: 1749284 - DNA, 18 bp, Homo sapiens
agggtcagccatttttaa

SEQ ID NO: 1749285 - DNA, 13 bp, Homo sapiens
agggtccacagct

SEQ ID NO: 1749286 - DNA, 15 bp, Homo sapiens
agggtccacagctgg

SEQ ID NO: 1749287 - DNA, 19 bp, Homo sapiens
agggtccacagctggaaag

SEQ ID NO: 1749288 - DNA, 16 bp, Homo sapiens
agggtccacctggaga

SEQ ID NO: 1749289 - DNA, 17 bp, Homo sapiens
agggtccacctggagag

SEQ ID NO: 1749290 - DNA, 19 bp, Homo sapiens
agggtccctaattctcttc

SEQ ID NO: 1749291 - DNA, 14 bp, Homo sapiens
agggtccctctgtg

SEQ ID NO: 1749292 - DNA, 15 bp, Homo sapiens
agggtccctctgtgt

SEQ ID NO: 1749293 - DNA, 17 bp, Homo sapiens
agggtccgcaccagctg

SEQ ID NO: 1749294 - DNA, 19 bp, Homo sapiens
agggtccgcaccagctgct

SEQ ID NO: 1749295 - DNA, 16 bp, Homo sapiens
agggtcctctagccca

SEQ ID NO: 1749296 - DNA, 23 bp, Homo sapiens
agggtcctgccggtgggaccctg

SEQ ID NO: 1749297 - DNA, 17 bp, Homo sapiens
agggtcctggctcctga

SEQ ID NO: 1749298 - DNA, 19 bp, Homo sapiens
agggtcctggctcctgagg

SEQ ID NO: 1749299 - DNA, 20 bp, Homo sapiens
agggtcctggctcctgaggg

SEQ ID NO: 1749300 - DNA, 14 bp, Homo sapiens
agggtcctgtgcct

SEQ ID NO: 1749301 - DNA, 14 bp, Homo sapiens
agggtcgaaagctc

SEQ ID NO: 1749302 - DNA, 16 bp, Homo sapiens
agggtctagggagaga

SEQ ID NO: 1749303 - DNA, 19 bp, Homo sapiens
agggtctctctccaggtca

SEQ ID NO: 1749304 - DNA, 22 bp, Homo sapiens
agggtctctctccaggtcagcc

SEQ ID NO: 1749305 - DNA, 17 bp, Homo sapiens
agggtctgctctttctc

SEQ ID NO: 1749306 - DNA, 17 bp, Homo sapiens
agggtcttccctacctc

SEQ ID NO: 1749307 - DNA, 16 bp, Homo sapiens
agggtcttcttggcag

SEQ ID NO: 1749308 - DNA, 17 bp, Homo sapiens
agggtcttcttggcagc

SEQ ID NO: 1749309 - DNA, 21 bp, Homo sapiens
agggtcttgggctactggcag

SEQ ID NO: 1749310 - DNA, 16 bp, Homo sapiens
agggtgacgcccagct

SEQ ID NO: 1749311 - DNA, 18 bp, Homo sapiens
agggtgacgcccagctcc

SEQ ID NO: 1749312 - DNA, 17 bp, Homo sapiens
agggtgcagccctcttg

SEQ ID NO: 1749313 - DNA, 21 bp, Homo sapiens
agggtgccccgcctgagtcag

SEQ ID NO: 1749314 - DNA, 18 bp, Homo sapiens
agggtgccttaaaaataa

SEQ ID NO: 1749315 - DNA, 14 bp, Homo sapiens
agggtgctgactgg

SEQ ID NO: 1749316 - DNA, 12 bp, Homo sapiens
agggtggaaata

SEQ ID NO: 1749317 - DNA, 21 bp, Homo sapiens
agggtggagactaagccctgt

SEQ ID NO: 1749318 - DNA, 22 bp, Homo sapiens
agggtggaggaaggtgctgagc

SEQ ID NO: 1749319 - DNA, 20 bp, Homo sapiens
agggtggatgacagggcaga

SEQ ID NO: 1749320 - DNA, 11 bp, Homo sapiens
agggtggcagg

SEQ ID NO: 1749321 - DNA, 22 bp, Homo sapiens
agggtggcaggtcactgtcact

SEQ ID NO: 1749322 - DNA, 14 bp, Homo sapiens
agggtggcccttgc

SEQ ID NO: 1749323 - DNA, 19 bp, Homo sapiens
agggtggctttaattgtat

SEQ ID NO: 1749324 - DNA, 22 bp, Homo sapiens
agggtggctttaattgtataag

SEQ ID NO: 1749325 - DNA, 12 bp, Homo sapiens
agggtgggaaga

SEQ ID NO: 1749326 - DNA, 14 bp, Homo sapiens
agggtgggaagaga

SEQ ID NO: 1749327 - DNA, 18 bp, Homo sapiens
agggtgggagagcccagc

SEQ ID NO: 1749328 - DNA, 14 bp, Homo sapiens
agggtgggagccta

SEQ ID NO: 1749329 - DNA, 22 bp, Homo sapiens
agggtgggggtgctctctctga

SEQ ID NO: 1749330 - DNA, 23 bp, Homo sapiens
agggtggtctcttcttggggccc

SEQ ID NO: 1749331 - DNA, 17 bp, Homo sapiens
agggtggtgctgggact

SEQ ID NO: 1749332 - DNA, 14 bp, Homo sapiens
agggtgtaggggcc

SEQ ID NO: 1749333 - DNA, 16 bp, Homo sapiens
agggtgtatagtgttc

SEQ ID NO: 1749334 - DNA, 19 bp, Homo sapiens
agggtgtatagtgttcaca

SEQ ID NO: 1749335 - DNA, 15 bp, Homo sapiens
agggtgtgccctcac

SEQ ID NO: 1749336 - DNA, 18 bp, Homo sapiens
agggtgtggccctgccat

SEQ ID NO: 1749337 - DNA, 20 bp, Homo sapiens
agggtgtggtatgagggggt

SEQ ID NO: 1749338 - DNA, 23 bp, Homo sapiens
agggtgtggtatgagggggtggt

SEQ ID NO: 1749339 - DNA, 17 bp, Homo sapiens
agggtgtgtgttcacct

SEQ ID NO: 1749340 - DNA, 18 bp, Homo sapiens
agggttaggaatctcttc

SEQ ID NO: 1749341 - DNA, 19 bp, Homo sapiens
agggttaggaatctcttca

SEQ ID NO: 1749342 - DNA, 20 bp, Homo sapiens
agggttaggaatctcttcac

SEQ ID NO: 1749343 - DNA, 15 bp, Homo sapiens
agggttagggagggg

SEQ ID NO: 1749344 - DNA, 16 bp, Homo sapiens
agggttagggaggggt

SEQ ID NO: 1749345 - DNA, 13 bp, Homo sapiens
agggttataataa

SEQ ID NO: 1749346 - DNA, 18 bp, Homo sapiens
agggttcacacagcccag

SEQ ID NO: 1749347 - DNA, 19 bp, Homo sapiens
agggttcacacagcccagt

SEQ ID NO: 1749348 - DNA, 15 bp, Homo sapiens
agggttcccctggcc

SEQ ID NO: 1749349 - DNA, 13 bp, Homo sapiens
agggttctgccct

SEQ ID NO: 1749350 - DNA, 14 bp, Homo sapiens
agggttctggctgc

SEQ ID NO: 1749351 - DNA, 21 bp, Homo sapiens
agggttgaagacggaaaacaa

SEQ ID NO: 1749352 - DNA, 21 bp, Homo sapiens
agggttgagttacttcctatc

SEQ ID NO: 1749353 - DNA, 17 bp, Homo sapiens
agggttggggaggggcg

SEQ ID NO: 1749354 - DNA, 15 bp, Homo sapiens
agggtttcgactggt

SEQ ID NO: 1749355 - DNA, 18 bp, Homo sapiens
agggtttcgactggtcca

SEQ ID NO: 1749356 - DNA, 16 bp, Homo sapiens
agggtttgagagcccg

SEQ ID NO: 1749357 - DNA, 15 bp, Homo sapiens
agggttttctcataa

SEQ ID NO: 1749358 - DNA, 13 bp, Homo sapiens
agggttttctttt

SEQ ID NO: 1749359 - DNA, 15 bp, Homo sapiens
agggttttgcaataa

SEQ ID NO: 1749360 - DNA, 11 bp, Homo sapiens
agggttttgta

SEQ ID NO: 1749361 - DNA, 17 bp, Homo sapiens
aggtaaaacaactacat

SEQ ID NO: 1749362 - DNA, 14 bp, Homo sapiens
aggtaaaacagggc

SEQ ID NO: 1749363 - DNA, 19 bp, Homo sapiens
aggtaaaattgaaaggcat

SEQ ID NO: 1749364 - DNA, 23 bp, Homo sapiens
aggtaaatctagagtttatacag

SEQ ID NO: 1749365 - DNA, 23 bp, Homo sapiens
aggtaacaagatgagaacagata

SEQ ID NO: 1749366 - DNA, 14 bp, Homo sapiens
aggtaattattgct

SEQ ID NO: 1749367 - DNA, 20 bp, Homo sapiens
aggtaattgttttttaaagc

SEQ ID NO: 1749368 - DNA, 14 bp, Homo sapiens
aggtacaaaatctt

SEQ ID NO: 1749369 - DNA, 15 bp, Homo sapiens
aggtacaaaatcttg

SEQ ID NO: 1749370 - DNA, 14 bp, Homo sapiens
aggtacagaaaaca

SEQ ID NO: 1749371 - DNA, 18 bp, Homo sapiens
aggtacaggagaggcagc

SEQ ID NO: 1749372 - DNA, 22 bp, Homo sapiens
aggtaccaaacaaggaagccaa

SEQ ID NO: 1749373 - DNA, 16 bp, Homo sapiens
aggtaccagctgcgct

SEQ ID NO: 1749374 - DNA, 23 bp, Homo sapiens
aggtaccagctgcgcttgctttt

SEQ ID NO: 1749375 - DNA, 17 bp, Homo sapiens
aggtacccctttctggc

SEQ ID NO: 1749376 - DNA, 12 bp, Homo sapiens
aggtaccctggg

SEQ ID NO: 1749377 - DNA, 15 bp, Homo sapiens
aggtaccgatttctg

SEQ ID NO: 1749378 - DNA, 17 bp, Homo sapiens
aggtaccgatttctgct

SEQ ID NO: 1749379 - DNA, 19 bp, Homo sapiens
aggtacgatgacagtgttc

SEQ ID NO: 1749380 - DNA, 14 bp, Homo sapiens
aggtacggagaaga

SEQ ID NO: 1749381 - DNA, 15 bp, Homo sapiens
aggtactaaatacct

SEQ ID NO: 1749382 - DNA, 15 bp, Homo sapiens
aggtactatatttgc

SEQ ID NO: 1749383 - DNA, 16 bp, Homo sapiens
aggtactggtcccttc

SEQ ID NO: 1749384 - DNA, 19 bp, Homo sapiens
aggtactggtcccttcctt

SEQ ID NO: 1749385 - DNA, 16 bp, Homo sapiens
aggtacttcctcctga

SEQ ID NO: 1749386 - DNA, 12 bp, Homo sapiens
aggtagaaactt

SEQ ID NO: 1749387 - DNA, 12 bp, Homo sapiens
aggtagagaaac

SEQ ID NO: 1749388 - DNA, 15 bp, Homo sapiens
aggtagcccagcact

SEQ ID NO: 1749389 - DNA, 16 bp, Homo sapiens
aggtagcccagcactg

SEQ ID NO: 1749390 - DNA, 21 bp, Homo sapiens
aggtagcccagcactgtgaag

SEQ ID NO: 1749391 - DNA, 22 bp, Homo sapiens
aggtagcccagcactgtgaaga

SEQ ID NO: 1749392 - DNA, 23 bp, Homo sapiens
aggtagcccagcactgtgaagac

SEQ ID NO: 1749393 - DNA, 21 bp, Homo sapiens
aggtagccgagtcacacccgg

SEQ ID NO: 1749394 - DNA, 13 bp, Homo sapiens
aggtagcttcagc

SEQ ID NO: 1749395 - DNA, 18 bp, Homo sapiens
aggtaggaagcaacagct

SEQ ID NO: 1749396 - DNA, 12 bp, Homo sapiens
aggtaggccctt

SEQ ID NO: 1749397 - DNA, 17 bp, Homo sapiens
aggtaggcccttgtcct

SEQ ID NO: 1749398 - DNA, 18 bp, Homo sapiens
aggtaggcccttgtcctg

SEQ ID NO: 1749399 - DNA, 21 bp, Homo sapiens
aggtaggcccttgtcctgcca

SEQ ID NO: 1749400 - DNA, 18 bp, Homo sapiens
aggtaggggccgtgtccc

SEQ ID NO: 1749401 - DNA, 20 bp, Homo sapiens
aggtaggtggatcacctgag

SEQ ID NO: 1749402 - DNA, 18 bp, Homo sapiens
aggtagtattacaccacc

SEQ ID NO: 1749403 - DNA, 21 bp, Homo sapiens
aggtatactttagtagacatt

SEQ ID NO: 1749404 - DNA, 15 bp, Homo sapiens
aggtatatcattcta

SEQ ID NO: 1749405 - DNA, 20 bp, Homo sapiens
aggtatatcattctaaagat

SEQ ID NO: 1749406 - DNA, 21 bp, Homo sapiens
aggtatatcattctaaagata

SEQ ID NO: 1749407 - DNA, 17 bp, Homo sapiens
aggtatgcaatcaaatc

SEQ ID NO: 1749408 - DNA, 18 bp, Homo sapiens
aggtatggcagaggtgca

SEQ ID NO: 1749409 - DNA, 19 bp, Homo sapiens
aggtattaaaactaaattt

SEQ ID NO: 1749410 - DNA, 15 bp, Homo sapiens
aggtattagcaaagc

SEQ ID NO: 1749411 - DNA, 13 bp, Homo sapiens
aggtattatacat

SEQ ID NO: 1749412 - DNA, 14 bp, Homo sapiens
aggtatttctccag

SEQ ID NO: 1749413 - DNA, 17 bp, Homo sapiens
aggtattttgaatacca

SEQ ID NO: 1749414 - DNA, 18 bp, Homo sapiens
aggtattttgtagatgtg

SEQ ID NO: 1749415 - DNA, 14 bp, Homo sapiens
aggtcaagcccaga

SEQ ID NO: 1749416 - DNA, 13 bp, Homo sapiens
aggtcaataacac

SEQ ID NO: 1749417 - DNA, 15 bp, Homo sapiens
aggtcacataaaact

SEQ ID NO: 1749418 - DNA, 12 bp, Homo sapiens
aggtcaccagct

SEQ ID NO: 1749419 - DNA, 21 bp, Homo sapiens
aggtcaccagctgctgtgccc

SEQ ID NO: 1749420 - DNA, 15 bp, Homo sapiens
aggtcaccctttgct

SEQ ID NO: 1749421 - DNA, 15 bp, Homo sapiens
aggtcactcctgggg

SEQ ID NO: 1749422 - DNA, 19 bp, Homo sapiens
aggtcactcctggggcctc

SEQ ID NO: 1749423 - DNA, 16 bp, Homo sapiens
aggtcactggaaaggg

SEQ ID NO: 1749424 - DNA, 20 bp, Homo sapiens
aggtcactggaaaggggaga

SEQ ID NO: 1749425 - DNA, 16 bp, Homo sapiens
aggtcactggctctcc

SEQ ID NO: 1749426 - DNA, 18 bp, Homo sapiens
aggtcactggctctccaa

SEQ ID NO: 1749427 - DNA, 18 bp, Homo sapiens
aggtcactgtcactgccg

SEQ ID NO: 1749428 - DNA, 19 bp, Homo sapiens
aggtcactgtcactgccga

SEQ ID NO: 1749429 - DNA, 12 bp, Homo sapiens
aggtcagagatg

SEQ ID NO: 1749430 - DNA, 15 bp, Homo sapiens
aggtcagcatgtcta

SEQ ID NO: 1749431 - DNA, 14 bp, Homo sapiens
aggtcagcctggaa

SEQ ID NO: 1749432 - DNA, 22 bp, Homo sapiens
aggtcaggagttcaagaccagc

SEQ ID NO: 1749433 - DNA, 15 bp, Homo sapiens
aggtcaggagttcct

SEQ ID NO: 1749434 - DNA, 18 bp, Homo sapiens
aggtcaggagttgtgtct

SEQ ID NO: 1749435 - DNA, 23 bp, Homo sapiens
aggtcaggatgcacatttctgga

SEQ ID NO: 1749436 - DNA, 17 bp, Homo sapiens
aggtcatcagatgcctg

SEQ ID NO: 1749437 - DNA, 21 bp, Homo sapiens
aggtcatcagatgcctgcttg

SEQ ID NO: 1749438 - DNA, 21 bp, Homo sapiens
aggtccaaatgtttatgtttt

SEQ ID NO: 1749439 - DNA, 17 bp, Homo sapiens
aggtccaacaagaatgc

SEQ ID NO: 1749440 - DNA, 14 bp, Homo sapiens
aggtccaagatacc

SEQ ID NO: 1749441 - DNA, 13 bp, Homo sapiens
aggtccaagggcc

SEQ ID NO: 1749442 - DNA, 14 bp, Homo sapiens
aggtccaagggcca

SEQ ID NO: 1749443 - DNA, 15 bp, Homo sapiens
aggtccaagggccat

SEQ ID NO: 1749444 - DNA, 15 bp, Homo sapiens
aggtccagacccact

SEQ ID NO: 1749445 - DNA, 16 bp, Homo sapiens
aggtccagctctggag

SEQ ID NO: 1749446 - DNA, 18 bp, Homo sapiens
aggtccagctctggaggg

SEQ ID NO: 1749447 - DNA, 18 bp, Homo sapiens
aggtccagctgggcctcc

SEQ ID NO: 1749448 - DNA, 22 bp, Homo sapiens
aggtccagctgggcctcctgcc

SEQ ID NO: 1749449 - DNA, 19 bp, Homo sapiens
aggtccattcattaattag

SEQ ID NO: 1749450 - DNA, 13 bp, Homo sapiens
aggtcccccgact

SEQ ID NO: 1749451 - DNA, 17 bp, Homo sapiens
aggtcccggccagctct

SEQ ID NO: 1749452 - DNA, 13 bp, Homo sapiens
aggtcctaaggca

SEQ ID NO: 1749453 - DNA, 22 bp, Homo sapiens
aggtcctccgtagggtctttct

SEQ ID NO: 1749454 - DNA, 21 bp, Homo sapiens
aggtcctctacttaatgagat

SEQ ID NO: 1749455 - DNA, 13 bp, Homo sapiens
aggtcctctcagt

SEQ ID NO: 1749456 - DNA, 22 bp, Homo sapiens
aggtcctgctccgctgcctgga

SEQ ID NO: 1749457 - DNA, 23 bp, Homo sapiens
aggtcctggtgggtcagcccagc

SEQ ID NO: 1749458 - DNA, 21 bp, Homo sapiens
aggtcgcagctaccctcagcc

SEQ ID NO: 1749459 - DNA, 14 bp, Homo sapiens
aggtctatttggat

SEQ ID NO: 1749460 - DNA, 14 bp, Homo sapiens
aggtctcatctctt

SEQ ID NO: 1749461 - DNA, 15 bp, Homo sapiens
aggtctcatctcttc

SEQ ID NO: 1749462 - DNA, 16 bp, Homo sapiens
aggtctcatctcttca

SEQ ID NO: 1749463 - DNA, 18 bp, Homo sapiens
aggtctcatgctgttgct

SEQ ID NO: 1749464 - DNA, 21 bp, Homo sapiens
aggtctcatggaccagtggct

SEQ ID NO: 1749465 - DNA, 23 bp, Homo sapiens
aggtctccaagggagggtgcagc

SEQ ID NO: 1749466 - DNA, 20 bp, Homo sapiens
aggtctcctcagggtggggg

SEQ ID NO: 1749467 - DNA, 11 bp, Homo sapiens
aggtctcctct

SEQ ID NO: 1749468 - DNA, 19 bp, Homo sapiens
aggtctccttactctgagc

SEQ ID NO: 1749469 - DNA, 22 bp, Homo sapiens
aggtctccttactctgagccca

SEQ ID NO: 1749470 - DNA, 22 bp, Homo sapiens
aggtttttcctactgtcctcag

SEQ ID NO: 1749471 - DNA, 20 bp, Homo sapiens
aggtttttggaattatgtct

SEQ ID NO: 1749472 - DNA, 15 bp, Homo sapiens
aggtttttgtaaaga

SEQ ID NO: 1749473 - DNA, 22 bp, Homo sapiens
aggtttttttgtatagtaaagt

SEQ ID NO: 1749474 - DNA, 12 bp, Homo sapiens
agtaaaaacact

SEQ ID NO: 1749475 - DNA, 17 bp, Homo sapiens
agtaaaaattaaaaaat

SEQ ID NO: 1749476 - DNA, 16 bp, Homo sapiens
agtaaaaccacagcag

SEQ ID NO: 1749477 - DNA, 20 bp, Homo sapiens
agtaaaaccacagcagttga

SEQ ID NO: 1749478 - DNA, 14 bp, Homo sapiens
agtaaaacttgctg

SEQ ID NO: 1749479 - DNA, 22 bp, Homo sapiens
agtaaaagccttattctaaggt

SEQ ID NO: 1749480 - DNA, 20 bp, Homo sapiens
agtaaaatactattgcctca

SEQ ID NO: 1749481 - DNA, 12 bp, Homo sapiens
agtaaaattcag

SEQ ID NO: 1749482 - DNA, 18 bp, Homo sapiens
agtaaaattcagtttttt

SEQ ID NO: 1749483 - DNA, 14 bp, Homo sapiens
agtaaactttttgt

SEQ ID NO: 1749484 - DNA, 18 bp, Homo sapiens
agtaaagccgttgtttac

SEQ ID NO: 1749485 - DNA, 12 bp, Homo sapiens
agtaaaggagga

SEQ ID NO: 1749486 - DNA, 20 bp, Homo sapiens
agtaaaggcctcatctcctt

SEQ ID NO: 1749487 - DNA, 22 bp, Homo sapiens
agtaaaggcctcatctccttta

SEQ ID NO: 1749488 - DNA, 18 bp, Homo sapiens
agtaaagtgataatttct

SEQ ID NO: 1749489 - DNA, 13 bp, Homo sapiens
agtaaagtgctta

SEQ ID NO: 1749490 - DNA, 18 bp, Homo sapiens
agtaaagtgttctgccag

SEQ ID NO: 1749491 - DNA, 17 bp, Homo sapiens
agtaaataaaattaaca

SEQ ID NO: 1749492 - DNA, 17 bp, Homo sapiens
agtaaatatatatgtca

SEQ ID NO: 1749493 - DNA, 18 bp, Homo sapiens
agtaaatatatatgtcaa

SEQ ID NO: 1749494 - DNA, 22 bp, Homo sapiens
agtaaatgctaggttaattcca

SEQ ID NO: 1749495 - DNA, 17 bp, Homo sapiens
agtaacaatctatggct

SEQ ID NO: 1749496 - DNA, 13 bp, Homo sapiens
agtaacactaata

SEQ ID NO: 1749497 - DNA, 16 bp, Homo sapiens
agtaacatttctgttc

SEQ ID NO: 1749498 - DNA, 19 bp, Homo sapiens
agtaacatttctgttctca

SEQ ID NO: 1749499 - DNA, 21 bp, Homo sapiens
agtaacccccttaaatttaat

SEQ ID NO: 1749500 - DNA, 19 bp, Homo sapiens
agtaacccctcctggctgt

SEQ ID NO: 1749501 - DNA, 19 bp, Homo sapiens
agtaactaattttgttgaa

SEQ ID NO: 1749502 - DNA, 19 bp, Homo sapiens
agtaactactttttatact

SEQ ID NO: 1749503 - DNA, 14 bp, Homo sapiens
agtaactgacaact

SEQ ID NO: 1749504 - DNA, 17 bp, Homo sapiens
agtaactggttgctgtg

SEQ ID NO: 1749505 - DNA, 18 bp, Homo sapiens
agtaactggttgctgtgt

SEQ ID NO: 1749506 - DNA, 11 bp, Homo sapiens
agtaactgttt

SEQ ID NO: 1749507 - DNA, 17 bp, Homo sapiens
agtaactgttttttaag

SEQ ID NO: 1749508 - DNA, 23 bp, Homo sapiens
agtaactgttttttaagtctctc

SEQ ID NO: 1749509 - DNA, 16 bp, Homo sapiens
agtaacttatttgact

SEQ ID NO: 1749510 - DNA, 22 bp, Homo sapiens
agtaacttatttgactatgaat

SEQ ID NO: 1749511 - DNA, 14 bp, Homo sapiens
agtaacttgggagt

SEQ ID NO: 1749512 - DNA, 21 bp, Homo sapiens
agtaacttttttgtgtatgta

SEQ ID NO: 1749513 - DNA, 13 bp, Homo sapiens
agtaagaaaagtg

SEQ ID NO: 1749514 - DNA, 21 bp, Homo sapiens
agtaagaaagtgaagcaaatc

SEQ ID NO: 1749515 - DNA, 17 bp, Homo sapiens
agtaagaaatttgcagt

SEQ ID NO: 1749516 - DNA, 15 bp, Homo sapiens
agtaagaagaggagc

SEQ ID NO: 1749517 - DNA, 15 bp, Homo sapiens
agtaagaatggccaa

SEQ ID NO: 1749518 - DNA, 12 bp, Homo sapiens
agtaagagctgg

SEQ ID NO: 1749519 - DNA, 19 bp, Homo sapiens
agtaagagctggtgtctga

SEQ ID NO: 1749520 - DNA, 14 bp, Homo sapiens
agtaagatatctca

SEQ ID NO: 1749521 - DNA, 16 bp, Homo sapiens
agtaagatgcactgaa

SEQ ID NO: 1749522 - DNA, 12 bp, Homo sapiens
agtaagattgat

SEQ ID NO: 1749523 - DNA, 22 bp, Homo sapiens
agtaagattgatatctataaaa

SEQ ID NO: 1749524 - DNA, 18 bp, Homo sapiens
agtaagctgctctattgt

SEQ ID NO: 1749525 - DNA, 21 bp, Homo sapiens
agtaaggctggtaagagaagt

SEQ ID NO: 1749526 - DNA, 20 bp, Homo sapiens
agtaagtaccactcaggcca

SEQ ID NO: 1749527 - DNA, 14 bp, Homo sapiens
agtaagtatttcca

SEQ ID NO: 1749528 - DNA, 15 bp, Homo sapiens
agtaagtatttccat

SEQ ID NO: 1749529 - DNA, 17 bp, Homo sapiens
agtaagtgtgtcttcct

SEQ ID NO: 1749530 - DNA, 16 bp, Homo sapiens
agtaataaactgtgtt

SEQ ID NO: 1749531 - DNA, 22 bp, Homo sapiens
agtaataccaaagactatttca

SEQ ID NO: 1749532 - DNA, 13 bp, Homo sapiens
agtaatagagcaa

SEQ ID NO: 1749533 - DNA, 14 bp, Homo sapiens
agtaatcaggcagc

SEQ ID NO: 1749534 - DNA, 16 bp, Homo sapiens
agtaatcaggcagcct

SEQ ID NO: 1749535 - DNA, 17 bp, Homo sapiens
agtaatcaggcagcctt

SEQ ID NO: 1749536 - DNA, 15 bp, Homo sapiens
agtaatctttaaact

SEQ ID NO: 1749537 - DNA, 22 bp, Homo sapiens
agtaatgacgtgtgtggctggg

SEQ ID NO: 1749538 - DNA, 22 bp, Homo sapiens
agtaatgatactgtgtgttttc

SEQ ID NO: 1749539 - DNA, 16 bp, Homo sapiens
agtaatgatttcttga

SEQ ID NO: 1749540 - DNA, 15 bp, Homo sapiens
agtaatggtgtagaa

SEQ ID NO: 1749541 - DNA, 15 bp, Homo sapiens
agtaatgtaaagatg

SEQ ID NO: 1749542 - DNA, 14 bp, Homo sapiens
agtaatgtttttta

SEQ ID NO: 1749543 - DNA, 17 bp, Homo sapiens
agtaatgttttttagaa

SEQ ID NO: 1749544 - DNA, 13 bp, Homo sapiens
agtaattatcggg

SEQ ID NO: 1749545 - DNA, 12 bp, Homo sapiens
agtaattgtgaa

SEQ ID NO: 1749546 - DNA, 16 bp, Homo sapiens
agtaattgtgaaaaag

SEQ ID NO: 1749547 - DNA, 23 bp, Homo sapiens
agtaatttattgtttttccttgt

SEQ ID NO: 1749548 - DNA, 14 bp, Homo sapiens
agtaatttcagtgt

SEQ ID NO: 1749549 - DNA, 14 bp, Homo sapiens
agtaatttcattta

SEQ ID NO: 1749550 - DNA, 14 bp, Homo sapiens
agtaatttcttttt

SEQ ID NO: 1749551 - DNA, 20 bp, Homo sapiens
agtacaataatgtactcaca

SEQ ID NO: 1749552 - DNA, 21 bp, Homo sapiens
agtacaataatgtactcacat

SEQ ID NO: 1749553 - DNA, 17 bp, Homo sapiens
agtacaatgaactgctt

SEQ ID NO: 1749554 - DNA, 21 bp, Homo sapiens
agtacaatgaactgcttttcc

SEQ ID NO: 1749555 - DNA, 16 bp, Homo sapiens
agtacacaccagaaga

SEQ ID NO: 1749556 - DNA, 14 bp, Homo sapiens
agtacagaaggcaa

SEQ ID NO: 1749557 - DNA, 17 bp, Homo sapiens
agtacagaatttgaatt

SEQ ID NO: 1749558 - DNA, 14 bp, Homo sapiens
agtacagatactgt

SEQ ID NO: 1749559 - DNA, 16 bp, Homo sapiens
agtacagatactgtga

SEQ ID NO: 1749560 - DNA, 20 bp, Homo sapiens
agtacagtgaggagggtgga

SEQ ID NO: 1749561 - DNA, 11 bp, Homo sapiens
agtacatatgt

SEQ ID NO: 1749562 - DNA, 17 bp, Homo sapiens
agtacatattaggaaaa

SEQ ID NO: 1749563 - DNA, 18 bp, Homo sapiens
agtacatattaggaaaat

SEQ ID NO: 1749564 - DNA, 13 bp, Homo sapiens
agtacatttaata

SEQ ID NO: 1749565 - DNA, 16 bp, Homo sapiens
agtacatttgctttaa

SEQ ID NO: 1749566 - DNA, 16 bp, Homo sapiens
agtaccaatcatttta

SEQ ID NO: 1749567 - DNA, 14 bp, Homo sapiens
agtaccaatgctgt

SEQ ID NO: 1749568 - DNA, 14 bp, Homo sapiens
agtacccagggcca

SEQ ID NO: 1749569 - DNA, 15 bp, Homo sapiens
agtacctccaagcaa

SEQ ID NO: 1749570 - DNA, 15 bp, Homo sapiens
agtacctgctgcccc

SEQ ID NO: 1749571 - DNA, 12 bp, Homo sapiens
agtaccttgctt

SEQ ID NO: 1749572 - DNA, 13 bp, Homo sapiens
agtaccttgcttc

SEQ ID NO: 1749573 - DNA, 14 bp, Homo sapiens
agtaccttgcttct

SEQ ID NO: 1749574 - DNA, 12 bp, Homo sapiens
agtacctttgga

SEQ ID NO: 1749575 - DNA, 15 bp, Homo sapiens
agtacctttgtcaca

SEQ ID NO: 1749576 - DNA, 16 bp, Homo sapiens
agtacgaacctacagt

SEQ ID NO: 1749577 - DNA, 16 bp, Homo sapiens
agtacgatcaagttgt

SEQ ID NO: 1749578 - DNA, 13 bp, Homo sapiens
agtactaaaatta

SEQ ID NO: 1749579 - DNA, 14 bp, Homo sapiens
agtactaaaattaa

SEQ ID NO: 1749580 - DNA, 14 bp, Homo sapiens
agtactaagcattt

SEQ ID NO: 1749581 - DNA, 14 bp, Homo sapiens
agtactatgtatca

SEQ ID NO: 1749582 - DNA, 15 bp, Homo sapiens
agtactatttcttaa

SEQ ID NO: 1749583 - DNA, 15 bp, Homo sapiens
agtactcaatgtttc

SEQ ID NO: 1749584 - DNA, 11 bp, Homo sapiens
agtactcactt

SEQ ID NO: 1749585 - DNA, 18 bp, Homo sapiens
agtactccttaagaacac

SEQ ID NO: 1749586 - DNA, 13 bp, Homo sapiens
agtcattcagcag

SEQ ID NO: 1749587 - DNA, 13 bp, Homo sapiens
agtcattgtatgt

SEQ ID NO: 1749588 - DNA, 19 bp, Homo sapiens
agtcatttgctgagcatgt

SEQ ID NO: 1749589 - DNA, 19 bp, Homo sapiens
agtcattttaactttatca

SEQ ID NO: 1749590 - DNA, 21 bp, Homo sapiens
agtcattttgtgttgaagagc

SEQ ID NO: 1749591 - DNA, 16 bp, Homo sapiens
agtccaaggtttaaag

SEQ ID NO: 1749592 - DNA, 14 bp, Homo sapiens
agtccacaggggcc

SEQ ID NO: 1749593 - DNA, 11 bp, Homo sapiens
agtccagacac

SEQ ID NO: 1749594 - DNA, 12 bp, Homo sapiens
agtccagattgt

SEQ ID NO: 1749595 - DNA, 12 bp, Homo sapiens
agtccagccagc

SEQ ID NO: 1749596 - DNA, 16 bp, Homo sapiens
agtccagccagctcct

SEQ ID NO: 1749597 - DNA, 22 bp, Homo sapiens
agtccaggactgggtctgacct

SEQ ID NO: 1749598 - DNA, 15 bp, Homo sapiens
agtccagtctcttct

SEQ ID NO: 1749599 - DNA, 18 bp, Homo sapiens
agtccatgctccagggtc

SEQ ID NO: 1749600 - DNA, 20 bp, Homo sapiens
agtccatgctccagggtcag

SEQ ID NO: 1749601 - DNA, 14 bp, Homo sapiens
agtccattctccca

SEQ ID NO: 1749602 - DNA, 17 bp, Homo sapiens
agtccattctcccaggt

SEQ ID NO: 1749603 - DNA, 19 bp, Homo sapiens
agtccatttcccacatctt

SEQ ID NO: 1749604 - DNA, 20 bp, Homo sapiens
agtccatttcccacatcttt

SEQ ID NO: 1749605 - DNA, 21 bp, Homo sapiens
agtcccacaccgctggtccct

SEQ ID NO: 1749606 - DNA, 20 bp, Homo sapiens
agtcccagagcacctcacct

SEQ ID NO: 1749607 - DNA, 23 bp, Homo sapiens
agtcccagagcaggaggcccctg

SEQ ID NO: 1749608 - DNA, 18 bp, Homo sapiens
agtcccagagctcatccc

SEQ ID NO: 1749609 - DNA, 20 bp, Homo sapiens
agtcccaggagctgcccaga

SEQ ID NO: 1749610 - DNA, 18 bp, Homo sapiens
agtcccatttttctcttg

SEQ ID NO: 1749611 - DNA, 16 bp, Homo sapiens
agtccccaaggcctct

SEQ ID NO: 1749612 - DNA, 18 bp, Homo sapiens
agtccccaaggcctctct

SEQ ID NO: 1749613 - DNA, 12 bp, Homo sapiens
agtccccacccc

SEQ ID NO: 1749614 - DNA, 18 bp, Homo sapiens
agtccccacccctgcccc

SEQ ID NO: 1749615 - DNA, 13 bp, Homo sapiens
agtccccacccgc

SEQ ID NO: 1749616 - DNA, 15 bp, Homo sapiens
agtccccgctagtgg

SEQ ID NO: 1749617 - DNA, 20 bp, Homo sapiens
agtccccgtgccccgcctcc

SEQ ID NO: 1749618 - DNA, 14 bp, Homo sapiens
agtcccctccagga

SEQ ID NO: 1749619 - DNA, 13 bp, Homo sapiens
agtcccctctctc

SEQ ID NO: 1749620 - DNA, 23 bp, Homo sapiens
agtcccctgttgattatcttcag

SEQ ID NO: 1749621 - DNA, 14 bp, Homo sapiens
agtccccttctgtg

SEQ ID NO: 1749622 - DNA, 13 bp, Homo sapiens
agtcccgtcagga

SEQ ID NO: 1749623 - DNA, 15 bp, Homo sapiens
agtccctatgtattt

SEQ ID NO: 1749624 - DNA, 21 bp, Homo sapiens
agtccctgactctctgtgacc

SEQ ID NO: 1749625 - DNA, 19 bp, Homo sapiens
agtccctgcacagtgactt

SEQ ID NO: 1749626 - DNA, 21 bp, Homo sapiens
agtccctgccacactcagtcc

SEQ ID NO: 1749627 - DNA, 17 bp, Homo sapiens
agtccctggagctgtcc

SEQ ID NO: 1749628 - DNA, 14 bp, Homo sapiens
agtccctgggggaa

SEQ ID NO: 1749629 - DNA, 17 bp, Homo sapiens
agtccctgggggaagcc

SEQ ID NO: 1749630 - DNA, 16 bp, Homo sapiens
agtccctggttcattg

SEQ ID NO: 1749631 - DNA, 22 bp, Homo sapiens
agtccctgtgatggccaggcca

SEQ ID NO: 1749632 - DNA, 21 bp, Homo sapiens
agtccctgttttctgagcccg

SEQ ID NO: 1749633 - DNA, 22 bp, Homo sapiens
agtccctgttttctgagcccgg

SEQ ID NO: 1749634 - DNA, 17 bp, Homo sapiens
agtcccttcccctccct

SEQ ID NO: 1749635 - DNA, 22 bp, Homo sapiens
agtccggatttctaacagtcct

SEQ ID NO: 1749636 - DNA, 13 bp, Homo sapiens
agtccgtgggacg

SEQ ID NO: 1749637 - DNA, 23 bp, Homo sapiens
agtccgtgggacgggatggttct

SEQ ID NO: 1749638 - DNA, 21 bp, Homo sapiens
agtcctaattcaatcctactt

SEQ ID NO: 1749639 - DNA, 16 bp, Homo sapiens
agtcctatggaaaaaa

SEQ ID NO: 1749640 - DNA, 16 bp, Homo sapiens
agtcctcactcccagt

SEQ ID NO: 1749641 - DNA, 19 bp, Homo sapiens
agtcctcaggaagggggcc

SEQ ID NO: 1749642 - DNA, 14 bp, Homo sapiens
agtcctcattataa

SEQ ID NO: 1749643 - DNA, 16 bp, Homo sapiens
agtcctccactcgacc

SEQ ID NO: 1749644 - DNA, 16 bp, Homo sapiens
agtcctccctcctgca

SEQ ID NO: 1749645 - DNA, 20 bp, Homo sapiens
agtcctccctcctgcaggct

SEQ ID NO: 1749646 - DNA, 13 bp, Homo sapiens
agtcctctgctcc

SEQ ID NO: 1749647 - DNA, 13 bp, Homo sapiens
agtcctgaagagg

SEQ ID NO: 1749648 - DNA, 15 bp, Homo sapiens
agtcctgctacctcc

SEQ ID NO: 1749649 - DNA, 14 bp, Homo sapiens
agtcctggaagcca

SEQ ID NO: 1749650 - DNA, 23 bp, Homo sapiens
agtcctggaagccagctttccct

SEQ ID NO: 1749651 - DNA, 22 bp, Homo sapiens
agtcctgggagaacctcaggct

SEQ ID NO: 1749652 - DNA, 12 bp, Homo sapiens
agtcctggtcct

SEQ ID NO: 1749653 - DNA, 19 bp, Homo sapiens
agtcctggtcctggctgca

SEQ ID NO: 1749654 - DNA, 21 bp, Homo sapiens
agtcctggtggggctgagcct

SEQ ID NO: 1749655 - DNA, 17 bp, Homo sapiens
agtcctggtttcctggc

SEQ ID NO: 1749656 - DNA, 20 bp, Homo sapiens
agtcctgtgaatgccactgc

SEQ ID NO: 1749657 - DNA, 21 bp, Homo sapiens
agtcctgtgaatgccactgcc

SEQ ID NO: 1749658 - DNA, 24 bp, Homo sapiens
agtccttaaaatgtaagattatag

SEQ ID NO: 1749659 - DNA, 20 bp, Homo sapiens
agtccttactgtctcactcg

SEQ ID NO: 1749660 - DNA, 14 bp, Homo sapiens
agtccttccacctg

SEQ ID NO: 1749661 - DNA, 17 bp, Homo sapiens
agtccttgaaaatattt

SEQ ID NO: 1749662 - DNA, 23 bp, Homo sapiens
agtccttgctgtgggatgtgcca

SEQ ID NO: 1749663 - DNA, 14 bp, Homo sapiens
agtccttgtcttgt

SEQ ID NO: 1749664 - DNA, 20 bp, Homo sapiens
agtcctttcccaccattcct

SEQ ID NO: 1749665 - DNA, 12 bp, Homo sapiens
agtcgaccccaa

SEQ ID NO: 1749666 - DNA, 17 bp, Homo sapiens
agtcgcaggatccgctg

SEQ ID NO: 1749667 - DNA, 20 bp, Homo sapiens
agtcgcaggatccgctgcca

SEQ ID NO: 1749668 - DNA, 14 bp, Homo sapiens
agtcggtctgcttt

SEQ ID NO: 1749669 - DNA, 18 bp, Homo sapiens
agtcgtacagaaagctgc

SEQ ID NO: 1749670 - DNA, 12 bp, Homo sapiens
agtcgtgcctgt

SEQ ID NO: 1749671 - DNA, 21 bp, Homo sapiens
agtcgtggctttggcagtgtt

SEQ ID NO: 1749672 - DNA, 21 bp, Homo sapiens
agtcgtggggtgtgctgggag

SEQ ID NO: 1749673 - DNA, 16 bp, Homo sapiens
agtcgttttagtgtct

SEQ ID NO: 1749674 - DNA, 22 bp, Homo sapiens
agtctaaagatggagtttctaa

SEQ ID NO: 1749675 - DNA, 17 bp, Homo sapiens
agtctaaatatttcctt

SEQ ID NO: 1749676 - DNA, 14 bp, Homo sapiens
agtctaagcaagat

SEQ ID NO: 1749677 - DNA, 17 bp, Homo sapiens
agtctaagcaagatgtt

SEQ ID NO: 1749678 - DNA, 14 bp, Homo sapiens
agtctaatgaagag

SEQ ID NO: 1749679 - DNA, 14 bp, Homo sapiens
agtctagaagttgt

SEQ ID NO: 1749680 - DNA, 16 bp, Homo sapiens
agtctagacacaattt

SEQ ID NO: 1749681 - DNA, 13 bp, Homo sapiens
agtctagattctc

SEQ ID NO: 1749682 - DNA, 16 bp, Homo sapiens
agtctagattctctgg

SEQ ID NO: 1749683 - DNA, 22 bp, Homo sapiens
agtctagttcctgatgacccag

SEQ ID NO: 1749684 - DNA, 19 bp, Homo sapiens
agtctatatggttctccaa

SEQ ID NO: 1749685 - DNA, 22 bp, Homo sapiens
agtctatatggttctccaagaa

SEQ ID NO: 1749686 - DNA, 21 bp, Homo sapiens
agtctatcctagtcttcacaa

SEQ ID NO: 1749687 - DNA, 14 bp, Homo sapiens
agtctattagccac

SEQ ID NO: 1749688 - DNA, 20 bp, Homo sapiens
agtctcaaaggtaattctga

SEQ ID NO: 1749689 - DNA, 16 bp, Homo sapiens
agtctcaagggtggca

SEQ ID NO: 1749690 - DNA, 19 bp, Homo sapiens
agtctcaagggtggcaggt

SEQ ID NO: 1749691 - DNA, 14 bp, Homo sapiens
agtctcacagagaa

SEQ ID NO: 1749692 - DNA, 13 bp, Homo sapiens
agtctcagaagag

SEQ ID NO: 1749693 - DNA, 19 bp, Homo sapiens
agtctcagagaccagcact

SEQ ID NO: 1749694 - DNA, 12 bp, Homo sapiens
agtctcagagca

SEQ ID NO: 1749695 - DNA, 15 bp, Homo sapiens
agtctcagctgctga

SEQ ID NO: 1749696 - DNA, 16 bp, Homo sapiens
agtctcagctgctgaa

SEQ ID NO: 1749697 - DNA, 17 bp, Homo sapiens
agtctcaggagcatggg

SEQ ID NO: 1749698 - DNA, 20 bp, Homo sapiens
agtctcagtttgtgtgtctt

SEQ ID NO: 1749699 - DNA, 22 bp, Homo sapiens
agtctccaacatgtttctgttt

SEQ ID NO: 1749700 - DNA, 12 bp, Homo sapiens
agtctccagggc

SEQ ID NO: 1749701 - DNA, 13 bp, Homo sapiens
agtctccctgcac

SEQ ID NO: 1749702 - DNA, 18 bp, Homo sapiens
agtctccctgcacagcct

SEQ ID NO: 1749703 - DNA, 14 bp, Homo sapiens
agtctcctctctga

SEQ ID NO: 1749704 - DNA, 18 bp, Homo sapiens
agtctcctttgcactgag

SEQ ID NO: 1749705 - DNA, 19 bp, Homo sapiens
agtctcctttgcactgagg

SEQ ID NO: 1749706 - DNA, 22 bp, Homo sapiens
agtctcctttgcactgagggcc

SEQ ID NO: 1749707 - DNA, 15 bp, Homo sapiens
agtctcgaatgtaat

SEQ ID NO: 1749708 - DNA, 21 bp, Homo sapiens
agtctctataccaataaagtg

SEQ ID NO: 1749709 - DNA, 16 bp, Homo sapiens
agtctctatattatgt

SEQ ID NO: 1749710 - DNA, 23 bp, Homo sapiens
agtctctatattatgtcttcttt

SEQ ID NO: 1749711 - DNA, 15 bp, Homo sapiens
agtctctcttctctc

SEQ ID NO: 1749712 - DNA, 23 bp, Homo sapiens
agtctctgatttgcaaatgcaca

SEQ ID NO: 1749713 - DNA, 20 bp, Homo sapiens
agtctctggaaaagctgggg

SEQ ID NO: 1749714 - DNA, 11 bp, Homo sapiens
agtctctgtga

SEQ ID NO: 1749715 - DNA, 12 bp, Homo sapiens
agtctctgtgaa

SEQ ID NO: 1749716 - DNA, 13 bp, Homo sapiens
agtctcttctcca

SEQ ID NO: 1749717 - DNA, 16 bp, Homo sapiens
agtctcttctccactg

SEQ ID NO: 1749718 - DNA, 21 bp, Homo sapiens
agtctcttctccactggatgg

SEQ ID NO: 1749719 - DNA, 23 bp, Homo sapiens
agtctctttaatcttcagtttta

SEQ ID NO: 1749720 - DNA, 17 bp, Homo sapiens
agtctgaacccttgtgc

SEQ ID NO: 1749721 - DNA, 19 bp, Homo sapiens
agtctgaacccttgtgctt

SEQ ID NO: 1749722 - DNA, 16 bp, Homo sapiens
agtctgaatgctgcca

SEQ ID NO: 1749723 - DNA, 14 bp, Homo sapiens
agtctgattttaat

SEQ ID NO: 1749724 - DNA, 22 bp, Homo sapiens
agtctgcgcccttgtgccctgc

SEQ ID NO: 1749725 - DNA, 13 bp, Homo sapiens
agtctgctccacc

SEQ ID NO: 1749726 - DNA, 18 bp, Homo sapiens
agtctggaaaacagaaac

SEQ ID NO: 1749727 - DNA, 20 bp, Homo sapiens
agtctggtttctagacttgt

SEQ ID NO: 1749728 - DNA, 23 bp, Homo sapiens
agtctgtcatgaacatgttcctg

SEQ ID NO: 1749729 - DNA, 15 bp, Homo sapiens
agtctgtcctgtgac

SEQ ID NO: 1749730 - DNA, 16 bp, Homo sapiens
agtctgtcctgtgacg

SEQ ID NO: 1749731 - DNA, 15 bp, Homo sapiens
agtctgtctactgtg

SEQ ID NO: 1749732 - DNA, 16 bp, Homo sapiens
agtctgtctactgtgg

SEQ ID NO: 1749733 - DNA, 14 bp, Homo sapiens
agtctgtggatcag

SEQ ID NO: 1749734 - DNA, 22 bp, Homo sapiens
agtctgtggctttttgttcaga

SEQ ID NO: 1749735 - DNA, 12 bp, Homo sapiens
agtctgtgtgaa

SEQ ID NO: 1749736 - DNA, 14 bp, Homo sapiens
agtctgttatgcac

SEQ ID NO: 1749737 - DNA, 12 bp, Homo sapiens
agtcttaacaaa

SEQ ID NO: 1749738 - DNA, 22 bp, Homo sapiens
agtcttaataaaataaactaga

SEQ ID NO: 1749739 - DNA, 18 bp, Homo sapiens
agtcttaatttatttctt

SEQ ID NO: 1749740 - DNA, 13 bp, Homo sapiens
agtcttagatgta

SEQ ID NO: 1749741 - DNA, 16 bp, Homo sapiens
agtcttagatgtatat

SEQ ID NO: 1749742 - DNA, 23 bp, Homo sapiens
agtcttagatgtatatatttcct

SEQ ID NO: 1749743 - DNA, 16 bp, Homo sapiens
agtcttcagacccaga

SEQ ID NO: 1749744 - DNA, 13 bp, Homo sapiens
agtcttccctgat

SEQ ID NO: 1749745 - DNA, 14 bp, Homo sapiens
agtcttctcctcca

SEQ ID NO: 1749746 - DNA, 18 bp, Homo sapiens
agtcttctctctggctca

SEQ ID NO: 1749747 - DNA, 20 bp, Homo sapiens
agtcttctctctggctcagg

SEQ ID NO: 1749748 - DNA, 12 bp, Homo sapiens
agtcttctggat

SEQ ID NO: 1749749 - DNA, 14 bp, Homo sapiens
agtcttgaaatgaa

SEQ ID NO: 1749750 - DNA, 18 bp, Homo sapiens
agtcttgaaatgaaaggg

SEQ ID NO: 1749751 - DNA, 20 bp, Homo sapiens
agtcttgaaatgaaagggaa

SEQ ID NO: 1749752 - DNA, 13 bp, Homo sapiens
agtcttgcctagg

SEQ ID NO: 1749753 - DNA, 18 bp, Homo sapiens
agtcttgcctatattttc

SEQ ID NO: 1749754 - DNA, 23 bp, Homo sapiens
agtcttgctctgttgcccaagct

SEQ ID NO: 1749755 - DNA, 14 bp, Homo sapiens
agtcttgcttacaa

SEQ ID NO: 1749756 - DNA, 16 bp, Homo sapiens
agtcttggaagctgtt

SEQ ID NO: 1749757 - DNA, 22 bp, Homo sapiens
agtcttggaagctgtttggaaa

SEQ ID NO: 1749758 - DNA, 15 bp, Homo sapiens
agtcttggttttatc

SEQ ID NO: 1749759 - DNA, 17 bp, Homo sapiens
agtcttgtcttagctct

SEQ ID NO: 1749760 - DNA, 14 bp, Homo sapiens
agtctttgccttct

SEQ ID NO: 1749761 - DNA, 16 bp, Homo sapiens
agtctttgctcagtgt

SEQ ID NO: 1749762 - DNA, 16 bp, Homo sapiens
agtctttggttctaag

SEQ ID NO: 1749763 - DNA, 18 bp, Homo sapiens
agtctttggttctaagga

SEQ ID NO: 1749764 - DNA, 15 bp, Homo sapiens
agtcttttctgttat

SEQ ID NO: 1749765 - DNA, 18 bp, Homo sapiens
agtcttttctgttattgt

SEQ ID NO: 1749766 - DNA, 18 bp, Homo sapiens
agtctttttataggtttt

SEQ ID NO: 1749767 - DNA, 14 bp, Homo sapiens
agtgaaaaatatgt

SEQ ID NO: 1749768 - DNA, 22 bp, Homo sapiens
agtgaaaaatatgttgagtgtt

SEQ ID NO: 1749769 - DNA, 19 bp, Homo sapiens
agtgaaacctttagggcag

SEQ ID NO: 1749770 - DNA, 22 bp, Homo sapiens
agtgaaacctttagggcagctt

SEQ ID NO: 1749771 - DNA, 22 bp, Homo sapiens
agtgaaagaggcagcttgaaac

SEQ ID NO: 1749772 - DNA, 20 bp, Homo sapiens
agtgaaataattacagaata

SEQ ID NO: 1749773 - DNA, 19 bp, Homo sapiens
agtgaaatggctggggccg

SEQ ID NO: 1749774 - DNA, 23 bp, Homo sapiens
agtgaaatggctggggccgctgg

SEQ ID NO: 1749775 - DNA, 20 bp, Homo sapiens
agtgaaattaagcattttga

SEQ ID NO: 1749776 - DNA, 21 bp, Homo sapiens
agtgaaattttggtgaatgtg

SEQ ID NO: 1749777 - DNA, 15 bp, Homo sapiens
agtgaacacatttta

SEQ ID NO: 1749778 - DNA, 16 bp, Homo sapiens
agtgaacactagccag

SEQ ID NO: 1749779 - DNA, 15 bp, Homo sapiens
agtgaacattcccag

SEQ ID NO: 1749780 - DNA, 21 bp, Homo sapiens
agtgaaccaaaaatagaaatt

SEQ ID NO: 1749781 - DNA, 23 bp, Homo sapiens
agtgaacctttaaagtaaaggcc

SEQ ID NO: 1749782 - DNA, 23 bp, Homo sapiens
agtgaacttacacttggagcccg

SEQ ID NO: 1749783 - DNA, 19 bp, Homo sapiens
agtgaagagggagaaggga

SEQ ID NO: 1749784 - DNA, 15 bp, Homo sapiens
agtgaagaggggcag

SEQ ID NO: 1749785 - DNA, 20 bp, Homo sapiens
agtgaagaggggcagccctt

SEQ ID NO: 1749786 - DNA, 15 bp, Homo sapiens
agtgaagatgctgta

SEQ ID NO: 1749787 - DNA, 16 bp, Homo sapiens
agtgaagatgctgtaa

SEQ ID NO: 1749788 - DNA, 18 bp, Homo sapiens
agtgaagatgctgtaaat

SEQ ID NO: 1749789 - DNA, 18 bp, Homo sapiens
agtgaagtaaaattgagt

SEQ ID NO: 1749790 - DNA, 20 bp, Homo sapiens
agtgaagtacacctgtgtgg

SEQ ID NO: 1749791 - DNA, 16 bp, Homo sapiens
agtgaagtagcctctt

SEQ ID NO: 1749792 - DNA, 16 bp, Homo sapiens
agtgaagttgtgcaac

SEQ ID NO: 1749793 - DNA, 20 bp, Homo sapiens
agtgaatactgctacagcaa

SEQ ID NO: 1749794 - DNA, 23 bp, Homo sapiens
agtgaatatttttgtattttaca

SEQ ID NO: 1749795 - DNA, 14 bp, Homo sapiens
agtgaatccctggg

SEQ ID NO: 1749796 - DNA, 16 bp, Homo sapiens
agtgaatctaaggata

SEQ ID NO: 1749797 - DNA, 22 bp, Homo sapiens
agtgaatgccatttagaatcta

SEQ ID NO: 1749798 - DNA, 20 bp, Homo sapiens
agtgaattcttgaaggaaaa

SEQ ID NO: 1749799 - DNA, 21 bp, Homo sapiens
agtgaattgtgaccaagttat

SEQ ID NO: 1749800 - DNA, 20 bp, Homo sapiens
agtgaatttttctctaactc

SEQ ID NO: 1749801 - DNA, 14 bp, Homo sapiens
agtgacaaaataga

SEQ ID NO: 1749802 - DNA, 24 bp, Homo sapiens
agtgacaaataaattaggaccaag

SEQ ID NO: 1749803 - DNA, 18 bp, Homo sapiens
agtgacaagtgaagaaca

SEQ ID NO: 1749804 - DNA, 17 bp, Homo sapiens
agtgacaccaataaatg

SEQ ID NO: 1749805 - DNA, 21 bp, Homo sapiens
agtgacaccaataaatgtttg

SEQ ID NO: 1749806 - DNA, 15 bp, Homo sapiens
agtgacactggacca

SEQ ID NO: 1749807 - DNA, 17 bp, Homo sapiens
agtgacagacaggctct

SEQ ID NO: 1749808 - DNA, 21 bp, Homo sapiens
agtgacagaccacatctttat

SEQ ID NO: 1749809 - DNA, 18 bp, Homo sapiens
agtgacagctttctggga

SEQ ID NO: 1749810 - DNA, 19 bp, Homo sapiens
agtgacagtggattgcatt

SEQ ID NO: 1749811 - DNA, 22 bp, Homo sapiens
agtgacataatatattctattt

SEQ ID NO: 1749812 - DNA, 18 bp, Homo sapiens
agtgacatcaaagcctgg

SEQ ID NO: 1749813 - DNA, 19 bp, Homo sapiens
agtgacatcaaagcctggc

SEQ ID NO: 1749814 - DNA, 14 bp, Homo sapiens
agtgacgtgcacct

SEQ ID NO: 1749815 - DNA, 18 bp, Homo sapiens
agtggcaccgcctcccca

SEQ ID NO: 1749816 - DNA, 17 bp, Homo sapiens
agtggcagacaaacaga

SEQ ID NO: 1749817 - DNA, 17 bp, Homo sapiens
agtggcagccatgcctc

SEQ ID NO: 1749818 - DNA, 16 bp, Homo sapiens
agtggcaggtgggctg

SEQ ID NO: 1749819 - DNA, 21 bp, Homo sapiens
agtggcaggtgggctgcctgc

SEQ ID NO: 1749820 - DNA, 16 bp, Homo sapiens
agtggcatgtgctgtg

SEQ ID NO: 1749821 - DNA, 13 bp, Homo sapiens
agtggccaggcag

SEQ ID NO: 1749822 - DNA, 17 bp, Homo sapiens
agtggccgggccggacg

SEQ ID NO: 1749823 - DNA, 12 bp, Homo sapiens
agtggcctccct

SEQ ID NO: 1749824 - DNA, 13 bp, Homo sapiens
agtggcctggcca

SEQ ID NO: 1749825 - DNA, 15 bp, Homo sapiens
agtggcctggccagg

SEQ ID NO: 1749826 - DNA, 18 bp, Homo sapiens
agtggcctggccaggagc

SEQ ID NO: 1749827 - DNA, 19 bp, Homo sapiens
agtggcctggccaggagct

SEQ ID NO: 1749828 - DNA, 20 bp, Homo sapiens
agtggcctggccaggagctc

SEQ ID NO: 1749829 - DNA, 22 bp, Homo sapiens
agtggcctggccaggagctctt

SEQ ID NO: 1749830 - DNA, 20 bp, Homo sapiens
agtggcgcgatctcagctca

SEQ ID NO: 1749831 - DNA, 19 bp, Homo sapiens
agtggcggcacgtccttgg

SEQ ID NO: 1749832 - DNA, 19 bp, Homo sapiens
agtggcgtgatctcagctc

SEQ ID NO: 1749833 - DNA, 20 bp, Homo sapiens
agtggcgtgatctcagctca

SEQ ID NO: 1749834 - DNA, 19 bp, Homo sapiens
agtggcgtgggagccagcc

SEQ ID NO: 1749835 - DNA, 21 bp, Homo sapiens
agtggctcctcccggtgccca

SEQ ID NO: 1749836 - DNA, 16 bp, Homo sapiens
agtggctcgctccctg

SEQ ID NO: 1749837 - DNA, 18 bp, Homo sapiens
agtggctgacaagggact

SEQ ID NO: 1749838 - DNA, 17 bp, Homo sapiens
agtggctgggtgccctc

SEQ ID NO: 1749839 - DNA, 18 bp, Homo sapiens
agtggctggtagaaaaag

SEQ ID NO: 1749840 - DNA, 17 bp, Homo sapiens
agtggctggtccagggc

SEQ ID NO: 1749841 - DNA, 21 bp, Homo sapiens
agtggctgtcttaaaagatat

SEQ ID NO: 1749842 - DNA, 15 bp, Homo sapiens
agtggcttcaaaata

SEQ ID NO: 1749843 - DNA, 18 bp, Homo sapiens
agtggcttcccagctctg

SEQ ID NO: 1749844 - DNA, 12 bp, Homo sapiens
agtggcttttca

SEQ ID NO: 1749845 - DNA, 20 bp, Homo sapiens
agtgggaacgtgactgcccc

SEQ ID NO: 1749846 - DNA, 12 bp, Homo sapiens
agtgggaagccc

SEQ ID NO: 1749847 - DNA, 17 bp, Homo sapiens
agtgggaagcccatcct

SEQ ID NO: 1749848 - DNA, 20 bp, Homo sapiens
agtgggaaggacttggcgcg

SEQ ID NO: 1749849 - DNA, 15 bp, Homo sapiens
agtgggacccataga

SEQ ID NO: 1749850 - DNA, 18 bp, Homo sapiens
agtgggacccatagatct

SEQ ID NO: 1749851 - DNA, 21 bp, Homo sapiens
agtgggacccatagatcttct

SEQ ID NO: 1749852 - DNA, 23 bp, Homo sapiens
agtgggacccatagatcttctga

SEQ ID NO: 1749853 - DNA, 16 bp, Homo sapiens
agtgggagctgagctg

SEQ ID NO: 1749854 - DNA, 21 bp, Homo sapiens
agtgggatttggggcctcaag

SEQ ID NO: 1749855 - DNA, 22 bp, Homo sapiens
agtgggcaggaggccccaggct

SEQ ID NO: 1749856 - DNA, 15 bp, Homo sapiens
agtgggccaggacag

SEQ ID NO: 1749857 - DNA, 16 bp, Homo sapiens
agtgggccaggacagg

SEQ ID NO: 1749858 - DNA, 20 bp, Homo sapiens
agtgggccaggacaggcccg

SEQ ID NO: 1749859 - DNA, 19 bp, Homo sapiens
agtgggccccgggctggag

SEQ ID NO: 1749860 - DNA, 21 bp, Homo sapiens
agtgggccccgggctggagaa

SEQ ID NO: 1749861 - DNA, 22 bp, Homo sapiens
agtgggccccgggctggagaaa

SEQ ID NO: 1749862 - DNA, 16 bp, Homo sapiens
agtgggcctgtgtgtg

SEQ ID NO: 1749863 - DNA, 22 bp, Homo sapiens
agtggggacgggggctgcttct

SEQ ID NO: 1749864 - DNA, 14 bp, Homo sapiens
agtggggagggaca

SEQ ID NO: 1749865 - DNA, 19 bp, Homo sapiens
agtggggagggacaaggga

SEQ ID NO: 1749866 - DNA, 21 bp, Homo sapiens
agtggggccagggtgggaggg

SEQ ID NO: 1749867 - DNA, 17 bp, Homo sapiens
agtggggcctgccctct

SEQ ID NO: 1749868 - DNA, 15 bp, Homo sapiens
agtggggctcgccat

SEQ ID NO: 1749869 - DNA, 18 bp, Homo sapiens
agtggggctcgccatgcc

SEQ ID NO: 1749870 - DNA, 21 bp, Homo sapiens
agtggggtcccccctgagtgg

SEQ ID NO: 1749871 - DNA, 18 bp, Homo sapiens
agtggggtctccctctcc

SEQ ID NO: 1749872 - DNA, 16 bp, Homo sapiens
agtggggtgaacagct

SEQ ID NO: 1749873 - DNA, 17 bp, Homo sapiens
agtggggtgaacagctg

SEQ ID NO: 1749874 - DNA, 21 bp, Homo sapiens
agtggggtgctgggaggaggg

SEQ ID NO: 1749875 - DNA, 20 bp, Homo sapiens
agtggggttatctctgtgtt

SEQ ID NO: 1749876 - DNA, 12 bp, Homo sapiens
agtggggttgat

SEQ ID NO: 1749877 - DNA, 19 bp, Homo sapiens
agtggggttgcaaccactg

SEQ ID NO: 1749878 - DNA, 22 bp, Homo sapiens
agtggggttgggggacagcctt

SEQ ID NO: 1749879 - DNA, 14 bp, Homo sapiens
agtgggtctgggat

SEQ ID NO: 1749880 - DNA, 23 bp, Homo sapiens
agtgggtctgggatatggctgcc

SEQ ID NO: 1749881 - DNA, 20 bp, Homo sapiens
agtgggtgcgtggtatacat

SEQ ID NO: 1749882 - DNA, 15 bp, Homo sapiens
agtgggtggcacctc

SEQ ID NO: 1749883 - DNA, 21 bp, Homo sapiens
agtgggtttcacaagtgaaaa

SEQ ID NO: 1749884 - DNA, 22 bp, Homo sapiens
agtgggttttattgtccttcag

SEQ ID NO: 1749885 - DNA, 21 bp, Homo sapiens
agtgggttttttagttgaatt

SEQ ID NO: 1749886 - DNA, 19 bp, Homo sapiens
agtggtacaatctggctca

SEQ ID NO: 1749887 - DNA, 20 bp, Homo sapiens
agtggtacaatctggctcac

SEQ ID NO: 1749888 - DNA, 15 bp, Homo sapiens
agtggtacaggaagg

SEQ ID NO: 1749889 - DNA, 16 bp, Homo sapiens
agtggtagtatctcgt

SEQ ID NO: 1749890 - DNA, 23 bp, Homo sapiens
agtggtcaggagttgtttctgac

SEQ ID NO: 1749891 - DNA, 15 bp, Homo sapiens
agtggtcataaaata

SEQ ID NO: 1749892 - DNA, 24 bp, Homo sapiens
agtggtccagcgtcactccagtgc

SEQ ID NO: 1749893 - DNA, 12 bp, Homo sapiens
agtggtctctgc

SEQ ID NO: 1749894 - DNA, 13 bp, Homo sapiens
agtggtctctgct

SEQ ID NO: 1749895 - DNA, 14 bp, Homo sapiens
agtggtctctgctg

SEQ ID NO: 1749896 - DNA, 20 bp, Homo sapiens
agtggtgcgtttataattgg

SEQ ID NO: 1749897 - DNA, 14 bp, Homo sapiens
agtggtgggtaatt

SEQ ID NO: 1749898 - DNA, 23 bp, Homo sapiens
agtggtgggtaattgtacaataa

SEQ ID NO: 1749899 - DNA, 14 bp, Homo sapiens
agtggttcctgtgg

SEQ ID NO: 1749900 - DNA, 21 bp, Homo sapiens
agtggtttctgcgtgtgtata

SEQ ID NO: 1749901 - DNA, 18 bp, Homo sapiens
agtggtttgcaggtcagc

SEQ ID NO: 1749902 - DNA, 17 bp, Homo sapiens
agtggttttatactgaa

SEQ ID NO: 1749903 - DNA, 14 bp, Homo sapiens
agtgtaaaaaatgt

SEQ ID NO: 1749904 - DNA, 20 bp, Homo sapiens
agtgtaacttgcttaaattt

SEQ ID NO: 1749905 - DNA, 23 bp, Homo sapiens
agtgtaagaactgtacattgtga

SEQ ID NO: 1749906 - DNA, 15 bp, Homo sapiens
agtgtaatgtgactt

SEQ ID NO: 1749907 - DNA, 18 bp, Homo sapiens
agtgtaatgtgacttcat

SEQ ID NO: 1749908 - DNA, 14 bp, Homo sapiens
agtgtacatcatgt

SEQ ID NO: 1749909 - DNA, 23 bp, Homo sapiens
agtgtacatggaataacatgtaa

SEQ ID NO: 1749910 - DNA, 19 bp, Homo sapiens
agtgtacatgtacatagta

SEQ ID NO: 1749911 - DNA, 14 bp, Homo sapiens
agtgtacctcctct

SEQ ID NO: 1749912 - DNA, 15 bp, Homo sapiens
agtgtacctcctctc

SEQ ID NO: 1749913 - DNA, 12 bp, Homo sapiens
agtgtagcctaa

SEQ ID NO: 1749914 - DNA, 20 bp, Homo sapiens
agtgtagcctaaagggcagg

SEQ ID NO: 1749915 - DNA, 12 bp, Homo sapiens
agtgtagctgta

SEQ ID NO: 1749916 - DNA, 13 bp, Homo sapiens
agtgtagctgtaa

SEQ ID NO: 1749917 - DNA, 13 bp, Homo sapiens
agtgtagctgtga

SEQ ID NO: 1749918 - DNA, 16 bp, Homo sapiens
agtgtagctgtgaaat

SEQ ID NO: 1749919 - DNA, 16 bp, Homo sapiens
agtgtagtttacagaa

SEQ ID NO: 1749920 - DNA, 20 bp, Homo sapiens
agtgtatatgattctcttga

SEQ ID NO: 1749921 - DNA, 21 bp, Homo sapiens
agtgtatatttattcataatg

SEQ ID NO: 1749922 - DNA, 19 bp, Homo sapiens
agtgtatgattactggcct

SEQ ID NO: 1749923 - DNA, 20 bp, Homo sapiens
agtgtatggaaataaatgta

SEQ ID NO: 1749924 - DNA, 21 bp, Homo sapiens
agtgtatggaaataaatgtat

SEQ ID NO: 1749925 - DNA, 13 bp, Homo sapiens
agtgtatgtcttg

SEQ ID NO: 1749926 - DNA, 14 bp, Homo sapiens
agtgtatttggaaa

SEQ ID NO: 1749927 - DNA, 23 bp, Homo sapiens
agtgtatttggaaataaagtcag

SEQ ID NO: 1749928 - DNA, 22 bp, Homo sapiens
agtgtattttttaaaattgatt

SEQ ID NO: 1749929 - DNA, 22 bp, Homo sapiens
agttaccttaaagctgaattta

SEQ ID NO: 1749930 - DNA, 16 bp, Homo sapiens
agttaccttatagtta

SEQ ID NO: 1749931 - DNA, 17 bp, Homo sapiens
agttaccttatagttac

SEQ ID NO: 1749932 - DNA, 21 bp, Homo sapiens
agttaccttatagttactgtg

SEQ ID NO: 1749933 - DNA, 14 bp, Homo sapiens
agttaccttcaaag

SEQ ID NO: 1749934 - DNA, 19 bp, Homo sapiens
agttacgagttttccctca

SEQ ID NO: 1749935 - DNA, 16 bp, Homo sapiens
agttactcagccctgg

SEQ ID NO: 1749936 - DNA, 17 bp, Homo sapiens
agttactcagccctggg

SEQ ID NO: 1749937 - DNA, 12 bp, Homo sapiens
agttactgaatg

SEQ ID NO: 1749938 - DNA, 18 bp, Homo sapiens
agttactgattcactgca

SEQ ID NO: 1749939 - DNA, 21 bp, Homo sapiens
agttactgccggtttgaaaat

SEQ ID NO: 1749940 - DNA, 12 bp, Homo sapiens
agttactgtaaa

SEQ ID NO: 1749941 - DNA, 19 bp, Homo sapiens
agttactgtgtaattagtg

SEQ ID NO: 1749942 - DNA, 15 bp, Homo sapiens
agttacttcctatca

SEQ ID NO: 1749943 - DNA, 16 bp, Homo sapiens
agttacttgaatttca

SEQ ID NO: 1749944 - DNA, 15 bp, Homo sapiens
agttacttgtctgag

SEQ ID NO: 1749945 - DNA, 20 bp, Homo sapiens
agttactttatgtttgtctt

SEQ ID NO: 1749946 - DNA, 19 bp, Homo sapiens
agttactttgtcagaggca

SEQ ID NO: 1749947 - DNA, 17 bp, Homo sapiens
agttagagattttacaa

SEQ ID NO: 1749948 - DNA, 18 bp, Homo sapiens
agttagagattttacaaa

SEQ ID NO: 1749949 - DNA, 20 bp, Homo sapiens
agttagcatgtatgaatgta

SEQ ID NO: 1749950 - DNA, 16 bp, Homo sapiens
agttagctcaggaggc

SEQ ID NO: 1749951 - DNA, 22 bp, Homo sapiens
agttagctcaggaggcttggaa

SEQ ID NO: 1749952 - DNA, 18 bp, Homo sapiens
agttagctgaagaattga

SEQ ID NO: 1749953 - DNA, 14 bp, Homo sapiens
agttagggagagag

SEQ ID NO: 1749954 - DNA, 22 bp, Homo sapiens
agttagggagagagaagcaggc

SEQ ID NO: 1749955 - DNA, 18 bp, Homo sapiens
agttagggggttcttatt

SEQ ID NO: 1749956 - DNA, 18 bp, Homo sapiens
agttagggttttgcaata

SEQ ID NO: 1749957 - DNA, 20 bp, Homo sapiens
agttagtatcttttgatatg

SEQ ID NO: 1749958 - DNA, 17 bp, Homo sapiens
agttagtattaaaatct

SEQ ID NO: 1749959 - DNA, 14 bp, Homo sapiens
agttagtggaaatc

SEQ ID NO: 1749960 - DNA, 17 bp, Homo sapiens
agttagtggaaatctga

SEQ ID NO: 1749961 - DNA, 17 bp, Homo sapiens
agttagtggattactgc

SEQ ID NO: 1749962 - DNA, 16 bp, Homo sapiens
agttatatttttgtgt

SEQ ID NO: 1749963 - DNA, 15 bp, Homo sapiens
agttatcaaaaagta

SEQ ID NO: 1749964 - DNA, 21 bp, Homo sapiens
agttatcaaaaagtattatca

SEQ ID NO: 1749965 - DNA, 14 bp, Homo sapiens
agttatcaggtgca

SEQ ID NO: 1749966 - DNA, 16 bp, Homo sapiens
agttatcatgaatttt

SEQ ID NO: 1749967 - DNA, 18 bp, Homo sapiens
agttatcatgaattttaa

SEQ ID NO: 1749968 - DNA, 14 bp, Homo sapiens
agttatgatgtaat

SEQ ID NO: 1749969 - DNA, 20 bp, Homo sapiens
agttatgatttttttttcat

SEQ ID NO: 1749970 - DNA, 23 bp, Homo sapiens
agttatgccgtataggatgtcag

SEQ ID NO: 1749971 - DNA, 19 bp, Homo sapiens
agttatggctataggtgct

SEQ ID NO: 1749972 - DNA, 18 bp, Homo sapiens
agttatggtgatgactta

SEQ ID NO: 1749973 - DNA, 13 bp, Homo sapiens
agttatgtgaatg

SEQ ID NO: 1749974 - DNA, 15 bp, Homo sapiens
agttatgtgaatgat

SEQ ID NO: 1749975 - DNA, 15 bp, Homo sapiens
agttattaaaattgt

SEQ ID NO: 1749976 - DNA, 18 bp, Homo sapiens
agttattaaaattgttgt

SEQ ID NO: 1749977 - DNA, 14 bp, Homo sapiens
agttattaacttta

SEQ ID NO: 1749978 - DNA, 17 bp, Homo sapiens
agttattgaatcttaat

SEQ ID NO: 1749979 - DNA, 21 bp, Homo sapiens
agttatttcatcttttattca

SEQ ID NO: 1749980 - DNA, 14 bp, Homo sapiens
agttatttctgttt

SEQ ID NO: 1749981 - DNA, 23 bp, Homo sapiens
agttattttctacagtggtttta

SEQ ID NO: 1749982 - DNA, 21 bp, Homo sapiens
agttatttttatttatttaaa

SEQ ID NO: 1749983 - DNA, 15 bp, Homo sapiens
agttatttttgtaca

SEQ ID NO: 1749984 - DNA, 13 bp, Homo sapiens
agttcaaacaaga

SEQ ID NO: 1749985 - DNA, 23 bp, Homo sapiens
agttcaaagaagtcatggcccaa

SEQ ID NO: 1749986 - DNA, 22 bp, Homo sapiens
agttcaaagtgtatatttattc

SEQ ID NO: 1749987 - DNA, 16 bp, Homo sapiens
agttcaaatcctcacc

SEQ ID NO: 1749988 - DNA, 17 bp, Homo sapiens
agttcaaatcctcacca

SEQ ID NO: 1749989 - DNA, 23 bp, Homo sapiens
agttcaaatcctcaccatccaca

SEQ ID NO: 1749990 - DNA, 16 bp, Homo sapiens
agttcaagaccagcct

SEQ ID NO: 1749991 - DNA, 18 bp, Homo sapiens
agttcaagaccagcctgt

SEQ ID NO: 1749992 - DNA, 19 bp, Homo sapiens
agttcaataaatgtctgtt

SEQ ID NO: 1749993 - DNA, 20 bp, Homo sapiens
agttcaatactcttgaaatg

SEQ ID NO: 1749994 - DNA, 18 bp, Homo sapiens
agttcacattagaattag

SEQ ID NO: 1749995 - DNA, 18 bp, Homo sapiens
agttcaccttggaagggc

SEQ ID NO: 1749996 - DNA, 18 bp, Homo sapiens
agttcagaaatttggcat

SEQ ID NO: 1749997 - DNA, 14 bp, Homo sapiens
agttcagaatggca

SEQ ID NO: 1749998 - DNA, 20 bp, Homo sapiens
agttcagaatggcagtcctg

SEQ ID NO: 1749999 - DNA, 15 bp, Homo sapiens
agttcagcaccaccc

SEQ ID NO: 1750000 - DNA, 17 bp, Homo sapiens
agttcagcaccacccta

SEQ ID NO: 1750001 - DNA, 18 bp, Homo sapiens
agttcagcaccaccctag

SEQ ID NO: 1750002 - DNA, 21 bp, Homo sapiens
agttcagcatccgcaggtgct

SEQ ID NO: 1750003 - DNA, 16 bp, Homo sapiens
agttcaggagtcccaa

SEQ ID NO: 1750004 - DNA, 20 bp, Homo sapiens
agttcaggagtcccaaggaa

SEQ ID NO: 1750005 - DNA, 21 bp, Homo sapiens
agttcaggagtcccaaggaaa

SEQ ID NO: 1750006 - DNA, 12 bp, Homo sapiens
agttcagggacc

SEQ ID NO: 1750007 - DNA, 13 bp, Homo sapiens
agttcagggaccg

SEQ ID NO: 1750008 - DNA, 19 bp, Homo sapiens
agttcatatctggagcctg

SEQ ID NO: 1750009 - DNA, 22 bp, Homo sapiens
agttcatatgtaccatgtacat

SEQ ID NO: 1750010 - DNA, 20 bp, Homo sapiens
agttcatattccatatttat

SEQ ID NO: 1750011 - DNA, 20 bp, Homo sapiens
agttcatccaatcctcactg

SEQ ID NO: 1750012 - DNA, 22 bp, Homo sapiens
agttcatccaatcctcactggg

SEQ ID NO: 1750013 - DNA, 16 bp, Homo sapiens
agttcatctcatttgt

SEQ ID NO: 1750014 - DNA, 14 bp, Homo sapiens
agttcatcttgcag

SEQ ID NO: 1750015 - DNA, 19 bp, Homo sapiens
agttcatcttgcagcattt

SEQ ID NO: 1750016 - DNA, 13 bp, Homo sapiens
agttcatgagaat

SEQ ID NO: 1750017 - DNA, 21 bp, Homo sapiens
agttcatgagaatctatattt

SEQ ID NO: 1750018 - DNA, 14 bp, Homo sapiens
agttcatgtctgaa

SEQ ID NO: 1750019 - DNA, 17 bp, Homo sapiens
agttcatgtctgaaaca

SEQ ID NO: 1750020 - DNA, 23 bp, Homo sapiens
agttcatgtttgcttcataaatg

SEQ ID NO: 1750021 - DNA, 18 bp, Homo sapiens
agttcattagaaatattt

SEQ ID NO: 1750022 - DNA, 15 bp, Homo sapiens
agttcattgcaatta

SEQ ID NO: 1750023 - DNA, 11 bp, Homo sapiens
agttccaacat

SEQ ID NO: 1750024 - DNA, 20 bp, Homo sapiens
agttccaagagtctaaagat

SEQ ID NO: 1750025 - DNA, 15 bp, Homo sapiens
agttccagaaagtaa

SEQ ID NO: 1750026 - DNA, 16 bp, Homo sapiens
agttccagaaagtaaa

SEQ ID NO: 1750027 - DNA, 17 bp, Homo sapiens
agttccagtttctcctt

SEQ ID NO: 1750028 - DNA, 18 bp, Homo sapiens
agttccagtttctccttg

SEQ ID NO: 1750029 - DNA, 13 bp, Homo sapiens
agttcccaactga

SEQ ID NO: 1750030 - DNA, 13 bp, Homo sapiens
agttcccagctcc

SEQ ID NO: 1750031 - DNA, 20 bp, Homo sapiens
agttccccatccctgtcatt

SEQ ID NO: 1750032 - DNA, 15 bp, Homo sapiens
agttcccccagtacc

SEQ ID NO: 1750033 - DNA, 22 bp, Homo sapiens
agttcccccagtacctccaagc

SEQ ID NO: 1750034 - DNA, 18 bp, Homo sapiens
agttcccggagcacagcc

SEQ ID NO: 1750035 - DNA, 19 bp, Homo sapiens
agttcccggagcacagccc

SEQ ID NO: 1750036 - DNA, 22 bp, Homo sapiens
agttcccggagcacagccctgg

SEQ ID NO: 1750037 - DNA, 19 bp, Homo sapiens
agttccctaaacaaaagca

SEQ ID NO: 1750038 - DNA, 17 bp, Homo sapiens
agttcccttgaaacttt

SEQ ID NO: 1750039 - DNA, 18 bp, Homo sapiens
agttcctaacaggatgaa

SEQ ID NO: 1750040 - DNA, 13 bp, Homo sapiens
agttcctcgccct

SEQ ID NO: 1750041 - DNA, 14 bp, Homo sapiens
agttcctcgccctg

SEQ ID NO: 1750042 - DNA, 18 bp, Homo sapiens
agttcctctagtgccctc

SEQ ID NO: 1750043 - DNA, 11 bp, Homo sapiens
agttggctgga

SEQ ID NO: 1750044 - DNA, 12 bp, Homo sapiens
agttggcttcta

SEQ ID NO: 1750045 - DNA, 16 bp, Homo sapiens
agttggctttgcccac

SEQ ID NO: 1750046 - DNA, 19 bp, Homo sapiens
agttggctttgcccacccc

SEQ ID NO: 1750047 - DNA, 24 bp, Homo sapiens
agttggctttgcccacccctcact

SEQ ID NO: 1750048 - DNA, 23 bp, Homo sapiens
agttgggaacttcagatggacct

SEQ ID NO: 1750049 - DNA, 19 bp, Homo sapiens
agttgggactcaggatatt

SEQ ID NO: 1750050 - DNA, 15 bp, Homo sapiens
agttgggagcactgg

SEQ ID NO: 1750051 - DNA, 16 bp, Homo sapiens
agttgggagcactgga

SEQ ID NO: 1750052 - DNA, 14 bp, Homo sapiens
agttgggaggagga

SEQ ID NO: 1750053 - DNA, 21 bp, Homo sapiens
agttgggatgccaatttcctc

SEQ ID NO: 1750054 - DNA, 16 bp, Homo sapiens
agttgggcccctgagg

SEQ ID NO: 1750055 - DNA, 20 bp, Homo sapiens
agttgggcctaaataaatga

SEQ ID NO: 1750056 - DNA, 15 bp, Homo sapiens
agttgggtgtttcca

SEQ ID NO: 1750057 - DNA, 13 bp, Homo sapiens
agttggtgacaga

SEQ ID NO: 1750058 - DNA, 17 bp, Homo sapiens
agttggtgactgggaaa

SEQ ID NO: 1750059 - DNA, 17 bp, Homo sapiens
agttggtttgtatgaga

SEQ ID NO: 1750060 - DNA, 12 bp, Homo sapiens
agttgtaaagta

SEQ ID NO: 1750061 - DNA, 13 bp, Homo sapiens
agttgtaaagtat

SEQ ID NO: 1750062 - DNA, 16 bp, Homo sapiens
agttgtaccaagtgaa

SEQ ID NO: 1750063 - DNA, 13 bp, Homo sapiens
agttgtactttaa

SEQ ID NO: 1750064 - DNA, 14 bp, Homo sapiens
agttgtagacaaag

SEQ ID NO: 1750065 - DNA, 16 bp, Homo sapiens
agttgtagacaaagta

SEQ ID NO: 1750066 - DNA, 16 bp, Homo sapiens
agttgtagcagattgt

SEQ ID NO: 1750067 - DNA, 23 bp, Homo sapiens
agttgtatcagcacgtgtggcct

SEQ ID NO: 1750068 - DNA, 15 bp, Homo sapiens
agttgtatctctttt

SEQ ID NO: 1750069 - DNA, 16 bp, Homo sapiens
agttgtcaaagaagct

SEQ ID NO: 1750070 - DNA, 19 bp, Homo sapiens
agttgtcaagtctctgctg

SEQ ID NO: 1750071 - DNA, 19 bp, Homo sapiens
agttgtcacagaaattatg

SEQ ID NO: 1750072 - DNA, 21 bp, Homo sapiens
agttgtcacagaaattatgat

SEQ ID NO: 1750073 - DNA, 20 bp, Homo sapiens
agttgtcctatggacaactt

SEQ ID NO: 1750074 - DNA, 22 bp, Homo sapiens
agttgtcttatgtgaaaaatta

SEQ ID NO: 1750075 - DNA, 21 bp, Homo sapiens
agttgtgatttctgtggatcc

SEQ ID NO: 1750076 - DNA, 20 bp, Homo sapiens
agttgtggaaagcctctgct

SEQ ID NO: 1750077 - DNA, 16 bp, Homo sapiens
agttgtgtctaggctg

SEQ ID NO: 1750078 - DNA, 16 bp, Homo sapiens
agttgtgtgtatgtgt

SEQ ID NO: 1750079 - DNA, 23 bp, Homo sapiens
agttgtgtttcaacggaaagtgc

SEQ ID NO: 1750080 - DNA, 19 bp, Homo sapiens
agttgtgttttttaagatg

SEQ ID NO: 1750081 - DNA, 21 bp, Homo sapiens
agttgtgttttttaagatggc

SEQ ID NO: 1750082 - DNA, 13 bp, Homo sapiens
agttgtttcattg

SEQ ID NO: 1750083 - DNA, 15 bp, Homo sapiens
agttgtttcattgac

SEQ ID NO: 1750084 - DNA, 18 bp, Homo sapiens
agttgtttgtttttgctt

SEQ ID NO: 1750085 - DNA, 18 bp, Homo sapiens
agtttaaaaaaataacat

SEQ ID NO: 1750086 - DNA, 18 bp, Homo sapiens
agtttaaatattaagcat

SEQ ID NO: 1750087 - DNA, 20 bp, Homo sapiens
agtttaaatattaagcatga

SEQ ID NO: 1750088 - DNA, 16 bp, Homo sapiens
agtttaacaataataa

SEQ ID NO: 1750089 - DNA, 17 bp, Homo sapiens
agtttaagaccagcctg

SEQ ID NO: 1750090 - DNA, 22 bp, Homo sapiens
agtttaatccttctagtttccc

SEQ ID NO: 1750091 - DNA, 19 bp, Homo sapiens
agtttacagaaaaatcttg

SEQ ID NO: 1750092 - DNA, 15 bp, Homo sapiens
agtttacagatgttt

SEQ ID NO: 1750093 - DNA, 22 bp, Homo sapiens
agtttacatcatttttgtatct

SEQ ID NO: 1750094 - DNA, 18 bp, Homo sapiens
agtttaccatttgtaata

SEQ ID NO: 1750095 - DNA, 22 bp, Homo sapiens
agtttaccatttgtaataaagt

SEQ ID NO: 1750096 - DNA, 15 bp, Homo sapiens
agtttactgagaatg

SEQ ID NO: 1750097 - DNA, 18 bp, Homo sapiens
agtttagaatggaggaag

SEQ ID NO: 1750098 - DNA, 23 bp, Homo sapiens
agtttagaatggaggaagaacaa

SEQ ID NO: 1750099 - DNA, 14 bp, Homo sapiens
agtttagaggaaaa

SEQ ID NO: 1750100 - DNA, 19 bp, Homo sapiens
agtttagaggaaaaaaatg

SEQ ID NO: 1750101 - DNA, 23 bp, Homo sapiens
agtttagatcccatgtcacctca

SEQ ID NO: 1750102 - DNA, 13 bp, Homo sapiens
agtttaggagaaa

SEQ ID NO: 1750103 - DNA, 16 bp, Homo sapiens
agtttaggcctatcaa

SEQ ID NO: 1750104 - DNA, 15 bp, Homo sapiens
agtttagttctgttg

SEQ ID NO: 1750105 - DNA, 19 bp, Homo sapiens
agtttagttctgttgacct

SEQ ID NO: 1750106 - DNA, 18 bp, Homo sapiens
agtttatacagtgtacat

SEQ ID NO: 1750107 - DNA, 19 bp, Homo sapiens
agtttatacagtgtacatg

SEQ ID NO: 1750108 - DNA, 20 bp, Homo sapiens
agtttatacagtgtacatgt

SEQ ID NO: 1750109 - DNA, 21 bp, Homo sapiens
agtttatatactgctatttac

SEQ ID NO: 1750110 - DNA, 16 bp, Homo sapiens
agtttatattactctc

SEQ ID NO: 1750111 - DNA, 19 bp, Homo sapiens
agtttatcagtaaataact

SEQ ID NO: 1750112 - DNA, 19 bp, Homo sapiens
agtttatggatatgctgct

SEQ ID NO: 1750113 - DNA, 17 bp, Homo sapiens
agtttatggcaaagatt

SEQ ID NO: 1750114 - DNA, 17 bp, Homo sapiens
agtttatggcagaaggg

SEQ ID NO: 1750115 - DNA, 23 bp, Homo sapiens
agtttatttccactattttcaaa

SEQ ID NO: 1750116 - DNA, 16 bp, Homo sapiens
agtttatttttaaaga

SEQ ID NO: 1750117 - DNA, 14 bp, Homo sapiens
agtttatttttcca

SEQ ID NO: 1750118 - DNA, 19 bp, Homo sapiens
agtttcaaacttactattt

SEQ ID NO: 1750119 - DNA, 15 bp, Homo sapiens
agtttcaagttttaa

SEQ ID NO: 1750120 - DNA, 20 bp, Homo sapiens
agtttcacaaatccttcaaa

SEQ ID NO: 1750121 - DNA, 18 bp, Homo sapiens
agtttcactgtactgcat

SEQ ID NO: 1750122 - DNA, 19 bp, Homo sapiens
agtttcactgtactgcatg

SEQ ID NO: 1750123 - DNA, 20 bp, Homo sapiens
agtttcactgtactgcatgt

SEQ ID NO: 1750124 - DNA, 12 bp, Homo sapiens
agtttcagagaa

SEQ ID NO: 1750125 - DNA, 18 bp, Homo sapiens
agtttcagagaagttctg

SEQ ID NO: 1750126 - DNA, 16 bp, Homo sapiens
agtttcatgtgagttt

SEQ ID NO: 1750127 - DNA, 12 bp, Homo sapiens
agtttccagtgg

SEQ ID NO: 1750128 - DNA, 17 bp, Homo sapiens
agtttccatagcaacag

SEQ ID NO: 1750129 - DNA, 20 bp, Homo sapiens
agtttccgaatctctttccc

SEQ ID NO: 1750130 - DNA, 21 bp, Homo sapiens
agtttccgaatctctttccct

SEQ ID NO: 1750131 - DNA, 11 bp, Homo sapiens
agtttcctgga

SEQ ID NO: 1750132 - DNA, 12 bp, Homo sapiens
agtttcctggaa

SEQ ID NO: 1750133 - DNA, 12 bp, Homo sapiens
agtttccttttt

SEQ ID NO: 1750134 - DNA, 16 bp, Homo sapiens
agtttcctttttaata

SEQ ID NO: 1750135 - DNA, 15 bp, Homo sapiens
agtttctaagattct

SEQ ID NO: 1750136 - DNA, 17 bp, Homo sapiens
agtttctaagattctaa

SEQ ID NO: 1750137 - DNA, 18 bp, Homo sapiens
agtttctaagattctaaa

SEQ ID NO: 1750138 - DNA, 21 bp, Homo sapiens
agtttctattctgtcagtgtt

SEQ ID NO: 1750139 - DNA, 12 bp, Homo sapiens
agtttctgcttg

SEQ ID NO: 1750140 - DNA, 16 bp, Homo sapiens
agtttcttaatgagat

SEQ ID NO: 1750141 - DNA, 22 bp, Homo sapiens
agtttcttactgttttgtatca

SEQ ID NO: 1750142 - DNA, 21 bp, Homo sapiens
agtttcttgcttggaagccag

SEQ ID NO: 1750143 - DNA, 23 bp, Homo sapiens
agtttcttgcttggaagccaggt

SEQ ID NO: 1750144 - DNA, 22 bp, Homo sapiens
agtttcttgtcttggacttttt

SEQ ID NO: 1750145 - DNA, 14 bp, Homo sapiens
agtttgaattcagt

SEQ ID NO: 1750146 - DNA, 16 bp, Homo sapiens
agtttgaattcagtaa

SEQ ID NO: 1750147 - DNA, 19 bp, Homo sapiens
agtttgagacaagccctgg

SEQ ID NO: 1750148 - DNA, 23 bp, Homo sapiens
agtttgagacaagccctggcaac

SEQ ID NO: 1750149 - DNA, 12 bp, Homo sapiens
agtttgagacca

SEQ ID NO: 1750150 - DNA, 19 bp, Homo sapiens
agtttgagaccaggctggg

SEQ ID NO: 1750151 - DNA, 14 bp, Homo sapiens
agtttgaggaaatt

SEQ ID NO: 1750152 - DNA, 17 bp, Homo sapiens
agtttgattattatgtt

SEQ ID NO: 1750153 - DNA, 17 bp, Homo sapiens
agtttgcaaaaaatgtt

SEQ ID NO: 1750154 - DNA, 18 bp, Homo sapiens
agtttgcactcaaatctt

SEQ ID NO: 1750155 - DNA, 22 bp, Homo sapiens
agtttgcactcaaatcttaaga

SEQ ID NO: 1750156 - DNA, 20 bp, Homo sapiens
agtttgcactgtatgctgga

SEQ ID NO: 1750157 - DNA, 15 bp, Homo sapiens
ataaaatattcactc

SEQ ID NO: 1750158 - DNA, 19 bp, Homo sapiens
ataaaatattttcatacag

SEQ ID NO: 1750159 - DNA, 22 bp, Homo sapiens
ataaaatatttttttcctatgg

SEQ ID NO: 1750160 - DNA, 12 bp, Homo sapiens
ataaaatcataa

SEQ ID NO: 1750161 - DNA, 19 bp, Homo sapiens
ataaaatcataagtatttg

SEQ ID NO: 1750162 - DNA, 20 bp, Homo sapiens
ataaaatcataagtatttgg

SEQ ID NO: 1750163 - DNA, 16 bp, Homo sapiens
ataaaatccaaaatga

SEQ ID NO: 1750164 - DNA, 14 bp, Homo sapiens
ataaaatcctgtgc

SEQ ID NO: 1750165 - DNA, 23 bp, Homo sapiens
ataaaatctgaattttgcaatgt

SEQ ID NO: 1750166 - DNA, 15 bp, Homo sapiens
ataaaatgcatttaa

SEQ ID NO: 1750167 - DNA, 17 bp, Homo sapiens
ataaaatgtaattactt

SEQ ID NO: 1750168 - DNA, 20 bp, Homo sapiens
ataaaatgtgatttttctga

SEQ ID NO: 1750169 - DNA, 13 bp, Homo sapiens
ataaaattatgcc

SEQ ID NO: 1750170 - DNA, 17 bp, Homo sapiens
ataaaattcctatctca

SEQ ID NO: 1750171 - DNA, 19 bp, Homo sapiens
ataaaattcgctttctaaa

SEQ ID NO: 1750172 - DNA, 12 bp, Homo sapiens
ataaaatttaaa

SEQ ID NO: 1750173 - DNA, 20 bp, Homo sapiens
ataaaatttaaaaaataaat

SEQ ID NO: 1750174 - DNA, 14 bp, Homo sapiens
ataaaatttacatt

SEQ ID NO: 1750175 - DNA, 20 bp, Homo sapiens
ataaaatttccttcaggttt

SEQ ID NO: 1750176 - DNA, 16 bp, Homo sapiens
ataaacaaagattcat

SEQ ID NO: 1750177 - DNA, 15 bp, Homo sapiens
ataaacaagaatgaa

SEQ ID NO: 1750178 - DNA, 20 bp, Homo sapiens
ataaacactgttttatagaa

SEQ ID NO: 1750179 - DNA, 21 bp, Homo sapiens
ataaacagacaaaaacaagta

SEQ ID NO: 1750180 - DNA, 18 bp, Homo sapiens
ataaacagcacacctgtg

SEQ ID NO: 1750181 - DNA, 22 bp, Homo sapiens
ataaacagcacacctgtgtcca

SEQ ID NO: 1750182 - DNA, 21 bp, Homo sapiens
ataaacaggaattttattttg

SEQ ID NO: 1750183 - DNA, 19 bp, Homo sapiens
ataaacatatttttatact

SEQ ID NO: 1750184 - DNA, 20 bp, Homo sapiens
ataaacatatttttatactt

SEQ ID NO: 1750185 - DNA, 21 bp, Homo sapiens
ataaacatatttttatacttt

SEQ ID NO: 1750186 - DNA, 16 bp, Homo sapiens
ataaacatcacacaca

SEQ ID NO: 1750187 - DNA, 21 bp, Homo sapiens
ataaacatccttcaagaactc

SEQ ID NO: 1750188 - DNA, 13 bp, Homo sapiens
ataaacattaaac

SEQ ID NO: 1750189 - DNA, 14 bp, Homo sapiens
ataaacattaaaca

SEQ ID NO: 1750190 - DNA, 17 bp, Homo sapiens
ataaacattaaacactg

SEQ ID NO: 1750191 - DNA, 17 bp, Homo sapiens
ataaacattaattttgt

SEQ ID NO: 1750192 - DNA, 22 bp, Homo sapiens
ataaacattaattttgtgcatt

SEQ ID NO: 1750193 - DNA, 18 bp, Homo sapiens
ataaacattttttaagaa

SEQ ID NO: 1750194 - DNA, 16 bp, Homo sapiens
ataaacccacattctt

SEQ ID NO: 1750195 - DNA, 16 bp, Homo sapiens
ataaacctcaaaatgt

SEQ ID NO: 1750196 - DNA, 16 bp, Homo sapiens
ataaacctgaggcagg

SEQ ID NO: 1750197 - DNA, 13 bp, Homo sapiens
ataaacctggaga

SEQ ID NO: 1750198 - DNA, 16 bp, Homo sapiens
ataaacctggagatat

SEQ ID NO: 1750199 - DNA, 17 bp, Homo sapiens
ataaacgaccaaactca

SEQ ID NO: 1750200 - DNA, 12 bp, Homo sapiens
ataaactagttt

SEQ ID NO: 1750201 - DNA, 16 bp, Homo sapiens
ataaactagtttccag

SEQ ID NO: 1750202 - DNA, 22 bp, Homo sapiens
ataaactagtttccagtggatc

SEQ ID NO: 1750203 - DNA, 17 bp, Homo sapiens
ataaactataaacttaa

SEQ ID NO: 1750204 - DNA, 19 bp, Homo sapiens
ataaactatttatatcaca

SEQ ID NO: 1750205 - DNA, 18 bp, Homo sapiens
ataaactccttaacttca

SEQ ID NO: 1750206 - DNA, 20 bp, Homo sapiens
ataaactccttaacttcagg

SEQ ID NO: 1750207 - DNA, 13 bp, Homo sapiens
ataaactctttta

SEQ ID NO: 1750208 - DNA, 12 bp, Homo sapiens
ataaactgagcc

SEQ ID NO: 1750209 - DNA, 16 bp, Homo sapiens
ataaacttaagggcaa

SEQ ID NO: 1750210 - DNA, 19 bp, Homo sapiens
ataaacttaagggcaagga

SEQ ID NO: 1750211 - DNA, 12 bp, Homo sapiens
ataaactttatt

SEQ ID NO: 1750212 - DNA, 23 bp, Homo sapiens
ataaacttttttttgagaatggt

SEQ ID NO: 1750213 - DNA, 21 bp, Homo sapiens
ataaagaacaaggtagttttt

SEQ ID NO: 1750214 - DNA, 11 bp, Homo sapiens
ataaagacaag

SEQ ID NO: 1750215 - DNA, 17 bp, Homo sapiens
ataaagagggtaacaat

SEQ ID NO: 1750216 - DNA, 22 bp, Homo sapiens
ataaagataacccttattccat

SEQ ID NO: 1750217 - DNA, 16 bp, Homo sapiens
ataaagatattgttca

SEQ ID NO: 1750218 - DNA, 17 bp, Homo sapiens
ataaagatatttccaag

SEQ ID NO: 1750219 - DNA, 13 bp, Homo sapiens
ataaagatgagtt

SEQ ID NO: 1750220 - DNA, 14 bp, Homo sapiens
ataaagatgagttg

SEQ ID NO: 1750221 - DNA, 15 bp, Homo sapiens
ataaagatgagttgg

SEQ ID NO: 1750222 - DNA, 15 bp, Homo sapiens
ataaagatgtgaaaa

SEQ ID NO: 1750223 - DNA, 16 bp, Homo sapiens
ataaagatgtgaaaac

SEQ ID NO: 1750224 - DNA, 17 bp, Homo sapiens
ataaagatgtgaaaact

SEQ ID NO: 1750225 - DNA, 20 bp, Homo sapiens
ataaagattataatatgtgc

SEQ ID NO: 1750226 - DNA, 18 bp, Homo sapiens
ataaagattatataaaga

SEQ ID NO: 1750227 - DNA, 20 bp, Homo sapiens
ataaagattatataaagacc

SEQ ID NO: 1750228 - DNA, 15 bp, Homo sapiens
ataaagattgtactt

SEQ ID NO: 1750229 - DNA, 11 bp, Homo sapiens
ataaagcaatt

SEQ ID NO: 1750230 - DNA, 14 bp, Homo sapiens
ataaagcacagctg

SEQ ID NO: 1750231 - DNA, 16 bp, Homo sapiens
ataaagcagtattttt

SEQ ID NO: 1750232 - DNA, 12 bp, Homo sapiens
ataaagccactg

SEQ ID NO: 1750233 - DNA, 16 bp, Homo sapiens
ataaagccacttctgg

SEQ ID NO: 1750234 - DNA, 18 bp, Homo sapiens
ataaagcctcaaggtttt

SEQ ID NO: 1750235 - DNA, 20 bp, Homo sapiens
ataaagcctgttttgtcttt

SEQ ID NO: 1750236 - DNA, 22 bp, Homo sapiens
ataaagcctttgtatctttctt

SEQ ID NO: 1750237 - DNA, 13 bp, Homo sapiens
ataaagctgttat

SEQ ID NO: 1750238 - DNA, 17 bp, Homo sapiens
ataaagcttgtggcccc

SEQ ID NO: 1750239 - DNA, 17 bp, Homo sapiens
ataaaggcagctgcctc

SEQ ID NO: 1750240 - DNA, 19 bp, Homo sapiens
ataaaggcagctgcctctg

SEQ ID NO: 1750241 - DNA, 20 bp, Homo sapiens
ataaaggcagctgcctctgc

SEQ ID NO: 1750242 - DNA, 18 bp, Homo sapiens
ataaaggcagttttctaa

SEQ ID NO: 1750243 - DNA, 16 bp, Homo sapiens
ataaaggtcccttagc

SEQ ID NO: 1750244 - DNA, 22 bp, Homo sapiens
ataaaggtctttgcacatgtga

SEQ ID NO: 1750245 - DNA, 22 bp, Homo sapiens
ataaaggtttaaagctgaagag

SEQ ID NO: 1750246 - DNA, 15 bp, Homo sapiens
ataaagtacaaatga

SEQ ID NO: 1750247 - DNA, 17 bp, Homo sapiens
ataaagtacaaatgaag

SEQ ID NO: 1750248 - DNA, 20 bp, Homo sapiens
ataaagtacaaatgaagaaa

SEQ ID NO: 1750249 - DNA, 16 bp, Homo sapiens
ataaagtagtcctgtg

SEQ ID NO: 1750250 - DNA, 16 bp, Homo sapiens
ataaagtctaagcaag

SEQ ID NO: 1750251 - DNA, 14 bp, Homo sapiens
ataaagtgtaacaa

SEQ ID NO: 1750252 - DNA, 19 bp, Homo sapiens
ataaagtgtaacaattgtg

SEQ ID NO: 1750253 - DNA, 18 bp, Homo sapiens
ataaagttacttgaattt

SEQ ID NO: 1750254 - DNA, 13 bp, Homo sapiens
ataaagttcctta

SEQ ID NO: 1750255 - DNA, 14 bp, Homo sapiens
ataaagttccttaa

SEQ ID NO: 1750256 - DNA, 17 bp, Homo sapiens
ataaagttgtattgcat

SEQ ID NO: 1750257 - DNA, 12 bp, Homo sapiens
ataaagtttgct

SEQ ID NO: 1750258 - DNA, 19 bp, Homo sapiens
ataaagtttgcttagaaaa

SEQ ID NO: 1750259 - DNA, 20 bp, Homo sapiens
ataaagttttatttgaatga

SEQ ID NO: 1750260 - DNA, 17 bp, Homo sapiens
ataaataaaaatggata

SEQ ID NO: 1750261 - DNA, 22 bp, Homo sapiens
ataaataaaagctagatactgg

SEQ ID NO: 1750262 - DNA, 14 bp, Homo sapiens
ataaataaagaaga

SEQ ID NO: 1750263 - DNA, 15 bp, Homo sapiens
ataaataaagaagaa

SEQ ID NO: 1750264 - DNA, 21 bp, Homo sapiens
ataaataatcggcccacagct

SEQ ID NO: 1750265 - DNA, 19 bp, Homo sapiens
ataaatactgtcaaacaat

SEQ ID NO: 1750266 - DNA, 17 bp, Homo sapiens
ataaataggtttatatt

SEQ ID NO: 1750267 - DNA, 21 bp, Homo sapiens
ataaatatcagtattctgaca

SEQ ID NO: 1750268 - DNA, 15 bp, Homo sapiens
ataaatattctgcat

SEQ ID NO: 1750269 - DNA, 14 bp, Homo sapiens
ataaatatttatgt

SEQ ID NO: 1750270 - DNA, 14 bp, Homo sapiens
ataaatcaatgtca

SEQ ID NO: 1750271 - DNA, 14 bp, Homo sapiens
ataaatcagtattt

SEQ ID NO: 1750272 - DNA, 20 bp, Homo sapiens
ataattatcggaagcagtgc

SEQ ID NO: 1750273 - DNA, 21 bp, Homo sapiens
ataattatcggaagcagtgcc

SEQ ID NO: 1750274 - DNA, 16 bp, Homo sapiens
ataattatgacagtta

SEQ ID NO: 1750275 - DNA, 14 bp, Homo sapiens
ataattcatttgta

SEQ ID NO: 1750276 - DNA, 17 bp, Homo sapiens
ataattccctatctttt

SEQ ID NO: 1750277 - DNA, 21 bp, Homo sapiens
ataattctaagttatttactt

SEQ ID NO: 1750278 - DNA, 19 bp, Homo sapiens
ataattctacatgttgtct

SEQ ID NO: 1750279 - DNA, 15 bp, Homo sapiens
ataattctcattaaa

SEQ ID NO: 1750280 - DNA, 12 bp, Homo sapiens
ataattctgtaa

SEQ ID NO: 1750281 - DNA, 14 bp, Homo sapiens
ataattctgtaaat

SEQ ID NO: 1750282 - DNA, 15 bp, Homo sapiens
ataattctgtactga

SEQ ID NO: 1750283 - DNA, 17 bp, Homo sapiens
ataattctgtactgatt

SEQ ID NO: 1750284 - DNA, 17 bp, Homo sapiens
ataattctgttatatga

SEQ ID NO: 1750285 - DNA, 14 bp, Homo sapiens
ataattcttgtata

SEQ ID NO: 1750286 - DNA, 22 bp, Homo sapiens
ataattgaaaagattttaacaa

SEQ ID NO: 1750287 - DNA, 22 bp, Homo sapiens
ataattgacaggattattggaa

SEQ ID NO: 1750288 - DNA, 14 bp, Homo sapiens
ataattgatcaaat

SEQ ID NO: 1750289 - DNA, 17 bp, Homo sapiens
ataattgcatcagttca

SEQ ID NO: 1750290 - DNA, 12 bp, Homo sapiens
ataattggaata

SEQ ID NO: 1750291 - DNA, 12 bp, Homo sapiens
ataattggctta

SEQ ID NO: 1750292 - DNA, 17 bp, Homo sapiens
ataattggtttgactgt

SEQ ID NO: 1750293 - DNA, 19 bp, Homo sapiens
ataattgtacaaaattaag

SEQ ID NO: 1750294 - DNA, 24 bp, Homo sapiens
ataattgtacaaaattaagcaaat

SEQ ID NO: 1750295 - DNA, 21 bp, Homo sapiens
ataattgtgattagacagaac

SEQ ID NO: 1750296 - DNA, 21 bp, Homo sapiens
ataattgtgtgatatttcaga

SEQ ID NO: 1750297 - DNA, 22 bp, Homo sapiens
ataattgtgtgatatttcagaa

SEQ ID NO: 1750298 - DNA, 23 bp, Homo sapiens
ataattgtgtgatatttcagaaa

SEQ ID NO: 1750299 - DNA, 23 bp, Homo sapiens
ataattgttctcagaatccctta

SEQ ID NO: 1750300 - DNA, 13 bp, Homo sapiens
ataattgtttcca

SEQ ID NO: 1750301 - DNA, 11 bp, Homo sapiens
ataattgtttt

SEQ ID NO: 1750302 - DNA, 16 bp, Homo sapiens
ataatttacaagatat

SEQ ID NO: 1750303 - DNA, 18 bp, Homo sapiens
ataatttacaggttctta

SEQ ID NO: 1750304 - DNA, 16 bp, Homo sapiens
ataatttacctaagat

SEQ ID NO: 1750305 - DNA, 21 bp, Homo sapiens
ataatttagtggatggaatat

SEQ ID NO: 1750306 - DNA, 19 bp, Homo sapiens
ataatttcacttaataatt

SEQ ID NO: 1750307 - DNA, 11 bp, Homo sapiens
ataatttccca

SEQ ID NO: 1750308 - DNA, 18 bp, Homo sapiens
ataatttcccaattagga

SEQ ID NO: 1750309 - DNA, 14 bp, Homo sapiens
ataatttctaatgt

SEQ ID NO: 1750310 - DNA, 19 bp, Homo sapiens
ataatttctattaatatca

SEQ ID NO: 1750311 - DNA, 21 bp, Homo sapiens
ataatttgaatgtatttgatt

SEQ ID NO: 1750312 - DNA, 16 bp, Homo sapiens
ataatttgtacaatgg

SEQ ID NO: 1750313 - DNA, 21 bp, Homo sapiens
ataatttgtacaatggtttat

SEQ ID NO: 1750314 - DNA, 24 bp, Homo sapiens
ataatttgtacaatggtttattcc

SEQ ID NO: 1750315 - DNA, 22 bp, Homo sapiens
ataatttgtacatatgtaaaat

SEQ ID NO: 1750316 - DNA, 21 bp, Homo sapiens
ataattttaaaaaagccttcc

SEQ ID NO: 1750317 - DNA, 21 bp, Homo sapiens
ataattttaagaaatcaaaga

SEQ ID NO: 1750318 - DNA, 23 bp, Homo sapiens
ataattttcttcatgcaatgaca

SEQ ID NO: 1750319 - DNA, 12 bp, Homo sapiens
ataattttgcct

SEQ ID NO: 1750320 - DNA, 17 bp, Homo sapiens
ataattttggaataatt

SEQ ID NO: 1750321 - DNA, 21 bp, Homo sapiens
ataattttggaataatttcta

SEQ ID NO: 1750322 - DNA, 21 bp, Homo sapiens
ataatttttaaagtatatatt

SEQ ID NO: 1750323 - DNA, 23 bp, Homo sapiens
ataatttttacctaatctccact

SEQ ID NO: 1750324 - DNA, 22 bp, Homo sapiens
ataatttttttcaatatttatt

SEQ ID NO: 1750325 - DNA, 18 bp, Homo sapiens
ataattttttttaaaata

SEQ ID NO: 1750326 - DNA, 14 bp, Homo sapiens
atacaaaaaattag

SEQ ID NO: 1750327 - DNA, 13 bp, Homo sapiens
atacaaaaatgaa

SEQ ID NO: 1750328 - DNA, 19 bp, Homo sapiens
atacaaaaattagccgggc

SEQ ID NO: 1750329 - DNA, 20 bp, Homo sapiens
atacaaaaccttgtgtaaga

SEQ ID NO: 1750330 - DNA, 17 bp, Homo sapiens
atacaaaatatttaagt

SEQ ID NO: 1750331 - DNA, 17 bp, Homo sapiens
atacaaactggtattct

SEQ ID NO: 1750332 - DNA, 14 bp, Homo sapiens
atacaaatggattt

SEQ ID NO: 1750333 - DNA, 23 bp, Homo sapiens
atacaaatttggccttaagaact

SEQ ID NO: 1750334 - DNA, 18 bp, Homo sapiens
atacaacagaaaccagaa

SEQ ID NO: 1750335 - DNA, 16 bp, Homo sapiens
atacaacttaaataat

SEQ ID NO: 1750336 - DNA, 16 bp, Homo sapiens
atacaagaaaatgtat

SEQ ID NO: 1750337 - DNA, 20 bp, Homo sapiens
atacaaggtataataaaatt

SEQ ID NO: 1750338 - DNA, 20 bp, Homo sapiens
atacaaggtgagtgtgactt

SEQ ID NO: 1750339 - DNA, 12 bp, Homo sapiens
atacaagtttca

SEQ ID NO: 1750340 - DNA, 17 bp, Homo sapiens
atacaagtttcagacag

SEQ ID NO: 1750341 - DNA, 16 bp, Homo sapiens
atacaatcagcccagt

SEQ ID NO: 1750342 - DNA, 17 bp, Homo sapiens
atacaatctcactctgt

SEQ ID NO: 1750343 - DNA, 14 bp, Homo sapiens
atacaatgtacaat

SEQ ID NO: 1750344 - DNA, 15 bp, Homo sapiens
atacaatgtacaatt

SEQ ID NO: 1750345 - DNA, 12 bp, Homo sapiens
atacaatgtatg

SEQ ID NO: 1750346 - DNA, 16 bp, Homo sapiens
atacaatgtatgtaca

SEQ ID NO: 1750347 - DNA, 17 bp, Homo sapiens
atacaatgtatgtacaa

SEQ ID NO: 1750348 - DNA, 21 bp, Homo sapiens
atacaatgtatttatttaaaa

SEQ ID NO: 1750349 - DNA, 15 bp, Homo sapiens
atacaattctacatt

SEQ ID NO: 1750350 - DNA, 13 bp, Homo sapiens
atacaatttgtac

SEQ ID NO: 1750351 - DNA, 16 bp, Homo sapiens
atacacaaaatcaaat

SEQ ID NO: 1750352 - DNA, 18 bp, Homo sapiens
atacacaaaatcaaataa

SEQ ID NO: 1750353 - DNA, 15 bp, Homo sapiens
atacacaagtaaaca

SEQ ID NO: 1750354 - DNA, 19 bp, Homo sapiens
atacacactcgaatcattg

SEQ ID NO: 1750355 - DNA, 22 bp, Homo sapiens
atacacatgaaaacaagaaaga

SEQ ID NO: 1750356 - DNA, 14 bp, Homo sapiens
atacacatttgcta

SEQ ID NO: 1750357 - DNA, 23 bp, Homo sapiens
atacaccgtttagaaaaaacaat

SEQ ID NO: 1750358 - DNA, 14 bp, Homo sapiens
atacactaaaaatc

SEQ ID NO: 1750359 - DNA, 22 bp, Homo sapiens
atacactatttgtgagcaaagg

SEQ ID NO: 1750360 - DNA, 21 bp, Homo sapiens
atacactgaaaggaaaaatgt

SEQ ID NO: 1750361 - DNA, 21 bp, Homo sapiens
atacactgaagttaacagaga

SEQ ID NO: 1750362 - DNA, 20 bp, Homo sapiens
atacactgtagtttttgaaa

SEQ ID NO: 1750363 - DNA, 23 bp, Homo sapiens
atacactgtagtttttgaaaatt

SEQ ID NO: 1750364 - DNA, 15 bp, Homo sapiens
atacactgtatctaa

SEQ ID NO: 1750365 - DNA, 23 bp, Homo sapiens
atacactgtatctaaaaaataac

SEQ ID NO: 1750366 - DNA, 18 bp, Homo sapiens
atacactgtgtaaatacc

SEQ ID NO: 1750367 - DNA, 17 bp, Homo sapiens
atacactttgttgcaag

SEQ ID NO: 1750368 - DNA, 16 bp, Homo sapiens
atacagaaatgcaaaa

SEQ ID NO: 1750369 - DNA, 18 bp, Homo sapiens
atacagaatcttgttttg

SEQ ID NO: 1750370 - DNA, 19 bp, Homo sapiens
atacagacactaagttata

SEQ ID NO: 1750371 - DNA, 21 bp, Homo sapiens
atacagacattcaatgaatta

SEQ ID NO: 1750372 - DNA, 22 bp, Homo sapiens
atacagaggatgccttttctgt

SEQ ID NO: 1750373 - DNA, 13 bp, Homo sapiens
atacagataaatg

SEQ ID NO: 1750374 - DNA, 20 bp, Homo sapiens
atacagataattcatttgta

SEQ ID NO: 1750375 - DNA, 13 bp, Homo sapiens
atacagcaaagga

SEQ ID NO: 1750376 - DNA, 15 bp, Homo sapiens
atacagcaaaggaaa

SEQ ID NO: 1750377 - DNA, 16 bp, Homo sapiens
atacagcaacaattta

SEQ ID NO: 1750378 - DNA, 20 bp, Homo sapiens
atacagcattacaaattgct

SEQ ID NO: 1750379 - DNA, 17 bp, Homo sapiens
atacagctgaagtcaaa

SEQ ID NO: 1750380 - DNA, 13 bp, Homo sapiens
atacagctgccta

SEQ ID NO: 1750381 - DNA, 11 bp, Homo sapiens
atacaggaaat

SEQ ID NO: 1750382 - DNA, 15 bp, Homo sapiens
atacaggtcatatta

SEQ ID NO: 1750383 - DNA, 17 bp, Homo sapiens
atacagtaactttatgt

SEQ ID NO: 1750384 - DNA, 12 bp, Homo sapiens
atacagtacaca

SEQ ID NO: 1750385 - DNA, 23 bp, Homo sapiens
atacagtacggatttgtccaaat

SEQ ID NO: 1750386 - DNA, 19 bp, Homo sapiens
atagcagagagccaaatct

SEQ ID NO: 1750387 - DNA, 22 bp, Homo sapiens
atagcagattttaattttgaat

SEQ ID NO: 1750388 - DNA, 19 bp, Homo sapiens
atagcagccagttcaaaaa

SEQ ID NO: 1750389 - DNA, 19 bp, Homo sapiens
atagcagcctttctctctt

SEQ ID NO: 1750390 - DNA, 22 bp, Homo sapiens
atagcagtatatgttaatttgt

SEQ ID NO: 1750391 - DNA, 23 bp, Homo sapiens
atagcatcctgattattgaatgt

SEQ ID NO: 1750392 - DNA, 23 bp, Homo sapiens
atagcatctcaggagatttcatg

SEQ ID NO: 1750393 - DNA, 12 bp, Homo sapiens
atagcatgaatt

SEQ ID NO: 1750394 - DNA, 14 bp, Homo sapiens
atagcatgcttcct

SEQ ID NO: 1750395 - DNA, 16 bp, Homo sapiens
atagcatgcttccttt

SEQ ID NO: 1750396 - DNA, 19 bp, Homo sapiens
atagcatgcttcctttctc

SEQ ID NO: 1750397 - DNA, 18 bp, Homo sapiens
atagcatggggcccctgg

SEQ ID NO: 1750398 - DNA, 20 bp, Homo sapiens
atagcatggggcccctggcc

SEQ ID NO: 1750399 - DNA, 13 bp, Homo sapiens
atagcatgtaatg

SEQ ID NO: 1750400 - DNA, 18 bp, Homo sapiens
atagcattgtttttgtca

SEQ ID NO: 1750401 - DNA, 14 bp, Homo sapiens
atagccagagagga

SEQ ID NO: 1750402 - DNA, 22 bp, Homo sapiens
atagccagagaggagcacctga

SEQ ID NO: 1750403 - DNA, 19 bp, Homo sapiens
atagccagcattcagcaca

SEQ ID NO: 1750404 - DNA, 20 bp, Homo sapiens
atagccagcattcagcacac

SEQ ID NO: 1750405 - DNA, 21 bp, Homo sapiens
atagccagcattcagcacaca

SEQ ID NO: 1750406 - DNA, 13 bp, Homo sapiens
atagccagcattt

SEQ ID NO: 1750407 - DNA, 20 bp, Homo sapiens
atagccatcgactcctgcct

SEQ ID NO: 1750408 - DNA, 13 bp, Homo sapiens
atagccccagact

SEQ ID NO: 1750409 - DNA, 15 bp, Homo sapiens
atagccccagactgg

SEQ ID NO: 1750410 - DNA, 20 bp, Homo sapiens
atagcctaagcggctgttta

SEQ ID NO: 1750411 - DNA, 13 bp, Homo sapiens
atagcctgaattt

SEQ ID NO: 1750412 - DNA, 15 bp, Homo sapiens
atagcctgaatttga

SEQ ID NO: 1750413 - DNA, 19 bp, Homo sapiens
atagcctgcctgatccctg

SEQ ID NO: 1750414 - DNA, 20 bp, Homo sapiens
atagcctgcctgatccctga

SEQ ID NO: 1750415 - DNA, 11 bp, Homo sapiens
atagcctggac

SEQ ID NO: 1750416 - DNA, 18 bp, Homo sapiens
atagcctggactgctacc

SEQ ID NO: 1750417 - DNA, 16 bp, Homo sapiens
atagcgatgtgcagga

SEQ ID NO: 1750418 - DNA, 17 bp, Homo sapiens
atagcgtcctgccctgc

SEQ ID NO: 1750419 - DNA, 15 bp, Homo sapiens
atagctacaggaagc

SEQ ID NO: 1750420 - DNA, 22 bp, Homo sapiens
atagctcagtttatccaaggtg

SEQ ID NO: 1750421 - DNA, 18 bp, Homo sapiens
atagctctactgccctcc

SEQ ID NO: 1750422 - DNA, 12 bp, Homo sapiens
atagctctgggg

SEQ ID NO: 1750423 - DNA, 14 bp, Homo sapiens
atagctgaaaaggg

SEQ ID NO: 1750424 - DNA, 17 bp, Homo sapiens
atagctgaaaagggcac

SEQ ID NO: 1750425 - DNA, 16 bp, Homo sapiens
atagcttaactaattt

SEQ ID NO: 1750426 - DNA, 23 bp, Homo sapiens
atagcttacctgaacaggaatcc

SEQ ID NO: 1750427 - DNA, 17 bp, Homo sapiens
atagcttctgtgtgtga

SEQ ID NO: 1750428 - DNA, 10 bp, Homo sapiens
atagctttat

SEQ ID NO: 1750429 - DNA, 19 bp, Homo sapiens
atagctttattttttaagt

SEQ ID NO: 1750430 - DNA, 21 bp, Homo sapiens
atagctttattttttaagtat

SEQ ID NO: 1750431 - DNA, 22 bp, Homo sapiens
atagctttattttttaagtatt

SEQ ID NO: 1750432 - DNA, 16 bp, Homo sapiens
ataggaaactgaagca

SEQ ID NO: 1750433 - DNA, 19 bp, Homo sapiens
ataggaaagcatatgcagc

SEQ ID NO: 1750434 - DNA, 19 bp, Homo sapiens
ataggaacaatctttgctg

SEQ ID NO: 1750435 - DNA, 20 bp, Homo sapiens
ataggaatcattcagaaatg

SEQ ID NO: 1750436 - DNA, 21 bp, Homo sapiens
ataggaatcattcagaaatgt

SEQ ID NO: 1750437 - DNA, 20 bp, Homo sapiens
ataggaatgtccaccatgaa

SEQ ID NO: 1750438 - DNA, 12 bp, Homo sapiens
ataggaatttag

SEQ ID NO: 1750439 - DNA, 23 bp, Homo sapiens
ataggacctttccaccacagcca

SEQ ID NO: 1750440 - DNA, 13 bp, Homo sapiens
ataggacgtattt

SEQ ID NO: 1750441 - DNA, 14 bp, Homo sapiens
ataggacgtattta

SEQ ID NO: 1750442 - DNA, 21 bp, Homo sapiens
ataggacgtatttataatagg

SEQ ID NO: 1750443 - DNA, 12 bp, Homo sapiens
ataggagggaga

SEQ ID NO: 1750444 - DNA, 16 bp, Homo sapiens
ataggagggagactgt

SEQ ID NO: 1750445 - DNA, 21 bp, Homo sapiens
ataggagtggtgatttgaaaa

SEQ ID NO: 1750446 - DNA, 17 bp, Homo sapiens
ataggattgggaaagaa

SEQ ID NO: 1750447 - DNA, 18 bp, Homo sapiens
ataggcctgtcccttgcc

SEQ ID NO: 1750448 - DNA, 19 bp, Homo sapiens
ataggcctgtcccttgcct

SEQ ID NO: 1750449 - DNA, 20 bp, Homo sapiens
ataggcggtcatgtgtgcat

SEQ ID NO: 1750450 - DNA, 14 bp, Homo sapiens
ataggctctgcaca

SEQ ID NO: 1750451 - DNA, 19 bp, Homo sapiens
ataggctctgcacagatgg

SEQ ID NO: 1750452 - DNA, 21 bp, Homo sapiens
ataggctcttaagcagcatgg

SEQ ID NO: 1750453 - DNA, 17 bp, Homo sapiens
ataggctggtggccttg

SEQ ID NO: 1750454 - DNA, 16 bp, Homo sapiens
atagggaaaattctaa

SEQ ID NO: 1750455 - DNA, 18 bp, Homo sapiens
atagggagaatatttact

SEQ ID NO: 1750456 - DNA, 16 bp, Homo sapiens
ataggggctttgctga

SEQ ID NO: 1750457 - DNA, 22 bp, Homo sapiens
atagggtaaggggaggctgctt

SEQ ID NO: 1750458 - DNA, 16 bp, Homo sapiens
ataggtaaaatctctg

SEQ ID NO: 1750459 - DNA, 17 bp, Homo sapiens
ataggtcactggctctc

SEQ ID NO: 1750460 - DNA, 20 bp, Homo sapiens
ataggtcactggctctccaa

SEQ ID NO: 1750461 - DNA, 15 bp, Homo sapiens
ataggtcatcatgaa

SEQ ID NO: 1750462 - DNA, 22 bp, Homo sapiens
ataggtcctgtgttaaacacta

SEQ ID NO: 1750463 - DNA, 19 bp, Homo sapiens
ataggtctcatctcttcag

SEQ ID NO: 1750464 - DNA, 21 bp, Homo sapiens
ataggtgctacaaaaacacag

SEQ ID NO: 1750465 - DNA, 22 bp, Homo sapiens
ataggtgcttattctcaaagca

SEQ ID NO: 1750466 - DNA, 14 bp, Homo sapiens
ataggttactacct

SEQ ID NO: 1750467 - DNA, 17 bp, Homo sapiens
ataggttttaaatctgc

SEQ ID NO: 1750468 - DNA, 22 bp, Homo sapiens
atagtaaacattaagtaaatgc

SEQ ID NO: 1750469 - DNA, 12 bp, Homo sapiens
atagtaaagtat

SEQ ID NO: 1750470 - DNA, 14 bp, Homo sapiens
atagtaataagatg

SEQ ID NO: 1750471 - DNA, 16 bp, Homo sapiens
atagtactaagcattt

SEQ ID NO: 1750472 - DNA, 15 bp, Homo sapiens
atagtaggcatgtta

SEQ ID NO: 1750473 - DNA, 13 bp, Homo sapiens
atagtagtatgat

SEQ ID NO: 1750474 - DNA, 17 bp, Homo sapiens
atagtagttaaataact

SEQ ID NO: 1750475 - DNA, 13 bp, Homo sapiens
atagtatacattg

SEQ ID NO: 1750476 - DNA, 15 bp, Homo sapiens
atagtatatttatac

SEQ ID NO: 1750477 - DNA, 14 bp, Homo sapiens
atagtcacaagagc

SEQ ID NO: 1750478 - DNA, 15 bp, Homo sapiens
atagtcacctgctgg

SEQ ID NO: 1750479 - DNA, 10 bp, Homo sapiens
atagtcagtg

SEQ ID NO: 1750480 - DNA, 18 bp, Homo sapiens
atagtctaagactatata

SEQ ID NO: 1750481 - DNA, 13 bp, Homo sapiens
atagtctgtgtga

SEQ ID NO: 1750482 - DNA, 14 bp, Homo sapiens
atagtcttccacaa

SEQ ID NO: 1750483 - DNA, 15 bp, Homo sapiens
atagtcttgaaatga

SEQ ID NO: 1750484 - DNA, 13 bp, Homo sapiens
atagtgaatactg

SEQ ID NO: 1750485 - DNA, 16 bp, Homo sapiens
atagtgaatacttact

SEQ ID NO: 1750486 - DNA, 20 bp, Homo sapiens
atagtgacaagtgaagaaca

SEQ ID NO: 1750487 - DNA, 23 bp, Homo sapiens
atagtgacttttcaagtatttaa

SEQ ID NO: 1750488 - DNA, 16 bp, Homo sapiens
atagtgggtacatcaa

SEQ ID NO: 1750489 - DNA, 18 bp, Homo sapiens
atagtgtaacttgcttaa

SEQ ID NO: 1750490 - DNA, 14 bp, Homo sapiens
atagtgtaagaact

SEQ ID NO: 1750491 - DNA, 15 bp, Homo sapiens
atagtgtaagaactg

SEQ ID NO: 1750492 - DNA, 16 bp, Homo sapiens
atagtgtaagaactgt

SEQ ID NO: 1750493 - DNA, 17 bp, Homo sapiens
atagtgtaagaactgta

SEQ ID NO: 1750494 - DNA, 19 bp, Homo sapiens
atagtgtcatataaactca

SEQ ID NO: 1750495 - DNA, 15 bp, Homo sapiens
atagtgtgaaatata

SEQ ID NO: 1750496 - DNA, 23 bp, Homo sapiens
atagtgttctgctcctgcttttc

SEQ ID NO: 1750497 - DNA, 23 bp, Homo sapiens
atagttaaaagactgcagctgct

SEQ ID NO: 1750498 - DNA, 21 bp, Homo sapiens
atagttaaatgttacctctga

SEQ ID NO: 1750499 - DNA, 21 bp, Homo sapiens
atagttactgtaaaatgcaaa

SEQ ID NO: 1750500 - DNA, 13 bp, Homo sapiens
atagttactgtgt

SEQ ID NO: 1750501 - DNA, 18 bp, Homo sapiens
atagttagatctttgtaa

SEQ ID NO: 1750502 - DNA, 15 bp, Homo sapiens
atagttcagtagaat

SEQ ID NO: 1750503 - DNA, 22 bp, Homo sapiens
atagttccttgccttaataaat

SEQ ID NO: 1750504 - DNA, 12 bp, Homo sapiens
atagttctaggc

SEQ ID NO: 1750505 - DNA, 13 bp, Homo sapiens
atagttctatttc

SEQ ID NO: 1750506 - DNA, 14 bp, Homo sapiens
atagttctatttct

SEQ ID NO: 1750507 - DNA, 18 bp, Homo sapiens
atagttctatttctatct

SEQ ID NO: 1750508 - DNA, 14 bp, Homo sapiens
atagttctgtatat

SEQ ID NO: 1750509 - DNA, 19 bp, Homo sapiens
atagttcttagctttgaaa

SEQ ID NO: 1750510 - DNA, 12 bp, Homo sapiens
atagttgaatta

SEQ ID NO: 1750511 - DNA, 13 bp, Homo sapiens
atagttgagcccc

SEQ ID NO: 1750512 - DNA, 14 bp, Homo sapiens
atagttgatatgta

SEQ ID NO: 1750513 - DNA, 20 bp, Homo sapiens
atagttgcatagcagtatat

SEQ ID NO: 1750514 - DNA, 19 bp, Homo sapiens
atagttgtagacaaagtac

SEQ ID NO: 1750515 - DNA, 16 bp, Homo sapiens
atagtttaggagaaac

SEQ ID NO: 1750516 - DNA, 14 bp, Homo sapiens
atagtttattgaca

SEQ ID NO: 1750517 - DNA, 14 bp, Homo sapiens
atagtttctgaggc

SEQ ID NO: 1750518 - DNA, 12 bp, Homo sapiens
atagtttgtcat

SEQ ID NO: 1750519 - DNA, 22 bp, Homo sapiens
atataaaactgtacttcactgt

SEQ ID NO: 1750520 - DNA, 18 bp, Homo sapiens
atataaagacctataaat

SEQ ID NO: 1750521 - DNA, 19 bp, Homo sapiens
atataaagtagtcctgtga

SEQ ID NO: 1750522 - DNA, 23 bp, Homo sapiens
atataaatagatgatttcaatag

SEQ ID NO: 1750523 - DNA, 15 bp, Homo sapiens
atataaatggctggt

SEQ ID NO: 1750524 - DNA, 18 bp, Homo sapiens
atataaatggctggtttt

SEQ ID NO: 1750525 - DNA, 14 bp, Homo sapiens
atataaatttaagc

SEQ ID NO: 1750526 - DNA, 19 bp, Homo sapiens
atataaatttaagcaaacg

SEQ ID NO: 1750527 - DNA, 20 bp, Homo sapiens
atataaatttttaagagaaa

SEQ ID NO: 1750528 - DNA, 16 bp, Homo sapiens
atataacatatatgga

SEQ ID NO: 1750529 - DNA, 14 bp, Homo sapiens
atataacatgcaaa

SEQ ID NO: 1750530 - DNA, 14 bp, Homo sapiens
atataactgtcttg

SEQ ID NO: 1750531 - DNA, 16 bp, Homo sapiens
atataactgtcttgtt

SEQ ID NO: 1750532 - DNA, 18 bp, Homo sapiens
atataactgtcttgtttc

SEQ ID NO: 1750533 - DNA, 20 bp, Homo sapiens
atataactgtcttgtttcag

SEQ ID NO: 1750534 - DNA, 21 bp, Homo sapiens
atataactgtcttgtttcagt

SEQ ID NO: 1750535 - DNA, 22 bp, Homo sapiens
atataactgtcttgtttcagtg

SEQ ID NO: 1750536 - DNA, 19 bp, Homo sapiens
atataagtattctaaattt

SEQ ID NO: 1750537 - DNA, 17 bp, Homo sapiens
atataagtttgaaggaa

SEQ ID NO: 1750538 - DNA, 16 bp, Homo sapiens
atataataatgatgat

SEQ ID NO: 1750539 - DNA, 20 bp, Homo sapiens
atataatattcagccagctt

SEQ ID NO: 1750540 - DNA, 15 bp, Homo sapiens
atataatggtttcaa

SEQ ID NO: 1750541 - DNA, 14 bp, Homo sapiens
atataatgtatttt

SEQ ID NO: 1750542 - DNA, 16 bp, Homo sapiens
atataattctgtaaat

SEQ ID NO: 1750543 - DNA, 12 bp, Homo sapiens
atataattctta

SEQ ID NO: 1750544 - DNA, 15 bp, Homo sapiens
atatacaaacatgta

SEQ ID NO: 1750545 - DNA, 17 bp, Homo sapiens
atatacagtaactttat

SEQ ID NO: 1750546 - DNA, 16 bp, Homo sapiens
atatacatctgtgtat

SEQ ID NO: 1750547 - DNA, 18 bp, Homo sapiens
atatacattcaaacttaa

SEQ ID NO: 1750548 - DNA, 12 bp, Homo sapiens
atatacattgtg

SEQ ID NO: 1750549 - DNA, 14 bp, Homo sapiens
atatacattttcta

SEQ ID NO: 1750550 - DNA, 17 bp, Homo sapiens
atatacattttctaaat

SEQ ID NO: 1750551 - DNA, 18 bp, Homo sapiens
atatacctggcttttact

SEQ ID NO: 1750552 - DNA, 22 bp, Homo sapiens
atatacctggcttttactttat

SEQ ID NO: 1750553 - DNA, 14 bp, Homo sapiens
atatacctggttta

SEQ ID NO: 1750554 - DNA, 20 bp, Homo sapiens
atatactgaagtcttttctg

SEQ ID NO: 1750555 - DNA, 17 bp, Homo sapiens
atatactgcttgtcatc

SEQ ID NO: 1750556 - DNA, 18 bp, Homo sapiens
atatacttgtttttgtaa

SEQ ID NO: 1750557 - DNA, 20 bp, Homo sapiens
atatacttgtttttgtaaag

SEQ ID NO: 1750558 - DNA, 20 bp, Homo sapiens
atatactttgaaaggagatg

SEQ ID NO: 1750559 - DNA, 18 bp, Homo sapiens
atatagaaagctgtttat

SEQ ID NO: 1750560 - DNA, 20 bp, Homo sapiens
atatagacagtccttaaaaa

SEQ ID NO: 1750561 - DNA, 18 bp, Homo sapiens
atatagacattctcacat

SEQ ID NO: 1750562 - DNA, 14 bp, Homo sapiens
atatagagaataag

SEQ ID NO: 1750563 - DNA, 22 bp, Homo sapiens
atatagagtcattgtaatgttg

SEQ ID NO: 1750564 - DNA, 18 bp, Homo sapiens
atatagattataacttgt

SEQ ID NO: 1750565 - DNA, 14 bp, Homo sapiens
atatagctgctcct

SEQ ID NO: 1750566 - DNA, 16 bp, Homo sapiens
atatagtatatttata

SEQ ID NO: 1750567 - DNA, 19 bp, Homo sapiens
atatagtatatttatactc

SEQ ID NO: 1750568 - DNA, 21 bp, Homo sapiens
atatagtatatttatactcta

SEQ ID NO: 1750569 - DNA, 15 bp, Homo sapiens
atatagtccagacac

SEQ ID NO: 1750570 - DNA, 18 bp, Homo sapiens
atatagtgggtacatcaa

SEQ ID NO: 1750571 - DNA, 12 bp, Homo sapiens
atatagttcctt

SEQ ID NO: 1750572 - DNA, 15 bp, Homo sapiens
atatagttgaacaag

SEQ ID NO: 1750573 - DNA, 17 bp, Homo sapiens
atatagttgaacaagat

SEQ ID NO: 1750574 - DNA, 12 bp, Homo sapiens
atatagttttac

SEQ ID NO: 1750575 - DNA, 19 bp, Homo sapiens
atatataaaaagaaaagat

SEQ ID NO: 1750576 - DNA, 22 bp, Homo sapiens
atatataaagacaacaaaagaa

SEQ ID NO: 1750577 - DNA, 12 bp, Homo sapiens
atatataaatgt

SEQ ID NO: 1750578 - DNA, 13 bp, Homo sapiens
atatataactatt

SEQ ID NO: 1750579 - DNA, 12 bp, Homo sapiens
atatataataaa

SEQ ID NO: 1750580 - DNA, 15 bp, Homo sapiens
atatataataaatac

SEQ ID NO: 1750581 - DNA, 21 bp, Homo sapiens
atatataatggtaatagaata

SEQ ID NO: 1750582 - DNA, 17 bp, Homo sapiens
atatataatgttgccag

SEQ ID NO: 1750583 - DNA, 20 bp, Homo sapiens
atatatacagtaactttatg

SEQ ID NO: 1750584 - DNA, 13 bp, Homo sapiens
atatatacatttt

SEQ ID NO: 1750585 - DNA, 15 bp, Homo sapiens
atatatacatttttt

SEQ ID NO: 1750586 - DNA, 23 bp, Homo sapiens
atatatagctacattcacacact

SEQ ID NO: 1750587 - DNA, 16 bp, Homo sapiens
atatatataaatgtat

SEQ ID NO: 1750588 - DNA, 15 bp, Homo sapiens
atatatatatataac

SEQ ID NO: 1750589 - DNA, 15 bp, Homo sapiens
atatatatatatgca

SEQ ID NO: 1750590 - DNA, 12 bp, Homo sapiens
atatatatatgt

SEQ ID NO: 1750591 - DNA, 21 bp, Homo sapiens
atatatatctatatatataat

SEQ ID NO: 1750592 - DNA, 20 bp, Homo sapiens
atatatatggtcatatacat

SEQ ID NO: 1750593 - DNA, 16 bp, Homo sapiens
atatatatgtatatgt

SEQ ID NO: 1750594 - DNA, 19 bp, Homo sapiens
atatatcaagaagtcttga

SEQ ID NO: 1750595 - DNA, 17 bp, Homo sapiens
atatatccctgataaat

SEQ ID NO: 1750596 - DNA, 15 bp, Homo sapiens
atatatctatatcat

SEQ ID NO: 1750597 - DNA, 13 bp, Homo sapiens
atatatcttttgt

SEQ ID NO: 1750598 - DNA, 15 bp, Homo sapiens
atatatcttttgtaa

SEQ ID NO: 1750599 - DNA, 14 bp, Homo sapiens
atatatgacttcct

SEQ ID NO: 1750600 - DNA, 13 bp, Homo sapiens
atatatgaggact

SEQ ID NO: 1750601 - DNA, 15 bp, Homo sapiens
atatatgcactatgt

SEQ ID NO: 1750602 - DNA, 13 bp, Homo sapiens
atatatgcatata

SEQ ID NO: 1750603 - DNA, 20 bp, Homo sapiens
atatatgcatatatatatgt

SEQ ID NO: 1750604 - DNA, 19 bp, Homo sapiens
atatatgtataatatatat

SEQ ID NO: 1750605 - DNA, 19 bp, Homo sapiens
atatatgtatatatatgca

SEQ ID NO: 1750606 - DNA, 14 bp, Homo sapiens
atatatgtatatgt

SEQ ID NO: 1750607 - DNA, 15 bp, Homo sapiens
atatatgtatatgta

SEQ ID NO: 1750608 - DNA, 17 bp, Homo sapiens
atatatgtatatgtata

SEQ ID NO: 1750609 - DNA, 12 bp, Homo sapiens
atatatgtattt

SEQ ID NO: 1750610 - DNA, 18 bp, Homo sapiens
atatatgtgaacatttat

SEQ ID NO: 1750611 - DNA, 19 bp, Homo sapiens
atatatgtgtgtgtatgtt

SEQ ID NO: 1750612 - DNA, 13 bp, Homo sapiens
atatatgtgtttt

SEQ ID NO: 1750613 - DNA, 15 bp, Homo sapiens
atatatgttttgtct

SEQ ID NO: 1750614 - DNA, 23 bp, Homo sapiens
atatattcgggcaggactgttgt

SEQ ID NO: 1750615 - DNA, 17 bp, Homo sapiens
atatattcttataaaaa

SEQ ID NO: 1750616 - DNA, 16 bp, Homo sapiens
atatatttaaaaataa

SEQ ID NO: 1750617 - DNA, 15 bp, Homo sapiens
atattctgttgcttt

SEQ ID NO: 1750618 - DNA, 18 bp, Homo sapiens
atattctgttgctttaca

SEQ ID NO: 1750619 - DNA, 13 bp, Homo sapiens
atattcttataaa

SEQ ID NO: 1750620 - DNA, 22 bp, Homo sapiens
atattcttgctttcacaaatat

SEQ ID NO: 1750621 - DNA, 20 bp, Homo sapiens
atattctttctcataaaact

SEQ ID NO: 1750622 - DNA, 20 bp, Homo sapiens
atattgaaaggcaaacattt

SEQ ID NO: 1750623 - DNA, 20 bp, Homo sapiens
atattgaagacaatttgata

SEQ ID NO: 1750624 - DNA, 18 bp, Homo sapiens
atattgaaggagaaaata

SEQ ID NO: 1750625 - DNA, 12 bp, Homo sapiens
atattgaatgtt

SEQ ID NO: 1750626 - DNA, 13 bp, Homo sapiens
atattgacatttg

SEQ ID NO: 1750627 - DNA, 14 bp, Homo sapiens
atattgacatttgt

SEQ ID NO: 1750628 - DNA, 15 bp, Homo sapiens
atattgacatttgta

SEQ ID NO: 1750629 - DNA, 23 bp, Homo sapiens
atattgacccaaatgtgtaatat

SEQ ID NO: 1750630 - DNA, 17 bp, Homo sapiens
atattgactcaaaccat

SEQ ID NO: 1750631 - DNA, 15 bp, Homo sapiens
atattgatatgctta

SEQ ID NO: 1750632 - DNA, 15 bp, Homo sapiens
atattgattgggaaa

SEQ ID NO: 1750633 - DNA, 15 bp, Homo sapiens
atattgccttatttg

SEQ ID NO: 1750634 - DNA, 20 bp, Homo sapiens
atattggtgcgtttttacag

SEQ ID NO: 1750635 - DNA, 14 bp, Homo sapiens
atattggttcttcc

SEQ ID NO: 1750636 - DNA, 15 bp, Homo sapiens
atattggttcttccc

SEQ ID NO: 1750637 - DNA, 13 bp, Homo sapiens
atattgtacataa

SEQ ID NO: 1750638 - DNA, 18 bp, Homo sapiens
atattgtatgtaagtaat

SEQ ID NO: 1750639 - DNA, 22 bp, Homo sapiens
atattgtcagagttctgctcta

SEQ ID NO: 1750640 - DNA, 13 bp, Homo sapiens
atattgtgaagta

SEQ ID NO: 1750641 - DNA, 13 bp, Homo sapiens
atattgtgattct

SEQ ID NO: 1750642 - DNA, 18 bp, Homo sapiens
atattgtgttgtgaatgt

SEQ ID NO: 1750643 - DNA, 12 bp, Homo sapiens
atattgttaagg

SEQ ID NO: 1750644 - DNA, 15 bp, Homo sapiens
atattgttgacaact

SEQ ID NO: 1750645 - DNA, 19 bp, Homo sapiens
atattgtttggtaaatgtt

SEQ ID NO: 1750646 - DNA, 18 bp, Homo sapiens
atattgttttctgtaaat

SEQ ID NO: 1750647 - DNA, 23 bp, Homo sapiens
atattgttttctgtaaataacct

SEQ ID NO: 1750648 - DNA, 22 bp, Homo sapiens
atattgtttttttatttggcat

SEQ ID NO: 1750649 - DNA, 16 bp, Homo sapiens
atatttaaaaataagt

SEQ ID NO: 1750650 - DNA, 19 bp, Homo sapiens
atatttaaaaattgtttct

SEQ ID NO: 1750651 - DNA, 22 bp, Homo sapiens
atatttaaaaattgtttcttga

SEQ ID NO: 1750652 - DNA, 19 bp, Homo sapiens
atatttaaagggaaattga

SEQ ID NO: 1750653 - DNA, 14 bp, Homo sapiens
atatttaagaaaat

SEQ ID NO: 1750654 - DNA, 19 bp, Homo sapiens
atatttaagaaaatacaat

SEQ ID NO: 1750655 - DNA, 19 bp, Homo sapiens
atatttaagccttttgtgt

SEQ ID NO: 1750656 - DNA, 14 bp, Homo sapiens
atatttaagtatat

SEQ ID NO: 1750657 - DNA, 20 bp, Homo sapiens
atatttaagtatatagtata

SEQ ID NO: 1750658 - DNA, 9 bp, Homo sapiens
atatttaat

SEQ ID NO: 1750659 - DNA, 16 bp, Homo sapiens
atatttaataatgctt

SEQ ID NO: 1750660 - DNA, 12 bp, Homo sapiens
atatttaatgat

SEQ ID NO: 1750661 - DNA, 23 bp, Homo sapiens
atatttaatgataagtaaatgct

SEQ ID NO: 1750662 - DNA, 16 bp, Homo sapiens
atatttaatgttgaac

SEQ ID NO: 1750663 - DNA, 21 bp, Homo sapiens
atatttacatgaattgcattt

SEQ ID NO: 1750664 - DNA, 16 bp, Homo sapiens
atatttactgctcttt

SEQ ID NO: 1750665 - DNA, 15 bp, Homo sapiens
atatttagaaaattt

SEQ ID NO: 1750666 - DNA, 11 bp, Homo sapiens
atatttataac

SEQ ID NO: 1750667 - DNA, 23 bp, Homo sapiens
atatttataactcatcataaaat

SEQ ID NO: 1750668 - DNA, 15 bp, Homo sapiens
atatttatagtcaca

SEQ ID NO: 1750669 - DNA, 15 bp, Homo sapiens
atatttatatatatt

SEQ ID NO: 1750670 - DNA, 15 bp, Homo sapiens
atatttatatttcac

SEQ ID NO: 1750671 - DNA, 17 bp, Homo sapiens
atatttatgaagaaaat

SEQ ID NO: 1750672 - DNA, 19 bp, Homo sapiens
atatttatgaagaaaatac

SEQ ID NO: 1750673 - DNA, 21 bp, Homo sapiens
atatttatgaagaaaatactt

SEQ ID NO: 1750674 - DNA, 13 bp, Homo sapiens
atatttattactt

SEQ ID NO: 1750675 - DNA, 21 bp, Homo sapiens
atatttattgcattgctggta

SEQ ID NO: 1750676 - DNA, 22 bp, Homo sapiens
atatttattgtttatttatcag

SEQ ID NO: 1750677 - DNA, 23 bp, Homo sapiens
atatttattgtttatttatcagt

SEQ ID NO: 1750678 - DNA, 20 bp, Homo sapiens
atatttatttaaaatttcgt

SEQ ID NO: 1750679 - DNA, 15 bp, Homo sapiens
atatttcaaacatca

SEQ ID NO: 1750680 - DNA, 11 bp, Homo sapiens
atatttcaatc

SEQ ID NO: 1750681 - DNA, 15 bp, Homo sapiens
atatttccatttctt

SEQ ID NO: 1750682 - DNA, 17 bp, Homo sapiens
atatttcctaaggcatg

SEQ ID NO: 1750683 - DNA, 23 bp, Homo sapiens
atatttcctaaggcatgtggcct

SEQ ID NO: 1750684 - DNA, 13 bp, Homo sapiens
atatttcctgact

SEQ ID NO: 1750685 - DNA, 17 bp, Homo sapiens
atatttcctttatgtga

SEQ ID NO: 1750686 - DNA, 15 bp, Homo sapiens
atatttcgaaagctg

SEQ ID NO: 1750687 - DNA, 14 bp, Homo sapiens
atatttctaactat

SEQ ID NO: 1750688 - DNA, 15 bp, Homo sapiens
atatttctaactata

SEQ ID NO: 1750689 - DNA, 16 bp, Homo sapiens
atatttctaactatat

SEQ ID NO: 1750690 - DNA, 21 bp, Homo sapiens
atatttctaagcttatttcta

SEQ ID NO: 1750691 - DNA, 13 bp, Homo sapiens
atatttcttgctt

SEQ ID NO: 1750692 - DNA, 18 bp, Homo sapiens
atatttgaaatagtatac

SEQ ID NO: 1750693 - DNA, 13 bp, Homo sapiens
atatttgaatttt

SEQ ID NO: 1750694 - DNA, 15 bp, Homo sapiens
atatttgattatgta

SEQ ID NO: 1750695 - DNA, 18 bp, Homo sapiens
atatttgatttctaattg

SEQ ID NO: 1750696 - DNA, 13 bp, Homo sapiens
atatttggaaaga

SEQ ID NO: 1750697 - DNA, 23 bp, Homo sapiens
atatttggagctatcagtgcttt

SEQ ID NO: 1750698 - DNA, 15 bp, Homo sapiens
atatttgtactttct

SEQ ID NO: 1750699 - DNA, 13 bp, Homo sapiens
atatttgtaggag

SEQ ID NO: 1750700 - DNA, 18 bp, Homo sapiens
atatttgtatagttgctt

SEQ ID NO: 1750701 - DNA, 16 bp, Homo sapiens
atatttgtcttccgat

SEQ ID NO: 1750702 - DNA, 17 bp, Homo sapiens
atatttgtcttccgatc

SEQ ID NO: 1750703 - DNA, 22 bp, Homo sapiens
atatttgtgccgtaattatgta

SEQ ID NO: 1750704 - DNA, 13 bp, Homo sapiens
atattttaaaatt

SEQ ID NO: 1750705 - DNA, 13 bp, Homo sapiens
atattttatcctg

SEQ ID NO: 1750706 - DNA, 15 bp, Homo sapiens
atattttatgaacat

SEQ ID NO: 1750707 - DNA, 20 bp, Homo sapiens
atattttatgaacattgtac

SEQ ID NO: 1750708 - DNA, 20 bp, Homo sapiens
atattttatgtgagagaaag

SEQ ID NO: 1750709 - DNA, 15 bp, Homo sapiens
atattttatttttca

SEQ ID NO: 1750710 - DNA, 20 bp, Homo sapiens
atattttcaacgcagccctg

SEQ ID NO: 1750711 - DNA, 24 bp, Homo sapiens
atattttcctagtagatctatatt

SEQ ID NO: 1750712 - DNA, 13 bp, Homo sapiens
atattttctctgt

SEQ ID NO: 1750713 - DNA, 18 bp, Homo sapiens
atattttctctgtacttt

SEQ ID NO: 1750714 - DNA, 18 bp, Homo sapiens
atattttgagaaactgct

SEQ ID NO: 1750715 - DNA, 13 bp, Homo sapiens
atattttgctaac

SEQ ID NO: 1750716 - DNA, 14 bp, Homo sapiens
atattttgctaact

SEQ ID NO: 1750717 - DNA, 23 bp, Homo sapiens
atattttgctaactggttaaaca

SEQ ID NO: 1750718 - DNA, 19 bp, Homo sapiens
atattttgggaatcttttc

SEQ ID NO: 1750719 - DNA, 13 bp, Homo sapiens
atattttgtgtga

SEQ ID NO: 1750720 - DNA, 21 bp, Homo sapiens
atattttgttgccttcatctt

SEQ ID NO: 1750721 - DNA, 21 bp, Homo sapiens
atattttgttgctttcttacc

SEQ ID NO: 1750722 - DNA, 16 bp, Homo sapiens
atattttgttgttcct

SEQ ID NO: 1750723 - DNA, 12 bp, Homo sapiens
atatttttaaga

SEQ ID NO: 1750724 - DNA, 16 bp, Homo sapiens
atatttttaagataat

SEQ ID NO: 1750725 - DNA, 19 bp, Homo sapiens
atatttttatatttccttt

SEQ ID NO: 1750726 - DNA, 15 bp, Homo sapiens
atatttttatcttta

SEQ ID NO: 1750727 - DNA, 20 bp, Homo sapiens
atatttttatctttatatga

SEQ ID NO: 1750728 - DNA, 14 bp, Homo sapiens
atatttttcacata

SEQ ID NO: 1750729 - DNA, 18 bp, Homo sapiens
atatttttcacatatcta

SEQ ID NO: 1750730 - DNA, 18 bp, Homo sapiens
atatttttcataaacaag

SEQ ID NO: 1750731 - DNA, 15 bp, Homo sapiens
atatttttgtatttt

SEQ ID NO: 1750732 - DNA, 23 bp, Homo sapiens
atcatagattattataaactata

SEQ ID NO: 1750733 - DNA, 22 bp, Homo sapiens
atcataggaagggaccaaggca

SEQ ID NO: 1750734 - DNA, 18 bp, Homo sapiens
atcatataaattttttgt

SEQ ID NO: 1750735 - DNA, 16 bp, Homo sapiens
atcatataataaatgt

SEQ ID NO: 1750736 - DNA, 16 bp, Homo sapiens
atcatatattaaaaca

SEQ ID NO: 1750737 - DNA, 19 bp, Homo sapiens
atcatatattaaaacaata

SEQ ID NO: 1750738 - DNA, 13 bp, Homo sapiens
atcatatgattct

SEQ ID NO: 1750739 - DNA, 16 bp, Homo sapiens
atcatatgattctgct

SEQ ID NO: 1750740 - DNA, 13 bp, Homo sapiens
atcatattgtatg

SEQ ID NO: 1750741 - DNA, 16 bp, Homo sapiens
atcatattgtatgtaa

SEQ ID NO: 1750742 - DNA, 12 bp, Homo sapiens
atcatcaagaag

SEQ ID NO: 1750743 - DNA, 21 bp, Homo sapiens
atcatcaagaagggctgcatg

SEQ ID NO: 1750744 - DNA, 23 bp, Homo sapiens
atcatcaagcaggaattatgtcg

SEQ ID NO: 1750745 - DNA, 20 bp, Homo sapiens
atcatcaatacttttgtgta

SEQ ID NO: 1750746 - DNA, 13 bp, Homo sapiens
atcatcactgtaa

SEQ ID NO: 1750747 - DNA, 15 bp, Homo sapiens
atcatcactgtaaag

SEQ ID NO: 1750748 - DNA, 16 bp, Homo sapiens
atcatcactgtaaaga

SEQ ID NO: 1750749 - DNA, 18 bp, Homo sapiens
atcatcactgtaaagaca

SEQ ID NO: 1750750 - DNA, 23 bp, Homo sapiens
atcatcattcttgtgggagacag

SEQ ID NO: 1750751 - DNA, 15 bp, Homo sapiens
atcatcctaagctat

SEQ ID NO: 1750752 - DNA, 22 bp, Homo sapiens
atcatcctttgttctgagcatt

SEQ ID NO: 1750753 - DNA, 22 bp, Homo sapiens
atcatcgccagaggtgcttcac

SEQ ID NO: 1750754 - DNA, 15 bp, Homo sapiens
atcatctatagaaag

SEQ ID NO: 1750755 - DNA, 19 bp, Homo sapiens
atcatctcagctcactgca

SEQ ID NO: 1750756 - DNA, 18 bp, Homo sapiens
atcatctgcattcctgat

SEQ ID NO: 1750757 - DNA, 13 bp, Homo sapiens
atcatctgccgtg

SEQ ID NO: 1750758 - DNA, 17 bp, Homo sapiens
atcatgaaaagaggaac

SEQ ID NO: 1750759 - DNA, 16 bp, Homo sapiens
atcatgaaacacttct

SEQ ID NO: 1750760 - DNA, 14 bp, Homo sapiens
atcatgaactggct

SEQ ID NO: 1750761 - DNA, 24 bp, Homo sapiens
atcatgaactggcttgtacatttt

SEQ ID NO: 1750762 - DNA, 15 bp, Homo sapiens
atcatgaataactga

SEQ ID NO: 1750763 - DNA, 17 bp, Homo sapiens
atcatgaattatataat

SEQ ID NO: 1750764 - DNA, 20 bp, Homo sapiens
atcatgaattcccttttaat

SEQ ID NO: 1750765 - DNA, 14 bp, Homo sapiens
atcatgaattttaa

SEQ ID NO: 1750766 - DNA, 15 bp, Homo sapiens
atcatgaattttaaa

SEQ ID NO: 1750767 - DNA, 17 bp, Homo sapiens
atcatgcgttttatatc

SEQ ID NO: 1750768 - DNA, 19 bp, Homo sapiens
atcatggaggtttgaagat

SEQ ID NO: 1750769 - DNA, 14 bp, Homo sapiens
atcatgggccagag

SEQ ID NO: 1750770 - DNA, 18 bp, Homo sapiens
atcatgggccagagcctc

SEQ ID NO: 1750771 - DNA, 14 bp, Homo sapiens
atcatgggtcaaga

SEQ ID NO: 1750772 - DNA, 18 bp, Homo sapiens
atcatggtcaagttccca

SEQ ID NO: 1750773 - DNA, 12 bp, Homo sapiens
atcatggttttt

SEQ ID NO: 1750774 - DNA, 16 bp, Homo sapiens
atcatgtccatacact

SEQ ID NO: 1750775 - DNA, 17 bp, Homo sapiens
atcatgtcgtaggtaaa

SEQ ID NO: 1750776 - DNA, 12 bp, Homo sapiens
atcatgtctgta

SEQ ID NO: 1750777 - DNA, 23 bp, Homo sapiens
atcatgtctgtatactcctgtca

SEQ ID NO: 1750778 - DNA, 17 bp, Homo sapiens
atcatgtggccccaccc

SEQ ID NO: 1750779 - DNA, 15 bp, Homo sapiens
atcatgttaaattag

SEQ ID NO: 1750780 - DNA, 15 bp, Homo sapiens
atcatgttgaaacaa

SEQ ID NO: 1750781 - DNA, 16 bp, Homo sapiens
atcatgttgatcatgt

SEQ ID NO: 1750782 - DNA, 14 bp, Homo sapiens
atcatgtttctttg

SEQ ID NO: 1750783 - DNA, 23 bp, Homo sapiens
atcatgtttctttgatcatgaat

SEQ ID NO: 1750784 - DNA, 12 bp, Homo sapiens
atcatgtttgct

SEQ ID NO: 1750785 - DNA, 13 bp, Homo sapiens
atcatgtttgctc

SEQ ID NO: 1750786 - DNA, 16 bp, Homo sapiens
atcatgtttgctctcc

SEQ ID NO: 1750787 - DNA, 14 bp, Homo sapiens
atcattaaaaatta

SEQ ID NO: 1750788 - DNA, 15 bp, Homo sapiens
atcattaagacaact

SEQ ID NO: 1750789 - DNA, 11 bp, Homo sapiens
atcattaatac

SEQ ID NO: 1750790 - DNA, 14 bp, Homo sapiens
atcattaatgtaat

SEQ ID NO: 1750791 - DNA, 20 bp, Homo sapiens
atcattataactgaaggaga

SEQ ID NO: 1750792 - DNA, 12 bp, Homo sapiens
atcattcagaaa

SEQ ID NO: 1750793 - DNA, 14 bp, Homo sapiens
atcattcagaaatg

SEQ ID NO: 1750794 - DNA, 22 bp, Homo sapiens
atcattccaattctaaatccga

SEQ ID NO: 1750795 - DNA, 13 bp, Homo sapiens
atcattccctctc

SEQ ID NO: 1750796 - DNA, 22 bp, Homo sapiens
atcattccctctcatctcaggt

SEQ ID NO: 1750797 - DNA, 19 bp, Homo sapiens
atcattcttttatagagca

SEQ ID NO: 1750798 - DNA, 19 bp, Homo sapiens
atcatttattttttacatt

SEQ ID NO: 1750799 - DNA, 18 bp, Homo sapiens
atcatttctattaaatga

SEQ ID NO: 1750800 - DNA, 21 bp, Homo sapiens
atcatttctattaaatgagca

SEQ ID NO: 1750801 - DNA, 17 bp, Homo sapiens
atcatttgaacaactag

SEQ ID NO: 1750802 - DNA, 16 bp, Homo sapiens
atcatttgtcctgttc

SEQ ID NO: 1750803 - DNA, 13 bp, Homo sapiens
atcatttgtttaa

SEQ ID NO: 1750804 - DNA, 13 bp, Homo sapiens
atcattttccccc

SEQ ID NO: 1750805 - DNA, 15 bp, Homo sapiens
atcattttcccccca

SEQ ID NO: 1750806 - DNA, 13 bp, Homo sapiens
atcatttttaatt

SEQ ID NO: 1750807 - DNA, 14 bp, Homo sapiens
atcatttttgtatc

SEQ ID NO: 1750808 - DNA, 17 bp, Homo sapiens
atcattttttatatata

SEQ ID NO: 1750809 - DNA, 13 bp, Homo sapiens
atccaaaagaagc

SEQ ID NO: 1750810 - DNA, 19 bp, Homo sapiens
atccaaaagaagcccccag

SEQ ID NO: 1750811 - DNA, 13 bp, Homo sapiens
atccaaaagacaa

SEQ ID NO: 1750812 - DNA, 20 bp, Homo sapiens
atccaaaagacaaaaatcaa

SEQ ID NO: 1750813 - DNA, 13 bp, Homo sapiens
atccaaaagcttt

SEQ ID NO: 1750814 - DNA, 20 bp, Homo sapiens
atccaaaatgaatgcaaaat

SEQ ID NO: 1750815 - DNA, 19 bp, Homo sapiens
atccaaaatgtgtatttct

SEQ ID NO: 1750816 - DNA, 23 bp, Homo sapiens
atccaaaatgtgtatttcttata

SEQ ID NO: 1750817 - DNA, 21 bp, Homo sapiens
atccaaagcttattttgtaag

SEQ ID NO: 1750818 - DNA, 20 bp, Homo sapiens
atccaaagttgccacagatg

SEQ ID NO: 1750819 - DNA, 13 bp, Homo sapiens
atccaaatattgt

SEQ ID NO: 1750820 - DNA, 19 bp, Homo sapiens
atccaaatctgtcctctgt

SEQ ID NO: 1750821 - DNA, 21 bp, Homo sapiens
atccaaatctgtcctctgtag

SEQ ID NO: 1750822 - DNA, 20 bp, Homo sapiens
atccaaccccccacctgcca

SEQ ID NO: 1750823 - DNA, 15 bp, Homo sapiens
atccaactccagcaa

SEQ ID NO: 1750824 - DNA, 16 bp, Homo sapiens
atccaactccagcaac

SEQ ID NO: 1750825 - DNA, 14 bp, Homo sapiens
atccaactttcaca

SEQ ID NO: 1750826 - DNA, 22 bp, Homo sapiens
atccaagacagaataatgaatg

SEQ ID NO: 1750827 - DNA, 12 bp, Homo sapiens
atccaagcctcc

SEQ ID NO: 1750828 - DNA, 15 bp, Homo sapiens
atccaagcctccaca

SEQ ID NO: 1750829 - DNA, 16 bp, Homo sapiens
atccaagcctccacag

SEQ ID NO: 1750830 - DNA, 18 bp, Homo sapiens
atccaaggaaacatttta

SEQ ID NO: 1750831 - DNA, 22 bp, Homo sapiens
atccaagtctttcttctttttt

SEQ ID NO: 1750832 - DNA, 14 bp, Homo sapiens
atccaatactgccc

SEQ ID NO: 1750833 - DNA, 17 bp, Homo sapiens
atccaatattttgcctt

SEQ ID NO: 1750834 - DNA, 18 bp, Homo sapiens
atccacacaacaccagga

SEQ ID NO: 1750835 - DNA, 20 bp, Homo sapiens
atccacacacagaggaagag

SEQ ID NO: 1750836 - DNA, 15 bp, Homo sapiens
atccacatgaaaata

SEQ ID NO: 1750837 - DNA, 18 bp, Homo sapiens
atccacattgttttaaaa

SEQ ID NO: 1750838 - DNA, 16 bp, Homo sapiens
atccacatttctaaaa

SEQ ID NO: 1750839 - DNA, 15 bp, Homo sapiens
atccaccaccttgcc

SEQ ID NO: 1750840 - DNA, 15 bp, Homo sapiens
atccacccagtgctg

SEQ ID NO: 1750841 - DNA, 20 bp, Homo sapiens
atccacccagtgctgccatg

SEQ ID NO: 1750842 - DNA, 20 bp, Homo sapiens
atccacccgggggagcccag

SEQ ID NO: 1750843 - DNA, 21 bp, Homo sapiens
atccacccgggggagcccagt

SEQ ID NO: 1750844 - DNA, 17 bp, Homo sapiens
atccacctgccttggct

SEQ ID NO: 1750845 - DNA, 19 bp, Homo sapiens
atccacctgtcttggcctc

SEQ ID NO: 1750846 - DNA, 21 bp, Homo sapiens
atccaccttcccttctacaag

SEQ ID NO: 1750847 - DNA, 16 bp, Homo sapiens
atcctgtgacatgtaa

SEQ ID NO: 1750848 - DNA, 18 bp, Homo sapiens
atcctgtgacatgtaaca

SEQ ID NO: 1750849 - DNA, 15 bp, Homo sapiens
atcctgtgcaataga

SEQ ID NO: 1750850 - DNA, 12 bp, Homo sapiens
atcctgtgtaac

SEQ ID NO: 1750851 - DNA, 14 bp, Homo sapiens
atcctgtgtagcat

SEQ ID NO: 1750852 - DNA, 22 bp, Homo sapiens
atcctgtgtggagagggaatgt

SEQ ID NO: 1750853 - DNA, 19 bp, Homo sapiens
atcctgtttgtatgaaatt

SEQ ID NO: 1750854 - DNA, 21 bp, Homo sapiens
atccttataggcctgtccctt

SEQ ID NO: 1750855 - DNA, 20 bp, Homo sapiens
atccttcaagaactctgggc

SEQ ID NO: 1750856 - DNA, 17 bp, Homo sapiens
atccttcacaggcagtg

SEQ ID NO: 1750857 - DNA, 23 bp, Homo sapiens
atccttcacaggcagtgcatgtg

SEQ ID NO: 1750858 - DNA, 17 bp, Homo sapiens
atccttcaccagagccc

SEQ ID NO: 1750859 - DNA, 13 bp, Homo sapiens
atccttccatcca

SEQ ID NO: 1750860 - DNA, 11 bp, Homo sapiens
atccttcccca

SEQ ID NO: 1750861 - DNA, 16 bp, Homo sapiens
atccttccctgctctt

SEQ ID NO: 1750862 - DNA, 21 bp, Homo sapiens
atccttccctttggagatgct

SEQ ID NO: 1750863 - DNA, 22 bp, Homo sapiens
atccttccttcccacccatcgc

SEQ ID NO: 1750864 - DNA, 13 bp, Homo sapiens
atccttctagttt

SEQ ID NO: 1750865 - DNA, 19 bp, Homo sapiens
atccttctagtttcccaca

SEQ ID NO: 1750866 - DNA, 19 bp, Homo sapiens
atccttctgagctccacct

SEQ ID NO: 1750867 - DNA, 19 bp, Homo sapiens
atccttggactgagaaatt

SEQ ID NO: 1750868 - DNA, 23 bp, Homo sapiens
atccttggagtcccaggggcagc

SEQ ID NO: 1750869 - DNA, 14 bp, Homo sapiens
atccttggtgctgt

SEQ ID NO: 1750870 - DNA, 15 bp, Homo sapiens
atccttggtgctgtg

SEQ ID NO: 1750871 - DNA, 19 bp, Homo sapiens
atccttgtgttcagctctt

SEQ ID NO: 1750872 - DNA, 13 bp, Homo sapiens
atccttgtttcaa

SEQ ID NO: 1750873 - DNA, 16 bp, Homo sapiens
atccttgtttcaaaca

SEQ ID NO: 1750874 - DNA, 23 bp, Homo sapiens
atccttgtttcaaacacaaatgc

SEQ ID NO: 1750875 - DNA, 15 bp, Homo sapiens
atcctttctaaacaa

SEQ ID NO: 1750876 - DNA, 13 bp, Homo sapiens
atcctttctaaca

SEQ ID NO: 1750877 - DNA, 17 bp, Homo sapiens
atcctttgagaatgtga

SEQ ID NO: 1750878 - DNA, 17 bp, Homo sapiens
atcctttgttctgagca

SEQ ID NO: 1750879 - DNA, 19 bp, Homo sapiens
atcctttgttttctgacta

SEQ ID NO: 1750880 - DNA, 19 bp, Homo sapiens
atccttttaaccattttaa

SEQ ID NO: 1750881 - DNA, 12 bp, Homo sapiens
atccttttcctt

SEQ ID NO: 1750882 - DNA, 20 bp, Homo sapiens
atccttttccttatttgcct

SEQ ID NO: 1750883 - DNA, 18 bp, Homo sapiens
atccttttgataaattta

SEQ ID NO: 1750884 - DNA, 13 bp, Homo sapiens
atccttttgcctg

SEQ ID NO: 1750885 - DNA, 17 bp, Homo sapiens
atccttttgttttgaag

SEQ ID NO: 1750886 - DNA, 18 bp, Homo sapiens
atccttttgttttgaagc

SEQ ID NO: 1750887 - DNA, 19 bp, Homo sapiens
atccttttgttttgaagct

SEQ ID NO: 1750888 - DNA, 18 bp, Homo sapiens
atcctttttctttataaa

SEQ ID NO: 1750889 - DNA, 16 bp, Homo sapiens
atccttttttaaaagt

SEQ ID NO: 1750890 - DNA, 20 bp, Homo sapiens
atcgaaatgacggtgttaat

SEQ ID NO: 1750891 - DNA, 19 bp, Homo sapiens
atcgaagggtttttagaga

SEQ ID NO: 1750892 - DNA, 18 bp, Homo sapiens
atcgaccacaccagcctc

SEQ ID NO: 1750893 - DNA, 16 bp, Homo sapiens
atcgacttagcctgag

SEQ ID NO: 1750894 - DNA, 15 bp, Homo sapiens
atcgagaccatcctg

SEQ ID NO: 1750895 - DNA, 17 bp, Homo sapiens
atcgagaccatcctggc

SEQ ID NO: 1750896 - DNA, 19 bp, Homo sapiens
atcgagaccatcctggcta

SEQ ID NO: 1750897 - DNA, 18 bp, Homo sapiens
atcgatgagcgccacctc

SEQ ID NO: 1750898 - DNA, 11 bp, Homo sapiens
atcgattggct

SEQ ID NO: 1750899 - DNA, 13 bp, Homo sapiens
atcgccctccttt

SEQ ID NO: 1750900 - DNA, 19 bp, Homo sapiens
atcgccctcctttccctta

SEQ ID NO: 1750901 - DNA, 17 bp, Homo sapiens
atcgcctgagcccagga

SEQ ID NO: 1750902 - DNA, 14 bp, Homo sapiens
atcgctgatgcaga

SEQ ID NO: 1750903 - DNA, 21 bp, Homo sapiens
atcgctgctacatcagactct

SEQ ID NO: 1750904 - DNA, 12 bp, Homo sapiens
atcgctgggctc

SEQ ID NO: 1750905 - DNA, 16 bp, Homo sapiens
atcgctgtgatgctgg

SEQ ID NO: 1750906 - DNA, 23 bp, Homo sapiens
atcgctgtgtgttagttcccaac

SEQ ID NO: 1750907 - DNA, 13 bp, Homo sapiens
atcggaaaaataa

SEQ ID NO: 1750908 - DNA, 15 bp, Homo sapiens
atcggaacagctcct

SEQ ID NO: 1750909 - DNA, 18 bp, Homo sapiens
atcggaagcagtgccttc

SEQ ID NO: 1750910 - DNA, 16 bp, Homo sapiens
atcggattactgaatt

SEQ ID NO: 1750911 - DNA, 16 bp, Homo sapiens
atcgggaacagtgttt

SEQ ID NO: 1750912 - DNA, 21 bp, Homo sapiens
atcgggaacagtgtttcccat

SEQ ID NO: 1750913 - DNA, 19 bp, Homo sapiens
atcgggagcacccagagca

SEQ ID NO: 1750914 - DNA, 21 bp, Homo sapiens
atcggtgaaactaacagataa

SEQ ID NO: 1750915 - DNA, 16 bp, Homo sapiens
atcggttgttctttcc

SEQ ID NO: 1750916 - DNA, 14 bp, Homo sapiens
atcgtacctgtccc

SEQ ID NO: 1750917 - DNA, 13 bp, Homo sapiens
atcgtagacacag

SEQ ID NO: 1750918 - DNA, 15 bp, Homo sapiens
atcgtaggcagccac

SEQ ID NO: 1750919 - DNA, 19 bp, Homo sapiens
atcgtccagcgaccttcct

SEQ ID NO: 1750920 - DNA, 13 bp, Homo sapiens
atcgtccttcctc

SEQ ID NO: 1750921 - DNA, 16 bp, Homo sapiens
atcgtccttcctctca

SEQ ID NO: 1750922 - DNA, 15 bp, Homo sapiens
atcgtgaagaagcct

SEQ ID NO: 1750923 - DNA, 18 bp, Homo sapiens
atcgtgccgttactctcc

SEQ ID NO: 1750924 - DNA, 12 bp, Homo sapiens
atcgtgctaaat

SEQ ID NO: 1750925 - DNA, 21 bp, Homo sapiens
atcgtgtgccatggatctgat

SEQ ID NO: 1750926 - DNA, 22 bp, Homo sapiens
atcgttagtatctaacatgtat

SEQ ID NO: 1750927 - DNA, 15 bp, Homo sapiens
atcgttccagttccc

SEQ ID NO: 1750928 - DNA, 21 bp, Homo sapiens
atcgtttaaaaacaaaggaat

SEQ ID NO: 1750929 - DNA, 15 bp, Homo sapiens
atcgtttttgtattt

SEQ ID NO: 1750930 - DNA, 16 bp, Homo sapiens
atctaaaaataactgt

SEQ ID NO: 1750931 - DNA, 16 bp, Homo sapiens
atctaaaaatatacat

SEQ ID NO: 1750932 - DNA, 20 bp, Homo sapiens
atctaaaatttgtaatattt

SEQ ID NO: 1750933 - DNA, 18 bp, Homo sapiens
atctaaacagttatttct

SEQ ID NO: 1750934 - DNA, 19 bp, Homo sapiens
atctaaacagttatttctg

SEQ ID NO: 1750935 - DNA, 21 bp, Homo sapiens
atctaaacgtggtcaccttcg

SEQ ID NO: 1750936 - DNA, 20 bp, Homo sapiens
atctaaactggagtgatgtt

SEQ ID NO: 1750937 - DNA, 13 bp, Homo sapiens
atctaaatctatt

SEQ ID NO: 1750938 - DNA, 16 bp, Homo sapiens
atctaaatctatttat

SEQ ID NO: 1750939 - DNA, 22 bp, Homo sapiens
atctaaatctatttattaatat

SEQ ID NO: 1750940 - DNA, 15 bp, Homo sapiens
atctaacaataatat

SEQ ID NO: 1750941 - DNA, 20 bp, Homo sapiens
atctaacaataatatttcaa

SEQ ID NO: 1750942 - DNA, 19 bp, Homo sapiens
atctaaccccttacccatc

SEQ ID NO: 1750943 - DNA, 16 bp, Homo sapiens
atctaagcctttccat

SEQ ID NO: 1750944 - DNA, 11 bp, Homo sapiens
atctaaggata

SEQ ID NO: 1750945 - DNA, 20 bp, Homo sapiens
atctaagggaagatcactgt

SEQ ID NO: 1750946 - DNA, 17 bp, Homo sapiens
atctaataaactttatt

SEQ ID NO: 1750947 - DNA, 19 bp, Homo sapiens
atctaatacctctgtgtgc

SEQ ID NO: 1750948 - DNA, 18 bp, Homo sapiens
atctaatatatatgaata

SEQ ID NO: 1750949 - DNA, 19 bp, Homo sapiens
atctaatatatatgaataa

SEQ ID NO: 1750950 - DNA, 20 bp, Homo sapiens
atctaatatatatgaataaa

SEQ ID NO: 1750951 - DNA, 22 bp, Homo sapiens
atctaatatatatgaataaagt

SEQ ID NO: 1750952 - DNA, 15 bp, Homo sapiens
atctaatctcttatt

SEQ ID NO: 1750953 - DNA, 15 bp, Homo sapiens
atctaattaaatgta

SEQ ID NO: 1750954 - DNA, 13 bp, Homo sapiens
atctaattctgat

SEQ ID NO: 1750955 - DNA, 19 bp, Homo sapiens
atctaatttataaaaaggt

SEQ ID NO: 1750956 - DNA, 23 bp, Homo sapiens
atctacaatatatattatatata

SEQ ID NO: 1750957 - DNA, 19 bp, Homo sapiens
atctacaatctctttttgt

SEQ ID NO: 1750958 - DNA, 14 bp, Homo sapiens
atctacacatgttg

SEQ ID NO: 1750959 - DNA, 19 bp, Homo sapiens
atctacaccaatgaaaaca

SEQ ID NO: 1750960 - DNA, 15 bp, Homo sapiens
atctacagaactaca

SEQ ID NO: 1750961 - DNA, 16 bp, Homo sapiens
atctacagctcacctc

SEQ ID NO: 1750962 - DNA, 21 bp, Homo sapiens
atctgccttaaaaccaaagag

SEQ ID NO: 1750963 - DNA, 22 bp, Homo sapiens
atctgcggatctcagctttgag

SEQ ID NO: 1750964 - DNA, 23 bp, Homo sapiens
atctgcggatctcagctttgaga

SEQ ID NO: 1750965 - DNA, 15 bp, Homo sapiens
atctgcgtgtgtgca

SEQ ID NO: 1750966 - DNA, 13 bp, Homo sapiens
atctgctagaaag

SEQ ID NO: 1750967 - DNA, 13 bp, Homo sapiens
atctgctcacttt

SEQ ID NO: 1750968 - DNA, 20 bp, Homo sapiens
atctgctctagattcataaa

SEQ ID NO: 1750969 - DNA, 14 bp, Homo sapiens
atctgctctccttc

SEQ ID NO: 1750970 - DNA, 15 bp, Homo sapiens
atctgctctccttcc

SEQ ID NO: 1750971 - DNA, 17 bp, Homo sapiens
atctgctgcatagctct

SEQ ID NO: 1750972 - DNA, 21 bp, Homo sapiens
atctgctgcatagctctattt

SEQ ID NO: 1750973 - DNA, 23 bp, Homo sapiens
atctgctgcatagctctatttta

SEQ ID NO: 1750974 - DNA, 18 bp, Homo sapiens
atctgctgcctctgaaaa

SEQ ID NO: 1750975 - DNA, 20 bp, Homo sapiens
atctgctgcctctgaaaata

SEQ ID NO: 1750976 - DNA, 15 bp, Homo sapiens
atctgctgtatatgg

SEQ ID NO: 1750977 - DNA, 20 bp, Homo sapiens
atctgctgttgccatagccc

SEQ ID NO: 1750978 - DNA, 21 bp, Homo sapiens
atctgcttcatccaatgtgaa

SEQ ID NO: 1750979 - DNA, 15 bp, Homo sapiens
atctgcttctagctt

SEQ ID NO: 1750980 - DNA, 20 bp, Homo sapiens
atctgctttagtttcacatt

SEQ ID NO: 1750981 - DNA, 22 bp, Homo sapiens
atctgctttttaaagaatgctc

SEQ ID NO: 1750982 - DNA, 11 bp, Homo sapiens
atctggaaccc

SEQ ID NO: 1750983 - DNA, 16 bp, Homo sapiens
atctggaacccagact

SEQ ID NO: 1750984 - DNA, 17 bp, Homo sapiens
atctggaacccagactc

SEQ ID NO: 1750985 - DNA, 19 bp, Homo sapiens
atctggaacccagactcag

SEQ ID NO: 1750986 - DNA, 20 bp, Homo sapiens
atctggaacctcagcctggc

SEQ ID NO: 1750987 - DNA, 21 bp, Homo sapiens
atctggaagccaaaatgtagg

SEQ ID NO: 1750988 - DNA, 21 bp, Homo sapiens
atctggaatctggagaccagg

SEQ ID NO: 1750989 - DNA, 20 bp, Homo sapiens
atctggagaccagggagcct

SEQ ID NO: 1750990 - DNA, 22 bp, Homo sapiens
atctggagaccagggagccttt

SEQ ID NO: 1750991 - DNA, 19 bp, Homo sapiens
atctggaggccttccagct

SEQ ID NO: 1750992 - DNA, 23 bp, Homo sapiens
atctggaggccttccagctgctg

SEQ ID NO: 1750993 - DNA, 20 bp, Homo sapiens
atctggatgcctcattatgt

SEQ ID NO: 1750994 - DNA, 15 bp, Homo sapiens
atctggatgtaaatc

SEQ ID NO: 1750995 - DNA, 16 bp, Homo sapiens
atctggattctacaaa

SEQ ID NO: 1750996 - DNA, 13 bp, Homo sapiens
atctggcactgtt

SEQ ID NO: 1750997 - DNA, 14 bp, Homo sapiens
atctggcccagggt

SEQ ID NO: 1750998 - DNA, 21 bp, Homo sapiens
atctggccccaggtagaaact

SEQ ID NO: 1750999 - DNA, 19 bp, Homo sapiens
atctggcggaggtctctgg

SEQ ID NO: 1751000 - DNA, 21 bp, Homo sapiens
atctggcggaggtctctggga

SEQ ID NO: 1751001 - DNA, 22 bp, Homo sapiens
atctggcggaggtctctgggag

SEQ ID NO: 1751002 - DNA, 23 bp, Homo sapiens
atctggcttagtgccacccacct

SEQ ID NO: 1751003 - DNA, 11 bp, Homo sapiens
atctggcttcc

SEQ ID NO: 1751004 - DNA, 18 bp, Homo sapiens
atctggcttccctggaag

SEQ ID NO: 1751005 - DNA, 19 bp, Homo sapiens
atctggctttttctgccac

SEQ ID NO: 1751006 - DNA, 22 bp, Homo sapiens
atctgggaccctttccttcctt

SEQ ID NO: 1751007 - DNA, 21 bp, Homo sapiens
atctgggaggcagaacaggct

SEQ ID NO: 1751008 - DNA, 19 bp, Homo sapiens
atctgggtaagaagaaagc

SEQ ID NO: 1751009 - DNA, 15 bp, Homo sapiens
atctgggtgactgag

SEQ ID NO: 1751010 - DNA, 15 bp, Homo sapiens
atctgggtgccctga

SEQ ID NO: 1751011 - DNA, 21 bp, Homo sapiens
atctgggtggtaactgccagc

SEQ ID NO: 1751012 - DNA, 17 bp, Homo sapiens
atctggtagatttttaa

SEQ ID NO: 1751013 - DNA, 17 bp, Homo sapiens
atctggtcccttgcagc

SEQ ID NO: 1751014 - DNA, 19 bp, Homo sapiens
atctggtcttgttagaaaa

SEQ ID NO: 1751015 - DNA, 17 bp, Homo sapiens
atctggtgtaggaagtt

SEQ ID NO: 1751016 - DNA, 16 bp, Homo sapiens
atctgtaaatttaact

SEQ ID NO: 1751017 - DNA, 17 bp, Homo sapiens
atctgtaaatttaactg

SEQ ID NO: 1751018 - DNA, 21 bp, Homo sapiens
atctgtaaatttaactgcata

SEQ ID NO: 1751019 - DNA, 21 bp, Homo sapiens
atctgtaagagcttgctccag

SEQ ID NO: 1751020 - DNA, 18 bp, Homo sapiens
atctgtaatggtactgac

SEQ ID NO: 1751021 - DNA, 13 bp, Homo sapiens
atctgtacatact

SEQ ID NO: 1751022 - DNA, 15 bp, Homo sapiens
atctgtacgtaagaa

SEQ ID NO: 1751023 - DNA, 17 bp, Homo sapiens
atctgtacttcttcgat

SEQ ID NO: 1751024 - DNA, 12 bp, Homo sapiens
atctgtagatac

SEQ ID NO: 1751025 - DNA, 21 bp, Homo sapiens
atctgtagctataatgagcat

SEQ ID NO: 1751026 - DNA, 16 bp, Homo sapiens
atctgtatataaaata

SEQ ID NO: 1751027 - DNA, 17 bp, Homo sapiens
atctgtatataaaatat

SEQ ID NO: 1751028 - DNA, 22 bp, Homo sapiens
atctgtatataaaatattttca

SEQ ID NO: 1751029 - DNA, 20 bp, Homo sapiens
atctgtatatacaataacat

SEQ ID NO: 1751030 - DNA, 20 bp, Homo sapiens
atctgtatatgttgtaataa

SEQ ID NO: 1751031 - DNA, 20 bp, Homo sapiens
atctgtcacacctgtgcctc

SEQ ID NO: 1751032 - DNA, 18 bp, Homo sapiens
atctgtcataagcattac

SEQ ID NO: 1751033 - DNA, 20 bp, Homo sapiens
atctgtccacatccccagag

SEQ ID NO: 1751034 - DNA, 15 bp, Homo sapiens
atctgtcctcagcct

SEQ ID NO: 1751035 - DNA, 18 bp, Homo sapiens
atctgtcctcagccttgc

SEQ ID NO: 1751036 - DNA, 21 bp, Homo sapiens
atctgtcctcagccttgccag

SEQ ID NO: 1751037 - DNA, 12 bp, Homo sapiens
atctgtcctctg

SEQ ID NO: 1751038 - DNA, 18 bp, Homo sapiens
atctgtcctctgtagtat

SEQ ID NO: 1751039 - DNA, 12 bp, Homo sapiens
atctgtctgatt

SEQ ID NO: 1751040 - DNA, 18 bp, Homo sapiens
atctgtctgattctatgc

SEQ ID NO: 1751041 - DNA, 19 bp, Homo sapiens
atctgtctgccaacctaaa

SEQ ID NO: 1751042 - DNA, 14 bp, Homo sapiens
atctgtctggtggc

SEQ ID NO: 1751043 - DNA, 18 bp, Homo sapiens
atctgtcttgccagccag

SEQ ID NO: 1751044 - DNA, 21 bp, Homo sapiens
atctgtcttgccagccagaag

SEQ ID NO: 1751045 - DNA, 13 bp, Homo sapiens
atctgtgattggc

SEQ ID NO: 1751046 - DNA, 14 bp, Homo sapiens
atctgtgattggct

SEQ ID NO: 1751047 - DNA, 22 bp, Homo sapiens
atctgtgcaaatccttgatact

SEQ ID NO: 1751048 - DNA, 13 bp, Homo sapiens
atctgtggagctg

SEQ ID NO: 1751049 - DNA, 15 bp, Homo sapiens
atctgtggagctgcc

SEQ ID NO: 1751050 - DNA, 18 bp, Homo sapiens
atctgtggagttcctgct

SEQ ID NO: 1751051 - DNA, 16 bp, Homo sapiens
atctgtgtttttgaaa

SEQ ID NO: 1751052 - DNA, 21 bp, Homo sapiens
atctgtgtttttgaaatatta

SEQ ID NO: 1751053 - DNA, 15 bp, Homo sapiens
atctgttagggcctt

SEQ ID NO: 1751054 - DNA, 18 bp, Homo sapiens
atctgttatagctttaaa

SEQ ID NO: 1751055 - DNA, 21 bp, Homo sapiens
atctgttattcaaatttgatg

SEQ ID NO: 1751056 - DNA, 17 bp, Homo sapiens
atctgttgataaatcca

SEQ ID NO: 1751057 - DNA, 16 bp, Homo sapiens
atctgtttgaggagag

SEQ ID NO: 1751058 - DNA, 15 bp, Homo sapiens
atctgtttgtttttt

SEQ ID NO: 1751059 - DNA, 14 bp, Homo sapiens
atctgttttaaatt

SEQ ID NO: 1751060 - DNA, 15 bp, Homo sapiens
atctgttttctggaa

SEQ ID NO: 1751061 - DNA, 17 bp, Homo sapiens
atctgttttctggaagt

SEQ ID NO: 1751062 - DNA, 14 bp, Homo sapiens
atcttaaacaatgt

SEQ ID NO: 1751063 - DNA, 19 bp, Homo sapiens
atcttaaacaatgtataaa

SEQ ID NO: 1751064 - DNA, 19 bp, Homo sapiens
atcttaaagaaacagcttt

SEQ ID NO: 1751065 - DNA, 23 bp, Homo sapiens
atcttaaagaaacagctttcaag

SEQ ID NO: 1751066 - DNA, 18 bp, Homo sapiens
atcttaaatctaaacaaa

SEQ ID NO: 1751067 - DNA, 21 bp, Homo sapiens
atcttaaattcatttctagac

SEQ ID NO: 1751068 - DNA, 13 bp, Homo sapiens
atcttaagaaata

SEQ ID NO: 1751069 - DNA, 16 bp, Homo sapiens
atcttaagaaataaat

SEQ ID NO: 1751070 - DNA, 12 bp, Homo sapiens
atcttaagcagg

SEQ ID NO: 1751071 - DNA, 21 bp, Homo sapiens
atcttaagcatgtcaattcat

SEQ ID NO: 1751072 - DNA, 15 bp, Homo sapiens
atcttaatactgtta

SEQ ID NO: 1751073 - DNA, 21 bp, Homo sapiens
atcttaatactgttattcttt

SEQ ID NO: 1751074 - DNA, 18 bp, Homo sapiens
atcttaatatatacattt

SEQ ID NO: 1751075 - DNA, 20 bp, Homo sapiens
atcttaatatatacattttt

SEQ ID NO: 1751076 - DNA, 14 bp, Homo sapiens
atgaagttgctgtt

SEQ ID NO: 1751077 - DNA, 17 bp, Homo sapiens
atgaataaagacaccta

SEQ ID NO: 1751078 - DNA, 23 bp, Homo sapiens
atgaataactaagatatagaaac

SEQ ID NO: 1751079 - DNA, 13 bp, Homo sapiens
atgaataatttca

SEQ ID NO: 1751080 - DNA, 22 bp, Homo sapiens
atgaataatttcccaattagga

SEQ ID NO: 1751081 - DNA, 21 bp, Homo sapiens
atgaatatcaggctattattt

SEQ ID NO: 1751082 - DNA, 22 bp, Homo sapiens
atgaatattactctcaaaatct

SEQ ID NO: 1751083 - DNA, 21 bp, Homo sapiens
atgaatattgatgttaacaag

SEQ ID NO: 1751084 - DNA, 12 bp, Homo sapiens
atgaatcaatgg

SEQ ID NO: 1751085 - DNA, 13 bp, Homo sapiens
atgaatcactgtg

SEQ ID NO: 1751086 - DNA, 15 bp, Homo sapiens
atgaatccaacgtgt

SEQ ID NO: 1751087 - DNA, 18 bp, Homo sapiens
atgaatcccacccacatg

SEQ ID NO: 1751088 - DNA, 21 bp, Homo sapiens
atgaatcccacccacatgtga

SEQ ID NO: 1751089 - DNA, 21 bp, Homo sapiens
atgaatctacatttgtttgta

SEQ ID NO: 1751090 - DNA, 22 bp, Homo sapiens
atgaatctacatttgtttgtat

SEQ ID NO: 1751091 - DNA, 21 bp, Homo sapiens
atgaatctatgccaaagatca

SEQ ID NO: 1751092 - DNA, 16 bp, Homo sapiens
atgaatctattatact

SEQ ID NO: 1751093 - DNA, 14 bp, Homo sapiens
atgaatctgctcac

SEQ ID NO: 1751094 - DNA, 16 bp, Homo sapiens
atgaatctgctcactt

SEQ ID NO: 1751095 - DNA, 17 bp, Homo sapiens
atgaatgaaacattttg

SEQ ID NO: 1751096 - DNA, 18 bp, Homo sapiens
atgaatgaacaaacctgt

SEQ ID NO: 1751097 - DNA, 15 bp, Homo sapiens
atgaatgaataacta

SEQ ID NO: 1751098 - DNA, 23 bp, Homo sapiens
atgaatgacttccccaatatctt

SEQ ID NO: 1751099 - DNA, 20 bp, Homo sapiens
atgaatgaggtcccaggcag

SEQ ID NO: 1751100 - DNA, 21 bp, Homo sapiens
atgaatgagtgggctgtagtt

SEQ ID NO: 1751101 - DNA, 20 bp, Homo sapiens
atgaatgcaaaattgttttc

SEQ ID NO: 1751102 - DNA, 23 bp, Homo sapiens
atgaatggactcaaactgccttg

SEQ ID NO: 1751103 - DNA, 21 bp, Homo sapiens
atgaatggtatggaactctct

SEQ ID NO: 1751104 - DNA, 12 bp, Homo sapiens
atgaatggtctg

SEQ ID NO: 1751105 - DNA, 18 bp, Homo sapiens
atgaatggtctggcaata

SEQ ID NO: 1751106 - DNA, 16 bp, Homo sapiens
atgaatgtaaatttgt

SEQ ID NO: 1751107 - DNA, 15 bp, Homo sapiens
atgaatgtactatgt

SEQ ID NO: 1751108 - DNA, 17 bp, Homo sapiens
atgaatgtatttatttg

SEQ ID NO: 1751109 - DNA, 14 bp, Homo sapiens
atgaatgtgctggt

SEQ ID NO: 1751110 - DNA, 13 bp, Homo sapiens
atgaatgttcctg

SEQ ID NO: 1751111 - DNA, 11 bp, Homo sapiens
atgaatgttta

SEQ ID NO: 1751112 - DNA, 14 bp, Homo sapiens
atgaattaaataaa

SEQ ID NO: 1751113 - DNA, 18 bp, Homo sapiens
atgaattactgtatataa

SEQ ID NO: 1751114 - DNA, 23 bp, Homo sapiens
atgaattatattcaatgcattta

SEQ ID NO: 1751115 - DNA, 22 bp, Homo sapiens
atgaattgaaaaacaattttct

SEQ ID NO: 1751116 - DNA, 14 bp, Homo sapiens
atgaattgtacaga

SEQ ID NO: 1751117 - DNA, 13 bp, Homo sapiens
atgaatttaaata

SEQ ID NO: 1751118 - DNA, 16 bp, Homo sapiens
atgaatttatctttac

SEQ ID NO: 1751119 - DNA, 20 bp, Homo sapiens
atgaatttggagactctgtg

SEQ ID NO: 1751120 - DNA, 15 bp, Homo sapiens
atgaattttaaagta

SEQ ID NO: 1751121 - DNA, 16 bp, Homo sapiens
atgaattttaaagtat

SEQ ID NO: 1751122 - DNA, 21 bp, Homo sapiens
atgaattttatcagccatgtt

SEQ ID NO: 1751123 - DNA, 22 bp, Homo sapiens
atgaattttcaagtaattgtga

SEQ ID NO: 1751124 - DNA, 20 bp, Homo sapiens
atgaattttctgcagctgtt

SEQ ID NO: 1751125 - DNA, 23 bp, Homo sapiens
atgaattttgtatgctgaatttc

SEQ ID NO: 1751126 - DNA, 21 bp, Homo sapiens
atgaatttttttcatcttctc

SEQ ID NO: 1751127 - DNA, 23 bp, Homo sapiens
atgaatttttttcatcttctctg

SEQ ID NO: 1751128 - DNA, 17 bp, Homo sapiens
atgacaaaaaatgtttt

SEQ ID NO: 1751129 - DNA, 12 bp, Homo sapiens
atgacaaaagat

SEQ ID NO: 1751130 - DNA, 23 bp, Homo sapiens
atgacaaaagatacaaaagcttt

SEQ ID NO: 1751131 - DNA, 17 bp, Homo sapiens
atgacaaataagtggaa

SEQ ID NO: 1751132 - DNA, 16 bp, Homo sapiens
atgacaaatgtttcta

SEQ ID NO: 1751133 - DNA, 14 bp, Homo sapiens
atgacaacagaaaa

SEQ ID NO: 1751134 - DNA, 17 bp, Homo sapiens
atgacaacagaaaaaca

SEQ ID NO: 1751135 - DNA, 20 bp, Homo sapiens
atgacaacagaaaaacaatc

SEQ ID NO: 1751136 - DNA, 22 bp, Homo sapiens
atgacaacttttaaagaaaaat

SEQ ID NO: 1751137 - DNA, 16 bp, Homo sapiens
atgacaagatgggaca

SEQ ID NO: 1751138 - DNA, 13 bp, Homo sapiens
atgacaagatgtt

SEQ ID NO: 1751139 - DNA, 13 bp, Homo sapiens
atgacaagcattt

SEQ ID NO: 1751140 - DNA, 19 bp, Homo sapiens
atgacaagtgagacaaaaa

SEQ ID NO: 1751141 - DNA, 17 bp, Homo sapiens
atgacacagttatcaaa

SEQ ID NO: 1751142 - DNA, 15 bp, Homo sapiens
atgacacccatgcca

SEQ ID NO: 1751143 - DNA, 17 bp, Homo sapiens
atgacacccatgccaga

SEQ ID NO: 1751144 - DNA, 15 bp, Homo sapiens
atgacaccctggcct

SEQ ID NO: 1751145 - DNA, 16 bp, Homo sapiens
atgacaccctggcctg

SEQ ID NO: 1751146 - DNA, 19 bp, Homo sapiens
atgacagaaaatatgtatt

SEQ ID NO: 1751147 - DNA, 13 bp, Homo sapiens
atgacagatttct

SEQ ID NO: 1751148 - DNA, 17 bp, Homo sapiens
atgacagatttctgtaa

SEQ ID NO: 1751149 - DNA, 17 bp, Homo sapiens
atgacagccagagcctg

SEQ ID NO: 1751150 - DNA, 16 bp, Homo sapiens
atgacagctgtccctg

SEQ ID NO: 1751151 - DNA, 22 bp, Homo sapiens
atgacaggcatgaatcactgtg

SEQ ID NO: 1751152 - DNA, 17 bp, Homo sapiens
atgacaggctgttcagc

SEQ ID NO: 1751153 - DNA, 12 bp, Homo sapiens
atgacagggcag

SEQ ID NO: 1751154 - DNA, 18 bp, Homo sapiens
atgacagggcagagcagg

SEQ ID NO: 1751155 - DNA, 19 bp, Homo sapiens
atgacatcacttgtacaaa

SEQ ID NO: 1751156 - DNA, 14 bp, Homo sapiens
atgacatgcactga

SEQ ID NO: 1751157 - DNA, 15 bp, Homo sapiens
atgacatgcactgac

SEQ ID NO: 1751158 - DNA, 18 bp, Homo sapiens
atgacatgcactgaccct

SEQ ID NO: 1751159 - DNA, 22 bp, Homo sapiens
atgacatgcactgacccttcca

SEQ ID NO: 1751160 - DNA, 22 bp, Homo sapiens
atgacatttaaatgtaacttat

SEQ ID NO: 1751161 - DNA, 22 bp, Homo sapiens
atgaccactcttggctattgaa

SEQ ID NO: 1751162 - DNA, 23 bp, Homo sapiens
atgaccactcttggctattgaag

SEQ ID NO: 1751163 - DNA, 21 bp, Homo sapiens
atgaccagatgcgtcccaaga

SEQ ID NO: 1751164 - DNA, 14 bp, Homo sapiens
atgaccagggatgc

SEQ ID NO: 1751165 - DNA, 22 bp, Homo sapiens
atgaccagggatgctgggctgg

SEQ ID NO: 1751166 - DNA, 15 bp, Homo sapiens
atgacccacactgcc

SEQ ID NO: 1751167 - DNA, 16 bp, Homo sapiens
atgacccacccctgtg

SEQ ID NO: 1751168 - DNA, 14 bp, Homo sapiens
atgaccgagccctg

SEQ ID NO: 1751169 - DNA, 13 bp, Homo sapiens
atgacctaaatcc

SEQ ID NO: 1751170 - DNA, 22 bp, Homo sapiens
atgacctaagtcaggtaatata

SEQ ID NO: 1751171 - DNA, 13 bp, Homo sapiens
atgacctccattt

SEQ ID NO: 1751172 - DNA, 15 bp, Homo sapiens
atgacggaagaacat

SEQ ID NO: 1751173 - DNA, 23 bp, Homo sapiens
atgacggtgttaattttgctaac

SEQ ID NO: 1751174 - DNA, 15 bp, Homo sapiens
atgacgtgtgtggct

SEQ ID NO: 1751175 - DNA, 19 bp, Homo sapiens
atgacgtgtgtggctggga

SEQ ID NO: 1751176 - DNA, 12 bp, Homo sapiens
atgactaaagag

SEQ ID NO: 1751177 - DNA, 13 bp, Homo sapiens
atgactaaagaga

SEQ ID NO: 1751178 - DNA, 14 bp, Homo sapiens
atgactaaagagag

SEQ ID NO: 1751179 - DNA, 17 bp, Homo sapiens
atgactaaagagagaat

SEQ ID NO: 1751180 - DNA, 19 bp, Homo sapiens
atgactaaagagagaatgt

SEQ ID NO: 1751181 - DNA, 23 bp, Homo sapiens
atgactaaagagagaatgtagat

SEQ ID NO: 1751182 - DNA, 15 bp, Homo sapiens
atgactagaggcagg

SEQ ID NO: 1751183 - DNA, 22 bp, Homo sapiens
atgactagaggcagggagggga

SEQ ID NO: 1751184 - DNA, 14 bp, Homo sapiens
atgactcagaatat

SEQ ID NO: 1751185 - DNA, 13 bp, Homo sapiens
atgactctctcca

SEQ ID NO: 1751186 - DNA, 23 bp, Homo sapiens
atgactctctccaagagggcagg

SEQ ID NO: 1751187 - DNA, 16 bp, Homo sapiens
atgactggctgtctgc

SEQ ID NO: 1751188 - DNA, 21 bp, Homo sapiens
atgactggctgtctgcctgta

SEQ ID NO: 1751189 - DNA, 18 bp, Homo sapiens
atgactggggagggctgc

SEQ ID NO: 1751190 - DNA, 22 bp, Homo sapiens
atgcagaaatagacaaaaagta

SEQ ID NO: 1751191 - DNA, 22 bp, Homo sapiens
atgcagaatacttgactcattt

SEQ ID NO: 1751192 - DNA, 12 bp, Homo sapiens
atgcagacacag

SEQ ID NO: 1751193 - DNA, 16 bp, Homo sapiens
atgcagacagtctgtt

SEQ ID NO: 1751194 - DNA, 23 bp, Homo sapiens
atgcagacctcatgcccagctct

SEQ ID NO: 1751195 - DNA, 15 bp, Homo sapiens
atgcagaggtctcca

SEQ ID NO: 1751196 - DNA, 23 bp, Homo sapiens
atgcagaggtctccaaactgatt

SEQ ID NO: 1751197 - DNA, 16 bp, Homo sapiens
atgcagattcctgggc

SEQ ID NO: 1751198 - DNA, 18 bp, Homo sapiens
atgcagattcctgggcct

SEQ ID NO: 1751199 - DNA, 19 bp, Homo sapiens
atgcagattcctgggcctg

SEQ ID NO: 1751200 - DNA, 18 bp, Homo sapiens
atgcagccacttaggaca

SEQ ID NO: 1751201 - DNA, 21 bp, Homo sapiens
atgcagcccatgcccacctgc

SEQ ID NO: 1751202 - DNA, 16 bp, Homo sapiens
atgcagccgtgatcaa

SEQ ID NO: 1751203 - DNA, 15 bp, Homo sapiens
atgcagctgtggcag

SEQ ID NO: 1751204 - DNA, 15 bp, Homo sapiens
atgcagctttgcaaa

SEQ ID NO: 1751205 - DNA, 21 bp, Homo sapiens
atgcaggaagaggcccactag

SEQ ID NO: 1751206 - DNA, 15 bp, Homo sapiens
atgcaggacaggagg

SEQ ID NO: 1751207 - DNA, 22 bp, Homo sapiens
atgcaggagcttctgggagatt

SEQ ID NO: 1751208 - DNA, 19 bp, Homo sapiens
atgcaggaggctcaggtga

SEQ ID NO: 1751209 - DNA, 14 bp, Homo sapiens
atgcaggaggtgga

SEQ ID NO: 1751210 - DNA, 19 bp, Homo sapiens
atgcaggaggtggagaaaa

SEQ ID NO: 1751211 - DNA, 20 bp, Homo sapiens
atgcaggaggtggagaaaat

SEQ ID NO: 1751212 - DNA, 22 bp, Homo sapiens
atgcaggaggtggagaaaattg

SEQ ID NO: 1751213 - DNA, 19 bp, Homo sapiens
atgcaggcacctcttttaa

SEQ ID NO: 1751214 - DNA, 18 bp, Homo sapiens
atgcagggaagagggcag

SEQ ID NO: 1751215 - DNA, 16 bp, Homo sapiens
atgcagggagcactgt

SEQ ID NO: 1751216 - DNA, 17 bp, Homo sapiens
atgcagggaggggaggc

SEQ ID NO: 1751217 - DNA, 19 bp, Homo sapiens
atgcagggaggggaggcag

SEQ ID NO: 1751218 - DNA, 18 bp, Homo sapiens
atgcagggattgctgcca

SEQ ID NO: 1751219 - DNA, 17 bp, Homo sapiens
atgcaggtgaacttttt

SEQ ID NO: 1751220 - DNA, 21 bp, Homo sapiens
atgcagtacattctaaagaga

SEQ ID NO: 1751221 - DNA, 17 bp, Homo sapiens
atgcagtactaaaatta

SEQ ID NO: 1751222 - DNA, 23 bp, Homo sapiens
atgcagtcacttattgtccaggt

SEQ ID NO: 1751223 - DNA, 11 bp, Homo sapiens
atgcagtcctg

SEQ ID NO: 1751224 - DNA, 14 bp, Homo sapiens
atgcagtcctgagg

SEQ ID NO: 1751225 - DNA, 19 bp, Homo sapiens
atgcagtcctgaggagagg

SEQ ID NO: 1751226 - DNA, 22 bp, Homo sapiens
atgcagttacaaattataatgt

SEQ ID NO: 1751227 - DNA, 19 bp, Homo sapiens
atgcagttgataagaggaa

SEQ ID NO: 1751228 - DNA, 15 bp, Homo sapiens
atgcataaagtcagt

SEQ ID NO: 1751229 - DNA, 13 bp, Homo sapiens
atgcataatttat

SEQ ID NO: 1751230 - DNA, 15 bp, Homo sapiens
atgcataatttatgg

SEQ ID NO: 1751231 - DNA, 16 bp, Homo sapiens
atgcatattaaataat

SEQ ID NO: 1751232 - DNA, 20 bp, Homo sapiens
atgcatattaaataataaag

SEQ ID NO: 1751233 - DNA, 16 bp, Homo sapiens
atgcatattgtattac

SEQ ID NO: 1751234 - DNA, 12 bp, Homo sapiens
atgcatatttgt

SEQ ID NO: 1751235 - DNA, 14 bp, Homo sapiens
atgcatcttactga

SEQ ID NO: 1751236 - DNA, 14 bp, Homo sapiens
atgcatgaaatgaa

SEQ ID NO: 1751237 - DNA, 22 bp, Homo sapiens
atgcatgaaatgaatgtctgag

SEQ ID NO: 1751238 - DNA, 18 bp, Homo sapiens
atgcatgacacttccaaa

SEQ ID NO: 1751239 - DNA, 14 bp, Homo sapiens
atgcatgagctccc

SEQ ID NO: 1751240 - DNA, 16 bp, Homo sapiens
atgcatgcaaatgagc

SEQ ID NO: 1751241 - DNA, 23 bp, Homo sapiens
atgcatggagggctgccctgtac

SEQ ID NO: 1751242 - DNA, 17 bp, Homo sapiens
atgcatggtgccccagg

SEQ ID NO: 1751243 - DNA, 18 bp, Homo sapiens
atgcatggtgccccagga

SEQ ID NO: 1751244 - DNA, 21 bp, Homo sapiens
atgcatggtgccccaggacca

SEQ ID NO: 1751245 - DNA, 15 bp, Homo sapiens
atgcatgtcttttaa

SEQ ID NO: 1751246 - DNA, 21 bp, Homo sapiens
atgcattataggatcatttgt

SEQ ID NO: 1751247 - DNA, 13 bp, Homo sapiens
atgcattattaaa

SEQ ID NO: 1751248 - DNA, 22 bp, Homo sapiens
atgcattcacatttagaaaagt

SEQ ID NO: 1751249 - DNA, 19 bp, Homo sapiens
atgcattccctgaatctgt

SEQ ID NO: 1751250 - DNA, 15 bp, Homo sapiens
atgcattggcctctg

SEQ ID NO: 1751251 - DNA, 16 bp, Homo sapiens
atgcattggcctctgt

SEQ ID NO: 1751252 - DNA, 18 bp, Homo sapiens
atgcattgtcttgtggag

SEQ ID NO: 1751253 - DNA, 15 bp, Homo sapiens
atgcatttaaaatac

SEQ ID NO: 1751254 - DNA, 14 bp, Homo sapiens
atgcatttaataaa

SEQ ID NO: 1751255 - DNA, 21 bp, Homo sapiens
atgcatttaataaagatgagt

SEQ ID NO: 1751256 - DNA, 22 bp, Homo sapiens
atgcatttaataaagatgagtt

SEQ ID NO: 1751257 - DNA, 14 bp, Homo sapiens
atgcatttgcattt

SEQ ID NO: 1751258 - DNA, 22 bp, Homo sapiens
atgcattttgagtgtttataga

SEQ ID NO: 1751259 - DNA, 20 bp, Homo sapiens
atgccaaagccattctcccc

SEQ ID NO: 1751260 - DNA, 18 bp, Homo sapiens
atgccaaagctagggtgg

SEQ ID NO: 1751261 - DNA, 20 bp, Homo sapiens
atgccaagggggtgactgga

SEQ ID NO: 1751262 - DNA, 22 bp, Homo sapiens
atgccaattagcaattgactgt

SEQ ID NO: 1751263 - DNA, 15 bp, Homo sapiens
atgccaatttcctct

SEQ ID NO: 1751264 - DNA, 15 bp, Homo sapiens
atgccacacctggcc

SEQ ID NO: 1751265 - DNA, 17 bp, Homo sapiens
atgccacacctggcctt

SEQ ID NO: 1751266 - DNA, 18 bp, Homo sapiens
atgccacatcaaaccttt

SEQ ID NO: 1751267 - DNA, 15 bp, Homo sapiens
atgccaccacccacc

SEQ ID NO: 1751268 - DNA, 19 bp, Homo sapiens
atgccaccctgttttcagc

SEQ ID NO: 1751269 - DNA, 17 bp, Homo sapiens
atgccacgcctggaagg

SEQ ID NO: 1751270 - DNA, 16 bp, Homo sapiens
atgccactcctccctc

SEQ ID NO: 1751271 - DNA, 13 bp, Homo sapiens
atgccactgccag

SEQ ID NO: 1751272 - DNA, 19 bp, Homo sapiens
atgccactgccaggcacct

SEQ ID NO: 1751273 - DNA, 21 bp, Homo sapiens
atgccactgccaggcacctgg

SEQ ID NO: 1751274 - DNA, 17 bp, Homo sapiens
atgccactgccttcgct

SEQ ID NO: 1751275 - DNA, 21 bp, Homo sapiens
atgccactgggacagctggct

SEQ ID NO: 1751276 - DNA, 12 bp, Homo sapiens
atgccagagagg

SEQ ID NO: 1751277 - DNA, 17 bp, Homo sapiens
atgccagagccaacctg

SEQ ID NO: 1751278 - DNA, 22 bp, Homo sapiens
atgccagagccaacctggactt

SEQ ID NO: 1751279 - DNA, 13 bp, Homo sapiens
atgccagagggcc

SEQ ID NO: 1751280 - DNA, 15 bp, Homo sapiens
atgccagagggccag

SEQ ID NO: 1751281 - DNA, 16 bp, Homo sapiens
atgccagagggccagc

SEQ ID NO: 1751282 - DNA, 19 bp, Homo sapiens
atgccagagggccagcagg

SEQ ID NO: 1751283 - DNA, 22 bp, Homo sapiens
atgccagagggccagcaggctc

SEQ ID NO: 1751284 - DNA, 12 bp, Homo sapiens
atgccagccttg

SEQ ID NO: 1751285 - DNA, 13 bp, Homo sapiens
atgccagcttctc

SEQ ID NO: 1751286 - DNA, 14 bp, Homo sapiens
atgccagcttctct

SEQ ID NO: 1751287 - DNA, 20 bp, Homo sapiens
atgccagcttctctctccag

SEQ ID NO: 1751288 - DNA, 23 bp, Homo sapiens
atgccagcttctctctccagggt

SEQ ID NO: 1751289 - DNA, 21 bp, Homo sapiens
atgccagggccgaccagagga

SEQ ID NO: 1751290 - DNA, 20 bp, Homo sapiens
atgccagtatttttaaaggc

SEQ ID NO: 1751291 - DNA, 22 bp, Homo sapiens
atgccagtatttttaaaggcat

SEQ ID NO: 1751292 - DNA, 18 bp, Homo sapiens
atgccataatcagaacac

SEQ ID NO: 1751293 - DNA, 22 bp, Homo sapiens
atgccatagaaatgtaggtcct

SEQ ID NO: 1751294 - DNA, 17 bp, Homo sapiens
atgccatgaacaaattc

SEQ ID NO: 1751295 - DNA, 23 bp, Homo sapiens
atgccattctgcctcagcctcct

SEQ ID NO: 1751296 - DNA, 21 bp, Homo sapiens
atgccatttaaagcttattaa

SEQ ID NO: 1751297 - DNA, 16 bp, Homo sapiens
atgccatttagaatct

SEQ ID NO: 1751298 - DNA, 17 bp, Homo sapiens
atgccatttagaatcta

SEQ ID NO: 1751299 - DNA, 22 bp, Homo sapiens
atgccatttagaatctagaaat

SEQ ID NO: 1751300 - DNA, 20 bp, Homo sapiens
atgccatttcagtggcttcc

SEQ ID NO: 1751301 - DNA, 24 bp, Homo sapiens
atgccattttgtacatgtatgaaa

SEQ ID NO: 1751302 - DNA, 17 bp, Homo sapiens
atgcccaagccctgaga

SEQ ID NO: 1751303 - DNA, 14 bp, Homo sapiens
atgcccaatatatt

SEQ ID NO: 1751304 - DNA, 15 bp, Homo sapiens
atgctttgggaggcc

SEQ ID NO: 1751305 - DNA, 16 bp, Homo sapiens
atgctttgggaggcca

SEQ ID NO: 1751306 - DNA, 19 bp, Homo sapiens
atgctttgggaggccaagg

SEQ ID NO: 1751307 - DNA, 16 bp, Homo sapiens
atgctttgtgtgattg

SEQ ID NO: 1751308 - DNA, 22 bp, Homo sapiens
atgctttgtgtgattgaatctg

SEQ ID NO: 1751309 - DNA, 22 bp, Homo sapiens
atgcttttatagctgcttggat

SEQ ID NO: 1751310 - DNA, 20 bp, Homo sapiens
atggaaaaaaacataaaaag

SEQ ID NO: 1751311 - DNA, 14 bp, Homo sapiens
atggaaaaaatgat

SEQ ID NO: 1751312 - DNA, 16 bp, Homo sapiens
atggaaaaatactgcc

SEQ ID NO: 1751313 - DNA, 12 bp, Homo sapiens
atggaaaaggaa

SEQ ID NO: 1751314 - DNA, 16 bp, Homo sapiens
atggaaaagggtcttc

SEQ ID NO: 1751315 - DNA, 18 bp, Homo sapiens
atggaaaagtgtccttct

SEQ ID NO: 1751316 - DNA, 12 bp, Homo sapiens
atggaaaataaa

SEQ ID NO: 1751317 - DNA, 15 bp, Homo sapiens
atggaaaattttctc

SEQ ID NO: 1751318 - DNA, 21 bp, Homo sapiens
atggaaaattttctccttggt

SEQ ID NO: 1751319 - DNA, 13 bp, Homo sapiens
atggaaactgaat

SEQ ID NO: 1751320 - DNA, 14 bp, Homo sapiens
atggaaactgaatg

SEQ ID NO: 1751321 - DNA, 21 bp, Homo sapiens
atggaaagactgggacagccc

SEQ ID NO: 1751322 - DNA, 18 bp, Homo sapiens
atggaaatgcaaactggg

SEQ ID NO: 1751323 - DNA, 21 bp, Homo sapiens
atggaacataaagttgtattg

SEQ ID NO: 1751324 - DNA, 16 bp, Homo sapiens
atggaactactgtact

SEQ ID NO: 1751325 - DNA, 12 bp, Homo sapiens
atggaagaaagt

SEQ ID NO: 1751326 - DNA, 14 bp, Homo sapiens
atggaaggggcttc

SEQ ID NO: 1751327 - DNA, 17 bp, Homo sapiens
atggaaggtttgtatat

SEQ ID NO: 1751328 - DNA, 22 bp, Homo sapiens
atggaaggtttgtatattgtca

SEQ ID NO: 1751329 - DNA, 15 bp, Homo sapiens
atggaataacatgta

SEQ ID NO: 1751330 - DNA, 16 bp, Homo sapiens
atggaataactctgtg

SEQ ID NO: 1751331 - DNA, 17 bp, Homo sapiens
atggaatacagtgttat

SEQ ID NO: 1751332 - DNA, 14 bp, Homo sapiens
atggaatatcagaa

SEQ ID NO: 1751333 - DNA, 18 bp, Homo sapiens
atggaatatcagaagtat

SEQ ID NO: 1751334 - DNA, 16 bp, Homo sapiens
atggaatcgaagtgtt

SEQ ID NO: 1751335 - DNA, 18 bp, Homo sapiens
atggaatcgatttcctcc

SEQ ID NO: 1751336 - DNA, 16 bp, Homo sapiens
atggaatgctgtgtta

SEQ ID NO: 1751337 - DNA, 15 bp, Homo sapiens
atggaattatgtata

SEQ ID NO: 1751338 - DNA, 19 bp, Homo sapiens
atggaattatgtataacaa

SEQ ID NO: 1751339 - DNA, 20 bp, Homo sapiens
atggaattattttgaatgtc

SEQ ID NO: 1751340 - DNA, 15 bp, Homo sapiens
atggacaacttattt

SEQ ID NO: 1751341 - DNA, 18 bp, Homo sapiens
atggacaccttgtgttta

SEQ ID NO: 1751342 - DNA, 23 bp, Homo sapiens
atggacacgagccacaagctgca

SEQ ID NO: 1751343 - DNA, 15 bp, Homo sapiens
atggacactttgaaa

SEQ ID NO: 1751344 - DNA, 19 bp, Homo sapiens
atggacatgatcttcttta

SEQ ID NO: 1751345 - DNA, 18 bp, Homo sapiens
atggacatttagaagaaa

SEQ ID NO: 1751346 - DNA, 16 bp, Homo sapiens
atggaccagtggctgg

SEQ ID NO: 1751347 - DNA, 19 bp, Homo sapiens
atggacccactacccttct

SEQ ID NO: 1751348 - DNA, 20 bp, Homo sapiens
atggacccactacccttctc

SEQ ID NO: 1751349 - DNA, 21 bp, Homo sapiens
atggacccactacccttctcc

SEQ ID NO: 1751350 - DNA, 19 bp, Homo sapiens
atggaccgggtgggcctgg

SEQ ID NO: 1751351 - DNA, 21 bp, Homo sapiens
atggaccgggtgggcctggcc

SEQ ID NO: 1751352 - DNA, 13 bp, Homo sapiens
atggacctaacat

SEQ ID NO: 1751353 - DNA, 15 bp, Homo sapiens
atggacctaacattc

SEQ ID NO: 1751354 - DNA, 21 bp, Homo sapiens
atggactaaccccaacgcaca

SEQ ID NO: 1751355 - DNA, 13 bp, Homo sapiens
atggactatctgt

SEQ ID NO: 1751356 - DNA, 17 bp, Homo sapiens
atggactatctgtctgg

SEQ ID NO: 1751357 - DNA, 22 bp, Homo sapiens
atggactatctgtctggtggcc

SEQ ID NO: 1751358 - DNA, 16 bp, Homo sapiens
atggacttgtatattt

SEQ ID NO: 1751359 - DNA, 22 bp, Homo sapiens
atggacttgtatatttgtacaa

SEQ ID NO: 1751360 - DNA, 19 bp, Homo sapiens
atggacttgtgattggctg

SEQ ID NO: 1751361 - DNA, 21 bp, Homo sapiens
atggacttgtgattggctgca

SEQ ID NO: 1751362 - DNA, 23 bp, Homo sapiens
atggacttgtgattggctgcagg

SEQ ID NO: 1751363 - DNA, 15 bp, Homo sapiens
atggagaaagaagtg

SEQ ID NO: 1751364 - DNA, 21 bp, Homo sapiens
atggagaaagaagtggagaca

SEQ ID NO: 1751365 - DNA, 15 bp, Homo sapiens
atggagaagggttct

SEQ ID NO: 1751366 - DNA, 20 bp, Homo sapiens
atggagaatctgctgcatag

SEQ ID NO: 1751367 - DNA, 20 bp, Homo sapiens
atggagacgtggtgggactc

SEQ ID NO: 1751368 - DNA, 20 bp, Homo sapiens
atggagactcctgccctgtt

SEQ ID NO: 1751369 - DNA, 18 bp, Homo sapiens
atggagactgtctcaaga

SEQ ID NO: 1751370 - DNA, 11 bp, Homo sapiens
atggagagaat

SEQ ID NO: 1751371 - DNA, 13 bp, Homo sapiens
atggagagagggg

SEQ ID NO: 1751372 - DNA, 14 bp, Homo sapiens
atggagagagggga

SEQ ID NO: 1751373 - DNA, 15 bp, Homo sapiens
atggagatgggaagg

SEQ ID NO: 1751374 - DNA, 15 bp, Homo sapiens
atggagccagctccc

SEQ ID NO: 1751375 - DNA, 23 bp, Homo sapiens
atggagccagctccctctattta

SEQ ID NO: 1751376 - DNA, 21 bp, Homo sapiens
atggagcccataggccacccc

SEQ ID NO: 1751377 - DNA, 14 bp, Homo sapiens
atggagccccacct

SEQ ID NO: 1751378 - DNA, 16 bp, Homo sapiens
atggagctttctgtat

SEQ ID NO: 1751379 - DNA, 13 bp, Homo sapiens
atggaggaaaaag

SEQ ID NO: 1751380 - DNA, 23 bp, Homo sapiens
atggaggaagaacaacaaagaca

SEQ ID NO: 1751381 - DNA, 11 bp, Homo sapiens
atggaggagaa

SEQ ID NO: 1751382 - DNA, 18 bp, Homo sapiens
atggaggatggagagagg

SEQ ID NO: 1751383 - DNA, 22 bp, Homo sapiens
atggaggattctttccccagag

SEQ ID NO: 1751384 - DNA, 15 bp, Homo sapiens
atggaggcctgtcct

SEQ ID NO: 1751385 - DNA, 14 bp, Homo sapiens
atggaggctgcagc

SEQ ID NO: 1751386 - DNA, 15 bp, Homo sapiens
atggaggctgcagcg

SEQ ID NO: 1751387 - DNA, 14 bp, Homo sapiens
atggagggcttggc

SEQ ID NO: 1751388 - DNA, 19 bp, Homo sapiens
atggagggcttggcccagc

SEQ ID NO: 1751389 - DNA, 22 bp, Homo sapiens
atggagtgagtcacctgctcca

SEQ ID NO: 1751390 - DNA, 17 bp, Homo sapiens
atggagtgtgcagacag

SEQ ID NO: 1751391 - DNA, 18 bp, Homo sapiens
atggagtgtgcagacagc

SEQ ID NO: 1751392 - DNA, 15 bp, Homo sapiens
atggagttaaataaa

SEQ ID NO: 1751393 - DNA, 15 bp, Homo sapiens
atggagtttctaagg

SEQ ID NO: 1751394 - DNA, 16 bp, Homo sapiens
atggataaactgagcc

SEQ ID NO: 1751395 - DNA, 15 bp, Homo sapiens
atggataatgtgtat

SEQ ID NO: 1751396 - DNA, 20 bp, Homo sapiens
atggatatatttgaaatagt

SEQ ID NO: 1751397 - DNA, 21 bp, Homo sapiens
atggatatatttgaaatagta

SEQ ID NO: 1751398 - DNA, 13 bp, Homo sapiens
atggatatgctgc

SEQ ID NO: 1751399 - DNA, 15 bp, Homo sapiens
atggatatgctgctt

SEQ ID NO: 1751400 - DNA, 18 bp, Homo sapiens
atggatatgctgctttaa

SEQ ID NO: 1751401 - DNA, 16 bp, Homo sapiens
atggatcttttctaaa

SEQ ID NO: 1751402 - DNA, 20 bp, Homo sapiens
atggatcttttctaaatgtt

SEQ ID NO: 1751403 - DNA, 21 bp, Homo sapiens
atggatgattcagaaattgga

SEQ ID NO: 1751404 - DNA, 15 bp, Homo sapiens
atggatgatttaagt

SEQ ID NO: 1751405 - DNA, 15 bp, Homo sapiens
atggatggcaccctg

SEQ ID NO: 1751406 - DNA, 19 bp, Homo sapiens
atggatggcaccctggaac

SEQ ID NO: 1751407 - DNA, 12 bp, Homo sapiens
atggatgtgctt

SEQ ID NO: 1751408 - DNA, 20 bp, Homo sapiens
atggattcacccccctctgc

SEQ ID NO: 1751409 - DNA, 12 bp, Homo sapiens
atggattcagca

SEQ ID NO: 1751410 - DNA, 19 bp, Homo sapiens
atggattctccactcagtt

SEQ ID NO: 1751411 - DNA, 20 bp, Homo sapiens
atggattgataattgcattc

SEQ ID NO: 1751412 - DNA, 23 bp, Homo sapiens
atggattgattcagtcttctgga

SEQ ID NO: 1751413 - DNA, 15 bp, Homo sapiens
atggattttgggagt

SEQ ID NO: 1751414 - DNA, 16 bp, Homo sapiens
atggatttttctttaa

SEQ ID NO: 1751415 - DNA, 14 bp, Homo sapiens
atggcaacagatct

SEQ ID NO: 1751416 - DNA, 24 bp, Homo sapiens
atggcaacagatctggaacctcag

SEQ ID NO: 1751417 - DNA, 18 bp, Homo sapiens
atggcaatagggtagaat

SEQ ID NO: 1751418 - DNA, 21 bp, Homo sapiens
atggcacaaaaaatgaggaat

SEQ ID NO: 1751419 - DNA, 21 bp, Homo sapiens
atgtactggtaattgtacaat

SEQ ID NO: 1751420 - DNA, 14 bp, Homo sapiens
atgtacttcctgtg

SEQ ID NO: 1751421 - DNA, 15 bp, Homo sapiens
atgtacttcctgtgt

SEQ ID NO: 1751422 - DNA, 20 bp, Homo sapiens
atgtacttgaaaaatgtttt

SEQ ID NO: 1751423 - DNA, 16 bp, Homo sapiens
atgtacttgtttgcta

SEQ ID NO: 1751424 - DNA, 18 bp, Homo sapiens
atgtacttgtttgctatg

SEQ ID NO: 1751425 - DNA, 14 bp, Homo sapiens
atgtagaactcagc

SEQ ID NO: 1751426 - DNA, 22 bp, Homo sapiens
atgtagaactgttcatttccac

SEQ ID NO: 1751427 - DNA, 14 bp, Homo sapiens
atgtagaattgaaa

SEQ ID NO: 1751428 - DNA, 18 bp, Homo sapiens
atgtagagagaacaggtg

SEQ ID NO: 1751429 - DNA, 18 bp, Homo sapiens
atgtagaggcttgtttac

SEQ ID NO: 1751430 - DNA, 23 bp, Homo sapiens
atgtagatattgtgaagtacata

SEQ ID NO: 1751431 - DNA, 18 bp, Homo sapiens
atgtagatgggcattttt

SEQ ID NO: 1751432 - DNA, 16 bp, Homo sapiens
atgtagcccatccttc

SEQ ID NO: 1751433 - DNA, 21 bp, Homo sapiens
atgtagccccctggcctctgt

SEQ ID NO: 1751434 - DNA, 23 bp, Homo sapiens
atgtagccccctggcctctgtgc

SEQ ID NO: 1751435 - DNA, 17 bp, Homo sapiens
atgtagcgacagcattt

SEQ ID NO: 1751436 - DNA, 14 bp, Homo sapiens
atgtagctatgggc

SEQ ID NO: 1751437 - DNA, 15 bp, Homo sapiens
atgtagctggtttcc

SEQ ID NO: 1751438 - DNA, 19 bp, Homo sapiens
atgtaggggaagagatgtt

SEQ ID NO: 1751439 - DNA, 18 bp, Homo sapiens
atgtagggtaaggtgcct

SEQ ID NO: 1751440 - DNA, 16 bp, Homo sapiens
atgtaggtaagactgt

SEQ ID NO: 1751441 - DNA, 19 bp, Homo sapiens
atgtaggtaagactgtaga

SEQ ID NO: 1751442 - DNA, 20 bp, Homo sapiens
atgtaggtaagactgtagat

SEQ ID NO: 1751443 - DNA, 13 bp, Homo sapiens
atgtagtaacact

SEQ ID NO: 1751444 - DNA, 17 bp, Homo sapiens
atgtagtaacactaata

SEQ ID NO: 1751445 - DNA, 17 bp, Homo sapiens
atgtagtataaagaaaa

SEQ ID NO: 1751446 - DNA, 18 bp, Homo sapiens
atgtagtattaaaagttg

SEQ ID NO: 1751447 - DNA, 23 bp, Homo sapiens
atgtagtattttttgtataattg

SEQ ID NO: 1751448 - DNA, 20 bp, Homo sapiens
atgtagtttgaggaaatttg

SEQ ID NO: 1751449 - DNA, 19 bp, Homo sapiens
atgtataaaaattatcaaa

SEQ ID NO: 1751450 - DNA, 22 bp, Homo sapiens
atgtataaaatacatagtgaaa

SEQ ID NO: 1751451 - DNA, 12 bp, Homo sapiens
atgtataaatat

SEQ ID NO: 1751452 - DNA, 14 bp, Homo sapiens
atgtataaatatac

SEQ ID NO: 1751453 - DNA, 12 bp, Homo sapiens
atgtataatata

SEQ ID NO: 1751454 - DNA, 13 bp, Homo sapiens
atgtataatatat

SEQ ID NO: 1751455 - DNA, 17 bp, Homo sapiens
atgtataatatatatct

SEQ ID NO: 1751456 - DNA, 22 bp, Homo sapiens
atgtataatgtgcagaaaatat

SEQ ID NO: 1751457 - DNA, 15 bp, Homo sapiens
atgtatataagtact

SEQ ID NO: 1751458 - DNA, 17 bp, Homo sapiens
atgtatatatatatagt

SEQ ID NO: 1751459 - DNA, 17 bp, Homo sapiens
atgtatatgtatatata

SEQ ID NO: 1751460 - DNA, 16 bp, Homo sapiens
atgtatatgtgttcat

SEQ ID NO: 1751461 - DNA, 20 bp, Homo sapiens
atgtatatttttttaattta

SEQ ID NO: 1751462 - DNA, 15 bp, Homo sapiens
atgtatcaatgagta

SEQ ID NO: 1751463 - DNA, 20 bp, Homo sapiens
atgtatccaaggaaacattt

SEQ ID NO: 1751464 - DNA, 22 bp, Homo sapiens
atgtatccaaggaaacatttta

SEQ ID NO: 1751465 - DNA, 20 bp, Homo sapiens
atgtatctagtgtgtcctgt

SEQ ID NO: 1751466 - DNA, 22 bp, Homo sapiens
atgtatctagtgtgtcctgtga

SEQ ID NO: 1751467 - DNA, 20 bp, Homo sapiens
atgtatctatttgtacaatt

SEQ ID NO: 1751468 - DNA, 13 bp, Homo sapiens
atgtatgaatgta

SEQ ID NO: 1751469 - DNA, 22 bp, Homo sapiens
atgtatggatatatttgaaata

SEQ ID NO: 1751470 - DNA, 19 bp, Homo sapiens
atgtatgggtagggtaaat

SEQ ID NO: 1751471 - DNA, 13 bp, Homo sapiens
atgtatgtacaat

SEQ ID NO: 1751472 - DNA, 15 bp, Homo sapiens
atgtatgtcagtgct

SEQ ID NO: 1751473 - DNA, 14 bp, Homo sapiens
atgtatgtgcattt

SEQ ID NO: 1751474 - DNA, 12 bp, Homo sapiens
atgtatgttacc

SEQ ID NO: 1751475 - DNA, 18 bp, Homo sapiens
atgtattagctcactgaa

SEQ ID NO: 1751476 - DNA, 22 bp, Homo sapiens
atgtattagtatggttcaagat

SEQ ID NO: 1751477 - DNA, 13 bp, Homo sapiens
atgtattattctg

SEQ ID NO: 1751478 - DNA, 16 bp, Homo sapiens
atgtattattctgcag

SEQ ID NO: 1751479 - DNA, 15 bp, Homo sapiens
atgtattatttataa

SEQ ID NO: 1751480 - DNA, 16 bp, Homo sapiens
atgtattcccttgtat

SEQ ID NO: 1751481 - DNA, 21 bp, Homo sapiens
atgtattcccttgtattttgt

SEQ ID NO: 1751482 - DNA, 20 bp, Homo sapiens
atgtattctagctaatgtaa

SEQ ID NO: 1751483 - DNA, 17 bp, Homo sapiens
atgtattctgtatccgt

SEQ ID NO: 1751484 - DNA, 22 bp, Homo sapiens
atgtattctttctgcctttaat

SEQ ID NO: 1751485 - DNA, 13 bp, Homo sapiens
atgtattggcctg

SEQ ID NO: 1751486 - DNA, 15 bp, Homo sapiens
atgtattggcctgga

SEQ ID NO: 1751487 - DNA, 14 bp, Homo sapiens
atgtatttaaagtt

SEQ ID NO: 1751488 - DNA, 16 bp, Homo sapiens
atgtatttatttaaaa

SEQ ID NO: 1751489 - DNA, 18 bp, Homo sapiens
atgtatttatttaaaaga

SEQ ID NO: 1751490 - DNA, 22 bp, Homo sapiens
atgtatttatttaaaagattca

SEQ ID NO: 1751491 - DNA, 14 bp, Homo sapiens
atgtatttgattta

SEQ ID NO: 1751492 - DNA, 10 bp, Homo sapiens
atgtatttgt

SEQ ID NO: 1751493 - DNA, 21 bp, Homo sapiens
atgtatttgttatatataata

SEQ ID NO: 1751494 - DNA, 21 bp, Homo sapiens
atgtattttaactatttttgt

SEQ ID NO: 1751495 - DNA, 23 bp, Homo sapiens
atgtattttaataacatatctaa

SEQ ID NO: 1751496 - DNA, 20 bp, Homo sapiens
atgtattttattattttctt

SEQ ID NO: 1751497 - DNA, 12 bp, Homo sapiens
atgtattttcct

SEQ ID NO: 1751498 - DNA, 19 bp, Homo sapiens
atgtcaaagtgtaacagat

SEQ ID NO: 1751499 - DNA, 22 bp, Homo sapiens
atgtcaaggaagacttttggta

SEQ ID NO: 1751500 - DNA, 16 bp, Homo sapiens
atgtcaagttgggttc

SEQ ID NO: 1751501 - DNA, 23 bp, Homo sapiens
atgtcaatgaccattcaattagt

SEQ ID NO: 1751502 - DNA, 20 bp, Homo sapiens
atgtcaatttgtatatcatg

SEQ ID NO: 1751503 - DNA, 14 bp, Homo sapiens
atgtcacaacctct

SEQ ID NO: 1751504 - DNA, 23 bp, Homo sapiens
atgtcacagtccaaccagaaaca

SEQ ID NO: 1751505 - DNA, 19 bp, Homo sapiens
atgtcaccaccttcccagc

SEQ ID NO: 1751506 - DNA, 23 bp, Homo sapiens
atgtcaccaccttcccagctctc

SEQ ID NO: 1751507 - DNA, 13 bp, Homo sapiens
atgtcacctcagc

SEQ ID NO: 1751508 - DNA, 23 bp, Homo sapiens
atgtcactaaacaagaaatctga

SEQ ID NO: 1751509 - DNA, 19 bp, Homo sapiens
atgtcagacaataccactg

SEQ ID NO: 1751510 - DNA, 14 bp, Homo sapiens
atgtcagatacaat

SEQ ID NO: 1751511 - DNA, 16 bp, Homo sapiens
atgtcagatttctggt

SEQ ID NO: 1751512 - DNA, 15 bp, Homo sapiens
atgtcagcagctctg

SEQ ID NO: 1751513 - DNA, 19 bp, Homo sapiens
atgtcagccgagccgggcc

SEQ ID NO: 1751514 - DNA, 23 bp, Homo sapiens
atgtcagccgagccgggcctggg

SEQ ID NO: 1751515 - DNA, 15 bp, Homo sapiens
atgtcaggaacagaa

SEQ ID NO: 1751516 - DNA, 16 bp, Homo sapiens
atgtcagggccaggtg

SEQ ID NO: 1751517 - DNA, 20 bp, Homo sapiens
atgtcagggccaggtgcaga

SEQ ID NO: 1751518 - DNA, 12 bp, Homo sapiens
atgtcataaatt

SEQ ID NO: 1751519 - DNA, 16 bp, Homo sapiens
atgtcataaattactg

SEQ ID NO: 1751520 - DNA, 20 bp, Homo sapiens
atgtcataaattactgtttt

SEQ ID NO: 1751521 - DNA, 22 bp, Homo sapiens
atgtcatactctgtgtaatctc

SEQ ID NO: 1751522 - DNA, 22 bp, Homo sapiens
atgtcatagaaatattgactca

SEQ ID NO: 1751523 - DNA, 12 bp, Homo sapiens
atgtcatagcca

SEQ ID NO: 1751524 - DNA, 17 bp, Homo sapiens
atgtcatagccaaagcc

SEQ ID NO: 1751525 - DNA, 19 bp, Homo sapiens
atgtcatagtcttgaaatg

SEQ ID NO: 1751526 - DNA, 20 bp, Homo sapiens
atgtcatagtcttgaaatga

SEQ ID NO: 1751527 - DNA, 12 bp, Homo sapiens
atgtcatcttga

SEQ ID NO: 1751528 - DNA, 14 bp, Homo sapiens
atgtcatcttgagc

SEQ ID NO: 1751529 - DNA, 18 bp, Homo sapiens
atgtcatgtacttcctgt

SEQ ID NO: 1751530 - DNA, 13 bp, Homo sapiens
atgtcattaaatg

SEQ ID NO: 1751531 - DNA, 14 bp, Homo sapiens
atgtcattgctaaa

SEQ ID NO: 1751532 - DNA, 17 bp, Homo sapiens
atgtcatttcagaagtt

SEQ ID NO: 1751533 - DNA, 21 bp, Homo sapiens
atgttcattataatctcaaag

SEQ ID NO: 1751534 - DNA, 11 bp, Homo sapiens
atgttcattta

SEQ ID NO: 1751535 - DNA, 16 bp, Homo sapiens
atgttcccagcagtgg

SEQ ID NO: 1751536 - DNA, 12 bp, Homo sapiens
atgttccctgca

SEQ ID NO: 1751537 - DNA, 14 bp, Homo sapiens
atgttccctgcacc

SEQ ID NO: 1751538 - DNA, 23 bp, Homo sapiens
atgttccggcgtttatttctgcg

SEQ ID NO: 1751539 - DNA, 17 bp, Homo sapiens
atgttcctaacaaaatg

SEQ ID NO: 1751540 - DNA, 17 bp, Homo sapiens
atgttcctagtgaaaga

SEQ ID NO: 1751541 - DNA, 16 bp, Homo sapiens
atgttcctcaaatcag

SEQ ID NO: 1751542 - DNA, 23 bp, Homo sapiens
atgttcctccttttcttcaccct

SEQ ID NO: 1751543 - DNA, 21 bp, Homo sapiens
atgttcctgctgtatttcctg

SEQ ID NO: 1751544 - DNA, 19 bp, Homo sapiens
atgttccttccagattgtg

SEQ ID NO: 1751545 - DNA, 22 bp, Homo sapiens
atgttcctttggaagaaaaaat

SEQ ID NO: 1751546 - DNA, 23 bp, Homo sapiens
atgttccttttttgtatattaca

SEQ ID NO: 1751547 - DNA, 15 bp, Homo sapiens
atgttcgggtgtggg

SEQ ID NO: 1751548 - DNA, 17 bp, Homo sapiens
atgttctaaggctctga

SEQ ID NO: 1751549 - DNA, 20 bp, Homo sapiens
atgttctaaggctctgagag

SEQ ID NO: 1751550 - DNA, 13 bp, Homo sapiens
atgttctaagttt

SEQ ID NO: 1751551 - DNA, 20 bp, Homo sapiens
atgttctaagtttctaagat

SEQ ID NO: 1751552 - DNA, 11 bp, Homo sapiens
atgttctatta

SEQ ID NO: 1751553 - DNA, 20 bp, Homo sapiens
atgttctattttttgttttg

SEQ ID NO: 1751554 - DNA, 13 bp, Homo sapiens
atgttctccattt

SEQ ID NO: 1751555 - DNA, 18 bp, Homo sapiens
atgttctgaataatttct

SEQ ID NO: 1751556 - DNA, 22 bp, Homo sapiens
atgttctgaccctgcttcaaat

SEQ ID NO: 1751557 - DNA, 13 bp, Homo sapiens
atgttctggccct

SEQ ID NO: 1751558 - DNA, 21 bp, Homo sapiens
atgttctgtgcctgtaaacat

SEQ ID NO: 1751559 - DNA, 20 bp, Homo sapiens
atgttcttagtggatgttct

SEQ ID NO: 1751560 - DNA, 15 bp, Homo sapiens
atgttctttgtacct

SEQ ID NO: 1751561 - DNA, 15 bp, Homo sapiens
atgttgaacaaaata

SEQ ID NO: 1751562 - DNA, 15 bp, Homo sapiens
atgttgagaggttct

SEQ ID NO: 1751563 - DNA, 17 bp, Homo sapiens
atgttgatttttactgt

SEQ ID NO: 1751564 - DNA, 20 bp, Homo sapiens
atgttgatttttactgtgtt

SEQ ID NO: 1751565 - DNA, 19 bp, Homo sapiens
atgttgccacctgttaaaa

SEQ ID NO: 1751566 - DNA, 22 bp, Homo sapiens
atgttgccacctgttaaaatgt

SEQ ID NO: 1751567 - DNA, 22 bp, Homo sapiens
atgttgcccctttctcttttcc

SEQ ID NO: 1751568 - DNA, 17 bp, Homo sapiens
atgttgctataataaag

SEQ ID NO: 1751569 - DNA, 23 bp, Homo sapiens
atgttgctgatggcccctccagc

SEQ ID NO: 1751570 - DNA, 17 bp, Homo sapiens
atgttgctgttattata

SEQ ID NO: 1751571 - DNA, 21 bp, Homo sapiens
atgttggaactctgtgcaggt

SEQ ID NO: 1751572 - DNA, 17 bp, Homo sapiens
atgttggaagagaaagc

SEQ ID NO: 1751573 - DNA, 17 bp, Homo sapiens
atgttggacacctttag

SEQ ID NO: 1751574 - DNA, 22 bp, Homo sapiens
atgttggacacctttaggttct

SEQ ID NO: 1751575 - DNA, 23 bp, Homo sapiens
atgttggacacctttaggttctt

SEQ ID NO: 1751576 - DNA, 16 bp, Homo sapiens
atgttggccaggctgg

SEQ ID NO: 1751577 - DNA, 12 bp, Homo sapiens
atgttgggaaag

SEQ ID NO: 1751578 - DNA, 15 bp, Homo sapiens
atgttgggaaagtat

SEQ ID NO: 1751579 - DNA, 21 bp, Homo sapiens
atgttgggaaagtatttactt

SEQ ID NO: 1751580 - DNA, 14 bp, Homo sapiens
atgttggtgttcca

SEQ ID NO: 1751581 - DNA, 21 bp, Homo sapiens
atgttggtttaattaataata

SEQ ID NO: 1751582 - DNA, 21 bp, Homo sapiens
atgttggttttttataaagtc

SEQ ID NO: 1751583 - DNA, 23 bp, Homo sapiens
atgttgtaataaaacttatgcta

SEQ ID NO: 1751584 - DNA, 11 bp, Homo sapiens
atgttgtattg

SEQ ID NO: 1751585 - DNA, 14 bp, Homo sapiens
atgttgtcaaggat

SEQ ID NO: 1751586 - DNA, 15 bp, Homo sapiens
atgttgtgaataatt

SEQ ID NO: 1751587 - DNA, 15 bp, Homo sapiens
atgttgtgatgtatt

SEQ ID NO: 1751588 - DNA, 23 bp, Homo sapiens
atgttgttaaacacgtgtctata

SEQ ID NO: 1751589 - DNA, 14 bp, Homo sapiens
atgttgttatttaa

SEQ ID NO: 1751590 - DNA, 18 bp, Homo sapiens
atgttgttttgtacagat

SEQ ID NO: 1751591 - DNA, 19 bp, Homo sapiens
atgttgttttgtacagatg

SEQ ID NO: 1751592 - DNA, 15 bp, Homo sapiens
atgtttaaaagaaat

SEQ ID NO: 1751593 - DNA, 17 bp, Homo sapiens
atgtttaaatataaatg

SEQ ID NO: 1751594 - DNA, 17 bp, Homo sapiens
atgtttaacaaatctaa

SEQ ID NO: 1751595 - DNA, 16 bp, Homo sapiens
atgtttacaaatggac

SEQ ID NO: 1751596 - DNA, 18 bp, Homo sapiens
atgtttacactctttgta

SEQ ID NO: 1751597 - DNA, 19 bp, Homo sapiens
atgtttactgtaaattttt

SEQ ID NO: 1751598 - DNA, 22 bp, Homo sapiens
atgtttatatactgggttcttg

SEQ ID NO: 1751599 - DNA, 12 bp, Homo sapiens
atgtttatgtaa

SEQ ID NO: 1751600 - DNA, 13 bp, Homo sapiens
atgtttatgtaaa

SEQ ID NO: 1751601 - DNA, 15 bp, Homo sapiens
atgtttattacaatt

SEQ ID NO: 1751602 - DNA, 16 bp, Homo sapiens
atgtttattacaattt

SEQ ID NO: 1751603 - DNA, 18 bp, Homo sapiens
atgtttattcctgataat

SEQ ID NO: 1751604 - DNA, 22 bp, Homo sapiens
atgtttattgttttttaaagaa

SEQ ID NO: 1751605 - DNA, 17 bp, Homo sapiens
atgtttatttactaatt

SEQ ID NO: 1751606 - DNA, 17 bp, Homo sapiens
atgtttcaaactttgga

SEQ ID NO: 1751607 - DNA, 21 bp, Homo sapiens
atgtttcacaccggaaggttt

SEQ ID NO: 1751608 - DNA, 23 bp, Homo sapiens
atgtttcagtgaagatgctgtaa

SEQ ID NO: 1751609 - DNA, 12 bp, Homo sapiens
atgtttcatatt

SEQ ID NO: 1751610 - DNA, 13 bp, Homo sapiens
atgtttcattatg

SEQ ID NO: 1751611 - DNA, 12 bp, Homo sapiens
atgtttccactg

SEQ ID NO: 1751612 - DNA, 13 bp, Homo sapiens
atgtttccagcag

SEQ ID NO: 1751613 - DNA, 15 bp, Homo sapiens
atgtttccagctgcc

SEQ ID NO: 1751614 - DNA, 23 bp, Homo sapiens
atgtttcgtgaagtatactgtat

SEQ ID NO: 1751615 - DNA, 13 bp, Homo sapiens
atgtttctaaggt

SEQ ID NO: 1751616 - DNA, 13 bp, Homo sapiens
atgtttctcacat

SEQ ID NO: 1751617 - DNA, 17 bp, Homo sapiens
atgtttctcacattgct

SEQ ID NO: 1751618 - DNA, 16 bp, Homo sapiens
atgtttctggacattc

SEQ ID NO: 1751619 - DNA, 23 bp, Homo sapiens
atgtttctgtgaaattctcagag

SEQ ID NO: 1751620 - DNA, 16 bp, Homo sapiens
atgtttcttttgtttg

SEQ ID NO: 1751621 - DNA, 11 bp, Homo sapiens
atgtttgaaaa

SEQ ID NO: 1751622 - DNA, 18 bp, Homo sapiens
atgtttgaaaattagaga

SEQ ID NO: 1751623 - DNA, 13 bp, Homo sapiens
atgtttgaacaaa

SEQ ID NO: 1751624 - DNA, 16 bp, Homo sapiens
atgtttgcacttgtga

SEQ ID NO: 1751625 - DNA, 13 bp, Homo sapiens
atgtttgcccaaa

SEQ ID NO: 1751626 - DNA, 15 bp, Homo sapiens
atgtttgccttctgc

SEQ ID NO: 1751627 - DNA, 16 bp, Homo sapiens
atgtttgctattgaca

SEQ ID NO: 1751628 - DNA, 20 bp, Homo sapiens
atgtttgctgaacattggag

SEQ ID NO: 1751629 - DNA, 20 bp, Homo sapiens
atgtttgcttcataaatgaa

SEQ ID NO: 1751630 - DNA, 19 bp, Homo sapiens
atgtttggggatcgatgtg

SEQ ID NO: 1751631 - DNA, 24 bp, Homo sapiens
atgtttgtgagaagcttctaatta

SEQ ID NO: 1751632 - DNA, 19 bp, Homo sapiens
atgtttgtgcagtaacttg

SEQ ID NO: 1751633 - DNA, 10 bp, Homo sapiens
atgtttgtgg

SEQ ID NO: 1751634 - DNA, 17 bp, Homo sapiens
atgtttgtgtgatttcc

SEQ ID NO: 1751635 - DNA, 22 bp, Homo sapiens
atgtttgttatttacactggtc

SEQ ID NO: 1751636 - DNA, 12 bp, Homo sapiens
atgttttaaaga

SEQ ID NO: 1751637 - DNA, 19 bp, Homo sapiens
atgttttagagttaacaat

SEQ ID NO: 1751638 - DNA, 16 bp, Homo sapiens
atgttttcaaaaggta

SEQ ID NO: 1751639 - DNA, 18 bp, Homo sapiens
atgttttctttgtttcct

SEQ ID NO: 1751640 - DNA, 19 bp, Homo sapiens
atgttttgtacaattacta

SEQ ID NO: 1751641 - DNA, 21 bp, Homo sapiens
atgttttgtcccatttccttg

SEQ ID NO: 1751642 - DNA, 11 bp, Homo sapiens
atgtttttaaa

SEQ ID NO: 1751643 - DNA, 15 bp, Homo sapiens
atgtttttatacaaa

SEQ ID NO: 1751644 - DNA, 16 bp, Homo sapiens
atgtttttatatgtct

SEQ ID NO: 1751645 - DNA, 22 bp, Homo sapiens
atgtttttctgccagggagctt

SEQ ID NO: 1751646 - DNA, 15 bp, Homo sapiens
atgttttttatgttc

SEQ ID NO: 1751647 - DNA, 20 bp, Homo sapiens
atgttttttccttttcacat

SEQ ID NO: 1751648 - DNA, 14 bp, Homo sapiens
attagtatgtctgt

SEQ ID NO: 1751649 - DNA, 16 bp, Homo sapiens
attagtccaaatgtga

SEQ ID NO: 1751650 - DNA, 23 bp, Homo sapiens
attagtccaaatgtgatcaactg

SEQ ID NO: 1751651 - DNA, 19 bp, Homo sapiens
attagtcctaattcaatcc

SEQ ID NO: 1751652 - DNA, 18 bp, Homo sapiens
attagtcttttgtaatat

SEQ ID NO: 1751653 - DNA, 19 bp, Homo sapiens
attagtgaaccaaaaatag

SEQ ID NO: 1751654 - DNA, 22 bp, Homo sapiens
attagtgaaccaaaaatagaaa

SEQ ID NO: 1751655 - DNA, 13 bp, Homo sapiens
attagtgattctg

SEQ ID NO: 1751656 - DNA, 19 bp, Homo sapiens
attagtgattctgatttca

SEQ ID NO: 1751657 - DNA, 18 bp, Homo sapiens
attagtgccacttaatgt

SEQ ID NO: 1751658 - DNA, 19 bp, Homo sapiens
attagtgccacttaatgta

SEQ ID NO: 1751659 - DNA, 21 bp, Homo sapiens
attagtgccacttaatgtatg

SEQ ID NO: 1751660 - DNA, 16 bp, Homo sapiens
attagtgccagaattt

SEQ ID NO: 1751661 - DNA, 19 bp, Homo sapiens
attagtgccagaattttag

SEQ ID NO: 1751662 - DNA, 21 bp, Homo sapiens
attagtgccagaattttagga

SEQ ID NO: 1751663 - DNA, 18 bp, Homo sapiens
attagtggtcataaaata

SEQ ID NO: 1751664 - DNA, 20 bp, Homo sapiens
attagtgtgacagtttccaa

SEQ ID NO: 1751665 - DNA, 22 bp, Homo sapiens
attagtgtgacagtttccaaat

SEQ ID NO: 1751666 - DNA, 19 bp, Homo sapiens
attagttccagtttctcct

SEQ ID NO: 1751667 - DNA, 21 bp, Homo sapiens
attagttgaaaggcctcaaga

SEQ ID NO: 1751668 - DNA, 19 bp, Homo sapiens
attagttgcactaactgct

SEQ ID NO: 1751669 - DNA, 14 bp, Homo sapiens
attagttgggatgc

SEQ ID NO: 1751670 - DNA, 17 bp, Homo sapiens
attagttggtttgtgtg

SEQ ID NO: 1751671 - DNA, 21 bp, Homo sapiens
attagtttcacatgatatacc

SEQ ID NO: 1751672 - DNA, 17 bp, Homo sapiens
attagtttcctttttaa

SEQ ID NO: 1751673 - DNA, 18 bp, Homo sapiens
attagtttcctttttaat

SEQ ID NO: 1751674 - DNA, 20 bp, Homo sapiens
attagttttagaggcattgt

SEQ ID NO: 1751675 - DNA, 18 bp, Homo sapiens
attataaaaaatgtaaca

SEQ ID NO: 1751676 - DNA, 19 bp, Homo sapiens
attataaaaaatgtaacat

SEQ ID NO: 1751677 - DNA, 21 bp, Homo sapiens
attataaactataaacttaag

SEQ ID NO: 1751678 - DNA, 19 bp, Homo sapiens
attataacaactatttact

SEQ ID NO: 1751679 - DNA, 20 bp, Homo sapiens
attataacaactatttactt

SEQ ID NO: 1751680 - DNA, 17 bp, Homo sapiens
attataacaagtgtgtc

SEQ ID NO: 1751681 - DNA, 12 bp, Homo sapiens
attataacagtt

SEQ ID NO: 1751682 - DNA, 15 bp, Homo sapiens
attataacagttata

SEQ ID NO: 1751683 - DNA, 16 bp, Homo sapiens
attataacagttatat

SEQ ID NO: 1751684 - DNA, 21 bp, Homo sapiens
attataactgaaggagaaggt

SEQ ID NO: 1751685 - DNA, 12 bp, Homo sapiens
attataactgta

SEQ ID NO: 1751686 - DNA, 15 bp, Homo sapiens
attataacttaaaaa

SEQ ID NO: 1751687 - DNA, 22 bp, Homo sapiens
attataacttaaaaaaatgaca

SEQ ID NO: 1751688 - DNA, 15 bp, Homo sapiens
attataagggagagc

SEQ ID NO: 1751689 - DNA, 15 bp, Homo sapiens
attataataaatata

SEQ ID NO: 1751690 - DNA, 21 bp, Homo sapiens
attataataggaacaatcttt

SEQ ID NO: 1751691 - DNA, 14 bp, Homo sapiens
attataatctcaaa

SEQ ID NO: 1751692 - DNA, 18 bp, Homo sapiens
attataatctcaaaggag

SEQ ID NO: 1751693 - DNA, 18 bp, Homo sapiens
attataatcttataattg

SEQ ID NO: 1751694 - DNA, 13 bp, Homo sapiens
attataatgtatt

SEQ ID NO: 1751695 - DNA, 22 bp, Homo sapiens
attatacatgtgatacattttt

SEQ ID NO: 1751696 - DNA, 14 bp, Homo sapiens
attatacgctggca

SEQ ID NO: 1751697 - DNA, 23 bp, Homo sapiens
attatactgtagctgatgaaact

SEQ ID NO: 1751698 - DNA, 12 bp, Homo sapiens
attatactgtat

SEQ ID NO: 1751699 - DNA, 12 bp, Homo sapiens
attatacttgag

SEQ ID NO: 1751700 - DNA, 14 bp, Homo sapiens
attatagaaaatta

SEQ ID NO: 1751701 - DNA, 23 bp, Homo sapiens
attatagagcagaaattctgttt

SEQ ID NO: 1751702 - DNA, 15 bp, Homo sapiens
attatagattctaaa

SEQ ID NO: 1751703 - DNA, 16 bp, Homo sapiens
attatagattctaaag

SEQ ID NO: 1751704 - DNA, 18 bp, Homo sapiens
attatagattctaaagat

SEQ ID NO: 1751705 - DNA, 19 bp, Homo sapiens
attatagattctaaagatt

SEQ ID NO: 1751706 - DNA, 19 bp, Homo sapiens
attatagcaactaatgttt

SEQ ID NO: 1751707 - DNA, 19 bp, Homo sapiens
attataggagccttaattt

SEQ ID NO: 1751708 - DNA, 15 bp, Homo sapiens
attatataactgtat

SEQ ID NO: 1751709 - DNA, 18 bp, Homo sapiens
attatataggatattgct

SEQ ID NO: 1751710 - DNA, 16 bp, Homo sapiens
attatatatatctata

SEQ ID NO: 1751711 - DNA, 16 bp, Homo sapiens
attatattaaacatac

SEQ ID NO: 1751712 - DNA, 16 bp, Homo sapiens
attatattcaatgcat

SEQ ID NO: 1751713 - DNA, 22 bp, Homo sapiens
attatattggtgcgtttttaca

SEQ ID NO: 1751714 - DNA, 16 bp, Homo sapiens
attatattgttttttt

SEQ ID NO: 1751715 - DNA, 15 bp, Homo sapiens
attatattttttcta

SEQ ID NO: 1751716 - DNA, 21 bp, Homo sapiens
attatcaagtagactactgtt

SEQ ID NO: 1751717 - DNA, 16 bp, Homo sapiens
attatcatgggaaaag

SEQ ID NO: 1751718 - DNA, 18 bp, Homo sapiens
attatcctcctgttctga

SEQ ID NO: 1751719 - DNA, 21 bp, Homo sapiens
attatcctcctgttctgaaac

SEQ ID NO: 1751720 - DNA, 21 bp, Homo sapiens
attatcctgaactcttctgca

SEQ ID NO: 1751721 - DNA, 17 bp, Homo sapiens
attatcggaagcagtgc

SEQ ID NO: 1751722 - DNA, 19 bp, Homo sapiens
attatcggaagcagtgcct

SEQ ID NO: 1751723 - DNA, 16 bp, Homo sapiens
attatcgggaacagtg

SEQ ID NO: 1751724 - DNA, 17 bp, Homo sapiens
attatcgggaacagtgt

SEQ ID NO: 1751725 - DNA, 18 bp, Homo sapiens
attatcgggaacagtgtt

SEQ ID NO: 1751726 - DNA, 17 bp, Homo sapiens
attatcgggagcagtgt

SEQ ID NO: 1751727 - DNA, 14 bp, Homo sapiens
attatctaatttat

SEQ ID NO: 1751728 - DNA, 14 bp, Homo sapiens
attatctgggctta

SEQ ID NO: 1751729 - DNA, 16 bp, Homo sapiens
attatcttcagcccag

SEQ ID NO: 1751730 - DNA, 12 bp, Homo sapiens
attatgacagtt

SEQ ID NO: 1751731 - DNA, 17 bp, Homo sapiens
attatgacagttatact

SEQ ID NO: 1751732 - DNA, 23 bp, Homo sapiens
attatgagattggttttcctgtg

SEQ ID NO: 1751733 - DNA, 15 bp, Homo sapiens
attatgagctacaac

SEQ ID NO: 1751734 - DNA, 16 bp, Homo sapiens
attatgagctttcttt

SEQ ID NO: 1751735 - DNA, 19 bp, Homo sapiens
attatgagttccctaaaca

SEQ ID NO: 1751736 - DNA, 16 bp, Homo sapiens
attatgatctaataaa

SEQ ID NO: 1751737 - DNA, 21 bp, Homo sapiens
attatgcacttttagaaatgc

SEQ ID NO: 1751738 - DNA, 23 bp, Homo sapiens
attatgcacttttagaaatgcat

SEQ ID NO: 1751739 - DNA, 13 bp, Homo sapiens
attatgcataaag

SEQ ID NO: 1751740 - DNA, 16 bp, Homo sapiens
attatggcaagtgata

SEQ ID NO: 1751741 - DNA, 13 bp, Homo sapiens
attatggcatttc

SEQ ID NO: 1751742 - DNA, 17 bp, Homo sapiens
attatgggtcacaggaa

SEQ ID NO: 1751743 - DNA, 15 bp, Homo sapiens
attatgggtcctgca

SEQ ID NO: 1751744 - DNA, 19 bp, Homo sapiens
attatggtgggtgattatt

SEQ ID NO: 1751745 - DNA, 20 bp, Homo sapiens
attatgtaaatacaatttgt

SEQ ID NO: 1751746 - DNA, 20 bp, Homo sapiens
attatgtaatatattgtaca

SEQ ID NO: 1751747 - DNA, 14 bp, Homo sapiens
attatgtaatgcaa

SEQ ID NO: 1751748 - DNA, 15 bp, Homo sapiens
attatgtaccatgaa

SEQ ID NO: 1751749 - DNA, 17 bp, Homo sapiens
attatgtaccatgaata

SEQ ID NO: 1751750 - DNA, 20 bp, Homo sapiens
attatgtaccatgaatattt

SEQ ID NO: 1751751 - DNA, 17 bp, Homo sapiens
attatgtatggatatat

SEQ ID NO: 1751752 - DNA, 17 bp, Homo sapiens
attatgtatgtttacat

SEQ ID NO: 1751753 - DNA, 12 bp, Homo sapiens
attatgtctctt

SEQ ID NO: 1751754 - DNA, 21 bp, Homo sapiens
attatgtctcttgagcatcaa

SEQ ID NO: 1751755 - DNA, 17 bp, Homo sapiens
attatgtcttcttttgt

SEQ ID NO: 1751756 - DNA, 20 bp, Homo sapiens
attatgtgcctaattttcta

SEQ ID NO: 1751757 - DNA, 14 bp, Homo sapiens
attatgtggtttta

SEQ ID NO: 1751758 - DNA, 16 bp, Homo sapiens
attatgttcctgctgt

SEQ ID NO: 1751759 - DNA, 19 bp, Homo sapiens
attatgttcctgctgtatt

SEQ ID NO: 1751760 - DNA, 12 bp, Homo sapiens
attatgtttatt

SEQ ID NO: 1751761 - DNA, 16 bp, Homo sapiens
attatgtttattacaa

SEQ ID NO: 1751762 - DNA, 19 bp, Homo sapiens
attatgtttattacaattt

SEQ ID NO: 1751763 - DNA, 19 bp, Homo sapiens
attcccagagcaaaataat

SEQ ID NO: 1751764 - DNA, 20 bp, Homo sapiens
attcccattttgcaaaattt

SEQ ID NO: 1751765 - DNA, 23 bp, Homo sapiens
attcccattttgcaaaatttcca

SEQ ID NO: 1751766 - DNA, 14 bp, Homo sapiens
attccccattcttc

SEQ ID NO: 1751767 - DNA, 15 bp, Homo sapiens
attccccattcttcc

SEQ ID NO: 1751768 - DNA, 15 bp, Homo sapiens
attcccctcccacct

SEQ ID NO: 1751769 - DNA, 21 bp, Homo sapiens
attcccctcccacctctcctt

SEQ ID NO: 1751770 - DNA, 22 bp, Homo sapiens
attcccctctgctgctgtccct

SEQ ID NO: 1751771 - DNA, 14 bp, Homo sapiens
attcccctgtgtca

SEQ ID NO: 1751772 - DNA, 14 bp, Homo sapiens
attccccttcctgt

SEQ ID NO: 1751773 - DNA, 18 bp, Homo sapiens
attcccgttttgtcactt

SEQ ID NO: 1751774 - DNA, 22 bp, Homo sapiens
attccctccccctccttgtgcc

SEQ ID NO: 1751775 - DNA, 14 bp, Homo sapiens
attccctcctgcta

SEQ ID NO: 1751776 - DNA, 16 bp, Homo sapiens
attccctctcatctca

SEQ ID NO: 1751777 - DNA, 20 bp, Homo sapiens
attccctgagtcaccaggaa

SEQ ID NO: 1751778 - DNA, 23 bp, Homo sapiens
attcccttttcaccttttcagga

SEQ ID NO: 1751779 - DNA, 13 bp, Homo sapiens
attccgagcattc

SEQ ID NO: 1751780 - DNA, 17 bp, Homo sapiens
attccgagcattccagt

SEQ ID NO: 1751781 - DNA, 16 bp, Homo sapiens
attccggatcctaagc

SEQ ID NO: 1751782 - DNA, 14 bp, Homo sapiens
attccgtatttaaa

SEQ ID NO: 1751783 - DNA, 14 bp, Homo sapiens
attccgttaggaat

SEQ ID NO: 1751784 - DNA, 22 bp, Homo sapiens
attccgttaggaataacactgc

SEQ ID NO: 1751785 - DNA, 23 bp, Homo sapiens
attccgttaggaataacactgca

SEQ ID NO: 1751786 - DNA, 18 bp, Homo sapiens
attccgttgtctgtggat

SEQ ID NO: 1751787 - DNA, 17 bp, Homo sapiens
attcctaaagaaaaata

SEQ ID NO: 1751788 - DNA, 16 bp, Homo sapiens
attcctaacctgtcag

SEQ ID NO: 1751789 - DNA, 21 bp, Homo sapiens
attcctaactagaattagtat

SEQ ID NO: 1751790 - DNA, 18 bp, Homo sapiens
attcctacaaagatgttt

SEQ ID NO: 1751791 - DNA, 12 bp, Homo sapiens
attcctagaaat

SEQ ID NO: 1751792 - DNA, 17 bp, Homo sapiens
attcctatatagtttat

SEQ ID NO: 1751793 - DNA, 13 bp, Homo sapiens
attcctcagctgc

SEQ ID NO: 1751794 - DNA, 14 bp, Homo sapiens
attcctcagggaca

SEQ ID NO: 1751795 - DNA, 16 bp, Homo sapiens
attcctcatgaatgta

SEQ ID NO: 1751796 - DNA, 15 bp, Homo sapiens
attcctcctgctcat

SEQ ID NO: 1751797 - DNA, 17 bp, Homo sapiens
attcctctccaggccag

SEQ ID NO: 1751798 - DNA, 18 bp, Homo sapiens
attcctctccaggccaga

SEQ ID NO: 1751799 - DNA, 14 bp, Homo sapiens
attcctcttcattg

SEQ ID NO: 1751800 - DNA, 16 bp, Homo sapiens
attcctgaagaaccag

SEQ ID NO: 1751801 - DNA, 12 bp, Homo sapiens
attcctgaccca

SEQ ID NO: 1751802 - DNA, 16 bp, Homo sapiens
attcctgacccaggcc

SEQ ID NO: 1751803 - DNA, 22 bp, Homo sapiens
attcctgacctccgccatccac

SEQ ID NO: 1751804 - DNA, 23 bp, Homo sapiens
attcctgatatgatttaaaacat

SEQ ID NO: 1751805 - DNA, 17 bp, Homo sapiens
attcctgatcttcccac

SEQ ID NO: 1751806 - DNA, 15 bp, Homo sapiens
attcctgcctgtctc

SEQ ID NO: 1751807 - DNA, 21 bp, Homo sapiens
attcctgcctttaagccaaag

SEQ ID NO: 1751808 - DNA, 14 bp, Homo sapiens
attcctggacatca

SEQ ID NO: 1751809 - DNA, 15 bp, Homo sapiens
attcctggacatcac

SEQ ID NO: 1751810 - DNA, 20 bp, Homo sapiens
attcctggacatcaccagtc

SEQ ID NO: 1751811 - DNA, 12 bp, Homo sapiens
attcctggactt

SEQ ID NO: 1751812 - DNA, 12 bp, Homo sapiens
attcctggcccc

SEQ ID NO: 1751813 - DNA, 22 bp, Homo sapiens
attcctggctctaccctgtctg

SEQ ID NO: 1751814 - DNA, 11 bp, Homo sapiens
attcctgggcc

SEQ ID NO: 1751815 - DNA, 16 bp, Homo sapiens
attcctgggcctgtcc

SEQ ID NO: 1751816 - DNA, 17 bp, Homo sapiens
attcctgggcctgtccc

SEQ ID NO: 1751817 - DNA, 20 bp, Homo sapiens
attcctggtacccagccatc

SEQ ID NO: 1751818 - DNA, 19 bp, Homo sapiens
attcctggtttgactcagt

SEQ ID NO: 1751819 - DNA, 23 bp, Homo sapiens
attcctggtttgactcagttcca

SEQ ID NO: 1751820 - DNA, 21 bp, Homo sapiens
attcctgtactgtgtctcatg

SEQ ID NO: 1751821 - DNA, 13 bp, Homo sapiens
attcctgtatgtt

SEQ ID NO: 1751822 - DNA, 13 bp, Homo sapiens
attcctgtgccct

SEQ ID NO: 1751823 - DNA, 19 bp, Homo sapiens
attcctgtgttcaatattt

SEQ ID NO: 1751824 - DNA, 13 bp, Homo sapiens
attcctgttgacc

SEQ ID NO: 1751825 - DNA, 19 bp, Homo sapiens
attcctgttgatgggaaaa

SEQ ID NO: 1751826 - DNA, 21 bp, Homo sapiens
attcctgttgatgggaaaagc

SEQ ID NO: 1751827 - DNA, 18 bp, Homo sapiens
attcctgttgctgtcttc

SEQ ID NO: 1751828 - DNA, 17 bp, Homo sapiens
attccttcgaaaggcct

SEQ ID NO: 1751829 - DNA, 22 bp, Homo sapiens
attccttcgaaaggccttcaga

SEQ ID NO: 1751830 - DNA, 21 bp, Homo sapiens
attccttgtcaccagcaacat

SEQ ID NO: 1751831 - DNA, 16 bp, Homo sapiens
attcctttgtcttcaa

SEQ ID NO: 1751832 - DNA, 23 bp, Homo sapiens
attcctttgtcttcaaactgtga

SEQ ID NO: 1751833 - DNA, 18 bp, Homo sapiens
attcctttgtgtttctat

SEQ ID NO: 1751834 - DNA, 22 bp, Homo sapiens
attccttttgatggggagaaag

SEQ ID NO: 1751835 - DNA, 16 bp, Homo sapiens
attcgaagtcagctaa

SEQ ID NO: 1751836 - DNA, 19 bp, Homo sapiens
attcgaagtcagctaattg

SEQ ID NO: 1751837 - DNA, 19 bp, Homo sapiens
attcgatctcattcagtat

SEQ ID NO: 1751838 - DNA, 21 bp, Homo sapiens
attcgctgaaatacttaatgt

SEQ ID NO: 1751839 - DNA, 22 bp, Homo sapiens
attcggccttggtgaacacaca

SEQ ID NO: 1751840 - DNA, 18 bp, Homo sapiens
attcggggtgatcctgtt

SEQ ID NO: 1751841 - DNA, 21 bp, Homo sapiens
attcggtatccccccatcttg

SEQ ID NO: 1751842 - DNA, 14 bp, Homo sapiens
attcggtgtgctgc

SEQ ID NO: 1751843 - DNA, 19 bp, Homo sapiens
attcggtgtgctgccaact

SEQ ID NO: 1751844 - DNA, 19 bp, Homo sapiens
attcgtctgtcccagagct

SEQ ID NO: 1751845 - DNA, 17 bp, Homo sapiens
attcgtggcatgttttg

SEQ ID NO: 1751846 - DNA, 18 bp, Homo sapiens
attcgtggcatgttttga

SEQ ID NO: 1751847 - DNA, 23 bp, Homo sapiens
attcgtggtgatcaattaaatgt

SEQ ID NO: 1751848 - DNA, 20 bp, Homo sapiens
attcgttgtgttttttaaga

SEQ ID NO: 1751849 - DNA, 22 bp, Homo sapiens
attcgttgtgttttttaagata

SEQ ID NO: 1751850 - DNA, 16 bp, Homo sapiens
attctaaaacattctt

SEQ ID NO: 1751851 - DNA, 18 bp, Homo sapiens
attctaaaacattcttta

SEQ ID NO: 1751852 - DNA, 14 bp, Homo sapiens
attctaaaaccatt

SEQ ID NO: 1751853 - DNA, 17 bp, Homo sapiens
attctaaacagactcat

SEQ ID NO: 1751854 - DNA, 13 bp, Homo sapiens
attctaaagagag

SEQ ID NO: 1751855 - DNA, 22 bp, Homo sapiens
attctaaagattctatagttct

SEQ ID NO: 1751856 - DNA, 14 bp, Homo sapiens
attctaaagctcaa

SEQ ID NO: 1751857 - DNA, 14 bp, Homo sapiens
attctaaaggtcca

SEQ ID NO: 1751858 - DNA, 23 bp, Homo sapiens
attctaaatccgacttgaatatt

SEQ ID NO: 1751859 - DNA, 14 bp, Homo sapiens
attctaaattttat

SEQ ID NO: 1751860 - DNA, 14 bp, Homo sapiens
attctaagatttgg

SEQ ID NO: 1751861 - DNA, 15 bp, Homo sapiens
attctaagtgaaatt

SEQ ID NO: 1751862 - DNA, 17 bp, Homo sapiens
attctaagttatttact

SEQ ID NO: 1751863 - DNA, 18 bp, Homo sapiens
attctaagttatttactt

SEQ ID NO: 1751864 - DNA, 20 bp, Homo sapiens
attctaagttatttactttt

SEQ ID NO: 1751865 - DNA, 22 bp, Homo sapiens
attctacagtttcttactgttt

SEQ ID NO: 1751866 - DNA, 14 bp, Homo sapiens
attctactcttgtc

SEQ ID NO: 1751867 - DNA, 17 bp, Homo sapiens
attctactcttgtcatt

SEQ ID NO: 1751868 - DNA, 22 bp, Homo sapiens
attctactcttgtcatttttaa

SEQ ID NO: 1751869 - DNA, 20 bp, Homo sapiens
attctactggaaaaaaatac

SEQ ID NO: 1751870 - DNA, 22 bp, Homo sapiens
attctagatcagatgctccaag

SEQ ID NO: 1751871 - DNA, 23 bp, Homo sapiens
attctagatcagatgctccaaga

SEQ ID NO: 1751872 - DNA, 17 bp, Homo sapiens
attctagatcctgcacc

SEQ ID NO: 1751873 - DNA, 14 bp, Homo sapiens
attctagcagggaa

SEQ ID NO: 1751874 - DNA, 19 bp, Homo sapiens
attctagctgtatgatttg

SEQ ID NO: 1751875 - DNA, 16 bp, Homo sapiens
attctaggcatcccag

SEQ ID NO: 1751876 - DNA, 16 bp, Homo sapiens
attctaggtgtttcaa

SEQ ID NO: 1751877 - DNA, 19 bp, Homo sapiens
attgataaccttgaaaaaa

SEQ ID NO: 1751878 - DNA, 15 bp, Homo sapiens
attgataagttcata

SEQ ID NO: 1751879 - DNA, 22 bp, Homo sapiens
attgataagttcatacattgta

SEQ ID NO: 1751880 - DNA, 18 bp, Homo sapiens
attgataatgctttcaca

SEQ ID NO: 1751881 - DNA, 16 bp, Homo sapiens
attgataattcaacat

SEQ ID NO: 1751882 - DNA, 13 bp, Homo sapiens
attgatacttcag

SEQ ID NO: 1751883 - DNA, 16 bp, Homo sapiens
attgatacttcaggtg

SEQ ID NO: 1751884 - DNA, 22 bp, Homo sapiens
attgatattatattaaacatac

SEQ ID NO: 1751885 - DNA, 20 bp, Homo sapiens
attgatatttttatacaagt

SEQ ID NO: 1751886 - DNA, 21 bp, Homo sapiens
attgatcattttccccccact

SEQ ID NO: 1751887 - DNA, 13 bp, Homo sapiens
attgatcttaaac

SEQ ID NO: 1751888 - DNA, 18 bp, Homo sapiens
attgatgcaatataagca

SEQ ID NO: 1751889 - DNA, 15 bp, Homo sapiens
attgatggatgtctt

SEQ ID NO: 1751890 - DNA, 14 bp, Homo sapiens
attgatggggacat

SEQ ID NO: 1751891 - DNA, 22 bp, Homo sapiens
attgatgtaaggactgtaaaca

SEQ ID NO: 1751892 - DNA, 22 bp, Homo sapiens
attgatgtacagtctgtcatga

SEQ ID NO: 1751893 - DNA, 14 bp, Homo sapiens
attgatgtatatgt

SEQ ID NO: 1751894 - DNA, 12 bp, Homo sapiens
attgatgtgttt

SEQ ID NO: 1751895 - DNA, 16 bp, Homo sapiens
attgattcagtcttct

SEQ ID NO: 1751896 - DNA, 22 bp, Homo sapiens
attgattccttttttcaaaatc

SEQ ID NO: 1751897 - DNA, 14 bp, Homo sapiens
attgattgggaaaa

SEQ ID NO: 1751898 - DNA, 19 bp, Homo sapiens
attgattgggaaaacattt

SEQ ID NO: 1751899 - DNA, 16 bp, Homo sapiens
attgattgtattgttg

SEQ ID NO: 1751900 - DNA, 14 bp, Homo sapiens
attgatttgattgg

SEQ ID NO: 1751901 - DNA, 19 bp, Homo sapiens
attgattttaaaatgtaca

SEQ ID NO: 1751902 - DNA, 23 bp, Homo sapiens
attgcaaaggttccaactgtata

SEQ ID NO: 1751903 - DNA, 10 bp, Homo sapiens
attgcaaagt

SEQ ID NO: 1751904 - DNA, 21 bp, Homo sapiens
attgcaacaaaatacattctt

SEQ ID NO: 1751905 - DNA, 11 bp, Homo sapiens
attgcacaata

SEQ ID NO: 1751906 - DNA, 23 bp, Homo sapiens
attgcaccatactccttgcttcc

SEQ ID NO: 1751907 - DNA, 15 bp, Homo sapiens
attgcacctgcaggc

SEQ ID NO: 1751908 - DNA, 17 bp, Homo sapiens
attgcacctgcaggctt

SEQ ID NO: 1751909 - DNA, 15 bp, Homo sapiens
attgcacgtggcctc

SEQ ID NO: 1751910 - DNA, 23 bp, Homo sapiens
attgcacgtggcctcttgagcag

SEQ ID NO: 1751911 - DNA, 15 bp, Homo sapiens
attgcactccagcct

SEQ ID NO: 1751912 - DNA, 16 bp, Homo sapiens
attgcactccagcctg

SEQ ID NO: 1751913 - DNA, 19 bp, Homo sapiens
attgcactccagcctgggc

SEQ ID NO: 1751914 - DNA, 18 bp, Homo sapiens
attgcactctagcctggc

SEQ ID NO: 1751915 - DNA, 23 bp, Homo sapiens
attgcaggagtccctgccatcat

SEQ ID NO: 1751916 - DNA, 14 bp, Homo sapiens
attgcaggatggtg

SEQ ID NO: 1751917 - DNA, 17 bp, Homo sapiens
attgcagttagccccag

SEQ ID NO: 1751918 - DNA, 21 bp, Homo sapiens
attgcagttcaaatcctcacc

SEQ ID NO: 1751919 - DNA, 14 bp, Homo sapiens
attgcattgctggt

SEQ ID NO: 1751920 - DNA, 14 bp, Homo sapiens
attgcatttctgct

SEQ ID NO: 1751921 - DNA, 12 bp, Homo sapiens
attgccatgtgg

SEQ ID NO: 1751922 - DNA, 18 bp, Homo sapiens
attgccccatctagacta

SEQ ID NO: 1751923 - DNA, 12 bp, Homo sapiens
attgccccctct

SEQ ID NO: 1751924 - DNA, 16 bp, Homo sapiens
attgccccctctcact

SEQ ID NO: 1751925 - DNA, 14 bp, Homo sapiens
attgcccctggctt

SEQ ID NO: 1751926 - DNA, 19 bp, Homo sapiens
attgcccctggctttgcct

SEQ ID NO: 1751927 - DNA, 21 bp, Homo sapiens
attgcccctggctttgcctct

SEQ ID NO: 1751928 - DNA, 22 bp, Homo sapiens
attgcccctggctttgcctctt

SEQ ID NO: 1751929 - DNA, 20 bp, Homo sapiens
attgcctacaataaaaagaa

SEQ ID NO: 1751930 - DNA, 12 bp, Homo sapiens
attgcctcctgt

SEQ ID NO: 1751931 - DNA, 19 bp, Homo sapiens
attgcctgtaacaatgtaa

SEQ ID NO: 1751932 - DNA, 20 bp, Homo sapiens
attgcctgtaacaatgtaat

SEQ ID NO: 1751933 - DNA, 14 bp, Homo sapiens
attgcctgttctgc

SEQ ID NO: 1751934 - DNA, 15 bp, Homo sapiens
attgcctgttctgct

SEQ ID NO: 1751935 - DNA, 16 bp, Homo sapiens
attgcctgttctgctt

SEQ ID NO: 1751936 - DNA, 15 bp, Homo sapiens
attgcctgtttctga

SEQ ID NO: 1751937 - DNA, 21 bp, Homo sapiens
attgcctgtttctgatttgct

SEQ ID NO: 1751938 - DNA, 18 bp, Homo sapiens
attgccttaactggagcc

SEQ ID NO: 1751939 - DNA, 18 bp, Homo sapiens
attgccttctctgcccac

SEQ ID NO: 1751940 - DNA, 21 bp, Homo sapiens
attgctaaaaaataaataaaa

SEQ ID NO: 1751941 - DNA, 18 bp, Homo sapiens
attgctaaccactgtctg

SEQ ID NO: 1751942 - DNA, 14 bp, Homo sapiens
attgctaattgtgt

SEQ ID NO: 1751943 - DNA, 16 bp, Homo sapiens
attgctaatttagaga

SEQ ID NO: 1751944 - DNA, 17 bp, Homo sapiens
attgctaccacagactt

SEQ ID NO: 1751945 - DNA, 21 bp, Homo sapiens
attgctatcgccctcctttcc

SEQ ID NO: 1751946 - DNA, 22 bp, Homo sapiens
attgctatctggaggccttcca

SEQ ID NO: 1751947 - DNA, 18 bp, Homo sapiens
attgctatcttttctgga

SEQ ID NO: 1751948 - DNA, 14 bp, Homo sapiens
attgctccagagca

SEQ ID NO: 1751949 - DNA, 23 bp, Homo sapiens
attgctcgcccagacaccatgtg

SEQ ID NO: 1751950 - DNA, 14 bp, Homo sapiens
attgctctctgggc

SEQ ID NO: 1751951 - DNA, 17 bp, Homo sapiens
attgctgagaagcaaac

SEQ ID NO: 1751952 - DNA, 16 bp, Homo sapiens
attgctgagcctctgc

SEQ ID NO: 1751953 - DNA, 23 bp, Homo sapiens
attgctgagcctctgctccccag

SEQ ID NO: 1751954 - DNA, 14 bp, Homo sapiens
attgctgccacttt

SEQ ID NO: 1751955 - DNA, 13 bp, Homo sapiens
attgctgctgccc

SEQ ID NO: 1751956 - DNA, 15 bp, Homo sapiens
attgctgctgctacc

SEQ ID NO: 1751957 - DNA, 13 bp, Homo sapiens
attgctgcttgga

SEQ ID NO: 1751958 - DNA, 14 bp, Homo sapiens
attgctgcttggat

SEQ ID NO: 1751959 - DNA, 16 bp, Homo sapiens
attgctggtgcaaaga

SEQ ID NO: 1751960 - DNA, 15 bp, Homo sapiens
attgctgtgtctcct

SEQ ID NO: 1751961 - DNA, 22 bp, Homo sapiens
attgcttacatttttacaataa

SEQ ID NO: 1751962 - DNA, 19 bp, Homo sapiens
attgcttattatgtaggta

SEQ ID NO: 1751963 - DNA, 19 bp, Homo sapiens
attgcttcctcctccccaa

SEQ ID NO: 1751964 - DNA, 17 bp, Homo sapiens
attgcttctaaaacaat

SEQ ID NO: 1751965 - DNA, 18 bp, Homo sapiens
attgcttgagcccaggag

SEQ ID NO: 1751966 - DNA, 14 bp, Homo sapiens
attgctttccactg

SEQ ID NO: 1751967 - DNA, 18 bp, Homo sapiens
attgctttcgtgtaaatt

SEQ ID NO: 1751968 - DNA, 14 bp, Homo sapiens
attgctttgccaaa

SEQ ID NO: 1751969 - DNA, 15 bp, Homo sapiens
attgctttgccaaaa

SEQ ID NO: 1751970 - DNA, 11 bp, Homo sapiens
attgcttttgt

SEQ ID NO: 1751971 - DNA, 21 bp, Homo sapiens
attgcttttgttgtgactttt

SEQ ID NO: 1751972 - DNA, 22 bp, Homo sapiens
attggaaatgtgaatcgcagct

SEQ ID NO: 1751973 - DNA, 16 bp, Homo sapiens
attggaagaccccacc

SEQ ID NO: 1751974 - DNA, 21 bp, Homo sapiens
attggaagctttgagttgact

SEQ ID NO: 1751975 - DNA, 14 bp, Homo sapiens
attggaatctgata

SEQ ID NO: 1751976 - DNA, 15 bp, Homo sapiens
attggaatcttcacc

SEQ ID NO: 1751977 - DNA, 20 bp, Homo sapiens
attggaatcttcacctcaga

SEQ ID NO: 1751978 - DNA, 22 bp, Homo sapiens
attggaatcttcacctcagagt

SEQ ID NO: 1751979 - DNA, 21 bp, Homo sapiens
attggaatggaactactgtac

SEQ ID NO: 1751980 - DNA, 15 bp, Homo sapiens
attggaattataaat

SEQ ID NO: 1751981 - DNA, 17 bp, Homo sapiens
attggacattttcttca

SEQ ID NO: 1751982 - DNA, 13 bp, Homo sapiens
attggaccaggcc

SEQ ID NO: 1751983 - DNA, 21 bp, Homo sapiens
attggagttggagtagaatgt

SEQ ID NO: 1751984 - DNA, 11 bp, Homo sapiens
attggatattt

SEQ ID NO: 1751985 - DNA, 22 bp, Homo sapiens
attggatattttttactttaga

SEQ ID NO: 1751986 - DNA, 14 bp, Homo sapiens
attggatttcctaa

SEQ ID NO: 1751987 - DNA, 23 bp, Homo sapiens
attggatttcctaatactgtcat

SEQ ID NO: 1751988 - DNA, 15 bp, Homo sapiens
attggcaccatgtgc

SEQ ID NO: 1751989 - DNA, 20 bp, Homo sapiens
attggcacctaatccaggca

SEQ ID NO: 1751990 - DNA, 17 bp, Homo sapiens
attggcaggataagaaa

SEQ ID NO: 1751991 - DNA, 13 bp, Homo sapiens
attggccactggg

SEQ ID NO: 1751992 - DNA, 18 bp, Homo sapiens
atttaagcaaacgtctat

SEQ ID NO: 1751993 - DNA, 16 bp, Homo sapiens
atttaagccttacaaa

SEQ ID NO: 1751994 - DNA, 20 bp, Homo sapiens
atttaagccttacaaaggga

SEQ ID NO: 1751995 - DNA, 14 bp, Homo sapiens
atttaaggatggat

SEQ ID NO: 1751996 - DNA, 19 bp, Homo sapiens
atttaaggatggatggcac

SEQ ID NO: 1751997 - DNA, 20 bp, Homo sapiens
atttaaggatggatggcacc

SEQ ID NO: 1751998 - DNA, 22 bp, Homo sapiens
atttaaggtctgtttgctgttg

SEQ ID NO: 1751999 - DNA, 13 bp, Homo sapiens
atttaagtatata

SEQ ID NO: 1752000 - DNA, 14 bp, Homo sapiens
atttaagtatatag

SEQ ID NO: 1752001 - DNA, 23 bp, Homo sapiens
atttaagtatatagtatatttat

SEQ ID NO: 1752002 - DNA, 15 bp, Homo sapiens
atttaagtatcttgt

SEQ ID NO: 1752003 - DNA, 16 bp, Homo sapiens
atttaagtatcttgtg

SEQ ID NO: 1752004 - DNA, 13 bp, Homo sapiens
atttaagtgacac

SEQ ID NO: 1752005 - DNA, 14 bp, Homo sapiens
atttaagtgacaca

SEQ ID NO: 1752006 - DNA, 16 bp, Homo sapiens
atttaagtgacacaga

SEQ ID NO: 1752007 - DNA, 18 bp, Homo sapiens
atttaagtgacacagaca

SEQ ID NO: 1752008 - DNA, 16 bp, Homo sapiens
atttaagtgtatttaa

SEQ ID NO: 1752009 - DNA, 19 bp, Homo sapiens
atttaagttcatattccat

SEQ ID NO: 1752010 - DNA, 16 bp, Homo sapiens
atttaataaaaaggaa

SEQ ID NO: 1752011 - DNA, 15 bp, Homo sapiens
atttaataaaactgc

SEQ ID NO: 1752012 - DNA, 15 bp, Homo sapiens
atttaataatgcttt

SEQ ID NO: 1752013 - DNA, 16 bp, Homo sapiens
atttaatagctgtgat

SEQ ID NO: 1752014 - DNA, 17 bp, Homo sapiens
atttaatatcaaaagaa

SEQ ID NO: 1752015 - DNA, 20 bp, Homo sapiens
atttaatatctggcactgtt

SEQ ID NO: 1752016 - DNA, 23 bp, Homo sapiens
atttaatatctggcactgttaat

SEQ ID NO: 1752017 - DNA, 20 bp, Homo sapiens
atttaatccagttataagaa

SEQ ID NO: 1752018 - DNA, 23 bp, Homo sapiens
atttaatccagttataagaagaa

SEQ ID NO: 1752019 - DNA, 21 bp, Homo sapiens
atttaatgaaagactgtacaa

SEQ ID NO: 1752020 - DNA, 22 bp, Homo sapiens
atttaatgataagtaaatgcta

SEQ ID NO: 1752021 - DNA, 14 bp, Homo sapiens
atttaatgttgaac

SEQ ID NO: 1752022 - DNA, 12 bp, Homo sapiens
atttaatgtttt

SEQ ID NO: 1752023 - DNA, 18 bp, Homo sapiens
atttaattcttcaccttt

SEQ ID NO: 1752024 - DNA, 22 bp, Homo sapiens
atttaattcttcacctttgtaa

SEQ ID NO: 1752025 - DNA, 18 bp, Homo sapiens
atttaattttgacactat

SEQ ID NO: 1752026 - DNA, 19 bp, Homo sapiens
atttacaagagctgttcat

SEQ ID NO: 1752027 - DNA, 18 bp, Homo sapiens
atttacaagatattatta

SEQ ID NO: 1752028 - DNA, 20 bp, Homo sapiens
atttacaagatattattaat

SEQ ID NO: 1752029 - DNA, 19 bp, Homo sapiens
atttacaataaatattctg

SEQ ID NO: 1752030 - DNA, 12 bp, Homo sapiens
atttacactggt

SEQ ID NO: 1752031 - DNA, 17 bp, Homo sapiens
atttacagttactgcct

SEQ ID NO: 1752032 - DNA, 18 bp, Homo sapiens
atttacagttactgccta

SEQ ID NO: 1752033 - DNA, 18 bp, Homo sapiens
atttacatgaattgcatt

SEQ ID NO: 1752034 - DNA, 18 bp, Homo sapiens
atttacatgctactaaat

SEQ ID NO: 1752035 - DNA, 20 bp, Homo sapiens
atttacatgctactaaattt

SEQ ID NO: 1752036 - DNA, 21 bp, Homo sapiens
atttacatgctactaaatttt

SEQ ID NO: 1752037 - DNA, 19 bp, Homo sapiens
atttacatgtattatttca

SEQ ID NO: 1752038 - DNA, 14 bp, Homo sapiens
atttacattttata

SEQ ID NO: 1752039 - DNA, 18 bp, Homo sapiens
atttaccatcatctctga

SEQ ID NO: 1752040 - DNA, 23 bp, Homo sapiens
atttacccttttcccccttccca

SEQ ID NO: 1752041 - DNA, 20 bp, Homo sapiens
atttactgagcttctctgtg

SEQ ID NO: 1752042 - DNA, 19 bp, Homo sapiens
atttactgttagaattctt

SEQ ID NO: 1752043 - DNA, 16 bp, Homo sapiens
atttacttcttataca

SEQ ID NO: 1752044 - DNA, 16 bp, Homo sapiens
atttacttgttttgga

SEQ ID NO: 1752045 - DNA, 18 bp, Homo sapiens
atttactttcttcaccaa

SEQ ID NO: 1752046 - DNA, 12 bp, Homo sapiens
atttacttttaa

SEQ ID NO: 1752047 - DNA, 22 bp, Homo sapiens
atttagaaaatagagcttttaa

SEQ ID NO: 1752048 - DNA, 22 bp, Homo sapiens
atttagaaagaagcccaatatt

SEQ ID NO: 1752049 - DNA, 14 bp, Homo sapiens
atttagaagaaaga

SEQ ID NO: 1752050 - DNA, 13 bp, Homo sapiens
atttagaagccaa

SEQ ID NO: 1752051 - DNA, 18 bp, Homo sapiens
atttagacaacctgaaat

SEQ ID NO: 1752052 - DNA, 23 bp, Homo sapiens
atttagacaacctgaaatttatt

SEQ ID NO: 1752053 - DNA, 16 bp, Homo sapiens
atttagacaagagatg

SEQ ID NO: 1752054 - DNA, 18 bp, Homo sapiens
atttagaccttttccctg

SEQ ID NO: 1752055 - DNA, 23 bp, Homo sapiens
atttagagatgaattaaatttaa

SEQ ID NO: 1752056 - DNA, 17 bp, Homo sapiens
atttagattgaaaactt

SEQ ID NO: 1752057 - DNA, 19 bp, Homo sapiens
atttagctacagcttgttt

SEQ ID NO: 1752058 - DNA, 14 bp, Homo sapiens
atttagctatttat

SEQ ID NO: 1752059 - DNA, 22 bp, Homo sapiens
atttaggccttaacacactggc

SEQ ID NO: 1752060 - DNA, 19 bp, Homo sapiens
atttagggccttttctgtg

SEQ ID NO: 1752061 - DNA, 20 bp, Homo sapiens
atttagggccttttctgtgc

SEQ ID NO: 1752062 - DNA, 20 bp, Homo sapiens
atttaggggaaaaaaaagtt

SEQ ID NO: 1752063 - DNA, 23 bp, Homo sapiens
atttaggtttttgtttgtttcct

SEQ ID NO: 1752064 - DNA, 19 bp, Homo sapiens
atttagtaacttctgtgtt

SEQ ID NO: 1752065 - DNA, 23 bp, Homo sapiens
atttagtctagacacaatttcat

SEQ ID NO: 1752066 - DNA, 21 bp, Homo sapiens
atttagtgatcaaattgtgca

SEQ ID NO: 1752067 - DNA, 12 bp, Homo sapiens
atttagttcttt

SEQ ID NO: 1752068 - DNA, 18 bp, Homo sapiens
atttagttgaaaaatcta

SEQ ID NO: 1752069 - DNA, 23 bp, Homo sapiens
atttagttgcagtccagctcttt

SEQ ID NO: 1752070 - DNA, 15 bp, Homo sapiens
atttataaacagaca

SEQ ID NO: 1752071 - DNA, 21 bp, Homo sapiens
atttataaagctaaaataacc

SEQ ID NO: 1752072 - DNA, 16 bp, Homo sapiens
atttataactcatcat

SEQ ID NO: 1752073 - DNA, 19 bp, Homo sapiens
atttataactcatcataaa

SEQ ID NO: 1752074 - DNA, 17 bp, Homo sapiens
atttataagcagattta

SEQ ID NO: 1752075 - DNA, 22 bp, Homo sapiens
atttataagcagatttaacaat

SEQ ID NO: 1752076 - DNA, 15 bp, Homo sapiens
atttataatacagaa

SEQ ID NO: 1752077 - DNA, 14 bp, Homo sapiens
atttataatgttag

SEQ ID NO: 1752078 - DNA, 22 bp, Homo sapiens
atttatacaagattgaaaatct

SEQ ID NO: 1752079 - DNA, 18 bp, Homo sapiens
atttatatatatatgtat

SEQ ID NO: 1752080 - DNA, 20 bp, Homo sapiens
atttatatatatatgtatat

SEQ ID NO: 1752081 - DNA, 14 bp, Homo sapiens
atttatatatgtat

SEQ ID NO: 1752082 - DNA, 18 bp, Homo sapiens
atttatatatttataact

SEQ ID NO: 1752083 - DNA, 20 bp, Homo sapiens
atttatatatttataactca

SEQ ID NO: 1752084 - DNA, 19 bp, Homo sapiens
atttatatggggaatatat

SEQ ID NO: 1752085 - DNA, 15 bp, Homo sapiens
atttatatgtactgt

SEQ ID NO: 1752086 - DNA, 17 bp, Homo sapiens
atttatatgtactgttt

SEQ ID NO: 1752087 - DNA, 12 bp, Homo sapiens
atttatatttgg

SEQ ID NO: 1752088 - DNA, 16 bp, Homo sapiens
atttatatttggaaag

SEQ ID NO: 1752089 - DNA, 17 bp, Homo sapiens
atttatatttggaaaga

SEQ ID NO: 1752090 - DNA, 13 bp, Homo sapiens
atttatatttttg

SEQ ID NO: 1752091 - DNA, 12 bp, Homo sapiens
atttatcaaatc

SEQ ID NO: 1752092 - DNA, 20 bp, Homo sapiens
atttatccagaaaactgtga

SEQ ID NO: 1752093 - DNA, 22 bp, Homo sapiens
atttatccagaaaactgtgatt

SEQ ID NO: 1752094 - DNA, 23 bp, Homo sapiens
atttatctcctcttcatggcatc

SEQ ID NO: 1752095 - DNA, 20 bp, Homo sapiens
atttatctgggattatggtt

SEQ ID NO: 1752096 - DNA, 16 bp, Homo sapiens
atttatctgtgcaaat

SEQ ID NO: 1752097 - DNA, 23 bp, Homo sapiens
atttatcttatctagcaagaaga

SEQ ID NO: 1752098 - DNA, 23 bp, Homo sapiens
atttatcttgaaggaaaaattca

SEQ ID NO: 1752099 - DNA, 14 bp, Homo sapiens
atttatctttacca

SEQ ID NO: 1752100 - DNA, 17 bp, Homo sapiens
atttatctttaccaaaa

SEQ ID NO: 1752101 - DNA, 23 bp, Homo sapiens
atttatctttaccaaaaaccatg

SEQ ID NO: 1752102 - DNA, 14 bp, Homo sapiens
atttatctttgata

SEQ ID NO: 1752103 - DNA, 18 bp, Homo sapiens
atttatgaaaaaatatga

SEQ ID NO: 1752104 - DNA, 13 bp, Homo sapiens
atttatgaaaaga

SEQ ID NO: 1752105 - DNA, 16 bp, Homo sapiens
atttatgaagaaaata

SEQ ID NO: 1752106 - DNA, 13 bp, Homo sapiens
atttcttgctttc

SEQ ID NO: 1752107 - DNA, 23 bp, Homo sapiens
atttcttggcaaattttaaaaca

SEQ ID NO: 1752108 - DNA, 19 bp, Homo sapiens
atttcttggcattggaatt

SEQ ID NO: 1752109 - DNA, 16 bp, Homo sapiens
atttcttggtattatt

SEQ ID NO: 1752110 - DNA, 23 bp, Homo sapiens
atttcttggtattattctgtttt

SEQ ID NO: 1752111 - DNA, 21 bp, Homo sapiens
atttctttctttgcaccaaag

SEQ ID NO: 1752112 - DNA, 23 bp, Homo sapiens
atttctttctttgcaccaaagac

SEQ ID NO: 1752113 - DNA, 15 bp, Homo sapiens
atttctttgattgtg

SEQ ID NO: 1752114 - DNA, 23 bp, Homo sapiens
atttctttttgggagagacttgt

SEQ ID NO: 1752115 - DNA, 15 bp, Homo sapiens
atttgaaaaatataa

SEQ ID NO: 1752116 - DNA, 15 bp, Homo sapiens
atttgaaataagaat

SEQ ID NO: 1752117 - DNA, 16 bp, Homo sapiens
atttgaaataagaatt

SEQ ID NO: 1752118 - DNA, 21 bp, Homo sapiens
atttgaaatagtatacattgt

SEQ ID NO: 1752119 - DNA, 15 bp, Homo sapiens
atttgaaatttagct

SEQ ID NO: 1752120 - DNA, 16 bp, Homo sapiens
atttgaacctggatcc

SEQ ID NO: 1752121 - DNA, 13 bp, Homo sapiens
atttgaaggccag

SEQ ID NO: 1752122 - DNA, 22 bp, Homo sapiens
atttgaagtaacttatttgact

SEQ ID NO: 1752123 - DNA, 18 bp, Homo sapiens
atttgaatgggtccattt

SEQ ID NO: 1752124 - DNA, 19 bp, Homo sapiens
atttgaatgttaagcagat

SEQ ID NO: 1752125 - DNA, 23 bp, Homo sapiens
atttgaattatcagcaaagaaaa

SEQ ID NO: 1752126 - DNA, 20 bp, Homo sapiens
atttgaattttaaatctaaa

SEQ ID NO: 1752127 - DNA, 13 bp, Homo sapiens
atttgacccccac

SEQ ID NO: 1752128 - DNA, 18 bp, Homo sapiens
atttgacctaatcactaa

SEQ ID NO: 1752129 - DNA, 12 bp, Homo sapiens
atttgactaatt

SEQ ID NO: 1752130 - DNA, 15 bp, Homo sapiens
atttgactaatttta

SEQ ID NO: 1752131 - DNA, 20 bp, Homo sapiens
atttgactatgaatgttatc

SEQ ID NO: 1752132 - DNA, 17 bp, Homo sapiens
atttgactattctgtat

SEQ ID NO: 1752133 - DNA, 22 bp, Homo sapiens
atttgacttgaaaagaaagaaa

SEQ ID NO: 1752134 - DNA, 17 bp, Homo sapiens
atttgagaaatgcatat

SEQ ID NO: 1752135 - DNA, 19 bp, Homo sapiens
atttgagaagttctcagaa

SEQ ID NO: 1752136 - DNA, 16 bp, Homo sapiens
atttgagaatacataa

SEQ ID NO: 1752137 - DNA, 18 bp, Homo sapiens
atttgagaatacataaac

SEQ ID NO: 1752138 - DNA, 18 bp, Homo sapiens
atttgagggcccagccag

SEQ ID NO: 1752139 - DNA, 22 bp, Homo sapiens
atttgaggggaaaacaccataa

SEQ ID NO: 1752140 - DNA, 19 bp, Homo sapiens
atttgagtgttttaagata

SEQ ID NO: 1752141 - DNA, 13 bp, Homo sapiens
atttgatacataa

SEQ ID NO: 1752142 - DNA, 19 bp, Homo sapiens
atttgatacataataaaaa

SEQ ID NO: 1752143 - DNA, 18 bp, Homo sapiens
atttgatatttttccatt

SEQ ID NO: 1752144 - DNA, 23 bp, Homo sapiens
atttgatcgttccagttcccact

SEQ ID NO: 1752145 - DNA, 17 bp, Homo sapiens
atttgatgagttaactg

SEQ ID NO: 1752146 - DNA, 19 bp, Homo sapiens
atttgatgatgttaaatgt

SEQ ID NO: 1752147 - DNA, 14 bp, Homo sapiens
atttgatgctaaat

SEQ ID NO: 1752148 - DNA, 15 bp, Homo sapiens
atttgatgtacatgt

SEQ ID NO: 1752149 - DNA, 18 bp, Homo sapiens
atttgatgtacatgtgta

SEQ ID NO: 1752150 - DNA, 17 bp, Homo sapiens
atttgattaacatttgt

SEQ ID NO: 1752151 - DNA, 20 bp, Homo sapiens
atttgattatgtatggatat

SEQ ID NO: 1752152 - DNA, 21 bp, Homo sapiens
atttgattatgtatggatata

SEQ ID NO: 1752153 - DNA, 22 bp, Homo sapiens
atttgatttttctaaccttgaa

SEQ ID NO: 1752154 - DNA, 18 bp, Homo sapiens
atttgatttttgtctcaa

SEQ ID NO: 1752155 - DNA, 20 bp, Homo sapiens
atttgcaacaggggaggaaa

SEQ ID NO: 1752156 - DNA, 22 bp, Homo sapiens
atttgcaacaggggaggaaaaa

SEQ ID NO: 1752157 - DNA, 23 bp, Homo sapiens
atttgcaacaggggaggaaaaaa

SEQ ID NO: 1752158 - DNA, 15 bp, Homo sapiens
atttgcagagacagg

SEQ ID NO: 1752159 - DNA, 19 bp, Homo sapiens
atttgcagatgttcaaata

SEQ ID NO: 1752160 - DNA, 17 bp, Homo sapiens
atttgcaggattccctt

SEQ ID NO: 1752161 - DNA, 22 bp, Homo sapiens
atttgcaggattcccttctggg

SEQ ID NO: 1752162 - DNA, 23 bp, Homo sapiens
atttgcatatcacccttccctgc

SEQ ID NO: 1752163 - DNA, 17 bp, Homo sapiens
atttgcatatttattgc

SEQ ID NO: 1752164 - DNA, 16 bp, Homo sapiens
atttgcatattttgag

SEQ ID NO: 1752165 - DNA, 22 bp, Homo sapiens
atttgcatattttgagaaactg

SEQ ID NO: 1752166 - DNA, 15 bp, Homo sapiens
atttgcatctgaaat

SEQ ID NO: 1752167 - DNA, 18 bp, Homo sapiens
atttgccaaaaactaaaa

SEQ ID NO: 1752168 - DNA, 20 bp, Homo sapiens
atttgccaataaagcttttg

SEQ ID NO: 1752169 - DNA, 11 bp, Homo sapiens
atttgccagca

SEQ ID NO: 1752170 - DNA, 13 bp, Homo sapiens
atttgccagcaca

SEQ ID NO: 1752171 - DNA, 16 bp, Homo sapiens
atttgccagcacaggg

SEQ ID NO: 1752172 - DNA, 22 bp, Homo sapiens
atttgcgcctcggtatctggct

SEQ ID NO: 1752173 - DNA, 14 bp, Homo sapiens
atttgctaatgtat

SEQ ID NO: 1752174 - DNA, 21 bp, Homo sapiens
atttgctaatgtataatgtgc

SEQ ID NO: 1752175 - DNA, 13 bp, Homo sapiens
atttgctaatttt

SEQ ID NO: 1752176 - DNA, 19 bp, Homo sapiens
atttgctaatttttattaa

SEQ ID NO: 1752177 - DNA, 16 bp, Homo sapiens
atttgctactgttgta

SEQ ID NO: 1752178 - DNA, 15 bp, Homo sapiens
atttgctatctctat

SEQ ID NO: 1752179 - DNA, 20 bp, Homo sapiens
atttgctatgagctggggat

SEQ ID NO: 1752180 - DNA, 14 bp, Homo sapiens
atttgctgaactca

SEQ ID NO: 1752181 - DNA, 21 bp, Homo sapiens
atttgctgacaaccattaaag

SEQ ID NO: 1752182 - DNA, 22 bp, Homo sapiens
atttgctgacaaccattaaagt

SEQ ID NO: 1752183 - DNA, 13 bp, Homo sapiens
atttgctgttgat

SEQ ID NO: 1752184 - DNA, 23 bp, Homo sapiens
atttgctttaatgagaatagaaa

SEQ ID NO: 1752185 - DNA, 18 bp, Homo sapiens
atttgctttaatgagtgc

SEQ ID NO: 1752186 - DNA, 13 bp, Homo sapiens
atttgctttcctc

SEQ ID NO: 1752187 - DNA, 16 bp, Homo sapiens
atttgctttcctctga

SEQ ID NO: 1752188 - DNA, 13 bp, Homo sapiens
atttggaaagaga

SEQ ID NO: 1752189 - DNA, 22 bp, Homo sapiens
atttggaaataaagtcagatgg

SEQ ID NO: 1752190 - DNA, 17 bp, Homo sapiens
atttggaaccttgtttt

SEQ ID NO: 1752191 - DNA, 14 bp, Homo sapiens
atttggaattagaa

SEQ ID NO: 1752192 - DNA, 17 bp, Homo sapiens
atttggagactctgtgg

SEQ ID NO: 1752193 - DNA, 15 bp, Homo sapiens
atttggagagaaata

SEQ ID NO: 1752194 - DNA, 19 bp, Homo sapiens
atttggattattctttctc

SEQ ID NO: 1752195 - DNA, 18 bp, Homo sapiens
atttggatttaaaagcct

SEQ ID NO: 1752196 - DNA, 18 bp, Homo sapiens
atttggcataactgtgat

SEQ ID NO: 1752197 - DNA, 18 bp, Homo sapiens
atttggcattgatcttaa

SEQ ID NO: 1752198 - DNA, 19 bp, Homo sapiens
atttggcctgcactaattt

SEQ ID NO: 1752199 - DNA, 13 bp, Homo sapiens
atttggccttaag

SEQ ID NO: 1752200 - DNA, 17 bp, Homo sapiens
atttggccttaagaact

SEQ ID NO: 1752201 - DNA, 21 bp, Homo sapiens
atttggccttaagaactgtgt

SEQ ID NO: 1752202 - DNA, 16 bp, Homo sapiens
atttggctttcacatt

SEQ ID NO: 1752203 - DNA, 23 bp, Homo sapiens
atttgggaaggtttgtgttttct

SEQ ID NO: 1752204 - DNA, 18 bp, Homo sapiens
atttgggagaagggcaga

SEQ ID NO: 1752205 - DNA, 14 bp, Homo sapiens
atttgggatggaga

SEQ ID NO: 1752206 - DNA, 22 bp, Homo sapiens
atttgggcctgctccagacctg

SEQ ID NO: 1752207 - DNA, 14 bp, Homo sapiens
atttgggctctggt

SEQ ID NO: 1752208 - DNA, 23 bp, Homo sapiens
atttggggtataggtctcatctc

SEQ ID NO: 1752209 - DNA, 12 bp, Homo sapiens
atttggggtgga

SEQ ID NO: 1752210 - DNA, 21 bp, Homo sapiens
atttggtaaaaatgctgctct

SEQ ID NO: 1752211 - DNA, 23 bp, Homo sapiens
atttggtacttttgagtgtgtgt

SEQ ID NO: 1752212 - DNA, 17 bp, Homo sapiens
atttggtccaaaaaaag

SEQ ID NO: 1752213 - DNA, 19 bp, Homo sapiens
atttggtccaaaaaaagga

SEQ ID NO: 1752214 - DNA, 22 bp, Homo sapiens
atttggtccaaaaaaaggaaaa

SEQ ID NO: 1752215 - DNA, 16 bp, Homo sapiens
atttggtgttcctgga

SEQ ID NO: 1752216 - DNA, 21 bp, Homo sapiens
atttggttaagtttttttcct

SEQ ID NO: 1752217 - DNA, 23 bp, Homo sapiens
atttggtttgggatcaataggaa

SEQ ID NO: 1752218 - DNA, 23 bp, Homo sapiens
atttgtaaaaacagcattgcttt

SEQ ID NO: 1752219 - DNA, 11 bp, Homo sapiens
atttttgtaca

SEQ ID NO: 1752220 - DNA, 12 bp, Homo sapiens
atttttgtacat

SEQ ID NO: 1752221 - DNA, 17 bp, Homo sapiens
atttttgtacatattgt

SEQ ID NO: 1752222 - DNA, 13 bp, Homo sapiens
atttttgtacatg

SEQ ID NO: 1752223 - DNA, 13 bp, Homo sapiens
atttttgtacatt

SEQ ID NO: 1752224 - DNA, 18 bp, Homo sapiens
atttttgtagttagacaa

SEQ ID NO: 1752225 - DNA, 23 bp, Homo sapiens
atttttgtatagtgtaaactgaa

SEQ ID NO: 1752226 - DNA, 18 bp, Homo sapiens
atttttgtatttttagga

SEQ ID NO: 1752227 - DNA, 20 bp, Homo sapiens
atttttgtgaaatgaaaaca

SEQ ID NO: 1752228 - DNA, 21 bp, Homo sapiens
atttttgtgaagtattcacaa

SEQ ID NO: 1752229 - DNA, 16 bp, Homo sapiens
atttttgttgttgttg

SEQ ID NO: 1752230 - DNA, 12 bp, Homo sapiens
attttttaaagc

SEQ ID NO: 1752231 - DNA, 18 bp, Homo sapiens
attttttaaatgtaaaat

SEQ ID NO: 1752232 - DNA, 11 bp, Homo sapiens
attttttaagt

SEQ ID NO: 1752233 - DNA, 19 bp, Homo sapiens
attttttaagtatttatat

SEQ ID NO: 1752234 - DNA, 15 bp, Homo sapiens
attttttactacata

SEQ ID NO: 1752235 - DNA, 23 bp, Homo sapiens
attttttactacataattaaatt

SEQ ID NO: 1752236 - DNA, 23 bp, Homo sapiens
attttttacttttcacactgtct

SEQ ID NO: 1752237 - DNA, 18 bp, Homo sapiens
attttttaggacatctta

SEQ ID NO: 1752238 - DNA, 17 bp, Homo sapiens
attttttataaaataca

SEQ ID NO: 1752239 - DNA, 15 bp, Homo sapiens
attttttatactgta

SEQ ID NO: 1752240 - DNA, 13 bp, Homo sapiens
attttttatatat

SEQ ID NO: 1752241 - DNA, 20 bp, Homo sapiens
attttttatatatatgcata

SEQ ID NO: 1752242 - DNA, 16 bp, Homo sapiens
attttttatttacatt

SEQ ID NO: 1752243 - DNA, 13 bp, Homo sapiens
attttttcagaaa

SEQ ID NO: 1752244 - DNA, 22 bp, Homo sapiens
attttttcagaaatatgtggtt

SEQ ID NO: 1752245 - DNA, 21 bp, Homo sapiens
attttttcgtgcactctgcta

SEQ ID NO: 1752246 - DNA, 14 bp, Homo sapiens
attttttctacaca

SEQ ID NO: 1752247 - DNA, 12 bp, Homo sapiens
attttttcttct

SEQ ID NO: 1752248 - DNA, 22 bp, Homo sapiens
attttttgctataatcattagt

SEQ ID NO: 1752249 - DNA, 20 bp, Homo sapiens
attttttggtggtgaaattg

SEQ ID NO: 1752250 - DNA, 16 bp, Homo sapiens
attttttgtataattg

SEQ ID NO: 1752251 - DNA, 14 bp, Homo sapiens
atttttttaaatca

SEQ ID NO: 1752252 - DNA, 18 bp, Homo sapiens
atttttttaaatcaagga

SEQ ID NO: 1752253 - DNA, 19 bp, Homo sapiens
atttttttaactacataaa

SEQ ID NO: 1752254 - DNA, 17 bp, Homo sapiens
atttttttatgctcttg

SEQ ID NO: 1752255 - DNA, 13 bp, Homo sapiens
atttttttctatt

SEQ ID NO: 1752256 - DNA, 23 bp, Homo sapiens
atttttttgcatgcatgcaaatg

SEQ ID NO: 1752257 - DNA, 15 bp, Homo sapiens
atttttttgtaataa

SEQ ID NO: 1752258 - DNA, 19 bp, Homo sapiens
attttttttaaaatagaaa

SEQ ID NO: 1752259 - DNA, 15 bp, Homo sapiens
attttttttaatgta

SEQ ID NO: 1752260 - DNA, 17 bp, Homo sapiens
attttttttatatttat

SEQ ID NO: 1752261 - DNA, 18 bp, Homo sapiens
attttttttggcctgttt

SEQ ID NO: 1752262 - DNA, 23 bp, Homo sapiens
attttttttggcctgtttgatgt

SEQ ID NO: 1752263 - DNA, 14 bp, Homo sapiens
atttttttttcata

SEQ ID NO: 1752264 - DNA, 19 bp, Homo sapiens
atttttttttcatacactt

SEQ ID NO: 1752265 - DNA, 19 bp, Homo sapiens
atttttttttctaagagaa

SEQ ID NO: 1752266 - DNA, 17 bp, Homo sapiens
atttttttttctttata

SEQ ID NO: 1752267 - DNA, 15 bp, Homo sapiens
caaaaaaaaaaagat

SEQ ID NO: 1752268 - DNA, 20 bp, Homo sapiens
caaaaaaaaagttttatttt

SEQ ID NO: 1752269 - DNA, 15 bp, Homo sapiens
caaaaaaagccttta

SEQ ID NO: 1752270 - DNA, 12 bp, Homo sapiens
caaaaaaaggaa

SEQ ID NO: 1752271 - DNA, 13 bp, Homo sapiens
caaaaaaaggaaa

SEQ ID NO: 1752272 - DNA, 20 bp, Homo sapiens
caaaaaaaggaaaaataatc

SEQ ID NO: 1752273 - DNA, 14 bp, Homo sapiens
caaaaaaattaaat

SEQ ID NO: 1752274 - DNA, 15 bp, Homo sapiens
caaaaaactacttct

SEQ ID NO: 1752275 - DNA, 19 bp, Homo sapiens
caaaaaataaattttaaaa

SEQ ID NO: 1752276 - DNA, 23 bp, Homo sapiens
caaaaaatatctagtaatatatt

SEQ ID NO: 1752277 - DNA, 13 bp, Homo sapiens
caaaaaatcatgt

SEQ ID NO: 1752278 - DNA, 19 bp, Homo sapiens
caaaaaatcttaatactgt

SEQ ID NO: 1752279 - DNA, 13 bp, Homo sapiens
caaaaaattagct

SEQ ID NO: 1752280 - DNA, 17 bp, Homo sapiens
caaaaacaaaaccagct

SEQ ID NO: 1752281 - DNA, 19 bp, Homo sapiens
caaaaacaaaaccagctgc

SEQ ID NO: 1752282 - DNA, 20 bp, Homo sapiens
caaaaacaaaaccagctgct

SEQ ID NO: 1752283 - DNA, 12 bp, Homo sapiens
caaaaacaagca

SEQ ID NO: 1752284 - DNA, 19 bp, Homo sapiens
caaaaacaagtaaatatat

SEQ ID NO: 1752285 - DNA, 20 bp, Homo sapiens
caaaaacaagtaaatatata

SEQ ID NO: 1752286 - DNA, 15 bp, Homo sapiens
caaaaacacagcaag

SEQ ID NO: 1752287 - DNA, 17 bp, Homo sapiens
caaaaacacagcaaggg

SEQ ID NO: 1752288 - DNA, 16 bp, Homo sapiens
caaaaacagaatttga

SEQ ID NO: 1752289 - DNA, 18 bp, Homo sapiens
caaaaacagaatttgaga

SEQ ID NO: 1752290 - DNA, 22 bp, Homo sapiens
caaaaacagcctcacagaagaa

SEQ ID NO: 1752291 - DNA, 20 bp, Homo sapiens
caaaaacaggtatatacttt

SEQ ID NO: 1752292 - DNA, 15 bp, Homo sapiens
caaaaacatgtatgt

SEQ ID NO: 1752293 - DNA, 15 bp, Homo sapiens
caaaaaccagcaggt

SEQ ID NO: 1752294 - DNA, 19 bp, Homo sapiens
caaaaaccttggcataaga

SEQ ID NO: 1752295 - DNA, 16 bp, Homo sapiens
caaaaactgtactgtg

SEQ ID NO: 1752296 - DNA, 17 bp, Homo sapiens
caaaaactgtactgtgt

SEQ ID NO: 1752297 - DNA, 22 bp, Homo sapiens
caaaaactgtctttaaaagaga

SEQ ID NO: 1752298 - DNA, 14 bp, Homo sapiens
caaaaagacaaaca

SEQ ID NO: 1752299 - DNA, 21 bp, Homo sapiens
caaaaagcaagggagaaaaga

SEQ ID NO: 1752300 - DNA, 21 bp, Homo sapiens
caaaaagcagagtggactgca

SEQ ID NO: 1752301 - DNA, 21 bp, Homo sapiens
caaaaagctaatgtgcaggga

SEQ ID NO: 1752302 - DNA, 14 bp, Homo sapiens
caaaaagcttctgt

SEQ ID NO: 1752303 - DNA, 22 bp, Homo sapiens
caaaaaggaccaactggcttct

SEQ ID NO: 1752304 - DNA, 18 bp, Homo sapiens
caaaaaggcaaatattga

SEQ ID NO: 1752305 - DNA, 21 bp, Homo sapiens
caaaaaggcaaatattgaagt

SEQ ID NO: 1752306 - DNA, 15 bp, Homo sapiens
caaaaagtattatca

SEQ ID NO: 1752307 - DNA, 15 bp, Homo sapiens
caaaaagtttccata

SEQ ID NO: 1752308 - DNA, 12 bp, Homo sapiens
caaaaataaact

SEQ ID NO: 1752309 - DNA, 22 bp, Homo sapiens
caaaaataaactagtttccagt

SEQ ID NO: 1752310 - DNA, 23 bp, Homo sapiens
caaaaataaactagtttccagtg

SEQ ID NO: 1752311 - DNA, 20 bp, Homo sapiens
caaaaataaccaagtcctcc

SEQ ID NO: 1752312 - DNA, 12 bp, Homo sapiens
caaaaataatag

SEQ ID NO: 1752313 - DNA, 18 bp, Homo sapiens
caaaaatagaaattagat

SEQ ID NO: 1752314 - DNA, 14 bp, Homo sapiens
caaaaatagctggg

SEQ ID NO: 1752315 - DNA, 15 bp, Homo sapiens
caaaaatataactta

SEQ ID NO: 1752316 - DNA, 16 bp, Homo sapiens
caaaaatattttccta

SEQ ID NO: 1752317 - DNA, 19 bp, Homo sapiens
caaaaatcccaccttccca

SEQ ID NO: 1752318 - DNA, 19 bp, Homo sapiens
caaaaatgaaagcatgtct

SEQ ID NO: 1752319 - DNA, 12 bp, Homo sapiens
caaaaatgagtt

SEQ ID NO: 1752320 - DNA, 14 bp, Homo sapiens
caaaaattagccgg

SEQ ID NO: 1752321 - DNA, 15 bp, Homo sapiens
caaaaattagctggg

SEQ ID NO: 1752322 - DNA, 21 bp, Homo sapiens
caaaaatttctgtaaaacagg

SEQ ID NO: 1752323 - DNA, 16 bp, Homo sapiens
caaaacaaaaagatgt

SEQ ID NO: 1752324 - DNA, 14 bp, Homo sapiens
caaaacaaaacaaa

SEQ ID NO: 1752325 - DNA, 19 bp, Homo sapiens
caaaacaaaacaaaacaaa

SEQ ID NO: 1752326 - DNA, 15 bp, Homo sapiens
caaaacaaaacaaac

SEQ ID NO: 1752327 - DNA, 10 bp, Homo sapiens
caaaacaaac

SEQ ID NO: 1752328 - DNA, 14 bp, Homo sapiens
caaaacaaacaaac

SEQ ID NO: 1752329 - DNA, 15 bp, Homo sapiens
caaaacaagccaaag

SEQ ID NO: 1752330 - DNA, 15 bp, Homo sapiens
caaaacactatgtat

SEQ ID NO: 1752331 - DNA, 21 bp, Homo sapiens
caaaacatttctggacagtac

SEQ ID NO: 1752332 - DNA, 16 bp, Homo sapiens
caaaacattttgaagg

SEQ ID NO: 1752333 - DNA, 18 bp, Homo sapiens
caaaacattttgaaggaa

SEQ ID NO: 1752334 - DNA, 21 bp, Homo sapiens
caaagcactgttgagaaggag

SEQ ID NO: 1752335 - DNA, 20 bp, Homo sapiens
caaagcacttttaaaaaaat

SEQ ID NO: 1752336 - DNA, 16 bp, Homo sapiens
caaagcagctttaaaa

SEQ ID NO: 1752337 - DNA, 24 bp, Homo sapiens
caaagcatggacatttagaagaaa

SEQ ID NO: 1752338 - DNA, 18 bp, Homo sapiens
caaagccaaactctgcca

SEQ ID NO: 1752339 - DNA, 22 bp, Homo sapiens
caaagccaacagtcaaaacaga

SEQ ID NO: 1752340 - DNA, 13 bp, Homo sapiens
caaagccactgga

SEQ ID NO: 1752341 - DNA, 17 bp, Homo sapiens
caaagccactggaagga

SEQ ID NO: 1752342 - DNA, 19 bp, Homo sapiens
caaagccactggaaggagc

SEQ ID NO: 1752343 - DNA, 14 bp, Homo sapiens
caaagccagaggag

SEQ ID NO: 1752344 - DNA, 16 bp, Homo sapiens
caaagccagaggagaa

SEQ ID NO: 1752345 - DNA, 21 bp, Homo sapiens
caaagccagaggagaagacaa

SEQ ID NO: 1752346 - DNA, 17 bp, Homo sapiens
caaagccattctccccc

SEQ ID NO: 1752347 - DNA, 16 bp, Homo sapiens
caaagccctgcctctg

SEQ ID NO: 1752348 - DNA, 19 bp, Homo sapiens
caaagccctgcctctgtgt

SEQ ID NO: 1752349 - DNA, 13 bp, Homo sapiens
caaagccctgtcc

SEQ ID NO: 1752350 - DNA, 17 bp, Homo sapiens
caaagccctgtccttca

SEQ ID NO: 1752351 - DNA, 18 bp, Homo sapiens
caaagcctcttcaaaaag

SEQ ID NO: 1752352 - DNA, 22 bp, Homo sapiens
caaagcctcttcaaaaagcaga

SEQ ID NO: 1752353 - DNA, 13 bp, Homo sapiens
caaagcctggcct

SEQ ID NO: 1752354 - DNA, 18 bp, Homo sapiens
caaagcgcccacccaggt

SEQ ID NO: 1752355 - DNA, 16 bp, Homo sapiens
caaagcggggggaggg

SEQ ID NO: 1752356 - DNA, 17 bp, Homo sapiens
caaagcggggggagggt

SEQ ID NO: 1752357 - DNA, 17 bp, Homo sapiens
caaagcggtccctgtcc

SEQ ID NO: 1752358 - DNA, 19 bp, Homo sapiens
caaagcggtccctgtccct

SEQ ID NO: 1752359 - DNA, 16 bp, Homo sapiens
caaagctaggatggtt

SEQ ID NO: 1752360 - DNA, 23 bp, Homo sapiens
caaagctaggatggttctgtgac

SEQ ID NO: 1752361 - DNA, 21 bp, Homo sapiens
caaagctagggtggcccttgc

SEQ ID NO: 1752362 - DNA, 20 bp, Homo sapiens
caaagctcaaataaaaataa

SEQ ID NO: 1752363 - DNA, 23 bp, Homo sapiens
caaagctctattaagatttccaa

SEQ ID NO: 1752364 - DNA, 17 bp, Homo sapiens
caaagctgagcctgcag

SEQ ID NO: 1752365 - DNA, 19 bp, Homo sapiens
caaagctgatgacaacttc

SEQ ID NO: 1752366 - DNA, 11 bp, Homo sapiens
caaagctgcct

SEQ ID NO: 1752367 - DNA, 19 bp, Homo sapiens
caaagcttctatcccagga

SEQ ID NO: 1752368 - DNA, 19 bp, Homo sapiens
caaagcttggagggaagcc

SEQ ID NO: 1752369 - DNA, 21 bp, Homo sapiens
caaagcttggtgtcttggcac

SEQ ID NO: 1752370 - DNA, 16 bp, Homo sapiens
caaagctttcctgccc

SEQ ID NO: 1752371 - DNA, 14 bp, Homo sapiens
caaagctttgctac

SEQ ID NO: 1752372 - DNA, 19 bp, Homo sapiens
caaagctttggctgagacc

SEQ ID NO: 1752373 - DNA, 20 bp, Homo sapiens
caaagcttttgcctgcaaga

SEQ ID NO: 1752374 - DNA, 22 bp, Homo sapiens
caaaggaaaatagtaatgtttt

SEQ ID NO: 1752375 - DNA, 16 bp, Homo sapiens
caaaggaacactgaca

SEQ ID NO: 1752376 - DNA, 11 bp, Homo sapiens
caaaggagaaa

SEQ ID NO: 1752377 - DNA, 14 bp, Homo sapiens
caaaggagaaaaaa

SEQ ID NO: 1752378 - DNA, 18 bp, Homo sapiens
caaaggagaaaaaaaacc

SEQ ID NO: 1752379 - DNA, 19 bp, Homo sapiens
caaaggagaaaaaaaacct

SEQ ID NO: 1752380 - DNA, 17 bp, Homo sapiens
caaaggagctcgaagga

SEQ ID NO: 1752381 - DNA, 16 bp, Homo sapiens
caaaggagctttctca

SEQ ID NO: 1752382 - DNA, 19 bp, Homo sapiens
caaaggcagctaagataga

SEQ ID NO: 1752383 - DNA, 18 bp, Homo sapiens
caaaggcatccaggccag

SEQ ID NO: 1752384 - DNA, 15 bp, Homo sapiens
caaaggccctcagtg

SEQ ID NO: 1752385 - DNA, 17 bp, Homo sapiens
caaagggaaagcctctg

SEQ ID NO: 1752386 - DNA, 17 bp, Homo sapiens
caaagggaaatatcatt

SEQ ID NO: 1752387 - DNA, 17 bp, Homo sapiens
caaagggaagtgaggcc

SEQ ID NO: 1752388 - DNA, 19 bp, Homo sapiens
caaagggaagtgaggccca

SEQ ID NO: 1752389 - DNA, 20 bp, Homo sapiens
caaagggaagtgaggcccaa

SEQ ID NO: 1752390 - DNA, 21 bp, Homo sapiens
caaagggagagaaaagctgga

SEQ ID NO: 1752391 - DNA, 11 bp, Homo sapiens
caaagggcagt

SEQ ID NO: 1752392 - DNA, 17 bp, Homo sapiens
caaagggcagttttgag

SEQ ID NO: 1752393 - DNA, 18 bp, Homo sapiens
caaaggggacagctgtgt

SEQ ID NO: 1752394 - DNA, 14 bp, Homo sapiens
caaaggggctgctg

SEQ ID NO: 1752395 - DNA, 17 bp, Homo sapiens
caaaggggctgctgggg

SEQ ID NO: 1752396 - DNA, 19 bp, Homo sapiens
caaaggggctgctggggca

SEQ ID NO: 1752397 - DNA, 20 bp, Homo sapiens
caaaggggctgctggggcat

SEQ ID NO: 1752398 - DNA, 19 bp, Homo sapiens
caaagggtgaagctattta

SEQ ID NO: 1752399 - DNA, 23 bp, Homo sapiens
caaagggtgaagctatttatctg

SEQ ID NO: 1752400 - DNA, 14 bp, Homo sapiens
caaaggtgcctcat

SEQ ID NO: 1752401 - DNA, 13 bp, Homo sapiens
caaaggtggaata

SEQ ID NO: 1752402 - DNA, 19 bp, Homo sapiens
caaaggtggtaaattcaga

SEQ ID NO: 1752403 - DNA, 21 bp, Homo sapiens
caaaggttctaggtttcaaag

SEQ ID NO: 1752404 - DNA, 19 bp, Homo sapiens
caaaggttttcctcttcta

SEQ ID NO: 1752405 - DNA, 16 bp, Homo sapiens
caaagtacattgtaaa

SEQ ID NO: 1752406 - DNA, 20 bp, Homo sapiens
caaagtacattgtaaaataa

SEQ ID NO: 1752407 - DNA, 14 bp, Homo sapiens
caaagtagaagtct

SEQ ID NO: 1752408 - DNA, 17 bp, Homo sapiens
caaagtatctaacaaaa

SEQ ID NO: 1752409 - DNA, 20 bp, Homo sapiens
caaagtatctaacaaaacca

SEQ ID NO: 1752410 - DNA, 22 bp, Homo sapiens
caaagtatttttttatcttggg

SEQ ID NO: 1752411 - DNA, 23 bp, Homo sapiens
caaagtatttttttatcttggga

SEQ ID NO: 1752412 - DNA, 15 bp, Homo sapiens
caaagtcacttctcc

SEQ ID NO: 1752413 - DNA, 17 bp, Homo sapiens
caaagtcctctgctcca

SEQ ID NO: 1752414 - DNA, 13 bp, Homo sapiens
caaagtctctaat

SEQ ID NO: 1752415 - DNA, 21 bp, Homo sapiens
caaagtgagaaaatgcctcaa

SEQ ID NO: 1752416 - DNA, 13 bp, Homo sapiens
caaagtgataaat

SEQ ID NO: 1752417 - DNA, 21 bp, Homo sapiens
caaagtgatagaaaagtgtgg

SEQ ID NO: 1752418 - DNA, 17 bp, Homo sapiens
caaagtgcgtgtgtgta

SEQ ID NO: 1752419 - DNA, 20 bp, Homo sapiens
caaagtgctatgcggaggaa

SEQ ID NO: 1752420 - DNA, 15 bp, Homo sapiens
caaagtgctgggatt

SEQ ID NO: 1752421 - DNA, 20 bp, Homo sapiens
caaagtgctgggattacagg

SEQ ID NO: 1752422 - DNA, 14 bp, Homo sapiens
caaagtgctgtacc

SEQ ID NO: 1752423 - DNA, 15 bp, Homo sapiens
caaagtggaacgaaa

SEQ ID NO: 1752424 - DNA, 17 bp, Homo sapiens
caaagtggggagggaca

SEQ ID NO: 1752425 - DNA, 20 bp, Homo sapiens
caaagtggggagggacaagg

SEQ ID NO: 1752426 - DNA, 15 bp, Homo sapiens
caaagtgtatattta

SEQ ID NO: 1752427 - DNA, 20 bp, Homo sapiens
caaagtgtatatttattcat

SEQ ID NO: 1752428 - DNA, 22 bp, Homo sapiens
caaagtgttgctgtggctccat

SEQ ID NO: 1752429 - DNA, 21 bp, Homo sapiens
caaagtgttttctcagaacag

SEQ ID NO: 1752430 - DNA, 15 bp, Homo sapiens
caaagttaacagatt

SEQ ID NO: 1752431 - DNA, 16 bp, Homo sapiens
caaagttaacagattt

SEQ ID NO: 1752432 - DNA, 20 bp, Homo sapiens
caaagttctattttattaat

SEQ ID NO: 1752433 - DNA, 17 bp, Homo sapiens
caaagttggggcaggct

SEQ ID NO: 1752434 - DNA, 20 bp, Homo sapiens
caaagtttcagagtatattg

SEQ ID NO: 1752435 - DNA, 17 bp, Homo sapiens
caaagtttgacaggaac

SEQ ID NO: 1752436 - DNA, 20 bp, Homo sapiens
caaagtttgacaggaacctt

SEQ ID NO: 1752437 - DNA, 14 bp, Homo sapiens
caaagtttgcaact

SEQ ID NO: 1752438 - DNA, 16 bp, Homo sapiens
caaagttttacagaga

SEQ ID NO: 1752439 - DNA, 18 bp, Homo sapiens
caaagttttcaaactgct

SEQ ID NO: 1752440 - DNA, 22 bp, Homo sapiens
caaagttttgttgtacttaaat

SEQ ID NO: 1752441 - DNA, 21 bp, Homo sapiens
caaataaatcatcctcatgtc

SEQ ID NO: 1752442 - DNA, 15 bp, Homo sapiens
caaataaatgattat

SEQ ID NO: 1752443 - DNA, 22 bp, Homo sapiens
caaataaatgattatattcaca

SEQ ID NO: 1752444 - DNA, 17 bp, Homo sapiens
caaataatggaaaaata

SEQ ID NO: 1752445 - DNA, 13 bp, Homo sapiens
caaatacacattt

SEQ ID NO: 1752446 - DNA, 17 bp, Homo sapiens
caaatacacatttgcta

SEQ ID NO: 1752447 - DNA, 12 bp, Homo sapiens
caaatacctcaa

SEQ ID NO: 1752448 - DNA, 11 bp, Homo sapiens
caaccagcctt

SEQ ID NO: 1752449 - DNA, 12 bp, Homo sapiens
caaccagccttt

SEQ ID NO: 1752450 - DNA, 20 bp, Homo sapiens
caaccaggagctgatggcag

SEQ ID NO: 1752451 - DNA, 16 bp, Homo sapiens
caaccaggcacctctt

SEQ ID NO: 1752452 - DNA, 20 bp, Homo sapiens
caaccaggccttcatcctcc

SEQ ID NO: 1752453 - DNA, 14 bp, Homo sapiens
caaccatgtcattt

SEQ ID NO: 1752454 - DNA, 14 bp, Homo sapiens
caaccattccccat

SEQ ID NO: 1752455 - DNA, 13 bp, Homo sapiens
caaccatttatct

SEQ ID NO: 1752456 - DNA, 16 bp, Homo sapiens
caaccatttatcttga

SEQ ID NO: 1752457 - DNA, 15 bp, Homo sapiens
caacccaaaccatga

SEQ ID NO: 1752458 - DNA, 17 bp, Homo sapiens
caacccacagctcagct

SEQ ID NO: 1752459 - DNA, 18 bp, Homo sapiens
caacccattcactacagg

SEQ ID NO: 1752460 - DNA, 18 bp, Homo sapiens
caaccccaaacccaagtg

SEQ ID NO: 1752461 - DNA, 17 bp, Homo sapiens
caaccccaagccagccc

SEQ ID NO: 1752462 - DNA, 12 bp, Homo sapiens
caacccccatct

SEQ ID NO: 1752463 - DNA, 17 bp, Homo sapiens
caacccccatctcccta

SEQ ID NO: 1752464 - DNA, 18 bp, Homo sapiens
caacccccatctccctag

SEQ ID NO: 1752465 - DNA, 16 bp, Homo sapiens
caaccccccagcactg

SEQ ID NO: 1752466 - DNA, 19 bp, Homo sapiens
caacccccctcctgctcct

SEQ ID NO: 1752467 - DNA, 18 bp, Homo sapiens
caaccccgcggtgctctg

SEQ ID NO: 1752468 - DNA, 18 bp, Homo sapiens
caacccctgacctacccc

SEQ ID NO: 1752469 - DNA, 12 bp, Homo sapiens
caacccctgtac

SEQ ID NO: 1752470 - DNA, 20 bp, Homo sapiens
caacccctgtacccagctcc

SEQ ID NO: 1752471 - DNA, 21 bp, Homo sapiens
caacccgtctggcccaccagg

SEQ ID NO: 1752472 - DNA, 14 bp, Homo sapiens
caaccctaccctgg

SEQ ID NO: 1752473 - DNA, 18 bp, Homo sapiens
caaccctaccctggcagg

SEQ ID NO: 1752474 - DNA, 20 bp, Homo sapiens
caaccctatctcctgacaga

SEQ ID NO: 1752475 - DNA, 13 bp, Homo sapiens
caaccctcagagc

SEQ ID NO: 1752476 - DNA, 18 bp, Homo sapiens
caaccctcagagccaccc

SEQ ID NO: 1752477 - DNA, 21 bp, Homo sapiens
caaccctcagagccaccccta

SEQ ID NO: 1752478 - DNA, 12 bp, Homo sapiens
caaccctcagcc

SEQ ID NO: 1752479 - DNA, 13 bp, Homo sapiens
caaccctcagcct

SEQ ID NO: 1752480 - DNA, 15 bp, Homo sapiens
caaccctctcctgtc

SEQ ID NO: 1752481 - DNA, 20 bp, Homo sapiens
caaccctgggctggggagga

SEQ ID NO: 1752482 - DNA, 21 bp, Homo sapiens
caaccctggggaaggagccag

SEQ ID NO: 1752483 - DNA, 22 bp, Homo sapiens
caaccctggggaaggagccagt

SEQ ID NO: 1752484 - DNA, 23 bp, Homo sapiens
caaccctggggaaggagccagtt

SEQ ID NO: 1752485 - DNA, 15 bp, Homo sapiens
caacccttacccctt

SEQ ID NO: 1752486 - DNA, 17 bp, Homo sapiens
caacccttcctgctgct

SEQ ID NO: 1752487 - DNA, 18 bp, Homo sapiens
caacccttcctgctgctg

SEQ ID NO: 1752488 - DNA, 19 bp, Homo sapiens
caacccttcctgctgctgc

SEQ ID NO: 1752489 - DNA, 12 bp, Homo sapiens
caacctagaatg

SEQ ID NO: 1752490 - DNA, 13 bp, Homo sapiens
caacctagaatgt

SEQ ID NO: 1752491 - DNA, 20 bp, Homo sapiens
caacctccgcctcccaggtt

SEQ ID NO: 1752492 - DNA, 13 bp, Homo sapiens
caacctcctgctc

SEQ ID NO: 1752493 - DNA, 20 bp, Homo sapiens
caacctcctgctctgggacg

SEQ ID NO: 1752494 - DNA, 16 bp, Homo sapiens
caacctcgctgagggc

SEQ ID NO: 1752495 - DNA, 19 bp, Homo sapiens
caacctctcctttctgtgc

SEQ ID NO: 1752496 - DNA, 16 bp, Homo sapiens
caacctctctgatctt

SEQ ID NO: 1752497 - DNA, 16 bp, Homo sapiens
caacctcttctggctc

SEQ ID NO: 1752498 - DNA, 17 bp, Homo sapiens
caacctcttctggctca

SEQ ID NO: 1752499 - DNA, 15 bp, Homo sapiens
caacctctttgctca

SEQ ID NO: 1752500 - DNA, 21 bp, Homo sapiens
caacctgaccaacatggagaa

SEQ ID NO: 1752501 - DNA, 20 bp, Homo sapiens
caacctggacttcctgtcat

SEQ ID NO: 1752502 - DNA, 20 bp, Homo sapiens
caacctggggggcagtggtg

SEQ ID NO: 1752503 - DNA, 22 bp, Homo sapiens
caacctgttacctactttgact

SEQ ID NO: 1752504 - DNA, 15 bp, Homo sapiens
caacctgttcttaga

SEQ ID NO: 1752505 - DNA, 22 bp, Homo sapiens
caacctgttcttagagtgtagc

SEQ ID NO: 1752506 - DNA, 14 bp, Homo sapiens
caaccttcggctcc

SEQ ID NO: 1752507 - DNA, 12 bp, Homo sapiens
caacctttctgt

SEQ ID NO: 1752508 - DNA, 13 bp, Homo sapiens
caacctttctgta

SEQ ID NO: 1752509 - DNA, 17 bp, Homo sapiens
caaccttttacattgtg

SEQ ID NO: 1752510 - DNA, 20 bp, Homo sapiens
caacgaagaaaaaaaataac

SEQ ID NO: 1752511 - DNA, 14 bp, Homo sapiens
caacgcacaggaaa

SEQ ID NO: 1752512 - DNA, 18 bp, Homo sapiens
caacgcagccctgctttg

SEQ ID NO: 1752513 - DNA, 21 bp, Homo sapiens
caacgcccctccaaacctcca

SEQ ID NO: 1752514 - DNA, 18 bp, Homo sapiens
caacgccgagtgcactgc

SEQ ID NO: 1752515 - DNA, 20 bp, Homo sapiens
caacggaaagtgctgtctta

SEQ ID NO: 1752516 - DNA, 15 bp, Homo sapiens
caacgtagcctgggc

SEQ ID NO: 1752517 - DNA, 19 bp, Homo sapiens
caacgtcccctccgccgtg

SEQ ID NO: 1752518 - DNA, 18 bp, Homo sapiens
caacgtgagagaaagaga

SEQ ID NO: 1752519 - DNA, 20 bp, Homo sapiens
caacgtgagagaaagagaga

SEQ ID NO: 1752520 - DNA, 13 bp, Homo sapiens
caacgtggcccag

SEQ ID NO: 1752521 - DNA, 14 bp, Homo sapiens
caacgtggcccaga

SEQ ID NO: 1752522 - DNA, 19 bp, Homo sapiens
caacgtggcccagagaagc

SEQ ID NO: 1752523 - DNA, 20 bp, Homo sapiens
caacgtggcccagagaagcc

SEQ ID NO: 1752524 - DNA, 23 bp, Homo sapiens
caacgtggctttttttttttccc

SEQ ID NO: 1752525 - DNA, 23 bp, Homo sapiens
caacgtgtaaccagttataaata

SEQ ID NO: 1752526 - DNA, 19 bp, Homo sapiens
caactaaaatttgaagtag

SEQ ID NO: 1752527 - DNA, 18 bp, Homo sapiens
caactacacaaagcaggc

SEQ ID NO: 1752528 - DNA, 21 bp, Homo sapiens
caactacctgagctaaataaa

SEQ ID NO: 1752529 - DNA, 18 bp, Homo sapiens
caactagatcaaggagcc

SEQ ID NO: 1752530 - DNA, 13 bp, Homo sapiens
caactagccaagg

SEQ ID NO: 1752531 - DNA, 15 bp, Homo sapiens
caactagccaaggct

SEQ ID NO: 1752532 - DNA, 18 bp, Homo sapiens
caactagcccctggggtg

SEQ ID NO: 1752533 - DNA, 18 bp, Homo sapiens
caactcacagcttctcca

SEQ ID NO: 1752534 - DNA, 23 bp, Homo sapiens
caactcagagaaaaatgctcccc

SEQ ID NO: 1752535 - DNA, 15 bp, Homo sapiens
caactccaggattta

SEQ ID NO: 1752536 - DNA, 15 bp, Homo sapiens
caactcccaacttct

SEQ ID NO: 1752537 - DNA, 14 bp, Homo sapiens
caactctcccaaag

SEQ ID NO: 1752538 - DNA, 11 bp, Homo sapiens
caactctcccc

SEQ ID NO: 1752539 - DNA, 13 bp, Homo sapiens
caactctccccag

SEQ ID NO: 1752540 - DNA, 14 bp, Homo sapiens
caactctccccagt

SEQ ID NO: 1752541 - DNA, 20 bp, Homo sapiens
caactctccccagtgcctgc

SEQ ID NO: 1752542 - DNA, 23 bp, Homo sapiens
caactctccccagtgcctgccac

SEQ ID NO: 1752543 - DNA, 16 bp, Homo sapiens
caactctgagcccata

SEQ ID NO: 1752544 - DNA, 17 bp, Homo sapiens
caactctgcactccatg

SEQ ID NO: 1752545 - DNA, 16 bp, Homo sapiens
caactctggctccagg

SEQ ID NO: 1752546 - DNA, 14 bp, Homo sapiens
caactgaaaagact

SEQ ID NO: 1752547 - DNA, 22 bp, Homo sapiens
caactgaaaagactcagtgttc

SEQ ID NO: 1752548 - DNA, 14 bp, Homo sapiens
caactgaaggggtg

SEQ ID NO: 1752549 - DNA, 11 bp, Homo sapiens
caactgacaca

SEQ ID NO: 1752550 - DNA, 14 bp, Homo sapiens
caactgacacagga

SEQ ID NO: 1752551 - DNA, 13 bp, Homo sapiens
caactgaggcaga

SEQ ID NO: 1752552 - DNA, 22 bp, Homo sapiens
caactgaggcagacagcagctc

SEQ ID NO: 1752553 - DNA, 17 bp, Homo sapiens
caactgagggccaggga

SEQ ID NO: 1752554 - DNA, 18 bp, Homo sapiens
caactgagggccagggac

SEQ ID NO: 1752555 - DNA, 15 bp, Homo sapiens
caactgatcctgctc

SEQ ID NO: 1752556 - DNA, 23 bp, Homo sapiens
caactgatcctgctccagcagca

SEQ ID NO: 1752557 - DNA, 12 bp, Homo sapiens
caactgattgca

SEQ ID NO: 1752558 - DNA, 19 bp, Homo sapiens
caactgcaaaaaaagcctc

SEQ ID NO: 1752559 - DNA, 20 bp, Homo sapiens
caactgcaaaaaaagcctcc

SEQ ID NO: 1752560 - DNA, 23 bp, Homo sapiens
caactgcaaagaaagtgggaggt

SEQ ID NO: 1752561 - DNA, 15 bp, Homo sapiens
caactgcacatgaaa

SEQ ID NO: 1752562 - DNA, 15 bp, Homo sapiens
caactgccaggctgc

SEQ ID NO: 1752563 - DNA, 17 bp, Homo sapiens
caagccctacagagctg

SEQ ID NO: 1752564 - DNA, 18 bp, Homo sapiens
caagccctacagagctgt

SEQ ID NO: 1752565 - DNA, 21 bp, Homo sapiens
caagccgaccttccctccgcc

SEQ ID NO: 1752566 - DNA, 17 bp, Homo sapiens
caagccgcaagctctca

SEQ ID NO: 1752567 - DNA, 17 bp, Homo sapiens
caagccgtggcttcccg

SEQ ID NO: 1752568 - DNA, 18 bp, Homo sapiens
caagcctaagggatcctg

SEQ ID NO: 1752569 - DNA, 18 bp, Homo sapiens
caagcctcttattccagg

SEQ ID NO: 1752570 - DNA, 23 bp, Homo sapiens
caagcctcttattccaggagaag

SEQ ID NO: 1752571 - DNA, 14 bp, Homo sapiens
caagcctgagaact

SEQ ID NO: 1752572 - DNA, 14 bp, Homo sapiens
caagcctgcctagg

SEQ ID NO: 1752573 - DNA, 15 bp, Homo sapiens
caagcctgcctccca

SEQ ID NO: 1752574 - DNA, 18 bp, Homo sapiens
caagcctgtaatcccagc

SEQ ID NO: 1752575 - DNA, 16 bp, Homo sapiens
caagcctgtgaataaa

SEQ ID NO: 1752576 - DNA, 17 bp, Homo sapiens
caagcgttcctggcctt

SEQ ID NO: 1752577 - DNA, 22 bp, Homo sapiens
caagctaagcactgccactggg

SEQ ID NO: 1752578 - DNA, 17 bp, Homo sapiens
caagctactttatgtaa

SEQ ID NO: 1752579 - DNA, 22 bp, Homo sapiens
caagctagccagagggtgggag

SEQ ID NO: 1752580 - DNA, 21 bp, Homo sapiens
caagctaggccccagaggccc

SEQ ID NO: 1752581 - DNA, 15 bp, Homo sapiens
caagctattcaattc

SEQ ID NO: 1752582 - DNA, 17 bp, Homo sapiens
caagctattctcatgcc

SEQ ID NO: 1752583 - DNA, 23 bp, Homo sapiens
caagctatttaatatctggcact

SEQ ID NO: 1752584 - DNA, 12 bp, Homo sapiens
caagctcacagt

SEQ ID NO: 1752585 - DNA, 22 bp, Homo sapiens
caagctcacagttcctcgccct

SEQ ID NO: 1752586 - DNA, 14 bp, Homo sapiens
caagctccaagccc

SEQ ID NO: 1752587 - DNA, 20 bp, Homo sapiens
caagctctgcctcccgggtt

SEQ ID NO: 1752588 - DNA, 20 bp, Homo sapiens
caagctgaaattttagaaat

SEQ ID NO: 1752589 - DNA, 23 bp, Homo sapiens
caagctgagtttcctatgggaac

SEQ ID NO: 1752590 - DNA, 13 bp, Homo sapiens
caagctgcactgt

SEQ ID NO: 1752591 - DNA, 17 bp, Homo sapiens
caagctgcactgtgaac

SEQ ID NO: 1752592 - DNA, 16 bp, Homo sapiens
caagctgctctgagcc

SEQ ID NO: 1752593 - DNA, 21 bp, Homo sapiens
caagctgctctgagccacagt

SEQ ID NO: 1752594 - DNA, 23 bp, Homo sapiens
caagctgcttgtcctgggcctgc

SEQ ID NO: 1752595 - DNA, 23 bp, Homo sapiens
caagctggaagaagtgagcagtg

SEQ ID NO: 1752596 - DNA, 15 bp, Homo sapiens
caagctgtccctgca

SEQ ID NO: 1752597 - DNA, 16 bp, Homo sapiens
caagctgtccctgcag

SEQ ID NO: 1752598 - DNA, 21 bp, Homo sapiens
caagctgtccctgcagggcca

SEQ ID NO: 1752599 - DNA, 22 bp, Homo sapiens
caagctgtccctgcagggccat

SEQ ID NO: 1752600 - DNA, 14 bp, Homo sapiens
caagctgtgcaggc

SEQ ID NO: 1752601 - DNA, 18 bp, Homo sapiens
caagctgtggcagccgtc

SEQ ID NO: 1752602 - DNA, 22 bp, Homo sapiens
caagctgtggcagccgtcccag

SEQ ID NO: 1752603 - DNA, 20 bp, Homo sapiens
caagctgttatttcttccct

SEQ ID NO: 1752604 - DNA, 20 bp, Homo sapiens
caagcttcaaccctcagcct

SEQ ID NO: 1752605 - DNA, 14 bp, Homo sapiens
caagcttcagagcc

SEQ ID NO: 1752606 - DNA, 19 bp, Homo sapiens
caagcttcagagcctagcc

SEQ ID NO: 1752607 - DNA, 22 bp, Homo sapiens
caagcttcagagcctagccacc

SEQ ID NO: 1752608 - DNA, 19 bp, Homo sapiens
caagcttccctccatcccc

SEQ ID NO: 1752609 - DNA, 13 bp, Homo sapiens
caagcttcttgct

SEQ ID NO: 1752610 - DNA, 14 bp, Homo sapiens
caagcttcttgctg

SEQ ID NO: 1752611 - DNA, 14 bp, Homo sapiens
caagcttggcagcc

SEQ ID NO: 1752612 - DNA, 16 bp, Homo sapiens
caagctttaaattatg

SEQ ID NO: 1752613 - DNA, 14 bp, Homo sapiens
caaggaaaaggagg

SEQ ID NO: 1752614 - DNA, 18 bp, Homo sapiens
caaggaaaaggaggaggt

SEQ ID NO: 1752615 - DNA, 16 bp, Homo sapiens
caaggaaaatctatat

SEQ ID NO: 1752616 - DNA, 22 bp, Homo sapiens
caaggaaaccgcctagtttact

SEQ ID NO: 1752617 - DNA, 20 bp, Homo sapiens
caaggaaacgctacctctct

SEQ ID NO: 1752618 - DNA, 18 bp, Homo sapiens
caaggaaaggctcattta

SEQ ID NO: 1752619 - DNA, 20 bp, Homo sapiens
caaggaaagggggtcccagt

SEQ ID NO: 1752620 - DNA, 22 bp, Homo sapiens
caaggaaagggggtcccagtgg

SEQ ID NO: 1752621 - DNA, 23 bp, Homo sapiens
caaggaaagggggtcccagtggg

SEQ ID NO: 1752622 - DNA, 14 bp, Homo sapiens
caaggaaataaagc

SEQ ID NO: 1752623 - DNA, 23 bp, Homo sapiens
caaggaaataaagcgtcctctca

SEQ ID NO: 1752624 - DNA, 23 bp, Homo sapiens
caaggaaatacaacctagggtgc

SEQ ID NO: 1752625 - DNA, 19 bp, Homo sapiens
caaggaagcagcctcagag

SEQ ID NO: 1752626 - DNA, 17 bp, Homo sapiens
caaggaaggaaagaaag

SEQ ID NO: 1752627 - DNA, 12 bp, Homo sapiens
caaggaatttct

SEQ ID NO: 1752628 - DNA, 23 bp, Homo sapiens
caaggaatttcttaacttcttgc

SEQ ID NO: 1752629 - DNA, 14 bp, Homo sapiens
caaggaccaggact

SEQ ID NO: 1752630 - DNA, 15 bp, Homo sapiens
caaggaccaggactc

SEQ ID NO: 1752631 - DNA, 18 bp, Homo sapiens
caaggaccaggactccct

SEQ ID NO: 1752632 - DNA, 12 bp, Homo sapiens
caaggacctctt

SEQ ID NO: 1752633 - DNA, 23 bp, Homo sapiens
caaggacctctttactctctccg

SEQ ID NO: 1752634 - DNA, 22 bp, Homo sapiens
caaggaccttttggaatgactg

SEQ ID NO: 1752635 - DNA, 22 bp, Homo sapiens
caaggacgctggctactgtcta

SEQ ID NO: 1752636 - DNA, 18 bp, Homo sapiens
caaggacggaaaatgctt

SEQ ID NO: 1752637 - DNA, 20 bp, Homo sapiens
caaggactgagcaccctctg

SEQ ID NO: 1752638 - DNA, 14 bp, Homo sapiens
caaggacttcctgt

SEQ ID NO: 1752639 - DNA, 18 bp, Homo sapiens
caaggagaaacagagaca

SEQ ID NO: 1752640 - DNA, 16 bp, Homo sapiens
caaggagaccaagtcc

SEQ ID NO: 1752641 - DNA, 14 bp, Homo sapiens
caaggagatttctt

SEQ ID NO: 1752642 - DNA, 15 bp, Homo sapiens
caaggagatttctta

SEQ ID NO: 1752643 - DNA, 15 bp, Homo sapiens
caaggagcacaagcc

SEQ ID NO: 1752644 - DNA, 20 bp, Homo sapiens
caaggagctcaccctgcccg

SEQ ID NO: 1752645 - DNA, 21 bp, Homo sapiens
caaggagcttacccaagctgt

SEQ ID NO: 1752646 - DNA, 12 bp, Homo sapiens
caaggaggaaaa

SEQ ID NO: 1752647 - DNA, 16 bp, Homo sapiens
caaggagtcagacatt

SEQ ID NO: 1752648 - DNA, 15 bp, Homo sapiens
caaggagtttattac

SEQ ID NO: 1752649 - DNA, 16 bp, Homo sapiens
caaggagtttattaca

SEQ ID NO: 1752650 - DNA, 22 bp, Homo sapiens
caaggagtttattacaatgtat

SEQ ID NO: 1752651 - DNA, 16 bp, Homo sapiens
caaggatagatgctgg

SEQ ID NO: 1752652 - DNA, 20 bp, Homo sapiens
caaggatagatgctggccca

SEQ ID NO: 1752653 - DNA, 21 bp, Homo sapiens
caaggatagatgctggcccag

SEQ ID NO: 1752654 - DNA, 23 bp, Homo sapiens
caaggatagatgctggcccaggg

SEQ ID NO: 1752655 - DNA, 14 bp, Homo sapiens
caaggcaaggcagg

SEQ ID NO: 1752656 - DNA, 13 bp, Homo sapiens
caaggcagaggcc

SEQ ID NO: 1752657 - DNA, 15 bp, Homo sapiens
caaggcagaggcctg

SEQ ID NO: 1752658 - DNA, 13 bp, Homo sapiens
caaggcagcctcc

SEQ ID NO: 1752659 - DNA, 16 bp, Homo sapiens
caaggcagcctccaga

SEQ ID NO: 1752660 - DNA, 19 bp, Homo sapiens
caaggcagcctccagagcc

SEQ ID NO: 1752661 - DNA, 22 bp, Homo sapiens
caaggcagcctccagagccagc

SEQ ID NO: 1752662 - DNA, 20 bp, Homo sapiens
caaggcagcctgaacactca

SEQ ID NO: 1752663 - DNA, 13 bp, Homo sapiens
caaggcaggtgcc

SEQ ID NO: 1752664 - DNA, 20 bp, Homo sapiens
caaggcaggtgcctccaggt

SEQ ID NO: 1752665 - DNA, 23 bp, Homo sapiens
caaggcaggtgcctccaggtgtg

SEQ ID NO: 1752666 - DNA, 21 bp, Homo sapiens
caaggccagagtggcctggcc

SEQ ID NO: 1752667 - DNA, 23 bp, Homo sapiens
caaggcccaggagacctccagct

SEQ ID NO: 1752668 - DNA, 13 bp, Homo sapiens
caaggccctttcc

SEQ ID NO: 1752669 - DNA, 15 bp, Homo sapiens
caaggccgccagcgt

SEQ ID NO: 1752670 - DNA, 20 bp, Homo sapiens
caaggccgctgttcacccac

SEQ ID NO: 1752671 - DNA, 11 bp, Homo sapiens
caaggcctctc

SEQ ID NO: 1752672 - DNA, 12 bp, Homo sapiens
caaggcctctct

SEQ ID NO: 1752673 - DNA, 13 bp, Homo sapiens
caaggcctctctc

SEQ ID NO: 1752674 - DNA, 15 bp, Homo sapiens
caaggcctctctctg

SEQ ID NO: 1752675 - DNA, 16 bp, Homo sapiens
caaggcctctctctgc

SEQ ID NO: 1752676 - DNA, 16 bp, Homo sapiens
caaggcctgtgctgca

SEQ ID NO: 1752677 - DNA, 13 bp, Homo sapiens
caaggccttcagt

SEQ ID NO: 1752678 - DNA, 14 bp, Homo sapiens
caaggccttctcct

SEQ ID NO: 1752679 - DNA, 19 bp, Homo sapiens
caaggccttggtggagcag

SEQ ID NO: 1752680 - DNA, 20 bp, Homo sapiens
caaggccttggtggagcagc

SEQ ID NO: 1752681 - DNA, 21 bp, Homo sapiens
caaggccttggtggagcagcc

SEQ ID NO: 1752682 - DNA, 22 bp, Homo sapiens
caaggcgtccgcgcgccagcac

SEQ ID NO: 1752683 - DNA, 20 bp, Homo sapiens
caaggctaacatcccactta

SEQ ID NO: 1752684 - DNA, 16 bp, Homo sapiens
caaggctcagaaggaa

SEQ ID NO: 1752685 - DNA, 17 bp, Homo sapiens
caaggctcatctttctg

SEQ ID NO: 1752686 - DNA, 23 bp, Homo sapiens
caaggctgaccaagagagaaaga

SEQ ID NO: 1752687 - DNA, 12 bp, Homo sapiens
caaggctgctgc

SEQ ID NO: 1752688 - DNA, 22 bp, Homo sapiens
caaggctggggtcttgggttcc

SEQ ID NO: 1752689 - DNA, 21 bp, Homo sapiens
caagggaaaaatttttatgta

SEQ ID NO: 1752690 - DNA, 21 bp, Homo sapiens
caagggaaaggcaagcttgag

SEQ ID NO: 1752691 - DNA, 16 bp, Homo sapiens
caagggaaaggggtgc

SEQ ID NO: 1752692 - DNA, 21 bp, Homo sapiens
caagggaaaggggtgctttta

SEQ ID NO: 1752693 - DNA, 15 bp, Homo sapiens
caagggaacctgtgt

SEQ ID NO: 1752694 - DNA, 15 bp, Homo sapiens
caagggacagcaagt

SEQ ID NO: 1752695 - DNA, 15 bp, Homo sapiens
caagggaccttcatg

SEQ ID NO: 1752696 - DNA, 19 bp, Homo sapiens
caagggactagtgagtcag

SEQ ID NO: 1752697 - DNA, 13 bp, Homo sapiens
caagggagaaaag

SEQ ID NO: 1752698 - DNA, 15 bp, Homo sapiens
caagggagaaaagag

SEQ ID NO: 1752699 - DNA, 20 bp, Homo sapiens
caagggagaaaagagaaacc

SEQ ID NO: 1752700 - DNA, 13 bp, Homo sapiens
caagggagaagac

SEQ ID NO: 1752701 - DNA, 14 bp, Homo sapiens
caagggatttgagg

SEQ ID NO: 1752702 - DNA, 18 bp, Homo sapiens
caagggcacattgcccat

SEQ ID NO: 1752703 - DNA, 16 bp, Homo sapiens
caagggcatcaggcac

SEQ ID NO: 1752704 - DNA, 19 bp, Homo sapiens
caagggcatcaggcactgg

SEQ ID NO: 1752705 - DNA, 13 bp, Homo sapiens
caagggcccagac

SEQ ID NO: 1752706 - DNA, 16 bp, Homo sapiens
caagggcccagaccct

SEQ ID NO: 1752707 - DNA, 17 bp, Homo sapiens
caagggccccaggggca

SEQ ID NO: 1752708 - DNA, 19 bp, Homo sapiens
caagggccccaggggcagc

SEQ ID NO: 1752709 - DNA, 23 bp, Homo sapiens
caagggccccaggggcagcaagg

SEQ ID NO: 1752710 - DNA, 18 bp, Homo sapiens
caagggccctggcacccc

SEQ ID NO: 1752711 - DNA, 14 bp, Homo sapiens
caagggctggcact

SEQ ID NO: 1752712 - DNA, 21 bp, Homo sapiens
caaggggaaaatgtgaagctg

SEQ ID NO: 1752713 - DNA, 16 bp, Homo sapiens
caaggggaccccgaga

SEQ ID NO: 1752714 - DNA, 18 bp, Homo sapiens
caaggggcccaaattctt

SEQ ID NO: 1752715 - DNA, 19 bp, Homo sapiens
caaggggctggctggagtc

SEQ ID NO: 1752716 - DNA, 15 bp, Homo sapiens
caagggggactgtct

SEQ ID NO: 1752717 - DNA, 14 bp, Homo sapiens
caagggggtgactg

SEQ ID NO: 1752718 - DNA, 22 bp, Homo sapiens
caagggtaatcttgggtttcta

SEQ ID NO: 1752719 - DNA, 23 bp, Homo sapiens
caagggtcattatgggttaggca

SEQ ID NO: 1752720 - DNA, 16 bp, Homo sapiens
caagggtctagggaga

SEQ ID NO: 1752721 - DNA, 17 bp, Homo sapiens
caagggtctagggagag

SEQ ID NO: 1752722 - DNA, 16 bp, Homo sapiens
caagggttaaggcctg

SEQ ID NO: 1752723 - DNA, 21 bp, Homo sapiens
caagggtttcgactggtccag

SEQ ID NO: 1752724 - DNA, 23 bp, Homo sapiens
caagggtttcgactggtccagct

SEQ ID NO: 1752725 - DNA, 23 bp, Homo sapiens
caaggtaattgttttttaaagca

SEQ ID NO: 1752726 - DNA, 17 bp, Homo sapiens
caaggtaccgatttctg

SEQ ID NO: 1752727 - DNA, 18 bp, Homo sapiens
caaggtaccgatttctgc

SEQ ID NO: 1752728 - DNA, 14 bp, Homo sapiens
caaggtataataaa

SEQ ID NO: 1752729 - DNA, 19 bp, Homo sapiens
caaggtataataaaattat

SEQ ID NO: 1752730 - DNA, 17 bp, Homo sapiens
caaggtatttctccagt

SEQ ID NO: 1752731 - DNA, 21 bp, Homo sapiens
caaggtctccttactctgagc

SEQ ID NO: 1752732 - DNA, 22 bp, Homo sapiens
caaggtctccttactctgagcc

SEQ ID NO: 1752733 - DNA, 23 bp, Homo sapiens
caaggtgaagcacatacggcaga

SEQ ID NO: 1752734 - DNA, 13 bp, Homo sapiens
caaggtgctaaca

SEQ ID NO: 1752735 - DNA, 14 bp, Homo sapiens
caaggtgctaacat

SEQ ID NO: 1752736 - DNA, 14 bp, Homo sapiens
caaggtggcctctg

SEQ ID NO: 1752737 - DNA, 19 bp, Homo sapiens
caaggtggcctctgcctgg

SEQ ID NO: 1752738 - DNA, 22 bp, Homo sapiens
caaggtggcctctgcctggggc

SEQ ID NO: 1752739 - DNA, 16 bp, Homo sapiens
caaggtgggctgagcc

SEQ ID NO: 1752740 - DNA, 20 bp, Homo sapiens
caaggtgggctgagccctgg

SEQ ID NO: 1752741 - DNA, 21 bp, Homo sapiens
caaggtgggctgagccctggc

SEQ ID NO: 1752742 - DNA, 14 bp, Homo sapiens
caaggtgtccaggg

SEQ ID NO: 1752743 - DNA, 16 bp, Homo sapiens
caaggtgtccctgcct

SEQ ID NO: 1752744 - DNA, 18 bp, Homo sapiens
caaggtgtccctgccttc

SEQ ID NO: 1752745 - DNA, 15 bp, Homo sapiens
caaggttctccaaca

SEQ ID NO: 1752746 - DNA, 14 bp, Homo sapiens
caaggttggagccc

SEQ ID NO: 1752747 - DNA, 17 bp, Homo sapiens
caaggttggagcccagg

SEQ ID NO: 1752748 - DNA, 21 bp, Homo sapiens
caaggtttacactgcggaagc

SEQ ID NO: 1752749 - DNA, 18 bp, Homo sapiens
caaggttttaggttctaa

SEQ ID NO: 1752750 - DNA, 23 bp, Homo sapiens
caaggttttaggttctaaagttc

SEQ ID NO: 1752751 - DNA, 16 bp, Homo sapiens
caaggttttggagtca

SEQ ID NO: 1752752 - DNA, 15 bp, Homo sapiens
caagtaaaaaggcta

SEQ ID NO: 1752753 - DNA, 22 bp, Homo sapiens
caagtaagaagacatgaaccaa

SEQ ID NO: 1752754 - DNA, 23 bp, Homo sapiens
caagtaattgtgaaaaagttaaa

SEQ ID NO: 1752755 - DNA, 14 bp, Homo sapiens
caagtaatttcagt

SEQ ID NO: 1752756 - DNA, 18 bp, Homo sapiens
caagtaccaatgctgttg

SEQ ID NO: 1752757 - DNA, 14 bp, Homo sapiens
caagtaccaccaag

SEQ ID NO: 1752758 - DNA, 13 bp, Homo sapiens
caagtaggcattc

SEQ ID NO: 1752759 - DNA, 22 bp, Homo sapiens
caagtatccaaccaacttggtt

SEQ ID NO: 1752760 - DNA, 16 bp, Homo sapiens
caagtatgaataaaga

SEQ ID NO: 1752761 - DNA, 13 bp, Homo sapiens
caagtatgcctta

SEQ ID NO: 1752762 - DNA, 20 bp, Homo sapiens
caagtatgccttaagcagaa

SEQ ID NO: 1752763 - DNA, 22 bp, Homo sapiens
caagtatgccttaagcagaaca

SEQ ID NO: 1752764 - DNA, 22 bp, Homo sapiens
caagtatttaagcctaaagatt

SEQ ID NO: 1752765 - DNA, 17 bp, Homo sapiens
caagtcacagctgcagc

SEQ ID NO: 1752766 - DNA, 18 bp, Homo sapiens
caagtcacagctgcagct

SEQ ID NO: 1752767 - DNA, 19 bp, Homo sapiens
caagtcacagctgcagctg

SEQ ID NO: 1752768 - DNA, 20 bp, Homo sapiens
caagtcacagctgcagctgg

SEQ ID NO: 1752769 - DNA, 23 bp, Homo sapiens
caagtcacagctgcagctgggcc

SEQ ID NO: 1752770 - DNA, 15 bp, Homo sapiens
caagtcactagaagt

SEQ ID NO: 1752771 - DNA, 17 bp, Homo sapiens
caagtcactagaagtcc

SEQ ID NO: 1752772 - DNA, 20 bp, Homo sapiens
caagtcatagccataaatga

SEQ ID NO: 1752773 - DNA, 19 bp, Homo sapiens
caagtcatttttgtatttt

SEQ ID NO: 1752774 - DNA, 15 bp, Homo sapiens
caagtcccaccctct

SEQ ID NO: 1752775 - DNA, 20 bp, Homo sapiens
caagtccctgactctctgtg

SEQ ID NO: 1752776 - DNA, 21 bp, Homo sapiens
caagtccctgactctctgtga

SEQ ID NO: 1752777 - DNA, 20 bp, Homo sapiens
caagtccctgttttctgagc

SEQ ID NO: 1752778 - DNA, 15 bp, Homo sapiens
caagtcctgaagagg

SEQ ID NO: 1752779 - DNA, 23 bp, Homo sapiens
caagtcctgaagaggcgggccag

SEQ ID NO: 1752780 - DNA, 20 bp, Homo sapiens
caagtccttgacctctataa

SEQ ID NO: 1752781 - DNA, 21 bp, Homo sapiens
caagtccttgacctctataaa

SEQ ID NO: 1752782 - DNA, 16 bp, Homo sapiens
caagtctaatgaagag

SEQ ID NO: 1752783 - DNA, 14 bp, Homo sapiens
caagtctcagaaga

SEQ ID NO: 1752784 - DNA, 18 bp, Homo sapiens
caagtctggatctgggac

SEQ ID NO: 1752785 - DNA, 19 bp, Homo sapiens
caagtctggatctgggacc

SEQ ID NO: 1752786 - DNA, 14 bp, Homo sapiens
caagtcttaacaaa

SEQ ID NO: 1752787 - DNA, 23 bp, Homo sapiens
caagtcttaacaaaccaacatct

SEQ ID NO: 1752788 - DNA, 14 bp, Homo sapiens
caagtcttccctga

SEQ ID NO: 1752789 - DNA, 15 bp, Homo sapiens
caagtcttccctgat

SEQ ID NO: 1752790 - DNA, 18 bp, Homo sapiens
caagtcttctcccgtcca

SEQ ID NO: 1752791 - DNA, 19 bp, Homo sapiens
caatggatcagccaaggcc

SEQ ID NO: 1752792 - DNA, 18 bp, Homo sapiens
caatggcagctagactgg

SEQ ID NO: 1752793 - DNA, 20 bp, Homo sapiens
caatgggaagactcaggagt

SEQ ID NO: 1752794 - DNA, 15 bp, Homo sapiens
caatggtgcttcccc

SEQ ID NO: 1752795 - DNA, 21 bp, Homo sapiens
caatggtgtcagtatccaggc

SEQ ID NO: 1752796 - DNA, 18 bp, Homo sapiens
caatggtttattcccaag

SEQ ID NO: 1752797 - DNA, 12 bp, Homo sapiens
caatgtacaatt

SEQ ID NO: 1752798 - DNA, 19 bp, Homo sapiens
caatgtacaattatgtctc

SEQ ID NO: 1752799 - DNA, 22 bp, Homo sapiens
caatgtacaggaagtagttcta

SEQ ID NO: 1752800 - DNA, 15 bp, Homo sapiens
caatgtataaagatt

SEQ ID NO: 1752801 - DNA, 19 bp, Homo sapiens
caatgtataaagattgtac

SEQ ID NO: 1752802 - DNA, 21 bp, Homo sapiens
caatgtataaagattgtactt

SEQ ID NO: 1752803 - DNA, 19 bp, Homo sapiens
caatgtatacttcagtgct

SEQ ID NO: 1752804 - DNA, 20 bp, Homo sapiens
caatgtatacttcagtgctc

SEQ ID NO: 1752805 - DNA, 16 bp, Homo sapiens
caatgtatgtaatttg

SEQ ID NO: 1752806 - DNA, 16 bp, Homo sapiens
caatgtatgtacaata

SEQ ID NO: 1752807 - DNA, 13 bp, Homo sapiens
caatgtatttagc

SEQ ID NO: 1752808 - DNA, 15 bp, Homo sapiens
caatgtatttagcta

SEQ ID NO: 1752809 - DNA, 15 bp, Homo sapiens
caatgtatttattta

SEQ ID NO: 1752810 - DNA, 22 bp, Homo sapiens
caatgtatttatttaaaagatt

SEQ ID NO: 1752811 - DNA, 12 bp, Homo sapiens
caatgtctgtgc

SEQ ID NO: 1752812 - DNA, 14 bp, Homo sapiens
caatgtctgtgcta

SEQ ID NO: 1752813 - DNA, 22 bp, Homo sapiens
caatgtcttttgacaggtgcct

SEQ ID NO: 1752814 - DNA, 21 bp, Homo sapiens
caatgtgaagttcatcttgca

SEQ ID NO: 1752815 - DNA, 23 bp, Homo sapiens
caatgtgacacctaactcttttc

SEQ ID NO: 1752816 - DNA, 15 bp, Homo sapiens
caatgtgcagactga

SEQ ID NO: 1752817 - DNA, 23 bp, Homo sapiens
caatgtgctactgattgtttcat

SEQ ID NO: 1752818 - DNA, 16 bp, Homo sapiens
caatgtggagcagcag

SEQ ID NO: 1752819 - DNA, 18 bp, Homo sapiens
caatgtggagcagcagcc

SEQ ID NO: 1752820 - DNA, 20 bp, Homo sapiens
caatgtggagcagcagccac

SEQ ID NO: 1752821 - DNA, 18 bp, Homo sapiens
caatgtggtgacacctcc

SEQ ID NO: 1752822 - DNA, 21 bp, Homo sapiens
caatgtggtgacacctccccc

SEQ ID NO: 1752823 - DNA, 21 bp, Homo sapiens
caatgtggttgcaaggccgct

SEQ ID NO: 1752824 - DNA, 12 bp, Homo sapiens
caatgttaatca

SEQ ID NO: 1752825 - DNA, 20 bp, Homo sapiens
caatgttccttttttgtata

SEQ ID NO: 1752826 - DNA, 18 bp, Homo sapiens
caatgttctttgtctcaa

SEQ ID NO: 1752827 - DNA, 23 bp, Homo sapiens
caatgttgagaagttcccattat

SEQ ID NO: 1752828 - DNA, 15 bp, Homo sapiens
caatgttgtccaaca

SEQ ID NO: 1752829 - DNA, 18 bp, Homo sapiens
caatgttgtccaacaata

SEQ ID NO: 1752830 - DNA, 17 bp, Homo sapiens
caatgttgttttaagac

SEQ ID NO: 1752831 - DNA, 23 bp, Homo sapiens
caatgtttatgcaaggaaggaaa

SEQ ID NO: 1752832 - DNA, 21 bp, Homo sapiens
caatgtttatttcataaagaa

SEQ ID NO: 1752833 - DNA, 16 bp, Homo sapiens
caatgtttctggacat

SEQ ID NO: 1752834 - DNA, 22 bp, Homo sapiens
caatgtttctggacattctctt

SEQ ID NO: 1752835 - DNA, 23 bp, Homo sapiens
caatgtttctggacattctcttt

SEQ ID NO: 1752836 - DNA, 15 bp, Homo sapiens
caatgtttcttcatt

SEQ ID NO: 1752837 - DNA, 18 bp, Homo sapiens
caatgtttttaaaaatct

SEQ ID NO: 1752838 - DNA, 12 bp, Homo sapiens
caattaaatgta

SEQ ID NO: 1752839 - DNA, 15 bp, Homo sapiens
caattaatagtttgt

SEQ ID NO: 1752840 - DNA, 18 bp, Homo sapiens
caattacccataaacagc

SEQ ID NO: 1752841 - DNA, 16 bp, Homo sapiens
caattacttattttag

SEQ ID NO: 1752842 - DNA, 23 bp, Homo sapiens
caattaggaagtgtaacagctga

SEQ ID NO: 1752843 - DNA, 21 bp, Homo sapiens
caattagtggtcataaaatag

SEQ ID NO: 1752844 - DNA, 22 bp, Homo sapiens
caattagtgtgacagtttccaa

SEQ ID NO: 1752845 - DNA, 14 bp, Homo sapiens
caattagtttcctt

SEQ ID NO: 1752846 - DNA, 18 bp, Homo sapiens
caattagtttccttttta

SEQ ID NO: 1752847 - DNA, 17 bp, Homo sapiens
caattatataaatcatt

SEQ ID NO: 1752848 - DNA, 23 bp, Homo sapiens
caattatatcagtcctctttcaa

SEQ ID NO: 1752849 - DNA, 16 bp, Homo sapiens
caattatttgcatatt

SEQ ID NO: 1752850 - DNA, 11 bp, Homo sapiens
caattccactg

SEQ ID NO: 1752851 - DNA, 19 bp, Homo sapiens
caattccaggctgagccat

SEQ ID NO: 1752852 - DNA, 21 bp, Homo sapiens
caattccaggctgagccatga

SEQ ID NO: 1752853 - DNA, 23 bp, Homo sapiens
caattccaggctgagccatgagg

SEQ ID NO: 1752854 - DNA, 18 bp, Homo sapiens
caattccatgctataaaa

SEQ ID NO: 1752855 - DNA, 11 bp, Homo sapiens
caattcccctc

SEQ ID NO: 1752856 - DNA, 17 bp, Homo sapiens
caattcccctctgctgc

SEQ ID NO: 1752857 - DNA, 18 bp, Homo sapiens
caattcctagataaaaag

SEQ ID NO: 1752858 - DNA, 22 bp, Homo sapiens
caattcctagataaaaagatgg

SEQ ID NO: 1752859 - DNA, 14 bp, Homo sapiens
caattcctcttcat

SEQ ID NO: 1752860 - DNA, 13 bp, Homo sapiens
caattcctgggcc

SEQ ID NO: 1752861 - DNA, 13 bp, Homo sapiens
caattctaaatcc

SEQ ID NO: 1752862 - DNA, 16 bp, Homo sapiens
caattctcctgcctca

SEQ ID NO: 1752863 - DNA, 14 bp, Homo sapiens
caattctgactgtc

SEQ ID NO: 1752864 - DNA, 14 bp, Homo sapiens
caattctgttttag

SEQ ID NO: 1752865 - DNA, 12 bp, Homo sapiens
caattgaaaagt

SEQ ID NO: 1752866 - DNA, 21 bp, Homo sapiens
caattgaaaagtgttctgtgc

SEQ ID NO: 1752867 - DNA, 22 bp, Homo sapiens
caattgacataggcaataataa

SEQ ID NO: 1752868 - DNA, 14 bp, Homo sapiens
caattgactctcac

SEQ ID NO: 1752869 - DNA, 21 bp, Homo sapiens
caattgagggcattagtactt

SEQ ID NO: 1752870 - DNA, 21 bp, Homo sapiens
caattgatgtatatgtttata

SEQ ID NO: 1752871 - DNA, 15 bp, Homo sapiens
caattgcactgctgt

SEQ ID NO: 1752872 - DNA, 16 bp, Homo sapiens
caattgcactgctgtt

SEQ ID NO: 1752873 - DNA, 13 bp, Homo sapiens
caattgctcccat

SEQ ID NO: 1752874 - DNA, 19 bp, Homo sapiens
caattggattggaatgcag

SEQ ID NO: 1752875 - DNA, 17 bp, Homo sapiens
caattggtggaattcct

SEQ ID NO: 1752876 - DNA, 17 bp, Homo sapiens
caattgtcactttttat

SEQ ID NO: 1752877 - DNA, 16 bp, Homo sapiens
caattgtcatttataa

SEQ ID NO: 1752878 - DNA, 20 bp, Homo sapiens
caattgtcttttttttcctt

SEQ ID NO: 1752879 - DNA, 15 bp, Homo sapiens
caattgtgtagcctt

SEQ ID NO: 1752880 - DNA, 16 bp, Homo sapiens
caattgtgtagccttt

SEQ ID NO: 1752881 - DNA, 17 bp, Homo sapiens
caattgtgtagcctttt

SEQ ID NO: 1752882 - DNA, 18 bp, Homo sapiens
caattgtgtagccttttt

SEQ ID NO: 1752883 - DNA, 13 bp, Homo sapiens
caattgttacaag

SEQ ID NO: 1752884 - DNA, 21 bp, Homo sapiens
caattgttgacagttctgaag

SEQ ID NO: 1752885 - DNA, 24 bp, Homo sapiens
caattgttgacagttctgaagaat

SEQ ID NO: 1752886 - DNA, 13 bp, Homo sapiens
caatttaattcct

SEQ ID NO: 1752887 - DNA, 17 bp, Homo sapiens
caatttcaaattactct

SEQ ID NO: 1752888 - DNA, 15 bp, Homo sapiens
caatttcaaggttct

SEQ ID NO: 1752889 - DNA, 16 bp, Homo sapiens
caatttcaaggttcta

SEQ ID NO: 1752890 - DNA, 19 bp, Homo sapiens
caatttcaaggttctaacc

SEQ ID NO: 1752891 - DNA, 16 bp, Homo sapiens
caatttcatttccagc

SEQ ID NO: 1752892 - DNA, 17 bp, Homo sapiens
caatttcccccctcgtg

SEQ ID NO: 1752893 - DNA, 13 bp, Homo sapiens
caatttcctggcc

SEQ ID NO: 1752894 - DNA, 22 bp, Homo sapiens
caatttctgtgttgccaagctc

SEQ ID NO: 1752895 - DNA, 17 bp, Homo sapiens
caatttcttggtattat

SEQ ID NO: 1752896 - DNA, 19 bp, Homo sapiens
caatttgatacataataaa

SEQ ID NO: 1752897 - DNA, 20 bp, Homo sapiens
caatttgatacataataaaa

SEQ ID NO: 1752898 - DNA, 20 bp, Homo sapiens
caatttgcactaaatcagag

SEQ ID NO: 1752899 - DNA, 21 bp, Homo sapiens
caatttgcactaaatcagaga

SEQ ID NO: 1752900 - DNA, 23 bp, Homo sapiens
caatttggatttaaaagcctgct

SEQ ID NO: 1752901 - DNA, 16 bp, Homo sapiens
caatttgggagatata

SEQ ID NO: 1752902 - DNA, 21 bp, Homo sapiens
caatttggtaaaaatgctgct

SEQ ID NO: 1752903 - DNA, 23 bp, Homo sapiens
caatttgtaattgcttacatttt

SEQ ID NO: 1752904 - DNA, 11 bp, Homo sapiens
caatttgtact

SEQ ID NO: 1752905 - DNA, 21 bp, Homo sapiens
cacacagaggctgcctctccc

SEQ ID NO: 1752906 - DNA, 15 bp, Homo sapiens
cacacagagtggtct

SEQ ID NO: 1752907 - DNA, 19 bp, Homo sapiens
cacacagatcccctggaaa

SEQ ID NO: 1752908 - DNA, 13 bp, Homo sapiens
cacacagctcctc

SEQ ID NO: 1752909 - DNA, 14 bp, Homo sapiens
cacacaggacagcg

SEQ ID NO: 1752910 - DNA, 19 bp, Homo sapiens
cacacaggcaactgaggca

SEQ ID NO: 1752911 - DNA, 20 bp, Homo sapiens
cacacaggcaactgaggcag

SEQ ID NO: 1752912 - DNA, 17 bp, Homo sapiens
cacacagggcactgact

SEQ ID NO: 1752913 - DNA, 22 bp, Homo sapiens
cacacagggcccggccacaccc

SEQ ID NO: 1752914 - DNA, 23 bp, Homo sapiens
cacacagggtctgcaaggtcttt

SEQ ID NO: 1752915 - DNA, 12 bp, Homo sapiens
cacacatatata

SEQ ID NO: 1752916 - DNA, 13 bp, Homo sapiens
cacacatatatat

SEQ ID NO: 1752917 - DNA, 13 bp, Homo sapiens
cacacatcaggag

SEQ ID NO: 1752918 - DNA, 15 bp, Homo sapiens
cacacatcccaggag

SEQ ID NO: 1752919 - DNA, 16 bp, Homo sapiens
cacacatctggccctg

SEQ ID NO: 1752920 - DNA, 19 bp, Homo sapiens
cacacatctgggtgccctg

SEQ ID NO: 1752921 - DNA, 22 bp, Homo sapiens
cacacatctgggtgccctgaaa

SEQ ID NO: 1752922 - DNA, 15 bp, Homo sapiens
cacacatgaataaag

SEQ ID NO: 1752923 - DNA, 16 bp, Homo sapiens
cacaccaaccaggcct

SEQ ID NO: 1752924 - DNA, 19 bp, Homo sapiens
cacaccactgtactccagc

SEQ ID NO: 1752925 - DNA, 18 bp, Homo sapiens
cacaccagccgctgcagg

SEQ ID NO: 1752926 - DNA, 19 bp, Homo sapiens
cacaccagccgctgcaggg

SEQ ID NO: 1752927 - DNA, 13 bp, Homo sapiens
cacaccagctgct

SEQ ID NO: 1752928 - DNA, 22 bp, Homo sapiens
cacaccaggccgtcctcccggg

SEQ ID NO: 1752929 - DNA, 15 bp, Homo sapiens
cacacccaaagctga

SEQ ID NO: 1752930 - DNA, 22 bp, Homo sapiens
cacacccaaagctgagcctgca

SEQ ID NO: 1752931 - DNA, 14 bp, Homo sapiens
cacacccatttaaa

SEQ ID NO: 1752932 - DNA, 17 bp, Homo sapiens
cacaccctctcccagga

SEQ ID NO: 1752933 - DNA, 12 bp, Homo sapiens
cacaccctctgt

SEQ ID NO: 1752934 - DNA, 16 bp, Homo sapiens
cacaccctctgtgctt

SEQ ID NO: 1752935 - DNA, 21 bp, Homo sapiens
cacaccctgtactgttctgtg

SEQ ID NO: 1752936 - DNA, 14 bp, Homo sapiens
cacaccgctggtcc

SEQ ID NO: 1752937 - DNA, 17 bp, Homo sapiens
cacacctcagccccact

SEQ ID NO: 1752938 - DNA, 15 bp, Homo sapiens
cacacctcagtggga

SEQ ID NO: 1752939 - DNA, 17 bp, Homo sapiens
cacacctcagtgggaag

SEQ ID NO: 1752940 - DNA, 20 bp, Homo sapiens
cacacctcagttcccttggc

SEQ ID NO: 1752941 - DNA, 22 bp, Homo sapiens
cacacctcagttcccttggcct

SEQ ID NO: 1752942 - DNA, 16 bp, Homo sapiens
cacacctgaacttgcc

SEQ ID NO: 1752943 - DNA, 16 bp, Homo sapiens
cacacctgcagtgcca

SEQ ID NO: 1752944 - DNA, 13 bp, Homo sapiens
cacacctgcctgc

SEQ ID NO: 1752945 - DNA, 14 bp, Homo sapiens
cacacctgcctgcg

SEQ ID NO: 1752946 - DNA, 21 bp, Homo sapiens
cacacctggctaattttttgt

SEQ ID NO: 1752947 - DNA, 20 bp, Homo sapiens
cacacctgtagtcccagcta

SEQ ID NO: 1752948 - DNA, 13 bp, Homo sapiens
cacacctgtgtcc

SEQ ID NO: 1752949 - DNA, 15 bp, Homo sapiens
cacacctgtgtccaa

SEQ ID NO: 1752950 - DNA, 14 bp, Homo sapiens
cacaccttccaggg

SEQ ID NO: 1752951 - DNA, 15 bp, Homo sapiens
cacaccttccagggc

SEQ ID NO: 1752952 - DNA, 19 bp, Homo sapiens
cacacgagcaaacccagag

SEQ ID NO: 1752953 - DNA, 16 bp, Homo sapiens
cacacgagttccagac

SEQ ID NO: 1752954 - DNA, 11 bp, Homo sapiens
cacacgatgca

SEQ ID NO: 1752955 - DNA, 19 bp, Homo sapiens
cacacgatgcatttaataa

SEQ ID NO: 1752956 - DNA, 22 bp, Homo sapiens
cacacgatgcatttaataaaga

SEQ ID NO: 1752957 - DNA, 24 bp, Homo sapiens
cacacgatgcatttaataaagatg

SEQ ID NO: 1752958 - DNA, 21 bp, Homo sapiens
cacacgcacgcacacacacaa

SEQ ID NO: 1752959 - DNA, 18 bp, Homo sapiens
cacacgcactgcgcctgt

SEQ ID NO: 1752960 - DNA, 17 bp, Homo sapiens
cacacgctccctggaag

SEQ ID NO: 1752961 - DNA, 14 bp, Homo sapiens
cacacgctgcacct

SEQ ID NO: 1752962 - DNA, 20 bp, Homo sapiens
cacacggctggtcactctgc

SEQ ID NO: 1752963 - DNA, 22 bp, Homo sapiens
cacacggctggtcactctgccc

SEQ ID NO: 1752964 - DNA, 17 bp, Homo sapiens
cacacgtaccttcatgt

SEQ ID NO: 1752965 - DNA, 19 bp, Homo sapiens
cacacgtcatgtttcttca

SEQ ID NO: 1752966 - DNA, 23 bp, Homo sapiens
cacacgtttaatcccagcacttt

SEQ ID NO: 1752967 - DNA, 18 bp, Homo sapiens
cacactaatctgaaagga

SEQ ID NO: 1752968 - DNA, 17 bp, Homo sapiens
cacactagcctctccag

SEQ ID NO: 1752969 - DNA, 18 bp, Homo sapiens
cacactagcctctccagg

SEQ ID NO: 1752970 - DNA, 19 bp, Homo sapiens
cacactagcctctccagga

SEQ ID NO: 1752971 - DNA, 20 bp, Homo sapiens
cacactattaccatgagaag

SEQ ID NO: 1752972 - DNA, 13 bp, Homo sapiens
cacactccactct

SEQ ID NO: 1752973 - DNA, 15 bp, Homo sapiens
cacactccactctga

SEQ ID NO: 1752974 - DNA, 12 bp, Homo sapiens
cacactccactg

SEQ ID NO: 1752975 - DNA, 15 bp, Homo sapiens
cacactccactgaca

SEQ ID NO: 1752976 - DNA, 22 bp, Homo sapiens
cacactgaatcagctgctgact

SEQ ID NO: 1752977 - DNA, 19 bp, Homo sapiens
cacactgcaagagccttgg

SEQ ID NO: 1752978 - DNA, 23 bp, Homo sapiens
cacactgcgcaggtctcttctgg

SEQ ID NO: 1752979 - DNA, 13 bp, Homo sapiens
cacactggaatat

SEQ ID NO: 1752980 - DNA, 12 bp, Homo sapiens
cacactggccat

SEQ ID NO: 1752981 - DNA, 20 bp, Homo sapiens
cacactgggtgcgtctccag

SEQ ID NO: 1752982 - DNA, 18 bp, Homo sapiens
cacactggtttgccaggc

SEQ ID NO: 1752983 - DNA, 19 bp, Homo sapiens
cacactggtttgccaggcc

SEQ ID NO: 1752984 - DNA, 19 bp, Homo sapiens
cacactgtgtcctggtgct

SEQ ID NO: 1752985 - DNA, 15 bp, Homo sapiens
cacactgttactcca

SEQ ID NO: 1752986 - DNA, 16 bp, Homo sapiens
cacactgttactccac

SEQ ID NO: 1752987 - DNA, 15 bp, Homo sapiens
cacacttatatttta

SEQ ID NO: 1752988 - DNA, 15 bp, Homo sapiens
cacacttccccatct

SEQ ID NO: 1752989 - DNA, 16 bp, Homo sapiens
cacacttgaaaccttt

SEQ ID NO: 1752990 - DNA, 13 bp, Homo sapiens
cacacttgtgtgt

SEQ ID NO: 1752991 - DNA, 21 bp, Homo sapiens
cacacttgtgtgtgggctgtg

SEQ ID NO: 1752992 - DNA, 16 bp, Homo sapiens
cacacttgttccagct

SEQ ID NO: 1752993 - DNA, 17 bp, Homo sapiens
cacacttgttccagctc

SEQ ID NO: 1752994 - DNA, 18 bp, Homo sapiens
cacacttgttccagctct

SEQ ID NO: 1752995 - DNA, 15 bp, Homo sapiens
cacactttctggcaa

SEQ ID NO: 1752996 - DNA, 17 bp, Homo sapiens
cacactttttaagaaat

SEQ ID NO: 1752997 - DNA, 13 bp, Homo sapiens
cacagaaacacaa

SEQ ID NO: 1752998 - DNA, 18 bp, Homo sapiens
cacagaaacacaatattt

SEQ ID NO: 1752999 - DNA, 15 bp, Homo sapiens
cacagaaacactgcc

SEQ ID NO: 1753000 - DNA, 19 bp, Homo sapiens
cacagaaacctctactaaa

SEQ ID NO: 1753001 - DNA, 15 bp, Homo sapiens
cacagaaagactgag

SEQ ID NO: 1753002 - DNA, 20 bp, Homo sapiens
cacagaaatcagaggagaga

SEQ ID NO: 1753003 - DNA, 13 bp, Homo sapiens
cacagaaatgctg

SEQ ID NO: 1753004 - DNA, 17 bp, Homo sapiens
cacagaaatgctgctgg

SEQ ID NO: 1753005 - DNA, 18 bp, Homo sapiens
cacagaaatgctgctggc

SEQ ID NO: 1753006 - DNA, 19 bp, Homo sapiens
cacagaaatgctgctggcc

SEQ ID NO: 1753007 - DNA, 20 bp, Homo sapiens
cacagaaatgctgctggcca

SEQ ID NO: 1753008 - DNA, 21 bp, Homo sapiens
cacagaaatgctgctggccaa

SEQ ID NO: 1753009 - DNA, 13 bp, Homo sapiens
cacagaacccttg

SEQ ID NO: 1753010 - DNA, 16 bp, Homo sapiens
cacagaatatttttat

SEQ ID NO: 1753011 - DNA, 12 bp, Homo sapiens
cacagaatgcaa

SEQ ID NO: 1753012 - DNA, 15 bp, Homo sapiens
cacagaatgctcagg

SEQ ID NO: 1753013 - DNA, 19 bp, Homo sapiens
cacagacaagcagcccttg

SEQ ID NO: 1753014 - DNA, 14 bp, Homo sapiens
cacagacacacaca

SEQ ID NO: 1753015 - DNA, 22 bp, Homo sapiens
cacagacacacacacgcacgca

SEQ ID NO: 1753016 - DNA, 21 bp, Homo sapiens
cacagacacgctcgcgggcag

SEQ ID NO: 1753017 - DNA, 14 bp, Homo sapiens
cacagaccacctgc

SEQ ID NO: 1753018 - DNA, 22 bp, Homo sapiens
cacagaccccgggtctccttgg

SEQ ID NO: 1753019 - DNA, 14 bp, Homo sapiens
cacagacctggagc

SEQ ID NO: 1753020 - DNA, 15 bp, Homo sapiens
cacaggcccttcctc

SEQ ID NO: 1753021 - DNA, 17 bp, Homo sapiens
cacaggcccttcctctc

SEQ ID NO: 1753022 - DNA, 19 bp, Homo sapiens
cacaggcccttcctctcca

SEQ ID NO: 1753023 - DNA, 22 bp, Homo sapiens
cacaggcccttcctctccactg

SEQ ID NO: 1753024 - DNA, 18 bp, Homo sapiens
cacaggcctctgcctgct

SEQ ID NO: 1753025 - DNA, 14 bp, Homo sapiens
cacaggcctgagat

SEQ ID NO: 1753026 - DNA, 19 bp, Homo sapiens
cacaggcctgagatttcat

SEQ ID NO: 1753027 - DNA, 22 bp, Homo sapiens
cacaggctatcaacatgttatt

SEQ ID NO: 1753028 - DNA, 17 bp, Homo sapiens
cacagggagaattgaaa

SEQ ID NO: 1753029 - DNA, 20 bp, Homo sapiens
cacagggagtgcacatatcc

SEQ ID NO: 1753030 - DNA, 19 bp, Homo sapiens
cacagggcactgactgata

SEQ ID NO: 1753031 - DNA, 19 bp, Homo sapiens
cacagggccccagaaggca

SEQ ID NO: 1753032 - DNA, 15 bp, Homo sapiens
cacagggcccggcca

SEQ ID NO: 1753033 - DNA, 16 bp, Homo sapiens
cacagggctctttgat

SEQ ID NO: 1753034 - DNA, 13 bp, Homo sapiens
cacaggggcaggc

SEQ ID NO: 1753035 - DNA, 14 bp, Homo sapiens
cacaggggcaggcc

SEQ ID NO: 1753036 - DNA, 16 bp, Homo sapiens
cacaggggcaggcctg

SEQ ID NO: 1753037 - DNA, 17 bp, Homo sapiens
cacaggggcaggcctgg

SEQ ID NO: 1753038 - DNA, 23 bp, Homo sapiens
cacaggggccaccacctttggct

SEQ ID NO: 1753039 - DNA, 14 bp, Homo sapiens
cacaggggccccag

SEQ ID NO: 1753040 - DNA, 23 bp, Homo sapiens
cacaggggccccagatctgcctg

SEQ ID NO: 1753041 - DNA, 15 bp, Homo sapiens
cacaggggcggggca

SEQ ID NO: 1753042 - DNA, 21 bp, Homo sapiens
cacagggtccccgagtgccta

SEQ ID NO: 1753043 - DNA, 15 bp, Homo sapiens
cacagggtctgctct

SEQ ID NO: 1753044 - DNA, 23 bp, Homo sapiens
cacagggtctgctctttctctgc

SEQ ID NO: 1753045 - DNA, 14 bp, Homo sapiens
cacagggtgggcct

SEQ ID NO: 1753046 - DNA, 16 bp, Homo sapiens
cacagggttgggccca

SEQ ID NO: 1753047 - DNA, 18 bp, Homo sapiens
cacagggttgggcccaga

SEQ ID NO: 1753048 - DNA, 16 bp, Homo sapiens
cacagggttttgtatt

SEQ ID NO: 1753049 - DNA, 19 bp, Homo sapiens
cacaggtacagcaacagga

SEQ ID NO: 1753050 - DNA, 13 bp, Homo sapiens
cacaggtctagac

SEQ ID NO: 1753051 - DNA, 19 bp, Homo sapiens
cacaggttcatgccaccat

SEQ ID NO: 1753052 - DNA, 20 bp, Homo sapiens
cacagtaaaaacttgtacta

SEQ ID NO: 1753053 - DNA, 20 bp, Homo sapiens
cacagtacaataatgtactc

SEQ ID NO: 1753054 - DNA, 21 bp, Homo sapiens
cacagtacaataatgtactca

SEQ ID NO: 1753055 - DNA, 15 bp, Homo sapiens
cacagtacacacaaa

SEQ ID NO: 1753056 - DNA, 23 bp, Homo sapiens
cacagtacacacaaaaaccttgg

SEQ ID NO: 1753057 - DNA, 20 bp, Homo sapiens
cacagtacacaccagaagat

SEQ ID NO: 1753058 - DNA, 17 bp, Homo sapiens
cacagtaccggattctc

SEQ ID NO: 1753059 - DNA, 18 bp, Homo sapiens
cacagtaccggattctct

SEQ ID NO: 1753060 - DNA, 16 bp, Homo sapiens
cacagtactttattgt

SEQ ID NO: 1753061 - DNA, 18 bp, Homo sapiens
cacagtactttattgtac

SEQ ID NO: 1753062 - DNA, 16 bp, Homo sapiens
cacagtagagccagct

SEQ ID NO: 1753063 - DNA, 17 bp, Homo sapiens
cacagtagagccagctt

SEQ ID NO: 1753064 - DNA, 17 bp, Homo sapiens
cacagtaggaattggaa

SEQ ID NO: 1753065 - DNA, 23 bp, Homo sapiens
cacagtaggtcccggccagctct

SEQ ID NO: 1753066 - DNA, 17 bp, Homo sapiens
cacagtattatgcctga

SEQ ID NO: 1753067 - DNA, 15 bp, Homo sapiens
cacagtatttgtaat

SEQ ID NO: 1753068 - DNA, 14 bp, Homo sapiens
cacagtcagtggag

SEQ ID NO: 1753069 - DNA, 17 bp, Homo sapiens
cacagtcagtggagcct

SEQ ID NO: 1753070 - DNA, 16 bp, Homo sapiens
cacagtccaaccagaa

SEQ ID NO: 1753071 - DNA, 18 bp, Homo sapiens
cacagtccaaccagaaac

SEQ ID NO: 1753072 - DNA, 13 bp, Homo sapiens
cacagtctctgga

SEQ ID NO: 1753073 - DNA, 15 bp, Homo sapiens
cacagtgaagcaaat

SEQ ID NO: 1753074 - DNA, 15 bp, Homo sapiens
cacagtgaagtgctg

SEQ ID NO: 1753075 - DNA, 14 bp, Homo sapiens
cacagtgacactgg

SEQ ID NO: 1753076 - DNA, 14 bp, Homo sapiens
cacagtgacttcct

SEQ ID NO: 1753077 - DNA, 17 bp, Homo sapiens
cacagtgacttctgaga

SEQ ID NO: 1753078 - DNA, 11 bp, Homo sapiens
cacagtgattt

SEQ ID NO: 1753079 - DNA, 17 bp, Homo sapiens
cacagtgcatctcagcc

SEQ ID NO: 1753080 - DNA, 19 bp, Homo sapiens
cacagtgcatctcagccca

SEQ ID NO: 1753081 - DNA, 14 bp, Homo sapiens
cacagtgccaccca

SEQ ID NO: 1753082 - DNA, 19 bp, Homo sapiens
cacagtgccttcaataaat

SEQ ID NO: 1753083 - DNA, 16 bp, Homo sapiens
cacagtgctcttttct

SEQ ID NO: 1753084 - DNA, 15 bp, Homo sapiens
cacagtgctgggatt

SEQ ID NO: 1753085 - DNA, 17 bp, Homo sapiens
cacagtggactcagcag

SEQ ID NO: 1753086 - DNA, 21 bp, Homo sapiens
cacagtggactcagcagtgac

SEQ ID NO: 1753087 - DNA, 20 bp, Homo sapiens
cacagtggcacggagagaag

SEQ ID NO: 1753088 - DNA, 19 bp, Homo sapiens
cacagtgggaactctgaca

SEQ ID NO: 1753089 - DNA, 14 bp, Homo sapiens
cacagtgggagcca

SEQ ID NO: 1753090 - DNA, 20 bp, Homo sapiens
cacagtgggcctgtgtgtgt

SEQ ID NO: 1753091 - DNA, 13 bp, Homo sapiens
cacagtgggtggc

SEQ ID NO: 1753092 - DNA, 15 bp, Homo sapiens
cacagtgggtggcac

SEQ ID NO: 1753093 - DNA, 18 bp, Homo sapiens
cacagtgggtggcacctc

SEQ ID NO: 1753094 - DNA, 19 bp, Homo sapiens
cacagtggtcccatttata

SEQ ID NO: 1753095 - DNA, 18 bp, Homo sapiens
cacagtgtctgtatcgga

SEQ ID NO: 1753096 - DNA, 12 bp, Homo sapiens
cacagtgtgtga

SEQ ID NO: 1753097 - DNA, 13 bp, Homo sapiens
cacagtgtgtttg

SEQ ID NO: 1753098 - DNA, 14 bp, Homo sapiens
cacagtgttgccca

SEQ ID NO: 1753099 - DNA, 16 bp, Homo sapiens
cacagtgttggaggtt

SEQ ID NO: 1753100 - DNA, 15 bp, Homo sapiens
cacagtgttgtgccc

SEQ ID NO: 1753101 - DNA, 22 bp, Homo sapiens
cacagtgtttttattgctcgcc

SEQ ID NO: 1753102 - DNA, 13 bp, Homo sapiens
cacagttattaca

SEQ ID NO: 1753103 - DNA, 15 bp, Homo sapiens
cacagttattacata

SEQ ID NO: 1753104 - DNA, 15 bp, Homo sapiens
cacagttggccttca

SEQ ID NO: 1753105 - DNA, 22 bp, Homo sapiens
cacagttgtctattctgagcct

SEQ ID NO: 1753106 - DNA, 13 bp, Homo sapiens
cacagttttaata

SEQ ID NO: 1753107 - DNA, 14 bp, Homo sapiens
cacagttttaataa

SEQ ID NO: 1753108 - DNA, 22 bp, Homo sapiens
cacagttttaataagaacagat

SEQ ID NO: 1753109 - DNA, 15 bp, Homo sapiens
cacagttttctgaga

SEQ ID NO: 1753110 - DNA, 20 bp, Homo sapiens
cacagttttctgagaaagac

SEQ ID NO: 1753111 - DNA, 21 bp, Homo sapiens
cacagttttctgagaaagact

SEQ ID NO: 1753112 - DNA, 22 bp, Homo sapiens
cacagttttctgagaaagacta

SEQ ID NO: 1753113 - DNA, 17 bp, Homo sapiens
cacagtttttcctggaa

SEQ ID NO: 1753114 - DNA, 17 bp, Homo sapiens
cacataaaagccccagc

SEQ ID NO: 1753115 - DNA, 13 bp, Homo sapiens
cacataaatctgt

SEQ ID NO: 1753116 - DNA, 18 bp, Homo sapiens
cacataaatctgtctgat

SEQ ID NO: 1753117 - DNA, 20 bp, Homo sapiens
cacataaatctgtctgattc

SEQ ID NO: 1753118 - DNA, 22 bp, Homo sapiens
cacataaatggattaattacta

SEQ ID NO: 1753119 - DNA, 15 bp, Homo sapiens
cacataacaaagggc

SEQ ID NO: 1753120 - DNA, 18 bp, Homo sapiens
cacataacaaagggcagc

SEQ ID NO: 1753121 - DNA, 15 bp, Homo sapiens
cacataattaacact

SEQ ID NO: 1753122 - DNA, 13 bp, Homo sapiens
cacatacaacaca

SEQ ID NO: 1753123 - DNA, 20 bp, Homo sapiens
cacatacacccaaacactta

SEQ ID NO: 1753124 - DNA, 17 bp, Homo sapiens
cacatacatagatcttc

SEQ ID NO: 1753125 - DNA, 22 bp, Homo sapiens
cacataccaggcaacctcccat

SEQ ID NO: 1753126 - DNA, 13 bp, Homo sapiens
cacataccctccc

SEQ ID NO: 1753127 - DNA, 22 bp, Homo sapiens
cacataccctcttcatggatgg

SEQ ID NO: 1753128 - DNA, 18 bp, Homo sapiens
cacatacgtgcacagggt

SEQ ID NO: 1753129 - DNA, 17 bp, Homo sapiens
cacatagagctttttaa

SEQ ID NO: 1753130 - DNA, 18 bp, Homo sapiens
cacatagagctttttaat

SEQ ID NO: 1753131 - DNA, 19 bp, Homo sapiens
cacatagagctttttaata

SEQ ID NO: 1753132 - DNA, 20 bp, Homo sapiens
cacatagagctttttaatag

SEQ ID NO: 1753133 - DNA, 13 bp, Homo sapiens
cacatagattaat

SEQ ID NO: 1753134 - DNA, 20 bp, Homo sapiens
cacatagattaatggcactg

SEQ ID NO: 1753135 - DNA, 16 bp, Homo sapiens
caccatattcagtgct

SEQ ID NO: 1753136 - DNA, 15 bp, Homo sapiens
caccatcagcctgtt

SEQ ID NO: 1753137 - DNA, 22 bp, Homo sapiens
caccatccagtgggcccggaga

SEQ ID NO: 1753138 - DNA, 13 bp, Homo sapiens
caccatcctgagc

SEQ ID NO: 1753139 - DNA, 14 bp, Homo sapiens
caccatcctgagcc

SEQ ID NO: 1753140 - DNA, 20 bp, Homo sapiens
caccatcctgcagcctcctc

SEQ ID NO: 1753141 - DNA, 13 bp, Homo sapiens
caccatctgcttg

SEQ ID NO: 1753142 - DNA, 21 bp, Homo sapiens
caccatgcactcacccctagc

SEQ ID NO: 1753143 - DNA, 20 bp, Homo sapiens
caccatggtatcatatatta

SEQ ID NO: 1753144 - DNA, 23 bp, Homo sapiens
caccatggtatcatatattaaaa

SEQ ID NO: 1753145 - DNA, 15 bp, Homo sapiens
caccatgtgccatct

SEQ ID NO: 1753146 - DNA, 22 bp, Homo sapiens
caccatgtgccatctgtacata

SEQ ID NO: 1753147 - DNA, 14 bp, Homo sapiens
caccatgtgggcac

SEQ ID NO: 1753148 - DNA, 20 bp, Homo sapiens
caccatgttggccaggctgg

SEQ ID NO: 1753149 - DNA, 20 bp, Homo sapiens
caccatgttggccaggcttg

SEQ ID NO: 1753150 - DNA, 20 bp, Homo sapiens
caccattcacatttgatgta

SEQ ID NO: 1753151 - DNA, 23 bp, Homo sapiens
caccattcacatttgatgtacat

SEQ ID NO: 1753152 - DNA, 11 bp, Homo sapiens
caccattcctg

SEQ ID NO: 1753153 - DNA, 14 bp, Homo sapiens
caccattcctgcct

SEQ ID NO: 1753154 - DNA, 14 bp, Homo sapiens
caccattctcctgc

SEQ ID NO: 1753155 - DNA, 18 bp, Homo sapiens
caccattctcctgcctca

SEQ ID NO: 1753156 - DNA, 23 bp, Homo sapiens
caccattctcctgcctcaccctc

SEQ ID NO: 1753157 - DNA, 14 bp, Homo sapiens
caccattctgactc

SEQ ID NO: 1753158 - DNA, 15 bp, Homo sapiens
caccattgctggaaa

SEQ ID NO: 1753159 - DNA, 13 bp, Homo sapiens
caccattgttcat

SEQ ID NO: 1753160 - DNA, 14 bp, Homo sapiens
cacccaaaagtcaa

SEQ ID NO: 1753161 - DNA, 19 bp, Homo sapiens
cacccaaacacttctgctt

SEQ ID NO: 1753162 - DNA, 20 bp, Homo sapiens
cacccaaacacttctgcttt

SEQ ID NO: 1753163 - DNA, 23 bp, Homo sapiens
cacccaaacacttctgctttcac

SEQ ID NO: 1753164 - DNA, 16 bp, Homo sapiens
cacccaaagctgagcc

SEQ ID NO: 1753165 - DNA, 18 bp, Homo sapiens
cacccaaagctgagcctg

SEQ ID NO: 1753166 - DNA, 15 bp, Homo sapiens
cacccaaccccaagc

SEQ ID NO: 1753167 - DNA, 23 bp, Homo sapiens
cacccaaccctatctcctgacag

SEQ ID NO: 1753168 - DNA, 24 bp, Homo sapiens
cacccaaccctatctcctgacaga

SEQ ID NO: 1753169 - DNA, 22 bp, Homo sapiens
cacccaagcctgatccagcctt

SEQ ID NO: 1753170 - DNA, 15 bp, Homo sapiens
cacccaagcctgctg

SEQ ID NO: 1753171 - DNA, 17 bp, Homo sapiens
cacccaagcctgctggc

SEQ ID NO: 1753172 - DNA, 13 bp, Homo sapiens
cacccaagcttgg

SEQ ID NO: 1753173 - DNA, 15 bp, Homo sapiens
cacccaagcttggca

SEQ ID NO: 1753174 - DNA, 19 bp, Homo sapiens
cacccaagcttggcagccg

SEQ ID NO: 1753175 - DNA, 15 bp, Homo sapiens
cacccaattggccca

SEQ ID NO: 1753176 - DNA, 15 bp, Homo sapiens
cacccacacactcgc

SEQ ID NO: 1753177 - DNA, 16 bp, Homo sapiens
cacccacacagctgcc

SEQ ID NO: 1753178 - DNA, 12 bp, Homo sapiens
cacccacatgtg

SEQ ID NO: 1753179 - DNA, 21 bp, Homo sapiens
cacccacatgtgacacatatg

SEQ ID NO: 1753180 - DNA, 13 bp, Homo sapiens
cacccaccccctt

SEQ ID NO: 1753181 - DNA, 11 bp, Homo sapiens
cacccacccct

SEQ ID NO: 1753182 - DNA, 14 bp, Homo sapiens
cacccacccctgca

SEQ ID NO: 1753183 - DNA, 16 bp, Homo sapiens
cacccacccctgcaca

SEQ ID NO: 1753184 - DNA, 15 bp, Homo sapiens
cacccacccctgccc

SEQ ID NO: 1753185 - DNA, 18 bp, Homo sapiens
cacccacctgttttctga

SEQ ID NO: 1753186 - DNA, 19 bp, Homo sapiens
cacccacctgttttctgaa

SEQ ID NO: 1753187 - DNA, 22 bp, Homo sapiens
cacccacctgttttctgaaaca

SEQ ID NO: 1753188 - DNA, 23 bp, Homo sapiens
cacccacgcatacacacatgccc

SEQ ID NO: 1753189 - DNA, 23 bp, Homo sapiens
cacccacgtgagagaatctgcct

SEQ ID NO: 1753190 - DNA, 18 bp, Homo sapiens
cacccactcaccagggtc

SEQ ID NO: 1753191 - DNA, 16 bp, Homo sapiens
cacccagacagctccc

SEQ ID NO: 1753192 - DNA, 20 bp, Homo sapiens
cacccagactggaatgcagt

SEQ ID NO: 1753193 - DNA, 21 bp, Homo sapiens
cacccagagcaccccctgctc

SEQ ID NO: 1753194 - DNA, 11 bp, Homo sapiens
cacccagccca

SEQ ID NO: 1753195 - DNA, 12 bp, Homo sapiens
cacccagcccat

SEQ ID NO: 1753196 - DNA, 22 bp, Homo sapiens
cacccagcccattctctctcct

SEQ ID NO: 1753197 - DNA, 23 bp, Homo sapiens
cacccaggcctccctgcagactc

SEQ ID NO: 1753198 - DNA, 12 bp, Homo sapiens
cacccaggctgc

SEQ ID NO: 1753199 - DNA, 16 bp, Homo sapiens
cacccaggctgcactg

SEQ ID NO: 1753200 - DNA, 17 bp, Homo sapiens
cacccaggctgcactgc

SEQ ID NO: 1753201 - DNA, 19 bp, Homo sapiens
cacccaggctgcactgcag

SEQ ID NO: 1753202 - DNA, 21 bp, Homo sapiens
cacccaggctggaatgcagtg

SEQ ID NO: 1753203 - DNA, 20 bp, Homo sapiens
cacccaggctggagtgcagt

SEQ ID NO: 1753204 - DNA, 22 bp, Homo sapiens
cacccaggtcccccgactgcct

SEQ ID NO: 1753205 - DNA, 20 bp, Homo sapiens
cacccaggttggagtgcagt

SEQ ID NO: 1753206 - DNA, 15 bp, Homo sapiens
cacccagtgctgcca

SEQ ID NO: 1753207 - DNA, 16 bp, Homo sapiens
cacccagtgctgccat

SEQ ID NO: 1753208 - DNA, 19 bp, Homo sapiens
cacccagtgctgccatgcc

SEQ ID NO: 1753209 - DNA, 21 bp, Homo sapiens
cacccagtgctgccatgccac

SEQ ID NO: 1753210 - DNA, 23 bp, Homo sapiens
cacccagtgctgccatgccactg

SEQ ID NO: 1753211 - DNA, 17 bp, Homo sapiens
cacccatcttcctgctg

SEQ ID NO: 1753212 - DNA, 22 bp, Homo sapiens
cacccatgcaagcagaggacca

SEQ ID NO: 1753213 - DNA, 16 bp, Homo sapiens
cacccatgcacactca

SEQ ID NO: 1753214 - DNA, 14 bp, Homo sapiens
cacccatgccagag

SEQ ID NO: 1753215 - DNA, 13 bp, Homo sapiens
cacccatggtacc

SEQ ID NO: 1753216 - DNA, 14 bp, Homo sapiens
cacccatgtgggcg

SEQ ID NO: 1753217 - DNA, 20 bp, Homo sapiens
cacccatgtgggcgcccacc

SEQ ID NO: 1753218 - DNA, 23 bp, Homo sapiens
cacccatgtgggcgcccaccctg

SEQ ID NO: 1753219 - DNA, 14 bp, Homo sapiens
cacccattatctgg

SEQ ID NO: 1753220 - DNA, 18 bp, Homo sapiens
caccccaaagctttcctg

SEQ ID NO: 1753221 - DNA, 12 bp, Homo sapiens
caccccaactct

SEQ ID NO: 1753222 - DNA, 18 bp, Homo sapiens
caccccaactctccccag

SEQ ID NO: 1753223 - DNA, 10 bp, Homo sapiens
caccccaccc

SEQ ID NO: 1753224 - DNA, 22 bp, Homo sapiens
caccccacccccttcagtgccc

SEQ ID NO: 1753225 - DNA, 22 bp, Homo sapiens
caccccagcattccagctctgc

SEQ ID NO: 1753226 - DNA, 23 bp, Homo sapiens
caccccagcattccagctctgcc

SEQ ID NO: 1753227 - DNA, 15 bp, Homo sapiens
caccccatcccacac

SEQ ID NO: 1753228 - DNA, 15 bp, Homo sapiens
caccccatgccaaag

SEQ ID NO: 1753229 - DNA, 17 bp, Homo sapiens
caccccatgccaaagct

SEQ ID NO: 1753230 - DNA, 21 bp, Homo sapiens
caccccatgtgggtgaccagg

SEQ ID NO: 1753231 - DNA, 12 bp, Homo sapiens
cacccccaaggt

SEQ ID NO: 1753232 - DNA, 23 bp, Homo sapiens
cacccccacaagctgtccctgca

SEQ ID NO: 1753233 - DNA, 12 bp, Homo sapiens
cacccccagctc

SEQ ID NO: 1753234 - DNA, 13 bp, Homo sapiens
cacccccatccct

SEQ ID NO: 1753235 - DNA, 17 bp, Homo sapiens
cacccccatctctccct

SEQ ID NO: 1753236 - DNA, 21 bp, Homo sapiens
caccccccagaacctgtcctt

SEQ ID NO: 1753237 - DNA, 18 bp, Homo sapiens
cacccccctctctttctc

SEQ ID NO: 1753238 - DNA, 18 bp, Homo sapiens
cacccccgaccctgccct

SEQ ID NO: 1753239 - DNA, 15 bp, Homo sapiens
caccccctccccagg

SEQ ID NO: 1753240 - DNA, 17 bp, Homo sapiens
caccccctccccagggg

SEQ ID NO: 1753241 - DNA, 19 bp, Homo sapiens
caccccctccccgcccctg

SEQ ID NO: 1753242 - DNA, 14 bp, Homo sapiens
caccccctgccctg

SEQ ID NO: 1753243 - DNA, 13 bp, Homo sapiens
caccccctgctcc

SEQ ID NO: 1753244 - DNA, 19 bp, Homo sapiens
caccccctgctccaccagc

SEQ ID NO: 1753245 - DNA, 23 bp, Homo sapiens
caccccctgtcccattctagatc

SEQ ID NO: 1753246 - DNA, 12 bp, Homo sapiens
cacccccttccc

SEQ ID NO: 1753247 - DNA, 13 bp, Homo sapiens
cacccccttcccc

SEQ ID NO: 1753248 - DNA, 13 bp, Homo sapiens
cacccccttctct

SEQ ID NO: 1753249 - DNA, 13 bp, Homo sapiens
caccccctttggt

SEQ ID NO: 1753250 - DNA, 16 bp, Homo sapiens
cacgacgtcagcctct

SEQ ID NO: 1753251 - DNA, 17 bp, Homo sapiens
cacgactggccagggcc

SEQ ID NO: 1753252 - DNA, 20 bp, Homo sapiens
cacgagcaggctactgtcag

SEQ ID NO: 1753253 - DNA, 22 bp, Homo sapiens
cacgagcaggctactgtcagct

SEQ ID NO: 1753254 - DNA, 18 bp, Homo sapiens
cacgagccacaagctgca

SEQ ID NO: 1753255 - DNA, 22 bp, Homo sapiens
cacgagccacaagctgcactgt

SEQ ID NO: 1753256 - DNA, 13 bp, Homo sapiens
cacgagggctggc

SEQ ID NO: 1753257 - DNA, 17 bp, Homo sapiens
cacgagggctggctggc

SEQ ID NO: 1753258 - DNA, 21 bp, Homo sapiens
cacgagggctggctggcctca

SEQ ID NO: 1753259 - DNA, 14 bp, Homo sapiens
cacgagtcacctgc

SEQ ID NO: 1753260 - DNA, 23 bp, Homo sapiens
cacgagtcacctgcaagccccag

SEQ ID NO: 1753261 - DNA, 15 bp, Homo sapiens
cacgatcacaggcct

SEQ ID NO: 1753262 - DNA, 17 bp, Homo sapiens
cacgatcacaggccttg

SEQ ID NO: 1753263 - DNA, 12 bp, Homo sapiens
cacgatgaaaaa

SEQ ID NO: 1753264 - DNA, 15 bp, Homo sapiens
cacgatgaaaaactt

SEQ ID NO: 1753265 - DNA, 14 bp, Homo sapiens
cacgatgtggccct

SEQ ID NO: 1753266 - DNA, 16 bp, Homo sapiens
cacgatgtggccctgg

SEQ ID NO: 1753267 - DNA, 17 bp, Homo sapiens
cacgatgtggccctggc

SEQ ID NO: 1753268 - DNA, 16 bp, Homo sapiens
cacgattttcaagatt

SEQ ID NO: 1753269 - DNA, 19 bp, Homo sapiens
cacgattttcaagattcta

SEQ ID NO: 1753270 - DNA, 18 bp, Homo sapiens
cacgcaagggcatcaggc

SEQ ID NO: 1753271 - DNA, 20 bp, Homo sapiens
cacgcaagggcatcaggcac

SEQ ID NO: 1753272 - DNA, 23 bp, Homo sapiens
cacgcaagggcatcaggcactgg

SEQ ID NO: 1753273 - DNA, 13 bp, Homo sapiens
cacgcacacacac

SEQ ID NO: 1753274 - DNA, 14 bp, Homo sapiens
cacgcacacacaca

SEQ ID NO: 1753275 - DNA, 21 bp, Homo sapiens
cacgcacatgcgaccccgagg

SEQ ID NO: 1753276 - DNA, 15 bp, Homo sapiens
cacgcaccactgctt

SEQ ID NO: 1753277 - DNA, 17 bp, Homo sapiens
cacgcaccactgcttcc

SEQ ID NO: 1753278 - DNA, 22 bp, Homo sapiens
cacgcaccactgcttcccactg

SEQ ID NO: 1753279 - DNA, 16 bp, Homo sapiens
cacgcactgggccacg

SEQ ID NO: 1753280 - DNA, 20 bp, Homo sapiens
cacgcacttgcctgttggct

SEQ ID NO: 1753281 - DNA, 24 bp, Homo sapiens
cacgcacttgcctgttggctgctg

SEQ ID NO: 1753282 - DNA, 19 bp, Homo sapiens
cacgcagccaggacaccgg

SEQ ID NO: 1753283 - DNA, 15 bp, Homo sapiens
cacgcaggcacagca

SEQ ID NO: 1753284 - DNA, 19 bp, Homo sapiens
cacgcagggccatccactg

SEQ ID NO: 1753285 - DNA, 22 bp, Homo sapiens
cacgcatacacacatgccctcc

SEQ ID NO: 1753286 - DNA, 14 bp, Homo sapiens
cacgccctccctct

SEQ ID NO: 1753287 - DNA, 17 bp, Homo sapiens
cacgccgtaattctttc

SEQ ID NO: 1753288 - DNA, 21 bp, Homo sapiens
cacgccgtaattctttctgtc

SEQ ID NO: 1753289 - DNA, 18 bp, Homo sapiens
cacgcctatgatcccagc

SEQ ID NO: 1753290 - DNA, 16 bp, Homo sapiens
cacgcctgcaggctgg

SEQ ID NO: 1753291 - DNA, 18 bp, Homo sapiens
cacgcctgccatcttctc

SEQ ID NO: 1753292 - DNA, 16 bp, Homo sapiens
cacgcctggctaattt

SEQ ID NO: 1753293 - DNA, 14 bp, Homo sapiens
cacgcctgtaatcc

SEQ ID NO: 1753294 - DNA, 21 bp, Homo sapiens
cacgcctgtaatcccagcact

SEQ ID NO: 1753295 - DNA, 15 bp, Homo sapiens
cacgctcatgtcctg

SEQ ID NO: 1753296 - DNA, 18 bp, Homo sapiens
cacgctcatgtcctgtcc

SEQ ID NO: 1753297 - DNA, 19 bp, Homo sapiens
cacgctcatgtcctgtcct

SEQ ID NO: 1753298 - DNA, 21 bp, Homo sapiens
cacgctcatgtcctgtcctgg

SEQ ID NO: 1753299 - DNA, 18 bp, Homo sapiens
cacgctccagctgccccg

SEQ ID NO: 1753300 - DNA, 19 bp, Homo sapiens
cacgctccagctgccccgg

SEQ ID NO: 1753301 - DNA, 19 bp, Homo sapiens
cacgctcccccgcagtccc

SEQ ID NO: 1753302 - DNA, 15 bp, Homo sapiens
cacgctccctggaag

SEQ ID NO: 1753303 - DNA, 23 bp, Homo sapiens
cacgctcgcgggcagcgggccag

SEQ ID NO: 1753304 - DNA, 22 bp, Homo sapiens
cacgctcttgaggaagcccagg

SEQ ID NO: 1753305 - DNA, 15 bp, Homo sapiens
cacgctgcctggtct

SEQ ID NO: 1753306 - DNA, 23 bp, Homo sapiens
cacgctgttgacatcagcctgct

SEQ ID NO: 1753307 - DNA, 14 bp, Homo sapiens
cacgctttctagct

SEQ ID NO: 1753308 - DNA, 19 bp, Homo sapiens
cacgcttttaattctcatt

SEQ ID NO: 1753309 - DNA, 24 bp, Homo sapiens
cacggaaacatacagaggatgcct

SEQ ID NO: 1753310 - DNA, 22 bp, Homo sapiens
cacggagagaaggcccatacct

SEQ ID NO: 1753311 - DNA, 21 bp, Homo sapiens
cacggagcagttcagagtgga

SEQ ID NO: 1753312 - DNA, 22 bp, Homo sapiens
cacggagccgcgggacagccaa

SEQ ID NO: 1753313 - DNA, 20 bp, Homo sapiens
cacggaggagggatgctgct

SEQ ID NO: 1753314 - DNA, 23 bp, Homo sapiens
cacggagggggacggggctcagc

SEQ ID NO: 1753315 - DNA, 20 bp, Homo sapiens
cacggatggtgcatgggctc

SEQ ID NO: 1753316 - DNA, 12 bp, Homo sapiens
cacggccaccct

SEQ ID NO: 1753317 - DNA, 18 bp, Homo sapiens
cacggccccgggtccagg

SEQ ID NO: 1753318 - DNA, 16 bp, Homo sapiens
cacggccctgtcagag

SEQ ID NO: 1753319 - DNA, 12 bp, Homo sapiens
cacggctggtca

SEQ ID NO: 1753320 - DNA, 24 bp, Homo sapiens
cacggctggtcactctgccctctg

SEQ ID NO: 1753321 - DNA, 13 bp, Homo sapiens
cacggcttcactg

SEQ ID NO: 1753322 - DNA, 18 bp, Homo sapiens
cacggcttcactgaccag

SEQ ID NO: 1753323 - DNA, 14 bp, Homo sapiens
cacgggcagcctgg

SEQ ID NO: 1753324 - DNA, 22 bp, Homo sapiens
cacgggcagcctggctcccagg

SEQ ID NO: 1753325 - DNA, 21 bp, Homo sapiens
cacggggttggctgttccaga

SEQ ID NO: 1753326 - DNA, 22 bp, Homo sapiens
cacggggttggctgttccagac

SEQ ID NO: 1753327 - DNA, 22 bp, Homo sapiens
cacggtatttatagagagagac

SEQ ID NO: 1753328 - DNA, 17 bp, Homo sapiens
cacggtgactctgtcca

SEQ ID NO: 1753329 - DNA, 20 bp, Homo sapiens
cacggtgcccaaacaccagt

SEQ ID NO: 1753330 - DNA, 16 bp, Homo sapiens
cacggtgcgtggctgt

SEQ ID NO: 1753331 - DNA, 19 bp, Homo sapiens
cacggtgcgtggctgtggc

SEQ ID NO: 1753332 - DNA, 20 bp, Homo sapiens
cacggtgcgtggctgtggca

SEQ ID NO: 1753333 - DNA, 21 bp, Homo sapiens
cacggtgcgtggctgtggcac

SEQ ID NO: 1753334 - DNA, 12 bp, Homo sapiens
cacggtgtccac

SEQ ID NO: 1753335 - DNA, 15 bp, Homo sapiens
cacggtgtccaccat

SEQ ID NO: 1753336 - DNA, 23 bp, Homo sapiens
cacggtgtccaccatccccagct

SEQ ID NO: 1753337 - DNA, 18 bp, Homo sapiens
cacgtatttatatttgga

SEQ ID NO: 1753338 - DNA, 20 bp, Homo sapiens
cacgtatttcacagagcacg

SEQ ID NO: 1753339 - DNA, 14 bp, Homo sapiens
cacgtcatgggagg

SEQ ID NO: 1753340 - DNA, 23 bp, Homo sapiens
cacgtcattaaggttatgcactg

SEQ ID NO: 1753341 - DNA, 20 bp, Homo sapiens
cacgtcccagcatccctgga

SEQ ID NO: 1753342 - DNA, 22 bp, Homo sapiens
cacgtcccagcatccctggagc

SEQ ID NO: 1753343 - DNA, 13 bp, Homo sapiens
cacgtcctgagaa

SEQ ID NO: 1753344 - DNA, 14 bp, Homo sapiens
cacgtctcctcctc

SEQ ID NO: 1753345 - DNA, 22 bp, Homo sapiens
cacgtctcctcctcgaagccat

SEQ ID NO: 1753346 - DNA, 18 bp, Homo sapiens
cacgtctctgccgcctgc

SEQ ID NO: 1753347 - DNA, 14 bp, Homo sapiens
cacgtgaaatattt

SEQ ID NO: 1753348 - DNA, 20 bp, Homo sapiens
cacgtgagaatccctggcaa

SEQ ID NO: 1753349 - DNA, 21 bp, Homo sapiens
cacgtgagaatccctggcaaa

SEQ ID NO: 1753350 - DNA, 18 bp, Homo sapiens
cacgtgcaggacagctct

SEQ ID NO: 1753351 - DNA, 19 bp, Homo sapiens
cacgtgcaggacagctctt

SEQ ID NO: 1753352 - DNA, 21 bp, Homo sapiens
cacgtgcaggacagctcttga

SEQ ID NO: 1753353 - DNA, 13 bp, Homo sapiens
cacgtgccaggcc

SEQ ID NO: 1753354 - DNA, 15 bp, Homo sapiens
cacgtgccaggcccg

SEQ ID NO: 1753355 - DNA, 19 bp, Homo sapiens
cacgtggcatgtggcctgt

SEQ ID NO: 1753356 - DNA, 12 bp, Homo sapiens
cacgtggcctct

SEQ ID NO: 1753357 - DNA, 23 bp, Homo sapiens
cacgtgtatagtatctgtatata

SEQ ID NO: 1753358 - DNA, 19 bp, Homo sapiens
cacgtgtggcctgttcttc

SEQ ID NO: 1753359 - DNA, 23 bp, Homo sapiens
cacgtgttttattcctgtatgtt

SEQ ID NO: 1753360 - DNA, 17 bp, Homo sapiens
cacgtttaatcccagca

SEQ ID NO: 1753361 - DNA, 18 bp, Homo sapiens
cacgtttaatcccagcac

SEQ ID NO: 1753362 - DNA, 21 bp, Homo sapiens
cacgtttaatcccagcacttt

SEQ ID NO: 1753363 - DNA, 16 bp, Homo sapiens
cactgggcacctgcgc

SEQ ID NO: 1753364 - DNA, 23 bp, Homo sapiens
cactgggcacctgcgcacaggtg

SEQ ID NO: 1753365 - DNA, 12 bp, Homo sapiens
cactgggcagca

SEQ ID NO: 1753366 - DNA, 15 bp, Homo sapiens
cactgggccacggag

SEQ ID NO: 1753367 - DNA, 18 bp, Homo sapiens
cactgggccacggaggag

SEQ ID NO: 1753368 - DNA, 15 bp, Homo sapiens
cactgggccagccct

SEQ ID NO: 1753369 - DNA, 12 bp, Homo sapiens
cactgggcctgg

SEQ ID NO: 1753370 - DNA, 16 bp, Homo sapiens
cactggggaaaactcc

SEQ ID NO: 1753371 - DNA, 15 bp, Homo sapiens
cactgggggagggga

SEQ ID NO: 1753372 - DNA, 21 bp, Homo sapiens
cactgggggaggggacattga

SEQ ID NO: 1753373 - DNA, 20 bp, Homo sapiens
cactggggtcctggggcctc

SEQ ID NO: 1753374 - DNA, 18 bp, Homo sapiens
cactgggtctcactcctg

SEQ ID NO: 1753375 - DNA, 13 bp, Homo sapiens
cactgggtgccaa

SEQ ID NO: 1753376 - DNA, 14 bp, Homo sapiens
cactgggtggtggc

SEQ ID NO: 1753377 - DNA, 17 bp, Homo sapiens
cactgggtggtggcctg

SEQ ID NO: 1753378 - DNA, 22 bp, Homo sapiens
cactgggtggtggcctggtccc

SEQ ID NO: 1753379 - DNA, 15 bp, Homo sapiens
cactgggttgacttt

SEQ ID NO: 1753380 - DNA, 20 bp, Homo sapiens
cactggtagaccaaaataaa

SEQ ID NO: 1753381 - DNA, 18 bp, Homo sapiens
cactggtaggttgggaca

SEQ ID NO: 1753382 - DNA, 19 bp, Homo sapiens
cactggtaggttgggacac

SEQ ID NO: 1753383 - DNA, 21 bp, Homo sapiens
cactggtaggttgggacacca

SEQ ID NO: 1753384 - DNA, 14 bp, Homo sapiens
cactggtcaggtgc

SEQ ID NO: 1753385 - DNA, 20 bp, Homo sapiens
cactggtctgtttgcatttg

SEQ ID NO: 1753386 - DNA, 15 bp, Homo sapiens
cactggtgaactgag

SEQ ID NO: 1753387 - DNA, 17 bp, Homo sapiens
cactggtgccatgtcag

SEQ ID NO: 1753388 - DNA, 18 bp, Homo sapiens
cactggtggttctactga

SEQ ID NO: 1753389 - DNA, 19 bp, Homo sapiens
cactggtggtttttgctct

SEQ ID NO: 1753390 - DNA, 15 bp, Homo sapiens
cactggttgcactta

SEQ ID NO: 1753391 - DNA, 19 bp, Homo sapiens
cactggtttctcagaatcc

SEQ ID NO: 1753392 - DNA, 13 bp, Homo sapiens
cactgtaaaatgt

SEQ ID NO: 1753393 - DNA, 16 bp, Homo sapiens
cactgtaatcttaaaa

SEQ ID NO: 1753394 - DNA, 14 bp, Homo sapiens
cactgtaatgagga

SEQ ID NO: 1753395 - DNA, 18 bp, Homo sapiens
cactgtaatgaggaaaaa

SEQ ID NO: 1753396 - DNA, 15 bp, Homo sapiens
cactgtactgcatgt

SEQ ID NO: 1753397 - DNA, 18 bp, Homo sapiens
cactgtagaatgatttca

SEQ ID NO: 1753398 - DNA, 16 bp, Homo sapiens
cactgtagttctaaga

SEQ ID NO: 1753399 - DNA, 11 bp, Homo sapiens
cactgtatata

SEQ ID NO: 1753400 - DNA, 14 bp, Homo sapiens
cactgtatataaac

SEQ ID NO: 1753401 - DNA, 15 bp, Homo sapiens
cactgtatataaaca

SEQ ID NO: 1753402 - DNA, 16 bp, Homo sapiens
cactgtatgctggacg

SEQ ID NO: 1753403 - DNA, 22 bp, Homo sapiens
cactgtattagagcgccagctc

SEQ ID NO: 1753404 - DNA, 11 bp, Homo sapiens
cactgtatttt

SEQ ID NO: 1753405 - DNA, 16 bp, Homo sapiens
cactgtattttaatgt

SEQ ID NO: 1753406 - DNA, 21 bp, Homo sapiens
cactgtcaccaccctgctcat

SEQ ID NO: 1753407 - DNA, 21 bp, Homo sapiens
cactgtcactgccgacatccc

SEQ ID NO: 1753408 - DNA, 13 bp, Homo sapiens
cactgtcctgggc

SEQ ID NO: 1753409 - DNA, 14 bp, Homo sapiens
cactgtcctgggcg

SEQ ID NO: 1753410 - DNA, 15 bp, Homo sapiens
cactgtcctgggcgc

SEQ ID NO: 1753411 - DNA, 23 bp, Homo sapiens
cactgtcctgggcgccctggaag

SEQ ID NO: 1753412 - DNA, 17 bp, Homo sapiens
cactgtccttccctgcc

SEQ ID NO: 1753413 - DNA, 13 bp, Homo sapiens
cactgtctgtccc

SEQ ID NO: 1753414 - DNA, 20 bp, Homo sapiens
cactgtgaacctgggcactc

SEQ ID NO: 1753415 - DNA, 20 bp, Homo sapiens
cactgtgaagacccagcagg

SEQ ID NO: 1753416 - DNA, 23 bp, Homo sapiens
cactgtgaagacccagcaggaag

SEQ ID NO: 1753417 - DNA, 14 bp, Homo sapiens
cactgtgaaggacc

SEQ ID NO: 1753418 - DNA, 18 bp, Homo sapiens
cactgtgaatcctggcaa

SEQ ID NO: 1753419 - DNA, 19 bp, Homo sapiens
cactgtgaatcctggcaag

SEQ ID NO: 1753420 - DNA, 14 bp, Homo sapiens
cactgtgaccaggc

SEQ ID NO: 1753421 - DNA, 12 bp, Homo sapiens
cactgtgccctg

SEQ ID NO: 1753422 - DNA, 15 bp, Homo sapiens
cactgtgccctggtg

SEQ ID NO: 1753423 - DNA, 12 bp, Homo sapiens
cactgtgctcca

SEQ ID NO: 1753424 - DNA, 17 bp, Homo sapiens
cactgtgctccaacctg

SEQ ID NO: 1753425 - DNA, 12 bp, Homo sapiens
cactgtggccac

SEQ ID NO: 1753426 - DNA, 21 bp, Homo sapiens
cactgtggccacagccccctt

SEQ ID NO: 1753427 - DNA, 12 bp, Homo sapiens
cactgtggccag

SEQ ID NO: 1753428 - DNA, 15 bp, Homo sapiens
cactgtggccagagc

SEQ ID NO: 1753429 - DNA, 17 bp, Homo sapiens
cactgtggccagagctg

SEQ ID NO: 1753430 - DNA, 18 bp, Homo sapiens
cactgtggccagagctgg

SEQ ID NO: 1753431 - DNA, 23 bp, Homo sapiens
cactgtggccagtaaaatactat

SEQ ID NO: 1753432 - DNA, 17 bp, Homo sapiens
cactgtgtcctggtgct

SEQ ID NO: 1753433 - DNA, 18 bp, Homo sapiens
cactgtgtgctgactgaa

SEQ ID NO: 1753434 - DNA, 21 bp, Homo sapiens
cactgtgtgctgactgaacat

SEQ ID NO: 1753435 - DNA, 16 bp, Homo sapiens
cactgtgttactgctt

SEQ ID NO: 1753436 - DNA, 20 bp, Homo sapiens
cactgtgttactgctttgca

SEQ ID NO: 1753437 - DNA, 18 bp, Homo sapiens
cactgttaatacacagta

SEQ ID NO: 1753438 - DNA, 22 bp, Homo sapiens
cactgttaatacacagtacttt

SEQ ID NO: 1753439 - DNA, 16 bp, Homo sapiens
cactgttactccacag

SEQ ID NO: 1753440 - DNA, 18 bp, Homo sapiens
cactgttactccacagcg

SEQ ID NO: 1753441 - DNA, 15 bp, Homo sapiens
cactgttatcaaaac

SEQ ID NO: 1753442 - DNA, 21 bp, Homo sapiens
cactgttcacaaaggttttgt

SEQ ID NO: 1753443 - DNA, 19 bp, Homo sapiens
cactgttctgaaagtgact

SEQ ID NO: 1753444 - DNA, 17 bp, Homo sapiens
cactgttgaattttctc

SEQ ID NO: 1753445 - DNA, 16 bp, Homo sapiens
cactgttgagccccag

SEQ ID NO: 1753446 - DNA, 19 bp, Homo sapiens
cactgttgagccccagtgc

SEQ ID NO: 1753447 - DNA, 21 bp, Homo sapiens
cactgttgagccccagtgctg

SEQ ID NO: 1753448 - DNA, 23 bp, Homo sapiens
cactgttgcagtggcctggccgt

SEQ ID NO: 1753449 - DNA, 17 bp, Homo sapiens
cactgtttctcttgagc

SEQ ID NO: 1753450 - DNA, 18 bp, Homo sapiens
cactgtttctcttgagct

SEQ ID NO: 1753451 - DNA, 19 bp, Homo sapiens
cactgtttctcttgagctg

SEQ ID NO: 1753452 - DNA, 21 bp, Homo sapiens
cactgtttctcttgagctggc

SEQ ID NO: 1753453 - DNA, 16 bp, Homo sapiens
cacttaaaaaatgtcc

SEQ ID NO: 1753454 - DNA, 16 bp, Homo sapiens
cacttaaacagaagca

SEQ ID NO: 1753455 - DNA, 21 bp, Homo sapiens
cacttaaacgaagagttccct

SEQ ID NO: 1753456 - DNA, 15 bp, Homo sapiens
cacttaaacttgcat

SEQ ID NO: 1753457 - DNA, 21 bp, Homo sapiens
cacttaaagggtcttatgaaa

SEQ ID NO: 1753458 - DNA, 17 bp, Homo sapiens
cacttaaatttgttctt

SEQ ID NO: 1753459 - DNA, 20 bp, Homo sapiens
cacttaactataaggtgcct

SEQ ID NO: 1753460 - DNA, 21 bp, Homo sapiens
cacttaagactgtgtattcta

SEQ ID NO: 1753461 - DNA, 17 bp, Homo sapiens
cacttaaggcactctgt

SEQ ID NO: 1753462 - DNA, 12 bp, Homo sapiens
cacttaatgtat

SEQ ID NO: 1753463 - DNA, 18 bp, Homo sapiens
cacttacctagatttaca

SEQ ID NO: 1753464 - DNA, 21 bp, Homo sapiens
cacttacctgagttgaagagg

SEQ ID NO: 1753465 - DNA, 21 bp, Homo sapiens
cacttactggtaggaccaagc

SEQ ID NO: 1753466 - DNA, 21 bp, Homo sapiens
cacttagcaggcaccgccacg

SEQ ID NO: 1753467 - DNA, 15 bp, Homo sapiens
cacttagccgcaccc

SEQ ID NO: 1753468 - DNA, 22 bp, Homo sapiens
cacttagccgcaccctgcacct

SEQ ID NO: 1753469 - DNA, 17 bp, Homo sapiens
cacttaggttttgtcca

SEQ ID NO: 1753470 - DNA, 11 bp, Homo sapiens
cacttatatat

SEQ ID NO: 1753471 - DNA, 12 bp, Homo sapiens
cacttatgattt

SEQ ID NO: 1753472 - DNA, 19 bp, Homo sapiens
cacttatgttatacaatac

SEQ ID NO: 1753473 - DNA, 21 bp, Homo sapiens
cacttattggaactctgcttg

SEQ ID NO: 1753474 - DNA, 22 bp, Homo sapiens
cacttattggaactctgcttga

SEQ ID NO: 1753475 - DNA, 17 bp, Homo sapiens
cacttatttcataaaca

SEQ ID NO: 1753476 - DNA, 17 bp, Homo sapiens
cacttcaacccccagct

SEQ ID NO: 1753477 - DNA, 18 bp, Homo sapiens
cacttcacacacaggcaa

SEQ ID NO: 1753478 - DNA, 16 bp, Homo sapiens
cagaagctgctccttt

SEQ ID NO: 1753479 - DNA, 19 bp, Homo sapiens
cagaagctgttgggagaaa

SEQ ID NO: 1753480 - DNA, 22 bp, Homo sapiens
cagaagctgttgggagaaagca

SEQ ID NO: 1753481 - DNA, 23 bp, Homo sapiens
cagaaggaaagaagggggccctg

SEQ ID NO: 1753482 - DNA, 14 bp, Homo sapiens
cagaaggaatctgt

SEQ ID NO: 1753483 - DNA, 19 bp, Homo sapiens
cagaaggaatctgtgcaga

SEQ ID NO: 1753484 - DNA, 18 bp, Homo sapiens
cagaaggacggcaggagt

SEQ ID NO: 1753485 - DNA, 14 bp, Homo sapiens
cagaaggactggtg

SEQ ID NO: 1753486 - DNA, 16 bp, Homo sapiens
cagaaggactggtgcg

SEQ ID NO: 1753487 - DNA, 22 bp, Homo sapiens
cagaaggactggtgcgaccccc

SEQ ID NO: 1753488 - DNA, 20 bp, Homo sapiens
cagaaggagaaggaaggaga

SEQ ID NO: 1753489 - DNA, 14 bp, Homo sapiens
cagaaggagagtga

SEQ ID NO: 1753490 - DNA, 21 bp, Homo sapiens
cagaaggaggattcgagcatc

SEQ ID NO: 1753491 - DNA, 17 bp, Homo sapiens
cagaaggagggcagagc

SEQ ID NO: 1753492 - DNA, 21 bp, Homo sapiens
cagaaggagggcagagccatg

SEQ ID NO: 1753493 - DNA, 23 bp, Homo sapiens
cagaaggcaaagtttacagatgt

SEQ ID NO: 1753494 - DNA, 13 bp, Homo sapiens
cagaaggccaaga

SEQ ID NO: 1753495 - DNA, 18 bp, Homo sapiens
cagaaggccccagagaga

SEQ ID NO: 1753496 - DNA, 11 bp, Homo sapiens
cagaagggaat

SEQ ID NO: 1753497 - DNA, 17 bp, Homo sapiens
cagaagggaattgctca

SEQ ID NO: 1753498 - DNA, 19 bp, Homo sapiens
cagaagggggtggtgtctc

SEQ ID NO: 1753499 - DNA, 20 bp, Homo sapiens
cagaagggggtggtgtctcc

SEQ ID NO: 1753500 - DNA, 18 bp, Homo sapiens
cagaaggtaggggccgtg

SEQ ID NO: 1753501 - DNA, 13 bp, Homo sapiens
cagaagtattctt

SEQ ID NO: 1753502 - DNA, 19 bp, Homo sapiens
cagaagtctggctttgctc

SEQ ID NO: 1753503 - DNA, 21 bp, Homo sapiens
cagaagtgagctttgctgcta

SEQ ID NO: 1753504 - DNA, 13 bp, Homo sapiens
cagaagtgctctt

SEQ ID NO: 1753505 - DNA, 13 bp, Homo sapiens
cagaagtggagct

SEQ ID NO: 1753506 - DNA, 19 bp, Homo sapiens
cagaagttagtttgtatat

SEQ ID NO: 1753507 - DNA, 16 bp, Homo sapiens
cagaagtttaaatatt

SEQ ID NO: 1753508 - DNA, 22 bp, Homo sapiens
cagaagtttaaatattaagcat

SEQ ID NO: 1753509 - DNA, 19 bp, Homo sapiens
cagaataactacctcctca

SEQ ID NO: 1753510 - DNA, 21 bp, Homo sapiens
cagaataactacctcctcact

SEQ ID NO: 1753511 - DNA, 22 bp, Homo sapiens
cagaatacggaagagcaggtga

SEQ ID NO: 1753512 - DNA, 17 bp, Homo sapiens
cagaatactgggttctt

SEQ ID NO: 1753513 - DNA, 14 bp, Homo sapiens
cagaataggaaaac

SEQ ID NO: 1753514 - DNA, 18 bp, Homo sapiens
cagaataggaaaacattg

SEQ ID NO: 1753515 - DNA, 16 bp, Homo sapiens
cagaatatcatctttt

SEQ ID NO: 1753516 - DNA, 15 bp, Homo sapiens
cagaatatgacaatc

SEQ ID NO: 1753517 - DNA, 13 bp, Homo sapiens
cagaatattagcc

SEQ ID NO: 1753518 - DNA, 19 bp, Homo sapiens
cagaatatttctattgaat

SEQ ID NO: 1753519 - DNA, 14 bp, Homo sapiens
cagaatattttcaa

SEQ ID NO: 1753520 - DNA, 21 bp, Homo sapiens
cagaatatttttatatttcct

SEQ ID NO: 1753521 - DNA, 23 bp, Homo sapiens
cagaatatttttatatttccttt

SEQ ID NO: 1753522 - DNA, 13 bp, Homo sapiens
cagaatccaaaga

SEQ ID NO: 1753523 - DNA, 18 bp, Homo sapiens
cagaatccaaagatcaca

SEQ ID NO: 1753524 - DNA, 19 bp, Homo sapiens
cagaatccaagtgaacact

SEQ ID NO: 1753525 - DNA, 17 bp, Homo sapiens
cagaatctaaacgtggt

SEQ ID NO: 1753526 - DNA, 17 bp, Homo sapiens
cagaatctcaaataact

SEQ ID NO: 1753527 - DNA, 14 bp, Homo sapiens
cagaatctccatcc

SEQ ID NO: 1753528 - DNA, 13 bp, Homo sapiens
cagaatctgctgt

SEQ ID NO: 1753529 - DNA, 16 bp, Homo sapiens
cagaatctgctgttgc

SEQ ID NO: 1753530 - DNA, 17 bp, Homo sapiens
cagaatctgctgttgcc

SEQ ID NO: 1753531 - DNA, 18 bp, Homo sapiens
cagaatctgctgttgcca

SEQ ID NO: 1753532 - DNA, 20 bp, Homo sapiens
cagaatctgctgttgccata

SEQ ID NO: 1753533 - DNA, 21 bp, Homo sapiens
cagaatctgctgttgccatag

SEQ ID NO: 1753534 - DNA, 21 bp, Homo sapiens
cagaatcttgactttctgatt

SEQ ID NO: 1753535 - DNA, 22 bp, Homo sapiens
cagaatcttgactttctgattg

SEQ ID NO: 1753536 - DNA, 16 bp, Homo sapiens
cagaatcttgtatttg

SEQ ID NO: 1753537 - DNA, 13 bp, Homo sapiens
cagaatgaaaact

SEQ ID NO: 1753538 - DNA, 18 bp, Homo sapiens
cagaatgaggaataataa

SEQ ID NO: 1753539 - DNA, 17 bp, Homo sapiens
cagaatgctatttcact

SEQ ID NO: 1753540 - DNA, 15 bp, Homo sapiens
cagaatgctcctgag

SEQ ID NO: 1753541 - DNA, 20 bp, Homo sapiens
cagaatggcagtcctggagg

SEQ ID NO: 1753542 - DNA, 21 bp, Homo sapiens
cagaatgtaagtgggcccacc

SEQ ID NO: 1753543 - DNA, 20 bp, Homo sapiens
cagaatgtgttcttttctcc

SEQ ID NO: 1753544 - DNA, 15 bp, Homo sapiens
cagaatgttgtactt

SEQ ID NO: 1753545 - DNA, 18 bp, Homo sapiens
cagaatgttgtacttgaa

SEQ ID NO: 1753546 - DNA, 20 bp, Homo sapiens
cagaatgttttactgtgaaa

SEQ ID NO: 1753547 - DNA, 19 bp, Homo sapiens
cagaattaaacttttaatt

SEQ ID NO: 1753548 - DNA, 23 bp, Homo sapiens
cagaattaaacttttaattcatt

SEQ ID NO: 1753549 - DNA, 18 bp, Homo sapiens
cagaattaactataacaa

SEQ ID NO: 1753550 - DNA, 19 bp, Homo sapiens
cagaattaactataacaat

SEQ ID NO: 1753551 - DNA, 15 bp, Homo sapiens
cagaattatttttaa

SEQ ID NO: 1753552 - DNA, 12 bp, Homo sapiens
cagaattcacta

SEQ ID NO: 1753553 - DNA, 21 bp, Homo sapiens
cagaattcccttgaattgtgt

SEQ ID NO: 1753554 - DNA, 22 bp, Homo sapiens
cagaattcccttgaattgtgta

SEQ ID NO: 1753555 - DNA, 17 bp, Homo sapiens
cagaattcggtgtgctg

SEQ ID NO: 1753556 - DNA, 16 bp, Homo sapiens
cagaattctcccagcg

SEQ ID NO: 1753557 - DNA, 13 bp, Homo sapiens
cagaattctgcta

SEQ ID NO: 1753558 - DNA, 20 bp, Homo sapiens
cagaattggtaaaaacagca

SEQ ID NO: 1753559 - DNA, 20 bp, Homo sapiens
cagaattgtatctcatactg

SEQ ID NO: 1753560 - DNA, 19 bp, Homo sapiens
cagaatttaccatcatctc

SEQ ID NO: 1753561 - DNA, 22 bp, Homo sapiens
cagaatttaccatcatctctga

SEQ ID NO: 1753562 - DNA, 19 bp, Homo sapiens
cagaatttattagtttaaa

SEQ ID NO: 1753563 - DNA, 22 bp, Homo sapiens
cagaatttattagtttaaaatg

SEQ ID NO: 1753564 - DNA, 19 bp, Homo sapiens
cagaatttctttgtcattc

SEQ ID NO: 1753565 - DNA, 22 bp, Homo sapiens
cagaatttctttgtcattcaag

SEQ ID NO: 1753566 - DNA, 13 bp, Homo sapiens
cagaatttgagaa

SEQ ID NO: 1753567 - DNA, 21 bp, Homo sapiens
cagaatttgagaaccttggac

SEQ ID NO: 1753568 - DNA, 19 bp, Homo sapiens
cagaattttaatgtgaaga

SEQ ID NO: 1753569 - DNA, 24 bp, Homo sapiens
cagaattttaatgtgaagacattt

SEQ ID NO: 1753570 - DNA, 15 bp, Homo sapiens
cagaattttaggaac

SEQ ID NO: 1753571 - DNA, 23 bp, Homo sapiens
cagaattttaggaacttcagaga

SEQ ID NO: 1753572 - DNA, 14 bp, Homo sapiens
cagaattttgtata

SEQ ID NO: 1753573 - DNA, 12 bp, Homo sapiens
cagaatttttcc

SEQ ID NO: 1753574 - DNA, 18 bp, Homo sapiens
cagacaaaaacagcctca

SEQ ID NO: 1753575 - DNA, 20 bp, Homo sapiens
cagacaaaaacagcctcaca

SEQ ID NO: 1753576 - DNA, 16 bp, Homo sapiens
cagacaaaatttgaga

SEQ ID NO: 1753577 - DNA, 13 bp, Homo sapiens
cagacaacagaag

SEQ ID NO: 1753578 - DNA, 14 bp, Homo sapiens
cagacaacagaagt

SEQ ID NO: 1753579 - DNA, 17 bp, Homo sapiens
cagacaacagaagtcat

SEQ ID NO: 1753580 - DNA, 16 bp, Homo sapiens
cagacaacctcatcag

SEQ ID NO: 1753581 - DNA, 14 bp, Homo sapiens
cagacaagagctgc

SEQ ID NO: 1753582 - DNA, 19 bp, Homo sapiens
cagacaagcaacaggtttt

SEQ ID NO: 1753583 - DNA, 14 bp, Homo sapiens
cagacaagcagccc

SEQ ID NO: 1753584 - DNA, 16 bp, Homo sapiens
cagacaagcagccctt

SEQ ID NO: 1753585 - DNA, 17 bp, Homo sapiens
cagacaagcagcccttg

SEQ ID NO: 1753586 - DNA, 20 bp, Homo sapiens
cagacaagcagcccttgctt

SEQ ID NO: 1753587 - DNA, 21 bp, Homo sapiens
cagacaagtgactgtatctgt

SEQ ID NO: 1753588 - DNA, 22 bp, Homo sapiens
cagacaatatgtgagtgccttt

SEQ ID NO: 1753589 - DNA, 14 bp, Homo sapiens
cagacaattagaaa

SEQ ID NO: 1753590 - DNA, 20 bp, Homo sapiens
cagacacaacccaataggag

SEQ ID NO: 1753591 - DNA, 11 bp, Homo sapiens
cagacacacac

SEQ ID NO: 1753592 - DNA, 14 bp, Homo sapiens
cagagcctagccac

SEQ ID NO: 1753593 - DNA, 15 bp, Homo sapiens
cagagcctagccacc

SEQ ID NO: 1753594 - DNA, 17 bp, Homo sapiens
cagagcctagccacctc

SEQ ID NO: 1753595 - DNA, 19 bp, Homo sapiens
cagagcctagccacctccc

SEQ ID NO: 1753596 - DNA, 21 bp, Homo sapiens
cagagcctagccacctcccac

SEQ ID NO: 1753597 - DNA, 17 bp, Homo sapiens
cagagcctggctgccca

SEQ ID NO: 1753598 - DNA, 20 bp, Homo sapiens
cagagcctggggtgttctct

SEQ ID NO: 1753599 - DNA, 11 bp, Homo sapiens
cagagccttca

SEQ ID NO: 1753600 - DNA, 15 bp, Homo sapiens
cagagccttcaagtg

SEQ ID NO: 1753601 - DNA, 18 bp, Homo sapiens
cagagccttcaagtgcca

SEQ ID NO: 1753602 - DNA, 19 bp, Homo sapiens
cagagccttcaagtgccaa

SEQ ID NO: 1753603 - DNA, 13 bp, Homo sapiens
cagagccttctca

SEQ ID NO: 1753604 - DNA, 15 bp, Homo sapiens
cagagcgcacaggga

SEQ ID NO: 1753605 - DNA, 14 bp, Homo sapiens
cagagcgtccttcc

SEQ ID NO: 1753606 - DNA, 17 bp, Homo sapiens
cagagcgtccttccccc

SEQ ID NO: 1753607 - DNA, 19 bp, Homo sapiens
cagagctaaactccttcct

SEQ ID NO: 1753608 - DNA, 20 bp, Homo sapiens
cagagctaaactccttcctg

SEQ ID NO: 1753609 - DNA, 15 bp, Homo sapiens
cagagctactgagac

SEQ ID NO: 1753610 - DNA, 18 bp, Homo sapiens
cagagctactgagacttg

SEQ ID NO: 1753611 - DNA, 14 bp, Homo sapiens
cagagctaggcccc

SEQ ID NO: 1753612 - DNA, 20 bp, Homo sapiens
cagagctcatcccccctgct

SEQ ID NO: 1753613 - DNA, 24 bp, Homo sapiens
cagagctcatcccccctgctgccc

SEQ ID NO: 1753614 - DNA, 12 bp, Homo sapiens
cagagctctctc

SEQ ID NO: 1753615 - DNA, 17 bp, Homo sapiens
cagagctctctctacag

SEQ ID NO: 1753616 - DNA, 21 bp, Homo sapiens
cagagctctgggttgtgcaca

SEQ ID NO: 1753617 - DNA, 17 bp, Homo sapiens
cagagctcttcaagctg

SEQ ID NO: 1753618 - DNA, 20 bp, Homo sapiens
cagagctcttcaagctgtcc

SEQ ID NO: 1753619 - DNA, 21 bp, Homo sapiens
cagagctcttcaagctgtccc

SEQ ID NO: 1753620 - DNA, 14 bp, Homo sapiens
cagagctgaacctt

SEQ ID NO: 1753621 - DNA, 13 bp, Homo sapiens
cagagctgagggc

SEQ ID NO: 1753622 - DNA, 22 bp, Homo sapiens
cagagctgagggccctgtggag

SEQ ID NO: 1753623 - DNA, 14 bp, Homo sapiens
cagagctggaaggc

SEQ ID NO: 1753624 - DNA, 23 bp, Homo sapiens
cagagctggaaggcagggcagag

SEQ ID NO: 1753625 - DNA, 12 bp, Homo sapiens
cagagctgtgcc

SEQ ID NO: 1753626 - DNA, 18 bp, Homo sapiens
cagagctgtgccagcagg

SEQ ID NO: 1753627 - DNA, 20 bp, Homo sapiens
cagagctgtgcctgctcagc

SEQ ID NO: 1753628 - DNA, 20 bp, Homo sapiens
cagagctgtttatggcctca

SEQ ID NO: 1753629 - DNA, 17 bp, Homo sapiens
cagagcttattggccac

SEQ ID NO: 1753630 - DNA, 18 bp, Homo sapiens
cagagcttctctgggctg

SEQ ID NO: 1753631 - DNA, 20 bp, Homo sapiens
cagagcttctctgggctgaa

SEQ ID NO: 1753632 - DNA, 21 bp, Homo sapiens
cagagcttctctgggctgaat

SEQ ID NO: 1753633 - DNA, 15 bp, Homo sapiens
cagagcttgaagcct

SEQ ID NO: 1753634 - DNA, 15 bp, Homo sapiens
cagagctttggtctg

SEQ ID NO: 1753635 - DNA, 17 bp, Homo sapiens
cagagctttggtctgtg

SEQ ID NO: 1753636 - DNA, 21 bp, Homo sapiens
cagaggaacaagcatgtctct

SEQ ID NO: 1753637 - DNA, 14 bp, Homo sapiens
cagaggaagagcag

SEQ ID NO: 1753638 - DNA, 16 bp, Homo sapiens
cagaggaatcctggca

SEQ ID NO: 1753639 - DNA, 17 bp, Homo sapiens
cagaggaatcctggcag

SEQ ID NO: 1753640 - DNA, 18 bp, Homo sapiens
cagaggaatcctggcagc

SEQ ID NO: 1753641 - DNA, 21 bp, Homo sapiens
cagaggaatcctggcagccca

SEQ ID NO: 1753642 - DNA, 22 bp, Homo sapiens
cagaggaatcctggcagcccag

SEQ ID NO: 1753643 - DNA, 18 bp, Homo sapiens
cagaggaatgtagggcct

SEQ ID NO: 1753644 - DNA, 21 bp, Homo sapiens
cagaggaatgtagggcctgca

SEQ ID NO: 1753645 - DNA, 22 bp, Homo sapiens
cagaggacagtatttgtgggga

SEQ ID NO: 1753646 - DNA, 15 bp, Homo sapiens
cagaggaccagggcc

SEQ ID NO: 1753647 - DNA, 19 bp, Homo sapiens
cagaggactcccaaccctg

SEQ ID NO: 1753648 - DNA, 22 bp, Homo sapiens
cagaggactcccaaccctggct

SEQ ID NO: 1753649 - DNA, 23 bp, Homo sapiens
cagaggagagtcccagagcagga

SEQ ID NO: 1753650 - DNA, 18 bp, Homo sapiens
cagaggagccaccagttc

SEQ ID NO: 1753651 - DNA, 14 bp, Homo sapiens
cagaggagcctttt

SEQ ID NO: 1753652 - DNA, 22 bp, Homo sapiens
cagaggagcctttttaaaacac

SEQ ID NO: 1753653 - DNA, 18 bp, Homo sapiens
cagaggatgccttttctg

SEQ ID NO: 1753654 - DNA, 20 bp, Homo sapiens
cagaggatgccttttctgtg

SEQ ID NO: 1753655 - DNA, 21 bp, Homo sapiens
cagaggatgccttttctgtga

SEQ ID NO: 1753656 - DNA, 22 bp, Homo sapiens
cagaggatgccttttctgtgat

SEQ ID NO: 1753657 - DNA, 19 bp, Homo sapiens
cagaggatgctctttccca

SEQ ID NO: 1753658 - DNA, 20 bp, Homo sapiens
cagaggatgctctttcccag

SEQ ID NO: 1753659 - DNA, 13 bp, Homo sapiens
cagaggcacctca

SEQ ID NO: 1753660 - DNA, 13 bp, Homo sapiens
cagaggcagaggt

SEQ ID NO: 1753661 - DNA, 21 bp, Homo sapiens
cagaggcagcccgcacacctg

SEQ ID NO: 1753662 - DNA, 14 bp, Homo sapiens
cagaggccatggca

SEQ ID NO: 1753663 - DNA, 24 bp, Homo sapiens
cagaggcccccagcccagggctcc

SEQ ID NO: 1753664 - DNA, 13 bp, Homo sapiens
cagaggccctgga

SEQ ID NO: 1753665 - DNA, 16 bp, Homo sapiens
cagaggccctggaggt

SEQ ID NO: 1753666 - DNA, 20 bp, Homo sapiens
cagaggccgaaggtgcctca

SEQ ID NO: 1753667 - DNA, 23 bp, Homo sapiens
cagaggccgaaggtgcctcagac

SEQ ID NO: 1753668 - DNA, 12 bp, Homo sapiens
cagaggcctccc

SEQ ID NO: 1753669 - DNA, 23 bp, Homo sapiens
cagaggcctgggggacccctggc

SEQ ID NO: 1753670 - DNA, 20 bp, Homo sapiens
cagaggcgtactacccagct

SEQ ID NO: 1753671 - DNA, 16 bp, Homo sapiens
cagaggctaagatgag

SEQ ID NO: 1753672 - DNA, 13 bp, Homo sapiens
cagaggctgaggt

SEQ ID NO: 1753673 - DNA, 12 bp, Homo sapiens
cagaggctgcag

SEQ ID NO: 1753674 - DNA, 15 bp, Homo sapiens
cagaggctgcaggac

SEQ ID NO: 1753675 - DNA, 13 bp, Homo sapiens
cagaggctggagg

SEQ ID NO: 1753676 - DNA, 19 bp, Homo sapiens
cagaggctggaggcagggc

SEQ ID NO: 1753677 - DNA, 21 bp, Homo sapiens
cagaggctggaggcagggcct

SEQ ID NO: 1753678 - DNA, 19 bp, Homo sapiens
cagagggaatgttccctgc

SEQ ID NO: 1753679 - DNA, 21 bp, Homo sapiens
cagagggaatgttccctgcac

SEQ ID NO: 1753680 - DNA, 13 bp, Homo sapiens
cagagggacaggg

SEQ ID NO: 1753681 - DNA, 20 bp, Homo sapiens
cagagggactgtcagctgag

SEQ ID NO: 1753682 - DNA, 21 bp, Homo sapiens
cagagggactgtcagctgagc

SEQ ID NO: 1753683 - DNA, 19 bp, Homo sapiens
cagagggactttgtataga

SEQ ID NO: 1753684 - DNA, 13 bp, Homo sapiens
cagagggagctgt

SEQ ID NO: 1753685 - DNA, 12 bp, Homo sapiens
cagagggcacat

SEQ ID NO: 1753686 - DNA, 15 bp, Homo sapiens
cagagggcagtggcc

SEQ ID NO: 1753687 - DNA, 20 bp, Homo sapiens
cagagggccagcaggctcct

SEQ ID NO: 1753688 - DNA, 21 bp, Homo sapiens
cagagggccagcaggctcctg

SEQ ID NO: 1753689 - DNA, 18 bp, Homo sapiens
cagagggcccaggcaggc

SEQ ID NO: 1753690 - DNA, 22 bp, Homo sapiens
cagagggcccaggcaggccacc

SEQ ID NO: 1753691 - DNA, 14 bp, Homo sapiens
cagagggcctggac

SEQ ID NO: 1753692 - DNA, 14 bp, Homo sapiens
cagagggctaggga

SEQ ID NO: 1753693 - DNA, 17 bp, Homo sapiens
cagagggctggaggccc

SEQ ID NO: 1753694 - DNA, 21 bp, Homo sapiens
cagagggctggaggcccaggc

SEQ ID NO: 1753695 - DNA, 23 bp, Homo sapiens
cagaggggaaaccagtgtagcct

SEQ ID NO: 1753696 - DNA, 15 bp, Homo sapiens
cagaggggcagccgc

SEQ ID NO: 1753697 - DNA, 18 bp, Homo sapiens
cagaggggcagccgctag

SEQ ID NO: 1753698 - DNA, 18 bp, Homo sapiens
cagaggggctttctggag

SEQ ID NO: 1753699 - DNA, 19 bp, Homo sapiens
cagaggggctttctggaga

SEQ ID NO: 1753700 - DNA, 20 bp, Homo sapiens
cagagggggagtagccaagc

SEQ ID NO: 1753701 - DNA, 16 bp, Homo sapiens
cagaggtcgcagctac

SEQ ID NO: 1753702 - DNA, 19 bp, Homo sapiens
cagaggtcgcagctaccct

SEQ ID NO: 1753703 - DNA, 16 bp, Homo sapiens
cagaggtctgtgctga

SEQ ID NO: 1753704 - DNA, 22 bp, Homo sapiens
cagaggtgaaattccagatgag

SEQ ID NO: 1753705 - DNA, 14 bp, Homo sapiens
cagaggtgcaagac

SEQ ID NO: 1753706 - DNA, 17 bp, Homo sapiens
cagcacaaacacacctc

SEQ ID NO: 1753707 - DNA, 23 bp, Homo sapiens
cagcacaaacacacctctgccac

SEQ ID NO: 1753708 - DNA, 18 bp, Homo sapiens
cagcacaaggccttgcct

SEQ ID NO: 1753709 - DNA, 16 bp, Homo sapiens
cagcacacacagtgga

SEQ ID NO: 1753710 - DNA, 20 bp, Homo sapiens
cagcacacacttcacaaagc

SEQ ID NO: 1753711 - DNA, 17 bp, Homo sapiens
cagcacaccaagtggct

SEQ ID NO: 1753712 - DNA, 18 bp, Homo sapiens
cagcacaccaagtggctg

SEQ ID NO: 1753713 - DNA, 14 bp, Homo sapiens
cagcacaccagccg

SEQ ID NO: 1753714 - DNA, 15 bp, Homo sapiens
cagcacaccagccgc

SEQ ID NO: 1753715 - DNA, 18 bp, Homo sapiens
cagcacaccagccgctgc

SEQ ID NO: 1753716 - DNA, 19 bp, Homo sapiens
cagcacaccagccgctgca

SEQ ID NO: 1753717 - DNA, 20 bp, Homo sapiens
cagcacaccagccgctgcag

SEQ ID NO: 1753718 - DNA, 15 bp, Homo sapiens
cagcacacctcagcc

SEQ ID NO: 1753719 - DNA, 21 bp, Homo sapiens
cagcacacctcagccccactg

SEQ ID NO: 1753720 - DNA, 14 bp, Homo sapiens
cagcacacctgtgt

SEQ ID NO: 1753721 - DNA, 21 bp, Homo sapiens
cagcacacctgtgtccaagaa

SEQ ID NO: 1753722 - DNA, 14 bp, Homo sapiens
cagcacactctcct

SEQ ID NO: 1753723 - DNA, 13 bp, Homo sapiens
cagcacagcttga

SEQ ID NO: 1753724 - DNA, 16 bp, Homo sapiens
cagcacagcttgacct

SEQ ID NO: 1753725 - DNA, 17 bp, Homo sapiens
cagcacagcttgacctg

SEQ ID NO: 1753726 - DNA, 14 bp, Homo sapiens
cagcacaggggccc

SEQ ID NO: 1753727 - DNA, 17 bp, Homo sapiens
cagcacaggggccccag

SEQ ID NO: 1753728 - DNA, 16 bp, Homo sapiens
cagcacagtaggtccc

SEQ ID NO: 1753729 - DNA, 16 bp, Homo sapiens
cagcacatcacctctt

SEQ ID NO: 1753730 - DNA, 16 bp, Homo sapiens
cagcacatgcgggctc

SEQ ID NO: 1753731 - DNA, 20 bp, Homo sapiens
cagcacatgcgggctcgccc

SEQ ID NO: 1753732 - DNA, 21 bp, Homo sapiens
cagcacatggccatagaggcc

SEQ ID NO: 1753733 - DNA, 23 bp, Homo sapiens
cagcacatggccatagaggccca

SEQ ID NO: 1753734 - DNA, 20 bp, Homo sapiens
cagcacattcgggaccaata

SEQ ID NO: 1753735 - DNA, 22 bp, Homo sapiens
cagcaccacctacacaggagtc

SEQ ID NO: 1753736 - DNA, 16 bp, Homo sapiens
cagcaccccttccatg

SEQ ID NO: 1753737 - DNA, 13 bp, Homo sapiens
cagcaccctgggt

SEQ ID NO: 1753738 - DNA, 14 bp, Homo sapiens
cagcaccctgggtg

SEQ ID NO: 1753739 - DNA, 17 bp, Homo sapiens
cagcaccgggggagagg

SEQ ID NO: 1753740 - DNA, 18 bp, Homo sapiens
cagcaccgggggagaggg

SEQ ID NO: 1753741 - DNA, 23 bp, Homo sapiens
cagcacctcacctgagacctcca

SEQ ID NO: 1753742 - DNA, 16 bp, Homo sapiens
cagcacctccaggcct

SEQ ID NO: 1753743 - DNA, 18 bp, Homo sapiens
cagcaccttggcccagga

SEQ ID NO: 1753744 - DNA, 13 bp, Homo sapiens
cagcaccttgtgc

SEQ ID NO: 1753745 - DNA, 17 bp, Homo sapiens
cagcactaaagcagtgg

SEQ ID NO: 1753746 - DNA, 11 bp, Homo sapiens
cagcactactc

SEQ ID NO: 1753747 - DNA, 13 bp, Homo sapiens
cagcactcagcct

SEQ ID NO: 1753748 - DNA, 21 bp, Homo sapiens
cagcactccccagagctgtgc

SEQ ID NO: 1753749 - DNA, 22 bp, Homo sapiens
cagcactccccagagctgtgcc

SEQ ID NO: 1753750 - DNA, 21 bp, Homo sapiens
cagcactctctaaatcttcct

SEQ ID NO: 1753751 - DNA, 11 bp, Homo sapiens
cagcactgagg

SEQ ID NO: 1753752 - DNA, 12 bp, Homo sapiens
cagcactggagg

SEQ ID NO: 1753753 - DNA, 20 bp, Homo sapiens
cagcactggaggggcccacc

SEQ ID NO: 1753754 - DNA, 22 bp, Homo sapiens
cagcactggtgaactgagctgg

SEQ ID NO: 1753755 - DNA, 13 bp, Homo sapiens
cagcactgtccct

SEQ ID NO: 1753756 - DNA, 18 bp, Homo sapiens
cagcactgtcccttgcct

SEQ ID NO: 1753757 - DNA, 20 bp, Homo sapiens
cagcactgtcccttgcctca

SEQ ID NO: 1753758 - DNA, 23 bp, Homo sapiens
cagcactgtctcagtttcacttt

SEQ ID NO: 1753759 - DNA, 11 bp, Homo sapiens
cagcactgtga

SEQ ID NO: 1753760 - DNA, 22 bp, Homo sapiens
cagcactgtgaagacccagcag

SEQ ID NO: 1753761 - DNA, 12 bp, Homo sapiens
cagcactgtgag

SEQ ID NO: 1753762 - DNA, 23 bp, Homo sapiens
cagcacttgggggttcaggcccg

SEQ ID NO: 1753763 - DNA, 19 bp, Homo sapiens
cagcactttgagaggctga

SEQ ID NO: 1753764 - DNA, 19 bp, Homo sapiens
cagcactttgggaggcagg

SEQ ID NO: 1753765 - DNA, 18 bp, Homo sapiens
cagcactttgggaggcca

SEQ ID NO: 1753766 - DNA, 20 bp, Homo sapiens
cagcactttgggaggccaag

SEQ ID NO: 1753767 - DNA, 23 bp, Homo sapiens
cagcactttgggaggccaaggag

SEQ ID NO: 1753768 - DNA, 22 bp, Homo sapiens
cagcactttgggaggctgaggc

SEQ ID NO: 1753769 - DNA, 23 bp, Homo sapiens
cagcactttgggaggctgaggtg

SEQ ID NO: 1753770 - DNA, 17 bp, Homo sapiens
cagcagaacctgcacac

SEQ ID NO: 1753771 - DNA, 15 bp, Homo sapiens
cagcagaagacaaaa

SEQ ID NO: 1753772 - DNA, 19 bp, Homo sapiens
cagcagaatggaggcaggg

SEQ ID NO: 1753773 - DNA, 16 bp, Homo sapiens
cagcagacagagccag

SEQ ID NO: 1753774 - DNA, 18 bp, Homo sapiens
cagcagacagagccagga

SEQ ID NO: 1753775 - DNA, 23 bp, Homo sapiens
cagcagaggacagtctggagaag

SEQ ID NO: 1753776 - DNA, 22 bp, Homo sapiens
cagcagaggcccagatattaga

SEQ ID NO: 1753777 - DNA, 23 bp, Homo sapiens
cagcagagggggagtagccaagc

SEQ ID NO: 1753778 - DNA, 20 bp, Homo sapiens
cagcagagttattgaatctt

SEQ ID NO: 1753779 - DNA, 18 bp, Homo sapiens
cagcagatcccagctcac

SEQ ID NO: 1753780 - DNA, 21 bp, Homo sapiens
cagcagatcccagctcacgtc

SEQ ID NO: 1753781 - DNA, 15 bp, Homo sapiens
cagcagcaaattttc

SEQ ID NO: 1753782 - DNA, 16 bp, Homo sapiens
cagcagcacacctcag

SEQ ID NO: 1753783 - DNA, 19 bp, Homo sapiens
cagcagcacacctcagccc

SEQ ID NO: 1753784 - DNA, 19 bp, Homo sapiens
cagcagcaccaaccacagc

SEQ ID NO: 1753785 - DNA, 15 bp, Homo sapiens
cagcagcagagaacc

SEQ ID NO: 1753786 - DNA, 13 bp, Homo sapiens
cagcagcagcagg

SEQ ID NO: 1753787 - DNA, 15 bp, Homo sapiens
cagcagcagcccaag

SEQ ID NO: 1753788 - DNA, 12 bp, Homo sapiens
cagcagcaggtg

SEQ ID NO: 1753789 - DNA, 12 bp, Homo sapiens
cagcagccagca

SEQ ID NO: 1753790 - DNA, 15 bp, Homo sapiens
cagcagccagcacca

SEQ ID NO: 1753791 - DNA, 18 bp, Homo sapiens
cagcagccagcaccacct

SEQ ID NO: 1753792 - DNA, 14 bp, Homo sapiens
cagcagccagctct

SEQ ID NO: 1753793 - DNA, 17 bp, Homo sapiens
cagcagccagctctcag

SEQ ID NO: 1753794 - DNA, 20 bp, Homo sapiens
cagcagccagctctcagcca

SEQ ID NO: 1753795 - DNA, 21 bp, Homo sapiens
cagcagccagggacccccaga

SEQ ID NO: 1753796 - DNA, 22 bp, Homo sapiens
cagcagccagggacccccagaa

SEQ ID NO: 1753797 - DNA, 11 bp, Homo sapiens
cagcagccagt

SEQ ID NO: 1753798 - DNA, 20 bp, Homo sapiens
cagcagccagtctcagagac

SEQ ID NO: 1753799 - DNA, 21 bp, Homo sapiens
cagcagccagtctcagagacc

SEQ ID NO: 1753800 - DNA, 21 bp, Homo sapiens
cagcagccatcataggaaggg

SEQ ID NO: 1753801 - DNA, 12 bp, Homo sapiens
cagcagcccagc

SEQ ID NO: 1753802 - DNA, 19 bp, Homo sapiens
cagcagcccatggcctctg

SEQ ID NO: 1753803 - DNA, 23 bp, Homo sapiens
cagcagcccatggcctctggcca

SEQ ID NO: 1753804 - DNA, 12 bp, Homo sapiens
cagcagcccccc

SEQ ID NO: 1753805 - DNA, 16 bp, Homo sapiens
cagcagccctaaggat

SEQ ID NO: 1753806 - DNA, 20 bp, Homo sapiens
cagcagccctaaggatctct

SEQ ID NO: 1753807 - DNA, 24 bp, Homo sapiens
cagcagccctaaggatctctcagg

SEQ ID NO: 1753808 - DNA, 11 bp, Homo sapiens
cagcagccctc

SEQ ID NO: 1753809 - DNA, 13 bp, Homo sapiens
cagcagccctcct

SEQ ID NO: 1753810 - DNA, 18 bp, Homo sapiens
cagcagccctcctcaccc

SEQ ID NO: 1753811 - DNA, 21 bp, Homo sapiens
cagcagccgccttaagctgat

SEQ ID NO: 1753812 - DNA, 22 bp, Homo sapiens
cagcagccgccttaagctgatc

SEQ ID NO: 1753813 - DNA, 17 bp, Homo sapiens
cagcagcctcgcacagg

SEQ ID NO: 1753814 - DNA, 13 bp, Homo sapiens
cagcagcctgtat

SEQ ID NO: 1753815 - DNA, 14 bp, Homo sapiens
cagcagcctgtatg

SEQ ID NO: 1753816 - DNA, 21 bp, Homo sapiens
cagcagcgcgcaggcctgcgt

SEQ ID NO: 1753817 - DNA, 15 bp, Homo sapiens
cagcagctaggactg

SEQ ID NO: 1753818 - DNA, 19 bp, Homo sapiens
cagcagctaggactgagga

SEQ ID NO: 1753819 - DNA, 22 bp, Homo sapiens
cagcagctcaacctaccctggt

SEQ ID NO: 1753820 - DNA, 17 bp, Homo sapiens
cagccagccagtcttgc

SEQ ID NO: 1753821 - DNA, 12 bp, Homo sapiens
cagccagcccag

SEQ ID NO: 1753822 - DNA, 14 bp, Homo sapiens
cagccagcccagcc

SEQ ID NO: 1753823 - DNA, 19 bp, Homo sapiens
cagccagccggtgcctggc

SEQ ID NO: 1753824 - DNA, 20 bp, Homo sapiens
cagccagccggtgcctggcg

SEQ ID NO: 1753825 - DNA, 14 bp, Homo sapiens
cagccagcctcaga

SEQ ID NO: 1753826 - DNA, 19 bp, Homo sapiens
cagccagcctcagaaggcc

SEQ ID NO: 1753827 - DNA, 22 bp, Homo sapiens
cagccagcctcagaaggcccca

SEQ ID NO: 1753828 - DNA, 18 bp, Homo sapiens
cagccagcgtcccttggt

SEQ ID NO: 1753829 - DNA, 11 bp, Homo sapiens
cagccaggaca

SEQ ID NO: 1753830 - DNA, 14 bp, Homo sapiens
cagccaggagcaga

SEQ ID NO: 1753831 - DNA, 12 bp, Homo sapiens
cagccaggcaga

SEQ ID NO: 1753832 - DNA, 23 bp, Homo sapiens
cagccaggccaacagcacctccc

SEQ ID NO: 1753833 - DNA, 12 bp, Homo sapiens
cagccaggcggg

SEQ ID NO: 1753834 - DNA, 15 bp, Homo sapiens
cagccaggcgggctc

SEQ ID NO: 1753835 - DNA, 12 bp, Homo sapiens
cagccaggctcc

SEQ ID NO: 1753836 - DNA, 13 bp, Homo sapiens
cagccaggctcct

SEQ ID NO: 1753837 - DNA, 21 bp, Homo sapiens
cagccaggctcctacctgtct

SEQ ID NO: 1753838 - DNA, 12 bp, Homo sapiens
cagccaggctgc

SEQ ID NO: 1753839 - DNA, 16 bp, Homo sapiens
cagccaggctgccaag

SEQ ID NO: 1753840 - DNA, 15 bp, Homo sapiens
cagccagggaccccc

SEQ ID NO: 1753841 - DNA, 17 bp, Homo sapiens
cagccagggacccccag

SEQ ID NO: 1753842 - DNA, 13 bp, Homo sapiens
cagccaggtgcat

SEQ ID NO: 1753843 - DNA, 15 bp, Homo sapiens
cagccagtctcagag

SEQ ID NO: 1753844 - DNA, 20 bp, Homo sapiens
cagccagtctcagagaccag

SEQ ID NO: 1753845 - DNA, 17 bp, Homo sapiens
cagccagtctcagatgc

SEQ ID NO: 1753846 - DNA, 16 bp, Homo sapiens
cagccagtcttgccta

SEQ ID NO: 1753847 - DNA, 18 bp, Homo sapiens
cagccagtcttgcctagg

SEQ ID NO: 1753848 - DNA, 19 bp, Homo sapiens
cagccagtcttgcctaggc

SEQ ID NO: 1753849 - DNA, 21 bp, Homo sapiens
cagccagtcttgcctaggcca

SEQ ID NO: 1753850 - DNA, 17 bp, Homo sapiens
cagccagtggcacagga

SEQ ID NO: 1753851 - DNA, 18 bp, Homo sapiens
cagccatagacctacaga

SEQ ID NO: 1753852 - DNA, 18 bp, Homo sapiens
cagccatcataggaaggg

SEQ ID NO: 1753853 - DNA, 13 bp, Homo sapiens
cagccatctgccc

SEQ ID NO: 1753854 - DNA, 15 bp, Homo sapiens
cagccatctgcccag

SEQ ID NO: 1753855 - DNA, 17 bp, Homo sapiens
cagccatctgcccaggg

SEQ ID NO: 1753856 - DNA, 18 bp, Homo sapiens
cagccatctgcccagggg

SEQ ID NO: 1753857 - DNA, 14 bp, Homo sapiens
cagccatgcctcat

SEQ ID NO: 1753858 - DNA, 16 bp, Homo sapiens
cagccatgcctcatgc

SEQ ID NO: 1753859 - DNA, 22 bp, Homo sapiens
cagccatttccccctcctcaga

SEQ ID NO: 1753860 - DNA, 19 bp, Homo sapiens
cagcccaaaacccagggca

SEQ ID NO: 1753861 - DNA, 16 bp, Homo sapiens
cagcccaaaatttgat

SEQ ID NO: 1753862 - DNA, 24 bp, Homo sapiens
cagcccacattggattcatcagca

SEQ ID NO: 1753863 - DNA, 17 bp, Homo sapiens
cagcccaccaccctggc

SEQ ID NO: 1753864 - DNA, 14 bp, Homo sapiens
cagcccaccctgct

SEQ ID NO: 1753865 - DNA, 16 bp, Homo sapiens
cagcccaccctgctgc

SEQ ID NO: 1753866 - DNA, 18 bp, Homo sapiens
cagcccaccctgctgctg

SEQ ID NO: 1753867 - DNA, 16 bp, Homo sapiens
cagcccacggtctgga

SEQ ID NO: 1753868 - DNA, 11 bp, Homo sapiens
cagcccagaga

SEQ ID NO: 1753869 - DNA, 19 bp, Homo sapiens
cagcccagagccacctgga

SEQ ID NO: 1753870 - DNA, 15 bp, Homo sapiens
cagcccagagcctgg

SEQ ID NO: 1753871 - DNA, 15 bp, Homo sapiens
cagcccagcacctgc

SEQ ID NO: 1753872 - DNA, 21 bp, Homo sapiens
cagcccagcacctgctcccag

SEQ ID NO: 1753873 - DNA, 15 bp, Homo sapiens
cagcccagccacgga

SEQ ID NO: 1753874 - DNA, 13 bp, Homo sapiens
cagcccagccagg

SEQ ID NO: 1753875 - DNA, 15 bp, Homo sapiens
cagcccagcccagct

SEQ ID NO: 1753876 - DNA, 13 bp, Homo sapiens
cagcccagctggc

SEQ ID NO: 1753877 - DNA, 16 bp, Homo sapiens
cagcccagggctcctg

SEQ ID NO: 1753878 - DNA, 19 bp, Homo sapiens
cagcccagggctcctgcac

SEQ ID NO: 1753879 - DNA, 12 bp, Homo sapiens
cagcccatccat

SEQ ID NO: 1753880 - DNA, 18 bp, Homo sapiens
cagcccatccattaggcc

SEQ ID NO: 1753881 - DNA, 16 bp, Homo sapiens
cagcccatgcccacct

SEQ ID NO: 1753882 - DNA, 15 bp, Homo sapiens
cagcccatggccccc

SEQ ID NO: 1753883 - DNA, 20 bp, Homo sapiens
cagcccatggcccccaataa

SEQ ID NO: 1753884 - DNA, 22 bp, Homo sapiens
cagcccatggcccccaataaag

SEQ ID NO: 1753885 - DNA, 21 bp, Homo sapiens
cagcccattctctctcctgtc

SEQ ID NO: 1753886 - DNA, 14 bp, Homo sapiens
cagcccattgctgc

SEQ ID NO: 1753887 - DNA, 19 bp, Homo sapiens
cagcccattgctgccaagg

SEQ ID NO: 1753888 - DNA, 16 bp, Homo sapiens
cagccccaacctccca

SEQ ID NO: 1753889 - DNA, 12 bp, Homo sapiens
cagccccaccca

SEQ ID NO: 1753890 - DNA, 14 bp, Homo sapiens
cagccccacccagg

SEQ ID NO: 1753891 - DNA, 15 bp, Homo sapiens
cagccccacccagga

SEQ ID NO: 1753892 - DNA, 17 bp, Homo sapiens
cagccccaccctggcct

SEQ ID NO: 1753893 - DNA, 20 bp, Homo sapiens
cagccccactgccagcagca

SEQ ID NO: 1753894 - DNA, 13 bp, Homo sapiens
cagccccacttca

SEQ ID NO: 1753895 - DNA, 19 bp, Homo sapiens
cagccccacttcaccccca

SEQ ID NO: 1753896 - DNA, 13 bp, Homo sapiens
cagcccccaccag

SEQ ID NO: 1753897 - DNA, 22 bp, Homo sapiens
cagcccccgggccgctggctgg

SEQ ID NO: 1753898 - DNA, 15 bp, Homo sapiens
cagccccctccagct

SEQ ID NO: 1753899 - DNA, 14 bp, Homo sapiens
cagccccctgtggc

SEQ ID NO: 1753900 - DNA, 14 bp, Homo sapiens
cagcccccttgccc

SEQ ID NO: 1753901 - DNA, 15 bp, Homo sapiens
cagccccgacttcct

SEQ ID NO: 1753902 - DNA, 20 bp, Homo sapiens
cagccccggtggctgggcag

SEQ ID NO: 1753903 - DNA, 14 bp, Homo sapiens
cagcccctactgct

SEQ ID NO: 1753904 - DNA, 15 bp, Homo sapiens
cagcccctactgctg

SEQ ID NO: 1753905 - DNA, 21 bp, Homo sapiens
cagcccctcaaagggagagaa

SEQ ID NO: 1753906 - DNA, 12 bp, Homo sapiens
cagcccctcctc

SEQ ID NO: 1753907 - DNA, 16 bp, Homo sapiens
cagcccctcctctgcc

SEQ ID NO: 1753908 - DNA, 22 bp, Homo sapiens
cagcccctcctctgccacctcc

SEQ ID NO: 1753909 - DNA, 16 bp, Homo sapiens
cagcccctctggtcgc

SEQ ID NO: 1753910 - DNA, 21 bp, Homo sapiens
cagcccctctggtcgctcctg

SEQ ID NO: 1753911 - DNA, 18 bp, Homo sapiens
cagcccctcttggagaag

SEQ ID NO: 1753912 - DNA, 20 bp, Homo sapiens
cagcccctcttggagaagtc

SEQ ID NO: 1753913 - DNA, 12 bp, Homo sapiens
cagcccctgccc

SEQ ID NO: 1753914 - DNA, 23 bp, Homo sapiens
cagcccctgcccctcatgccaac

SEQ ID NO: 1753915 - DNA, 13 bp, Homo sapiens
cagcccctgtccc

SEQ ID NO: 1753916 - DNA, 14 bp, Homo sapiens
cagcccctgtccca

SEQ ID NO: 1753917 - DNA, 19 bp, Homo sapiens
cagccccttctggccggtg

SEQ ID NO: 1753918 - DNA, 14 bp, Homo sapiens
cagcccgcctgccg

SEQ ID NO: 1753919 - DNA, 14 bp, Homo sapiens
cagcccggacctct

SEQ ID NO: 1753920 - DNA, 18 bp, Homo sapiens
cagcccggacctctggag

SEQ ID NO: 1753921 - DNA, 22 bp, Homo sapiens
cagcccggacctctggagtgcc

SEQ ID NO: 1753922 - DNA, 15 bp, Homo sapiens
cagcccggaccttgg

SEQ ID NO: 1753923 - DNA, 14 bp, Homo sapiens
cagcccggcctgct

SEQ ID NO: 1753924 - DNA, 14 bp, Homo sapiens
cagcccggctggtt

SEQ ID NO: 1753925 - DNA, 14 bp, Homo sapiens
cagcccggggagga

SEQ ID NO: 1753926 - DNA, 15 bp, Homo sapiens
cagcccggggaggaa

SEQ ID NO: 1753927 - DNA, 23 bp, Homo sapiens
cagcccgtgaagcagtgcctcga

SEQ ID NO: 1753928 - DNA, 18 bp, Homo sapiens
cagccctaaggatctctc

SEQ ID NO: 1753929 - DNA, 22 bp, Homo sapiens
cagccctaaggatctctcagga

SEQ ID NO: 1753930 - DNA, 22 bp, Homo sapiens
cagccctagaggcgagccaggc

SEQ ID NO: 1753931 - DNA, 14 bp, Homo sapiens
cagccctcacccct

SEQ ID NO: 1753932 - DNA, 16 bp, Homo sapiens
cagccctcacctctga

SEQ ID NO: 1753933 - DNA, 17 bp, Homo sapiens
cagccctccctgcccct

SEQ ID NO: 1753934 - DNA, 22 bp, Homo sapiens
cagccctccctgcccctccctt

SEQ ID NO: 1753935 - DNA, 15 bp, Homo sapiens
cagccctccctgtcc

SEQ ID NO: 1753936 - DNA, 16 bp, Homo sapiens
cagctactcagaagcc

SEQ ID NO: 1753937 - DNA, 19 bp, Homo sapiens
cagctactcagaagcctga

SEQ ID NO: 1753938 - DNA, 13 bp, Homo sapiens
cagctactcagga

SEQ ID NO: 1753939 - DNA, 17 bp, Homo sapiens
cagctactcaggaggct

SEQ ID NO: 1753940 - DNA, 18 bp, Homo sapiens
cagctactcaggaggctg

SEQ ID NO: 1753941 - DNA, 19 bp, Homo sapiens
cagctactcaggaggctga

SEQ ID NO: 1753942 - DNA, 18 bp, Homo sapiens
cagctactctgtccaggc

SEQ ID NO: 1753943 - DNA, 23 bp, Homo sapiens
cagctactctgtccaggccactg

SEQ ID NO: 1753944 - DNA, 14 bp, Homo sapiens
cagctactggaatg

SEQ ID NO: 1753945 - DNA, 21 bp, Homo sapiens
cagctacttcctcctccccac

SEQ ID NO: 1753946 - DNA, 22 bp, Homo sapiens
cagctacttctgggaaaaacaa

SEQ ID NO: 1753947 - DNA, 17 bp, Homo sapiens
cagctacttggtttgtg

SEQ ID NO: 1753948 - DNA, 13 bp, Homo sapiens
cagctagactgga

SEQ ID NO: 1753949 - DNA, 18 bp, Homo sapiens
cagctagactggagtgag

SEQ ID NO: 1753950 - DNA, 20 bp, Homo sapiens
cagctaggaagagcaggact

SEQ ID NO: 1753951 - DNA, 21 bp, Homo sapiens
cagctaggaagagcaggactc

SEQ ID NO: 1753952 - DNA, 19 bp, Homo sapiens
cagctaggtggggcctaga

SEQ ID NO: 1753953 - DNA, 21 bp, Homo sapiens
cagctagttggggagctaagg

SEQ ID NO: 1753954 - DNA, 14 bp, Homo sapiens
cagctataattctg

SEQ ID NO: 1753955 - DNA, 18 bp, Homo sapiens
cagctataattctgttat

SEQ ID NO: 1753956 - DNA, 15 bp, Homo sapiens
cagctatatttgatt

SEQ ID NO: 1753957 - DNA, 21 bp, Homo sapiens
cagctatatttgattatgtat

SEQ ID NO: 1753958 - DNA, 24 bp, Homo sapiens
cagctatcgaacttcacaactagg

SEQ ID NO: 1753959 - DNA, 15 bp, Homo sapiens
cagctatgggagccc

SEQ ID NO: 1753960 - DNA, 21 bp, Homo sapiens
cagctatgggagccccagggt

SEQ ID NO: 1753961 - DNA, 22 bp, Homo sapiens
cagctcaagtcttccctgatca

SEQ ID NO: 1753962 - DNA, 23 bp, Homo sapiens
cagctcacaccctaccttcccca

SEQ ID NO: 1753963 - DNA, 24 bp, Homo sapiens
cagctcacaccctaccttccccag

SEQ ID NO: 1753964 - DNA, 13 bp, Homo sapiens
cagctcacagtgc

SEQ ID NO: 1753965 - DNA, 16 bp, Homo sapiens
cagctcacctctgaag

SEQ ID NO: 1753966 - DNA, 20 bp, Homo sapiens
cagctcacgtaatgcattgc

SEQ ID NO: 1753967 - DNA, 20 bp, Homo sapiens
cagctcactgctgctgcctc

SEQ ID NO: 1753968 - DNA, 22 bp, Homo sapiens
cagctcactgctgctgcctctg

SEQ ID NO: 1753969 - DNA, 14 bp, Homo sapiens
cagctcagaggccc

SEQ ID NO: 1753970 - DNA, 13 bp, Homo sapiens
cagctcagctgcc

SEQ ID NO: 1753971 - DNA, 16 bp, Homo sapiens
cagctcagctgcccat

SEQ ID NO: 1753972 - DNA, 17 bp, Homo sapiens
cagctcagctgcccatc

SEQ ID NO: 1753973 - DNA, 21 bp, Homo sapiens
cagctcagctgcccatcccag

SEQ ID NO: 1753974 - DNA, 12 bp, Homo sapiens
cagctcaggaca

SEQ ID NO: 1753975 - DNA, 16 bp, Homo sapiens
cagctcaggacagatg

SEQ ID NO: 1753976 - DNA, 19 bp, Homo sapiens
cagctcaggacagatgcca

SEQ ID NO: 1753977 - DNA, 18 bp, Homo sapiens
cagctcagtcccatcaga

SEQ ID NO: 1753978 - DNA, 14 bp, Homo sapiens
cagctcattaaact

SEQ ID NO: 1753979 - DNA, 16 bp, Homo sapiens
cagctcattaaacttt

SEQ ID NO: 1753980 - DNA, 22 bp, Homo sapiens
cagctcattataatgtcattaa

SEQ ID NO: 1753981 - DNA, 17 bp, Homo sapiens
cagctccaacctgcaaa

SEQ ID NO: 1753982 - DNA, 14 bp, Homo sapiens
cagctccagctgct

SEQ ID NO: 1753983 - DNA, 20 bp, Homo sapiens
cagctccagggaatccaagc

SEQ ID NO: 1753984 - DNA, 12 bp, Homo sapiens
cagctcccaccc

SEQ ID NO: 1753985 - DNA, 20 bp, Homo sapiens
cagctcccaccccaccccct

SEQ ID NO: 1753986 - DNA, 22 bp, Homo sapiens
cagctcccaccccacccccttc

SEQ ID NO: 1753987 - DNA, 13 bp, Homo sapiens
cagctcccactcc

SEQ ID NO: 1753988 - DNA, 13 bp, Homo sapiens
cagctcccaggcc

SEQ ID NO: 1753989 - DNA, 16 bp, Homo sapiens
cagctcccagggtgga

SEQ ID NO: 1753990 - DNA, 17 bp, Homo sapiens
cagctccccaggactca

SEQ ID NO: 1753991 - DNA, 20 bp, Homo sapiens
cagctcccctcggagaagag

SEQ ID NO: 1753992 - DNA, 22 bp, Homo sapiens
cagctcccctcggagaagagct

SEQ ID NO: 1753993 - DNA, 20 bp, Homo sapiens
cagctcccgctgtggccgca

SEQ ID NO: 1753994 - DNA, 13 bp, Homo sapiens
cagctccctcctg

SEQ ID NO: 1753995 - DNA, 14 bp, Homo sapiens
cagctccctcctgc

SEQ ID NO: 1753996 - DNA, 15 bp, Homo sapiens
cagctccctcctgca

SEQ ID NO: 1753997 - DNA, 18 bp, Homo sapiens
cagctccctcctgcacac

SEQ ID NO: 1753998 - DNA, 21 bp, Homo sapiens
cagctccgagctgtaggagag

SEQ ID NO: 1753999 - DNA, 21 bp, Homo sapiens
cagctcctcctcttggagctg

SEQ ID NO: 1754000 - DNA, 21 bp, Homo sapiens
cagctcctctccttgggctcc

SEQ ID NO: 1754001 - DNA, 22 bp, Homo sapiens
cagctcctctccttgggctcct

SEQ ID NO: 1754002 - DNA, 23 bp, Homo sapiens
cagctcctctccttgggctcctg

SEQ ID NO: 1754003 - DNA, 12 bp, Homo sapiens
cagctcctctta

SEQ ID NO: 1754004 - DNA, 13 bp, Homo sapiens
cagctcctgaata

SEQ ID NO: 1754005 - DNA, 16 bp, Homo sapiens
cagctcctgggcagct

SEQ ID NO: 1754006 - DNA, 19 bp, Homo sapiens
cagctcctgggcagcttga

SEQ ID NO: 1754007 - DNA, 22 bp, Homo sapiens
cagctcgctggctttctctctg

SEQ ID NO: 1754008 - DNA, 18 bp, Homo sapiens
cagctcgtgtgtcctcat

SEQ ID NO: 1754009 - DNA, 15 bp, Homo sapiens
cagctctactggtct

SEQ ID NO: 1754010 - DNA, 13 bp, Homo sapiens
cagctctcagcca

SEQ ID NO: 1754011 - DNA, 21 bp, Homo sapiens
cagctctccccaggcatttgc

SEQ ID NO: 1754012 - DNA, 14 bp, Homo sapiens
cagctctccctctg

SEQ ID NO: 1754013 - DNA, 15 bp, Homo sapiens
cagctctccctctgg

SEQ ID NO: 1754014 - DNA, 16 bp, Homo sapiens
cagctctccctctggc

SEQ ID NO: 1754015 - DNA, 19 bp, Homo sapiens
cagctctccctctggccct

SEQ ID NO: 1754016 - DNA, 12 bp, Homo sapiens
cagctctctgac

SEQ ID NO: 1754017 - DNA, 17 bp, Homo sapiens
cagctctctgccctgtg

SEQ ID NO: 1754018 - DNA, 19 bp, Homo sapiens
cagctctctgccctgtgta

SEQ ID NO: 1754019 - DNA, 21 bp, Homo sapiens
cagctctctgccctgtgtact

SEQ ID NO: 1754020 - DNA, 22 bp, Homo sapiens
cagctctgacatcccttcctgg

SEQ ID NO: 1754021 - DNA, 13 bp, Homo sapiens
cagctctgagaca

SEQ ID NO: 1754022 - DNA, 12 bp, Homo sapiens
cagctctgcccc

SEQ ID NO: 1754023 - DNA, 15 bp, Homo sapiens
cagctctgcccccgc

SEQ ID NO: 1754024 - DNA, 23 bp, Homo sapiens
cagctctgcccccgcgggttcta

SEQ ID NO: 1754025 - DNA, 13 bp, Homo sapiens
cagctctggagaa

SEQ ID NO: 1754026 - DNA, 15 bp, Homo sapiens
cagctctggagaaca

SEQ ID NO: 1754027 - DNA, 16 bp, Homo sapiens
cagctctggagaacag

SEQ ID NO: 1754028 - DNA, 18 bp, Homo sapiens
cagctctggaggggaggg

SEQ ID NO: 1754029 - DNA, 12 bp, Homo sapiens
cagctctggagt

SEQ ID NO: 1754030 - DNA, 22 bp, Homo sapiens
cagctctgtggcctgtgtccag

SEQ ID NO: 1754031 - DNA, 21 bp, Homo sapiens
cagctcttctcagtgtctgaa

SEQ ID NO: 1754032 - DNA, 13 bp, Homo sapiens
cagctcttctctt

SEQ ID NO: 1754033 - DNA, 15 bp, Homo sapiens
cagctcttctcttcc

SEQ ID NO: 1754034 - DNA, 20 bp, Homo sapiens
cagctcttgatttgggtgga

SEQ ID NO: 1754035 - DNA, 15 bp, Homo sapiens
cagctcttgctctct

SEQ ID NO: 1754036 - DNA, 15 bp, Homo sapiens
cagctcttggcccct

SEQ ID NO: 1754037 - DNA, 17 bp, Homo sapiens
cagctcttggcccctgt

SEQ ID NO: 1754038 - DNA, 20 bp, Homo sapiens
cagctcttggcccctgtgtg

SEQ ID NO: 1754039 - DNA, 22 bp, Homo sapiens
cagctcttggcccctgtgtgag

SEQ ID NO: 1754040 - DNA, 15 bp, Homo sapiens
cagctctttccaaat

SEQ ID NO: 1754041 - DNA, 19 bp, Homo sapiens
cagctctttccaaattaaa

SEQ ID NO: 1754042 - DNA, 22 bp, Homo sapiens
cagctctttgaaatagtctgtg

SEQ ID NO: 1754043 - DNA, 17 bp, Homo sapiens
cagctgaaattgaaaag

SEQ ID NO: 1754044 - DNA, 14 bp, Homo sapiens
cagctgacatcttg

SEQ ID NO: 1754045 - DNA, 16 bp, Homo sapiens
cagctgacctttgtca

SEQ ID NO: 1754046 - DNA, 19 bp, Homo sapiens
cagctgactgtggccccct

SEQ ID NO: 1754047 - DNA, 14 bp, Homo sapiens
cagctgagcttgag

SEQ ID NO: 1754048 - DNA, 17 bp, Homo sapiens
cagctgagcttgagctc

SEQ ID NO: 1754049 - DNA, 23 bp, Homo sapiens
cagctgagtgaaaaatctgtgga

SEQ ID NO: 1754050 - DNA, 20 bp, Homo sapiens
caggacctctgtaggcagca

SEQ ID NO: 1754051 - DNA, 19 bp, Homo sapiens
caggactccaggcccaagg

SEQ ID NO: 1754052 - DNA, 21 bp, Homo sapiens
caggactccaggcccaaggct

SEQ ID NO: 1754053 - DNA, 19 bp, Homo sapiens
caggactccctcctcacct

SEQ ID NO: 1754054 - DNA, 23 bp, Homo sapiens
caggactccctcctcacctctgg

SEQ ID NO: 1754055 - DNA, 15 bp, Homo sapiens
caggactgaggacag

SEQ ID NO: 1754056 - DNA, 13 bp, Homo sapiens
caggactgggcca

SEQ ID NO: 1754057 - DNA, 15 bp, Homo sapiens
caggactgggccact

SEQ ID NO: 1754058 - DNA, 16 bp, Homo sapiens
caggactgggccactt

SEQ ID NO: 1754059 - DNA, 13 bp, Homo sapiens
caggactgggtct

SEQ ID NO: 1754060 - DNA, 20 bp, Homo sapiens
caggactgtaaagatttgtt

SEQ ID NO: 1754061 - DNA, 13 bp, Homo sapiens
caggactgttgtg

SEQ ID NO: 1754062 - DNA, 20 bp, Homo sapiens
caggacttaacggctccagg

SEQ ID NO: 1754063 - DNA, 23 bp, Homo sapiens
caggacttaacggctccaggatt

SEQ ID NO: 1754064 - DNA, 19 bp, Homo sapiens
caggacttctgcctgaacc

SEQ ID NO: 1754065 - DNA, 16 bp, Homo sapiens
caggacttgaaagaaa

SEQ ID NO: 1754066 - DNA, 23 bp, Homo sapiens
caggacttggtctgatttcagga

SEQ ID NO: 1754067 - DNA, 16 bp, Homo sapiens
caggagaagagaggaa

SEQ ID NO: 1754068 - DNA, 15 bp, Homo sapiens
caggagaagctcagc

SEQ ID NO: 1754069 - DNA, 17 bp, Homo sapiens
caggagaagctcagctg

SEQ ID NO: 1754070 - DNA, 15 bp, Homo sapiens
caggagaagtgctcc

SEQ ID NO: 1754071 - DNA, 18 bp, Homo sapiens
caggagaagtgctccctg

SEQ ID NO: 1754072 - DNA, 19 bp, Homo sapiens
caggagaatagcttttact

SEQ ID NO: 1754073 - DNA, 15 bp, Homo sapiens
caggagacctccagc

SEQ ID NO: 1754074 - DNA, 16 bp, Homo sapiens
caggagacctccagct

SEQ ID NO: 1754075 - DNA, 19 bp, Homo sapiens
caggagactgggctctggc

SEQ ID NO: 1754076 - DNA, 18 bp, Homo sapiens
caggagagactgagcagc

SEQ ID NO: 1754077 - DNA, 21 bp, Homo sapiens
caggagagagccaggatgccc

SEQ ID NO: 1754078 - DNA, 22 bp, Homo sapiens
caggagagtgcagatctgtgct

SEQ ID NO: 1754079 - DNA, 22 bp, Homo sapiens
caggagagtgtgtgggcagggt

SEQ ID NO: 1754080 - DNA, 20 bp, Homo sapiens
caggagatggaagttgcagt

SEQ ID NO: 1754081 - DNA, 16 bp, Homo sapiens
caggagatggagggct

SEQ ID NO: 1754082 - DNA, 18 bp, Homo sapiens
caggagatggagggcttg

SEQ ID NO: 1754083 - DNA, 20 bp, Homo sapiens
caggagatggagggcttggc

SEQ ID NO: 1754084 - DNA, 15 bp, Homo sapiens
caggagcacaggcag

SEQ ID NO: 1754085 - DNA, 23 bp, Homo sapiens
caggagcacaggcagctggatga

SEQ ID NO: 1754086 - DNA, 13 bp, Homo sapiens
caggagcagaaga

SEQ ID NO: 1754087 - DNA, 12 bp, Homo sapiens
caggagcagcag

SEQ ID NO: 1754088 - DNA, 21 bp, Homo sapiens
caggagcagcagccagcacca

SEQ ID NO: 1754089 - DNA, 24 bp, Homo sapiens
caggagcagcagccagcaccacct

SEQ ID NO: 1754090 - DNA, 21 bp, Homo sapiens
caggagcagctgtgctgcacc

SEQ ID NO: 1754091 - DNA, 12 bp, Homo sapiens
caggagcagctt

SEQ ID NO: 1754092 - DNA, 22 bp, Homo sapiens
caggagccaaatgaccgagccc

SEQ ID NO: 1754093 - DNA, 15 bp, Homo sapiens
caggagccccgccac

SEQ ID NO: 1754094 - DNA, 14 bp, Homo sapiens
caggagcccctggg

SEQ ID NO: 1754095 - DNA, 16 bp, Homo sapiens
caggagcctaccccct

SEQ ID NO: 1754096 - DNA, 13 bp, Homo sapiens
caggagcctagcg

SEQ ID NO: 1754097 - DNA, 19 bp, Homo sapiens
caggagcctagcggagccc

SEQ ID NO: 1754098 - DNA, 20 bp, Homo sapiens
caggagcctagcggagccca

SEQ ID NO: 1754099 - DNA, 15 bp, Homo sapiens
caggagcctgtgcct

SEQ ID NO: 1754100 - DNA, 22 bp, Homo sapiens
caggagccttcctttctcctgc

SEQ ID NO: 1754101 - DNA, 23 bp, Homo sapiens
caggagccttcctttctcctgcc

SEQ ID NO: 1754102 - DNA, 24 bp, Homo sapiens
caggagccttcctttctcctgccc

SEQ ID NO: 1754103 - DNA, 13 bp, Homo sapiens
caggagcgcaaga

SEQ ID NO: 1754104 - DNA, 19 bp, Homo sapiens
caggagctagcccagtccc

SEQ ID NO: 1754105 - DNA, 14 bp, Homo sapiens
caggagctcctgga

SEQ ID NO: 1754106 - DNA, 16 bp, Homo sapiens
caggagctctgcgcca

SEQ ID NO: 1754107 - DNA, 17 bp, Homo sapiens
caggagctctgcgccag

SEQ ID NO: 1754108 - DNA, 18 bp, Homo sapiens
caggagctctgcgccagg

SEQ ID NO: 1754109 - DNA, 21 bp, Homo sapiens
caggagctctgcgccaggcag

SEQ ID NO: 1754110 - DNA, 22 bp, Homo sapiens
caggagctctgcgccaggcaga

SEQ ID NO: 1754111 - DNA, 20 bp, Homo sapiens
caggagctcttcaggcctcc

SEQ ID NO: 1754112 - DNA, 19 bp, Homo sapiens
caggagctgagtcacctcc

SEQ ID NO: 1754113 - DNA, 22 bp, Homo sapiens
caggagctgcccagagttgctg

SEQ ID NO: 1754114 - DNA, 23 bp, Homo sapiens
caggagctgggcagaaggccaag

SEQ ID NO: 1754115 - DNA, 17 bp, Homo sapiens
caggagctttggaccta

SEQ ID NO: 1754116 - DNA, 18 bp, Homo sapiens
caggaggcaggaccttcg

SEQ ID NO: 1754117 - DNA, 12 bp, Homo sapiens
caggaggcaggc

SEQ ID NO: 1754118 - DNA, 23 bp, Homo sapiens
caggaggcaggcatggccctggg

SEQ ID NO: 1754119 - DNA, 16 bp, Homo sapiens
caggaggccccaggct

SEQ ID NO: 1754120 - DNA, 19 bp, Homo sapiens
caggaggccccaggctgag

SEQ ID NO: 1754121 - DNA, 23 bp, Homo sapiens
caggaggccccaggctgagagcc

SEQ ID NO: 1754122 - DNA, 16 bp, Homo sapiens
caggaggcccctggcc

SEQ ID NO: 1754123 - DNA, 17 bp, Homo sapiens
caggaggcccctggccc

SEQ ID NO: 1754124 - DNA, 20 bp, Homo sapiens
caggaggccctggtcctggc

SEQ ID NO: 1754125 - DNA, 21 bp, Homo sapiens
caggaggcccttgtcgtggga

SEQ ID NO: 1754126 - DNA, 22 bp, Homo sapiens
caggaggcgcccttggcttctg

SEQ ID NO: 1754127 - DNA, 20 bp, Homo sapiens
caggaggcggcccggccagc

SEQ ID NO: 1754128 - DNA, 17 bp, Homo sapiens
caggaggctgagacagg

SEQ ID NO: 1754129 - DNA, 18 bp, Homo sapiens
caggaggctgagacagga

SEQ ID NO: 1754130 - DNA, 19 bp, Homo sapiens
caggaggctgagacaggag

SEQ ID NO: 1754131 - DNA, 13 bp, Homo sapiens
caggaggctgagg

SEQ ID NO: 1754132 - DNA, 20 bp, Homo sapiens
caggaggctgaggcagaaga

SEQ ID NO: 1754133 - DNA, 19 bp, Homo sapiens
caggaggctgaggcaggag

SEQ ID NO: 1754134 - DNA, 15 bp, Homo sapiens
caggaggctgagggg

SEQ ID NO: 1754135 - DNA, 21 bp, Homo sapiens
caggaggcttggaaagcatca

SEQ ID NO: 1754136 - DNA, 11 bp, Homo sapiens
caggagggagg

SEQ ID NO: 1754137 - DNA, 12 bp, Homo sapiens
caggagggaggt

SEQ ID NO: 1754138 - DNA, 18 bp, Homo sapiens
caggagggccagcgctgt

SEQ ID NO: 1754139 - DNA, 16 bp, Homo sapiens
caggagggtgacgccc

SEQ ID NO: 1754140 - DNA, 21 bp, Homo sapiens
caggagggtgacgcccagctc

SEQ ID NO: 1754141 - DNA, 22 bp, Homo sapiens
caggagggtgacgcccagctcc

SEQ ID NO: 1754142 - DNA, 23 bp, Homo sapiens
caggagggtgacgcccagctccg

SEQ ID NO: 1754143 - DNA, 15 bp, Homo sapiens
caggaggtggagaaa

SEQ ID NO: 1754144 - DNA, 20 bp, Homo sapiens
caggaggtggaggttgcagt

SEQ ID NO: 1754145 - DNA, 21 bp, Homo sapiens
caggaggttggtgactgaaac

SEQ ID NO: 1754146 - DNA, 14 bp, Homo sapiens
caggagtaaaagag

SEQ ID NO: 1754147 - DNA, 14 bp, Homo sapiens
caggagtccctgcc

SEQ ID NO: 1754148 - DNA, 20 bp, Homo sapiens
caggagtctgccacttgtca

SEQ ID NO: 1754149 - DNA, 16 bp, Homo sapiens
caggagtctgtgctct

SEQ ID NO: 1754150 - DNA, 21 bp, Homo sapiens
caggagtcttcagacccagag

SEQ ID NO: 1754151 - DNA, 13 bp, Homo sapiens
caggagtgccagg

SEQ ID NO: 1754152 - DNA, 19 bp, Homo sapiens
caggagtgtcctgcccatg

SEQ ID NO: 1754153 - DNA, 23 bp, Homo sapiens
caggagtgtcctgcccatgcccc

SEQ ID NO: 1754154 - DNA, 19 bp, Homo sapiens
caggagttcgaggctgcag

SEQ ID NO: 1754155 - DNA, 21 bp, Homo sapiens
caggagttgtgtctaggctgg

SEQ ID NO: 1754156 - DNA, 22 bp, Homo sapiens
caggagtttaagaccagcctgg

SEQ ID NO: 1754157 - DNA, 17 bp, Homo sapiens
caggagtttgagaccag

SEQ ID NO: 1754158 - DNA, 21 bp, Homo sapiens
caggagtttgaggctgcagcg

SEQ ID NO: 1754159 - DNA, 23 bp, Homo sapiens
caggatactctgtcagatgggaa

SEQ ID NO: 1754160 - DNA, 15 bp, Homo sapiens
caggatactggcaca

SEQ ID NO: 1754161 - DNA, 18 bp, Homo sapiens
caggatactggcacagag

SEQ ID NO: 1754162 - DNA, 20 bp, Homo sapiens
caggatactggcacagaggt

SEQ ID NO: 1754163 - DNA, 16 bp, Homo sapiens
caggctgcactgcagt

SEQ ID NO: 1754164 - DNA, 15 bp, Homo sapiens
caggctgcagaggca

SEQ ID NO: 1754165 - DNA, 22 bp, Homo sapiens
caggctgccaaggccagagtgg

SEQ ID NO: 1754166 - DNA, 16 bp, Homo sapiens
caggctgccgtggggc

SEQ ID NO: 1754167 - DNA, 16 bp, Homo sapiens
caggctgcctcccttg

SEQ ID NO: 1754168 - DNA, 19 bp, Homo sapiens
caggctgcctcctgccctt

SEQ ID NO: 1754169 - DNA, 15 bp, Homo sapiens
caggctgcctcggac

SEQ ID NO: 1754170 - DNA, 19 bp, Homo sapiens
caggctgcctcggactcca

SEQ ID NO: 1754171 - DNA, 22 bp, Homo sapiens
caggctgcctcggactccatgg

SEQ ID NO: 1754172 - DNA, 16 bp, Homo sapiens
caggctggagtgcagt

SEQ ID NO: 1754173 - DNA, 20 bp, Homo sapiens
caggctggagtgcagtggcg

SEQ ID NO: 1754174 - DNA, 16 bp, Homo sapiens
caggctggccagtcca

SEQ ID NO: 1754175 - DNA, 18 bp, Homo sapiens
caggctggccagtccagg

SEQ ID NO: 1754176 - DNA, 14 bp, Homo sapiens
caggctggccagtg

SEQ ID NO: 1754177 - DNA, 21 bp, Homo sapiens
caggctggccagtgctgccca

SEQ ID NO: 1754178 - DNA, 15 bp, Homo sapiens
caggctggcgcagcc

SEQ ID NO: 1754179 - DNA, 16 bp, Homo sapiens
caggctggcgcagcca

SEQ ID NO: 1754180 - DNA, 17 bp, Homo sapiens
caggctgggccatgtcc

SEQ ID NO: 1754181 - DNA, 20 bp, Homo sapiens
caggctgggccatgtccaaa

SEQ ID NO: 1754182 - DNA, 22 bp, Homo sapiens
caggctgggctctgcctgtctg

SEQ ID NO: 1754183 - DNA, 23 bp, Homo sapiens
caggctggtctcaaactcctgac

SEQ ID NO: 1754184 - DNA, 13 bp, Homo sapiens
caggctgtaattc

SEQ ID NO: 1754185 - DNA, 13 bp, Homo sapiens
caggctgtcctta

SEQ ID NO: 1754186 - DNA, 17 bp, Homo sapiens
caggctgttctgcactg

SEQ ID NO: 1754187 - DNA, 21 bp, Homo sapiens
caggctgttctgcactgaaaa

SEQ ID NO: 1754188 - DNA, 13 bp, Homo sapiens
caggctgtttcag

SEQ ID NO: 1754189 - DNA, 12 bp, Homo sapiens
caggcttcctgg

SEQ ID NO: 1754190 - DNA, 15 bp, Homo sapiens
caggcttcctggtga

SEQ ID NO: 1754191 - DNA, 17 bp, Homo sapiens
caggcttcctggtgaga

SEQ ID NO: 1754192 - DNA, 19 bp, Homo sapiens
caggcttcctggtgagaac

SEQ ID NO: 1754193 - DNA, 14 bp, Homo sapiens
caggcttccttggc

SEQ ID NO: 1754194 - DNA, 21 bp, Homo sapiens
caggcttcggacagtgcccat

SEQ ID NO: 1754195 - DNA, 12 bp, Homo sapiens
caggcttggagg

SEQ ID NO: 1754196 - DNA, 21 bp, Homo sapiens
caggctttgggaacactggcc

SEQ ID NO: 1754197 - DNA, 19 bp, Homo sapiens
cagggaacagccccagggt

SEQ ID NO: 1754198 - DNA, 18 bp, Homo sapiens
cagggaacattggagctg

SEQ ID NO: 1754199 - DNA, 20 bp, Homo sapiens
cagggaacattggagctgac

SEQ ID NO: 1754200 - DNA, 15 bp, Homo sapiens
cagggaagagggcag

SEQ ID NO: 1754201 - DNA, 16 bp, Homo sapiens
cagggaagcccagctc

SEQ ID NO: 1754202 - DNA, 19 bp, Homo sapiens
cagggaagcccagctccag

SEQ ID NO: 1754203 - DNA, 21 bp, Homo sapiens
cagggaagcccagctccaggg

SEQ ID NO: 1754204 - DNA, 23 bp, Homo sapiens
cagggaagcccagctccagggcc

SEQ ID NO: 1754205 - DNA, 15 bp, Homo sapiens
cagggaagccccaca

SEQ ID NO: 1754206 - DNA, 14 bp, Homo sapiens
cagggaagctggcc

SEQ ID NO: 1754207 - DNA, 17 bp, Homo sapiens
cagggaagctggccgag

SEQ ID NO: 1754208 - DNA, 15 bp, Homo sapiens
cagggaaggacagga

SEQ ID NO: 1754209 - DNA, 17 bp, Homo sapiens
cagggaaggacaggacc

SEQ ID NO: 1754210 - DNA, 21 bp, Homo sapiens
cagggaaggacaggaccctca

SEQ ID NO: 1754211 - DNA, 15 bp, Homo sapiens
cagggaaggctaagc

SEQ ID NO: 1754212 - DNA, 18 bp, Homo sapiens
cagggaaggtggggccct

SEQ ID NO: 1754213 - DNA, 20 bp, Homo sapiens
cagggaaggtggggccctgc

SEQ ID NO: 1754214 - DNA, 21 bp, Homo sapiens
cagggaaggtggggccctgcc

SEQ ID NO: 1754215 - DNA, 22 bp, Homo sapiens
cagggaaggtggggccctgccc

SEQ ID NO: 1754216 - DNA, 17 bp, Homo sapiens
cagggaatgcagcagga

SEQ ID NO: 1754217 - DNA, 21 bp, Homo sapiens
cagggacaaaacactgtgtcc

SEQ ID NO: 1754218 - DNA, 17 bp, Homo sapiens
cagggacaaagaggcct

SEQ ID NO: 1754219 - DNA, 23 bp, Homo sapiens
cagggacacctcgcccttcagcc

SEQ ID NO: 1754220 - DNA, 15 bp, Homo sapiens
cagggacacgggcag

SEQ ID NO: 1754221 - DNA, 19 bp, Homo sapiens
cagggacagagacacctgc

SEQ ID NO: 1754222 - DNA, 18 bp, Homo sapiens
cagggacagaggccccag

SEQ ID NO: 1754223 - DNA, 23 bp, Homo sapiens
cagggacagaggccccagcctcc

SEQ ID NO: 1754224 - DNA, 20 bp, Homo sapiens
cagggacatgccctgtgtgg

SEQ ID NO: 1754225 - DNA, 22 bp, Homo sapiens
cagggaccacaccctgtactgt

SEQ ID NO: 1754226 - DNA, 24 bp, Homo sapiens
cagggaccactgggtgagagagga

SEQ ID NO: 1754227 - DNA, 19 bp, Homo sapiens
cagggaccagggccaccgc

SEQ ID NO: 1754228 - DNA, 14 bp, Homo sapiens
cagggacccccaga

SEQ ID NO: 1754229 - DNA, 15 bp, Homo sapiens
cagggacccccagaa

SEQ ID NO: 1754230 - DNA, 19 bp, Homo sapiens
cagggacccggggtctcct

SEQ ID NO: 1754231 - DNA, 20 bp, Homo sapiens
cagggacccggggtctcctg

SEQ ID NO: 1754232 - DNA, 19 bp, Homo sapiens
cagggaccggtgctgcagg

SEQ ID NO: 1754233 - DNA, 17 bp, Homo sapiens
cagggaccgtccagggg

SEQ ID NO: 1754234 - DNA, 22 bp, Homo sapiens
cagggacttgtttagagagcct

SEQ ID NO: 1754235 - DNA, 13 bp, Homo sapiens
cagggagaagctc

SEQ ID NO: 1754236 - DNA, 22 bp, Homo sapiens
cagggagacggtttccagggag

SEQ ID NO: 1754237 - DNA, 18 bp, Homo sapiens
cagggagactttctgaag

SEQ ID NO: 1754238 - DNA, 19 bp, Homo sapiens
cagggagaggtcaccagct

SEQ ID NO: 1754239 - DNA, 21 bp, Homo sapiens
cagggagaggtcaccagctgc

SEQ ID NO: 1754240 - DNA, 16 bp, Homo sapiens
cagggagcagggaagg

SEQ ID NO: 1754241 - DNA, 21 bp, Homo sapiens
cagggagcagggaaggcctga

SEQ ID NO: 1754242 - DNA, 16 bp, Homo sapiens
cagggagctctgggga

SEQ ID NO: 1754243 - DNA, 17 bp, Homo sapiens
cagggagctctggggac

SEQ ID NO: 1754244 - DNA, 15 bp, Homo sapiens
cagggagctgggaca

SEQ ID NO: 1754245 - DNA, 15 bp, Homo sapiens
cagggagctgggccc

SEQ ID NO: 1754246 - DNA, 23 bp, Homo sapiens
cagggaggcaacactgctgtcca

SEQ ID NO: 1754247 - DNA, 21 bp, Homo sapiens
cagggaggggactatttatga

SEQ ID NO: 1754248 - DNA, 17 bp, Homo sapiens
cagggaggggaggcaga

SEQ ID NO: 1754249 - DNA, 12 bp, Homo sapiens
cagggaggggcc

SEQ ID NO: 1754250 - DNA, 16 bp, Homo sapiens
cagggaggggccggcc

SEQ ID NO: 1754251 - DNA, 19 bp, Homo sapiens
cagggaggggccggccctg

SEQ ID NO: 1754252 - DNA, 16 bp, Homo sapiens
cagggaggtcattttg

SEQ ID NO: 1754253 - DNA, 23 bp, Homo sapiens
cagggagtcccctccccggccct

SEQ ID NO: 1754254 - DNA, 22 bp, Homo sapiens
cagggagtgtctgcagtcctgg

SEQ ID NO: 1754255 - DNA, 19 bp, Homo sapiens
cagggataaggcctgtggg

SEQ ID NO: 1754256 - DNA, 15 bp, Homo sapiens
cagggatattgcctt

SEQ ID NO: 1754257 - DNA, 16 bp, Homo sapiens
cagggatattgcctta

SEQ ID NO: 1754258 - DNA, 19 bp, Homo sapiens
cagggatcactggctggcc

SEQ ID NO: 1754259 - DNA, 19 bp, Homo sapiens
cagggatgatggcagagcc

SEQ ID NO: 1754260 - DNA, 15 bp, Homo sapiens
cagggatgctgggct

SEQ ID NO: 1754261 - DNA, 18 bp, Homo sapiens
cagggatgctgggctggg

SEQ ID NO: 1754262 - DNA, 21 bp, Homo sapiens
cagggatgctgggctgggccc

SEQ ID NO: 1754263 - DNA, 22 bp, Homo sapiens
cagggatgctgggctgggccct

SEQ ID NO: 1754264 - DNA, 19 bp, Homo sapiens
cagggatggagatgggaag

SEQ ID NO: 1754265 - DNA, 15 bp, Homo sapiens
cagggatgttcctta

SEQ ID NO: 1754266 - DNA, 14 bp, Homo sapiens
cagggcaaatgaca

SEQ ID NO: 1754267 - DNA, 23 bp, Homo sapiens
cagggcaaatgacatgcactgac

SEQ ID NO: 1754268 - DNA, 23 bp, Homo sapiens
cagggcaacaagcccgttagccc

SEQ ID NO: 1754269 - DNA, 17 bp, Homo sapiens
cagggcaaggacacagc

SEQ ID NO: 1754270 - DNA, 23 bp, Homo sapiens
cagggcaagggttaaggcctgaa

SEQ ID NO: 1754271 - DNA, 15 bp, Homo sapiens
cagggcaccagaggc

SEQ ID NO: 1754272 - DNA, 17 bp, Homo sapiens
cagggcacgcaggacca

SEQ ID NO: 1754273 - DNA, 12 bp, Homo sapiens
cagggcagagga

SEQ ID NO: 1754274 - DNA, 13 bp, Homo sapiens
cagggcagaggaa

SEQ ID NO: 1754275 - DNA, 15 bp, Homo sapiens
cagggcagaggaatg

SEQ ID NO: 1754276 - DNA, 19 bp, Homo sapiens
cagggcagaggaatgtagg

SEQ ID NO: 1754277 - DNA, 23 bp, Homo sapiens
caggtgccgccagctgccgcacc

SEQ ID NO: 1754278 - DNA, 11 bp, Homo sapiens
caggtgcctcc

SEQ ID NO: 1754279 - DNA, 15 bp, Homo sapiens
caggtgcctccaggt

SEQ ID NO: 1754280 - DNA, 21 bp, Homo sapiens
caggtgcctccaggtgtgcac

SEQ ID NO: 1754281 - DNA, 14 bp, Homo sapiens
caggtgcctgtcct

SEQ ID NO: 1754282 - DNA, 23 bp, Homo sapiens
caggtgcctgtccttgaaaaaca

SEQ ID NO: 1754283 - DNA, 21 bp, Homo sapiens
caggtgccttacatcttttct

SEQ ID NO: 1754284 - DNA, 14 bp, Homo sapiens
caggtgctacaaca

SEQ ID NO: 1754285 - DNA, 23 bp, Homo sapiens
caggtgctcccctgacagtccct

SEQ ID NO: 1754286 - DNA, 11 bp, Homo sapiens
caggtgctgcc

SEQ ID NO: 1754287 - DNA, 14 bp, Homo sapiens
caggtgctgccttg

SEQ ID NO: 1754288 - DNA, 13 bp, Homo sapiens
caggtgctgggct

SEQ ID NO: 1754289 - DNA, 18 bp, Homo sapiens
caggtgctgggctggact

SEQ ID NO: 1754290 - DNA, 18 bp, Homo sapiens
caggtgcttctcaccacg

SEQ ID NO: 1754291 - DNA, 18 bp, Homo sapiens
caggtggagggcacagcc

SEQ ID NO: 1754292 - DNA, 21 bp, Homo sapiens
caggtggagggcacagccctc

SEQ ID NO: 1754293 - DNA, 22 bp, Homo sapiens
caggtggagggtttgcactcca

SEQ ID NO: 1754294 - DNA, 12 bp, Homo sapiens
caggtggatcac

SEQ ID NO: 1754295 - DNA, 22 bp, Homo sapiens
caggtggatctatttcatgttt

SEQ ID NO: 1754296 - DNA, 17 bp, Homo sapiens
caggtggatgaggagac

SEQ ID NO: 1754297 - DNA, 14 bp, Homo sapiens
caggtggccacagc

SEQ ID NO: 1754298 - DNA, 19 bp, Homo sapiens
caggtggccgcccctgagg

SEQ ID NO: 1754299 - DNA, 19 bp, Homo sapiens
caggtggcctagcaggcac

SEQ ID NO: 1754300 - DNA, 15 bp, Homo sapiens
caggtggctgaccca

SEQ ID NO: 1754301 - DNA, 19 bp, Homo sapiens
caggtggctgacccagtcc

SEQ ID NO: 1754302 - DNA, 20 bp, Homo sapiens
caggtggctgacccagtccc

SEQ ID NO: 1754303 - DNA, 22 bp, Homo sapiens
caggtgggaggaaagggcctgg

SEQ ID NO: 1754304 - DNA, 16 bp, Homo sapiens
caggtgggctgcctgc

SEQ ID NO: 1754305 - DNA, 17 bp, Homo sapiens
caggtgggtgtgggaca

SEQ ID NO: 1754306 - DNA, 21 bp, Homo sapiens
caggtggttgggttctgcctt

SEQ ID NO: 1754307 - DNA, 20 bp, Homo sapiens
caggtggttgtcttattgca

SEQ ID NO: 1754308 - DNA, 14 bp, Homo sapiens
caggtgtcaggccc

SEQ ID NO: 1754309 - DNA, 14 bp, Homo sapiens
caggtgtgcctgtg

SEQ ID NO: 1754310 - DNA, 21 bp, Homo sapiens
caggtgtgggatctggggaga

SEQ ID NO: 1754311 - DNA, 17 bp, Homo sapiens
caggtgttaacattcca

SEQ ID NO: 1754312 - DNA, 20 bp, Homo sapiens
caggtgttaacattccaaga

SEQ ID NO: 1754313 - DNA, 20 bp, Homo sapiens
caggtgttctacactcatct

SEQ ID NO: 1754314 - DNA, 14 bp, Homo sapiens
caggtgttgccatt

SEQ ID NO: 1754315 - DNA, 20 bp, Homo sapiens
caggtgttgccatttctctg

SEQ ID NO: 1754316 - DNA, 18 bp, Homo sapiens
caggtgttgggacctgct

SEQ ID NO: 1754317 - DNA, 15 bp, Homo sapiens
caggttataacagtg

SEQ ID NO: 1754318 - DNA, 16 bp, Homo sapiens
caggttataacagtgt

SEQ ID NO: 1754319 - DNA, 16 bp, Homo sapiens
caggttcaacccacag

SEQ ID NO: 1754320 - DNA, 17 bp, Homo sapiens
caggttcaacccacagc

SEQ ID NO: 1754321 - DNA, 19 bp, Homo sapiens
caggttcaacccacagcta

SEQ ID NO: 1754322 - DNA, 23 bp, Homo sapiens
caggttccatccaccaccttgcc

SEQ ID NO: 1754323 - DNA, 20 bp, Homo sapiens
caggttccccaagggccctg

SEQ ID NO: 1754324 - DNA, 22 bp, Homo sapiens
caggttccccaagggccctggc

SEQ ID NO: 1754325 - DNA, 18 bp, Homo sapiens
caggttcccccagcaagc

SEQ ID NO: 1754326 - DNA, 13 bp, Homo sapiens
caggttcctcctt

SEQ ID NO: 1754327 - DNA, 20 bp, Homo sapiens
caggttctccgttagctcct

SEQ ID NO: 1754328 - DNA, 14 bp, Homo sapiens
caggttctgaaaga

SEQ ID NO: 1754329 - DNA, 14 bp, Homo sapiens
caggttgcagctgc

SEQ ID NO: 1754330 - DNA, 18 bp, Homo sapiens
caggttgggctagagaaa

SEQ ID NO: 1754331 - DNA, 20 bp, Homo sapiens
caggttgttttctactttgc

SEQ ID NO: 1754332 - DNA, 23 bp, Homo sapiens
caggtttgatgcctgtgaagaac

SEQ ID NO: 1754333 - DNA, 21 bp, Homo sapiens
caggtttgccagtgaagactt

SEQ ID NO: 1754334 - DNA, 23 bp, Homo sapiens
caggtttggggagggggaagaga

SEQ ID NO: 1754335 - DNA, 18 bp, Homo sapiens
caggtttgtcctggtcat

SEQ ID NO: 1754336 - DNA, 21 bp, Homo sapiens
caggtttttcatctgaaaagc

SEQ ID NO: 1754337 - DNA, 11 bp, Homo sapiens
caggtttttcc

SEQ ID NO: 1754338 - DNA, 13 bp, Homo sapiens
caggtttttcctt

SEQ ID NO: 1754339 - DNA, 15 bp, Homo sapiens
caggtttttcctttt

SEQ ID NO: 1754340 - DNA, 17 bp, Homo sapiens
caggtttttctgtctca

SEQ ID NO: 1754341 - DNA, 13 bp, Homo sapiens
cagtaaacaaatt

SEQ ID NO: 1754342 - DNA, 10 bp, Homo sapiens
cagtaaacat

SEQ ID NO: 1754343 - DNA, 21 bp, Homo sapiens
cagtaaaccactgaaaaaata

SEQ ID NO: 1754344 - DNA, 18 bp, Homo sapiens
cagtaaagaaagcagaat

SEQ ID NO: 1754345 - DNA, 14 bp, Homo sapiens
cagtaaataacagg

SEQ ID NO: 1754346 - DNA, 23 bp, Homo sapiens
cagtaaataactggaaaacagaa

SEQ ID NO: 1754347 - DNA, 23 bp, Homo sapiens
cagtaaatagtgtcatataaact

SEQ ID NO: 1754348 - DNA, 20 bp, Homo sapiens
cagtaacataactgcttctt

SEQ ID NO: 1754349 - DNA, 20 bp, Homo sapiens
cagtaacccccttaaattta

SEQ ID NO: 1754350 - DNA, 20 bp, Homo sapiens
cagtaacgcgtcttcctgag

SEQ ID NO: 1754351 - DNA, 21 bp, Homo sapiens
cagtaacgcgtcttcctgagt

SEQ ID NO: 1754352 - DNA, 17 bp, Homo sapiens
cagtaactttatgtgta

SEQ ID NO: 1754353 - DNA, 20 bp, Homo sapiens
cagtaactttatgtgtaaat

SEQ ID NO: 1754354 - DNA, 14 bp, Homo sapiens
cagtaagtcttttt

SEQ ID NO: 1754355 - DNA, 13 bp, Homo sapiens
cagtaataactct

SEQ ID NO: 1754356 - DNA, 13 bp, Homo sapiens
cagtaatatttat

SEQ ID NO: 1754357 - DNA, 20 bp, Homo sapiens
cagtaatatttatatattta

SEQ ID NO: 1754358 - DNA, 23 bp, Homo sapiens
cagtaatgcagtttttaaaaacc

SEQ ID NO: 1754359 - DNA, 13 bp, Homo sapiens
cagtacaataatg

SEQ ID NO: 1754360 - DNA, 14 bp, Homo sapiens
cagtacaataatgt

SEQ ID NO: 1754361 - DNA, 21 bp, Homo sapiens
cagtacaataatgtactcaca

SEQ ID NO: 1754362 - DNA, 22 bp, Homo sapiens
cagtacaataatgtactcacat

SEQ ID NO: 1754363 - DNA, 22 bp, Homo sapiens
cagtacacatccccagaatcca

SEQ ID NO: 1754364 - DNA, 18 bp, Homo sapiens
cagtacagtattctttta

SEQ ID NO: 1754365 - DNA, 17 bp, Homo sapiens
cagtacatttaaatttt

SEQ ID NO: 1754366 - DNA, 14 bp, Homo sapiens
cagtacccaccacc

SEQ ID NO: 1754367 - DNA, 19 bp, Homo sapiens
cagtaccctctcagctcca

SEQ ID NO: 1754368 - DNA, 20 bp, Homo sapiens
cagtaccctctcagctccag

SEQ ID NO: 1754369 - DNA, 22 bp, Homo sapiens
cagtaccctctcagctccaggt

SEQ ID NO: 1754370 - DNA, 16 bp, Homo sapiens
cagtacctccaagcaa

SEQ ID NO: 1754371 - DNA, 19 bp, Homo sapiens
cagtacctcgtttctacac

SEQ ID NO: 1754372 - DNA, 13 bp, Homo sapiens
cagtacctgggaa

SEQ ID NO: 1754373 - DNA, 14 bp, Homo sapiens
cagtacctgggaaa

SEQ ID NO: 1754374 - DNA, 22 bp, Homo sapiens
cagtacctgggaaaggacccac

SEQ ID NO: 1754375 - DNA, 15 bp, Homo sapiens
cagtacctttgtcac

SEQ ID NO: 1754376 - DNA, 16 bp, Homo sapiens
cagtacctttgtcaca

SEQ ID NO: 1754377 - DNA, 17 bp, Homo sapiens
cagtacctttgtcacaa

SEQ ID NO: 1754378 - DNA, 18 bp, Homo sapiens
cagtacgtcccgctgctg

SEQ ID NO: 1754379 - DNA, 22 bp, Homo sapiens
cagtacgtcccgctgctgtgct

SEQ ID NO: 1754380 - DNA, 21 bp, Homo sapiens
cagtacttgtgaaacacagct

SEQ ID NO: 1754381 - DNA, 22 bp, Homo sapiens
cagtacttgtgaaacacagctg

SEQ ID NO: 1754382 - DNA, 20 bp, Homo sapiens
cagtactttattgtacagac

SEQ ID NO: 1754383 - DNA, 15 bp, Homo sapiens
cagtacttttttaaa

SEQ ID NO: 1754384 - DNA, 23 bp, Homo sapiens
cagtacttttttaaatattttct

SEQ ID NO: 1754385 - DNA, 18 bp, Homo sapiens
cagtagaaataatatgca

SEQ ID NO: 1754386 - DNA, 19 bp, Homo sapiens
cagtagaaataatatgcat

SEQ ID NO: 1754387 - DNA, 13 bp, Homo sapiens
cagtagagccagc

SEQ ID NO: 1754388 - DNA, 15 bp, Homo sapiens
cagtagagccagctt

SEQ ID NO: 1754389 - DNA, 16 bp, Homo sapiens
cagtagagtcatctcc

SEQ ID NO: 1754390 - DNA, 17 bp, Homo sapiens
cagtagagtcatctcca

SEQ ID NO: 1754391 - DNA, 14 bp, Homo sapiens
cagtgctgccatgc

SEQ ID NO: 1754392 - DNA, 16 bp, Homo sapiens
cagtgctgccatgcca

SEQ ID NO: 1754393 - DNA, 18 bp, Homo sapiens
cagtgctgccatgccact

SEQ ID NO: 1754394 - DNA, 20 bp, Homo sapiens
cagtgctgcccatgagcaag

SEQ ID NO: 1754395 - DNA, 18 bp, Homo sapiens
cagtgctgcttctcttgg

SEQ ID NO: 1754396 - DNA, 12 bp, Homo sapiens
cagtgctgtggc

SEQ ID NO: 1754397 - DNA, 15 bp, Homo sapiens
cagtgctgtggcctg

SEQ ID NO: 1754398 - DNA, 20 bp, Homo sapiens
cagtgctgtggcctgggcaa

SEQ ID NO: 1754399 - DNA, 15 bp, Homo sapiens
cagtgcttcagcctg

SEQ ID NO: 1754400 - DNA, 16 bp, Homo sapiens
cagtgcttcagcctga

SEQ ID NO: 1754401 - DNA, 17 bp, Homo sapiens
cagtgcttcagcctgag

SEQ ID NO: 1754402 - DNA, 18 bp, Homo sapiens
cagtgcttcagcctgagg

SEQ ID NO: 1754403 - DNA, 15 bp, Homo sapiens
cagtgcttcccgagt

SEQ ID NO: 1754404 - DNA, 16 bp, Homo sapiens
cagtgctttaatggca

SEQ ID NO: 1754405 - DNA, 15 bp, Homo sapiens
cagtgctttgttgat

SEQ ID NO: 1754406 - DNA, 20 bp, Homo sapiens
cagtgcttttaagtgaaaat

SEQ ID NO: 1754407 - DNA, 22 bp, Homo sapiens
cagtggaagtttttttttcctc

SEQ ID NO: 1754408 - DNA, 23 bp, Homo sapiens
cagtggacatcgtaggcagccac

SEQ ID NO: 1754409 - DNA, 19 bp, Homo sapiens
cagtggactcagcagtgac

SEQ ID NO: 1754410 - DNA, 17 bp, Homo sapiens
cagtggactctgaggac

SEQ ID NO: 1754411 - DNA, 17 bp, Homo sapiens
cagtggagcctgccgcc

SEQ ID NO: 1754412 - DNA, 20 bp, Homo sapiens
cagtggagcctgccgccccc

SEQ ID NO: 1754413 - DNA, 16 bp, Homo sapiens
cagtggaggctgctgt

SEQ ID NO: 1754414 - DNA, 15 bp, Homo sapiens
cagtggaggtttgtc

SEQ ID NO: 1754415 - DNA, 23 bp, Homo sapiens
cagtggatatgacccacactgcc

SEQ ID NO: 1754416 - DNA, 17 bp, Homo sapiens
cagtggatcacaaagtg

SEQ ID NO: 1754417 - DNA, 13 bp, Homo sapiens
cagtggattccag

SEQ ID NO: 1754418 - DNA, 16 bp, Homo sapiens
cagtggattgcatttc

SEQ ID NO: 1754419 - DNA, 23 bp, Homo sapiens
cagtggcacggagagaaggccca

SEQ ID NO: 1754420 - DNA, 11 bp, Homo sapiens
cagtggccagg

SEQ ID NO: 1754421 - DNA, 14 bp, Homo sapiens
cagtggccaggcag

SEQ ID NO: 1754422 - DNA, 17 bp, Homo sapiens
cagtggcgcatgcctgt

SEQ ID NO: 1754423 - DNA, 21 bp, Homo sapiens
cagtggcgcgatctcagctca

SEQ ID NO: 1754424 - DNA, 21 bp, Homo sapiens
cagtggcgtgatcttggctca

SEQ ID NO: 1754425 - DNA, 13 bp, Homo sapiens
cagtggctcgctc

SEQ ID NO: 1754426 - DNA, 13 bp, Homo sapiens
cagtggctctggg

SEQ ID NO: 1754427 - DNA, 18 bp, Homo sapiens
cagtggcttcccagctct

SEQ ID NO: 1754428 - DNA, 21 bp, Homo sapiens
cagtggcttcccagctctgac

SEQ ID NO: 1754429 - DNA, 21 bp, Homo sapiens
cagtgggaacgtgactgcccc

SEQ ID NO: 1754430 - DNA, 19 bp, Homo sapiens
cagtgggacagggcatggc

SEQ ID NO: 1754431 - DNA, 17 bp, Homo sapiens
cagtgggagccagggct

SEQ ID NO: 1754432 - DNA, 11 bp, Homo sapiens
cagtgggaggg

SEQ ID NO: 1754433 - DNA, 17 bp, Homo sapiens
cagtgggaggggcaggc

SEQ ID NO: 1754434 - DNA, 21 bp, Homo sapiens
cagtgggaggggcaggctgac

SEQ ID NO: 1754435 - DNA, 15 bp, Homo sapiens
cagtgggcaggaggc

SEQ ID NO: 1754436 - DNA, 21 bp, Homo sapiens
cagtgggcaggaggccccagg

SEQ ID NO: 1754437 - DNA, 22 bp, Homo sapiens
cagtgggcaggaggccccaggc

SEQ ID NO: 1754438 - DNA, 23 bp, Homo sapiens
cagtgggcaggaggccccaggct

SEQ ID NO: 1754439 - DNA, 17 bp, Homo sapiens
cagtgggcaggtggccg

SEQ ID NO: 1754440 - DNA, 13 bp, Homo sapiens
cagtgggcccgga

SEQ ID NO: 1754441 - DNA, 18 bp, Homo sapiens
cagtgggcgttgggagcc

SEQ ID NO: 1754442 - DNA, 16 bp, Homo sapiens
cagtggggcagcctct

SEQ ID NO: 1754443 - DNA, 15 bp, Homo sapiens
cagtggtcatgctca

SEQ ID NO: 1754444 - DNA, 17 bp, Homo sapiens
cagtggtcatgctcagc

SEQ ID NO: 1754445 - DNA, 19 bp, Homo sapiens
cagtggtcatgctcagcct

SEQ ID NO: 1754446 - DNA, 23 bp, Homo sapiens
cagtggtcatgctcagccttgct

SEQ ID NO: 1754447 - DNA, 19 bp, Homo sapiens
cagtggtgggtaattgtac

SEQ ID NO: 1754448 - DNA, 14 bp, Homo sapiens
cagtggttatttag

SEQ ID NO: 1754449 - DNA, 21 bp, Homo sapiens
cagtggttttatactgaagga

SEQ ID NO: 1754450 - DNA, 15 bp, Homo sapiens
cagtgtaaagtgtgt

SEQ ID NO: 1754451 - DNA, 15 bp, Homo sapiens
cagtgtaatgtgact

SEQ ID NO: 1754452 - DNA, 22 bp, Homo sapiens
cagtgtacacgtctggaccccg

SEQ ID NO: 1754453 - DNA, 17 bp, Homo sapiens
cagtgtacatgtacata

SEQ ID NO: 1754454 - DNA, 16 bp, Homo sapiens
cagtgtatggggcagc

SEQ ID NO: 1754455 - DNA, 23 bp, Homo sapiens
cagtgtatggggcagcttccggc

SEQ ID NO: 1754456 - DNA, 17 bp, Homo sapiens
cagtgtcccctgcccca

SEQ ID NO: 1754457 - DNA, 18 bp, Homo sapiens
cagtgtcccctgccccag

SEQ ID NO: 1754458 - DNA, 22 bp, Homo sapiens
cagtgtcccctgccccagaggt

SEQ ID NO: 1754459 - DNA, 23 bp, Homo sapiens
cagtgtcccctgccccagaggtc

SEQ ID NO: 1754460 - DNA, 14 bp, Homo sapiens
cagtgtcccgggcc

SEQ ID NO: 1754461 - DNA, 19 bp, Homo sapiens
cagtgtcctcttgctcaaa

SEQ ID NO: 1754462 - DNA, 13 bp, Homo sapiens
cagtgtcctttcc

SEQ ID NO: 1754463 - DNA, 14 bp, Homo sapiens
cagtgtctgttcag

SEQ ID NO: 1754464 - DNA, 14 bp, Homo sapiens
cagtgtcttccata

SEQ ID NO: 1754465 - DNA, 15 bp, Homo sapiens
cagtgtcttccataa

SEQ ID NO: 1754466 - DNA, 22 bp, Homo sapiens
cagtgtcttccataatgtataa

SEQ ID NO: 1754467 - DNA, 15 bp, Homo sapiens
cagtgtcttcttaaa

SEQ ID NO: 1754468 - DNA, 16 bp, Homo sapiens
cagtgtcttgagctct

SEQ ID NO: 1754469 - DNA, 20 bp, Homo sapiens
cagtgtgaggacctccctgt

SEQ ID NO: 1754470 - DNA, 14 bp, Homo sapiens
cagtgtgcacccct

SEQ ID NO: 1754471 - DNA, 20 bp, Homo sapiens
cagtgtgcacccctccccat

SEQ ID NO: 1754472 - DNA, 22 bp, Homo sapiens
cagtgtgcacgagtgggaagga

SEQ ID NO: 1754473 - DNA, 19 bp, Homo sapiens
cagtgtgcacgcctgcagg

SEQ ID NO: 1754474 - DNA, 13 bp, Homo sapiens
cagtgtggagtgg

SEQ ID NO: 1754475 - DNA, 23 bp, Homo sapiens
cagtgtggagttcaccttggaag

SEQ ID NO: 1754476 - DNA, 11 bp, Homo sapiens
cagtgtggcct

SEQ ID NO: 1754477 - DNA, 13 bp, Homo sapiens
cagtgtggcctct

SEQ ID NO: 1754478 - DNA, 21 bp, Homo sapiens
cagtgtgtcgagtcaaaatgt

SEQ ID NO: 1754479 - DNA, 23 bp, Homo sapiens
cagtgtgtctaaatttgaatgtt

SEQ ID NO: 1754480 - DNA, 14 bp, Homo sapiens
cagtgtgtgactta

SEQ ID NO: 1754481 - DNA, 23 bp, Homo sapiens
cagtgttacttgcaggtactttg

SEQ ID NO: 1754482 - DNA, 14 bp, Homo sapiens
cagtgttagagaaa

SEQ ID NO: 1754483 - DNA, 16 bp, Homo sapiens
cagtgttagtgctggt

SEQ ID NO: 1754484 - DNA, 19 bp, Homo sapiens
cagtgttagtgctggtcag

SEQ ID NO: 1754485 - DNA, 13 bp, Homo sapiens
cagtgttctattt

SEQ ID NO: 1754486 - DNA, 17 bp, Homo sapiens
cagtgttctatttgctt

SEQ ID NO: 1754487 - DNA, 14 bp, Homo sapiens
cagtgttggctgtg

SEQ ID NO: 1754488 - DNA, 18 bp, Homo sapiens
cagtgttggggatgcctt

SEQ ID NO: 1754489 - DNA, 16 bp, Homo sapiens
cagtgttggtatattt

SEQ ID NO: 1754490 - DNA, 23 bp, Homo sapiens
cagtgttgtgccccttcactcat

SEQ ID NO: 1754491 - DNA, 14 bp, Homo sapiens
cagtgttgtttgta

SEQ ID NO: 1754492 - DNA, 23 bp, Homo sapiens
cagtgttgtttgtaaataagaga

SEQ ID NO: 1754493 - DNA, 14 bp, Homo sapiens
cagtgtttaaaact

SEQ ID NO: 1754494 - DNA, 14 bp, Homo sapiens
cagtgtttcccata

SEQ ID NO: 1754495 - DNA, 17 bp, Homo sapiens
cagtgtttcccataatt

SEQ ID NO: 1754496 - DNA, 15 bp, Homo sapiens
cagtgttttctggga

SEQ ID NO: 1754497 - DNA, 18 bp, Homo sapiens
cagtgttttctttgagga

SEQ ID NO: 1754498 - DNA, 11 bp, Homo sapiens
cagtgttttgg

SEQ ID NO: 1754499 - DNA, 22 bp, Homo sapiens
cagtgttttggactccatctct

SEQ ID NO: 1754500 - DNA, 17 bp, Homo sapiens
cagtgtttttattgctc

SEQ ID NO: 1754501 - DNA, 23 bp, Homo sapiens
cagttaaggaagatcctgaagca

SEQ ID NO: 1754502 - DNA, 20 bp, Homo sapiens
cagttaaggaccgtggccct

SEQ ID NO: 1754503 - DNA, 18 bp, Homo sapiens
cagttaatactccagaga

SEQ ID NO: 1754504 - DNA, 13 bp, Homo sapiens
cagttaattacat

SEQ ID NO: 1754505 - DNA, 12 bp, Homo sapiens
cagttaattttt

SEQ ID NO: 1754506 - DNA, 15 bp, Homo sapiens
cataccttccttccc

SEQ ID NO: 1754507 - DNA, 18 bp, Homo sapiens
cataccttccttccctgg

SEQ ID NO: 1754508 - DNA, 17 bp, Homo sapiens
cataccttggccagcaa

SEQ ID NO: 1754509 - DNA, 15 bp, Homo sapiens
catacgtgcacaggg

SEQ ID NO: 1754510 - DNA, 16 bp, Homo sapiens
catactacctagaagt

SEQ ID NO: 1754511 - DNA, 18 bp, Homo sapiens
catactactgaaacagat

SEQ ID NO: 1754512 - DNA, 22 bp, Homo sapiens
catactactgaaacagatttca

SEQ ID NO: 1754513 - DNA, 18 bp, Homo sapiens
catactcaagctgtctct

SEQ ID NO: 1754514 - DNA, 23 bp, Homo sapiens
catactcaaggtgagaattaagt

SEQ ID NO: 1754515 - DNA, 20 bp, Homo sapiens
catactccgtgaggctgctg

SEQ ID NO: 1754516 - DNA, 23 bp, Homo sapiens
catactccgtgaggctgctgcca

SEQ ID NO: 1754517 - DNA, 22 bp, Homo sapiens
catactctgtgtaatctctgat

SEQ ID NO: 1754518 - DNA, 19 bp, Homo sapiens
catactgacttcagtggga

SEQ ID NO: 1754519 - DNA, 15 bp, Homo sapiens
catactgagggacca

SEQ ID NO: 1754520 - DNA, 19 bp, Homo sapiens
catactgagggaccaactg

SEQ ID NO: 1754521 - DNA, 17 bp, Homo sapiens
catactgattgggaggt

SEQ ID NO: 1754522 - DNA, 20 bp, Homo sapiens
catactgattgggaggtgcg

SEQ ID NO: 1754523 - DNA, 23 bp, Homo sapiens
catactgattgggaggtgcgtgt

SEQ ID NO: 1754524 - DNA, 15 bp, Homo sapiens
catactgtctgggat

SEQ ID NO: 1754525 - DNA, 15 bp, Homo sapiens
catacttaagcaaaa

SEQ ID NO: 1754526 - DNA, 16 bp, Homo sapiens
catacttagaaacaaa

SEQ ID NO: 1754527 - DNA, 18 bp, Homo sapiens
catacttcttacttgtct

SEQ ID NO: 1754528 - DNA, 13 bp, Homo sapiens
catacttgaaggg

SEQ ID NO: 1754529 - DNA, 14 bp, Homo sapiens
catacttgaagggc

SEQ ID NO: 1754530 - DNA, 20 bp, Homo sapiens
catacttgaagggccagagc

SEQ ID NO: 1754531 - DNA, 22 bp, Homo sapiens
catacttgaagggccagagcca

SEQ ID NO: 1754532 - DNA, 23 bp, Homo sapiens
catactttgacaaggaaaatcta

SEQ ID NO: 1754533 - DNA, 14 bp, Homo sapiens
catactttgtaaat

SEQ ID NO: 1754534 - DNA, 15 bp, Homo sapiens
catactttgtaaata

SEQ ID NO: 1754535 - DNA, 22 bp, Homo sapiens
catactttgtaaataggatttt

SEQ ID NO: 1754536 - DNA, 13 bp, Homo sapiens
catactttgtctg

SEQ ID NO: 1754537 - DNA, 16 bp, Homo sapiens
catactttgtctgaaa

SEQ ID NO: 1754538 - DNA, 15 bp, Homo sapiens
catacttttggctcc

SEQ ID NO: 1754539 - DNA, 20 bp, Homo sapiens
catactttttaaatgtaaag

SEQ ID NO: 1754540 - DNA, 22 bp, Homo sapiens
catactttttaaatgtaaagat

SEQ ID NO: 1754541 - DNA, 16 bp, Homo sapiens
catagaaacatgacac

SEQ ID NO: 1754542 - DNA, 20 bp, Homo sapiens
catagaaacatgacactgac

SEQ ID NO: 1754543 - DNA, 14 bp, Homo sapiens
catagaaattgtgt

SEQ ID NO: 1754544 - DNA, 21 bp, Homo sapiens
catagaactgtcccacaaaat

SEQ ID NO: 1754545 - DNA, 14 bp, Homo sapiens
catagaattttgag

SEQ ID NO: 1754546 - DNA, 14 bp, Homo sapiens
catagacatgaaag

SEQ ID NO: 1754547 - DNA, 16 bp, Homo sapiens
catagacatgaaaggt

SEQ ID NO: 1754548 - DNA, 21 bp, Homo sapiens
catagaccctctttcttgttt

SEQ ID NO: 1754549 - DNA, 17 bp, Homo sapiens
catagagatttgtctaa

SEQ ID NO: 1754550 - DNA, 13 bp, Homo sapiens
catagagatttta

SEQ ID NO: 1754551 - DNA, 23 bp, Homo sapiens
catagagctttttaatagcacta

SEQ ID NO: 1754552 - DNA, 19 bp, Homo sapiens
catagaggcccaggcacca

SEQ ID NO: 1754553 - DNA, 15 bp, Homo sapiens
catagaggcttctcc

SEQ ID NO: 1754554 - DNA, 19 bp, Homo sapiens
catagaggcttctccgcca

SEQ ID NO: 1754555 - DNA, 22 bp, Homo sapiens
catagaggcttctccgccagcc

SEQ ID NO: 1754556 - DNA, 24 bp, Homo sapiens
catagataatattgtttggtaaat

SEQ ID NO: 1754557 - DNA, 23 bp, Homo sapiens
catagatgtccctttcttggcca

SEQ ID NO: 1754558 - DNA, 17 bp, Homo sapiens
catagattaatggcact

SEQ ID NO: 1754559 - DNA, 14 bp, Homo sapiens
catagattattata

SEQ ID NO: 1754560 - DNA, 16 bp, Homo sapiens
catagcaacaggaaaa

SEQ ID NO: 1754561 - DNA, 14 bp, Homo sapiens
catagcaagacaca

SEQ ID NO: 1754562 - DNA, 15 bp, Homo sapiens
catagcaagacacat

SEQ ID NO: 1754563 - DNA, 17 bp, Homo sapiens
catagcaagcttttgct

SEQ ID NO: 1754564 - DNA, 14 bp, Homo sapiens
catagcagatctgt

SEQ ID NO: 1754565 - DNA, 18 bp, Homo sapiens
catagcatagccagcatt

SEQ ID NO: 1754566 - DNA, 21 bp, Homo sapiens
catagcatagctagagattgg

SEQ ID NO: 1754567 - DNA, 15 bp, Homo sapiens
catagcatgcttcct

SEQ ID NO: 1754568 - DNA, 21 bp, Homo sapiens
catagcatgcttcctttctct

SEQ ID NO: 1754569 - DNA, 23 bp, Homo sapiens
catagcatgcttcctttctctcc

SEQ ID NO: 1754570 - DNA, 13 bp, Homo sapiens
catagccagcatt

SEQ ID NO: 1754571 - DNA, 21 bp, Homo sapiens
catagccagcattcagcacac

SEQ ID NO: 1754572 - DNA, 13 bp, Homo sapiens
catagccataaat

SEQ ID NO: 1754573 - DNA, 11 bp, Homo sapiens
catagcccagt

SEQ ID NO: 1754574 - DNA, 18 bp, Homo sapiens
catagccctcctgagcac

SEQ ID NO: 1754575 - DNA, 13 bp, Homo sapiens
catagctctattt

SEQ ID NO: 1754576 - DNA, 13 bp, Homo sapiens
catagctctgggg

SEQ ID NO: 1754577 - DNA, 20 bp, Homo sapiens
catagctctggggtgggcag

SEQ ID NO: 1754578 - DNA, 16 bp, Homo sapiens
catagctgtacttctt

SEQ ID NO: 1754579 - DNA, 14 bp, Homo sapiens
catagctgtctaga

SEQ ID NO: 1754580 - DNA, 13 bp, Homo sapiens
catagcttccatg

SEQ ID NO: 1754581 - DNA, 20 bp, Homo sapiens
catagcttgataaagggcca

SEQ ID NO: 1754582 - DNA, 24 bp, Homo sapiens
cataggaagggaccaaggcaaggc

SEQ ID NO: 1754583 - DNA, 19 bp, Homo sapiens
cataggaagggatctgaga

SEQ ID NO: 1754584 - DNA, 17 bp, Homo sapiens
cataggaattaaatgta

SEQ ID NO: 1754585 - DNA, 17 bp, Homo sapiens
cataggacatactgcat

SEQ ID NO: 1754586 - DNA, 20 bp, Homo sapiens
cataggacatactgcatgta

SEQ ID NO: 1754587 - DNA, 23 bp, Homo sapiens
cataggactaccgcaggcccgga

SEQ ID NO: 1754588 - DNA, 14 bp, Homo sapiens
cataggcctgggtg

SEQ ID NO: 1754589 - DNA, 19 bp, Homo sapiens
cataggcctgggtgctggc

SEQ ID NO: 1754590 - DNA, 20 bp, Homo sapiens
cataggcggtcatgtgtgca

SEQ ID NO: 1754591 - DNA, 21 bp, Homo sapiens
cataggcggtcatgtgtgcat

SEQ ID NO: 1754592 - DNA, 22 bp, Homo sapiens
cataggcttcaattggtggaat

SEQ ID NO: 1754593 - DNA, 17 bp, Homo sapiens
catagggtcactttgcc

SEQ ID NO: 1754594 - DNA, 14 bp, Homo sapiens
cataggtcactggc

SEQ ID NO: 1754595 - DNA, 22 bp, Homo sapiens
cataggttaaaaaaaaaagtca

SEQ ID NO: 1754596 - DNA, 16 bp, Homo sapiens
cataggttactaccta

SEQ ID NO: 1754597 - DNA, 17 bp, Homo sapiens
cataggttactacctat

SEQ ID NO: 1754598 - DNA, 16 bp, Homo sapiens
cataggttagatatag

SEQ ID NO: 1754599 - DNA, 18 bp, Homo sapiens
cataggttttaaatctgc

SEQ ID NO: 1754600 - DNA, 17 bp, Homo sapiens
catagtaaagtattttt

SEQ ID NO: 1754601 - DNA, 20 bp, Homo sapiens
catagtaataagatggctgt

SEQ ID NO: 1754602 - DNA, 22 bp, Homo sapiens
catagtaccaatcattttaatt

SEQ ID NO: 1754603 - DNA, 21 bp, Homo sapiens
catagtactctttgtagcaaa

SEQ ID NO: 1754604 - DNA, 20 bp, Homo sapiens
catagtagtatgatgataca

SEQ ID NO: 1754605 - DNA, 18 bp, Homo sapiens
catagtataactttaaat

SEQ ID NO: 1754606 - DNA, 21 bp, Homo sapiens
catagtatcttcactgtgtta

SEQ ID NO: 1754607 - DNA, 13 bp, Homo sapiens
catagtcccagct

SEQ ID NO: 1754608 - DNA, 15 bp, Homo sapiens
catagtcctgttact

SEQ ID NO: 1754609 - DNA, 16 bp, Homo sapiens
catagtcttgaaatga

SEQ ID NO: 1754610 - DNA, 19 bp, Homo sapiens
catagtcttgaaatgaaag

SEQ ID NO: 1754611 - DNA, 21 bp, Homo sapiens
catagtcttgaaatgaaaggg

SEQ ID NO: 1754612 - DNA, 21 bp, Homo sapiens
catagtgagacccctgtctcc

SEQ ID NO: 1754613 - DNA, 18 bp, Homo sapiens
catagtgatggttcccct

SEQ ID NO: 1754614 - DNA, 22 bp, Homo sapiens
catagtgatggttcccctgttc

SEQ ID NO: 1754615 - DNA, 16 bp, Homo sapiens
catagttaaaaaagaa

SEQ ID NO: 1754616 - DNA, 13 bp, Homo sapiens
catagttactgta

SEQ ID NO: 1754617 - DNA, 19 bp, Homo sapiens
catagttactgtaaaatgc

SEQ ID NO: 1754618 - DNA, 21 bp, Homo sapiens
catagttactgtaaaatgcaa

SEQ ID NO: 1754619 - DNA, 23 bp, Homo sapiens
catagtttaagttgattaaaaat

SEQ ID NO: 1754620 - DNA, 20 bp, Homo sapiens
catctccttcccccagccca

SEQ ID NO: 1754621 - DNA, 22 bp, Homo sapiens
catctccttcccccagcccaat

SEQ ID NO: 1754622 - DNA, 16 bp, Homo sapiens
catctcgagccccctg

SEQ ID NO: 1754623 - DNA, 18 bp, Homo sapiens
catctcgagccccctgga

SEQ ID NO: 1754624 - DNA, 22 bp, Homo sapiens
catctcgggagtcctctagcag

SEQ ID NO: 1754625 - DNA, 15 bp, Homo sapiens
catctctactaaaaa

SEQ ID NO: 1754626 - DNA, 17 bp, Homo sapiens
catctctcatcctccag

SEQ ID NO: 1754627 - DNA, 15 bp, Homo sapiens
catctctccctcccc

SEQ ID NO: 1754628 - DNA, 14 bp, Homo sapiens
catctctctacctc

SEQ ID NO: 1754629 - DNA, 22 bp, Homo sapiens
catctctctacctccaccctgc

SEQ ID NO: 1754630 - DNA, 23 bp, Homo sapiens
catctctctactcctacctcagc

SEQ ID NO: 1754631 - DNA, 18 bp, Homo sapiens
catctctctgcccaaccc

SEQ ID NO: 1754632 - DNA, 22 bp, Homo sapiens
catctctctgccccacataatt

SEQ ID NO: 1754633 - DNA, 11 bp, Homo sapiens
catctctgcac

SEQ ID NO: 1754634 - DNA, 15 bp, Homo sapiens
catctctggcccaga

SEQ ID NO: 1754635 - DNA, 13 bp, Homo sapiens
catctcttcaggt

SEQ ID NO: 1754636 - DNA, 14 bp, Homo sapiens
catctcttcaggtt

SEQ ID NO: 1754637 - DNA, 15 bp, Homo sapiens
catctcttcaggttc

SEQ ID NO: 1754638 - DNA, 15 bp, Homo sapiens
catctcttctgcaag

SEQ ID NO: 1754639 - DNA, 14 bp, Homo sapiens
catctcttgaaacc

SEQ ID NO: 1754640 - DNA, 20 bp, Homo sapiens
catctcttgaggccaggagt

SEQ ID NO: 1754641 - DNA, 14 bp, Homo sapiens
catctgaaaagaaa

SEQ ID NO: 1754642 - DNA, 15 bp, Homo sapiens
catctgaaaagaaat

SEQ ID NO: 1754643 - DNA, 12 bp, Homo sapiens
catctgaaagcc

SEQ ID NO: 1754644 - DNA, 14 bp, Homo sapiens
catctgaaagccac

SEQ ID NO: 1754645 - DNA, 20 bp, Homo sapiens
catctgaatcccgggctaag

SEQ ID NO: 1754646 - DNA, 14 bp, Homo sapiens
catctgacacaaaa

SEQ ID NO: 1754647 - DNA, 15 bp, Homo sapiens
catctgacacaaaaa

SEQ ID NO: 1754648 - DNA, 16 bp, Homo sapiens
catctgacacaaaaaa

SEQ ID NO: 1754649 - DNA, 12 bp, Homo sapiens
catctgaccatc

SEQ ID NO: 1754650 - DNA, 17 bp, Homo sapiens
catctgactatgacata

SEQ ID NO: 1754651 - DNA, 19 bp, Homo sapiens
catctgactgccaagccag

SEQ ID NO: 1754652 - DNA, 21 bp, Homo sapiens
catctgactgccaagccagat

SEQ ID NO: 1754653 - DNA, 20 bp, Homo sapiens
catctgagaaggccctgtgc

SEQ ID NO: 1754654 - DNA, 23 bp, Homo sapiens
catctgagaaggccctgtgccct

SEQ ID NO: 1754655 - DNA, 15 bp, Homo sapiens
catctgaggttttat

SEQ ID NO: 1754656 - DNA, 17 bp, Homo sapiens
catctgatgtttcatat

SEQ ID NO: 1754657 - DNA, 15 bp, Homo sapiens
catctgattaaaaca

SEQ ID NO: 1754658 - DNA, 19 bp, Homo sapiens
catctgcaccccttctctc

SEQ ID NO: 1754659 - DNA, 22 bp, Homo sapiens
catctgcaccccttctctcctc

SEQ ID NO: 1754660 - DNA, 23 bp, Homo sapiens
catctgcatcactcatggaacac

SEQ ID NO: 1754661 - DNA, 12 bp, Homo sapiens
catctgcccagg

SEQ ID NO: 1754662 - DNA, 13 bp, Homo sapiens
catctgcccctcc

SEQ ID NO: 1754663 - DNA, 15 bp, Homo sapiens
catctgcccctcccc

SEQ ID NO: 1754664 - DNA, 16 bp, Homo sapiens
catctgcccctccccc

SEQ ID NO: 1754665 - DNA, 13 bp, Homo sapiens
catctgctctaga

SEQ ID NO: 1754666 - DNA, 16 bp, Homo sapiens
catctgctctagggaa

SEQ ID NO: 1754667 - DNA, 15 bp, Homo sapiens
catctgctctccttc

SEQ ID NO: 1754668 - DNA, 16 bp, Homo sapiens
catctgctctccttcc

SEQ ID NO: 1754669 - DNA, 18 bp, Homo sapiens
catctgctctccttcctg

SEQ ID NO: 1754670 - DNA, 19 bp, Homo sapiens
catctgctggtccgtggga

SEQ ID NO: 1754671 - DNA, 22 bp, Homo sapiens
catctgcttggttggctggcag

SEQ ID NO: 1754672 - DNA, 16 bp, Homo sapiens
catctggaatctggag

SEQ ID NO: 1754673 - DNA, 21 bp, Homo sapiens
catctggaatctggagaccag

SEQ ID NO: 1754674 - DNA, 16 bp, Homo sapiens
catctggatgtaaatc

SEQ ID NO: 1754675 - DNA, 17 bp, Homo sapiens
catctggatgtaaatcc

SEQ ID NO: 1754676 - DNA, 22 bp, Homo sapiens
catctggcggaggtctctggga

SEQ ID NO: 1754677 - DNA, 14 bp, Homo sapiens
catctggctcagca

SEQ ID NO: 1754678 - DNA, 15 bp, Homo sapiens
catctgggtgccctg

SEQ ID NO: 1754679 - DNA, 16 bp, Homo sapiens
catctgggtgccctga

SEQ ID NO: 1754680 - DNA, 16 bp, Homo sapiens
catctgtaagagcttg

SEQ ID NO: 1754681 - DNA, 17 bp, Homo sapiens
catctgtacctctgcct

SEQ ID NO: 1754682 - DNA, 12 bp, Homo sapiens
catctgtagata

SEQ ID NO: 1754683 - DNA, 23 bp, Homo sapiens
catctgtctgccaacctaaaact

SEQ ID NO: 1754684 - DNA, 17 bp, Homo sapiens
catctgtcttgccagcc

SEQ ID NO: 1754685 - DNA, 21 bp, Homo sapiens
catctgtgactataaagctgt

SEQ ID NO: 1754686 - DNA, 20 bp, Homo sapiens
catctgtggagctgccacag

SEQ ID NO: 1754687 - DNA, 13 bp, Homo sapiens
catctgtgtattt

SEQ ID NO: 1754688 - DNA, 16 bp, Homo sapiens
catctgttagggcctt

SEQ ID NO: 1754689 - DNA, 17 bp, Homo sapiens
catctgtttcaaactga

SEQ ID NO: 1754690 - DNA, 15 bp, Homo sapiens
catcttaatgttact

SEQ ID NO: 1754691 - DNA, 14 bp, Homo sapiens
catcttactgaagg

SEQ ID NO: 1754692 - DNA, 16 bp, Homo sapiens
catcttcaatatgaat

SEQ ID NO: 1754693 - DNA, 15 bp, Homo sapiens
catcttcactgcaat

SEQ ID NO: 1754694 - DNA, 14 bp, Homo sapiens
catcttcacttcta

SEQ ID NO: 1754695 - DNA, 10 bp, Homo sapiens
catcttccca

SEQ ID NO: 1754696 - DNA, 12 bp, Homo sapiens
catcttcccagc

SEQ ID NO: 1754697 - DNA, 15 bp, Homo sapiens
catcttcctgtgtcc

SEQ ID NO: 1754698 - DNA, 16 bp, Homo sapiens
catcttcctgtgtcct

SEQ ID NO: 1754699 - DNA, 23 bp, Homo sapiens
catcttctccccgaggctgcccc

SEQ ID NO: 1754700 - DNA, 12 bp, Homo sapiens
catcttctggct

SEQ ID NO: 1754701 - DNA, 17 bp, Homo sapiens
catcttctggcttgact

SEQ ID NO: 1754702 - DNA, 14 bp, Homo sapiens
catcttcttccctt

SEQ ID NO: 1754703 - DNA, 22 bp, Homo sapiens
catcttcttcccttaactccaa

SEQ ID NO: 1754704 - DNA, 16 bp, Homo sapiens
catcttgagccacagt

SEQ ID NO: 1754705 - DNA, 21 bp, Homo sapiens
catcttgcagcatttactatg

SEQ ID NO: 1754706 - DNA, 22 bp, Homo sapiens
catcttgccaagggtccctgtg

SEQ ID NO: 1754707 - DNA, 20 bp, Homo sapiens
catcttgctaccagtattta

SEQ ID NO: 1754708 - DNA, 15 bp, Homo sapiens
catcttgcttcccta

SEQ ID NO: 1754709 - DNA, 16 bp, Homo sapiens
catcttggagggacca

SEQ ID NO: 1754710 - DNA, 19 bp, Homo sapiens
catcttggtagttctgtgc

SEQ ID NO: 1754711 - DNA, 17 bp, Homo sapiens
catcttgtatacacata

SEQ ID NO: 1754712 - DNA, 18 bp, Homo sapiens
catcttgtggggccagga

SEQ ID NO: 1754713 - DNA, 10 bp, Homo sapiens
catctttaag

SEQ ID NO: 1754714 - DNA, 22 bp, Homo sapiens
catctttatagaaggaatttgt

SEQ ID NO: 1754715 - DNA, 17 bp, Homo sapiens
catctttatctgttctt

SEQ ID NO: 1754716 - DNA, 17 bp, Homo sapiens
catctttattgaaattc

SEQ ID NO: 1754717 - DNA, 14 bp, Homo sapiens
catctttcacactt

SEQ ID NO: 1754718 - DNA, 21 bp, Homo sapiens
catctttccatccattacctc

SEQ ID NO: 1754719 - DNA, 23 bp, Homo sapiens
catctttcctcaagtatcttcta

SEQ ID NO: 1754720 - DNA, 16 bp, Homo sapiens
catctttcttctattt

SEQ ID NO: 1754721 - DNA, 22 bp, Homo sapiens
catctttgcctcaactccagga

SEQ ID NO: 1754722 - DNA, 23 bp, Homo sapiens
catctttgccttgggctgctcct

SEQ ID NO: 1754723 - DNA, 15 bp, Homo sapiens
catcttttattttgg

SEQ ID NO: 1754724 - DNA, 20 bp, Homo sapiens
catcttttcctgatggctgg

SEQ ID NO: 1754725 - DNA, 21 bp, Homo sapiens
catcttttctaatcacagtgt

SEQ ID NO: 1754726 - DNA, 19 bp, Homo sapiens
catcttttctagagacaca

SEQ ID NO: 1754727 - DNA, 21 bp, Homo sapiens
catcttttcttgcctctgtcc

SEQ ID NO: 1754728 - DNA, 15 bp, Homo sapiens
catcttttgatcttt

SEQ ID NO: 1754729 - DNA, 18 bp, Homo sapiens
catcttttttgttaactg

SEQ ID NO: 1754730 - DNA, 12 bp, Homo sapiens
catgaaaaagca

SEQ ID NO: 1754731 - DNA, 18 bp, Homo sapiens
catgaaaaagcagctacc

SEQ ID NO: 1754732 - DNA, 14 bp, Homo sapiens
catgaaaaagctgc

SEQ ID NO: 1754733 - DNA, 20 bp, Homo sapiens
catgaaaaatcatgggccag

SEQ ID NO: 1754734 - DNA, 21 bp, Homo sapiens
catgaaaaatcatgggccaga

SEQ ID NO: 1754735 - DNA, 22 bp, Homo sapiens
catgaaaaatcatgggccagag

SEQ ID NO: 1754736 - DNA, 21 bp, Homo sapiens
catgaaaacaagaaagaaatg

SEQ ID NO: 1754737 - DNA, 18 bp, Homo sapiens
catgaaaacacacataca

SEQ ID NO: 1754738 - DNA, 22 bp, Homo sapiens
catgaaacttgtttcactgaaa

SEQ ID NO: 1754739 - DNA, 20 bp, Homo sapiens
catgaaagttttgcaaaggg

SEQ ID NO: 1754740 - DNA, 22 bp, Homo sapiens
catgaaatatagatcagttata

SEQ ID NO: 1754741 - DNA, 13 bp, Homo sapiens
catgaaatgaatg

SEQ ID NO: 1754742 - DNA, 14 bp, Homo sapiens
catgaaatgaatgt

SEQ ID NO: 1754743 - DNA, 20 bp, Homo sapiens
catgaaatgtgaatttttat

SEQ ID NO: 1754744 - DNA, 23 bp, Homo sapiens
catgaaatgtgaatttttattgt

SEQ ID NO: 1754745 - DNA, 19 bp, Homo sapiens
catgaaattcttcctaatg

SEQ ID NO: 1754746 - DNA, 17 bp, Homo sapiens
catgaaattgtatctca

SEQ ID NO: 1754747 - DNA, 24 bp, Homo sapiens
catgaaattgtctagcagagcagg

SEQ ID NO: 1754748 - DNA, 15 bp, Homo sapiens
catgaacaaattctt

SEQ ID NO: 1754749 - DNA, 21 bp, Homo sapiens
catgaacaaattctttagtac

SEQ ID NO: 1754750 - DNA, 22 bp, Homo sapiens
catgaacaaattctttagtact

SEQ ID NO: 1754751 - DNA, 17 bp, Homo sapiens
catgaacacactgtgtc

SEQ ID NO: 1754752 - DNA, 20 bp, Homo sapiens
catgaacacactgtgtcctg

SEQ ID NO: 1754753 - DNA, 18 bp, Homo sapiens
catgaacacccttagaaa

SEQ ID NO: 1754754 - DNA, 20 bp, Homo sapiens
catgaagagcttgtgtcctg

SEQ ID NO: 1754755 - DNA, 15 bp, Homo sapiens
catgaagcaggaggc

SEQ ID NO: 1754756 - DNA, 20 bp, Homo sapiens
catgaaggtaaataaaaaga

SEQ ID NO: 1754757 - DNA, 21 bp, Homo sapiens
catgaaggtaaataaaaagaa

SEQ ID NO: 1754758 - DNA, 16 bp, Homo sapiens
catgaagtaaattatg

SEQ ID NO: 1754759 - DNA, 19 bp, Homo sapiens
catgaagtgcacaggagcc

SEQ ID NO: 1754760 - DNA, 16 bp, Homo sapiens
catgaataaaacactc

SEQ ID NO: 1754761 - DNA, 14 bp, Homo sapiens
catgaatcactgtg

SEQ ID NO: 1754762 - DNA, 15 bp, Homo sapiens
catgaatcactgtgc

SEQ ID NO: 1754763 - DNA, 21 bp, Homo sapiens
catgaatcactgtgctcagcc

SEQ ID NO: 1754764 - DNA, 15 bp, Homo sapiens
catgaatgtgctggt

SEQ ID NO: 1754765 - DNA, 18 bp, Homo sapiens
catgaattatataatttt

SEQ ID NO: 1754766 - DNA, 12 bp, Homo sapiens
catgaattccct

SEQ ID NO: 1754767 - DNA, 14 bp, Homo sapiens
catgaattttaaag

SEQ ID NO: 1754768 - DNA, 16 bp, Homo sapiens
catgaattttaaagta

SEQ ID NO: 1754769 - DNA, 21 bp, Homo sapiens
catgaattttaaagtatgcat

SEQ ID NO: 1754770 - DNA, 21 bp, Homo sapiens
catgaatttttttcatcttct

SEQ ID NO: 1754771 - DNA, 19 bp, Homo sapiens
catgacaagatgggacagc

SEQ ID NO: 1754772 - DNA, 13 bp, Homo sapiens
catgacaatcacc

SEQ ID NO: 1754773 - DNA, 15 bp, Homo sapiens
catgacagaaaatat

SEQ ID NO: 1754774 - DNA, 13 bp, Homo sapiens
catgacagccaga

SEQ ID NO: 1754775 - DNA, 19 bp, Homo sapiens
catgacagccagagcctgt

SEQ ID NO: 1754776 - DNA, 13 bp, Homo sapiens
catgacagcctcc

SEQ ID NO: 1754777 - DNA, 14 bp, Homo sapiens
catgacagcctgca

SEQ ID NO: 1754778 - DNA, 18 bp, Homo sapiens
catgaccatactgaggga

SEQ ID NO: 1754779 - DNA, 12 bp, Homo sapiens
catgacccaccc

SEQ ID NO: 1754780 - DNA, 15 bp, Homo sapiens
catgacccacccctg

SEQ ID NO: 1754781 - DNA, 18 bp, Homo sapiens
catgacctagttttccat

SEQ ID NO: 1754782 - DNA, 18 bp, Homo sapiens
catgacctgtgaccagca

SEQ ID NO: 1754783 - DNA, 20 bp, Homo sapiens
catgacgggttgtgagactt

SEQ ID NO: 1754784 - DNA, 20 bp, Homo sapiens
catgactaatgctttttaga

SEQ ID NO: 1754785 - DNA, 21 bp, Homo sapiens
catgactaatgctttttagaa

SEQ ID NO: 1754786 - DNA, 17 bp, Homo sapiens
catgactcgggggtggg

SEQ ID NO: 1754787 - DNA, 14 bp, Homo sapiens
catgacttattatg

SEQ ID NO: 1754788 - DNA, 20 bp, Homo sapiens
catgacttattatgcataaa

SEQ ID NO: 1754789 - DNA, 17 bp, Homo sapiens
catgagaagagggcctg

SEQ ID NO: 1754790 - DNA, 22 bp, Homo sapiens
catgagaatgctagcaggctgt

SEQ ID NO: 1754791 - DNA, 17 bp, Homo sapiens
catgagaatttgcaaca

SEQ ID NO: 1754792 - DNA, 17 bp, Homo sapiens
catgagaccactgttat

SEQ ID NO: 1754793 - DNA, 17 bp, Homo sapiens
catgagactcagtgcag

SEQ ID NO: 1754794 - DNA, 18 bp, Homo sapiens
catgagactcagtgcaga

SEQ ID NO: 1754795 - DNA, 19 bp, Homo sapiens
catgagactcagtgcagat

SEQ ID NO: 1754796 - DNA, 17 bp, Homo sapiens
catgagatggagaggct

SEQ ID NO: 1754797 - DNA, 22 bp, Homo sapiens
catgagatggagaggctgaggg

SEQ ID NO: 1754798 - DNA, 17 bp, Homo sapiens
catgagatgtgtggact

SEQ ID NO: 1754799 - DNA, 16 bp, Homo sapiens
catgagcaagcctagg

SEQ ID NO: 1754800 - DNA, 15 bp, Homo sapiens
catgagcctgctgga

SEQ ID NO: 1754801 - DNA, 16 bp, Homo sapiens
catgagcctgctggaa

SEQ ID NO: 1754802 - DNA, 14 bp, Homo sapiens
catgagctggcaac

SEQ ID NO: 1754803 - DNA, 17 bp, Homo sapiens
catgagctggcaaccag

SEQ ID NO: 1754804 - DNA, 20 bp, Homo sapiens
catgagctggcaaccagcca

SEQ ID NO: 1754805 - DNA, 18 bp, Homo sapiens
catgaggacagaaggact

SEQ ID NO: 1754806 - DNA, 19 bp, Homo sapiens
catgaggacagaaggactg

SEQ ID NO: 1754807 - DNA, 15 bp, Homo sapiens
catgaggagcgtgga

SEQ ID NO: 1754808 - DNA, 12 bp, Homo sapiens
catgaggagggt

SEQ ID NO: 1754809 - DNA, 16 bp, Homo sapiens
catgaggagttgctgt

SEQ ID NO: 1754810 - DNA, 15 bp, Homo sapiens
catgaggccatctca

SEQ ID NO: 1754811 - DNA, 16 bp, Homo sapiens
catgaggccatctcag

SEQ ID NO: 1754812 - DNA, 21 bp, Homo sapiens
catgaggccatctcaggagat

SEQ ID NO: 1754813 - DNA, 17 bp, Homo sapiens
catgagggatcacaggg

SEQ ID NO: 1754814 - DNA, 15 bp, Homo sapiens
catgaggggagagga

SEQ ID NO: 1754815 - DNA, 20 bp, Homo sapiens
catgaggtactggtcccttc

SEQ ID NO: 1754816 - DNA, 15 bp, Homo sapiens
catgagtcaaaacaa

SEQ ID NO: 1754817 - DNA, 17 bp, Homo sapiens
catgagtcaaaacaaag

SEQ ID NO: 1754818 - DNA, 18 bp, Homo sapiens
catgagtcactacgcctg

SEQ ID NO: 1754819 - DNA, 19 bp, Homo sapiens
catgagtccttgaaaatat

SEQ ID NO: 1754820 - DNA, 18 bp, Homo sapiens
catgagttatcatgaatt

SEQ ID NO: 1754821 - DNA, 21 bp, Homo sapiens
catgataccacctttactgtg

SEQ ID NO: 1754822 - DNA, 15 bp, Homo sapiens
catgatctccctgcc

SEQ ID NO: 1754823 - DNA, 21 bp, Homo sapiens
catgatctccctgccgcctca

SEQ ID NO: 1754824 - DNA, 18 bp, Homo sapiens
catgatgggaaaatattt

SEQ ID NO: 1754825 - DNA, 20 bp, Homo sapiens
catgatgggaaaatatttcc

SEQ ID NO: 1754826 - DNA, 20 bp, Homo sapiens
catgatgggaatagggagac

SEQ ID NO: 1754827 - DNA, 16 bp, Homo sapiens
catgatggtgcatgcc

SEQ ID NO: 1754828 - DNA, 23 bp, Homo sapiens
catgatggttattttcttttctt

SEQ ID NO: 1754829 - DNA, 19 bp, Homo sapiens
catgatgttaaccagaata

SEQ ID NO: 1754830 - DNA, 21 bp, Homo sapiens
catgatgtttgcccaaaattt

SEQ ID NO: 1754831 - DNA, 21 bp, Homo sapiens
catgattcatgccaattagca

SEQ ID NO: 1754832 - DNA, 21 bp, Homo sapiens
catgattctttaatagaagtt

SEQ ID NO: 1754833 - DNA, 23 bp, Homo sapiens
catgatttcccactgcactccag

SEQ ID NO: 1754834 - DNA, 19 bp, Homo sapiens
catgatttgtcccagcctg

SEQ ID NO: 1754835 - DNA, 21 bp, Homo sapiens
catgatttgtcccagcctggg

SEQ ID NO: 1754836 - DNA, 22 bp, Homo sapiens
catgattttaagtttctctgca

SEQ ID NO: 1754837 - DNA, 22 bp, Homo sapiens
catgcaaatgagctctgaaatc

SEQ ID NO: 1754838 - DNA, 16 bp, Homo sapiens
catgcaagtattctca

SEQ ID NO: 1754839 - DNA, 18 bp, Homo sapiens
catgcaataaaatttaaa

SEQ ID NO: 1754840 - DNA, 15 bp, Homo sapiens
catgcaatttgaagt

SEQ ID NO: 1754841 - DNA, 14 bp, Homo sapiens
catgcaattttatt

SEQ ID NO: 1754842 - DNA, 14 bp, Homo sapiens
catgcacacacttg

SEQ ID NO: 1754843 - DNA, 14 bp, Homo sapiens
catgcacactcatg

SEQ ID NO: 1754844 - DNA, 12 bp, Homo sapiens
catgcacagctg

SEQ ID NO: 1754845 - DNA, 13 bp, Homo sapiens
catgcacagctgc

SEQ ID NO: 1754846 - DNA, 15 bp, Homo sapiens
catgcacagctgctt

SEQ ID NO: 1754847 - DNA, 16 bp, Homo sapiens
catgcacagctgcttg

SEQ ID NO: 1754848 - DNA, 21 bp, Homo sapiens
catgcacagctgcttgtcctg

SEQ ID NO: 1754849 - DNA, 16 bp, Homo sapiens
cattcaaaagttgaaa

SEQ ID NO: 1754850 - DNA, 16 bp, Homo sapiens
cattcaaaatagttct

SEQ ID NO: 1754851 - DNA, 22 bp, Homo sapiens
cattcaaaatagttctatttct

SEQ ID NO: 1754852 - DNA, 23 bp, Homo sapiens
cattcaaaatagttctatttcta

SEQ ID NO: 1754853 - DNA, 14 bp, Homo sapiens
cattcaaatcagtg

SEQ ID NO: 1754854 - DNA, 17 bp, Homo sapiens
cattcaaatcagtgatc

SEQ ID NO: 1754855 - DNA, 18 bp, Homo sapiens
cattcaacagagactgaa

SEQ ID NO: 1754856 - DNA, 16 bp, Homo sapiens
cattcaaggcttattt

SEQ ID NO: 1754857 - DNA, 13 bp, Homo sapiens
cattcaatgttta

SEQ ID NO: 1754858 - DNA, 22 bp, Homo sapiens
cattcacagttctttgggccag

SEQ ID NO: 1754859 - DNA, 21 bp, Homo sapiens
cattcacatttgatgtacatg

SEQ ID NO: 1754860 - DNA, 22 bp, Homo sapiens
cattcaccaaatgatgccactt

SEQ ID NO: 1754861 - DNA, 14 bp, Homo sapiens
cattcactcttcca

SEQ ID NO: 1754862 - DNA, 11 bp, Homo sapiens
cattcacttca

SEQ ID NO: 1754863 - DNA, 15 bp, Homo sapiens
cattcagaaatgttg

SEQ ID NO: 1754864 - DNA, 17 bp, Homo sapiens
cattcagatcactgaat

SEQ ID NO: 1754865 - DNA, 16 bp, Homo sapiens
cattcagcatgggtcc

SEQ ID NO: 1754866 - DNA, 14 bp, Homo sapiens
cattcagctctgga

SEQ ID NO: 1754867 - DNA, 15 bp, Homo sapiens
cattcagctctggag

SEQ ID NO: 1754868 - DNA, 13 bp, Homo sapiens
cattcaggaaaac

SEQ ID NO: 1754869 - DNA, 23 bp, Homo sapiens
cattcaggaaaactgacagagga

SEQ ID NO: 1754870 - DNA, 13 bp, Homo sapiens
cattcaggaattc

SEQ ID NO: 1754871 - DNA, 23 bp, Homo sapiens
cattcagtccgcctggccggctc

SEQ ID NO: 1754872 - DNA, 22 bp, Homo sapiens
cattcatattaagacagtgtac

SEQ ID NO: 1754873 - DNA, 23 bp, Homo sapiens
cattcatgcaagagtttcttgta

SEQ ID NO: 1754874 - DNA, 17 bp, Homo sapiens
cattccaaatgctttca

SEQ ID NO: 1754875 - DNA, 18 bp, Homo sapiens
cattccaagactctagag

SEQ ID NO: 1754876 - DNA, 17 bp, Homo sapiens
cattccaattctaaatc

SEQ ID NO: 1754877 - DNA, 16 bp, Homo sapiens
cattccacatctgttt

SEQ ID NO: 1754878 - DNA, 14 bp, Homo sapiens
cattccagaggaag

SEQ ID NO: 1754879 - DNA, 13 bp, Homo sapiens
cattccagagtgc

SEQ ID NO: 1754880 - DNA, 19 bp, Homo sapiens
cattccagagttaaaatgt

SEQ ID NO: 1754881 - DNA, 13 bp, Homo sapiens
cattccagcccct

SEQ ID NO: 1754882 - DNA, 15 bp, Homo sapiens
cattccagcccctct

SEQ ID NO: 1754883 - DNA, 18 bp, Homo sapiens
cattccagcccctctggt

SEQ ID NO: 1754884 - DNA, 22 bp, Homo sapiens
cattccagcccctctggtcgct

SEQ ID NO: 1754885 - DNA, 13 bp, Homo sapiens
cattccagctctg

SEQ ID NO: 1754886 - DNA, 16 bp, Homo sapiens
cattccagctctgccc

SEQ ID NO: 1754887 - DNA, 22 bp, Homo sapiens
cattccagctgtcactctgtgc

SEQ ID NO: 1754888 - DNA, 18 bp, Homo sapiens
cattccaggcagcctctg

SEQ ID NO: 1754889 - DNA, 21 bp, Homo sapiens
cattccaggcagcctctgtca

SEQ ID NO: 1754890 - DNA, 15 bp, Homo sapiens
cattccagtaacttt

SEQ ID NO: 1754891 - DNA, 20 bp, Homo sapiens
cattccagtaacttttttgt

SEQ ID NO: 1754892 - DNA, 21 bp, Homo sapiens
cattcccaacgtgcaaagcca

SEQ ID NO: 1754893 - DNA, 17 bp, Homo sapiens
cattccccaggtggctg

SEQ ID NO: 1754894 - DNA, 20 bp, Homo sapiens
cattcccccatgtggctgaa

SEQ ID NO: 1754895 - DNA, 23 bp, Homo sapiens
cattcccctcccacctctccttt

SEQ ID NO: 1754896 - DNA, 23 bp, Homo sapiens
cattcccctttgcactgtaatga

SEQ ID NO: 1754897 - DNA, 17 bp, Homo sapiens
cattccctgagtcacca

SEQ ID NO: 1754898 - DNA, 23 bp, Homo sapiens
cattcccttggatgtagtctgag

SEQ ID NO: 1754899 - DNA, 17 bp, Homo sapiens
cattccggactggcaga

SEQ ID NO: 1754900 - DNA, 20 bp, Homo sapiens
cattccggactggcagaagc

SEQ ID NO: 1754901 - DNA, 21 bp, Homo sapiens
cattccggactggcagaagca

SEQ ID NO: 1754902 - DNA, 16 bp, Homo sapiens
cattccgttgtctgtg

SEQ ID NO: 1754903 - DNA, 21 bp, Homo sapiens
cattcctaacacagcatgtgt

SEQ ID NO: 1754904 - DNA, 15 bp, Homo sapiens
cattcctaactagaa

SEQ ID NO: 1754905 - DNA, 19 bp, Homo sapiens
cattcctaactagaattag

SEQ ID NO: 1754906 - DNA, 21 bp, Homo sapiens
cattcctaactagaattagta

SEQ ID NO: 1754907 - DNA, 14 bp, Homo sapiens
cattcctcagctgc

SEQ ID NO: 1754908 - DNA, 14 bp, Homo sapiens
cattcctctgccct

SEQ ID NO: 1754909 - DNA, 13 bp, Homo sapiens
cattcctgaagaa

SEQ ID NO: 1754910 - DNA, 20 bp, Homo sapiens
cattcctgaagaaccagtcc

SEQ ID NO: 1754911 - DNA, 15 bp, Homo sapiens
cattcctgcctgtct

SEQ ID NO: 1754912 - DNA, 16 bp, Homo sapiens
cattcctgcctgtctc

SEQ ID NO: 1754913 - DNA, 15 bp, Homo sapiens
cattcctgcctttaa

SEQ ID NO: 1754914 - DNA, 15 bp, Homo sapiens
cattcctggtaccca

SEQ ID NO: 1754915 - DNA, 17 bp, Homo sapiens
cattcctggtacccagc

SEQ ID NO: 1754916 - DNA, 20 bp, Homo sapiens
cattcctggtacccagccat

SEQ ID NO: 1754917 - DNA, 13 bp, Homo sapiens
cattcctgtgccc

SEQ ID NO: 1754918 - DNA, 17 bp, Homo sapiens
cattccttctggcctct

SEQ ID NO: 1754919 - DNA, 15 bp, Homo sapiens
cattccttgtcacca

SEQ ID NO: 1754920 - DNA, 17 bp, Homo sapiens
cattccttgtcaccagc

SEQ ID NO: 1754921 - DNA, 16 bp, Homo sapiens
cattcgacctataaga

SEQ ID NO: 1754922 - DNA, 22 bp, Homo sapiens
cattcgcctttgtcttgtactt

SEQ ID NO: 1754923 - DNA, 14 bp, Homo sapiens
cattcggactgctg

SEQ ID NO: 1754924 - DNA, 16 bp, Homo sapiens
cattcgtctgtcccag

SEQ ID NO: 1754925 - DNA, 21 bp, Homo sapiens
cattcgtgaaaaccaaccctg

SEQ ID NO: 1754926 - DNA, 21 bp, Homo sapiens
cattcgttgtgttttttaaga

SEQ ID NO: 1754927 - DNA, 15 bp, Homo sapiens
cattctaaaccaaaa

SEQ ID NO: 1754928 - DNA, 14 bp, Homo sapiens
cattctaatttgca

SEQ ID NO: 1754929 - DNA, 15 bp, Homo sapiens
cattctactgaaaag

SEQ ID NO: 1754930 - DNA, 11 bp, Homo sapiens
cattctagatc

SEQ ID NO: 1754931 - DNA, 14 bp, Homo sapiens
cattctaggatgtg

SEQ ID NO: 1754932 - DNA, 15 bp, Homo sapiens
cattctaggatgtgg

SEQ ID NO: 1754933 - DNA, 16 bp, Homo sapiens
cattctaggatgtgga

SEQ ID NO: 1754934 - DNA, 14 bp, Homo sapiens
cattctcaagccct

SEQ ID NO: 1754935 - DNA, 18 bp, Homo sapiens
cattctcaccctgtgaaa

SEQ ID NO: 1754936 - DNA, 13 bp, Homo sapiens
cattctcccgctt

SEQ ID NO: 1754937 - DNA, 16 bp, Homo sapiens
cattctcctgcctcag

SEQ ID NO: 1754938 - DNA, 15 bp, Homo sapiens
cattctccttgttgt

SEQ ID NO: 1754939 - DNA, 16 bp, Homo sapiens
cattctctctcctgtc

SEQ ID NO: 1754940 - DNA, 18 bp, Homo sapiens
cattctctttgataacaa

SEQ ID NO: 1754941 - DNA, 17 bp, Homo sapiens
cattctgaccatttcag

SEQ ID NO: 1754942 - DNA, 21 bp, Homo sapiens
cattctgcattgctagataaa

SEQ ID NO: 1754943 - DNA, 15 bp, Homo sapiens
cattctgccccagag

SEQ ID NO: 1754944 - DNA, 18 bp, Homo sapiens
cattctgccccagagtgg

SEQ ID NO: 1754945 - DNA, 21 bp, Homo sapiens
cattctgccgccccctcctga

SEQ ID NO: 1754946 - DNA, 14 bp, Homo sapiens
cattctgcctagag

SEQ ID NO: 1754947 - DNA, 21 bp, Homo sapiens
cattctgcctcagcctcctga

SEQ ID NO: 1754948 - DNA, 18 bp, Homo sapiens
cattctgcctctctagga

SEQ ID NO: 1754949 - DNA, 20 bp, Homo sapiens
cattctggaggggagagctt

SEQ ID NO: 1754950 - DNA, 18 bp, Homo sapiens
cattctggatagagtcct

SEQ ID NO: 1754951 - DNA, 21 bp, Homo sapiens
cattctggtcaagggctgtca

SEQ ID NO: 1754952 - DNA, 14 bp, Homo sapiens
cattcttagctctt

SEQ ID NO: 1754953 - DNA, 17 bp, Homo sapiens
cattcttagctcttaat

SEQ ID NO: 1754954 - DNA, 13 bp, Homo sapiens
cattcttatttta

SEQ ID NO: 1754955 - DNA, 20 bp, Homo sapiens
cattcttccatcatcactgt

SEQ ID NO: 1754956 - DNA, 21 bp, Homo sapiens
cattcttccatcatcactgta

SEQ ID NO: 1754957 - DNA, 23 bp, Homo sapiens
cattcttccatcatcactgtaaa

SEQ ID NO: 1754958 - DNA, 21 bp, Homo sapiens
cattcttcccaacttgccttt

SEQ ID NO: 1754959 - DNA, 18 bp, Homo sapiens
cattcttcctagttttct

SEQ ID NO: 1754960 - DNA, 21 bp, Homo sapiens
cattcttcctagttttctcct

SEQ ID NO: 1754961 - DNA, 12 bp, Homo sapiens
cattcttggctt

SEQ ID NO: 1754962 - DNA, 19 bp, Homo sapiens
cattcttggcttaatcatt

SEQ ID NO: 1754963 - DNA, 16 bp, Homo sapiens
cattctttactgcact

SEQ ID NO: 1754964 - DNA, 13 bp, Homo sapiens
ccaaaacttccaa

SEQ ID NO: 1754965 - DNA, 19 bp, Homo sapiens
ccaaaagattgctgaaatt

SEQ ID NO: 1754966 - DNA, 23 bp, Homo sapiens
ccaaaagattgctgaaattttat

SEQ ID NO: 1754967 - DNA, 15 bp, Homo sapiens
ccaaaagcagtaaat

SEQ ID NO: 1754968 - DNA, 23 bp, Homo sapiens
ccaaaaggtttaagaaatagaat

SEQ ID NO: 1754969 - DNA, 21 bp, Homo sapiens
ccaaaagtcaaaaggtgcctg

SEQ ID NO: 1754970 - DNA, 12 bp, Homo sapiens
ccaaaatattaa

SEQ ID NO: 1754971 - DNA, 19 bp, Homo sapiens
ccaaaatattaacattctt

SEQ ID NO: 1754972 - DNA, 18 bp, Homo sapiens
ccaaaatccaaaacttct

SEQ ID NO: 1754973 - DNA, 16 bp, Homo sapiens
ccaaaatctcaagaaa

SEQ ID NO: 1754974 - DNA, 22 bp, Homo sapiens
ccaaaatggtacagcttctgga

SEQ ID NO: 1754975 - DNA, 20 bp, Homo sapiens
ccaaaatgttggtcatttta

SEQ ID NO: 1754976 - DNA, 21 bp, Homo sapiens
ccaaaatttattttataagaa

SEQ ID NO: 1754977 - DNA, 13 bp, Homo sapiens
ccaaaatttgatg

SEQ ID NO: 1754978 - DNA, 15 bp, Homo sapiens
ccaaaattttaaaaa

SEQ ID NO: 1754979 - DNA, 12 bp, Homo sapiens
ccaaacaaggaa

SEQ ID NO: 1754980 - DNA, 20 bp, Homo sapiens
ccaaacaccttccagctcct

SEQ ID NO: 1754981 - DNA, 22 bp, Homo sapiens
ccaaacaccttccagctcctgt

SEQ ID NO: 1754982 - DNA, 12 bp, Homo sapiens
ccaaacactcag

SEQ ID NO: 1754983 - DNA, 13 bp, Homo sapiens
ccaaacacttctg

SEQ ID NO: 1754984 - DNA, 15 bp, Homo sapiens
ccaaacacttctgct

SEQ ID NO: 1754985 - DNA, 19 bp, Homo sapiens
ccaaacacttctgctttca

SEQ ID NO: 1754986 - DNA, 16 bp, Homo sapiens
ccaaacagctgcctct

SEQ ID NO: 1754987 - DNA, 13 bp, Homo sapiens
ccaaacatcagac

SEQ ID NO: 1754988 - DNA, 15 bp, Homo sapiens
ccaaacatcagacct

SEQ ID NO: 1754989 - DNA, 16 bp, Homo sapiens
ccaaaccacaagactc

SEQ ID NO: 1754990 - DNA, 14 bp, Homo sapiens
ccaaaccctcctgg

SEQ ID NO: 1754991 - DNA, 18 bp, Homo sapiens
ccaaacctccagcctccc

SEQ ID NO: 1754992 - DNA, 13 bp, Homo sapiens
ccaaacctgtctt

SEQ ID NO: 1754993 - DNA, 21 bp, Homo sapiens
ccaaacgccctttcctcctca

SEQ ID NO: 1754994 - DNA, 16 bp, Homo sapiens
ccaaactactgaatga

SEQ ID NO: 1754995 - DNA, 13 bp, Homo sapiens
ccaaactctgcca

SEQ ID NO: 1754996 - DNA, 12 bp, Homo sapiens
ccaaactgccta

SEQ ID NO: 1754997 - DNA, 16 bp, Homo sapiens
ccaaactgttcaagaa

SEQ ID NO: 1754998 - DNA, 22 bp, Homo sapiens
ccaaagaaaaagggctgccggg

SEQ ID NO: 1754999 - DNA, 14 bp, Homo sapiens
ccaaagaaacaagc

SEQ ID NO: 1755000 - DNA, 15 bp, Homo sapiens
ccaaagaaacaagct

SEQ ID NO: 1755001 - DNA, 17 bp, Homo sapiens
ccaaagaaacaagctgt

SEQ ID NO: 1755002 - DNA, 18 bp, Homo sapiens
ccaaagaaacaagctgtg

SEQ ID NO: 1755003 - DNA, 20 bp, Homo sapiens
ccaaagaaacaagctgtgca

SEQ ID NO: 1755004 - DNA, 17 bp, Homo sapiens
ccaaagaaatgtaaggg

SEQ ID NO: 1755005 - DNA, 14 bp, Homo sapiens
ccaaagaatgaatt

SEQ ID NO: 1755006 - DNA, 14 bp, Homo sapiens
ccaaagacctgcct

SEQ ID NO: 1755007 - DNA, 17 bp, Homo sapiens
ccaaagactatttcaaa

SEQ ID NO: 1755008 - DNA, 15 bp, Homo sapiens
ccaaagactctggag

SEQ ID NO: 1755009 - DNA, 17 bp, Homo sapiens
ccaaagactctggaggt

SEQ ID NO: 1755010 - DNA, 18 bp, Homo sapiens
ccaaagactctggaggtc

SEQ ID NO: 1755011 - DNA, 13 bp, Homo sapiens
ccaaagactgcag

SEQ ID NO: 1755012 - DNA, 16 bp, Homo sapiens
ccaaagactgcagaac

SEQ ID NO: 1755013 - DNA, 17 bp, Homo sapiens
ccaaagactgcagaacc

SEQ ID NO: 1755014 - DNA, 22 bp, Homo sapiens
ccaaagagaatcccacattagc

SEQ ID NO: 1755015 - DNA, 14 bp, Homo sapiens
ccaaagaggctgcc

SEQ ID NO: 1755016 - DNA, 16 bp, Homo sapiens
ccaaagaggctgcccc

SEQ ID NO: 1755017 - DNA, 16 bp, Homo sapiens
ccaaagagggcttcct

SEQ ID NO: 1755018 - DNA, 17 bp, Homo sapiens
ccaaagagggcttcctc

SEQ ID NO: 1755019 - DNA, 23 bp, Homo sapiens
ccaaagcaatgtgagtcccagag

SEQ ID NO: 1755020 - DNA, 16 bp, Homo sapiens
ccaaagcacagctggg

SEQ ID NO: 1755021 - DNA, 13 bp, Homo sapiens
ccaaagcatggac

SEQ ID NO: 1755022 - DNA, 17 bp, Homo sapiens
ccaaagccactggaagg

SEQ ID NO: 1755023 - DNA, 19 bp, Homo sapiens
ccaaagccactggaaggag

SEQ ID NO: 1755024 - DNA, 21 bp, Homo sapiens
ccaaagccattctccccctct

SEQ ID NO: 1755025 - DNA, 16 bp, Homo sapiens
ccaaagcctcttcaaa

SEQ ID NO: 1755026 - DNA, 16 bp, Homo sapiens
ccaaagcggtccctgt

SEQ ID NO: 1755027 - DNA, 13 bp, Homo sapiens
ccaaagctgccca

SEQ ID NO: 1755028 - DNA, 21 bp, Homo sapiens
ccaaagctgttggtctgtccc

SEQ ID NO: 1755029 - DNA, 21 bp, Homo sapiens
ccaaagctttactactgtgga

SEQ ID NO: 1755030 - DNA, 14 bp, Homo sapiens
ccaaagctttcctg

SEQ ID NO: 1755031 - DNA, 19 bp, Homo sapiens
ccaaagctttcctgcccca

SEQ ID NO: 1755032 - DNA, 16 bp, Homo sapiens
ccaaaggaggctggca

SEQ ID NO: 1755033 - DNA, 17 bp, Homo sapiens
ccaaaggcagctaagat

SEQ ID NO: 1755034 - DNA, 21 bp, Homo sapiens
ccaaaggcagctaagatagaa

SEQ ID NO: 1755035 - DNA, 16 bp, Homo sapiens
ccaaaggctctctcct

SEQ ID NO: 1755036 - DNA, 21 bp, Homo sapiens
ccaaaggctggtggcaagtgc

SEQ ID NO: 1755037 - DNA, 18 bp, Homo sapiens
ccaaagggaagtgaggcc

SEQ ID NO: 1755038 - DNA, 21 bp, Homo sapiens
ccaaagggaagtgaggcccaa

SEQ ID NO: 1755039 - DNA, 24 bp, Homo sapiens
ccaaagggaagtgaggcccaagga

SEQ ID NO: 1755040 - DNA, 24 bp, Homo sapiens
ccaaagggcttattgactctttct

SEQ ID NO: 1755041 - DNA, 17 bp, Homo sapiens
ccaaaggggctgctggg

SEQ ID NO: 1755042 - DNA, 19 bp, Homo sapiens
ccaaagtcctgggattaca

SEQ ID NO: 1755043 - DNA, 14 bp, Homo sapiens
ccaaagtctctaat

SEQ ID NO: 1755044 - DNA, 18 bp, Homo sapiens
ccaaagtgcgtgtgtgta

SEQ ID NO: 1755045 - DNA, 15 bp, Homo sapiens
ccaaagtgctgagat

SEQ ID NO: 1755046 - DNA, 20 bp, Homo sapiens
ccaaagtggggagggacaag

SEQ ID NO: 1755047 - DNA, 18 bp, Homo sapiens
ccaaataaacatttttta

SEQ ID NO: 1755048 - DNA, 23 bp, Homo sapiens
ccaaataaacattttttaagaaa

SEQ ID NO: 1755049 - DNA, 16 bp, Homo sapiens
ccaaataatgtctctg

SEQ ID NO: 1755050 - DNA, 16 bp, Homo sapiens
ccaaatacctcaattt

SEQ ID NO: 1755051 - DNA, 20 bp, Homo sapiens
ccaaatacctcaatttttgt

SEQ ID NO: 1755052 - DNA, 17 bp, Homo sapiens
ccaaatagccccagact

SEQ ID NO: 1755053 - DNA, 23 bp, Homo sapiens
ccaaatagccccagactgggccc

SEQ ID NO: 1755054 - DNA, 15 bp, Homo sapiens
ccaaatatgtcctgg

SEQ ID NO: 1755055 - DNA, 15 bp, Homo sapiens
ccaaatcagctgcta

SEQ ID NO: 1755056 - DNA, 19 bp, Homo sapiens
ccaaatccttggagtccca

SEQ ID NO: 1755057 - DNA, 22 bp, Homo sapiens
ccaaatcgtggcacgtattgct

SEQ ID NO: 1755058 - DNA, 23 bp, Homo sapiens
ccaaatctagccagagcccttca

SEQ ID NO: 1755059 - DNA, 20 bp, Homo sapiens
ccaaatctgacctaaaagtt

SEQ ID NO: 1755060 - DNA, 16 bp, Homo sapiens
ccaaatctgcctagaa

SEQ ID NO: 1755061 - DNA, 22 bp, Homo sapiens
ccaaatctgtcctctgtagtat

SEQ ID NO: 1755062 - DNA, 18 bp, Homo sapiens
ccaaatgaaaaatctcaa

SEQ ID NO: 1755063 - DNA, 18 bp, Homo sapiens
ccaaatgaccgagccctg

SEQ ID NO: 1755064 - DNA, 22 bp, Homo sapiens
ccaaatgaccgagccctggaga

SEQ ID NO: 1755065 - DNA, 20 bp, Homo sapiens
ccaaatgatagaactgtact

SEQ ID NO: 1755066 - DNA, 19 bp, Homo sapiens
ccaaatgatgccacttccc

SEQ ID NO: 1755067 - DNA, 22 bp, Homo sapiens
ccaaatggccagttttctggta

SEQ ID NO: 1755068 - DNA, 22 bp, Homo sapiens
ccaaatgtaattgaataaagtt

SEQ ID NO: 1755069 - DNA, 21 bp, Homo sapiens
ccaaatgtgatcaactgttca

SEQ ID NO: 1755070 - DNA, 17 bp, Homo sapiens
ccaaatgtgtacacctg

SEQ ID NO: 1755071 - DNA, 12 bp, Homo sapiens
ccaaattaaaaa

SEQ ID NO: 1755072 - DNA, 19 bp, Homo sapiens
ccaaattgagtttaacaat

SEQ ID NO: 1755073 - DNA, 16 bp, Homo sapiens
ccaaattgccttcagc

SEQ ID NO: 1755074 - DNA, 13 bp, Homo sapiens
ccaacaaaccatc

SEQ ID NO: 1755075 - DNA, 18 bp, Homo sapiens
ccaacaactctgccttta

SEQ ID NO: 1755076 - DNA, 12 bp, Homo sapiens
ccaacacagttg

SEQ ID NO: 1755077 - DNA, 23 bp, Homo sapiens
ccaacactgtccttccctgccac

SEQ ID NO: 1755078 - DNA, 16 bp, Homo sapiens
ccaagtgcaatagatt

SEQ ID NO: 1755079 - DNA, 15 bp, Homo sapiens
ccaagtgccagaggt

SEQ ID NO: 1755080 - DNA, 17 bp, Homo sapiens
ccaagtgccagaggtgg

SEQ ID NO: 1755081 - DNA, 14 bp, Homo sapiens
ccaagtgcctcacc

SEQ ID NO: 1755082 - DNA, 23 bp, Homo sapiens
ccaagtggctgggtgccctctca

SEQ ID NO: 1755083 - DNA, 16 bp, Homo sapiens
ccaagtgggggcagag

SEQ ID NO: 1755084 - DNA, 18 bp, Homo sapiens
ccaagtgggggcagaggg

SEQ ID NO: 1755085 - DNA, 15 bp, Homo sapiens
ccaagtggggtgctg

SEQ ID NO: 1755086 - DNA, 18 bp, Homo sapiens
ccaagtggtcaggagttg

SEQ ID NO: 1755087 - DNA, 14 bp, Homo sapiens
ccaagtggtccagc

SEQ ID NO: 1755088 - DNA, 21 bp, Homo sapiens
ccaagtggtgggaatcagatc

SEQ ID NO: 1755089 - DNA, 14 bp, Homo sapiens
ccaagtgtgaacaa

SEQ ID NO: 1755090 - DNA, 18 bp, Homo sapiens
ccaagttgctgtcactgt

SEQ ID NO: 1755091 - DNA, 20 bp, Homo sapiens
ccaagttgtgcttgagccag

SEQ ID NO: 1755092 - DNA, 20 bp, Homo sapiens
ccaagtttccatagcaacag

SEQ ID NO: 1755093 - DNA, 11 bp, Homo sapiens
ccaataaaagt

SEQ ID NO: 1755094 - DNA, 13 bp, Homo sapiens
ccaataaaagtga

SEQ ID NO: 1755095 - DNA, 15 bp, Homo sapiens
ccaataaaagtgact

SEQ ID NO: 1755096 - DNA, 23 bp, Homo sapiens
ccaataaagcttttggaagccgg

SEQ ID NO: 1755097 - DNA, 16 bp, Homo sapiens
ccaataaaggcagctg

SEQ ID NO: 1755098 - DNA, 21 bp, Homo sapiens
ccaataaaggcagctgcctct

SEQ ID NO: 1755099 - DNA, 22 bp, Homo sapiens
ccaataaaggcagctgcctctg

SEQ ID NO: 1755100 - DNA, 20 bp, Homo sapiens
ccaataaaggtcccttagcc

SEQ ID NO: 1755101 - DNA, 22 bp, Homo sapiens
ccaataaatgtgaaattctgtc

SEQ ID NO: 1755102 - DNA, 23 bp, Homo sapiens
ccaataacaaggagctcaccctg

SEQ ID NO: 1755103 - DNA, 20 bp, Homo sapiens
ccaataatggggcagacaca

SEQ ID NO: 1755104 - DNA, 13 bp, Homo sapiens
ccaatacatttgt

SEQ ID NO: 1755105 - DNA, 20 bp, Homo sapiens
ccaatacatttgtattttgt

SEQ ID NO: 1755106 - DNA, 13 bp, Homo sapiens
ccaataggagtct

SEQ ID NO: 1755107 - DNA, 22 bp, Homo sapiens
ccaatagggctgagctctctgt

SEQ ID NO: 1755108 - DNA, 17 bp, Homo sapiens
ccaatcaaagaattaca

SEQ ID NO: 1755109 - DNA, 13 bp, Homo sapiens
ccaatcagcactg

SEQ ID NO: 1755110 - DNA, 14 bp, Homo sapiens
ccaatcagcactga

SEQ ID NO: 1755111 - DNA, 15 bp, Homo sapiens
ccaatcagcactgaa

SEQ ID NO: 1755112 - DNA, 22 bp, Homo sapiens
ccaatcagcttttgttctagac

SEQ ID NO: 1755113 - DNA, 22 bp, Homo sapiens
ccaatcattttaattattattc

SEQ ID NO: 1755114 - DNA, 17 bp, Homo sapiens
ccaatcccggtcatgct

SEQ ID NO: 1755115 - DNA, 15 bp, Homo sapiens
ccaatcctcactggg

SEQ ID NO: 1755116 - DNA, 12 bp, Homo sapiens
ccaatcctctct

SEQ ID NO: 1755117 - DNA, 17 bp, Homo sapiens
ccaatcggactgccaaa

SEQ ID NO: 1755118 - DNA, 23 bp, Homo sapiens
ccaatcgggtccagagaccacac

SEQ ID NO: 1755119 - DNA, 23 bp, Homo sapiens
ccaatgaaatacacaagtaaaca

SEQ ID NO: 1755120 - DNA, 12 bp, Homo sapiens
ccaatgaaatga

SEQ ID NO: 1755121 - DNA, 14 bp, Homo sapiens
ccaatgaagaagac

SEQ ID NO: 1755122 - DNA, 21 bp, Homo sapiens
ccaatgaagaagacaaagtct

SEQ ID NO: 1755123 - DNA, 23 bp, Homo sapiens
ccaatgagactctagggtccagt

SEQ ID NO: 1755124 - DNA, 15 bp, Homo sapiens
ccaatgatggtcacc

SEQ ID NO: 1755125 - DNA, 19 bp, Homo sapiens
ccaatgcaggctgtttcct

SEQ ID NO: 1755126 - DNA, 16 bp, Homo sapiens
ccaatgcctttttaga

SEQ ID NO: 1755127 - DNA, 21 bp, Homo sapiens
ccaatgcggcccactttcctg

SEQ ID NO: 1755128 - DNA, 21 bp, Homo sapiens
ccaatggagactgtctcaaga

SEQ ID NO: 1755129 - DNA, 15 bp, Homo sapiens
ccaatggggccagca

SEQ ID NO: 1755130 - DNA, 17 bp, Homo sapiens
ccaatggggccagcact

SEQ ID NO: 1755131 - DNA, 16 bp, Homo sapiens
ccaatggtgcttcccc

SEQ ID NO: 1755132 - DNA, 21 bp, Homo sapiens
ccaatggtgcttcccccaccc

SEQ ID NO: 1755133 - DNA, 20 bp, Homo sapiens
ccaatggtgtagctgtcctc

SEQ ID NO: 1755134 - DNA, 22 bp, Homo sapiens
ccaatggtgtagctgtcctctc

SEQ ID NO: 1755135 - DNA, 15 bp, Homo sapiens
ccaatgtaggagctg

SEQ ID NO: 1755136 - DNA, 20 bp, Homo sapiens
ccaatgtaggagctgccttg

SEQ ID NO: 1755137 - DNA, 18 bp, Homo sapiens
ccaattacccataaacag

SEQ ID NO: 1755138 - DNA, 17 bp, Homo sapiens
ccaattaggaagtgtaa

SEQ ID NO: 1755139 - DNA, 23 bp, Homo sapiens
ccaattaggaagtgtaacagctg

SEQ ID NO: 1755140 - DNA, 22 bp, Homo sapiens
ccaattgactctcacactgaat

SEQ ID NO: 1755141 - DNA, 22 bp, Homo sapiens
ccaatttggtaaaaatgctgct

SEQ ID NO: 1755142 - DNA, 20 bp, Homo sapiens
ccaatttgtaaaaacagcat

SEQ ID NO: 1755143 - DNA, 15 bp, Homo sapiens
ccaatttgtaagtaa

SEQ ID NO: 1755144 - DNA, 17 bp, Homo sapiens
ccaattttaaaaaataa

SEQ ID NO: 1755145 - DNA, 15 bp, Homo sapiens
ccaattttgatcttt

SEQ ID NO: 1755146 - DNA, 19 bp, Homo sapiens
ccaattttgatctttttat

SEQ ID NO: 1755147 - DNA, 13 bp, Homo sapiens
ccacaaaaacagg

SEQ ID NO: 1755148 - DNA, 18 bp, Homo sapiens
ccacaaaatatttctaag

SEQ ID NO: 1755149 - DNA, 18 bp, Homo sapiens
ccacaaaattagaaagga

SEQ ID NO: 1755150 - DNA, 23 bp, Homo sapiens
ccacaaaccctgctgaacacagt

SEQ ID NO: 1755151 - DNA, 14 bp, Homo sapiens
ccacaactgacaca

SEQ ID NO: 1755152 - DNA, 16 bp, Homo sapiens
ccacaactgacacagg

SEQ ID NO: 1755153 - DNA, 15 bp, Homo sapiens
ccacaagattcccag

SEQ ID NO: 1755154 - DNA, 19 bp, Homo sapiens
ccacaagattcccagagac

SEQ ID NO: 1755155 - DNA, 16 bp, Homo sapiens
ccacaagcctgagaac

SEQ ID NO: 1755156 - DNA, 11 bp, Homo sapiens
ccacaagctgc

SEQ ID NO: 1755157 - DNA, 14 bp, Homo sapiens
ccacaagctgcact

SEQ ID NO: 1755158 - DNA, 17 bp, Homo sapiens
ccacaagctgcactgtg

SEQ ID NO: 1755159 - DNA, 19 bp, Homo sapiens
ccacaagctgcactgtgaa

SEQ ID NO: 1755160 - DNA, 19 bp, Homo sapiens
ccacaaggaaaaggaggag

SEQ ID NO: 1755161 - DNA, 22 bp, Homo sapiens
ccacaataaccaagatattttt

SEQ ID NO: 1755162 - DNA, 20 bp, Homo sapiens
ccacaatataaaactgtact

SEQ ID NO: 1755163 - DNA, 18 bp, Homo sapiens
ccacaattaaaccgcatg

SEQ ID NO: 1755164 - DNA, 12 bp, Homo sapiens
ccacacacagag

SEQ ID NO: 1755165 - DNA, 17 bp, Homo sapiens
ccacacacagaggaaga

SEQ ID NO: 1755166 - DNA, 14 bp, Homo sapiens
ccacacactcgccc

SEQ ID NO: 1755167 - DNA, 20 bp, Homo sapiens
ccacacagacttgggcaggg

SEQ ID NO: 1755168 - DNA, 13 bp, Homo sapiens
ccacacagagtgg

SEQ ID NO: 1755169 - DNA, 12 bp, Homo sapiens
ccacacagcagt

SEQ ID NO: 1755170 - DNA, 15 bp, Homo sapiens
ccacacagcagtgtc

SEQ ID NO: 1755171 - DNA, 20 bp, Homo sapiens
ccacacagcagtgtcccctg

SEQ ID NO: 1755172 - DNA, 13 bp, Homo sapiens
ccacacagctgcc

SEQ ID NO: 1755173 - DNA, 17 bp, Homo sapiens
ccacacagctgccctag

SEQ ID NO: 1755174 - DNA, 19 bp, Homo sapiens
ccacacagctgccctagct

SEQ ID NO: 1755175 - DNA, 12 bp, Homo sapiens
ccacacagggca

SEQ ID NO: 1755176 - DNA, 16 bp, Homo sapiens
ccacacagggcactga

SEQ ID NO: 1755177 - DNA, 18 bp, Homo sapiens
ccacacagggcactgact

SEQ ID NO: 1755178 - DNA, 20 bp, Homo sapiens
ccacaccactaaccatcccc

SEQ ID NO: 1755179 - DNA, 13 bp, Homo sapiens
ccacaccactgcc

SEQ ID NO: 1755180 - DNA, 14 bp, Homo sapiens
ccacaccagcctcc

SEQ ID NO: 1755181 - DNA, 21 bp, Homo sapiens
ccacaccccaacacttccagc

SEQ ID NO: 1755182 - DNA, 12 bp, Homo sapiens
ccacaccctccc

SEQ ID NO: 1755183 - DNA, 22 bp, Homo sapiens
ccacacctcagttcccttggcc

SEQ ID NO: 1755184 - DNA, 16 bp, Homo sapiens
ccacacctccctgaac

SEQ ID NO: 1755185 - DNA, 21 bp, Homo sapiens
ccacacctgagcgctgtggac

SEQ ID NO: 1755186 - DNA, 22 bp, Homo sapiens
ccacacctgagcgctgtggact

SEQ ID NO: 1755187 - DNA, 16 bp, Homo sapiens
ccacacctgcagtgcc

SEQ ID NO: 1755188 - DNA, 14 bp, Homo sapiens
ccacacctgcctgc

SEQ ID NO: 1755189 - DNA, 16 bp, Homo sapiens
ccacaccttccagggc

SEQ ID NO: 1755190 - DNA, 17 bp, Homo sapiens
ccacaccttccagggcc

SEQ ID NO: 1755191 - DNA, 21 bp, Homo sapiens
ccacaccttccagggccctag

SEQ ID NO: 1755192 - DNA, 16 bp, Homo sapiens
ccactagagggcccat

SEQ ID NO: 1755193 - DNA, 23 bp, Homo sapiens
ccactagagggcccatcaggcag

SEQ ID NO: 1755194 - DNA, 21 bp, Homo sapiens
ccactaggtgtccccaacgtc

SEQ ID NO: 1755195 - DNA, 13 bp, Homo sapiens
ccactatcacata

SEQ ID NO: 1755196 - DNA, 20 bp, Homo sapiens
ccactatcccaatcaaagaa

SEQ ID NO: 1755197 - DNA, 22 bp, Homo sapiens
ccactatctccgttccatctgg

SEQ ID NO: 1755198 - DNA, 13 bp, Homo sapiens
ccactattttcaa

SEQ ID NO: 1755199 - DNA, 23 bp, Homo sapiens
ccactcaatgtcttaggtcagga

SEQ ID NO: 1755200 - DNA, 19 bp, Homo sapiens
ccactcaccagccctagct

SEQ ID NO: 1755201 - DNA, 23 bp, Homo sapiens
ccactcagaactctccagggagg

SEQ ID NO: 1755202 - DNA, 11 bp, Homo sapiens
ccactcagcca

SEQ ID NO: 1755203 - DNA, 23 bp, Homo sapiens
ccactcagccatttccccctcct

SEQ ID NO: 1755204 - DNA, 13 bp, Homo sapiens
ccactcaggaggc

SEQ ID NO: 1755205 - DNA, 20 bp, Homo sapiens
ccactcaggccaacaagcca

SEQ ID NO: 1755206 - DNA, 20 bp, Homo sapiens
ccactccagacccctggctt

SEQ ID NO: 1755207 - DNA, 22 bp, Homo sapiens
ccactccagacccctggctttt

SEQ ID NO: 1755208 - DNA, 17 bp, Homo sapiens
ccactccagcctgggga

SEQ ID NO: 1755209 - DNA, 16 bp, Homo sapiens
ccactccagctctgag

SEQ ID NO: 1755210 - DNA, 17 bp, Homo sapiens
ccactcccaaagctcag

SEQ ID NO: 1755211 - DNA, 13 bp, Homo sapiens
ccactccccagcc

SEQ ID NO: 1755212 - DNA, 15 bp, Homo sapiens
ccactccccagcccc

SEQ ID NO: 1755213 - DNA, 22 bp, Homo sapiens
ccactccccagccccagcccct

SEQ ID NO: 1755214 - DNA, 15 bp, Homo sapiens
ccactcccccacctg

SEQ ID NO: 1755215 - DNA, 17 bp, Homo sapiens
ccactcccccacctgac

SEQ ID NO: 1755216 - DNA, 19 bp, Homo sapiens
ccactcccccgtttctcct

SEQ ID NO: 1755217 - DNA, 15 bp, Homo sapiens
ccactccctgagctt

SEQ ID NO: 1755218 - DNA, 15 bp, Homo sapiens
ccactccctgctcta

SEQ ID NO: 1755219 - DNA, 19 bp, Homo sapiens
ccactccctttccaacctc

SEQ ID NO: 1755220 - DNA, 17 bp, Homo sapiens
ccactccgagaggtggg

SEQ ID NO: 1755221 - DNA, 19 bp, Homo sapiens
ccactccgagaggtgggcc

SEQ ID NO: 1755222 - DNA, 17 bp, Homo sapiens
ccactcctatggaaaag

SEQ ID NO: 1755223 - DNA, 16 bp, Homo sapiens
ccactcctccaaagga

SEQ ID NO: 1755224 - DNA, 12 bp, Homo sapiens
ccactcctctaa

SEQ ID NO: 1755225 - DNA, 14 bp, Homo sapiens
ccactcctgctgca

SEQ ID NO: 1755226 - DNA, 21 bp, Homo sapiens
ccactcctgtcccgccttcct

SEQ ID NO: 1755227 - DNA, 14 bp, Homo sapiens
ccactcctgtccct

SEQ ID NO: 1755228 - DNA, 18 bp, Homo sapiens
ccactcgcagtcgcagga

SEQ ID NO: 1755229 - DNA, 16 bp, Homo sapiens
ccactctaccctccca

SEQ ID NO: 1755230 - DNA, 19 bp, Homo sapiens
ccactctaccctcccaccc

SEQ ID NO: 1755231 - DNA, 21 bp, Homo sapiens
ccactctaccctcccaccccc

SEQ ID NO: 1755232 - DNA, 22 bp, Homo sapiens
ccactctaggggtcaggctcca

SEQ ID NO: 1755233 - DNA, 16 bp, Homo sapiens
ccactctcattcccca

SEQ ID NO: 1755234 - DNA, 18 bp, Homo sapiens
ccactctcattccccagg

SEQ ID NO: 1755235 - DNA, 19 bp, Homo sapiens
ccactctcattccccaggt

SEQ ID NO: 1755236 - DNA, 14 bp, Homo sapiens
ccactctccccaca

SEQ ID NO: 1755237 - DNA, 12 bp, Homo sapiens
ccactctcctcc

SEQ ID NO: 1755238 - DNA, 13 bp, Homo sapiens
ccactctcggggc

SEQ ID NO: 1755239 - DNA, 22 bp, Homo sapiens
ccactctctgggactctcctcc

SEQ ID NO: 1755240 - DNA, 16 bp, Homo sapiens
ccactctgcctctgcc

SEQ ID NO: 1755241 - DNA, 14 bp, Homo sapiens
ccactctgcttctc

SEQ ID NO: 1755242 - DNA, 17 bp, Homo sapiens
ccactctgcttctctga

SEQ ID NO: 1755243 - DNA, 19 bp, Homo sapiens
ccactctgcttctctgact

SEQ ID NO: 1755244 - DNA, 13 bp, Homo sapiens
ccactcttcctgt

SEQ ID NO: 1755245 - DNA, 18 bp, Homo sapiens
ccactcttgatctctctt

SEQ ID NO: 1755246 - DNA, 14 bp, Homo sapiens
ccactgaacaaaac

SEQ ID NO: 1755247 - DNA, 13 bp, Homo sapiens
ccactgaattcac

SEQ ID NO: 1755248 - DNA, 17 bp, Homo sapiens
ccactgaattcactcca

SEQ ID NO: 1755249 - DNA, 18 bp, Homo sapiens
ccactgaattcactccag

SEQ ID NO: 1755250 - DNA, 21 bp, Homo sapiens
ccactgacaaacgtccccagc

SEQ ID NO: 1755251 - DNA, 17 bp, Homo sapiens
ccactgactgcagggac

SEQ ID NO: 1755252 - DNA, 14 bp, Homo sapiens
ccactgagcctggc

SEQ ID NO: 1755253 - DNA, 16 bp, Homo sapiens
ccactgagcctggccc

SEQ ID NO: 1755254 - DNA, 16 bp, Homo sapiens
ccactgaggagacaga

SEQ ID NO: 1755255 - DNA, 17 bp, Homo sapiens
ccactgaggagacagaa

SEQ ID NO: 1755256 - DNA, 14 bp, Homo sapiens
ccactgcactccag

SEQ ID NO: 1755257 - DNA, 18 bp, Homo sapiens
ccactgcactccagcctg

SEQ ID NO: 1755258 - DNA, 21 bp, Homo sapiens
ccactgcactccagcctgggc

SEQ ID NO: 1755259 - DNA, 14 bp, Homo sapiens
ccactgcaggcccc

SEQ ID NO: 1755260 - DNA, 17 bp, Homo sapiens
ccactgcaggccccgct

SEQ ID NO: 1755261 - DNA, 15 bp, Homo sapiens
ccactgccagcagca

SEQ ID NO: 1755262 - DNA, 16 bp, Homo sapiens
ccactgccaggcacct

SEQ ID NO: 1755263 - DNA, 21 bp, Homo sapiens
ccactgccaggcacctggcct

SEQ ID NO: 1755264 - DNA, 19 bp, Homo sapiens
ccactgccattacccagtg

SEQ ID NO: 1755265 - DNA, 16 bp, Homo sapiens
ccactgcccaccccct

SEQ ID NO: 1755266 - DNA, 19 bp, Homo sapiens
ccactgcccaccccctcaa

SEQ ID NO: 1755267 - DNA, 20 bp, Homo sapiens
ccactgccccctgctgccat

SEQ ID NO: 1755268 - DNA, 15 bp, Homo sapiens
ccactgccctgcctg

SEQ ID NO: 1755269 - DNA, 16 bp, Homo sapiens
ccactgccctgcctgc

SEQ ID NO: 1755270 - DNA, 17 bp, Homo sapiens
ccactgccctgcctgcc

SEQ ID NO: 1755271 - DNA, 18 bp, Homo sapiens
ccactgccctgcctgccc

SEQ ID NO: 1755272 - DNA, 17 bp, Homo sapiens
ccactgctctcagcctc

SEQ ID NO: 1755273 - DNA, 18 bp, Homo sapiens
ccactgctctcagcctcc

SEQ ID NO: 1755274 - DNA, 20 bp, Homo sapiens
ccactgctctcagcctccca

SEQ ID NO: 1755275 - DNA, 15 bp, Homo sapiens
ccactgctggctgca

SEQ ID NO: 1755276 - DNA, 14 bp, Homo sapiens
ccactgcttcccac

SEQ ID NO: 1755277 - DNA, 18 bp, Homo sapiens
ccactgcttcccactggg

SEQ ID NO: 1755278 - DNA, 20 bp, Homo sapiens
ccactgcttcttatggtggt

SEQ ID NO: 1755279 - DNA, 11 bp, Homo sapiens
ccactggaagg

SEQ ID NO: 1755280 - DNA, 13 bp, Homo sapiens
ccactggaaggag

SEQ ID NO: 1755281 - DNA, 11 bp, Homo sapiens
ccactggccac

SEQ ID NO: 1755282 - DNA, 13 bp, Homo sapiens
ccactggccacca

SEQ ID NO: 1755283 - DNA, 17 bp, Homo sapiens
ccactggccaccaggct

SEQ ID NO: 1755284 - DNA, 14 bp, Homo sapiens
ccactgggacagct

SEQ ID NO: 1755285 - DNA, 17 bp, Homo sapiens
ccactgggacagctggc

SEQ ID NO: 1755286 - DNA, 18 bp, Homo sapiens
ccactgggacagctggct

SEQ ID NO: 1755287 - DNA, 21 bp, Homo sapiens
ccactgggacagctggctggg

SEQ ID NO: 1755288 - DNA, 18 bp, Homo sapiens
ccactgggacatttttct

SEQ ID NO: 1755289 - DNA, 13 bp, Homo sapiens
ccactgggccagc

SEQ ID NO: 1755290 - DNA, 20 bp, Homo sapiens
ccactgggccagccctgcag

SEQ ID NO: 1755291 - DNA, 18 bp, Homo sapiens
ccactggggactttattt

SEQ ID NO: 1755292 - DNA, 15 bp, Homo sapiens
ccactgggtctcact

SEQ ID NO: 1755293 - DNA, 18 bp, Homo sapiens
ccactggtacttcctttc

SEQ ID NO: 1755294 - DNA, 20 bp, Homo sapiens
ccactggtccccaacaatgt

SEQ ID NO: 1755295 - DNA, 19 bp, Homo sapiens
ccactggtttctcagaatc

SEQ ID NO: 1755296 - DNA, 14 bp, Homo sapiens
ccactgtaaaatga

SEQ ID NO: 1755297 - DNA, 18 bp, Homo sapiens
ccactgtaaaatgaaatt

SEQ ID NO: 1755298 - DNA, 20 bp, Homo sapiens
ccactgtcctgggcctgcag

SEQ ID NO: 1755299 - DNA, 16 bp, Homo sapiens
ccactgtcctgggcgc

SEQ ID NO: 1755300 - DNA, 19 bp, Homo sapiens
ccactgtctccacccacct

SEQ ID NO: 1755301 - DNA, 17 bp, Homo sapiens
ccactgtgccactgact

SEQ ID NO: 1755302 - DNA, 18 bp, Homo sapiens
ccactgtgccactgactt

SEQ ID NO: 1755303 - DNA, 14 bp, Homo sapiens
ccactgtgcctcag

SEQ ID NO: 1755304 - DNA, 15 bp, Homo sapiens
ccactgtgcctcaga

SEQ ID NO: 1755305 - DNA, 18 bp, Homo sapiens
ccactgtgcctcagagac

SEQ ID NO: 1755306 - DNA, 15 bp, Homo sapiens
ccactgtggccagag

SEQ ID NO: 1755307 - DNA, 14 bp, Homo sapiens
ccagccagcctcag

SEQ ID NO: 1755308 - DNA, 12 bp, Homo sapiens
ccagccagctcc

SEQ ID NO: 1755309 - DNA, 21 bp, Homo sapiens
ccagccaggcaggtccacaga

SEQ ID NO: 1755310 - DNA, 20 bp, Homo sapiens
ccagccaggccaacagcacc

SEQ ID NO: 1755311 - DNA, 16 bp, Homo sapiens
ccagccatctgcccag

SEQ ID NO: 1755312 - DNA, 17 bp, Homo sapiens
ccagccatctgcccagg

SEQ ID NO: 1755313 - DNA, 18 bp, Homo sapiens
ccagccatctgcccaggg

SEQ ID NO: 1755314 - DNA, 20 bp, Homo sapiens
ccagccatctgcccaggggt

SEQ ID NO: 1755315 - DNA, 15 bp, Homo sapiens
ccagccatgcctgag

SEQ ID NO: 1755316 - DNA, 15 bp, Homo sapiens
ccagcccaataaagg

SEQ ID NO: 1755317 - DNA, 12 bp, Homo sapiens
ccagcccagagc

SEQ ID NO: 1755318 - DNA, 21 bp, Homo sapiens
ccagcccagattcccctgtgt

SEQ ID NO: 1755319 - DNA, 23 bp, Homo sapiens
ccagcccagattcccctgtgtca

SEQ ID NO: 1755320 - DNA, 14 bp, Homo sapiens
ccagcccagccagg

SEQ ID NO: 1755321 - DNA, 16 bp, Homo sapiens
ccagcccagcccagct

SEQ ID NO: 1755322 - DNA, 18 bp, Homo sapiens
ccagcccagcccagctgg

SEQ ID NO: 1755323 - DNA, 13 bp, Homo sapiens
ccagcccagggct

SEQ ID NO: 1755324 - DNA, 15 bp, Homo sapiens
ccagcccagggctcc

SEQ ID NO: 1755325 - DNA, 19 bp, Homo sapiens
ccagcccagggctcctgca

SEQ ID NO: 1755326 - DNA, 21 bp, Homo sapiens
ccagcccatggcccccaataa

SEQ ID NO: 1755327 - DNA, 23 bp, Homo sapiens
ccagcccatggcccccaataaag

SEQ ID NO: 1755328 - DNA, 20 bp, Homo sapiens
ccagcccatttgggctctgg

SEQ ID NO: 1755329 - DNA, 13 bp, Homo sapiens
ccagccccaagct

SEQ ID NO: 1755330 - DNA, 17 bp, Homo sapiens
ccagccccacccaggag

SEQ ID NO: 1755331 - DNA, 17 bp, Homo sapiens
ccagccccactgccagc

SEQ ID NO: 1755332 - DNA, 21 bp, Homo sapiens
ccagccccactgccagcagca

SEQ ID NO: 1755333 - DNA, 14 bp, Homo sapiens
ccagccccagcaag

SEQ ID NO: 1755334 - DNA, 15 bp, Homo sapiens
ccagccccagcaaga

SEQ ID NO: 1755335 - DNA, 22 bp, Homo sapiens
ccagccccccgcgcgcccaccc

SEQ ID NO: 1755336 - DNA, 16 bp, Homo sapiens
ccagccccctccagct

SEQ ID NO: 1755337 - DNA, 18 bp, Homo sapiens
ccagccccctccagctca

SEQ ID NO: 1755338 - DNA, 15 bp, Homo sapiens
ccagccccctggatg

SEQ ID NO: 1755339 - DNA, 15 bp, Homo sapiens
ccagccccgctccca

SEQ ID NO: 1755340 - DNA, 20 bp, Homo sapiens
ccagccccggtggctgggca

SEQ ID NO: 1755341 - DNA, 13 bp, Homo sapiens
ccagcccctctgg

SEQ ID NO: 1755342 - DNA, 22 bp, Homo sapiens
ccagcccctctggtcgctcctg

SEQ ID NO: 1755343 - DNA, 23 bp, Homo sapiens
ccagcccctctggtcgctcctgc

SEQ ID NO: 1755344 - DNA, 13 bp, Homo sapiens
ccagcccctgccc

SEQ ID NO: 1755345 - DNA, 13 bp, Homo sapiens
ccagcccctgtcc

SEQ ID NO: 1755346 - DNA, 17 bp, Homo sapiens
ccagcccctgtcccacc

SEQ ID NO: 1755347 - DNA, 17 bp, Homo sapiens
ccagcccggacctctgg

SEQ ID NO: 1755348 - DNA, 19 bp, Homo sapiens
ccagcccggcctgctccca

SEQ ID NO: 1755349 - DNA, 13 bp, Homo sapiens
ccagccctagctg

SEQ ID NO: 1755350 - DNA, 14 bp, Homo sapiens
ccagccctagctgt

SEQ ID NO: 1755351 - DNA, 18 bp, Homo sapiens
ccagccctagctgtccca

SEQ ID NO: 1755352 - DNA, 13 bp, Homo sapiens
ccagccctcagaa

SEQ ID NO: 1755353 - DNA, 20 bp, Homo sapiens
ccagccctccccatggagcc

SEQ ID NO: 1755354 - DNA, 16 bp, Homo sapiens
ccagccctccctggct

SEQ ID NO: 1755355 - DNA, 18 bp, Homo sapiens
ccagccctccctggctgt

SEQ ID NO: 1755356 - DNA, 16 bp, Homo sapiens
ccagccctccctgtcc

SEQ ID NO: 1755357 - DNA, 18 bp, Homo sapiens
ccagccctccctgtcctc

SEQ ID NO: 1755358 - DNA, 19 bp, Homo sapiens
ccagccctccctgtcctcc

SEQ ID NO: 1755359 - DNA, 21 bp, Homo sapiens
ccagccctccctgtcctcctc

SEQ ID NO: 1755360 - DNA, 14 bp, Homo sapiens
ccagccctgctggg

SEQ ID NO: 1755361 - DNA, 16 bp, Homo sapiens
ccagccctgctgggga

SEQ ID NO: 1755362 - DNA, 17 bp, Homo sapiens
ccagccctgctggggat

SEQ ID NO: 1755363 - DNA, 19 bp, Homo sapiens
ccagccctgctggggatcc

SEQ ID NO: 1755364 - DNA, 22 bp, Homo sapiens
ccagccctgctggggatccccg

SEQ ID NO: 1755365 - DNA, 12 bp, Homo sapiens
ccagccctggga

SEQ ID NO: 1755366 - DNA, 16 bp, Homo sapiens
ccagcccttgaagtca

SEQ ID NO: 1755367 - DNA, 23 bp, Homo sapiens
ccagccgccattgccaccaggag

SEQ ID NO: 1755368 - DNA, 15 bp, Homo sapiens
ccagccgctgcaggg

SEQ ID NO: 1755369 - DNA, 13 bp, Homo sapiens
ccagccggcctct

SEQ ID NO: 1755370 - DNA, 13 bp, Homo sapiens
ccagccggggcct

SEQ ID NO: 1755371 - DNA, 21 bp, Homo sapiens
ccagcctaagaagctctggcc

SEQ ID NO: 1755372 - DNA, 13 bp, Homo sapiens
ccagcctcagcct

SEQ ID NO: 1755373 - DNA, 19 bp, Homo sapiens
ccagcctcatctctttgtt

SEQ ID NO: 1755374 - DNA, 12 bp, Homo sapiens
ccagcctccagg

SEQ ID NO: 1755375 - DNA, 15 bp, Homo sapiens
ccagcctccagggca

SEQ ID NO: 1755376 - DNA, 21 bp, Homo sapiens
ccagcctccctgaagcctttg

SEQ ID NO: 1755377 - DNA, 17 bp, Homo sapiens
ccagcctccctgtctcc

SEQ ID NO: 1755378 - DNA, 19 bp, Homo sapiens
ccagcctccctgtctccag

SEQ ID NO: 1755379 - DNA, 21 bp, Homo sapiens
ccagcctccctgtctccagct

SEQ ID NO: 1755380 - DNA, 23 bp, Homo sapiens
ccagcctccctgtctccagctgc

SEQ ID NO: 1755381 - DNA, 11 bp, Homo sapiens
ccagcctcctc

SEQ ID NO: 1755382 - DNA, 16 bp, Homo sapiens
ccagcctcctctggac

SEQ ID NO: 1755383 - DNA, 20 bp, Homo sapiens
ccagcctctcccggctgcct

SEQ ID NO: 1755384 - DNA, 21 bp, Homo sapiens
ccagcctctcttggtttcctt

SEQ ID NO: 1755385 - DNA, 15 bp, Homo sapiens
ccagcctctggcatt

SEQ ID NO: 1755386 - DNA, 18 bp, Homo sapiens
ccagcctgaacagaagct

SEQ ID NO: 1755387 - DNA, 19 bp, Homo sapiens
ccagcctgaacagaagctc

SEQ ID NO: 1755388 - DNA, 16 bp, Homo sapiens
ccagcctgagtgacag

SEQ ID NO: 1755389 - DNA, 15 bp, Homo sapiens
ccagcctgctgacag

SEQ ID NO: 1755390 - DNA, 16 bp, Homo sapiens
ccagcctggccacgca

SEQ ID NO: 1755391 - DNA, 23 bp, Homo sapiens
ccagcctggccacgcagccagga

SEQ ID NO: 1755392 - DNA, 18 bp, Homo sapiens
ccagcctggctctgcccc

SEQ ID NO: 1755393 - DNA, 19 bp, Homo sapiens
ccagcctggcttctggagc

SEQ ID NO: 1755394 - DNA, 20 bp, Homo sapiens
ccagcctggcttctggagcc

SEQ ID NO: 1755395 - DNA, 14 bp, Homo sapiens
ccagcctgggactc

SEQ ID NO: 1755396 - DNA, 16 bp, Homo sapiens
ccagcctgggagccca

SEQ ID NO: 1755397 - DNA, 16 bp, Homo sapiens
ccagcctgggcaacaa

SEQ ID NO: 1755398 - DNA, 22 bp, Homo sapiens
ccagcctgggcagccaggctgc

SEQ ID NO: 1755399 - DNA, 20 bp, Homo sapiens
ccagcctggggaccccactt

SEQ ID NO: 1755400 - DNA, 22 bp, Homo sapiens
ccagcctggggaccccacttca

SEQ ID NO: 1755401 - DNA, 17 bp, Homo sapiens
ccagcctggggctccct

SEQ ID NO: 1755402 - DNA, 18 bp, Homo sapiens
ccagcctggggctccctc

SEQ ID NO: 1755403 - DNA, 20 bp, Homo sapiens
ccagcctggggctccctctc

SEQ ID NO: 1755404 - DNA, 22 bp, Homo sapiens
ccagcctggtgcccatcctccc

SEQ ID NO: 1755405 - DNA, 22 bp, Homo sapiens
ccagcctgtaccttgctgtggg

SEQ ID NO: 1755406 - DNA, 20 bp, Homo sapiens
ccagcctgtagggaactttc

SEQ ID NO: 1755407 - DNA, 13 bp, Homo sapiens
ccagcctgtggtt

SEQ ID NO: 1755408 - DNA, 19 bp, Homo sapiens
ccagcctgtggttacagtg

SEQ ID NO: 1755409 - DNA, 13 bp, Homo sapiens
ccagcctgtgtgt

SEQ ID NO: 1755410 - DNA, 16 bp, Homo sapiens
ccagccttcctctgca

SEQ ID NO: 1755411 - DNA, 21 bp, Homo sapiens
ccagccttcctctgcagctga

SEQ ID NO: 1755412 - DNA, 18 bp, Homo sapiens
ccagccttgagccctggc

SEQ ID NO: 1755413 - DNA, 12 bp, Homo sapiens
ccagccttggag

SEQ ID NO: 1755414 - DNA, 20 bp, Homo sapiens
ccagcctttctcccaggcca

SEQ ID NO: 1755415 - DNA, 15 bp, Homo sapiens
ccagcgagctctcaa

SEQ ID NO: 1755416 - DNA, 15 bp, Homo sapiens
ccagcgatggtgctg

SEQ ID NO: 1755417 - DNA, 21 bp, Homo sapiens
ccagcgatggtgctgcccagg

SEQ ID NO: 1755418 - DNA, 23 bp, Homo sapiens
ccagcgatggtgctgcccaggcc

SEQ ID NO: 1755419 - DNA, 24 bp, Homo sapiens
ccagcgccaagtaaacagggtacc

SEQ ID NO: 1755420 - DNA, 18 bp, Homo sapiens
ccagcgcccgctgggctg

SEQ ID NO: 1755421 - DNA, 13 bp, Homo sapiens
ccaggcagaagga

SEQ ID NO: 1755422 - DNA, 16 bp, Homo sapiens
ccaggcagagctgagg

SEQ ID NO: 1755423 - DNA, 18 bp, Homo sapiens
ccaggcagagctgagggc

SEQ ID NO: 1755424 - DNA, 17 bp, Homo sapiens
ccaggcagatccaggac

SEQ ID NO: 1755425 - DNA, 23 bp, Homo sapiens
ccaggcagatctgtgccccatgc

SEQ ID NO: 1755426 - DNA, 14 bp, Homo sapiens
ccaggcagcctctg

SEQ ID NO: 1755427 - DNA, 20 bp, Homo sapiens
ccaggcagctgtcactgctg

SEQ ID NO: 1755428 - DNA, 20 bp, Homo sapiens
ccaggcagggagtgtctgca

SEQ ID NO: 1755429 - DNA, 15 bp, Homo sapiens
ccaggcaggggtggg

SEQ ID NO: 1755430 - DNA, 22 bp, Homo sapiens
ccaggcaggggtgggggtggag

SEQ ID NO: 1755431 - DNA, 14 bp, Homo sapiens
ccaggcaggtctgc

SEQ ID NO: 1755432 - DNA, 15 bp, Homo sapiens
ccaggcaggtctgca

SEQ ID NO: 1755433 - DNA, 22 bp, Homo sapiens
ccaggcaggtctgcaagggccc

SEQ ID NO: 1755434 - DNA, 18 bp, Homo sapiens
ccaggcattggctcagcc

SEQ ID NO: 1755435 - DNA, 16 bp, Homo sapiens
ccaggccaacagcacc

SEQ ID NO: 1755436 - DNA, 17 bp, Homo sapiens
ccaggccaacagcacct

SEQ ID NO: 1755437 - DNA, 13 bp, Homo sapiens
ccaggccacctcc

SEQ ID NO: 1755438 - DNA, 17 bp, Homo sapiens
ccaggccactgtggcca

SEQ ID NO: 1755439 - DNA, 12 bp, Homo sapiens
ccaggccagcct

SEQ ID NO: 1755440 - DNA, 12 bp, Homo sapiens
ccaggccagggc

SEQ ID NO: 1755441 - DNA, 17 bp, Homo sapiens
ccaggccagggctcctg

SEQ ID NO: 1755442 - DNA, 15 bp, Homo sapiens
ccaggccattctgcc

SEQ ID NO: 1755443 - DNA, 17 bp, Homo sapiens
ccaggccattctgccgc

SEQ ID NO: 1755444 - DNA, 18 bp, Homo sapiens
ccaggcccaaggctcccg

SEQ ID NO: 1755445 - DNA, 22 bp, Homo sapiens
ccaggcccactgtgcctcagag

SEQ ID NO: 1755446 - DNA, 19 bp, Homo sapiens
ccaggcccatctcaggtgc

SEQ ID NO: 1755447 - DNA, 21 bp, Homo sapiens
ccaggcccatctcaggtgcca

SEQ ID NO: 1755448 - DNA, 23 bp, Homo sapiens
ccaggcccatctcaggtgccact

SEQ ID NO: 1755449 - DNA, 17 bp, Homo sapiens
ccaggccccctgcatct

SEQ ID NO: 1755450 - DNA, 18 bp, Homo sapiens
ccaggcccctgaggactg

SEQ ID NO: 1755451 - DNA, 23 bp, Homo sapiens
ccaggcccgcaccccggcctcag

SEQ ID NO: 1755452 - DNA, 24 bp, Homo sapiens
ccaggcccgcaccccggcctcagg

SEQ ID NO: 1755453 - DNA, 21 bp, Homo sapiens
ccaggcccggggctggcggct

SEQ ID NO: 1755454 - DNA, 17 bp, Homo sapiens
ccaggcccgtgggcgca

SEQ ID NO: 1755455 - DNA, 18 bp, Homo sapiens
ccaggcccgtgggcgcaa

SEQ ID NO: 1755456 - DNA, 16 bp, Homo sapiens
ccaggccctccatggg

SEQ ID NO: 1755457 - DNA, 18 bp, Homo sapiens
ccaggccctccatgggct

SEQ ID NO: 1755458 - DNA, 15 bp, Homo sapiens
ccaggccctgggtct

SEQ ID NO: 1755459 - DNA, 19 bp, Homo sapiens
ccaggccgcagctcttgcc

SEQ ID NO: 1755460 - DNA, 21 bp, Homo sapiens
ccaggccgcagctcttgccct

SEQ ID NO: 1755461 - DNA, 17 bp, Homo sapiens
ccaggccgcgcccagca

SEQ ID NO: 1755462 - DNA, 16 bp, Homo sapiens
ccaggccggagcccag

SEQ ID NO: 1755463 - DNA, 13 bp, Homo sapiens
ccaggcctccagc

SEQ ID NO: 1755464 - DNA, 20 bp, Homo sapiens
ccaggcctccagcctctccc

SEQ ID NO: 1755465 - DNA, 21 bp, Homo sapiens
ccaggcctccagcctctcccg

SEQ ID NO: 1755466 - DNA, 13 bp, Homo sapiens
ccaggcctccctg

SEQ ID NO: 1755467 - DNA, 14 bp, Homo sapiens
ccaggcctccctgc

SEQ ID NO: 1755468 - DNA, 19 bp, Homo sapiens
ccaggcctccctgcagact

SEQ ID NO: 1755469 - DNA, 20 bp, Homo sapiens
ccaggcctccctgcagactc

SEQ ID NO: 1755470 - DNA, 19 bp, Homo sapiens
ccaggcctgatcttgcctg

SEQ ID NO: 1755471 - DNA, 15 bp, Homo sapiens
ccaggcctgcctgca

SEQ ID NO: 1755472 - DNA, 16 bp, Homo sapiens
ccaggcctgcctgcat

SEQ ID NO: 1755473 - DNA, 18 bp, Homo sapiens
ccaggcctggcctctggg

SEQ ID NO: 1755474 - DNA, 16 bp, Homo sapiens
ccaggcctgtccaccc

SEQ ID NO: 1755475 - DNA, 21 bp, Homo sapiens
ccaggcctgtccaccctgcca

SEQ ID NO: 1755476 - DNA, 23 bp, Homo sapiens
ccaggccttcatcctcctcccca

SEQ ID NO: 1755477 - DNA, 18 bp, Homo sapiens
ccaggcgccccttccccc

SEQ ID NO: 1755478 - DNA, 12 bp, Homo sapiens
ccaggcgctgca

SEQ ID NO: 1755479 - DNA, 16 bp, Homo sapiens
ccaggcgctgcagggc

SEQ ID NO: 1755480 - DNA, 14 bp, Homo sapiens
ccaggcgggctcaa

SEQ ID NO: 1755481 - DNA, 22 bp, Homo sapiens
ccaggcgggctcaaggaaaggg

SEQ ID NO: 1755482 - DNA, 22 bp, Homo sapiens
ccaggctcctacctgtctgctg

SEQ ID NO: 1755483 - DNA, 20 bp, Homo sapiens
ccaggctcgtggactgagtg

SEQ ID NO: 1755484 - DNA, 23 bp, Homo sapiens
ccaggctcgtggactgagtggga

SEQ ID NO: 1755485 - DNA, 22 bp, Homo sapiens
ccaggctctcgctgccctgtgg

SEQ ID NO: 1755486 - DNA, 17 bp, Homo sapiens
ccaggctcttcctggac

SEQ ID NO: 1755487 - DNA, 18 bp, Homo sapiens
ccaggctcttcctggacc

SEQ ID NO: 1755488 - DNA, 19 bp, Homo sapiens
ccaggctcttcctggacct

SEQ ID NO: 1755489 - DNA, 22 bp, Homo sapiens
ccaggctcttcctggacctgag

SEQ ID NO: 1755490 - DNA, 17 bp, Homo sapiens
ccaggctgagagccaga

SEQ ID NO: 1755491 - DNA, 13 bp, Homo sapiens
ccaggctgcactg

SEQ ID NO: 1755492 - DNA, 14 bp, Homo sapiens
ccaggctgcactgc

SEQ ID NO: 1755493 - DNA, 16 bp, Homo sapiens
ccaggctgcagcctcc

SEQ ID NO: 1755494 - DNA, 19 bp, Homo sapiens
ccaggctgccaaggccaga

SEQ ID NO: 1755495 - DNA, 14 bp, Homo sapiens
ccaggctgcctcct

SEQ ID NO: 1755496 - DNA, 15 bp, Homo sapiens
ccaggctgcctcgga

SEQ ID NO: 1755497 - DNA, 17 bp, Homo sapiens
ccaggctgcctgagcac

SEQ ID NO: 1755498 - DNA, 13 bp, Homo sapiens
ccaggctgctcag

SEQ ID NO: 1755499 - DNA, 12 bp, Homo sapiens
ccaggctggaca

SEQ ID NO: 1755500 - DNA, 17 bp, Homo sapiens
ccaggctggacaccctc

SEQ ID NO: 1755501 - DNA, 19 bp, Homo sapiens
ccaggctggacaccctctg

SEQ ID NO: 1755502 - DNA, 20 bp, Homo sapiens
ccaggctggacaccctctgc

SEQ ID NO: 1755503 - DNA, 22 bp, Homo sapiens
ccaggctggacaccctctgccg

SEQ ID NO: 1755504 - DNA, 12 bp, Homo sapiens
ccaggctggcca

SEQ ID NO: 1755505 - DNA, 13 bp, Homo sapiens
ccaggctggccag

SEQ ID NO: 1755506 - DNA, 22 bp, Homo sapiens
ccaggctggccagtgctgccca

SEQ ID NO: 1755507 - DNA, 13 bp, Homo sapiens
ccaggctgggcat

SEQ ID NO: 1755508 - DNA, 20 bp, Homo sapiens
ccaggctgggctctgcctgt

SEQ ID NO: 1755509 - DNA, 16 bp, Homo sapiens
ccaggctggtctaaaa

SEQ ID NO: 1755510 - DNA, 20 bp, Homo sapiens
ccaggctggtctaaaactcc

SEQ ID NO: 1755511 - DNA, 13 bp, Homo sapiens
ccaggcttcctgg

SEQ ID NO: 1755512 - DNA, 18 bp, Homo sapiens
ccaggcttcctgggtcct

SEQ ID NO: 1755513 - DNA, 23 bp, Homo sapiens
ccaggcttgtcactagcagctgc

SEQ ID NO: 1755514 - DNA, 13 bp, Homo sapiens
ccaggcttttgct

SEQ ID NO: 1755515 - DNA, 14 bp, Homo sapiens
ccagggaacagccc

SEQ ID NO: 1755516 - DNA, 19 bp, Homo sapiens
ccagggaacagccccaggg

SEQ ID NO: 1755517 - DNA, 16 bp, Homo sapiens
ccagggaaggctaagc

SEQ ID NO: 1755518 - DNA, 22 bp, Homo sapiens
ccagggaaggtggggccctgcc

SEQ ID NO: 1755519 - DNA, 22 bp, Homo sapiens
ccagggacccaggtgtgcctgt

SEQ ID NO: 1755520 - DNA, 23 bp, Homo sapiens
ccagggacccaggtgtgcctgtg

SEQ ID NO: 1755521 - DNA, 18 bp, Homo sapiens
ccagggacccccagaaca

SEQ ID NO: 1755522 - DNA, 14 bp, Homo sapiens
ccagggagaagctc

SEQ ID NO: 1755523 - DNA, 14 bp, Homo sapiens
ccagggagcctttg

SEQ ID NO: 1755524 - DNA, 18 bp, Homo sapiens
ccagggagcctttggttc

SEQ ID NO: 1755525 - DNA, 16 bp, Homo sapiens
ccagggagctctgggg

SEQ ID NO: 1755526 - DNA, 18 bp, Homo sapiens
ccagggagctctggggac

SEQ ID NO: 1755527 - DNA, 21 bp, Homo sapiens
ccagggagcttctacctggaa

SEQ ID NO: 1755528 - DNA, 17 bp, Homo sapiens
ccagggagtcccctccc

SEQ ID NO: 1755529 - DNA, 15 bp, Homo sapiens
ccagggcagaggaat

SEQ ID NO: 1755530 - DNA, 16 bp, Homo sapiens
ccagggcagaggaatg

SEQ ID NO: 1755531 - DNA, 17 bp, Homo sapiens
ccagggcagaggaatgt

SEQ ID NO: 1755532 - DNA, 19 bp, Homo sapiens
ccagggcattgctcagccc

SEQ ID NO: 1755533 - DNA, 13 bp, Homo sapiens
ccagggccacgtg

SEQ ID NO: 1755534 - DNA, 20 bp, Homo sapiens
ccagggccactctgcctctg

SEQ ID NO: 1755535 - DNA, 21 bp, Homo sapiens
ccatctccagggagcaagaca

SEQ ID NO: 1755536 - DNA, 17 bp, Homo sapiens
ccatctccccaggcctc

SEQ ID NO: 1755537 - DNA, 16 bp, Homo sapiens
ccatctccctgcctgg

SEQ ID NO: 1755538 - DNA, 17 bp, Homo sapiens
ccatctccgcctccaca

SEQ ID NO: 1755539 - DNA, 17 bp, Homo sapiens
ccatctcctttcaggga

SEQ ID NO: 1755540 - DNA, 23 bp, Homo sapiens
ccatctcgccacccctccttcct

SEQ ID NO: 1755541 - DNA, 14 bp, Homo sapiens
ccatctctactaaa

SEQ ID NO: 1755542 - DNA, 14 bp, Homo sapiens
ccatctctccctcc

SEQ ID NO: 1755543 - DNA, 23 bp, Homo sapiens
ccatctctccctcccctgccatt

SEQ ID NO: 1755544 - DNA, 16 bp, Homo sapiens
ccatctctgcctgtca

SEQ ID NO: 1755545 - DNA, 17 bp, Homo sapiens
ccatctctgcctgtcaa

SEQ ID NO: 1755546 - DNA, 17 bp, Homo sapiens
ccatctgattaaaacaa

SEQ ID NO: 1755547 - DNA, 12 bp, Homo sapiens
ccatctgcaccc

SEQ ID NO: 1755548 - DNA, 12 bp, Homo sapiens
ccatctgcccag

SEQ ID NO: 1755549 - DNA, 19 bp, Homo sapiens
ccatctgcttggttggctg

SEQ ID NO: 1755550 - DNA, 16 bp, Homo sapiens
ccatctgggagtcccc

SEQ ID NO: 1755551 - DNA, 11 bp, Homo sapiens
ccatctgtctt

SEQ ID NO: 1755552 - DNA, 19 bp, Homo sapiens
ccatctgtcttgccagcca

SEQ ID NO: 1755553 - DNA, 22 bp, Homo sapiens
ccatctgtgactataaagctgt

SEQ ID NO: 1755554 - DNA, 19 bp, Homo sapiens
ccatctgtttggtgggggt

SEQ ID NO: 1755555 - DNA, 14 bp, Homo sapiens
ccatcttccacctg

SEQ ID NO: 1755556 - DNA, 15 bp, Homo sapiens
ccatcttccacctgt

SEQ ID NO: 1755557 - DNA, 14 bp, Homo sapiens
ccatcttcctgctg

SEQ ID NO: 1755558 - DNA, 22 bp, Homo sapiens
ccatcttcttcccttaactcca

SEQ ID NO: 1755559 - DNA, 17 bp, Homo sapiens
ccatcttggcagggtta

SEQ ID NO: 1755560 - DNA, 17 bp, Homo sapiens
ccatcttggtagttctg

SEQ ID NO: 1755561 - DNA, 23 bp, Homo sapiens
ccatcttggtagttctgtgcctc

SEQ ID NO: 1755562 - DNA, 23 bp, Homo sapiens
ccatctttatagaaggaatttgt

SEQ ID NO: 1755563 - DNA, 24 bp, Homo sapiens
ccatctttatagaaggaatttgta

SEQ ID NO: 1755564 - DNA, 15 bp, Homo sapiens
ccatctttccatcca

SEQ ID NO: 1755565 - DNA, 16 bp, Homo sapiens
ccatgaacaaattctt

SEQ ID NO: 1755566 - DNA, 18 bp, Homo sapiens
ccatgaacaaattcttta

SEQ ID NO: 1755567 - DNA, 16 bp, Homo sapiens
ccatgaacacactgtg

SEQ ID NO: 1755568 - DNA, 13 bp, Homo sapiens
ccatgaagacagg

SEQ ID NO: 1755569 - DNA, 19 bp, Homo sapiens
ccatgaagacaggacagtg

SEQ ID NO: 1755570 - DNA, 13 bp, Homo sapiens
ccatgaatattta

SEQ ID NO: 1755571 - DNA, 17 bp, Homo sapiens
ccatgaatatttattta

SEQ ID NO: 1755572 - DNA, 19 bp, Homo sapiens
ccatgaatgtatcaggaaa

SEQ ID NO: 1755573 - DNA, 14 bp, Homo sapiens
ccatgaccatactg

SEQ ID NO: 1755574 - DNA, 16 bp, Homo sapiens
ccatgacccacccctg

SEQ ID NO: 1755575 - DNA, 17 bp, Homo sapiens
ccatgacccacccctgt

SEQ ID NO: 1755576 - DNA, 19 bp, Homo sapiens
ccatgacccacccctgtgc

SEQ ID NO: 1755577 - DNA, 14 bp, Homo sapiens
ccatgactggctgt

SEQ ID NO: 1755578 - DNA, 17 bp, Homo sapiens
ccatgagaagagggcct

SEQ ID NO: 1755579 - DNA, 21 bp, Homo sapiens
ccatgagaagagggcctgtgg

SEQ ID NO: 1755580 - DNA, 15 bp, Homo sapiens
ccatgagctgctcat

SEQ ID NO: 1755581 - DNA, 11 bp, Homo sapiens
ccatgaggagc

SEQ ID NO: 1755582 - DNA, 21 bp, Homo sapiens
ccatgaggagcgtggactctg

SEQ ID NO: 1755583 - DNA, 23 bp, Homo sapiens
ccatgaggtactggtcccttcct

SEQ ID NO: 1755584 - DNA, 17 bp, Homo sapiens
ccatgagtccttgaaaa

SEQ ID NO: 1755585 - DNA, 20 bp, Homo sapiens
ccatgatactccactcccag

SEQ ID NO: 1755586 - DNA, 23 bp, Homo sapiens
ccatgatactccactcccagcag

SEQ ID NO: 1755587 - DNA, 20 bp, Homo sapiens
ccatgatcgagccactgcac

SEQ ID NO: 1755588 - DNA, 14 bp, Homo sapiens
ccatgatggcaaca

SEQ ID NO: 1755589 - DNA, 15 bp, Homo sapiens
ccatgatggcaacag

SEQ ID NO: 1755590 - DNA, 20 bp, Homo sapiens
ccatgatttcccactgcact

SEQ ID NO: 1755591 - DNA, 15 bp, Homo sapiens
ccatgcaagcagagg

SEQ ID NO: 1755592 - DNA, 20 bp, Homo sapiens
ccatgcaagcagaggaccag

SEQ ID NO: 1755593 - DNA, 23 bp, Homo sapiens
ccatgcaagcagaggaccagggc

SEQ ID NO: 1755594 - DNA, 20 bp, Homo sapiens
ccatgcacagtacaataatg

SEQ ID NO: 1755595 - DNA, 21 bp, Homo sapiens
ccatgcaccaggactggctgt

SEQ ID NO: 1755596 - DNA, 19 bp, Homo sapiens
ccatgcacctcccttccct

SEQ ID NO: 1755597 - DNA, 23 bp, Homo sapiens
ccatgcactcacccctagccctg

SEQ ID NO: 1755598 - DNA, 13 bp, Homo sapiens
ccatgcactgtga

SEQ ID NO: 1755599 - DNA, 15 bp, Homo sapiens
ccatgcagaacacca

SEQ ID NO: 1755600 - DNA, 21 bp, Homo sapiens
ccatgcagacctcatgcccag

SEQ ID NO: 1755601 - DNA, 22 bp, Homo sapiens
ccatgcagacctcatgcccagc

SEQ ID NO: 1755602 - DNA, 19 bp, Homo sapiens
ccatgcagccttggggcat

SEQ ID NO: 1755603 - DNA, 15 bp, Homo sapiens
ccatgcagctgctcc

SEQ ID NO: 1755604 - DNA, 17 bp, Homo sapiens
ccatgcagctgctcccc

SEQ ID NO: 1755605 - DNA, 16 bp, Homo sapiens
ccatgcaggaagaggc

SEQ ID NO: 1755606 - DNA, 18 bp, Homo sapiens
ccatgcaggaagaggccc

SEQ ID NO: 1755607 - DNA, 19 bp, Homo sapiens
ccatgcaggaagaggccca

SEQ ID NO: 1755608 - DNA, 20 bp, Homo sapiens
ccatgcaggaagaggcccac

SEQ ID NO: 1755609 - DNA, 21 bp, Homo sapiens
ccatgcaggaagaggcccact

SEQ ID NO: 1755610 - DNA, 20 bp, Homo sapiens
ccatgccaaagctagggtgg

SEQ ID NO: 1755611 - DNA, 12 bp, Homo sapiens
ccatgccactgc

SEQ ID NO: 1755612 - DNA, 14 bp, Homo sapiens
ccatgccactgcca

SEQ ID NO: 1755613 - DNA, 15 bp, Homo sapiens
ccatgccactgccag

SEQ ID NO: 1755614 - DNA, 17 bp, Homo sapiens
ccatgccactgccaggc

SEQ ID NO: 1755615 - DNA, 20 bp, Homo sapiens
ccatgccagacccactgaaa

SEQ ID NO: 1755616 - DNA, 14 bp, Homo sapiens
ccatgccagagagg

SEQ ID NO: 1755617 - DNA, 14 bp, Homo sapiens
ccatgccaggaacc

SEQ ID NO: 1755618 - DNA, 17 bp, Homo sapiens
ccatgcccacctgccca

SEQ ID NO: 1755619 - DNA, 18 bp, Homo sapiens
ccatgccccagctctgga

SEQ ID NO: 1755620 - DNA, 21 bp, Homo sapiens
ccatgccccagctctggatga

SEQ ID NO: 1755621 - DNA, 14 bp, Homo sapiens
ccatgccccaggat

SEQ ID NO: 1755622 - DNA, 13 bp, Homo sapiens
ccatgcctcatgc

SEQ ID NO: 1755623 - DNA, 16 bp, Homo sapiens
ccatgcctcatgccac

SEQ ID NO: 1755624 - DNA, 18 bp, Homo sapiens
ccatgcctcatgccacac

SEQ ID NO: 1755625 - DNA, 23 bp, Homo sapiens
ccatgcctcatgccacaccttct

SEQ ID NO: 1755626 - DNA, 14 bp, Homo sapiens
ccatgcctgagggt

SEQ ID NO: 1755627 - DNA, 22 bp, Homo sapiens
ccatgcctgcccccctcatctc

SEQ ID NO: 1755628 - DNA, 23 bp, Homo sapiens
ccatgcctgtagctttcctggtc

SEQ ID NO: 1755629 - DNA, 14 bp, Homo sapiens
ccatgcgccccctc

SEQ ID NO: 1755630 - DNA, 22 bp, Homo sapiens
ccatgcgccccctccgccctgc

SEQ ID NO: 1755631 - DNA, 16 bp, Homo sapiens
ccatgcgctcagggcc

SEQ ID NO: 1755632 - DNA, 23 bp, Homo sapiens
ccatgcgtgccgcctgctcctca

SEQ ID NO: 1755633 - DNA, 20 bp, Homo sapiens
ccatgcgtgctgagaggcga

SEQ ID NO: 1755634 - DNA, 20 bp, Homo sapiens
ccatgcgtgtttctgactct

SEQ ID NO: 1755635 - DNA, 21 bp, Homo sapiens
ccatgctatgagttttctcct

SEQ ID NO: 1755636 - DNA, 21 bp, Homo sapiens
ccatgctcaaccactgtggcg

SEQ ID NO: 1755637 - DNA, 13 bp, Homo sapiens
ccatgctcatctg

SEQ ID NO: 1755638 - DNA, 12 bp, Homo sapiens
ccatgctccacc

SEQ ID NO: 1755639 - DNA, 14 bp, Homo sapiens
ccatgctctgcccc

SEQ ID NO: 1755640 - DNA, 23 bp, Homo sapiens
ccatgctctgccccaagccccca

SEQ ID NO: 1755641 - DNA, 17 bp, Homo sapiens
ccatgctgaggcctggg

SEQ ID NO: 1755642 - DNA, 19 bp, Homo sapiens
ccatgctgcaaaggagaag

SEQ ID NO: 1755643 - DNA, 22 bp, Homo sapiens
ccatgctgctggggaagacagt

SEQ ID NO: 1755644 - DNA, 23 bp, Homo sapiens
ccatgctgctggggaagacagtg

SEQ ID NO: 1755645 - DNA, 12 bp, Homo sapiens
ccatgctgggcc

SEQ ID NO: 1755646 - DNA, 20 bp, Homo sapiens
ccatgctggtggaaagatag

SEQ ID NO: 1755647 - DNA, 16 bp, Homo sapiens
ccatgcttagtcactg

SEQ ID NO: 1755648 - DNA, 19 bp, Homo sapiens
ccatgcttagtcactgcct

SEQ ID NO: 1755649 - DNA, 12 bp, Homo sapiens
cccacccctgtg

SEQ ID NO: 1755650 - DNA, 22 bp, Homo sapiens
cccacccgccgcctcccacggc

SEQ ID NO: 1755651 - DNA, 13 bp, Homo sapiens
cccacccgcctgc

SEQ ID NO: 1755652 - DNA, 17 bp, Homo sapiens
cccacccggccacagct

SEQ ID NO: 1755653 - DNA, 19 bp, Homo sapiens
cccacccggccacagctgc

SEQ ID NO: 1755654 - DNA, 21 bp, Homo sapiens
cccacccggccacagctgctg

SEQ ID NO: 1755655 - DNA, 18 bp, Homo sapiens
cccaccctcagcacccct

SEQ ID NO: 1755656 - DNA, 21 bp, Homo sapiens
cccaccctccggcgggtgaca

SEQ ID NO: 1755657 - DNA, 13 bp, Homo sapiens
cccaccctggcct

SEQ ID NO: 1755658 - DNA, 20 bp, Homo sapiens
cccaccctggcctagaccag

SEQ ID NO: 1755659 - DNA, 12 bp, Homo sapiens
cccaccctgggc

SEQ ID NO: 1755660 - DNA, 13 bp, Homo sapiens
cccaccctgtggc

SEQ ID NO: 1755661 - DNA, 13 bp, Homo sapiens
cccaccgccccca

SEQ ID NO: 1755662 - DNA, 15 bp, Homo sapiens
cccaccgcccccacc

SEQ ID NO: 1755663 - DNA, 13 bp, Homo sapiens
cccaccggccagg

SEQ ID NO: 1755664 - DNA, 15 bp, Homo sapiens
cccaccggccaggcc

SEQ ID NO: 1755665 - DNA, 16 bp, Homo sapiens
cccaccggtccagctg

SEQ ID NO: 1755666 - DNA, 17 bp, Homo sapiens
cccaccggtccagctgg

SEQ ID NO: 1755667 - DNA, 23 bp, Homo sapiens
cccaccgtccgccctgctcctcc

SEQ ID NO: 1755668 - DNA, 15 bp, Homo sapiens
cccacctacccagct

SEQ ID NO: 1755669 - DNA, 22 bp, Homo sapiens
cccacctcacagctactcagtg

SEQ ID NO: 1755670 - DNA, 18 bp, Homo sapiens
cccacctcagcctcccaa

SEQ ID NO: 1755671 - DNA, 14 bp, Homo sapiens
cccacctccccctc

SEQ ID NO: 1755672 - DNA, 21 bp, Homo sapiens
cccacctctcctgccctgtga

SEQ ID NO: 1755673 - DNA, 13 bp, Homo sapiens
cccacctgcccat

SEQ ID NO: 1755674 - DNA, 12 bp, Homo sapiens
cccacctgcctg

SEQ ID NO: 1755675 - DNA, 13 bp, Homo sapiens
cccacctgcctgg

SEQ ID NO: 1755676 - DNA, 13 bp, Homo sapiens
cccacctgctgag

SEQ ID NO: 1755677 - DNA, 16 bp, Homo sapiens
cccacctggccacctg

SEQ ID NO: 1755678 - DNA, 17 bp, Homo sapiens
cccacctgttttctgaa

SEQ ID NO: 1755679 - DNA, 23 bp, Homo sapiens
cccacctgttttctgaaacacac

SEQ ID NO: 1755680 - DNA, 13 bp, Homo sapiens
cccaccttcccac

SEQ ID NO: 1755681 - DNA, 16 bp, Homo sapiens
cccaccttggcctccc

SEQ ID NO: 1755682 - DNA, 17 bp, Homo sapiens
cccacgagaccccggct

SEQ ID NO: 1755683 - DNA, 20 bp, Homo sapiens
cccacgaggatggcctggaa

SEQ ID NO: 1755684 - DNA, 17 bp, Homo sapiens
cccacgagtcacctgca

SEQ ID NO: 1755685 - DNA, 16 bp, Homo sapiens
cccacgatcccctccc

SEQ ID NO: 1755686 - DNA, 19 bp, Homo sapiens
cccacgatcccctccccca

SEQ ID NO: 1755687 - DNA, 17 bp, Homo sapiens
cccacgcctcaccagcc

SEQ ID NO: 1755688 - DNA, 14 bp, Homo sapiens
cccacgccttatcc

SEQ ID NO: 1755689 - DNA, 19 bp, Homo sapiens
cccacgctgaccatgcgtc

SEQ ID NO: 1755690 - DNA, 19 bp, Homo sapiens
cccacggcacctcggggac

SEQ ID NO: 1755691 - DNA, 21 bp, Homo sapiens
cccacgtctcctcctcgaagc

SEQ ID NO: 1755692 - DNA, 13 bp, Homo sapiens
cccacgtctgtcc

SEQ ID NO: 1755693 - DNA, 15 bp, Homo sapiens
cccacgtctgtcctc

SEQ ID NO: 1755694 - DNA, 21 bp, Homo sapiens
cccacgtctgtcctcctttct

SEQ ID NO: 1755695 - DNA, 21 bp, Homo sapiens
cccacgtgagagaatctgcct

SEQ ID NO: 1755696 - DNA, 23 bp, Homo sapiens
cccacgttctctctgcctgtgag

SEQ ID NO: 1755697 - DNA, 12 bp, Homo sapiens
cccactaaagag

SEQ ID NO: 1755698 - DNA, 20 bp, Homo sapiens
cccactacccttctcctttc

SEQ ID NO: 1755699 - DNA, 15 bp, Homo sapiens
cccactactgcagca

SEQ ID NO: 1755700 - DNA, 16 bp, Homo sapiens
cccactagagggccca

SEQ ID NO: 1755701 - DNA, 13 bp, Homo sapiens
cccactcaccagc

SEQ ID NO: 1755702 - DNA, 15 bp, Homo sapiens
cccactcaccagccc

SEQ ID NO: 1755703 - DNA, 18 bp, Homo sapiens
cccactcaccagccctag

SEQ ID NO: 1755704 - DNA, 17 bp, Homo sapiens
cccactcacctttctcc

SEQ ID NO: 1755705 - DNA, 19 bp, Homo sapiens
cccactcacctttctccac

SEQ ID NO: 1755706 - DNA, 17 bp, Homo sapiens
cccactccagccctgtc

SEQ ID NO: 1755707 - DNA, 17 bp, Homo sapiens
cccactccagcctgggg

SEQ ID NO: 1755708 - DNA, 18 bp, Homo sapiens
cccactccagcctgggga

SEQ ID NO: 1755709 - DNA, 13 bp, Homo sapiens
cccactccccagc

SEQ ID NO: 1755710 - DNA, 24 bp, Homo sapiens
cccactcccccgtttctccttttc

SEQ ID NO: 1755711 - DNA, 15 bp, Homo sapiens
cccactccctgctct

SEQ ID NO: 1755712 - DNA, 12 bp, Homo sapiens
cccactcctcta

SEQ ID NO: 1755713 - DNA, 13 bp, Homo sapiens
cccactctcattc

SEQ ID NO: 1755714 - DNA, 17 bp, Homo sapiens
cccactctccccacact

SEQ ID NO: 1755715 - DNA, 14 bp, Homo sapiens
cccactctgcctgc

SEQ ID NO: 1755716 - DNA, 14 bp, Homo sapiens
cccactctgtaata

SEQ ID NO: 1755717 - DNA, 14 bp, Homo sapiens
cccactgacaccca

SEQ ID NO: 1755718 - DNA, 15 bp, Homo sapiens
cccactgcaatcctg

SEQ ID NO: 1755719 - DNA, 15 bp, Homo sapiens
cccactgcactccag

SEQ ID NO: 1755720 - DNA, 15 bp, Homo sapiens
cccactgccagcagc

SEQ ID NO: 1755721 - DNA, 16 bp, Homo sapiens
cccactgccagcagca

SEQ ID NO: 1755722 - DNA, 21 bp, Homo sapiens
cccactgccagcagcagcagg

SEQ ID NO: 1755723 - DNA, 22 bp, Homo sapiens
cccactgcccaccccctcaagc

SEQ ID NO: 1755724 - DNA, 16 bp, Homo sapiens
cccactgctggctgca

SEQ ID NO: 1755725 - DNA, 23 bp, Homo sapiens
cccactgggccagccctgcagcc

SEQ ID NO: 1755726 - DNA, 17 bp, Homo sapiens
cccactgtatgatttat

SEQ ID NO: 1755727 - DNA, 15 bp, Homo sapiens
cccactgtgcctcag

SEQ ID NO: 1755728 - DNA, 22 bp, Homo sapiens
cccactgtgcctcagagaccag

SEQ ID NO: 1755729 - DNA, 23 bp, Homo sapiens
cccactgtttctcttgagctggc

SEQ ID NO: 1755730 - DNA, 15 bp, Homo sapiens
cccacttcagcctcc

SEQ ID NO: 1755731 - DNA, 14 bp, Homo sapiens
cccacttccattcc

SEQ ID NO: 1755732 - DNA, 13 bp, Homo sapiens
cccacttcccctc

SEQ ID NO: 1755733 - DNA, 18 bp, Homo sapiens
cccacttgattgagaaag

SEQ ID NO: 1755734 - DNA, 20 bp, Homo sapiens
cccacttgattgagaaagat

SEQ ID NO: 1755735 - DNA, 15 bp, Homo sapiens
cccacttgcctcttc

SEQ ID NO: 1755736 - DNA, 15 bp, Homo sapiens
cccactttcctgagc

SEQ ID NO: 1755737 - DNA, 21 bp, Homo sapiens
cccactttcctgagctgtcgc

SEQ ID NO: 1755738 - DNA, 22 bp, Homo sapiens
cccactttttttttttctgcct

SEQ ID NO: 1755739 - DNA, 23 bp, Homo sapiens
cccactttttttttttctgcctg

SEQ ID NO: 1755740 - DNA, 16 bp, Homo sapiens
cccagaaaacctccag

SEQ ID NO: 1755741 - DNA, 14 bp, Homo sapiens
cccagaaacaacag

SEQ ID NO: 1755742 - DNA, 19 bp, Homo sapiens
cccagaaagcctctctctc

SEQ ID NO: 1755743 - DNA, 17 bp, Homo sapiens
cccagaaattctggccc

SEQ ID NO: 1755744 - DNA, 22 bp, Homo sapiens
cccagaaattctggcccagcca

SEQ ID NO: 1755745 - DNA, 15 bp, Homo sapiens
cccagaacctgtcct

SEQ ID NO: 1755746 - DNA, 17 bp, Homo sapiens
cccagaacctgtccttg

SEQ ID NO: 1755747 - DNA, 19 bp, Homo sapiens
cccagaacctgtccttgca

SEQ ID NO: 1755748 - DNA, 14 bp, Homo sapiens
cccagaatctctga

SEQ ID NO: 1755749 - DNA, 16 bp, Homo sapiens
cccagaatctctgagc

SEQ ID NO: 1755750 - DNA, 18 bp, Homo sapiens
cccagaatggagcctgct

SEQ ID NO: 1755751 - DNA, 18 bp, Homo sapiens
cccagaatgtagcatctg

SEQ ID NO: 1755752 - DNA, 20 bp, Homo sapiens
cccagaatttaccatcatct

SEQ ID NO: 1755753 - DNA, 14 bp, Homo sapiens
cccagacacatggg

SEQ ID NO: 1755754 - DNA, 13 bp, Homo sapiens
cccagacagctcc

SEQ ID NO: 1755755 - DNA, 14 bp, Homo sapiens
cccagacagctccc

SEQ ID NO: 1755756 - DNA, 20 bp, Homo sapiens
cccagacagctccctctgcc

SEQ ID NO: 1755757 - DNA, 24 bp, Homo sapiens
cccagaccaggaaaggcttggctg

SEQ ID NO: 1755758 - DNA, 16 bp, Homo sapiens
cccagaccggcttctc

SEQ ID NO: 1755759 - DNA, 19 bp, Homo sapiens
cccagactctttttttgag

SEQ ID NO: 1755760 - DNA, 14 bp, Homo sapiens
cccagactgagctc

SEQ ID NO: 1755761 - DNA, 18 bp, Homo sapiens
cccagactgagctctcca

SEQ ID NO: 1755762 - DNA, 20 bp, Homo sapiens
cccagactgagctctccagg

SEQ ID NO: 1755763 - DNA, 21 bp, Homo sapiens
cccagactgggcccaggcagg

SEQ ID NO: 1755764 - DNA, 15 bp, Homo sapiens
cccagcctctggcat

SEQ ID NO: 1755765 - DNA, 10 bp, Homo sapiens
cccagcctga

SEQ ID NO: 1755766 - DNA, 12 bp, Homo sapiens
cccagcctgaaa

SEQ ID NO: 1755767 - DNA, 12 bp, Homo sapiens
cccagcctggga

SEQ ID NO: 1755768 - DNA, 24 bp, Homo sapiens
cccagcctggggctccctctctgg

SEQ ID NO: 1755769 - DNA, 16 bp, Homo sapiens
cccagcgcggccagcg

SEQ ID NO: 1755770 - DNA, 17 bp, Homo sapiens
cccagcggccccccgca

SEQ ID NO: 1755771 - DNA, 19 bp, Homo sapiens
cccagcggccccccgcaca

SEQ ID NO: 1755772 - DNA, 14 bp, Homo sapiens
cccagcggcccctc

SEQ ID NO: 1755773 - DNA, 18 bp, Homo sapiens
cccagcggcccctcccac

SEQ ID NO: 1755774 - DNA, 20 bp, Homo sapiens
cccagcggcccctcccacac

SEQ ID NO: 1755775 - DNA, 17 bp, Homo sapiens
cccagcggctggtgcag

SEQ ID NO: 1755776 - DNA, 13 bp, Homo sapiens
cccagcgggcaga

SEQ ID NO: 1755777 - DNA, 16 bp, Homo sapiens
cccagctaagaacctg

SEQ ID NO: 1755778 - DNA, 18 bp, Homo sapiens
cccagctaagaacctgga

SEQ ID NO: 1755779 - DNA, 23 bp, Homo sapiens
cccagctaatctgtagggctgga

SEQ ID NO: 1755780 - DNA, 22 bp, Homo sapiens
cccagctaatttttgtattttt

SEQ ID NO: 1755781 - DNA, 16 bp, Homo sapiens
cccagctacattcctc

SEQ ID NO: 1755782 - DNA, 20 bp, Homo sapiens
cccagctacattcctcagct

SEQ ID NO: 1755783 - DNA, 22 bp, Homo sapiens
cccagctaccctttttctccag

SEQ ID NO: 1755784 - DNA, 15 bp, Homo sapiens
cccagctactcagga

SEQ ID NO: 1755785 - DNA, 20 bp, Homo sapiens
cccagctactcaggaggctg

SEQ ID NO: 1755786 - DNA, 21 bp, Homo sapiens
cccagctactctgtccaggcc

SEQ ID NO: 1755787 - DNA, 23 bp, Homo sapiens
cccagctactctgtccaggccac

SEQ ID NO: 1755788 - DNA, 21 bp, Homo sapiens
cccagctactggggaggctga

SEQ ID NO: 1755789 - DNA, 15 bp, Homo sapiens
cccagctacttggga

SEQ ID NO: 1755790 - DNA, 18 bp, Homo sapiens
cccagctacttgggaggc

SEQ ID NO: 1755791 - DNA, 13 bp, Homo sapiens
cccagctaggaag

SEQ ID NO: 1755792 - DNA, 11 bp, Homo sapiens
cccagctcaat

SEQ ID NO: 1755793 - DNA, 9 bp, Homo sapiens
cccagctcc

SEQ ID NO: 1755794 - DNA, 17 bp, Homo sapiens
cccagctccagggccag

SEQ ID NO: 1755795 - DNA, 18 bp, Homo sapiens
cccagctccagggccaga

SEQ ID NO: 1755796 - DNA, 13 bp, Homo sapiens
cccagctcccccc

SEQ ID NO: 1755797 - DNA, 21 bp, Homo sapiens
cccagctccccccgcccaccc

SEQ ID NO: 1755798 - DNA, 12 bp, Homo sapiens
cccagctcctga

SEQ ID NO: 1755799 - DNA, 23 bp, Homo sapiens
cccagctccttttgtccccaggg

SEQ ID NO: 1755800 - DNA, 13 bp, Homo sapiens
cccagctcgctgg

SEQ ID NO: 1755801 - DNA, 14 bp, Homo sapiens
cccagctctccctc

SEQ ID NO: 1755802 - DNA, 19 bp, Homo sapiens
cccagctctccctctggcc

SEQ ID NO: 1755803 - DNA, 14 bp, Homo sapiens
cccagctctctgac

SEQ ID NO: 1755804 - DNA, 13 bp, Homo sapiens
cccagctctggct

SEQ ID NO: 1755805 - DNA, 13 bp, Homo sapiens
cccagctctggtg

SEQ ID NO: 1755806 - DNA, 22 bp, Homo sapiens
cccagctctggtgagtcttggc

SEQ ID NO: 1755807 - DNA, 14 bp, Homo sapiens
cccagctgaaggca

SEQ ID NO: 1755808 - DNA, 12 bp, Homo sapiens
cccagctgcacc

SEQ ID NO: 1755809 - DNA, 18 bp, Homo sapiens
cccagctgcacctgccag

SEQ ID NO: 1755810 - DNA, 12 bp, Homo sapiens
cccagctgcaga

SEQ ID NO: 1755811 - DNA, 13 bp, Homo sapiens
cccagctggccac

SEQ ID NO: 1755812 - DNA, 11 bp, Homo sapiens
cccagctggga

SEQ ID NO: 1755813 - DNA, 14 bp, Homo sapiens
cccagctgggaggc

SEQ ID NO: 1755814 - DNA, 21 bp, Homo sapiens
cccagctgggaggcaagaggg

SEQ ID NO: 1755815 - DNA, 13 bp, Homo sapiens
cccagctgggctc

SEQ ID NO: 1755816 - DNA, 14 bp, Homo sapiens
cccagctgggctct

SEQ ID NO: 1755817 - DNA, 22 bp, Homo sapiens
cccagctgggctctgccaccct

SEQ ID NO: 1755818 - DNA, 23 bp, Homo sapiens
cccagctggtggccctgtgcctg

SEQ ID NO: 1755819 - DNA, 15 bp, Homo sapiens
cccagctgtagccat

SEQ ID NO: 1755820 - DNA, 20 bp, Homo sapiens
cccagctgtagccatggctc

SEQ ID NO: 1755821 - DNA, 22 bp, Homo sapiens
cccagctgtagccatggctcag

SEQ ID NO: 1755822 - DNA, 12 bp, Homo sapiens
cccagcttcctg

SEQ ID NO: 1755823 - DNA, 14 bp, Homo sapiens
cccagcttggctca

SEQ ID NO: 1755824 - DNA, 18 bp, Homo sapiens
cccaggaacgtttctgaa

SEQ ID NO: 1755825 - DNA, 15 bp, Homo sapiens
cccaggaccaagcca

SEQ ID NO: 1755826 - DNA, 14 bp, Homo sapiens
cccaggaccagctc

SEQ ID NO: 1755827 - DNA, 15 bp, Homo sapiens
cccaggaccagctca

SEQ ID NO: 1755828 - DNA, 20 bp, Homo sapiens
cccaggaccagctcaggaca

SEQ ID NO: 1755829 - DNA, 21 bp, Homo sapiens
cccaggaccagctcaggacag

SEQ ID NO: 1755830 - DNA, 22 bp, Homo sapiens
cccaggaccagctcaggacaga

SEQ ID NO: 1755831 - DNA, 17 bp, Homo sapiens
cccaggaccagctgggg

SEQ ID NO: 1755832 - DNA, 19 bp, Homo sapiens
cccaggaccagctggggcg

SEQ ID NO: 1755833 - DNA, 11 bp, Homo sapiens
cccaggaccct

SEQ ID NO: 1755834 - DNA, 12 bp, Homo sapiens
cccaggactggg

SEQ ID NO: 1755835 - DNA, 13 bp, Homo sapiens
cccaggactgggc

SEQ ID NO: 1755836 - DNA, 14 bp, Homo sapiens
cccaggagagccag

SEQ ID NO: 1755837 - DNA, 18 bp, Homo sapiens
cccaggagagccagccct

SEQ ID NO: 1755838 - DNA, 19 bp, Homo sapiens
cccaggagagccagccctc

SEQ ID NO: 1755839 - DNA, 21 bp, Homo sapiens
cccaggagagccagccctccc

SEQ ID NO: 1755840 - DNA, 22 bp, Homo sapiens
cccaggagagccagccctccct

SEQ ID NO: 1755841 - DNA, 16 bp, Homo sapiens
cccaggagcagaagag

SEQ ID NO: 1755842 - DNA, 13 bp, Homo sapiens
cccaggagcagct

SEQ ID NO: 1755843 - DNA, 14 bp, Homo sapiens
cccaggagctctgc

SEQ ID NO: 1755844 - DNA, 16 bp, Homo sapiens
cccaggagctctgcgc

SEQ ID NO: 1755845 - DNA, 17 bp, Homo sapiens
cccaggagctctgcgcc

SEQ ID NO: 1755846 - DNA, 20 bp, Homo sapiens
cccaggagctctgcgccagg

SEQ ID NO: 1755847 - DNA, 17 bp, Homo sapiens
cccaggagctgcccaga

SEQ ID NO: 1755848 - DNA, 18 bp, Homo sapiens
cccaggagggagggggct

SEQ ID NO: 1755849 - DNA, 23 bp, Homo sapiens
cccaggaggtggaggttgcagtg

SEQ ID NO: 1755850 - DNA, 20 bp, Homo sapiens
cccaggagtttgagacaagc

SEQ ID NO: 1755851 - DNA, 18 bp, Homo sapiens
cccaggatcactctctgc

SEQ ID NO: 1755852 - DNA, 13 bp, Homo sapiens
cccaggattcccc

SEQ ID NO: 1755853 - DNA, 19 bp, Homo sapiens
cccaggattcccccagcca

SEQ ID NO: 1755854 - DNA, 21 bp, Homo sapiens
cccaggcaagcagctggtcag

SEQ ID NO: 1755855 - DNA, 17 bp, Homo sapiens
cccaggcactgggctcc

SEQ ID NO: 1755856 - DNA, 14 bp, Homo sapiens
cccaggcaggtctg

SEQ ID NO: 1755857 - DNA, 16 bp, Homo sapiens
cccaggcaggtctgca

SEQ ID NO: 1755858 - DNA, 20 bp, Homo sapiens
cccaggcaggtctgcaaggg

SEQ ID NO: 1755859 - DNA, 12 bp, Homo sapiens
cccaggccaccc

SEQ ID NO: 1755860 - DNA, 19 bp, Homo sapiens
cccaggccagagtgcagtg

SEQ ID NO: 1755861 - DNA, 11 bp, Homo sapiens
cccaggcccac

SEQ ID NO: 1755862 - DNA, 22 bp, Homo sapiens
cccaggcccactgtgcctcaga

SEQ ID NO: 1755863 - DNA, 13 bp, Homo sapiens
cccaggcccgaga

SEQ ID NO: 1755864 - DNA, 15 bp, Homo sapiens
cccaggccctccatg

SEQ ID NO: 1755865 - DNA, 18 bp, Homo sapiens
cccaggcccttggctgca

SEQ ID NO: 1755866 - DNA, 15 bp, Homo sapiens
cccaggccctttggc

SEQ ID NO: 1755867 - DNA, 19 bp, Homo sapiens
cccaggccgcaccatttct

SEQ ID NO: 1755868 - DNA, 14 bp, Homo sapiens
cccaggccgcagct

SEQ ID NO: 1755869 - DNA, 16 bp, Homo sapiens
cccaggccgcagctct

SEQ ID NO: 1755870 - DNA, 13 bp, Homo sapiens
cccaggccggagc

SEQ ID NO: 1755871 - DNA, 14 bp, Homo sapiens
cccaggccggagcc

SEQ ID NO: 1755872 - DNA, 14 bp, Homo sapiens
cccaggcctccagc

SEQ ID NO: 1755873 - DNA, 15 bp, Homo sapiens
cccaggcctccagcc

SEQ ID NO: 1755874 - DNA, 22 bp, Homo sapiens
cccaggctcgtggactgagtgg

SEQ ID NO: 1755875 - DNA, 14 bp, Homo sapiens
cccaggctgcactg

SEQ ID NO: 1755876 - DNA, 16 bp, Homo sapiens
cccaggctgcactgca

SEQ ID NO: 1755877 - DNA, 18 bp, Homo sapiens
cccaggctgcactgcagt

SEQ ID NO: 1755878 - DNA, 19 bp, Homo sapiens
cccaggctgcactgcagtg

SEQ ID NO: 1755879 - DNA, 20 bp, Homo sapiens
cccaggctgcactgcagtga

SEQ ID NO: 1755880 - DNA, 19 bp, Homo sapiens
ccccaacactgtgccctgg

SEQ ID NO: 1755881 - DNA, 20 bp, Homo sapiens
ccccaacactgtgccctggt

SEQ ID NO: 1755882 - DNA, 19 bp, Homo sapiens
ccccaacatctccctccca

SEQ ID NO: 1755883 - DNA, 16 bp, Homo sapiens
ccccaacatgcactga

SEQ ID NO: 1755884 - DNA, 13 bp, Homo sapiens
ccccaacccccac

SEQ ID NO: 1755885 - DNA, 22 bp, Homo sapiens
ccccaaccccgcggtgctctgg

SEQ ID NO: 1755886 - DNA, 21 bp, Homo sapiens
ccccaacctcagggctcccag

SEQ ID NO: 1755887 - DNA, 22 bp, Homo sapiens
ccccaacctcagggctcccagg

SEQ ID NO: 1755888 - DNA, 16 bp, Homo sapiens
ccccaacgtcccctcc

SEQ ID NO: 1755889 - DNA, 19 bp, Homo sapiens
ccccaactccctctctgtg

SEQ ID NO: 1755890 - DNA, 18 bp, Homo sapiens
ccccaactctccccagtg

SEQ ID NO: 1755891 - DNA, 20 bp, Homo sapiens
ccccaactgtggtagctcca

SEQ ID NO: 1755892 - DNA, 23 bp, Homo sapiens
ccccaactgtggtagctccagcg

SEQ ID NO: 1755893 - DNA, 13 bp, Homo sapiens
ccccaagcagcca

SEQ ID NO: 1755894 - DNA, 14 bp, Homo sapiens
ccccaagcagccag

SEQ ID NO: 1755895 - DNA, 18 bp, Homo sapiens
ccccaagcagccagccag

SEQ ID NO: 1755896 - DNA, 19 bp, Homo sapiens
ccccaagcagccagccagt

SEQ ID NO: 1755897 - DNA, 13 bp, Homo sapiens
ccccaaggcctct

SEQ ID NO: 1755898 - DNA, 17 bp, Homo sapiens
ccccaaggcctctctct

SEQ ID NO: 1755899 - DNA, 21 bp, Homo sapiens
ccccaaggcctctctctgcct

SEQ ID NO: 1755900 - DNA, 15 bp, Homo sapiens
ccccaagggcccaga

SEQ ID NO: 1755901 - DNA, 15 bp, Homo sapiens
ccccaagggccctgg

SEQ ID NO: 1755902 - DNA, 12 bp, Homo sapiens
ccccaataaaag

SEQ ID NO: 1755903 - DNA, 12 bp, Homo sapiens
ccccaataaagg

SEQ ID NO: 1755904 - DNA, 16 bp, Homo sapiens
ccccaataaaggcagc

SEQ ID NO: 1755905 - DNA, 17 bp, Homo sapiens
ccccaataaaggcagct

SEQ ID NO: 1755906 - DNA, 19 bp, Homo sapiens
ccccaataaaggcagctgc

SEQ ID NO: 1755907 - DNA, 21 bp, Homo sapiens
ccccaataaaggcagctgcct

SEQ ID NO: 1755908 - DNA, 24 bp, Homo sapiens
ccccaataaaggcagctgcctctg

SEQ ID NO: 1755909 - DNA, 15 bp, Homo sapiens
ccccaataattgcag

SEQ ID NO: 1755910 - DNA, 16 bp, Homo sapiens
ccccaatatcttgctt

SEQ ID NO: 1755911 - DNA, 18 bp, Homo sapiens
ccccaatcgggtccagag

SEQ ID NO: 1755912 - DNA, 21 bp, Homo sapiens
ccccaatgtatgtgtggctgt

SEQ ID NO: 1755913 - DNA, 15 bp, Homo sapiens
ccccaattctcccct

SEQ ID NO: 1755914 - DNA, 18 bp, Homo sapiens
ccccacaagctgtccctg

SEQ ID NO: 1755915 - DNA, 13 bp, Homo sapiens
ccccacacagggc

SEQ ID NO: 1755916 - DNA, 19 bp, Homo sapiens
ccccacaccttccagggcc

SEQ ID NO: 1755917 - DNA, 23 bp, Homo sapiens
ccccacacttgttccagctcttt

SEQ ID NO: 1755918 - DNA, 13 bp, Homo sapiens
ccccacagaacct

SEQ ID NO: 1755919 - DNA, 17 bp, Homo sapiens
ccccacagcgtccctgg

SEQ ID NO: 1755920 - DNA, 18 bp, Homo sapiens
ccccacagcgtccctggc

SEQ ID NO: 1755921 - DNA, 16 bp, Homo sapiens
ccccacagtgccaccc

SEQ ID NO: 1755922 - DNA, 15 bp, Homo sapiens
ccccacagttttaat

SEQ ID NO: 1755923 - DNA, 15 bp, Homo sapiens
ccccaccacactgaa

SEQ ID NO: 1755924 - DNA, 23 bp, Homo sapiens
ccccaccacgtctggctccctgc

SEQ ID NO: 1755925 - DNA, 19 bp, Homo sapiens
ccccaccatatgaattgta

SEQ ID NO: 1755926 - DNA, 18 bp, Homo sapiens
ccccacccccgccatgca

SEQ ID NO: 1755927 - DNA, 20 bp, Homo sapiens
ccccacccctacagcctgca

SEQ ID NO: 1755928 - DNA, 17 bp, Homo sapiens
ccccacccctgccccca

SEQ ID NO: 1755929 - DNA, 23 bp, Homo sapiens
ccccacccctgcccccagccccg

SEQ ID NO: 1755930 - DNA, 15 bp, Homo sapiens
ccccaccctccactc

SEQ ID NO: 1755931 - DNA, 13 bp, Homo sapiens
ccccaccctccat

SEQ ID NO: 1755932 - DNA, 14 bp, Homo sapiens
ccccaccctgggcc

SEQ ID NO: 1755933 - DNA, 20 bp, Homo sapiens
ccccacctcacagctactca

SEQ ID NO: 1755934 - DNA, 12 bp, Homo sapiens
ccccacctgcca

SEQ ID NO: 1755935 - DNA, 13 bp, Homo sapiens
ccccacctgcctg

SEQ ID NO: 1755936 - DNA, 15 bp, Homo sapiens
ccccaccttgtctgc

SEQ ID NO: 1755937 - DNA, 18 bp, Homo sapiens
ccccacgagggctggctg

SEQ ID NO: 1755938 - DNA, 21 bp, Homo sapiens
ccccacgagggctggctggcc

SEQ ID NO: 1755939 - DNA, 16 bp, Homo sapiens
ccccacgctgaccatg

SEQ ID NO: 1755940 - DNA, 16 bp, Homo sapiens
ccccacgtctgtcctc

SEQ ID NO: 1755941 - DNA, 14 bp, Homo sapiens
ccccacgtggagct

SEQ ID NO: 1755942 - DNA, 14 bp, Homo sapiens
ccccactactgcag

SEQ ID NO: 1755943 - DNA, 23 bp, Homo sapiens
ccccactactgcagcacctccag

SEQ ID NO: 1755944 - DNA, 10 bp, Homo sapiens
ccccactcca

SEQ ID NO: 1755945 - DNA, 14 bp, Homo sapiens
ccccactccagccc

SEQ ID NO: 1755946 - DNA, 15 bp, Homo sapiens
ccccactccagccct

SEQ ID NO: 1755947 - DNA, 21 bp, Homo sapiens
ccccactccagcctggggacc

SEQ ID NO: 1755948 - DNA, 19 bp, Homo sapiens
ccccactcccttgctggcc

SEQ ID NO: 1755949 - DNA, 14 bp, Homo sapiens
ccccactctgcctg

SEQ ID NO: 1755950 - DNA, 15 bp, Homo sapiens
ccccactgacaccca

SEQ ID NO: 1755951 - DNA, 15 bp, Homo sapiens
ccccactgacagcct

SEQ ID NO: 1755952 - DNA, 21 bp, Homo sapiens
ccccactgacagcctcccacc

SEQ ID NO: 1755953 - DNA, 14 bp, Homo sapiens
ccccactgaccaga

SEQ ID NO: 1755954 - DNA, 16 bp, Homo sapiens
ccccactgccagcagc

SEQ ID NO: 1755955 - DNA, 14 bp, Homo sapiens
ccccactgggccag

SEQ ID NO: 1755956 - DNA, 23 bp, Homo sapiens
ccccactgggccagccctgcagc

SEQ ID NO: 1755957 - DNA, 16 bp, Homo sapiens
ccccacttgcctcttc

SEQ ID NO: 1755958 - DNA, 13 bp, Homo sapiens
ccccactttgaag

SEQ ID NO: 1755959 - DNA, 21 bp, Homo sapiens
ccccagaaattctggcccagc

SEQ ID NO: 1755960 - DNA, 13 bp, Homo sapiens
ccccagaccccgc

SEQ ID NO: 1755961 - DNA, 20 bp, Homo sapiens
ccccagactgagctctccag

SEQ ID NO: 1755962 - DNA, 16 bp, Homo sapiens
ccccagactgggccca

SEQ ID NO: 1755963 - DNA, 20 bp, Homo sapiens
ccccagactgggcccaggca

SEQ ID NO: 1755964 - DNA, 23 bp, Homo sapiens
ccccagagagaccctgcaagacc

SEQ ID NO: 1755965 - DNA, 22 bp, Homo sapiens
ccccagagctgtttatggcctc

SEQ ID NO: 1755966 - DNA, 13 bp, Homo sapiens
ccccagaggcaga

SEQ ID NO: 1755967 - DNA, 12 bp, Homo sapiens
ccccagaggccc

SEQ ID NO: 1755968 - DNA, 14 bp, Homo sapiens
ccccagaggccctg

SEQ ID NO: 1755969 - DNA, 15 bp, Homo sapiens
ccccagaggccctgg

SEQ ID NO: 1755970 - DNA, 18 bp, Homo sapiens
ccccagaggccctggagg

SEQ ID NO: 1755971 - DNA, 14 bp, Homo sapiens
ccccagaggctccc

SEQ ID NO: 1755972 - DNA, 15 bp, Homo sapiens
ccccagaggctccca

SEQ ID NO: 1755973 - DNA, 20 bp, Homo sapiens
ccccagaggctcccaatcag

SEQ ID NO: 1755974 - DNA, 20 bp, Homo sapiens
ccccagaggtcgcagctacc

SEQ ID NO: 1755975 - DNA, 22 bp, Homo sapiens
ccccagaggtcgcagctaccct

SEQ ID NO: 1755976 - DNA, 22 bp, Homo sapiens
ccccagagtgtgggaagggaga

SEQ ID NO: 1755977 - DNA, 18 bp, Homo sapiens
ccccagatcaccagcccg

SEQ ID NO: 1755978 - DNA, 15 bp, Homo sapiens
ccccagatctgcctg

SEQ ID NO: 1755979 - DNA, 17 bp, Homo sapiens
ccccagatctgcctggg

SEQ ID NO: 1755980 - DNA, 22 bp, Homo sapiens
ccccagatctgcctgggcctgt

SEQ ID NO: 1755981 - DNA, 20 bp, Homo sapiens
ccccagcaacgcccctccaa

SEQ ID NO: 1755982 - DNA, 22 bp, Homo sapiens
ccccagcaacgcccctccaaac

SEQ ID NO: 1755983 - DNA, 17 bp, Homo sapiens
ccccagcaagcgggagc

SEQ ID NO: 1755984 - DNA, 22 bp, Homo sapiens
ccccagcaagcgggagcccgtg

SEQ ID NO: 1755985 - DNA, 12 bp, Homo sapiens
ccccagcactga

SEQ ID NO: 1755986 - DNA, 16 bp, Homo sapiens
ccccagcactgaggaa

SEQ ID NO: 1755987 - DNA, 11 bp, Homo sapiens
ccccagcactt

SEQ ID NO: 1755988 - DNA, 19 bp, Homo sapiens
ccccagcagtttctgtcct

SEQ ID NO: 1755989 - DNA, 11 bp, Homo sapiens
ccccagccaga

SEQ ID NO: 1755990 - DNA, 16 bp, Homo sapiens
ccccagcccaataaag

SEQ ID NO: 1755991 - DNA, 13 bp, Homo sapiens
ccccagcccagag

SEQ ID NO: 1755992 - DNA, 16 bp, Homo sapiens
ccccagcccagagaca

SEQ ID NO: 1755993 - DNA, 15 bp, Homo sapiens
ccccagccccttcca

SEQ ID NO: 1755994 - DNA, 15 bp, Homo sapiens
ccccagccctgggaa

SEQ ID NO: 1755995 - DNA, 21 bp, Homo sapiens
ccctgtgcttggaaacctttt

SEQ ID NO: 1755996 - DNA, 13 bp, Homo sapiens
ccctgtggacagg

SEQ ID NO: 1755997 - DNA, 21 bp, Homo sapiens
ccctgtggagtccagctctac

SEQ ID NO: 1755998 - DNA, 16 bp, Homo sapiens
ccctgtggccgccacc

SEQ ID NO: 1755999 - DNA, 22 bp, Homo sapiens
ccctgtgggcttatgtctctgc

SEQ ID NO: 1756000 - DNA, 23 bp, Homo sapiens
ccctgtgggcttatgtctctgcc

SEQ ID NO: 1756001 - DNA, 12 bp, Homo sapiens
ccctgtggggat

SEQ ID NO: 1756002 - DNA, 14 bp, Homo sapiens
ccctgtggggatct

SEQ ID NO: 1756003 - DNA, 20 bp, Homo sapiens
ccctgtggggatctcagggg

SEQ ID NO: 1756004 - DNA, 17 bp, Homo sapiens
ccctgtggggcaggagt

SEQ ID NO: 1756005 - DNA, 21 bp, Homo sapiens
ccctgtggggcaggagtgcca

SEQ ID NO: 1756006 - DNA, 22 bp, Homo sapiens
ccctgtggggcaggagtgccag

SEQ ID NO: 1756007 - DNA, 17 bp, Homo sapiens
ccctgtggtctattgtc

SEQ ID NO: 1756008 - DNA, 11 bp, Homo sapiens
ccctgtgtgca

SEQ ID NO: 1756009 - DNA, 15 bp, Homo sapiens
ccctgtgttgtctct

SEQ ID NO: 1756010 - DNA, 22 bp, Homo sapiens
ccctgttcactctacttagcat

SEQ ID NO: 1756011 - DNA, 13 bp, Homo sapiens
ccctgttctcctg

SEQ ID NO: 1756012 - DNA, 22 bp, Homo sapiens
ccctgtttctggagtcacatca

SEQ ID NO: 1756013 - DNA, 14 bp, Homo sapiens
ccctgttttctgag

SEQ ID NO: 1756014 - DNA, 17 bp, Homo sapiens
ccctgttttctgagccc

SEQ ID NO: 1756015 - DNA, 20 bp, Homo sapiens
ccctgttttctgagcccggg

SEQ ID NO: 1756016 - DNA, 18 bp, Homo sapiens
ccctgttttctgtttctt

SEQ ID NO: 1756017 - DNA, 23 bp, Homo sapiens
ccctgtttttagagcttccaaat

SEQ ID NO: 1756018 - DNA, 15 bp, Homo sapiens
cccttaactccaaga

SEQ ID NO: 1756019 - DNA, 23 bp, Homo sapiens
cccttaagaatgagtttcttaga

SEQ ID NO: 1756020 - DNA, 23 bp, Homo sapiens
cccttaagccaaactcaggccca

SEQ ID NO: 1756021 - DNA, 24 bp, Homo sapiens
cccttaagccaaactcaggcccag

SEQ ID NO: 1756022 - DNA, 21 bp, Homo sapiens
cccttaaggcacagtgggagc

SEQ ID NO: 1756023 - DNA, 21 bp, Homo sapiens
cccttaatattgaggctgcag

SEQ ID NO: 1756024 - DNA, 15 bp, Homo sapiens
cccttaatcttgctt

SEQ ID NO: 1756025 - DNA, 15 bp, Homo sapiens
cccttacacgtacct

SEQ ID NO: 1756026 - DNA, 16 bp, Homo sapiens
cccttacacgtacctc

SEQ ID NO: 1756027 - DNA, 19 bp, Homo sapiens
cccttactatgatctcagg

SEQ ID NO: 1756028 - DNA, 20 bp, Homo sapiens
cccttactatgatctcagga

SEQ ID NO: 1756029 - DNA, 21 bp, Homo sapiens
cccttactggcttacctcctc

SEQ ID NO: 1756030 - DNA, 19 bp, Homo sapiens
cccttagcctctcccaccc

SEQ ID NO: 1756031 - DNA, 21 bp, Homo sapiens
cccttattgcctcccaggcaa

SEQ ID NO: 1756032 - DNA, 16 bp, Homo sapiens
cccttcacagtgtttc

SEQ ID NO: 1756033 - DNA, 16 bp, Homo sapiens
cccttcactgccatga

SEQ ID NO: 1756034 - DNA, 16 bp, Homo sapiens
cccttcagactggccc

SEQ ID NO: 1756035 - DNA, 19 bp, Homo sapiens
cccttcagtaccctctcag

SEQ ID NO: 1756036 - DNA, 15 bp, Homo sapiens
cccttcatcttcctg

SEQ ID NO: 1756037 - DNA, 19 bp, Homo sapiens
cccttccatgccccaggat

SEQ ID NO: 1756038 - DNA, 16 bp, Homo sapiens
cccttccatgtgcctt

SEQ ID NO: 1756039 - DNA, 18 bp, Homo sapiens
cccttcccaatcagcact

SEQ ID NO: 1756040 - DNA, 20 bp, Homo sapiens
cccttcccaatcagcactga

SEQ ID NO: 1756041 - DNA, 17 bp, Homo sapiens
cccttcccagaccagga

SEQ ID NO: 1756042 - DNA, 14 bp, Homo sapiens
cccttcccaggagg

SEQ ID NO: 1756043 - DNA, 18 bp, Homo sapiens
cccttcccatctcttcct

SEQ ID NO: 1756044 - DNA, 14 bp, Homo sapiens
cccttccccaggcc

SEQ ID NO: 1756045 - DNA, 17 bp, Homo sapiens
cccttccccaggcccac

SEQ ID NO: 1756046 - DNA, 13 bp, Homo sapiens
cccttcccccacc

SEQ ID NO: 1756047 - DNA, 16 bp, Homo sapiens
cccttcccctccctgg

SEQ ID NO: 1756048 - DNA, 16 bp, Homo sapiens
cccttcccgcctccct

SEQ ID NO: 1756049 - DNA, 16 bp, Homo sapiens
cccttcccgccttcca

SEQ ID NO: 1756050 - DNA, 15 bp, Homo sapiens
cccttccctgtccct

SEQ ID NO: 1756051 - DNA, 16 bp, Homo sapiens
cccttccctgtccttg

SEQ ID NO: 1756052 - DNA, 19 bp, Homo sapiens
cccttcccttgagccctct

SEQ ID NO: 1756053 - DNA, 17 bp, Homo sapiens
cccttcctccccacact

SEQ ID NO: 1756054 - DNA, 21 bp, Homo sapiens
cccttcctctccactgccttc

SEQ ID NO: 1756055 - DNA, 20 bp, Homo sapiens
cccttcctcttcctgccctt

SEQ ID NO: 1756056 - DNA, 14 bp, Homo sapiens
cccttcctctttgg

SEQ ID NO: 1756057 - DNA, 14 bp, Homo sapiens
cccttcctgccact

SEQ ID NO: 1756058 - DNA, 15 bp, Homo sapiens
cccttcctgccactg

SEQ ID NO: 1756059 - DNA, 13 bp, Homo sapiens
cccttcctggaaa

SEQ ID NO: 1756060 - DNA, 15 bp, Homo sapiens
cccttcctggaaaca

SEQ ID NO: 1756061 - DNA, 22 bp, Homo sapiens
cccttcctggaaacagcatgaa

SEQ ID NO: 1756062 - DNA, 23 bp, Homo sapiens
cccttcctggcctcactggctgg

SEQ ID NO: 1756063 - DNA, 11 bp, Homo sapiens
cccttccttta

SEQ ID NO: 1756064 - DNA, 17 bp, Homo sapiens
cccttccttttccctgc

SEQ ID NO: 1756065 - DNA, 22 bp, Homo sapiens
cccttccttttccctgcttcca

SEQ ID NO: 1756066 - DNA, 18 bp, Homo sapiens
cccttctatacccaccca

SEQ ID NO: 1756067 - DNA, 19 bp, Homo sapiens
cccttctatacccacccag

SEQ ID NO: 1756068 - DNA, 20 bp, Homo sapiens
cccttctatacccacccaga

SEQ ID NO: 1756069 - DNA, 22 bp, Homo sapiens
cccttctccccagccagaggtg

SEQ ID NO: 1756070 - DNA, 18 bp, Homo sapiens
cccttctcccctgcactg

SEQ ID NO: 1756071 - DNA, 21 bp, Homo sapiens
cccttctcccctgcactgtaa

SEQ ID NO: 1756072 - DNA, 12 bp, Homo sapiens
cccttctccttt

SEQ ID NO: 1756073 - DNA, 17 bp, Homo sapiens
cccttctcctttccttc

SEQ ID NO: 1756074 - DNA, 11 bp, Homo sapiens
cccttctctct

SEQ ID NO: 1756075 - DNA, 15 bp, Homo sapiens
cccttctcttagtta

SEQ ID NO: 1756076 - DNA, 21 bp, Homo sapiens
cccttctgactgtttatttaa

SEQ ID NO: 1756077 - DNA, 22 bp, Homo sapiens
cccttctgactgtttatttaag

SEQ ID NO: 1756078 - DNA, 18 bp, Homo sapiens
cccttctttgctgctgct

SEQ ID NO: 1756079 - DNA, 14 bp, Homo sapiens
cccttgaaggaaga

SEQ ID NO: 1756080 - DNA, 16 bp, Homo sapiens
cccttgaaggaagagg

SEQ ID NO: 1756081 - DNA, 23 bp, Homo sapiens
cccttgacgtcaagtctccttcc

SEQ ID NO: 1756082 - DNA, 12 bp, Homo sapiens
cccttgagacct

SEQ ID NO: 1756083 - DNA, 14 bp, Homo sapiens
cccttgagacctca

SEQ ID NO: 1756084 - DNA, 18 bp, Homo sapiens
cccttgagacctcagcca

SEQ ID NO: 1756085 - DNA, 19 bp, Homo sapiens
cccttgagacctcagccat

SEQ ID NO: 1756086 - DNA, 20 bp, Homo sapiens
cccttgagacctcagccatg

SEQ ID NO: 1756087 - DNA, 17 bp, Homo sapiens
cccttgagccctctatg

SEQ ID NO: 1756088 - DNA, 17 bp, Homo sapiens
cccttgagggtttgaga

SEQ ID NO: 1756089 - DNA, 21 bp, Homo sapiens
cccttgatttaaacacacaga

SEQ ID NO: 1756090 - DNA, 22 bp, Homo sapiens
cccttgcaggggtcccccctca

SEQ ID NO: 1756091 - DNA, 15 bp, Homo sapiens
cccttgccagacatg

SEQ ID NO: 1756092 - DNA, 19 bp, Homo sapiens
cccttgccatccattctgg

SEQ ID NO: 1756093 - DNA, 14 bp, Homo sapiens
cccttgcccagggc

SEQ ID NO: 1756094 - DNA, 12 bp, Homo sapiens
cccttgccctcc

SEQ ID NO: 1756095 - DNA, 22 bp, Homo sapiens
cccttgccctccctttctctct

SEQ ID NO: 1756096 - DNA, 13 bp, Homo sapiens
cccttgccctccg

SEQ ID NO: 1756097 - DNA, 18 bp, Homo sapiens
cccttgcctccccatttc

SEQ ID NO: 1756098 - DNA, 20 bp, Homo sapiens
cccttgcctccccatttccc

SEQ ID NO: 1756099 - DNA, 22 bp, Homo sapiens
cccttgcctctgccctggattg

SEQ ID NO: 1756100 - DNA, 13 bp, Homo sapiens
cccttgctggccc

SEQ ID NO: 1756101 - DNA, 15 bp, Homo sapiens
cccttgctggcccca

SEQ ID NO: 1756102 - DNA, 16 bp, Homo sapiens
cccttgctggccccag

SEQ ID NO: 1756103 - DNA, 22 bp, Homo sapiens
cccttgcttgcctgcagggcca

SEQ ID NO: 1756104 - DNA, 23 bp, Homo sapiens
cccttgcttgcctgcagggccat

SEQ ID NO: 1756105 - DNA, 17 bp, Homo sapiens
cccttgctttcctgggc

SEQ ID NO: 1756106 - DNA, 21 bp, Homo sapiens
cccttggaaatgtctgctggt

SEQ ID NO: 1756107 - DNA, 15 bp, Homo sapiens
cccttggacacttgg

SEQ ID NO: 1756108 - DNA, 17 bp, Homo sapiens
cccttggaggctgtctt

SEQ ID NO: 1756109 - DNA, 19 bp, Homo sapiens
ccggcttcctttcccaagc

SEQ ID NO: 1756110 - DNA, 15 bp, Homo sapiens
ccgggacagacctgg

SEQ ID NO: 1756111 - DNA, 19 bp, Homo sapiens
ccgggaccacagctgctgg

SEQ ID NO: 1756112 - DNA, 14 bp, Homo sapiens
ccgggagctggcgg

SEQ ID NO: 1756113 - DNA, 23 bp, Homo sapiens
ccgggatattatagaaaattatt

SEQ ID NO: 1756114 - DNA, 22 bp, Homo sapiens
ccgggcaaatggctgagatgga

SEQ ID NO: 1756115 - DNA, 13 bp, Homo sapiens
ccgggcacagtgg

SEQ ID NO: 1756116 - DNA, 14 bp, Homo sapiens
ccgggcatggtggc

SEQ ID NO: 1756117 - DNA, 21 bp, Homo sapiens
ccgggcccctgggcttggcct

SEQ ID NO: 1756118 - DNA, 14 bp, Homo sapiens
ccgggccctccctt

SEQ ID NO: 1756119 - DNA, 18 bp, Homo sapiens
ccgggccctcccttggaa

SEQ ID NO: 1756120 - DNA, 12 bp, Homo sapiens
ccgggcctccca

SEQ ID NO: 1756121 - DNA, 14 bp, Homo sapiens
ccgggcctcccacc

SEQ ID NO: 1756122 - DNA, 15 bp, Homo sapiens
ccgggcctgggcctc

SEQ ID NO: 1756123 - DNA, 14 bp, Homo sapiens
ccgggcgcggtggc

SEQ ID NO: 1756124 - DNA, 13 bp, Homo sapiens
ccgggctctctgc

SEQ ID NO: 1756125 - DNA, 13 bp, Homo sapiens
ccgggctctggcc

SEQ ID NO: 1756126 - DNA, 18 bp, Homo sapiens
ccgggctctggccaccct

SEQ ID NO: 1756127 - DNA, 15 bp, Homo sapiens
ccgggctgagggcct

SEQ ID NO: 1756128 - DNA, 12 bp, Homo sapiens
ccgggctgcctg

SEQ ID NO: 1756129 - DNA, 16 bp, Homo sapiens
ccgggctgcctgggct

SEQ ID NO: 1756130 - DNA, 12 bp, Homo sapiens
ccgggctgctgc

SEQ ID NO: 1756131 - DNA, 15 bp, Homo sapiens
ccgggctgctgctga

SEQ ID NO: 1756132 - DNA, 13 bp, Homo sapiens
ccgggctggagaa

SEQ ID NO: 1756133 - DNA, 16 bp, Homo sapiens
ccgggctggagaaaga

SEQ ID NO: 1756134 - DNA, 21 bp, Homo sapiens
ccgggctgtagatcaggtttg

SEQ ID NO: 1756135 - DNA, 17 bp, Homo sapiens
ccggggaccgggacccg

SEQ ID NO: 1756136 - DNA, 11 bp, Homo sapiens
ccggggctgag

SEQ ID NO: 1756137 - DNA, 16 bp, Homo sapiens
ccggggctggcaagca

SEQ ID NO: 1756138 - DNA, 14 bp, Homo sapiens
ccgggggacagagg

SEQ ID NO: 1756139 - DNA, 12 bp, Homo sapiens
ccgggggagagg

SEQ ID NO: 1756140 - DNA, 15 bp, Homo sapiens
ccgggggaggaaggg

SEQ ID NO: 1756141 - DNA, 10 bp, Homo sapiens
ccggggggaa

SEQ ID NO: 1756142 - DNA, 14 bp, Homo sapiens
ccggggtctcctgg

SEQ ID NO: 1756143 - DNA, 17 bp, Homo sapiens
ccggggtctcctggacc

SEQ ID NO: 1756144 - DNA, 13 bp, Homo sapiens
ccggggtctgtgc

SEQ ID NO: 1756145 - DNA, 15 bp, Homo sapiens
ccggggtctgtgctg

SEQ ID NO: 1756146 - DNA, 21 bp, Homo sapiens
ccggggtggagcatgggcctg

SEQ ID NO: 1756147 - DNA, 14 bp, Homo sapiens
ccggggtggggtgc

SEQ ID NO: 1756148 - DNA, 16 bp, Homo sapiens
ccggggtggtggacag

SEQ ID NO: 1756149 - DNA, 21 bp, Homo sapiens
ccggggtgtaacttcctgctg

SEQ ID NO: 1756150 - DNA, 22 bp, Homo sapiens
ccggggtgtaacttcctgctgc

SEQ ID NO: 1756151 - DNA, 13 bp, Homo sapiens
ccgggtccccagc

SEQ ID NO: 1756152 - DNA, 17 bp, Homo sapiens
ccgggtctcgcagcctg

SEQ ID NO: 1756153 - DNA, 16 bp, Homo sapiens
ccgggtcttgattcag

SEQ ID NO: 1756154 - DNA, 16 bp, Homo sapiens
ccgggtgggcctggcc

SEQ ID NO: 1756155 - DNA, 17 bp, Homo sapiens
ccgggtgggcctggcct

SEQ ID NO: 1756156 - DNA, 20 bp, Homo sapiens
ccgggtgggcctggcctgag

SEQ ID NO: 1756157 - DNA, 23 bp, Homo sapiens
ccgggttcgcaccattctcctgc

SEQ ID NO: 1756158 - DNA, 18 bp, Homo sapiens
ccggtaactgtcctgtcc

SEQ ID NO: 1756159 - DNA, 19 bp, Homo sapiens
ccggtcacctagcaagctg

SEQ ID NO: 1756160 - DNA, 21 bp, Homo sapiens
ccggtccagctggcctggaca

SEQ ID NO: 1756161 - DNA, 20 bp, Homo sapiens
ccggtcccttgagacctcag

SEQ ID NO: 1756162 - DNA, 20 bp, Homo sapiens
ccggtcgggcagccagcaga

SEQ ID NO: 1756163 - DNA, 16 bp, Homo sapiens
ccggtgcacaggcctc

SEQ ID NO: 1756164 - DNA, 22 bp, Homo sapiens
ccggtgcacaggcctctgcctg

SEQ ID NO: 1756165 - DNA, 23 bp, Homo sapiens
ccggtgcacaggcctctgcctgc

SEQ ID NO: 1756166 - DNA, 11 bp, Homo sapiens
ccggtgcagct

SEQ ID NO: 1756167 - DNA, 14 bp, Homo sapiens
ccggtgctgcagga

SEQ ID NO: 1756168 - DNA, 21 bp, Homo sapiens
ccggtgctgggttcccactcc

SEQ ID NO: 1756169 - DNA, 20 bp, Homo sapiens
ccggtggcggccccagcacc

SEQ ID NO: 1756170 - DNA, 18 bp, Homo sapiens
ccggtgggaccctgtccg

SEQ ID NO: 1756171 - DNA, 17 bp, Homo sapiens
ccggtgtgcctgcagcc

SEQ ID NO: 1756172 - DNA, 13 bp, Homo sapiens
ccggtgttctaag

SEQ ID NO: 1756173 - DNA, 19 bp, Homo sapiens
ccggttaaattccatatgc

SEQ ID NO: 1756174 - DNA, 17 bp, Homo sapiens
ccggtttgggctgtctt

SEQ ID NO: 1756175 - DNA, 14 bp, Homo sapiens
ccgtaatcccagct

SEQ ID NO: 1756176 - DNA, 15 bp, Homo sapiens
ccgtaattctttctg

SEQ ID NO: 1756177 - DNA, 18 bp, Homo sapiens
ccgtaattctttctgtct

SEQ ID NO: 1756178 - DNA, 19 bp, Homo sapiens
ccgtaattctttctgtctc

SEQ ID NO: 1756179 - DNA, 22 bp, Homo sapiens
ccgtaattctttctgtctccct

SEQ ID NO: 1756180 - DNA, 23 bp, Homo sapiens
ccgtaattctttctgtctccctt

SEQ ID NO: 1756181 - DNA, 14 bp, Homo sapiens
ccgtaatttaactt

SEQ ID NO: 1756182 - DNA, 14 bp, Homo sapiens
ccgtaccccaccct

SEQ ID NO: 1756183 - DNA, 15 bp, Homo sapiens
ccgtaccccaccctc

SEQ ID NO: 1756184 - DNA, 17 bp, Homo sapiens
ccgtaccccaccctcag

SEQ ID NO: 1756185 - DNA, 23 bp, Homo sapiens
ccgtactaggttggacagccccc

SEQ ID NO: 1756186 - DNA, 16 bp, Homo sapiens
ccgtagactaggaagt

SEQ ID NO: 1756187 - DNA, 21 bp, Homo sapiens
ccgtaggcagcctctctgcta

SEQ ID NO: 1756188 - DNA, 15 bp, Homo sapiens
ccgtagggtctttct

SEQ ID NO: 1756189 - DNA, 20 bp, Homo sapiens
ccgtagggtctttcttggga

SEQ ID NO: 1756190 - DNA, 22 bp, Homo sapiens
ccgtagttccctgaaaacccag

SEQ ID NO: 1756191 - DNA, 16 bp, Homo sapiens
ccgtatcacagtgttt

SEQ ID NO: 1756192 - DNA, 14 bp, Homo sapiens
ccgtatttaaagtt

SEQ ID NO: 1756193 - DNA, 21 bp, Homo sapiens
ccgtcaccacgactggccagg

SEQ ID NO: 1756194 - DNA, 23 bp, Homo sapiens
ccgtcagggagaggtcaccagct

SEQ ID NO: 1756195 - DNA, 12 bp, Homo sapiens
ccgtcagggccc

SEQ ID NO: 1756196 - DNA, 14 bp, Homo sapiens
ccgtcattgctgct

SEQ ID NO: 1756197 - DNA, 16 bp, Homo sapiens
ccgtccacccaggctg

SEQ ID NO: 1756198 - DNA, 23 bp, Homo sapiens
ccgtccacccaggctgcactgca

SEQ ID NO: 1756199 - DNA, 23 bp, Homo sapiens
ccgtccatatcagaactgtgcca

SEQ ID NO: 1756200 - DNA, 23 bp, Homo sapiens
ccgtccatggcaccagccccctg

SEQ ID NO: 1756201 - DNA, 13 bp, Homo sapiens
ccgtcccaggcca

SEQ ID NO: 1756202 - DNA, 14 bp, Homo sapiens
ccgtcccaggccac

SEQ ID NO: 1756203 - DNA, 17 bp, Homo sapiens
ccgtcccgcgttcaaga

SEQ ID NO: 1756204 - DNA, 21 bp, Homo sapiens
ccgtccctttttctccacact

SEQ ID NO: 1756205 - DNA, 14 bp, Homo sapiens
ccgtccgccctgct

SEQ ID NO: 1756206 - DNA, 16 bp, Homo sapiens
ccgtcctcccgggccc

SEQ ID NO: 1756207 - DNA, 16 bp, Homo sapiens
ccgtcctgcctgtggc

SEQ ID NO: 1756208 - DNA, 16 bp, Homo sapiens
ccgtcgcgctggacag

SEQ ID NO: 1756209 - DNA, 13 bp, Homo sapiens
ccgtcggagctgc

SEQ ID NO: 1756210 - DNA, 16 bp, Homo sapiens
ccgtcggagctgcctg

SEQ ID NO: 1756211 - DNA, 18 bp, Homo sapiens
ccgtcggagctgcctgca

SEQ ID NO: 1756212 - DNA, 18 bp, Homo sapiens
ccgtctaggattgggcct

SEQ ID NO: 1756213 - DNA, 19 bp, Homo sapiens
ccgtctaggattgggcctc

SEQ ID NO: 1756214 - DNA, 17 bp, Homo sapiens
ccgtctgactccagagt

SEQ ID NO: 1756215 - DNA, 19 bp, Homo sapiens
ccgtctgactccagagtct

SEQ ID NO: 1756216 - DNA, 18 bp, Homo sapiens
ccgtctggcccaccaggg

SEQ ID NO: 1756217 - DNA, 20 bp, Homo sapiens
ccgtctgtctcgatgcctga

SEQ ID NO: 1756218 - DNA, 21 bp, Homo sapiens
ccgtcttcaatctctgttctg

SEQ ID NO: 1756219 - DNA, 15 bp, Homo sapiens
ccgtcttcacactgc

SEQ ID NO: 1756220 - DNA, 15 bp, Homo sapiens
ccgtcttcagcctag

SEQ ID NO: 1756221 - DNA, 18 bp, Homo sapiens
ccgtgaaaacggagctga

SEQ ID NO: 1756222 - DNA, 13 bp, Homo sapiens
ccgtgacagtggc

SEQ ID NO: 1756223 - DNA, 10 bp, Homo sapiens
ccgtgaccta

SEQ ID NO: 1756224 - DNA, 14 bp, Homo sapiens
ccgtgagcaggctt

SEQ ID NO: 1756225 - DNA, 21 bp, Homo sapiens
cctaggatgctgcagcagagt

SEQ ID NO: 1756226 - DNA, 11 bp, Homo sapiens
cctaggattct

SEQ ID NO: 1756227 - DNA, 19 bp, Homo sapiens
cctaggcagcctgcaggga

SEQ ID NO: 1756228 - DNA, 23 bp, Homo sapiens
cctaggccaaatgcacaagctca

SEQ ID NO: 1756229 - DNA, 15 bp, Homo sapiens
cctaggccactcctc

SEQ ID NO: 1756230 - DNA, 19 bp, Homo sapiens
cctaggccactcctccaaa

SEQ ID NO: 1756231 - DNA, 18 bp, Homo sapiens
cctaggctccaccccatc

SEQ ID NO: 1756232 - DNA, 20 bp, Homo sapiens
cctagggatgttctggccct

SEQ ID NO: 1756233 - DNA, 17 bp, Homo sapiens
cctaggggacacttccc

SEQ ID NO: 1756234 - DNA, 18 bp, Homo sapiens
cctaggggacacttccct

SEQ ID NO: 1756235 - DNA, 16 bp, Homo sapiens
cctaggggccagggct

SEQ ID NO: 1756236 - DNA, 22 bp, Homo sapiens
cctaggggtgcgctcacctgca

SEQ ID NO: 1756237 - DNA, 13 bp, Homo sapiens
cctaggtctattt

SEQ ID NO: 1756238 - DNA, 14 bp, Homo sapiens
cctaggtgcccagg

SEQ ID NO: 1756239 - DNA, 18 bp, Homo sapiens
cctagtactctctgctct

SEQ ID NO: 1756240 - DNA, 20 bp, Homo sapiens
cctagtagctgggatgacag

SEQ ID NO: 1756241 - DNA, 23 bp, Homo sapiens
cctagtcccccaaagggcctcct

SEQ ID NO: 1756242 - DNA, 16 bp, Homo sapiens
cctagtcccctttcct

SEQ ID NO: 1756243 - DNA, 14 bp, Homo sapiens
cctagtcccttccc

SEQ ID NO: 1756244 - DNA, 16 bp, Homo sapiens
cctagtcccttcccct

SEQ ID NO: 1756245 - DNA, 17 bp, Homo sapiens
cctagtctgtaactctt

SEQ ID NO: 1756246 - DNA, 12 bp, Homo sapiens
cctagtgcccca

SEQ ID NO: 1756247 - DNA, 15 bp, Homo sapiens
cctagtgccccagac

SEQ ID NO: 1756248 - DNA, 16 bp, Homo sapiens
cctagtgccccagact

SEQ ID NO: 1756249 - DNA, 21 bp, Homo sapiens
cctagtgccccagactgagct

SEQ ID NO: 1756250 - DNA, 22 bp, Homo sapiens
cctagtgccccagactgagctc

SEQ ID NO: 1756251 - DNA, 20 bp, Homo sapiens
cctagtgctattctgtgttg

SEQ ID NO: 1756252 - DNA, 15 bp, Homo sapiens
cctagttaaagaaag

SEQ ID NO: 1756253 - DNA, 18 bp, Homo sapiens
cctagttagcatccaggc

SEQ ID NO: 1756254 - DNA, 14 bp, Homo sapiens
cctagtttccctga

SEQ ID NO: 1756255 - DNA, 13 bp, Homo sapiens
cctagttttccat

SEQ ID NO: 1756256 - DNA, 16 bp, Homo sapiens
cctagttttctcctcc

SEQ ID NO: 1756257 - DNA, 17 bp, Homo sapiens
cctataaaattaaatgc

SEQ ID NO: 1756258 - DNA, 22 bp, Homo sapiens
cctataaagggcccacacctgg

SEQ ID NO: 1756259 - DNA, 16 bp, Homo sapiens
cctataagaagcctta

SEQ ID NO: 1756260 - DNA, 22 bp, Homo sapiens
cctataaggagagttcaagcct

SEQ ID NO: 1756261 - DNA, 21 bp, Homo sapiens
cctataatacaaatacacaat

SEQ ID NO: 1756262 - DNA, 12 bp, Homo sapiens
cctatagactgt

SEQ ID NO: 1756263 - DNA, 15 bp, Homo sapiens
cctatagagaggggg

SEQ ID NO: 1756264 - DNA, 18 bp, Homo sapiens
cctatagctacatgttct

SEQ ID NO: 1756265 - DNA, 14 bp, Homo sapiens
cctatagtttgtca

SEQ ID NO: 1756266 - DNA, 15 bp, Homo sapiens
cctatatatttctat

SEQ ID NO: 1756267 - DNA, 16 bp, Homo sapiens
cctatatcctgtgact

SEQ ID NO: 1756268 - DNA, 14 bp, Homo sapiens
cctatatctgagag

SEQ ID NO: 1756269 - DNA, 14 bp, Homo sapiens
cctatattttcctg

SEQ ID NO: 1756270 - DNA, 16 bp, Homo sapiens
cctatccacccagccc

SEQ ID NO: 1756271 - DNA, 17 bp, Homo sapiens
cctatccacccagccca

SEQ ID NO: 1756272 - DNA, 13 bp, Homo sapiens
cctatcccacctc

SEQ ID NO: 1756273 - DNA, 17 bp, Homo sapiens
cctatccccaggccagg

SEQ ID NO: 1756274 - DNA, 17 bp, Homo sapiens
cctatccgctgccagcc

SEQ ID NO: 1756275 - DNA, 17 bp, Homo sapiens
cctatcctaattgtcca

SEQ ID NO: 1756276 - DNA, 19 bp, Homo sapiens
cctatcctggtttttgtag

SEQ ID NO: 1756277 - DNA, 18 bp, Homo sapiens
cctatctaaccctcccat

SEQ ID NO: 1756278 - DNA, 15 bp, Homo sapiens
cctatctccctggct

SEQ ID NO: 1756279 - DNA, 16 bp, Homo sapiens
cctatctccctggctc

SEQ ID NO: 1756280 - DNA, 13 bp, Homo sapiens
cctatctcctgac

SEQ ID NO: 1756281 - DNA, 15 bp, Homo sapiens
cctatctcctgacag

SEQ ID NO: 1756282 - DNA, 16 bp, Homo sapiens
cctatctcctgacaga

SEQ ID NO: 1756283 - DNA, 20 bp, Homo sapiens
cctatcttccttcctctctc

SEQ ID NO: 1756284 - DNA, 15 bp, Homo sapiens
cctatgccagtgctc

SEQ ID NO: 1756285 - DNA, 12 bp, Homo sapiens
cctatgctgtgc

SEQ ID NO: 1756286 - DNA, 21 bp, Homo sapiens
cctatggaagtggttctatgt

SEQ ID NO: 1756287 - DNA, 23 bp, Homo sapiens
cctatggcagaaaaaatgtctgt

SEQ ID NO: 1756288 - DNA, 19 bp, Homo sapiens
cctatgggcctgccgggct

SEQ ID NO: 1756289 - DNA, 14 bp, Homo sapiens
cctatgtagtgtct

SEQ ID NO: 1756290 - DNA, 17 bp, Homo sapiens
cctattaaaacacagct

SEQ ID NO: 1756291 - DNA, 15 bp, Homo sapiens
cctattcaccctcca

SEQ ID NO: 1756292 - DNA, 17 bp, Homo sapiens
cctattcaccctccact

SEQ ID NO: 1756293 - DNA, 16 bp, Homo sapiens
cctattctataaaact

SEQ ID NO: 1756294 - DNA, 17 bp, Homo sapiens
cctattctgtgttttat

SEQ ID NO: 1756295 - DNA, 13 bp, Homo sapiens
cctattgggagag

SEQ ID NO: 1756296 - DNA, 17 bp, Homo sapiens
cctatttattgactttg

SEQ ID NO: 1756297 - DNA, 19 bp, Homo sapiens
cctatttattgactttgac

SEQ ID NO: 1756298 - DNA, 11 bp, Homo sapiens
cctatttcaga

SEQ ID NO: 1756299 - DNA, 19 bp, Homo sapiens
cctatttcagtgttacctg

SEQ ID NO: 1756300 - DNA, 16 bp, Homo sapiens
cctatttccagaaata

SEQ ID NO: 1756301 - DNA, 11 bp, Homo sapiens
cctatttctat

SEQ ID NO: 1756302 - DNA, 17 bp, Homo sapiens
cctatttctatgtcatt

SEQ ID NO: 1756303 - DNA, 22 bp, Homo sapiens
cctatttctatgtcatttttaa

SEQ ID NO: 1756304 - DNA, 12 bp, Homo sapiens
cctatttgtgtg

SEQ ID NO: 1756305 - DNA, 23 bp, Homo sapiens
cctatttttttagattgagaaat

SEQ ID NO: 1756306 - DNA, 17 bp, Homo sapiens
cctcaaaaaaagccttt

SEQ ID NO: 1756307 - DNA, 16 bp, Homo sapiens
cctcaaacctcctctt

SEQ ID NO: 1756308 - DNA, 18 bp, Homo sapiens
cctcaaacctcctcttct

SEQ ID NO: 1756309 - DNA, 14 bp, Homo sapiens
cctcaaagaaagtg

SEQ ID NO: 1756310 - DNA, 16 bp, Homo sapiens
cctcaaattttttgac

SEQ ID NO: 1756311 - DNA, 16 bp, Homo sapiens
cctcaacccacatggg

SEQ ID NO: 1756312 - DNA, 12 bp, Homo sapiens
cctcaacctctt

SEQ ID NO: 1756313 - DNA, 17 bp, Homo sapiens
cctcaacctcttctggc

SEQ ID NO: 1756314 - DNA, 20 bp, Homo sapiens
cctcaacctcttctggctca

SEQ ID NO: 1756315 - DNA, 13 bp, Homo sapiens
cctcaactgaagg

SEQ ID NO: 1756316 - DNA, 15 bp, Homo sapiens
cctcaactgcctact

SEQ ID NO: 1756317 - DNA, 17 bp, Homo sapiens
cctcaagcaataattgt

SEQ ID NO: 1756318 - DNA, 16 bp, Homo sapiens
cctcaagccaatcccc

SEQ ID NO: 1756319 - DNA, 18 bp, Homo sapiens
cctcaagccaatcccctc

SEQ ID NO: 1756320 - DNA, 18 bp, Homo sapiens
cctcaagccccatttcct

SEQ ID NO: 1756321 - DNA, 22 bp, Homo sapiens
cctcaaggacaaagtctccagc

SEQ ID NO: 1756322 - DNA, 22 bp, Homo sapiens
cctcaaggttttaggttctaaa

SEQ ID NO: 1756323 - DNA, 17 bp, Homo sapiens
cctcaagtgtcctgaaa

SEQ ID NO: 1756324 - DNA, 18 bp, Homo sapiens
cctcaatagatctccagc

SEQ ID NO: 1756325 - DNA, 19 bp, Homo sapiens
cctcaatgccctgccatta

SEQ ID NO: 1756326 - DNA, 20 bp, Homo sapiens
cctcaatgtgaatcagaccc

SEQ ID NO: 1756327 - DNA, 20 bp, Homo sapiens
cctcacacccctgtcccacc

SEQ ID NO: 1756328 - DNA, 11 bp, Homo sapiens
cctcacagcta

SEQ ID NO: 1756329 - DNA, 15 bp, Homo sapiens
cctcacatctttcac

SEQ ID NO: 1756330 - DNA, 17 bp, Homo sapiens
cctcaccaaggaccttg

SEQ ID NO: 1756331 - DNA, 13 bp, Homo sapiens
cctcaccatccag

SEQ ID NO: 1756332 - DNA, 15 bp, Homo sapiens
cctcaccatccagtg

SEQ ID NO: 1756333 - DNA, 16 bp, Homo sapiens
cctcaccatccagtgg

SEQ ID NO: 1756334 - DNA, 17 bp, Homo sapiens
cctcacccccaggtgtt

SEQ ID NO: 1756335 - DNA, 21 bp, Homo sapiens
cctcacccccaggtgttgcca

SEQ ID NO: 1756336 - DNA, 22 bp, Homo sapiens
cctcacccctcgccacctttca

SEQ ID NO: 1756337 - DNA, 21 bp, Homo sapiens
cctcacccctggttctcatct

SEQ ID NO: 1756338 - DNA, 15 bp, Homo sapiens
cctcacccctgtagg

SEQ ID NO: 1756339 - DNA, 19 bp, Homo sapiens
cctcacctcatgcccaccc

SEQ ID NO: 1756340 - DNA, 13 bp, Homo sapiens
cctcccacccctg

SEQ ID NO: 1756341 - DNA, 19 bp, Homo sapiens
cctcccaccttggcctccc

SEQ ID NO: 1756342 - DNA, 14 bp, Homo sapiens
cctcccactcctgc

SEQ ID NO: 1756343 - DNA, 16 bp, Homo sapiens
cctcccactcctgctg

SEQ ID NO: 1756344 - DNA, 18 bp, Homo sapiens
cctcccactcctgctgca

SEQ ID NO: 1756345 - DNA, 20 bp, Homo sapiens
cctcccagaggagccaccag

SEQ ID NO: 1756346 - DNA, 21 bp, Homo sapiens
cctcccagaggagccaccagt

SEQ ID NO: 1756347 - DNA, 14 bp, Homo sapiens
cctcccaggcgccc

SEQ ID NO: 1756348 - DNA, 20 bp, Homo sapiens
cctcccaggggagccagctg

SEQ ID NO: 1756349 - DNA, 23 bp, Homo sapiens
cctcccaggggagccagctgctt

SEQ ID NO: 1756350 - DNA, 21 bp, Homo sapiens
cctcccaggtcgggcagtgga

SEQ ID NO: 1756351 - DNA, 19 bp, Homo sapiens
cctcccagtgccttctggg

SEQ ID NO: 1756352 - DNA, 15 bp, Homo sapiens
cctcccatctccttc

SEQ ID NO: 1756353 - DNA, 18 bp, Homo sapiens
cctcccatgttcaagcga

SEQ ID NO: 1756354 - DNA, 13 bp, Homo sapiens
cctccccaactcc

SEQ ID NO: 1756355 - DNA, 13 bp, Homo sapiens
cctccccaagact

SEQ ID NO: 1756356 - DNA, 15 bp, Homo sapiens
cctccccacactcca

SEQ ID NO: 1756357 - DNA, 19 bp, Homo sapiens
cctccccacactccactct

SEQ ID NO: 1756358 - DNA, 22 bp, Homo sapiens
cctccccagctcttctcttcct

SEQ ID NO: 1756359 - DNA, 12 bp, Homo sapiens
cctccccagggg

SEQ ID NO: 1756360 - DNA, 19 bp, Homo sapiens
cctccccagtgcaaatgca

SEQ ID NO: 1756361 - DNA, 21 bp, Homo sapiens
cctccccattcagacacttca

SEQ ID NO: 1756362 - DNA, 16 bp, Homo sapiens
cctcccccaaaccctg

SEQ ID NO: 1756363 - DNA, 17 bp, Homo sapiens
cctcccccaaaccctgc

SEQ ID NO: 1756364 - DNA, 18 bp, Homo sapiens
cctcccccaaaccctgct

SEQ ID NO: 1756365 - DNA, 22 bp, Homo sapiens
cctcccccaacccccaccccac

SEQ ID NO: 1756366 - DNA, 16 bp, Homo sapiens
cctcccccactcctct

SEQ ID NO: 1756367 - DNA, 13 bp, Homo sapiens
cctcccccagcag

SEQ ID NO: 1756368 - DNA, 16 bp, Homo sapiens
cctcccccatgggctg

SEQ ID NO: 1756369 - DNA, 14 bp, Homo sapiens
cctcccccattccc

SEQ ID NO: 1756370 - DNA, 15 bp, Homo sapiens
cctccccccactgca

SEQ ID NO: 1756371 - DNA, 16 bp, Homo sapiens
cctccccccactgcag

SEQ ID NO: 1756372 - DNA, 18 bp, Homo sapiens
cctccccccactgcaggc

SEQ ID NO: 1756373 - DNA, 14 bp, Homo sapiens
cctccccccagact

SEQ ID NO: 1756374 - DNA, 16 bp, Homo sapiens
cctcccccccatgcac

SEQ ID NO: 1756375 - DNA, 19 bp, Homo sapiens
cctcccccccatgcactgt

SEQ ID NO: 1756376 - DNA, 19 bp, Homo sapiens
cctcccccggctgggcctc

SEQ ID NO: 1756377 - DNA, 15 bp, Homo sapiens
cctccccctcctgct

SEQ ID NO: 1756378 - DNA, 15 bp, Homo sapiens
cctccccctgccagt

SEQ ID NO: 1756379 - DNA, 17 bp, Homo sapiens
cctccccctgccagtgc

SEQ ID NO: 1756380 - DNA, 20 bp, Homo sapiens
cctccccctgccagtgcctt

SEQ ID NO: 1756381 - DNA, 15 bp, Homo sapiens
cctccccgcccctgt

SEQ ID NO: 1756382 - DNA, 23 bp, Homo sapiens
cctccccgcccctgtggccctgg

SEQ ID NO: 1756383 - DNA, 16 bp, Homo sapiens
cctccccgcccttttt

SEQ ID NO: 1756384 - DNA, 18 bp, Homo sapiens
cctccccgctctccctgt

SEQ ID NO: 1756385 - DNA, 17 bp, Homo sapiens
cctccccgtctcattcc

SEQ ID NO: 1756386 - DNA, 13 bp, Homo sapiens
cctcccctcaagg

SEQ ID NO: 1756387 - DNA, 13 bp, Homo sapiens
cctcccctcccac

SEQ ID NO: 1756388 - DNA, 15 bp, Homo sapiens
cctcccctccgcagc

SEQ ID NO: 1756389 - DNA, 15 bp, Homo sapiens
cctcccctctcagaa

SEQ ID NO: 1756390 - DNA, 21 bp, Homo sapiens
cctcccctctcttgcacccgc

SEQ ID NO: 1756391 - DNA, 12 bp, Homo sapiens
cctcccctgcca

SEQ ID NO: 1756392 - DNA, 14 bp, Homo sapiens
cctcccctgccacc

SEQ ID NO: 1756393 - DNA, 14 bp, Homo sapiens
cctcccctgccatt

SEQ ID NO: 1756394 - DNA, 13 bp, Homo sapiens
cctccccttgggc

SEQ ID NO: 1756395 - DNA, 14 bp, Homo sapiens
cctcccgccccgcc

SEQ ID NO: 1756396 - DNA, 13 bp, Homo sapiens
cctcccggggcct

SEQ ID NO: 1756397 - DNA, 23 bp, Homo sapiens
cctcccgtccttcccctcttctt

SEQ ID NO: 1756398 - DNA, 22 bp, Homo sapiens
cctccctcagctctctgggacc

SEQ ID NO: 1756399 - DNA, 16 bp, Homo sapiens
cctccctcctgcaggc

SEQ ID NO: 1756400 - DNA, 18 bp, Homo sapiens
cctccctcctgcaggctg

SEQ ID NO: 1756401 - DNA, 19 bp, Homo sapiens
cctccctcctgcaggctgg

SEQ ID NO: 1756402 - DNA, 14 bp, Homo sapiens
cctccctcctgggg

SEQ ID NO: 1756403 - DNA, 13 bp, Homo sapiens
cctccctctaatt

SEQ ID NO: 1756404 - DNA, 22 bp, Homo sapiens
cctccctctcccaggcccgaga

SEQ ID NO: 1756405 - DNA, 22 bp, Homo sapiens
cctccctctctcatgagaagcc

SEQ ID NO: 1756406 - DNA, 22 bp, Homo sapiens
cctccctctctcttctgctcca

SEQ ID NO: 1756407 - DNA, 17 bp, Homo sapiens
cctccctctgccccaag

SEQ ID NO: 1756408 - DNA, 18 bp, Homo sapiens
cctccctctgccccaagc

SEQ ID NO: 1756409 - DNA, 14 bp, Homo sapiens
cctccctgcagact

SEQ ID NO: 1756410 - DNA, 15 bp, Homo sapiens
cctccctgcagactc

SEQ ID NO: 1756411 - DNA, 13 bp, Homo sapiens
cctccctgccccc

SEQ ID NO: 1756412 - DNA, 21 bp, Homo sapiens
cctccctgcccctcccttcaa

SEQ ID NO: 1756413 - DNA, 16 bp, Homo sapiens
cctccctgcctcagtg

SEQ ID NO: 1756414 - DNA, 21 bp, Homo sapiens
cctccctgcttgcacacttcc

SEQ ID NO: 1756415 - DNA, 14 bp, Homo sapiens
cctccctggcactg

SEQ ID NO: 1756416 - DNA, 21 bp, Homo sapiens
cctccctggctgccctggccc

SEQ ID NO: 1756417 - DNA, 16 bp, Homo sapiens
cctccctggctgtgag

SEQ ID NO: 1756418 - DNA, 10 bp, Homo sapiens
cctccctggg

SEQ ID NO: 1756419 - DNA, 21 bp, Homo sapiens
cctccctggggaccaggagct

SEQ ID NO: 1756420 - DNA, 21 bp, Homo sapiens
cctccctgggggccccaggat

SEQ ID NO: 1756421 - DNA, 12 bp, Homo sapiens
cctccctgtcaa

SEQ ID NO: 1756422 - DNA, 19 bp, Homo sapiens
cctccctgtcactcagctg

SEQ ID NO: 1756423 - DNA, 11 bp, Homo sapiens
cctccctgtcc

SEQ ID NO: 1756424 - DNA, 14 bp, Homo sapiens
cctccctgtcctcc

SEQ ID NO: 1756425 - DNA, 16 bp, Homo sapiens
cctccctgtcctcctc

SEQ ID NO: 1756426 - DNA, 20 bp, Homo sapiens
cctccctgttccccagagaa

SEQ ID NO: 1756427 - DNA, 17 bp, Homo sapiens
cctcccttacagagcat

SEQ ID NO: 1756428 - DNA, 14 bp, Homo sapiens
cctcccttcccagg

SEQ ID NO: 1756429 - DNA, 21 bp, Homo sapiens
cctcccttccctccctgaggc

SEQ ID NO: 1756430 - DNA, 23 bp, Homo sapiens
cctcccttggaaacctgccctgc

SEQ ID NO: 1756431 - DNA, 13 bp, Homo sapiens
cctccctttctcc

SEQ ID NO: 1756432 - DNA, 18 bp, Homo sapiens
cctccgaccctcatggcc

SEQ ID NO: 1756433 - DNA, 13 bp, Homo sapiens
cctccgaggctcc

SEQ ID NO: 1756434 - DNA, 16 bp, Homo sapiens
cctccgagggacgcgg

SEQ ID NO: 1756435 - DNA, 14 bp, Homo sapiens
cctccgatgctgag

SEQ ID NO: 1756436 - DNA, 23 bp, Homo sapiens
cctccgatgctgaggccacccac

SEQ ID NO: 1756437 - DNA, 15 bp, Homo sapiens
cctccgccctgccac

SEQ ID NO: 1756438 - DNA, 16 bp, Homo sapiens
cctccgccgtgccggc

SEQ ID NO: 1756439 - DNA, 13 bp, Homo sapiens
cctccgcctactg

SEQ ID NO: 1756440 - DNA, 14 bp, Homo sapiens
cctccgcctcccag

SEQ ID NO: 1756441 - DNA, 16 bp, Homo sapiens
cctccggactggtgcc

SEQ ID NO: 1756442 - DNA, 18 bp, Homo sapiens
cctccggcgggtgacagc

SEQ ID NO: 1756443 - DNA, 21 bp, Homo sapiens
cctccggcgtcttgcccagca

SEQ ID NO: 1756444 - DNA, 14 bp, Homo sapiens
cctccgtagggtct

SEQ ID NO: 1756445 - DNA, 18 bp, Homo sapiens
cctccgtagggtctttct

SEQ ID NO: 1756446 - DNA, 22 bp, Homo sapiens
cctccgtagggtctttcttggg

SEQ ID NO: 1756447 - DNA, 18 bp, Homo sapiens
cctccgtccaggagcctg

SEQ ID NO: 1756448 - DNA, 13 bp, Homo sapiens
cctcctaaagctg

SEQ ID NO: 1756449 - DNA, 22 bp, Homo sapiens
cctcctaaagctgaatcccggc

SEQ ID NO: 1756450 - DNA, 18 bp, Homo sapiens
cctcctagacccaggtgg

SEQ ID NO: 1756451 - DNA, 23 bp, Homo sapiens
cctcctagaggtgggcagctggg

SEQ ID NO: 1756452 - DNA, 19 bp, Homo sapiens
cctcctaggaaaccagctc

SEQ ID NO: 1756453 - DNA, 20 bp, Homo sapiens
cctcctagggaaaagttcat

SEQ ID NO: 1756454 - DNA, 22 bp, Homo sapiens
cctcctatctccctggctcact

SEQ ID NO: 1756455 - DNA, 19 bp, Homo sapiens
cctctgcccttcctgcagg

SEQ ID NO: 1756456 - DNA, 22 bp, Homo sapiens
cctctgccggtcccccatgcca

SEQ ID NO: 1756457 - DNA, 11 bp, Homo sapiens
cctctgcctca

SEQ ID NO: 1756458 - DNA, 21 bp, Homo sapiens
cctctgcctgaaccttccatc

SEQ ID NO: 1756459 - DNA, 11 bp, Homo sapiens
cctctgcctgc

SEQ ID NO: 1756460 - DNA, 12 bp, Homo sapiens
cctctgcctgca

SEQ ID NO: 1756461 - DNA, 14 bp, Homo sapiens
cctctgcctgcact

SEQ ID NO: 1756462 - DNA, 18 bp, Homo sapiens
cctctgcctgcactccct

SEQ ID NO: 1756463 - DNA, 12 bp, Homo sapiens
cctctgcctgct

SEQ ID NO: 1756464 - DNA, 17 bp, Homo sapiens
cctctgccttcaggctt

SEQ ID NO: 1756465 - DNA, 15 bp, Homo sapiens
cctctgctcaccgcc

SEQ ID NO: 1756466 - DNA, 18 bp, Homo sapiens
cctctgctcaccgcccat

SEQ ID NO: 1756467 - DNA, 21 bp, Homo sapiens
cctctgctcaccgcccatcag

SEQ ID NO: 1756468 - DNA, 13 bp, Homo sapiens
cctctgctccagc

SEQ ID NO: 1756469 - DNA, 23 bp, Homo sapiens
cctctgctccagcaactgccctt

SEQ ID NO: 1756470 - DNA, 14 bp, Homo sapiens
cctctgctccccag

SEQ ID NO: 1756471 - DNA, 14 bp, Homo sapiens
cctctgctctgcct

SEQ ID NO: 1756472 - DNA, 15 bp, Homo sapiens
cctctgctctgcctg

SEQ ID NO: 1756473 - DNA, 14 bp, Homo sapiens
cctctgctctgtcc

SEQ ID NO: 1756474 - DNA, 20 bp, Homo sapiens
cctctgctgaatgcagggaa

SEQ ID NO: 1756475 - DNA, 14 bp, Homo sapiens
cctctgctgccatg

SEQ ID NO: 1756476 - DNA, 15 bp, Homo sapiens
cctctgctgccatgg

SEQ ID NO: 1756477 - DNA, 16 bp, Homo sapiens
cctctgctgctgcccg

SEQ ID NO: 1756478 - DNA, 17 bp, Homo sapiens
cctctgctgctgcccgg

SEQ ID NO: 1756479 - DNA, 14 bp, Homo sapiens
cctctgctgctgtc

SEQ ID NO: 1756480 - DNA, 15 bp, Homo sapiens
cctctgctgtcctgc

SEQ ID NO: 1756481 - DNA, 22 bp, Homo sapiens
cctctggacggcaggctcactg

SEQ ID NO: 1756482 - DNA, 17 bp, Homo sapiens
cctctggagccctaacc

SEQ ID NO: 1756483 - DNA, 22 bp, Homo sapiens
cctctggaggggtgtggctcct

SEQ ID NO: 1756484 - DNA, 15 bp, Homo sapiens
cctctggccctgcct

SEQ ID NO: 1756485 - DNA, 17 bp, Homo sapiens
cctctggccctgccttc

SEQ ID NO: 1756486 - DNA, 13 bp, Homo sapiens
cctctggctagag

SEQ ID NO: 1756487 - DNA, 23 bp, Homo sapiens
cctctggctagaggccagcccca

SEQ ID NO: 1756488 - DNA, 12 bp, Homo sapiens
cctctggcttcc

SEQ ID NO: 1756489 - DNA, 17 bp, Homo sapiens
cctctgggcagtgtggc

SEQ ID NO: 1756490 - DNA, 17 bp, Homo sapiens
cctctggtcgctcctgc

SEQ ID NO: 1756491 - DNA, 20 bp, Homo sapiens
cctctggtctactctagaag

SEQ ID NO: 1756492 - DNA, 19 bp, Homo sapiens
cctctggtgtgtggtgagg

SEQ ID NO: 1756493 - DNA, 23 bp, Homo sapiens
cctctggtgtgtggtgaggggct

SEQ ID NO: 1756494 - DNA, 15 bp, Homo sapiens
cctctggttcctttc

SEQ ID NO: 1756495 - DNA, 16 bp, Homo sapiens
cctctggttcctttca

SEQ ID NO: 1756496 - DNA, 22 bp, Homo sapiens
cctctggttcctttcatctctc

SEQ ID NO: 1756497 - DNA, 17 bp, Homo sapiens
cctctgtaccgcccggc

SEQ ID NO: 1756498 - DNA, 18 bp, Homo sapiens
cctctgtaccgcccggca

SEQ ID NO: 1756499 - DNA, 18 bp, Homo sapiens
cctctgtagctccctcct

SEQ ID NO: 1756500 - DNA, 23 bp, Homo sapiens
cctctgtagctccctcctcccat

SEQ ID NO: 1756501 - DNA, 20 bp, Homo sapiens
cctctgtcatcactccctgg

SEQ ID NO: 1756502 - DNA, 22 bp, Homo sapiens
cctctgtcatcactccctggat

SEQ ID NO: 1756503 - DNA, 15 bp, Homo sapiens
cctctgtccagggcc

SEQ ID NO: 1756504 - DNA, 14 bp, Homo sapiens
cctctgtccccttc

SEQ ID NO: 1756505 - DNA, 10 bp, Homo sapiens
cctctgtcta

SEQ ID NO: 1756506 - DNA, 15 bp, Homo sapiens
cctctgtctaggact

SEQ ID NO: 1756507 - DNA, 21 bp, Homo sapiens
cctctgtctaggactgcagtg

SEQ ID NO: 1756508 - DNA, 14 bp, Homo sapiens
cctctgtgccttct

SEQ ID NO: 1756509 - DNA, 20 bp, Homo sapiens
cctctgtgcttcgactactg

SEQ ID NO: 1756510 - DNA, 19 bp, Homo sapiens
cctctgtgtgctcctcctt

SEQ ID NO: 1756511 - DNA, 16 bp, Homo sapiens
cctctgttcaaagctg

SEQ ID NO: 1756512 - DNA, 20 bp, Homo sapiens
cctctgttgcaaactcagtt

SEQ ID NO: 1756513 - DNA, 17 bp, Homo sapiens
cctcttaaaaaataaaa

SEQ ID NO: 1756514 - DNA, 19 bp, Homo sapiens
cctcttaaaaaataaaaac

SEQ ID NO: 1756515 - DNA, 15 bp, Homo sapiens
cctcttaaattatat

SEQ ID NO: 1756516 - DNA, 17 bp, Homo sapiens
cctcttaccgtagcctc

SEQ ID NO: 1756517 - DNA, 18 bp, Homo sapiens
cctcttaccgtagcctcc

SEQ ID NO: 1756518 - DNA, 19 bp, Homo sapiens
cctcttaccgtagcctccg

SEQ ID NO: 1756519 - DNA, 14 bp, Homo sapiens
cctcttagagtcct

SEQ ID NO: 1756520 - DNA, 19 bp, Homo sapiens
cctcttagcctctggatct

SEQ ID NO: 1756521 - DNA, 13 bp, Homo sapiens
cctcttattccta

SEQ ID NO: 1756522 - DNA, 18 bp, Homo sapiens
cctcttcaaaaagcagag

SEQ ID NO: 1756523 - DNA, 16 bp, Homo sapiens
cctcttcactgtggcc

SEQ ID NO: 1756524 - DNA, 22 bp, Homo sapiens
cctcttcactgtggccacagcc

SEQ ID NO: 1756525 - DNA, 15 bp, Homo sapiens
cctcttccacccatt

SEQ ID NO: 1756526 - DNA, 22 bp, Homo sapiens
cctcttccccagaaaggagact

SEQ ID NO: 1756527 - DNA, 18 bp, Homo sapiens
cctcttcccttagcctct

SEQ ID NO: 1756528 - DNA, 23 bp, Homo sapiens
cctcttcccttagcctctcccac

SEQ ID NO: 1756529 - DNA, 15 bp, Homo sapiens
cctcttcctccctgg

SEQ ID NO: 1756530 - DNA, 16 bp, Homo sapiens
cctcttcctccctggg

SEQ ID NO: 1756531 - DNA, 17 bp, Homo sapiens
cctcttcctccctgggg

SEQ ID NO: 1756532 - DNA, 14 bp, Homo sapiens
cctcttcctctggt

SEQ ID NO: 1756533 - DNA, 16 bp, Homo sapiens
cctcttcctctggttc

SEQ ID NO: 1756534 - DNA, 13 bp, Homo sapiens
cctcttcctgtga

SEQ ID NO: 1756535 - DNA, 21 bp, Homo sapiens
cctcttcctgtgatccaccca

SEQ ID NO: 1756536 - DNA, 20 bp, Homo sapiens
cctcttctcttttgccccct

SEQ ID NO: 1756537 - DNA, 17 bp, Homo sapiens
cctcttctgacgtgcct

SEQ ID NO: 1756538 - DNA, 21 bp, Homo sapiens
cctcttctggagatggaagct

SEQ ID NO: 1756539 - DNA, 17 bp, Homo sapiens
cctcttctttgtgcctt

SEQ ID NO: 1756540 - DNA, 17 bp, Homo sapiens
cctcttgagcagtggct

SEQ ID NO: 1756541 - DNA, 16 bp, Homo sapiens
cctcttgattcctggt

SEQ ID NO: 1756542 - DNA, 12 bp, Homo sapiens
cctcttgctcaa

SEQ ID NO: 1756543 - DNA, 22 bp, Homo sapiens
cctcttggccatccttctgtgt

SEQ ID NO: 1756544 - DNA, 20 bp, Homo sapiens
cctcttggtgggtgtggcca

SEQ ID NO: 1756545 - DNA, 22 bp, Homo sapiens
cctcttggtgggtgtggccagc

SEQ ID NO: 1756546 - DNA, 15 bp, Homo sapiens
cctcttgtcctggcc

SEQ ID NO: 1756547 - DNA, 18 bp, Homo sapiens
cctcttgtcctggccctt

SEQ ID NO: 1756548 - DNA, 21 bp, Homo sapiens
cctcttgtcctggcccttcag

SEQ ID NO: 1756549 - DNA, 16 bp, Homo sapiens
cctcttgttactccct

SEQ ID NO: 1756550 - DNA, 16 bp, Homo sapiens
cctctttactctctcc

SEQ ID NO: 1756551 - DNA, 18 bp, Homo sapiens
cctctttactctctccga

SEQ ID NO: 1756552 - DNA, 18 bp, Homo sapiens
cctctttctgctctgcca

SEQ ID NO: 1756553 - DNA, 19 bp, Homo sapiens
cctctttctgctctgccat

SEQ ID NO: 1756554 - DNA, 14 bp, Homo sapiens
cctctttcttgttt

SEQ ID NO: 1756555 - DNA, 14 bp, Homo sapiens
cctctttgctgcag

SEQ ID NO: 1756556 - DNA, 19 bp, Homo sapiens
cctctttggctcccctgta

SEQ ID NO: 1756557 - DNA, 21 bp, Homo sapiens
cctctttggtggcatggaagg

SEQ ID NO: 1756558 - DNA, 13 bp, Homo sapiens
cctcttttcctgc

SEQ ID NO: 1756559 - DNA, 24 bp, Homo sapiens
cctcttttgcttgccaaagtacag

SEQ ID NO: 1756560 - DNA, 12 bp, Homo sapiens
cctcttttgtgc

SEQ ID NO: 1756561 - DNA, 14 bp, Homo sapiens
cctgaaaaactgat

SEQ ID NO: 1756562 - DNA, 20 bp, Homo sapiens
cctgaaaaactgatcaaaaa

SEQ ID NO: 1756563 - DNA, 19 bp, Homo sapiens
cctgaaaacgaaggggccc

SEQ ID NO: 1756564 - DNA, 20 bp, Homo sapiens
cctgaaaagggcggaagagt

SEQ ID NO: 1756565 - DNA, 17 bp, Homo sapiens
cctgaaacgctcctttg

SEQ ID NO: 1756566 - DNA, 20 bp, Homo sapiens
cctgaaacgctcctttgtgt

SEQ ID NO: 1756567 - DNA, 15 bp, Homo sapiens
cctgaaagaggctga

SEQ ID NO: 1756568 - DNA, 22 bp, Homo sapiens
cctgaaagggcccttcccctcc

SEQ ID NO: 1756569 - DNA, 13 bp, Homo sapiens
cctgaaagtgaca

SEQ ID NO: 1756570 - DNA, 22 bp, Homo sapiens
cctgcaggccaagagcagaggc

SEQ ID NO: 1756571 - DNA, 18 bp, Homo sapiens
cctgcaggctccatgcac

SEQ ID NO: 1756572 - DNA, 20 bp, Homo sapiens
cctgcaggctccatgcacct

SEQ ID NO: 1756573 - DNA, 12 bp, Homo sapiens
cctgcagggcca

SEQ ID NO: 1756574 - DNA, 23 bp, Homo sapiens
cctgcagggtggtgctgggactg

SEQ ID NO: 1756575 - DNA, 21 bp, Homo sapiens
cctgcaggtcagttgtaataa

SEQ ID NO: 1756576 - DNA, 19 bp, Homo sapiens
cctgcaggtgagcaggcag

SEQ ID NO: 1756577 - DNA, 20 bp, Homo sapiens
cctgcagtgccagctccctc

SEQ ID NO: 1756578 - DNA, 16 bp, Homo sapiens
cctgcagtttggccct

SEQ ID NO: 1756579 - DNA, 17 bp, Homo sapiens
cctgcagtttggccctg

SEQ ID NO: 1756580 - DNA, 18 bp, Homo sapiens
cctgcagtttggccctgg

SEQ ID NO: 1756581 - DNA, 22 bp, Homo sapiens
cctgcagtttggccctggagcc

SEQ ID NO: 1756582 - DNA, 22 bp, Homo sapiens
cctgcatccgtagttccctgaa

SEQ ID NO: 1756583 - DNA, 17 bp, Homo sapiens
cctgcatccttcctggg

SEQ ID NO: 1756584 - DNA, 18 bp, Homo sapiens
cctgcatccttcctgggg

SEQ ID NO: 1756585 - DNA, 19 bp, Homo sapiens
cctgcatccttcctgggga

SEQ ID NO: 1756586 - DNA, 22 bp, Homo sapiens
cctgcatctatcgagtttgcaa

SEQ ID NO: 1756587 - DNA, 15 bp, Homo sapiens
cctgcatctctgtga

SEQ ID NO: 1756588 - DNA, 18 bp, Homo sapiens
cctgcatctctgtgaagc

SEQ ID NO: 1756589 - DNA, 21 bp, Homo sapiens
cctgcatctctgtgaagcctc

SEQ ID NO: 1756590 - DNA, 17 bp, Homo sapiens
cctgcatgctgcccagc

SEQ ID NO: 1756591 - DNA, 15 bp, Homo sapiens
cctgcatggagaagg

SEQ ID NO: 1756592 - DNA, 19 bp, Homo sapiens
cctgcattcacccagacag

SEQ ID NO: 1756593 - DNA, 16 bp, Homo sapiens
cctgcattggcctggc

SEQ ID NO: 1756594 - DNA, 17 bp, Homo sapiens
cctgcattggcctggcc

SEQ ID NO: 1756595 - DNA, 18 bp, Homo sapiens
cctgcattggcctggcct

SEQ ID NO: 1756596 - DNA, 22 bp, Homo sapiens
cctgcattggcctggcctccag

SEQ ID NO: 1756597 - DNA, 23 bp, Homo sapiens
cctgcattggcctggcctccagc

SEQ ID NO: 1756598 - DNA, 15 bp, Homo sapiens
cctgccaagactcct

SEQ ID NO: 1756599 - DNA, 20 bp, Homo sapiens
cctgccaagtctcagaagag

SEQ ID NO: 1756600 - DNA, 12 bp, Homo sapiens
cctgccaccagg

SEQ ID NO: 1756601 - DNA, 16 bp, Homo sapiens
cctgccacctccctga

SEQ ID NO: 1756602 - DNA, 21 bp, Homo sapiens
cctgccactcactaggccccc

SEQ ID NO: 1756603 - DNA, 16 bp, Homo sapiens
cctgccactctctggg

SEQ ID NO: 1756604 - DNA, 18 bp, Homo sapiens
cctgccactctctgggac

SEQ ID NO: 1756605 - DNA, 21 bp, Homo sapiens
cctgccactctctgggactct

SEQ ID NO: 1756606 - DNA, 15 bp, Homo sapiens
cctgccagaggatgc

SEQ ID NO: 1756607 - DNA, 22 bp, Homo sapiens
cctgccagcaggccagggactc

SEQ ID NO: 1756608 - DNA, 13 bp, Homo sapiens
cctgccagcctgg

SEQ ID NO: 1756609 - DNA, 17 bp, Homo sapiens
cctgccagcctggcttc

SEQ ID NO: 1756610 - DNA, 12 bp, Homo sapiens
cctgccagctgc

SEQ ID NO: 1756611 - DNA, 13 bp, Homo sapiens
cctgccagctgca

SEQ ID NO: 1756612 - DNA, 16 bp, Homo sapiens
cctgccagctgcactg

SEQ ID NO: 1756613 - DNA, 18 bp, Homo sapiens
cctgccagctgcactgat

SEQ ID NO: 1756614 - DNA, 13 bp, Homo sapiens
cctgccagctgcc

SEQ ID NO: 1756615 - DNA, 14 bp, Homo sapiens
cctgccagctgcct

SEQ ID NO: 1756616 - DNA, 21 bp, Homo sapiens
cctgccaggagctttggacct

SEQ ID NO: 1756617 - DNA, 14 bp, Homo sapiens
cctgccaggcaggg

SEQ ID NO: 1756618 - DNA, 17 bp, Homo sapiens
cctgccagtgccttacc

SEQ ID NO: 1756619 - DNA, 17 bp, Homo sapiens
cctgcccaatgctttgg

SEQ ID NO: 1756620 - DNA, 21 bp, Homo sapiens
cctgcccaatgctttgggagg

SEQ ID NO: 1756621 - DNA, 22 bp, Homo sapiens
cctgcccaggagagccagccct

SEQ ID NO: 1756622 - DNA, 13 bp, Homo sapiens
cctgcccagtgtt

SEQ ID NO: 1756623 - DNA, 22 bp, Homo sapiens
cctgcccagttgcactcaggtg

SEQ ID NO: 1756624 - DNA, 16 bp, Homo sapiens
cctgcccatgccccag

SEQ ID NO: 1756625 - DNA, 19 bp, Homo sapiens
cctgccccaccccatccag

SEQ ID NO: 1756626 - DNA, 22 bp, Homo sapiens
cctgccccaccccatccagcca

SEQ ID NO: 1756627 - DNA, 24 bp, Homo sapiens
cctgccccaccccatccagccaga

SEQ ID NO: 1756628 - DNA, 14 bp, Homo sapiens
cctgccccaggcct

SEQ ID NO: 1756629 - DNA, 13 bp, Homo sapiens
cctgcccccagcc

SEQ ID NO: 1756630 - DNA, 12 bp, Homo sapiens
cctgcccccagg

SEQ ID NO: 1756631 - DNA, 14 bp, Homo sapiens
cctgcccccaggac

SEQ ID NO: 1756632 - DNA, 15 bp, Homo sapiens
cctgcccccaggact

SEQ ID NO: 1756633 - DNA, 18 bp, Homo sapiens
cctgcccccaggactggg

SEQ ID NO: 1756634 - DNA, 13 bp, Homo sapiens
cctgcccccatct

SEQ ID NO: 1756635 - DNA, 19 bp, Homo sapiens
cctgcccccatctccccag

SEQ ID NO: 1756636 - DNA, 20 bp, Homo sapiens
cctgcccccatctccccagg

SEQ ID NO: 1756637 - DNA, 12 bp, Homo sapiens
cctgccccctgg

SEQ ID NO: 1756638 - DNA, 16 bp, Homo sapiens
cctgccccgcccagct

SEQ ID NO: 1756639 - DNA, 22 bp, Homo sapiens
cctgccccgcccagctgcacct

SEQ ID NO: 1756640 - DNA, 13 bp, Homo sapiens
cctgccccgcccc

SEQ ID NO: 1756641 - DNA, 20 bp, Homo sapiens
cctgccccgcccccagtccc

SEQ ID NO: 1756642 - DNA, 18 bp, Homo sapiens
cctgccccggagctggag

SEQ ID NO: 1756643 - DNA, 18 bp, Homo sapiens
cctgccccgttgcttccc

SEQ ID NO: 1756644 - DNA, 22 bp, Homo sapiens
cctgcccctaggatgctgcagc

SEQ ID NO: 1756645 - DNA, 23 bp, Homo sapiens
cctgcccctaggatgctgcagca

SEQ ID NO: 1756646 - DNA, 24 bp, Homo sapiens
cctgcccctaggatgctgcagcag

SEQ ID NO: 1756647 - DNA, 14 bp, Homo sapiens
cctgcccctccctt

SEQ ID NO: 1756648 - DNA, 16 bp, Homo sapiens
cctgcccctctcccgc

SEQ ID NO: 1756649 - DNA, 21 bp, Homo sapiens
cctgcccgcaccctggcctgg

SEQ ID NO: 1756650 - DNA, 12 bp, Homo sapiens
cctgcccgctcc

SEQ ID NO: 1756651 - DNA, 22 bp, Homo sapiens
cctgcccggtggtttgccatgt

SEQ ID NO: 1756652 - DNA, 23 bp, Homo sapiens
cctgcccggtggtttgccatgtc

SEQ ID NO: 1756653 - DNA, 24 bp, Homo sapiens
cctgccctagagcacactgtagca

SEQ ID NO: 1756654 - DNA, 16 bp, Homo sapiens
cctgccctagctccac

SEQ ID NO: 1756655 - DNA, 13 bp, Homo sapiens
cctgccctcaagg

SEQ ID NO: 1756656 - DNA, 12 bp, Homo sapiens
cctgccctcact

SEQ ID NO: 1756657 - DNA, 13 bp, Homo sapiens
cctgccctcactc

SEQ ID NO: 1756658 - DNA, 16 bp, Homo sapiens
cctgccctcactccct

SEQ ID NO: 1756659 - DNA, 18 bp, Homo sapiens
cctgccctcactccctct

SEQ ID NO: 1756660 - DNA, 13 bp, Homo sapiens
cctgccctcccct

SEQ ID NO: 1756661 - DNA, 17 bp, Homo sapiens
cctgccctcccctgctc

SEQ ID NO: 1756662 - DNA, 21 bp, Homo sapiens
cctgccctcccctgctcccag

SEQ ID NO: 1756663 - DNA, 12 bp, Homo sapiens
cctgccctcgtg

SEQ ID NO: 1756664 - DNA, 18 bp, Homo sapiens
cctgccctcgtggccagc

SEQ ID NO: 1756665 - DNA, 22 bp, Homo sapiens
cctgccctcgtggccagcccgg

SEQ ID NO: 1756666 - DNA, 13 bp, Homo sapiens
cctgccctctgcc

SEQ ID NO: 1756667 - DNA, 16 bp, Homo sapiens
cctgccctctgctctg

SEQ ID NO: 1756668 - DNA, 20 bp, Homo sapiens
cctgccctctgctctgcctg

SEQ ID NO: 1756669 - DNA, 11 bp, Homo sapiens
cctgccctgca

SEQ ID NO: 1756670 - DNA, 22 bp, Homo sapiens
cctgccctgggcgagcccctcc

SEQ ID NO: 1756671 - DNA, 14 bp, Homo sapiens
cctgccgaacacac

SEQ ID NO: 1756672 - DNA, 16 bp, Homo sapiens
cctgccgaacacacat

SEQ ID NO: 1756673 - DNA, 14 bp, Homo sapiens
cctgccgcagacgg

SEQ ID NO: 1756674 - DNA, 19 bp, Homo sapiens
cctgccgcagacgggcaca

SEQ ID NO: 1756675 - DNA, 22 bp, Homo sapiens
cctgccgcagacgggcacagac

SEQ ID NO: 1756676 - DNA, 23 bp, Homo sapiens
cctgccgcagacgggcacagaca

SEQ ID NO: 1756677 - DNA, 17 bp, Homo sapiens
cctgccgcagagctggc

SEQ ID NO: 1756678 - DNA, 17 bp, Homo sapiens
cctgccgcccccgcctg

SEQ ID NO: 1756679 - DNA, 19 bp, Homo sapiens
cctgccgcccccgcctggg

SEQ ID NO: 1756680 - DNA, 20 bp, Homo sapiens
cctgccgcccccgcctgggc

SEQ ID NO: 1756681 - DNA, 21 bp, Homo sapiens
cctgccgggctgagggcctgc

SEQ ID NO: 1756682 - DNA, 20 bp, Homo sapiens
cctgccggtgcacaggcctc

SEQ ID NO: 1756683 - DNA, 16 bp, Homo sapiens
cctgccggtgggaccc

SEQ ID NO: 1756684 - DNA, 17 bp, Homo sapiens
cctggattcatttcctg

SEQ ID NO: 1756685 - DNA, 18 bp, Homo sapiens
cctggattcatttcctgc

SEQ ID NO: 1756686 - DNA, 19 bp, Homo sapiens
cctggattcatttcctgcc

SEQ ID NO: 1756687 - DNA, 20 bp, Homo sapiens
cctggattcatttcctgccc

SEQ ID NO: 1756688 - DNA, 15 bp, Homo sapiens
cctggattccagcag

SEQ ID NO: 1756689 - DNA, 17 bp, Homo sapiens
cctggattccagcagtg

SEQ ID NO: 1756690 - DNA, 22 bp, Homo sapiens
cctggattccagcagtgaatgc

SEQ ID NO: 1756691 - DNA, 18 bp, Homo sapiens
cctggattggttggcaaa

SEQ ID NO: 1756692 - DNA, 17 bp, Homo sapiens
cctggattttgccctct

SEQ ID NO: 1756693 - DNA, 16 bp, Homo sapiens
cctggcaacagagcga

SEQ ID NO: 1756694 - DNA, 23 bp, Homo sapiens
cctggcaacagagcgagattcca

SEQ ID NO: 1756695 - DNA, 14 bp, Homo sapiens
cctggcaagaaagc

SEQ ID NO: 1756696 - DNA, 15 bp, Homo sapiens
cctggcacaggactg

SEQ ID NO: 1756697 - DNA, 16 bp, Homo sapiens
cctggcacaggactga

SEQ ID NO: 1756698 - DNA, 16 bp, Homo sapiens
cctggcacgccctact

SEQ ID NO: 1756699 - DNA, 14 bp, Homo sapiens
cctggcagacacaa

SEQ ID NO: 1756700 - DNA, 14 bp, Homo sapiens
cctggcagcagcag

SEQ ID NO: 1756701 - DNA, 19 bp, Homo sapiens
cctggcagcagcaggtgtg

SEQ ID NO: 1756702 - DNA, 12 bp, Homo sapiens
cctggcagccgt

SEQ ID NO: 1756703 - DNA, 22 bp, Homo sapiens
cctggcagggtcatcctgtgct

SEQ ID NO: 1756704 - DNA, 16 bp, Homo sapiens
cctggcaggtggaact

SEQ ID NO: 1756705 - DNA, 17 bp, Homo sapiens
cctggcaggtggccagg

SEQ ID NO: 1756706 - DNA, 19 bp, Homo sapiens
cctggcaggtggccaggca

SEQ ID NO: 1756707 - DNA, 20 bp, Homo sapiens
cctggcagtgctgagggacc

SEQ ID NO: 1756708 - DNA, 16 bp, Homo sapiens
cctggcatcttctgga

SEQ ID NO: 1756709 - DNA, 17 bp, Homo sapiens
cctggcatggcacctgt

SEQ ID NO: 1756710 - DNA, 12 bp, Homo sapiens
cctggccacctg

SEQ ID NO: 1756711 - DNA, 22 bp, Homo sapiens
cctggccacgcagccaggacac

SEQ ID NO: 1756712 - DNA, 16 bp, Homo sapiens
cctggccactaaagct

SEQ ID NO: 1756713 - DNA, 13 bp, Homo sapiens
cctggccaggagc

SEQ ID NO: 1756714 - DNA, 15 bp, Homo sapiens
cctggccaggagctc

SEQ ID NO: 1756715 - DNA, 22 bp, Homo sapiens
cctggccaggagctcttcaggc

SEQ ID NO: 1756716 - DNA, 13 bp, Homo sapiens
cctggccagtctt

SEQ ID NO: 1756717 - DNA, 18 bp, Homo sapiens
cctggcccacgccctccc

SEQ ID NO: 1756718 - DNA, 20 bp, Homo sapiens
cctggcccagcggcccctcc

SEQ ID NO: 1756719 - DNA, 22 bp, Homo sapiens
cctggcccatagaaacatgaca

SEQ ID NO: 1756720 - DNA, 24 bp, Homo sapiens
cctggcccatagaaacatgacact

SEQ ID NO: 1756721 - DNA, 22 bp, Homo sapiens
cctggcccccaacctcagggct

SEQ ID NO: 1756722 - DNA, 17 bp, Homo sapiens
cctggccccgcctgcct

SEQ ID NO: 1756723 - DNA, 19 bp, Homo sapiens
cctggccccgggctctggc

SEQ ID NO: 1756724 - DNA, 21 bp, Homo sapiens
cctggccccgggctctggcca

SEQ ID NO: 1756725 - DNA, 14 bp, Homo sapiens
cctggcccctccag

SEQ ID NO: 1756726 - DNA, 15 bp, Homo sapiens
cctggcccgcccctc

SEQ ID NO: 1756727 - DNA, 13 bp, Homo sapiens
cctggccctgccc

SEQ ID NO: 1756728 - DNA, 15 bp, Homo sapiens
cctggccctgcccag

SEQ ID NO: 1756729 - DNA, 17 bp, Homo sapiens
cctggccctgcttcctg

SEQ ID NO: 1756730 - DNA, 23 bp, Homo sapiens
cctggccctgcttcctgcttgcc

SEQ ID NO: 1756731 - DNA, 12 bp, Homo sapiens
cctggcccttca

SEQ ID NO: 1756732 - DNA, 15 bp, Homo sapiens
cctggcccttcagtc

SEQ ID NO: 1756733 - DNA, 17 bp, Homo sapiens
cctggcccttcagtctg

SEQ ID NO: 1756734 - DNA, 19 bp, Homo sapiens
cctggcccttcagtctgct

SEQ ID NO: 1756735 - DNA, 22 bp, Homo sapiens
cctggcccttcagtctgctcca

SEQ ID NO: 1756736 - DNA, 14 bp, Homo sapiens
cctggccgccccct

SEQ ID NO: 1756737 - DNA, 16 bp, Homo sapiens
cctggccgcctccagg

SEQ ID NO: 1756738 - DNA, 19 bp, Homo sapiens
cctggccgcctccaggagc

SEQ ID NO: 1756739 - DNA, 13 bp, Homo sapiens
cctggccggctcc

SEQ ID NO: 1756740 - DNA, 15 bp, Homo sapiens
cctggccggctccag

SEQ ID NO: 1756741 - DNA, 21 bp, Homo sapiens
cctggccgttcagcctgtctc

SEQ ID NO: 1756742 - DNA, 13 bp, Homo sapiens
cctggcctcactg

SEQ ID NO: 1756743 - DNA, 22 bp, Homo sapiens
cctggcctcactggctggggca

SEQ ID NO: 1756744 - DNA, 17 bp, Homo sapiens
cctggcctcagttccca

SEQ ID NO: 1756745 - DNA, 13 bp, Homo sapiens
cctggcctccagc

SEQ ID NO: 1756746 - DNA, 14 bp, Homo sapiens
cctggcctccagct

SEQ ID NO: 1756747 - DNA, 16 bp, Homo sapiens
cctggcctccagctcc

SEQ ID NO: 1756748 - DNA, 17 bp, Homo sapiens
cctggcctccagctccc

SEQ ID NO: 1756749 - DNA, 16 bp, Homo sapiens
cctggcctctgggcag

SEQ ID NO: 1756750 - DNA, 17 bp, Homo sapiens
cctggcctgaactgagg

SEQ ID NO: 1756751 - DNA, 19 bp, Homo sapiens
cctggcctgaactgaggag

SEQ ID NO: 1756752 - DNA, 13 bp, Homo sapiens
cctggcctgagag

SEQ ID NO: 1756753 - DNA, 18 bp, Homo sapiens
cctggcctgagctggggc

SEQ ID NO: 1756754 - DNA, 22 bp, Homo sapiens
cctggcctgagctggggccaca

SEQ ID NO: 1756755 - DNA, 18 bp, Homo sapiens
cctggcctgctgggaacc

SEQ ID NO: 1756756 - DNA, 12 bp, Homo sapiens
cctggcctggct

SEQ ID NO: 1756757 - DNA, 16 bp, Homo sapiens
cctggcctggctcccc

SEQ ID NO: 1756758 - DNA, 16 bp, Homo sapiens
cctggcctggtccctg

SEQ ID NO: 1756759 - DNA, 21 bp, Homo sapiens
cctggcctggtccctggtcct

SEQ ID NO: 1756760 - DNA, 20 bp, Homo sapiens
cctggccttctgaactccat

SEQ ID NO: 1756761 - DNA, 14 bp, Homo sapiens
cctggccttttgtg

SEQ ID NO: 1756762 - DNA, 19 bp, Homo sapiens
cctggcgcaggtgggctgg

SEQ ID NO: 1756763 - DNA, 19 bp, Homo sapiens
cctggcgtgctcagaccca

SEQ ID NO: 1756764 - DNA, 14 bp, Homo sapiens
cctggctacatccc

SEQ ID NO: 1756765 - DNA, 19 bp, Homo sapiens
cctggctacatcccagcct

SEQ ID NO: 1756766 - DNA, 17 bp, Homo sapiens
cctggctacttcccttc

SEQ ID NO: 1756767 - DNA, 17 bp, Homo sapiens
cctggctcactggcagg

SEQ ID NO: 1756768 - DNA, 18 bp, Homo sapiens
cctggctcactggcaggt

SEQ ID NO: 1756769 - DNA, 18 bp, Homo sapiens
cctggctcaggcccagct

SEQ ID NO: 1756770 - DNA, 15 bp, Homo sapiens
cctggctcccaggac

SEQ ID NO: 1756771 - DNA, 17 bp, Homo sapiens
cctggctcccaggacac

SEQ ID NO: 1756772 - DNA, 21 bp, Homo sapiens
cctggctcccatgaccatact

SEQ ID NO: 1756773 - DNA, 16 bp, Homo sapiens
cctggctccccacgag

SEQ ID NO: 1756774 - DNA, 18 bp, Homo sapiens
cctggctccccacgagtc

SEQ ID NO: 1756775 - DNA, 23 bp, Homo sapiens
cctggctccctcctccaggcctg

SEQ ID NO: 1756776 - DNA, 19 bp, Homo sapiens
cctggctctaccctgtctg

SEQ ID NO: 1756777 - DNA, 15 bp, Homo sapiens
cctggctctcagagg

SEQ ID NO: 1756778 - DNA, 18 bp, Homo sapiens
cctggctctgccccctcc

SEQ ID NO: 1756779 - DNA, 21 bp, Homo sapiens
cctggctgaggttcctctgcc

SEQ ID NO: 1756780 - DNA, 23 bp, Homo sapiens
cctggctgaggttcctctgcctg

SEQ ID NO: 1756781 - DNA, 24 bp, Homo sapiens
cctggctgaggttcctctgcctgc

SEQ ID NO: 1756782 - DNA, 19 bp, Homo sapiens
cctggctgatgatccagaa

SEQ ID NO: 1756783 - DNA, 22 bp, Homo sapiens
cctggctgatgatccagaacag

SEQ ID NO: 1756784 - DNA, 13 bp, Homo sapiens
cctggctgcactc

SEQ ID NO: 1756785 - DNA, 16 bp, Homo sapiens
cctggctgccaggcgt

SEQ ID NO: 1756786 - DNA, 15 bp, Homo sapiens
cctggctgcccatca

SEQ ID NO: 1756787 - DNA, 12 bp, Homo sapiens
cctggctgccct

SEQ ID NO: 1756788 - DNA, 14 bp, Homo sapiens
cctggctgctgccc

SEQ ID NO: 1756789 - DNA, 15 bp, Homo sapiens
cctggctgctgcccc

SEQ ID NO: 1756790 - DNA, 22 bp, Homo sapiens
cctggctgctgcccccaccccg

SEQ ID NO: 1756791 - DNA, 12 bp, Homo sapiens
cctggctgtgcc

SEQ ID NO: 1756792 - DNA, 22 bp, Homo sapiens
cctggctgtgcccagcaggccc

SEQ ID NO: 1756793 - DNA, 24 bp, Homo sapiens
cctggctgtgcccagcaggcccag

SEQ ID NO: 1756794 - DNA, 15 bp, Homo sapiens
cctggctgtggaggc

SEQ ID NO: 1756795 - DNA, 16 bp, Homo sapiens
cctggctgtggaggcc

SEQ ID NO: 1756796 - DNA, 17 bp, Homo sapiens
cctggctgtggaggcct

SEQ ID NO: 1756797 - DNA, 14 bp, Homo sapiens
cctggcttctggag

SEQ ID NO: 1756798 - DNA, 17 bp, Homo sapiens
cctggcttctggagccc

SEQ ID NO: 1756799 - DNA, 18 bp, Homo sapiens
cctgtcgtgccagtcctg

SEQ ID NO: 1756800 - DNA, 13 bp, Homo sapiens
cctgtctactcat

SEQ ID NO: 1756801 - DNA, 18 bp, Homo sapiens
cctgtctactcatccaga

SEQ ID NO: 1756802 - DNA, 14 bp, Homo sapiens
cctgtctaggtctc

SEQ ID NO: 1756803 - DNA, 20 bp, Homo sapiens
cctgtctaggtctcctcagg

SEQ ID NO: 1756804 - DNA, 21 bp, Homo sapiens
cctgtctcaaaaaaaaaaaga

SEQ ID NO: 1756805 - DNA, 13 bp, Homo sapiens
cctgtctcagcct

SEQ ID NO: 1756806 - DNA, 14 bp, Homo sapiens
cctgtctcagcctc

SEQ ID NO: 1756807 - DNA, 17 bp, Homo sapiens
cctgtctcagcctcctg

SEQ ID NO: 1756808 - DNA, 18 bp, Homo sapiens
cctgtctcagcctcctga

SEQ ID NO: 1756809 - DNA, 12 bp, Homo sapiens
cctgtctccagc

SEQ ID NO: 1756810 - DNA, 15 bp, Homo sapiens
cctgtctccagctgc

SEQ ID NO: 1756811 - DNA, 20 bp, Homo sapiens
cctgtctccagctgcctggg

SEQ ID NO: 1756812 - DNA, 21 bp, Homo sapiens
cctgtctcccggctcccctcc

SEQ ID NO: 1756813 - DNA, 20 bp, Homo sapiens
cctgtctcggggcttgcccc

SEQ ID NO: 1756814 - DNA, 16 bp, Homo sapiens
cctgtctctaaaaaga

SEQ ID NO: 1756815 - DNA, 23 bp, Homo sapiens
cctgtctctaaaaagaagccaca

SEQ ID NO: 1756816 - DNA, 14 bp, Homo sapiens
cctgtctctgcctg

SEQ ID NO: 1756817 - DNA, 21 bp, Homo sapiens
cctgtctgaaggacacttcct

SEQ ID NO: 1756818 - DNA, 17 bp, Homo sapiens
cctgtctgccagccagc

SEQ ID NO: 1756819 - DNA, 21 bp, Homo sapiens
cctgtctgccagccagcagcc

SEQ ID NO: 1756820 - DNA, 23 bp, Homo sapiens
cctgtctgccagccagcagccag

SEQ ID NO: 1756821 - DNA, 16 bp, Homo sapiens
cctgtctgctgccagc

SEQ ID NO: 1756822 - DNA, 17 bp, Homo sapiens
cctgtctgctgccagca

SEQ ID NO: 1756823 - DNA, 23 bp, Homo sapiens
cctgtctggctcggacccacccc

SEQ ID NO: 1756824 - DNA, 16 bp, Homo sapiens
cctgtctgtccctttt

SEQ ID NO: 1756825 - DNA, 17 bp, Homo sapiens
cctgtctgtctctccat

SEQ ID NO: 1756826 - DNA, 12 bp, Homo sapiens
cctgtctgtgtc

SEQ ID NO: 1756827 - DNA, 13 bp, Homo sapiens
cctgtctgtgtcc

SEQ ID NO: 1756828 - DNA, 15 bp, Homo sapiens
cctgtctgtgtccca

SEQ ID NO: 1756829 - DNA, 21 bp, Homo sapiens
cctgtctgtgtcccagccacg

SEQ ID NO: 1756830 - DNA, 17 bp, Homo sapiens
cctgtcttatcctccac

SEQ ID NO: 1756831 - DNA, 22 bp, Homo sapiens
cctgtcttatcctccaccgtct

SEQ ID NO: 1756832 - DNA, 12 bp, Homo sapiens
cctgtcttcaga

SEQ ID NO: 1756833 - DNA, 15 bp, Homo sapiens
cctgtcttcctgcat

SEQ ID NO: 1756834 - DNA, 14 bp, Homo sapiens
cctgtcttggcctc

SEQ ID NO: 1756835 - DNA, 17 bp, Homo sapiens
cctgtcttggggccact

SEQ ID NO: 1756836 - DNA, 19 bp, Homo sapiens
cctgtctttgttgtctccc

SEQ ID NO: 1756837 - DNA, 21 bp, Homo sapiens
cctgtctttgttgtctccctc

SEQ ID NO: 1756838 - DNA, 19 bp, Homo sapiens
cctgtgaaatagttcaaag

SEQ ID NO: 1756839 - DNA, 16 bp, Homo sapiens
cctgtgaagcagtcag

SEQ ID NO: 1756840 - DNA, 21 bp, Homo sapiens
cctgtgaagtaacccctcctg

SEQ ID NO: 1756841 - DNA, 22 bp, Homo sapiens
cctgtgaagtaacccctcctgg

SEQ ID NO: 1756842 - DNA, 22 bp, Homo sapiens
cctgtgaagtttaattgtctca

SEQ ID NO: 1756843 - DNA, 17 bp, Homo sapiens
cctgtgaatcaatcctg

SEQ ID NO: 1756844 - DNA, 21 bp, Homo sapiens
cctgtgaatgccactgccttc

SEQ ID NO: 1756845 - DNA, 22 bp, Homo sapiens
cctgtgaatgccactgccttcg

SEQ ID NO: 1756846 - DNA, 17 bp, Homo sapiens
cctgtgacatggtgcct

SEQ ID NO: 1756847 - DNA, 23 bp, Homo sapiens
cctgtgacatggtgcctgagagg

SEQ ID NO: 1756848 - DNA, 16 bp, Homo sapiens
cctgtgaccagcactg

SEQ ID NO: 1756849 - DNA, 13 bp, Homo sapiens
cctgtgaggcagg

SEQ ID NO: 1756850 - DNA, 19 bp, Homo sapiens
cctgtgaggtgcagagtgc

SEQ ID NO: 1756851 - DNA, 13 bp, Homo sapiens
cctgtgagtaggc

SEQ ID NO: 1756852 - DNA, 23 bp, Homo sapiens
cctgtgagtaggctgggcctccc

SEQ ID NO: 1756853 - DNA, 16 bp, Homo sapiens
cctgtgatatgtctgc

SEQ ID NO: 1756854 - DNA, 20 bp, Homo sapiens
cctgtgatccacccaaccct

SEQ ID NO: 1756855 - DNA, 19 bp, Homo sapiens
cctgtgatctagtccttgt

SEQ ID NO: 1756856 - DNA, 16 bp, Homo sapiens
cctgtgatgctgggca

SEQ ID NO: 1756857 - DNA, 15 bp, Homo sapiens
cctgtgatggccagg

SEQ ID NO: 1756858 - DNA, 16 bp, Homo sapiens
cctgtgatggccaggc

SEQ ID NO: 1756859 - DNA, 13 bp, Homo sapiens
cctgtgcagcagc

SEQ ID NO: 1756860 - DNA, 22 bp, Homo sapiens
cctgtgcagcagcccagcttcc

SEQ ID NO: 1756861 - DNA, 23 bp, Homo sapiens
cctgtgcagcagcccagcttcct

SEQ ID NO: 1756862 - DNA, 17 bp, Homo sapiens
cctgtgcatgtatgtct

SEQ ID NO: 1756863 - DNA, 21 bp, Homo sapiens
cctgtgccacccaccagggcg

SEQ ID NO: 1756864 - DNA, 12 bp, Homo sapiens
cctgtgccagca

SEQ ID NO: 1756865 - DNA, 14 bp, Homo sapiens
cctgtgccctcacc

SEQ ID NO: 1756866 - DNA, 16 bp, Homo sapiens
cctgtgccctcaccac

SEQ ID NO: 1756867 - DNA, 15 bp, Homo sapiens
cctgtgcctcctcac

SEQ ID NO: 1756868 - DNA, 15 bp, Homo sapiens
cctgtgcctctggga

SEQ ID NO: 1756869 - DNA, 17 bp, Homo sapiens
cctgtgcctctgggact

SEQ ID NO: 1756870 - DNA, 20 bp, Homo sapiens
cctgtgcctctgggactgga

SEQ ID NO: 1756871 - DNA, 18 bp, Homo sapiens
cctgtgcctgggccctgg

SEQ ID NO: 1756872 - DNA, 23 bp, Homo sapiens
cctgtgcctgggccctgggctga

SEQ ID NO: 1756873 - DNA, 15 bp, Homo sapiens
cctgtgcgtcccagc

SEQ ID NO: 1756874 - DNA, 19 bp, Homo sapiens
cctgtgctagttttacaga

SEQ ID NO: 1756875 - DNA, 19 bp, Homo sapiens
cctgtgctatttgtacaaa

SEQ ID NO: 1756876 - DNA, 22 bp, Homo sapiens
cctgtgctatttgtacaaataa

SEQ ID NO: 1756877 - DNA, 22 bp, Homo sapiens
cctgtgctcccctgccacactg

SEQ ID NO: 1756878 - DNA, 17 bp, Homo sapiens
cctgtgctccgtgcctc

SEQ ID NO: 1756879 - DNA, 20 bp, Homo sapiens
cctgtgctccgtgcctccac

SEQ ID NO: 1756880 - DNA, 17 bp, Homo sapiens
cctgtgctcctgcccag

SEQ ID NO: 1756881 - DNA, 20 bp, Homo sapiens
cctgtgctcctgcccaggag

SEQ ID NO: 1756882 - DNA, 18 bp, Homo sapiens
cctgtgctgatcctgctg

SEQ ID NO: 1756883 - DNA, 19 bp, Homo sapiens
cctgtgctgatcctgctga

SEQ ID NO: 1756884 - DNA, 17 bp, Homo sapiens
cctgtgctgggccagtg

SEQ ID NO: 1756885 - DNA, 18 bp, Homo sapiens
cctgtgctggtgtcctga

SEQ ID NO: 1756886 - DNA, 23 bp, Homo sapiens
cctgtgctggtgtcctgaccacc

SEQ ID NO: 1756887 - DNA, 16 bp, Homo sapiens
cctgtggagtccagct

SEQ ID NO: 1756888 - DNA, 18 bp, Homo sapiens
cctgtggcacagccctga

SEQ ID NO: 1756889 - DNA, 16 bp, Homo sapiens
cctgtggcagctgccc

SEQ ID NO: 1756890 - DNA, 13 bp, Homo sapiens
cctgtggcaggag

SEQ ID NO: 1756891 - DNA, 14 bp, Homo sapiens
cctgtggcaggagg

SEQ ID NO: 1756892 - DNA, 15 bp, Homo sapiens
cctgtggcaggaggc

SEQ ID NO: 1756893 - DNA, 15 bp, Homo sapiens
cctgtggcataaatt

SEQ ID NO: 1756894 - DNA, 18 bp, Homo sapiens
cctgtggcatctttgcct

SEQ ID NO: 1756895 - DNA, 16 bp, Homo sapiens
cctgtggccaggaggt

SEQ ID NO: 1756896 - DNA, 16 bp, Homo sapiens
cctgtggccccaccct

SEQ ID NO: 1756897 - DNA, 17 bp, Homo sapiens
cctgtggccccaccctg

SEQ ID NO: 1756898 - DNA, 18 bp, Homo sapiens
cctgtggccccaccctgg

SEQ ID NO: 1756899 - DNA, 18 bp, Homo sapiens
cctgtggccgccacctga

SEQ ID NO: 1756900 - DNA, 18 bp, Homo sapiens
cctgtggcctgtgtccca

SEQ ID NO: 1756901 - DNA, 21 bp, Homo sapiens
cctgtggcctgtgtcccatga

SEQ ID NO: 1756902 - DNA, 13 bp, Homo sapiens
cctgtggccttgc

SEQ ID NO: 1756903 - DNA, 22 bp, Homo sapiens
cctgtggcgccgtctccagggg

SEQ ID NO: 1756904 - DNA, 16 bp, Homo sapiens
cctgtggcggtgcctg

SEQ ID NO: 1756905 - DNA, 19 bp, Homo sapiens
cctgtggcttggagtggcc

SEQ ID NO: 1756906 - DNA, 21 bp, Homo sapiens
cctgtggcttggagtggccaa

SEQ ID NO: 1756907 - DNA, 14 bp, Homo sapiens
cctgtgggagcctg

SEQ ID NO: 1756908 - DNA, 15 bp, Homo sapiens
cctgtgggagcctgc

SEQ ID NO: 1756909 - DNA, 21 bp, Homo sapiens
cctgtgggcttatgtctctgc

SEQ ID NO: 1756910 - DNA, 23 bp, Homo sapiens
cctgtgggcttatgtctctgcct

SEQ ID NO: 1756911 - DNA, 13 bp, Homo sapiens
cctgtggggcagg

SEQ ID NO: 1756912 - DNA, 14 bp, Homo sapiens
cctgtggggcagga

SEQ ID NO: 1756913 - DNA, 20 bp, Homo sapiens
ccttatcacccccttgttgt

SEQ ID NO: 1756914 - DNA, 14 bp, Homo sapiens
ccttatcaggcaaa

SEQ ID NO: 1756915 - DNA, 17 bp, Homo sapiens
ccttatcattcattctt

SEQ ID NO: 1756916 - DNA, 23 bp, Homo sapiens
ccttatctttctaaaactgcctt

SEQ ID NO: 1756917 - DNA, 18 bp, Homo sapiens
ccttattaaggccccaga

SEQ ID NO: 1756918 - DNA, 21 bp, Homo sapiens
ccttattcttgtggttaaaaa

SEQ ID NO: 1756919 - DNA, 20 bp, Homo sapiens
ccttattggaaggtattttt

SEQ ID NO: 1756920 - DNA, 15 bp, Homo sapiens
ccttattgtacctct

SEQ ID NO: 1756921 - DNA, 10 bp, Homo sapiens
ccttatttat

SEQ ID NO: 1756922 - DNA, 16 bp, Homo sapiens
ccttatttatttttgt

SEQ ID NO: 1756923 - DNA, 15 bp, Homo sapiens
ccttatttgtctgta

SEQ ID NO: 1756924 - DNA, 19 bp, Homo sapiens
ccttatttgtctgtaaaaa

SEQ ID NO: 1756925 - DNA, 14 bp, Homo sapiens
ccttattttcaaga

SEQ ID NO: 1756926 - DNA, 16 bp, Homo sapiens
ccttattttttcccaa

SEQ ID NO: 1756927 - DNA, 21 bp, Homo sapiens
ccttcaaaatgttctatttaa

SEQ ID NO: 1756928 - DNA, 14 bp, Homo sapiens
ccttcaaccattcc

SEQ ID NO: 1756929 - DNA, 19 bp, Homo sapiens
ccttcaagaactctgggct

SEQ ID NO: 1756930 - DNA, 19 bp, Homo sapiens
ccttcaagacgaggggcag

SEQ ID NO: 1756931 - DNA, 22 bp, Homo sapiens
ccttcaagacgaggggcaggga

SEQ ID NO: 1756932 - DNA, 22 bp, Homo sapiens
ccttcaataaatggtatagcaa

SEQ ID NO: 1756933 - DNA, 13 bp, Homo sapiens
ccttcacaaatgt

SEQ ID NO: 1756934 - DNA, 19 bp, Homo sapiens
ccttcacaggcagtgcatg

SEQ ID NO: 1756935 - DNA, 20 bp, Homo sapiens
ccttcacaggcagtgcatgt

SEQ ID NO: 1756936 - DNA, 15 bp, Homo sapiens
ccttcaccagagccc

SEQ ID NO: 1756937 - DNA, 17 bp, Homo sapiens
ccttcaccagagcccat

SEQ ID NO: 1756938 - DNA, 14 bp, Homo sapiens
ccttcacctcggag

SEQ ID NO: 1756939 - DNA, 17 bp, Homo sapiens
ccttcacctcggaggga

SEQ ID NO: 1756940 - DNA, 12 bp, Homo sapiens
ccttcactgcca

SEQ ID NO: 1756941 - DNA, 13 bp, Homo sapiens
ccttcactgtgct

SEQ ID NO: 1756942 - DNA, 19 bp, Homo sapiens
ccttcactgttccctctgg

SEQ ID NO: 1756943 - DNA, 13 bp, Homo sapiens
ccttcagacacat

SEQ ID NO: 1756944 - DNA, 12 bp, Homo sapiens
ccttcagagctc

SEQ ID NO: 1756945 - DNA, 20 bp, Homo sapiens
ccttcagcaacttattttgc

SEQ ID NO: 1756946 - DNA, 14 bp, Homo sapiens
ccttcagcacagga

SEQ ID NO: 1756947 - DNA, 17 bp, Homo sapiens
ccttcagcagcagctca

SEQ ID NO: 1756948 - DNA, 17 bp, Homo sapiens
ccttcagcccaccaccc

SEQ ID NO: 1756949 - DNA, 15 bp, Homo sapiens
ccttcagccctcacc

SEQ ID NO: 1756950 - DNA, 12 bp, Homo sapiens
ccttcagggcca

SEQ ID NO: 1756951 - DNA, 13 bp, Homo sapiens
ccttcagggccag

SEQ ID NO: 1756952 - DNA, 22 bp, Homo sapiens
ccttcagggccagaaggagggc

SEQ ID NO: 1756953 - DNA, 19 bp, Homo sapiens
ccttcagtaccctctcagc

SEQ ID NO: 1756954 - DNA, 20 bp, Homo sapiens
ccttcagtaccctctcagct

SEQ ID NO: 1756955 - DNA, 23 bp, Homo sapiens
ccttcagtaccctctcagctcca

SEQ ID NO: 1756956 - DNA, 16 bp, Homo sapiens
ccttcagtctgctcca

SEQ ID NO: 1756957 - DNA, 19 bp, Homo sapiens
ccttcagtctgctccacca

SEQ ID NO: 1756958 - DNA, 14 bp, Homo sapiens
ccttcagtgcccac

SEQ ID NO: 1756959 - DNA, 18 bp, Homo sapiens
ccttcagtgcccaccaac

SEQ ID NO: 1756960 - DNA, 18 bp, Homo sapiens
ccttcagtgctacatttt

SEQ ID NO: 1756961 - DNA, 20 bp, Homo sapiens
ccttcagtgctacattttgt

SEQ ID NO: 1756962 - DNA, 15 bp, Homo sapiens
ccttcataccgcctc

SEQ ID NO: 1756963 - DNA, 22 bp, Homo sapiens
ccttcataggcggtcatgtgtg

SEQ ID NO: 1756964 - DNA, 16 bp, Homo sapiens
ccttcatcttcctgtg

SEQ ID NO: 1756965 - DNA, 19 bp, Homo sapiens
ccttcatcttcctgtgtcc

SEQ ID NO: 1756966 - DNA, 22 bp, Homo sapiens
ccttcatcttcctgtgtcctga

SEQ ID NO: 1756967 - DNA, 17 bp, Homo sapiens
ccttcattccgttagga

SEQ ID NO: 1756968 - DNA, 19 bp, Homo sapiens
ccttcattctgagaccaaa

SEQ ID NO: 1756969 - DNA, 23 bp, Homo sapiens
ccttcattctgcaagtatactag

SEQ ID NO: 1756970 - DNA, 23 bp, Homo sapiens
ccttcattgccttaactggagcc

SEQ ID NO: 1756971 - DNA, 19 bp, Homo sapiens
ccttccaaaacctgcttcc

SEQ ID NO: 1756972 - DNA, 23 bp, Homo sapiens
ccttccaaaacctgcttccttca

SEQ ID NO: 1756973 - DNA, 14 bp, Homo sapiens
ccttccacctcagt

SEQ ID NO: 1756974 - DNA, 12 bp, Homo sapiens
ccttccacctcc

SEQ ID NO: 1756975 - DNA, 15 bp, Homo sapiens
ccttccactctggaa

SEQ ID NO: 1756976 - DNA, 13 bp, Homo sapiens
ccttccagacata

SEQ ID NO: 1756977 - DNA, 14 bp, Homo sapiens
ccttccagctgctg

SEQ ID NO: 1756978 - DNA, 19 bp, Homo sapiens
ccttccagggccctaggcc

SEQ ID NO: 1756979 - DNA, 18 bp, Homo sapiens
ccttccagggcctgagca

SEQ ID NO: 1756980 - DNA, 15 bp, Homo sapiens
ccttccaggtcagga

SEQ ID NO: 1756981 - DNA, 22 bp, Homo sapiens
ccttccatcagcgggtctcctc

SEQ ID NO: 1756982 - DNA, 24 bp, Homo sapiens
ccttccatccatctttccatccat

SEQ ID NO: 1756983 - DNA, 18 bp, Homo sapiens
ccttccatcttcacactg

SEQ ID NO: 1756984 - DNA, 18 bp, Homo sapiens
ccttccatcttgtggggc

SEQ ID NO: 1756985 - DNA, 18 bp, Homo sapiens
ccttccatgccccaggat

SEQ ID NO: 1756986 - DNA, 19 bp, Homo sapiens
ccttccatggtactgtagc

SEQ ID NO: 1756987 - DNA, 15 bp, Homo sapiens
ccttccatgtgcctt

SEQ ID NO: 1756988 - DNA, 17 bp, Homo sapiens
ccttccatgtgcctttc

SEQ ID NO: 1756989 - DNA, 12 bp, Homo sapiens
ccttccattcca

SEQ ID NO: 1756990 - DNA, 13 bp, Homo sapiens
ccttcccacccct

SEQ ID NO: 1756991 - DNA, 19 bp, Homo sapiens
ccttcccacctactgcact

SEQ ID NO: 1756992 - DNA, 13 bp, Homo sapiens
ccttcccagcaga

SEQ ID NO: 1756993 - DNA, 13 bp, Homo sapiens
ccttcccagctct

SEQ ID NO: 1756994 - DNA, 21 bp, Homo sapiens
ccttcccagctctccctctgg

SEQ ID NO: 1756995 - DNA, 20 bp, Homo sapiens
ccttcccaggccctttggct

SEQ ID NO: 1756996 - DNA, 18 bp, Homo sapiens
ccttcccatttcttccca

SEQ ID NO: 1756997 - DNA, 16 bp, Homo sapiens
ccttccccagacttgc

SEQ ID NO: 1756998 - DNA, 15 bp, Homo sapiens
ccttccccagcgtcc

SEQ ID NO: 1756999 - DNA, 12 bp, Homo sapiens
ccttccccaggc

SEQ ID NO: 1757000 - DNA, 14 bp, Homo sapiens
ccttccccaggccc

SEQ ID NO: 1757001 - DNA, 18 bp, Homo sapiens
ccttccccaggcccacca

SEQ ID NO: 1757002 - DNA, 21 bp, Homo sapiens
ccttcccccaccggtccagct

SEQ ID NO: 1757003 - DNA, 22 bp, Homo sapiens
ccttcccccaccggtccagctg

SEQ ID NO: 1757004 - DNA, 14 bp, Homo sapiens
ccttcccccagccc

SEQ ID NO: 1757005 - DNA, 17 bp, Homo sapiens
ccttccccctcccaggg

SEQ ID NO: 1757006 - DNA, 15 bp, Homo sapiens
ccttcccctccctgg

SEQ ID NO: 1757007 - DNA, 17 bp, Homo sapiens
ccttcccctccctggct

SEQ ID NO: 1757008 - DNA, 20 bp, Homo sapiens
ccttcccctgcacctggcct

SEQ ID NO: 1757009 - DNA, 22 bp, Homo sapiens
ccttcccctttactcagcccag

SEQ ID NO: 1757010 - DNA, 15 bp, Homo sapiens
ccttcccgccttcca

SEQ ID NO: 1757011 - DNA, 16 bp, Homo sapiens
ccttcccgccttccaa

SEQ ID NO: 1757012 - DNA, 14 bp, Homo sapiens
ccttccctccctga

SEQ ID NO: 1757013 - DNA, 15 bp, Homo sapiens
ccttccctccctgag

SEQ ID NO: 1757014 - DNA, 11 bp, Homo sapiens
ccttccctggc

SEQ ID NO: 1757015 - DNA, 15 bp, Homo sapiens
ccttccctgggctgt

SEQ ID NO: 1757016 - DNA, 16 bp, Homo sapiens
ccttcccttgagccct

SEQ ID NO: 1757017 - DNA, 12 bp, Homo sapiens
ccttcctcatcc

SEQ ID NO: 1757018 - DNA, 17 bp, Homo sapiens
ccttcctcatccacccc

SEQ ID NO: 1757019 - DNA, 15 bp, Homo sapiens
ccttcctccccacac

SEQ ID NO: 1757020 - DNA, 20 bp, Homo sapiens
ccttcctccccacactccac

SEQ ID NO: 1757021 - DNA, 16 bp, Homo sapiens
ccttcctcctccacag

SEQ ID NO: 1757022 - DNA, 17 bp, Homo sapiens
ccttcctcctccacagt

SEQ ID NO: 1757023 - DNA, 23 bp, Homo sapiens
ccttcctcctccacagtgctgct

SEQ ID NO: 1757024 - DNA, 20 bp, Homo sapiens
ccttcctctccactgccttc

SEQ ID NO: 1757025 - DNA, 15 bp, Homo sapiens
ccttcctctctccag

SEQ ID NO: 1757026 - DNA, 17 bp, Homo sapiens
ccttcctctctctacca

SEQ ID NO: 1757027 - DNA, 12 bp, Homo sapiens
ccttcctctgca

SEQ ID NO: 1757028 - DNA, 19 bp, Homo sapiens
cgaagcggagagagccaag

SEQ ID NO: 1757029 - DNA, 22 bp, Homo sapiens
cgaagcggagagagccaagacg

SEQ ID NO: 1757030 - DNA, 21 bp, Homo sapiens
cgaaggggaggcacactttct

SEQ ID NO: 1757031 - DNA, 22 bp, Homo sapiens
cgaaggggaggcacactttctg

SEQ ID NO: 1757032 - DNA, 16 bp, Homo sapiens
cgaaggggccccgggg

SEQ ID NO: 1757033 - DNA, 21 bp, Homo sapiens
cgaaggggccccggggctggc

SEQ ID NO: 1757034 - DNA, 16 bp, Homo sapiens
cgaaggtgcctcagac

SEQ ID NO: 1757035 - DNA, 17 bp, Homo sapiens
cgaaggtgcctcagact

SEQ ID NO: 1757036 - DNA, 23 bp, Homo sapiens
cgaagtctctttttttggcccag

SEQ ID NO: 1757037 - DNA, 12 bp, Homo sapiens
cgaatctctgtg

SEQ ID NO: 1757038 - DNA, 16 bp, Homo sapiens
cgaatctctgtgcctt

SEQ ID NO: 1757039 - DNA, 17 bp, Homo sapiens
cgaatgacggtaagtgt

SEQ ID NO: 1757040 - DNA, 15 bp, Homo sapiens
cgaatggtctttgct

SEQ ID NO: 1757041 - DNA, 15 bp, Homo sapiens
cgaatgtaattggaa

SEQ ID NO: 1757042 - DNA, 23 bp, Homo sapiens
cgaatgtgtacaacttaagttgg

SEQ ID NO: 1757043 - DNA, 19 bp, Homo sapiens
cgaattatttttttaaagt

SEQ ID NO: 1757044 - DNA, 12 bp, Homo sapiens
cgaattccactc

SEQ ID NO: 1757045 - DNA, 17 bp, Homo sapiens
cgaatttttcagatgat

SEQ ID NO: 1757046 - DNA, 15 bp, Homo sapiens
cgacaaaatctcctg

SEQ ID NO: 1757047 - DNA, 17 bp, Homo sapiens
cgacaaaatctcctggc

SEQ ID NO: 1757048 - DNA, 13 bp, Homo sapiens
cgacactgctgca

SEQ ID NO: 1757049 - DNA, 20 bp, Homo sapiens
cgacactgctgcaccagagt

SEQ ID NO: 1757050 - DNA, 15 bp, Homo sapiens
cgacagagagagggg

SEQ ID NO: 1757051 - DNA, 20 bp, Homo sapiens
cgacagagcgagactccatc

SEQ ID NO: 1757052 - DNA, 20 bp, Homo sapiens
cgacagcattttaaggttct

SEQ ID NO: 1757053 - DNA, 16 bp, Homo sapiens
cgacagtgccatcccc

SEQ ID NO: 1757054 - DNA, 18 bp, Homo sapiens
cgacatcccagaccagcc

SEQ ID NO: 1757055 - DNA, 22 bp, Homo sapiens
cgacatccgtcattgctgctgc

SEQ ID NO: 1757056 - DNA, 23 bp, Homo sapiens
cgacatccgtcattgctgctgct

SEQ ID NO: 1757057 - DNA, 15 bp, Homo sapiens
cgaccaactgcccta

SEQ ID NO: 1757058 - DNA, 12 bp, Homo sapiens
cgaccacaccag

SEQ ID NO: 1757059 - DNA, 14 bp, Homo sapiens
cgaccaggctggac

SEQ ID NO: 1757060 - DNA, 19 bp, Homo sapiens
cgaccaggctggacaccct

SEQ ID NO: 1757061 - DNA, 16 bp, Homo sapiens
cgaccccccgtgggct

SEQ ID NO: 1757062 - DNA, 13 bp, Homo sapiens
cgaccctcatggc

SEQ ID NO: 1757063 - DNA, 19 bp, Homo sapiens
cgaccctcatggcccccag

SEQ ID NO: 1757064 - DNA, 22 bp, Homo sapiens
cgaccctcatggcccccagggg

SEQ ID NO: 1757065 - DNA, 12 bp, Homo sapiens
cgaccctgccct

SEQ ID NO: 1757066 - DNA, 12 bp, Homo sapiens
cgaccctggggg

SEQ ID NO: 1757067 - DNA, 17 bp, Homo sapiens
cgaccctgggggcacag

SEQ ID NO: 1757068 - DNA, 23 bp, Homo sapiens
cgaccctgggggcacaggaggca

SEQ ID NO: 1757069 - DNA, 15 bp, Homo sapiens
cgacctcagccttcc

SEQ ID NO: 1757070 - DNA, 16 bp, Homo sapiens
cgacctccccacccgc

SEQ ID NO: 1757071 - DNA, 14 bp, Homo sapiens
cgacctcgtcctcc

SEQ ID NO: 1757072 - DNA, 12 bp, Homo sapiens
cgacgcccaccc

SEQ ID NO: 1757073 - DNA, 14 bp, Homo sapiens
cgacgcccacccaa

SEQ ID NO: 1757074 - DNA, 14 bp, Homo sapiens
cgacgtcagcctct

SEQ ID NO: 1757075 - DNA, 16 bp, Homo sapiens
cgactctggccctggc

SEQ ID NO: 1757076 - DNA, 23 bp, Homo sapiens
cgactctgtgcctccctccccag

SEQ ID NO: 1757077 - DNA, 11 bp, Homo sapiens
cgactgcctgt

SEQ ID NO: 1757078 - DNA, 15 bp, Homo sapiens
cgactggtccagctc

SEQ ID NO: 1757079 - DNA, 19 bp, Homo sapiens
cgactggtccagctctgac

SEQ ID NO: 1757080 - DNA, 18 bp, Homo sapiens
cgacttcccctgggcaag

SEQ ID NO: 1757081 - DNA, 22 bp, Homo sapiens
cgacttgaatattcctggactt

SEQ ID NO: 1757082 - DNA, 16 bp, Homo sapiens
cgacttggagactcct

SEQ ID NO: 1757083 - DNA, 19 bp, Homo sapiens
cgacttgtttttgcacatg

SEQ ID NO: 1757084 - DNA, 14 bp, Homo sapiens
cgactttctgcctg

SEQ ID NO: 1757085 - DNA, 15 bp, Homo sapiens
cgactttctgcctgg

SEQ ID NO: 1757086 - DNA, 16 bp, Homo sapiens
cgactttctgcctgga

SEQ ID NO: 1757087 - DNA, 19 bp, Homo sapiens
cgagaaagaggcaccagga

SEQ ID NO: 1757088 - DNA, 21 bp, Homo sapiens
cgagaaagaggcaccaggaag

SEQ ID NO: 1757089 - DNA, 22 bp, Homo sapiens
cgagaaccctgagcagggtcca

SEQ ID NO: 1757090 - DNA, 15 bp, Homo sapiens
cgagaaggggaaaaa

SEQ ID NO: 1757091 - DNA, 23 bp, Homo sapiens
cgagaaggggaaaaatgggaaat

SEQ ID NO: 1757092 - DNA, 14 bp, Homo sapiens
cgagacacttgcct

SEQ ID NO: 1757093 - DNA, 17 bp, Homo sapiens
cgagaccatcctggccc

SEQ ID NO: 1757094 - DNA, 12 bp, Homo sapiens
cgagacccccat

SEQ ID NO: 1757095 - DNA, 13 bp, Homo sapiens
cgagacccccatc

SEQ ID NO: 1757096 - DNA, 19 bp, Homo sapiens
cgagacccccatccagcct

SEQ ID NO: 1757097 - DNA, 20 bp, Homo sapiens
cgagaccccggcttcctttc

SEQ ID NO: 1757098 - DNA, 12 bp, Homo sapiens
cgagactggtct

SEQ ID NO: 1757099 - DNA, 18 bp, Homo sapiens
cgagacttggtttcaaaa

SEQ ID NO: 1757100 - DNA, 17 bp, Homo sapiens
cgagagatcaaagatga

SEQ ID NO: 1757101 - DNA, 20 bp, Homo sapiens
cgagagcctgctcccccacc

SEQ ID NO: 1757102 - DNA, 22 bp, Homo sapiens
cgagagcttggactacacaata

SEQ ID NO: 1757103 - DNA, 14 bp, Homo sapiens
cgagagggagagag

SEQ ID NO: 1757104 - DNA, 20 bp, Homo sapiens
cgagaggtgggccagtctgt

SEQ ID NO: 1757105 - DNA, 23 bp, Homo sapiens
cgagaggtgggccagtctgtgga

SEQ ID NO: 1757106 - DNA, 20 bp, Homo sapiens
cgagatcacgccactgcact

SEQ ID NO: 1757107 - DNA, 22 bp, Homo sapiens
cgagatccccagggcagcctgg

SEQ ID NO: 1757108 - DNA, 16 bp, Homo sapiens
cgagatcgggaagcag

SEQ ID NO: 1757109 - DNA, 18 bp, Homo sapiens
cgagatcgggaagcagaa

SEQ ID NO: 1757110 - DNA, 16 bp, Homo sapiens
cgagatcggggtagaa

SEQ ID NO: 1757111 - DNA, 20 bp, Homo sapiens
cgagcaaacccagaggtgga

SEQ ID NO: 1757112 - DNA, 13 bp, Homo sapiens
cgagcagcccagg

SEQ ID NO: 1757113 - DNA, 17 bp, Homo sapiens
cgagcagcccagggcct

SEQ ID NO: 1757114 - DNA, 19 bp, Homo sapiens
cgagcagcccagggcctag

SEQ ID NO: 1757115 - DNA, 15 bp, Homo sapiens
cgagcagtcctgcct

SEQ ID NO: 1757116 - DNA, 21 bp, Homo sapiens
cgagcatcccccaaagttcac

SEQ ID NO: 1757117 - DNA, 22 bp, Homo sapiens
cgagcatgggggctgccagcgt

SEQ ID NO: 1757118 - DNA, 15 bp, Homo sapiens
cgagcatgtcgtgga

SEQ ID NO: 1757119 - DNA, 19 bp, Homo sapiens
cgagcccagctacattcct

SEQ ID NO: 1757120 - DNA, 12 bp, Homo sapiens
cgagcccctcct

SEQ ID NO: 1757121 - DNA, 13 bp, Homo sapiens
cgagcccctcctt

SEQ ID NO: 1757122 - DNA, 20 bp, Homo sapiens
cgagcccctccttctcccct

SEQ ID NO: 1757123 - DNA, 14 bp, Homo sapiens
cgagcccctcggct

SEQ ID NO: 1757124 - DNA, 15 bp, Homo sapiens
cgagccgggcctggg

SEQ ID NO: 1757125 - DNA, 14 bp, Homo sapiens
cgagcctaatgaaa

SEQ ID NO: 1757126 - DNA, 15 bp, Homo sapiens
cgagcctaatgaaag

SEQ ID NO: 1757127 - DNA, 19 bp, Homo sapiens
cgagcggcaaaggcccggc

SEQ ID NO: 1757128 - DNA, 10 bp, Homo sapiens
cgagctcctc

SEQ ID NO: 1757129 - DNA, 19 bp, Homo sapiens
cgagctcgtgtatcctggg

SEQ ID NO: 1757130 - DNA, 22 bp, Homo sapiens
cgagctctcaaatccctctcca

SEQ ID NO: 1757131 - DNA, 14 bp, Homo sapiens
cgagctctggtgct

SEQ ID NO: 1757132 - DNA, 15 bp, Homo sapiens
cgagctgtaggagag

SEQ ID NO: 1757133 - DNA, 17 bp, Homo sapiens
cgaggaactcgcctcag

SEQ ID NO: 1757134 - DNA, 12 bp, Homo sapiens
cgaggacacagt

SEQ ID NO: 1757135 - DNA, 15 bp, Homo sapiens
cgaggaccaccagca

SEQ ID NO: 1757136 - DNA, 16 bp, Homo sapiens
cgaggaccaccagcag

SEQ ID NO: 1757137 - DNA, 13 bp, Homo sapiens
cgaggagctgggc

SEQ ID NO: 1757138 - DNA, 12 bp, Homo sapiens
cgaggagtaaca

SEQ ID NO: 1757139 - DNA, 14 bp, Homo sapiens
cgaggagtaacaat

SEQ ID NO: 1757140 - DNA, 21 bp, Homo sapiens
cgaggagtaacaatacaaatg

SEQ ID NO: 1757141 - DNA, 14 bp, Homo sapiens
cgaggattttaatt

SEQ ID NO: 1757142 - DNA, 23 bp, Homo sapiens
cgaggattttaattttttttagt

SEQ ID NO: 1757143 - DNA, 20 bp, Homo sapiens
cgccgccttggccttgcagc

SEQ ID NO: 1757144 - DNA, 22 bp, Homo sapiens
cgccgcgccagtccccgctagt

SEQ ID NO: 1757145 - DNA, 22 bp, Homo sapiens
cgccgtaattctttctgtctcc

SEQ ID NO: 1757146 - DNA, 23 bp, Homo sapiens
cgccgtaattctttctgtctccc

SEQ ID NO: 1757147 - DNA, 14 bp, Homo sapiens
cgccgtgggctgcg

SEQ ID NO: 1757148 - DNA, 15 bp, Homo sapiens
cgcctactgtccctc

SEQ ID NO: 1757149 - DNA, 21 bp, Homo sapiens
cgcctagtggggtctccctct

SEQ ID NO: 1757150 - DNA, 16 bp, Homo sapiens
cgcctataatcccagc

SEQ ID NO: 1757151 - DNA, 18 bp, Homo sapiens
cgcctataatcccagcta

SEQ ID NO: 1757152 - DNA, 16 bp, Homo sapiens
cgcctcaccagccccc

SEQ ID NO: 1757153 - DNA, 15 bp, Homo sapiens
cgcctccactctagt

SEQ ID NO: 1757154 - DNA, 13 bp, Homo sapiens
cgcctccaggagc

SEQ ID NO: 1757155 - DNA, 14 bp, Homo sapiens
cgcctcccacggca

SEQ ID NO: 1757156 - DNA, 15 bp, Homo sapiens
cgcctcccacggcac

SEQ ID NO: 1757157 - DNA, 16 bp, Homo sapiens
cgcctcccctgcccca

SEQ ID NO: 1757158 - DNA, 15 bp, Homo sapiens
cgcctccctctcaga

SEQ ID NO: 1757159 - DNA, 18 bp, Homo sapiens
cgcctcgacctccccacc

SEQ ID NO: 1757160 - DNA, 22 bp, Homo sapiens
cgcctcgacctccccacccgct

SEQ ID NO: 1757161 - DNA, 18 bp, Homo sapiens
cgcctcggtatctggctt

SEQ ID NO: 1757162 - DNA, 15 bp, Homo sapiens
cgcctcgtgccagca

SEQ ID NO: 1757163 - DNA, 18 bp, Homo sapiens
cgcctcgtgccagcagcc

SEQ ID NO: 1757164 - DNA, 16 bp, Homo sapiens
cgcctctggccgccac

SEQ ID NO: 1757165 - DNA, 18 bp, Homo sapiens
cgcctctggccgccaccc

SEQ ID NO: 1757166 - DNA, 16 bp, Homo sapiens
cgcctctgtctggagc

SEQ ID NO: 1757167 - DNA, 19 bp, Homo sapiens
cgcctcttcttcttcagaa

SEQ ID NO: 1757168 - DNA, 15 bp, Homo sapiens
cgcctctttcaagca

SEQ ID NO: 1757169 - DNA, 20 bp, Homo sapiens
cgcctgacaaccactggtct

SEQ ID NO: 1757170 - DNA, 21 bp, Homo sapiens
cgcctgacaaccactggtctg

SEQ ID NO: 1757171 - DNA, 21 bp, Homo sapiens
cgcctgagcccaggaggtgga

SEQ ID NO: 1757172 - DNA, 17 bp, Homo sapiens
cgcctgagtcagtgctc

SEQ ID NO: 1757173 - DNA, 21 bp, Homo sapiens
cgcctgagtcagtgctctcag

SEQ ID NO: 1757174 - DNA, 22 bp, Homo sapiens
cgcctgagtcagtgctctcagc

SEQ ID NO: 1757175 - DNA, 11 bp, Homo sapiens
cgcctgccatc

SEQ ID NO: 1757176 - DNA, 20 bp, Homo sapiens
cgcctgccatcttctccccg

SEQ ID NO: 1757177 - DNA, 22 bp, Homo sapiens
cgcctgccctcatggcccctct

SEQ ID NO: 1757178 - DNA, 13 bp, Homo sapiens
cgcctgccctccc

SEQ ID NO: 1757179 - DNA, 23 bp, Homo sapiens
cgcctgccgtgcatggctcctgt

SEQ ID NO: 1757180 - DNA, 15 bp, Homo sapiens
cgcctgcctctgcct

SEQ ID NO: 1757181 - DNA, 23 bp, Homo sapiens
cgcctgctcctcactggaggagc

SEQ ID NO: 1757182 - DNA, 12 bp, Homo sapiens
cgcctggcaggt

SEQ ID NO: 1757183 - DNA, 18 bp, Homo sapiens
cgcctggccaggagcagg

SEQ ID NO: 1757184 - DNA, 14 bp, Homo sapiens
cgcctggccggctc

SEQ ID NO: 1757185 - DNA, 17 bp, Homo sapiens
cgcctggccggctccag

SEQ ID NO: 1757186 - DNA, 19 bp, Homo sapiens
cgcctggctgcagcctgcg

SEQ ID NO: 1757187 - DNA, 17 bp, Homo sapiens
cgcctgggcaccgggac

SEQ ID NO: 1757188 - DNA, 17 bp, Homo sapiens
cgcctgtaatcccagca

SEQ ID NO: 1757189 - DNA, 18 bp, Homo sapiens
cgcctgtaatcccagcac

SEQ ID NO: 1757190 - DNA, 20 bp, Homo sapiens
cgcctgtaatcccagcactt

SEQ ID NO: 1757191 - DNA, 15 bp, Homo sapiens
cgcctgtgatgctgg

SEQ ID NO: 1757192 - DNA, 12 bp, Homo sapiens
cgccttaaactc

SEQ ID NO: 1757193 - DNA, 21 bp, Homo sapiens
cgccttccaaaacctgcttcc

SEQ ID NO: 1757194 - DNA, 18 bp, Homo sapiens
cgccttctcggagctggc

SEQ ID NO: 1757195 - DNA, 11 bp, Homo sapiens
cgccttggcct

SEQ ID NO: 1757196 - DNA, 13 bp, Homo sapiens
cgcctttgtcttg

SEQ ID NO: 1757197 - DNA, 18 bp, Homo sapiens
cgcgaggggaaaggcctg

SEQ ID NO: 1757198 - DNA, 15 bp, Homo sapiens
cgcgatctcagctca

SEQ ID NO: 1757199 - DNA, 22 bp, Homo sapiens
cgcgcatgtaatcccagctact

SEQ ID NO: 1757200 - DNA, 23 bp, Homo sapiens
cgcgccactacactccagcctga

SEQ ID NO: 1757201 - DNA, 16 bp, Homo sapiens
cgcgcccagcagaggc

SEQ ID NO: 1757202 - DNA, 21 bp, Homo sapiens
cgcgcgcccaccctccggcgg

SEQ ID NO: 1757203 - DNA, 19 bp, Homo sapiens
cgcgcgtccccctgccggc

SEQ ID NO: 1757204 - DNA, 16 bp, Homo sapiens
cgcgctcgcccagcag

SEQ ID NO: 1757205 - DNA, 14 bp, Homo sapiens
cgcgcttccctggg

SEQ ID NO: 1757206 - DNA, 21 bp, Homo sapiens
cgcggccagcgtcccagggta

SEQ ID NO: 1757207 - DNA, 21 bp, Homo sapiens
cgcggccaggcacccatgtgg

SEQ ID NO: 1757208 - DNA, 21 bp, Homo sapiens
cgcggccctcagtagtccctg

SEQ ID NO: 1757209 - DNA, 13 bp, Homo sapiens
cgcggccgcccgc

SEQ ID NO: 1757210 - DNA, 18 bp, Homo sapiens
cgcggctcaaaaggaaac

SEQ ID NO: 1757211 - DNA, 22 bp, Homo sapiens
cgcggctcccggggcagggcag

SEQ ID NO: 1757212 - DNA, 17 bp, Homo sapiens
cgcgggcagcgggccag

SEQ ID NO: 1757213 - DNA, 17 bp, Homo sapiens
cgcgggcccctcacctg

SEQ ID NO: 1757214 - DNA, 13 bp, Homo sapiens
cgcggtgctctgg

SEQ ID NO: 1757215 - DNA, 16 bp, Homo sapiens
cgcggtgctctggcgg

SEQ ID NO: 1757216 - DNA, 22 bp, Homo sapiens
cgcggtggcatgcatggaggac

SEQ ID NO: 1757217 - DNA, 12 bp, Homo sapiens
cgcgtccctgcc

SEQ ID NO: 1757218 - DNA, 15 bp, Homo sapiens
cgctaaagagccctt

SEQ ID NO: 1757219 - DNA, 13 bp, Homo sapiens
cgctacctccctc

SEQ ID NO: 1757220 - DNA, 16 bp, Homo sapiens
cgctatgggaggcagc

SEQ ID NO: 1757221 - DNA, 22 bp, Homo sapiens
cgctcacctttgtttagaacac

SEQ ID NO: 1757222 - DNA, 17 bp, Homo sapiens
cgctcagacggcggcca

SEQ ID NO: 1757223 - DNA, 19 bp, Homo sapiens
cgctcagacggcggccagg

SEQ ID NO: 1757224 - DNA, 22 bp, Homo sapiens
cgctcagacggcggccaggcac

SEQ ID NO: 1757225 - DNA, 13 bp, Homo sapiens
cgctcagcccagc

SEQ ID NO: 1757226 - DNA, 17 bp, Homo sapiens
cgctcaggacccaggcc

SEQ ID NO: 1757227 - DNA, 19 bp, Homo sapiens
cgctcaggacccaggccct

SEQ ID NO: 1757228 - DNA, 18 bp, Homo sapiens
cgctcccaacccccctcc

SEQ ID NO: 1757229 - DNA, 14 bp, Homo sapiens
cgctcccaccgccc

SEQ ID NO: 1757230 - DNA, 15 bp, Homo sapiens
cgctcccaccgcccc

SEQ ID NO: 1757231 - DNA, 17 bp, Homo sapiens
cgctcccaccgccccca

SEQ ID NO: 1757232 - DNA, 15 bp, Homo sapiens
cgctcccacctagtg

SEQ ID NO: 1757233 - DNA, 19 bp, Homo sapiens
cgctcccacctagtgcccc

SEQ ID NO: 1757234 - DNA, 16 bp, Homo sapiens
cgctcccactcagaac

SEQ ID NO: 1757235 - DNA, 24 bp, Homo sapiens
cgctcccaggttcccccagcaagc

SEQ ID NO: 1757236 - DNA, 15 bp, Homo sapiens
cgctccccacctacc

SEQ ID NO: 1757237 - DNA, 15 bp, Homo sapiens
cgctcccgctcccag

SEQ ID NO: 1757238 - DNA, 16 bp, Homo sapiens
cgctcccgctcccagg

SEQ ID NO: 1757239 - DNA, 20 bp, Homo sapiens
cgctccctgtagctctgcct

SEQ ID NO: 1757240 - DNA, 18 bp, Homo sapiens
cgctcccttcctgccact

SEQ ID NO: 1757241 - DNA, 15 bp, Homo sapiens
cgctccgtctctgtc

SEQ ID NO: 1757242 - DNA, 23 bp, Homo sapiens
cgctcctcgggaaacacacaagc

SEQ ID NO: 1757243 - DNA, 15 bp, Homo sapiens
cgctcctgccgcaga

SEQ ID NO: 1757244 - DNA, 16 bp, Homo sapiens
cgctcctgccgcagac

SEQ ID NO: 1757245 - DNA, 22 bp, Homo sapiens
cgctcctgccgcagacgggcac

SEQ ID NO: 1757246 - DNA, 20 bp, Homo sapiens
cgctcctgccgcagagctgg

SEQ ID NO: 1757247 - DNA, 14 bp, Homo sapiens
cgctcctgtctgcc

SEQ ID NO: 1757248 - DNA, 17 bp, Homo sapiens
cgctcctgtctgccagc

SEQ ID NO: 1757249 - DNA, 21 bp, Homo sapiens
cgctcctgtctgccagccagc

SEQ ID NO: 1757250 - DNA, 13 bp, Homo sapiens
cgctcgcccagca

SEQ ID NO: 1757251 - DNA, 14 bp, Homo sapiens
cgctcgcccagcag

SEQ ID NO: 1757252 - DNA, 18 bp, Homo sapiens
cgctcgcccagcaggaga

SEQ ID NO: 1757253 - DNA, 15 bp, Homo sapiens
cgctcgcgggcagcg

SEQ ID NO: 1757254 - DNA, 17 bp, Homo sapiens
cgctctccctaccttgc

SEQ ID NO: 1757255 - DNA, 16 bp, Homo sapiens
cgctctccctgtcacg

SEQ ID NO: 1757256 - DNA, 21 bp, Homo sapiens
cgctctctctcgctgcgtcct

SEQ ID NO: 1757257 - DNA, 12 bp, Homo sapiens
cgctctctctga

SEQ ID NO: 1757258 - DNA, 13 bp, Homo sapiens
cggggggagggtt

SEQ ID NO: 1757259 - DNA, 15 bp, Homo sapiens
cggggggctctgcct

SEQ ID NO: 1757260 - DNA, 17 bp, Homo sapiens
cggggtattcccactca

SEQ ID NO: 1757261 - DNA, 13 bp, Homo sapiens
cggggtctcctgg

SEQ ID NO: 1757262 - DNA, 23 bp, Homo sapiens
cggggtctgtgctgtgcctgcta

SEQ ID NO: 1757263 - DNA, 23 bp, Homo sapiens
cggggtgagtccattctcccagg

SEQ ID NO: 1757264 - DNA, 18 bp, Homo sapiens
cggggtgtaacttcctgc

SEQ ID NO: 1757265 - DNA, 20 bp, Homo sapiens
cggggttccccacacagggc

SEQ ID NO: 1757266 - DNA, 17 bp, Homo sapiens
cggggttgtctgcagga

SEQ ID NO: 1757267 - DNA, 17 bp, Homo sapiens
cgggtccagagaccaca

SEQ ID NO: 1757268 - DNA, 23 bp, Homo sapiens
cgggtccaggagaagtgctccct

SEQ ID NO: 1757269 - DNA, 19 bp, Homo sapiens
cgggtccccagctccccag

SEQ ID NO: 1757270 - DNA, 20 bp, Homo sapiens
cgggtccccagctccccagg

SEQ ID NO: 1757271 - DNA, 17 bp, Homo sapiens
cgggtcccggccgcgcc

SEQ ID NO: 1757272 - DNA, 18 bp, Homo sapiens
cgggtctcctcccagcgg

SEQ ID NO: 1757273 - DNA, 21 bp, Homo sapiens
cgggtctcctcccagcggcct

SEQ ID NO: 1757274 - DNA, 19 bp, Homo sapiens
cgggtggatcacctgaggt

SEQ ID NO: 1757275 - DNA, 14 bp, Homo sapiens
cgggtgggcctggc

SEQ ID NO: 1757276 - DNA, 16 bp, Homo sapiens
cgggtggggcttgggg

SEQ ID NO: 1757277 - DNA, 20 bp, Homo sapiens
cgggtggggcttggggctca

SEQ ID NO: 1757278 - DNA, 21 bp, Homo sapiens
cgggttttattgtttaaaatc

SEQ ID NO: 1757279 - DNA, 14 bp, Homo sapiens
cggtaactgtcctg

SEQ ID NO: 1757280 - DNA, 18 bp, Homo sapiens
cggtaactgtcctgtcct

SEQ ID NO: 1757281 - DNA, 18 bp, Homo sapiens
cggtatccccccatcttg

SEQ ID NO: 1757282 - DNA, 21 bp, Homo sapiens
cggtatctggcttccctggaa

SEQ ID NO: 1757283 - DNA, 18 bp, Homo sapiens
cggtattaaaatggagcg

SEQ ID NO: 1757284 - DNA, 23 bp, Homo sapiens
cggtcatgcttttgccactttgg

SEQ ID NO: 1757285 - DNA, 17 bp, Homo sapiens
cggtcatgtgtgcatgt

SEQ ID NO: 1757286 - DNA, 21 bp, Homo sapiens
cggtcccttgagacctcagcc

SEQ ID NO: 1757287 - DNA, 22 bp, Homo sapiens
cggtcccttgagacctcagcca

SEQ ID NO: 1757288 - DNA, 16 bp, Homo sapiens
cggtcgggcagccagc

SEQ ID NO: 1757289 - DNA, 22 bp, Homo sapiens
cggtcgggttttattgtttaaa

SEQ ID NO: 1757290 - DNA, 16 bp, Homo sapiens
cggtctgacagtcctt

SEQ ID NO: 1757291 - DNA, 15 bp, Homo sapiens
cggtgcacaggcctc

SEQ ID NO: 1757292 - DNA, 17 bp, Homo sapiens
cggtgcagctgaggttc

SEQ ID NO: 1757293 - DNA, 16 bp, Homo sapiens
cggtgccaagggcccc

SEQ ID NO: 1757294 - DNA, 19 bp, Homo sapiens
cggtgccatgtctgcagtg

SEQ ID NO: 1757295 - DNA, 23 bp, Homo sapiens
cggtgcccaaacaccagtcacct

SEQ ID NO: 1757296 - DNA, 15 bp, Homo sapiens
cggtgcccaagccag

SEQ ID NO: 1757297 - DNA, 13 bp, Homo sapiens
cggtgcccacacc

SEQ ID NO: 1757298 - DNA, 11 bp, Homo sapiens
cggtgcctggc

SEQ ID NO: 1757299 - DNA, 19 bp, Homo sapiens
cggtgcctgggtggggctg

SEQ ID NO: 1757300 - DNA, 20 bp, Homo sapiens
cggtgcgtggctgtggcaca

SEQ ID NO: 1757301 - DNA, 19 bp, Homo sapiens
cggtgctaaaaatgaaaat

SEQ ID NO: 1757302 - DNA, 22 bp, Homo sapiens
cggtgctcactcccaagggaca

SEQ ID NO: 1757303 - DNA, 11 bp, Homo sapiens
cggtgctctgg

SEQ ID NO: 1757304 - DNA, 15 bp, Homo sapiens
cggtgctctggcggc

SEQ ID NO: 1757305 - DNA, 13 bp, Homo sapiens
cggtgctgcagga

SEQ ID NO: 1757306 - DNA, 19 bp, Homo sapiens
cggtgctgggttcccactc

SEQ ID NO: 1757307 - DNA, 13 bp, Homo sapiens
cggtggaccaaag

SEQ ID NO: 1757308 - DNA, 17 bp, Homo sapiens
cggtggcatgcatggag

SEQ ID NO: 1757309 - DNA, 19 bp, Homo sapiens
cggtggcatgcatggagga

SEQ ID NO: 1757310 - DNA, 15 bp, Homo sapiens
cggtggcgggcacct

SEQ ID NO: 1757311 - DNA, 13 bp, Homo sapiens
cggtggctgcccc

SEQ ID NO: 1757312 - DNA, 17 bp, Homo sapiens
cggtggctgccccggcc

SEQ ID NO: 1757313 - DNA, 14 bp, Homo sapiens
cggtggctgggcag

SEQ ID NO: 1757314 - DNA, 19 bp, Homo sapiens
cggtgggtccgcatccctg

SEQ ID NO: 1757315 - DNA, 16 bp, Homo sapiens
cggtggtttgccatgt

SEQ ID NO: 1757316 - DNA, 20 bp, Homo sapiens
cggtggtttgccatgtcgct

SEQ ID NO: 1757317 - DNA, 20 bp, Homo sapiens
cggtgtccaccatccccagc

SEQ ID NO: 1757318 - DNA, 16 bp, Homo sapiens
cggtgtgctgccaact

SEQ ID NO: 1757319 - DNA, 16 bp, Homo sapiens
cggtgtgggctgtgtc

SEQ ID NO: 1757320 - DNA, 18 bp, Homo sapiens
cggtgttaattttgctaa

SEQ ID NO: 1757321 - DNA, 19 bp, Homo sapiens
cggtgtttggcaatgctaa

SEQ ID NO: 1757322 - DNA, 14 bp, Homo sapiens
cggttaaattccat

SEQ ID NO: 1757323 - DNA, 16 bp, Homo sapiens
cggttaacttgtatat

SEQ ID NO: 1757324 - DNA, 17 bp, Homo sapiens
cggttaacttgtatatt

SEQ ID NO: 1757325 - DNA, 20 bp, Homo sapiens
cggttatgaaattcaccccc

SEQ ID NO: 1757326 - DNA, 16 bp, Homo sapiens
cggttcaccagcctct

SEQ ID NO: 1757327 - DNA, 16 bp, Homo sapiens
cggttcagacccctgc

SEQ ID NO: 1757328 - DNA, 14 bp, Homo sapiens
cggttcctcatctg

SEQ ID NO: 1757329 - DNA, 18 bp, Homo sapiens
cggttgtttagaaacaga

SEQ ID NO: 1757330 - DNA, 16 bp, Homo sapiens
cggtttccacttgtgg

SEQ ID NO: 1757331 - DNA, 20 bp, Homo sapiens
cggtttccagggaggggccg

SEQ ID NO: 1757332 - DNA, 13 bp, Homo sapiens
cggtttttattaa

SEQ ID NO: 1757333 - DNA, 20 bp, Homo sapiens
cgtaaatacacaacacacac

SEQ ID NO: 1757334 - DNA, 15 bp, Homo sapiens
cgtaatagcttctgt

SEQ ID NO: 1757335 - DNA, 14 bp, Homo sapiens
cgtaatcccagcta

SEQ ID NO: 1757336 - DNA, 17 bp, Homo sapiens
cgtaatgcattgcctgt

SEQ ID NO: 1757337 - DNA, 18 bp, Homo sapiens
cgtaatgcattgcctgta

SEQ ID NO: 1757338 - DNA, 16 bp, Homo sapiens
cgtaatgggcctgccc

SEQ ID NO: 1757339 - DNA, 12 bp, Homo sapiens
cgtaatttaact

SEQ ID NO: 1757340 - DNA, 23 bp, Homo sapiens
cgtacaaaactctgtataagttg

SEQ ID NO: 1757341 - DNA, 11 bp, Homo sapiens
cgtacacagag

SEQ ID NO: 1757342 - DNA, 12 bp, Homo sapiens
cgtacacagaga

SEQ ID NO: 1757343 - DNA, 14 bp, Homo sapiens
cgtacatctgcaat

SEQ ID NO: 1757344 - DNA, 17 bp, Homo sapiens
cgtactacccagctctg

SEQ ID NO: 1757345 - DNA, 21 bp, Homo sapiens
cgtactaggttggacagcccc

SEQ ID NO: 1757346 - DNA, 22 bp, Homo sapiens
cgtacttagcagctatctctca

SEQ ID NO: 1757347 - DNA, 22 bp, Homo sapiens
cgtagcctgggctcactgtgct

SEQ ID NO: 1757348 - DNA, 20 bp, Homo sapiens
cgtagcgtgcccgtgtgcat

SEQ ID NO: 1757349 - DNA, 11 bp, Homo sapiens
cgtagctgcca

SEQ ID NO: 1757350 - DNA, 18 bp, Homo sapiens
cgtaggacgcatgaaggt

SEQ ID NO: 1757351 - DNA, 21 bp, Homo sapiens
cgtaggatgaaaagattcttc

SEQ ID NO: 1757352 - DNA, 20 bp, Homo sapiens
cgtagggagtacctgctgcc

SEQ ID NO: 1757353 - DNA, 16 bp, Homo sapiens
cgtaggggctcctgag

SEQ ID NO: 1757354 - DNA, 20 bp, Homo sapiens
cgtagggtggcactgggagg

SEQ ID NO: 1757355 - DNA, 12 bp, Homo sapiens
cgtaggtaaact

SEQ ID NO: 1757356 - DNA, 20 bp, Homo sapiens
cgtagtccatcaccatttct

SEQ ID NO: 1757357 - DNA, 14 bp, Homo sapiens
cgtagttccctgaa

SEQ ID NO: 1757358 - DNA, 22 bp, Homo sapiens
cgtagttccctgaaaacccaga

SEQ ID NO: 1757359 - DNA, 22 bp, Homo sapiens
cgtagttggcaggagctcctgg

SEQ ID NO: 1757360 - DNA, 14 bp, Homo sapiens
cgtataaatatcag

SEQ ID NO: 1757361 - DNA, 22 bp, Homo sapiens
cgtataaatatcagtattctga

SEQ ID NO: 1757362 - DNA, 19 bp, Homo sapiens
cgtataggatgtcagacaa

SEQ ID NO: 1757363 - DNA, 18 bp, Homo sapiens
cgtatattgtatcatttg

SEQ ID NO: 1757364 - DNA, 22 bp, Homo sapiens
cgtatgatcagtactgactttc

SEQ ID NO: 1757365 - DNA, 14 bp, Homo sapiens
cgtatgcactccct

SEQ ID NO: 1757366 - DNA, 20 bp, Homo sapiens
cgtatgcactcccttgagga

SEQ ID NO: 1757367 - DNA, 16 bp, Homo sapiens
cgtatttatatttgga

SEQ ID NO: 1757368 - DNA, 19 bp, Homo sapiens
cgtcaccatccaccttccc

SEQ ID NO: 1757369 - DNA, 14 bp, Homo sapiens
cgtcactccagtgc

SEQ ID NO: 1757370 - DNA, 23 bp, Homo sapiens
cgtcactccagtgctcagctgtg

SEQ ID NO: 1757371 - DNA, 17 bp, Homo sapiens
cgtcagaagcacccagg

SEQ ID NO: 1757372 - DNA, 11 bp, Homo sapiens
cgttgcttccc

SEQ ID NO: 1757373 - DNA, 14 bp, Homo sapiens
cgttgcttcccgct

SEQ ID NO: 1757374 - DNA, 18 bp, Homo sapiens
cgttggacttttcgttaa

SEQ ID NO: 1757375 - DNA, 23 bp, Homo sapiens
cgttggacttttcgttaacattg

SEQ ID NO: 1757376 - DNA, 15 bp, Homo sapiens
cgttgggagcctagc

SEQ ID NO: 1757377 - DNA, 18 bp, Homo sapiens
cgttgtgttttttaagat

SEQ ID NO: 1757378 - DNA, 23 bp, Homo sapiens
cgtttagtgagttcgttttggag

SEQ ID NO: 1757379 - DNA, 20 bp, Homo sapiens
cgtttattaatgcctctccc

SEQ ID NO: 1757380 - DNA, 18 bp, Homo sapiens
cgtttctccacctagact

SEQ ID NO: 1757381 - DNA, 22 bp, Homo sapiens
cgtttctccacctagactgtaa

SEQ ID NO: 1757382 - DNA, 16 bp, Homo sapiens
cgtttctccttttcct

SEQ ID NO: 1757383 - DNA, 17 bp, Homo sapiens
cgtttctccttttccta

SEQ ID NO: 1757384 - DNA, 13 bp, Homo sapiens
cgtttcttcctgc

SEQ ID NO: 1757385 - DNA, 16 bp, Homo sapiens
cgtttgcaccgcctgc

SEQ ID NO: 1757386 - DNA, 20 bp, Homo sapiens
cgtttgcaccgcctgccctc

SEQ ID NO: 1757387 - DNA, 13 bp, Homo sapiens
cgtttgtgcagaa

SEQ ID NO: 1757388 - DNA, 14 bp, Homo sapiens
cgtttgtgcagaat

SEQ ID NO: 1757389 - DNA, 18 bp, Homo sapiens
cgttttcttctttccctg

SEQ ID NO: 1757390 - DNA, 19 bp, Homo sapiens
cgttttcttctttccctgg

SEQ ID NO: 1757391 - DNA, 20 bp, Homo sapiens
cgttttggtgttgcttttca

SEQ ID NO: 1757392 - DNA, 15 bp, Homo sapiens
cgtttttgtattttc

SEQ ID NO: 1757393 - DNA, 16 bp, Homo sapiens
cgtttttgtttactgg

SEQ ID NO: 1757394 - DNA, 19 bp, Homo sapiens
ctaaaaaaaaaaaggccgc

SEQ ID NO: 1757395 - DNA, 11 bp, Homo sapiens
ctaaaaaacag

SEQ ID NO: 1757396 - DNA, 22 bp, Homo sapiens
ctaaaaaataactgtgcactat

SEQ ID NO: 1757397 - DNA, 22 bp, Homo sapiens
ctaaaaacttctttttaatctt

SEQ ID NO: 1757398 - DNA, 23 bp, Homo sapiens
ctaaaaataactgtaattatttg

SEQ ID NO: 1757399 - DNA, 22 bp, Homo sapiens
ctaaaaatacaccgtttagaaa

SEQ ID NO: 1757400 - DNA, 21 bp, Homo sapiens
ctaaaaatatacatgtttatg

SEQ ID NO: 1757401 - DNA, 19 bp, Homo sapiens
ctaaaaatatatctgttgg

SEQ ID NO: 1757402 - DNA, 12 bp, Homo sapiens
ctaaaaatgaag

SEQ ID NO: 1757403 - DNA, 17 bp, Homo sapiens
ctaaaaccattccattt

SEQ ID NO: 1757404 - DNA, 15 bp, Homo sapiens
ctaaaagccacccca

SEQ ID NO: 1757405 - DNA, 15 bp, Homo sapiens
ctaaaagctctgttc

SEQ ID NO: 1757406 - DNA, 14 bp, Homo sapiens
ctaaaagtaaacat

SEQ ID NO: 1757407 - DNA, 15 bp, Homo sapiens
ctaaaagtttgagga

SEQ ID NO: 1757408 - DNA, 17 bp, Homo sapiens
ctaaaatactcaccaaa

SEQ ID NO: 1757409 - DNA, 15 bp, Homo sapiens
ctaaaatatttatga

SEQ ID NO: 1757410 - DNA, 16 bp, Homo sapiens
ctaaaatatttatgaa

SEQ ID NO: 1757411 - DNA, 20 bp, Homo sapiens
ctaaaatatttatgaagaaa

SEQ ID NO: 1757412 - DNA, 15 bp, Homo sapiens
ctaaaatatttattt

SEQ ID NO: 1757413 - DNA, 17 bp, Homo sapiens
ctaaaatcccaccagaa

SEQ ID NO: 1757414 - DNA, 21 bp, Homo sapiens
ctaaaatcttatagttctagg

SEQ ID NO: 1757415 - DNA, 12 bp, Homo sapiens
ctaaaatgcttc

SEQ ID NO: 1757416 - DNA, 18 bp, Homo sapiens
ctaaaatgtgatgttcta

SEQ ID NO: 1757417 - DNA, 23 bp, Homo sapiens
ctaaaatgtgatgttctaaggct

SEQ ID NO: 1757418 - DNA, 17 bp, Homo sapiens
ctaaaattcaacaaatg

SEQ ID NO: 1757419 - DNA, 18 bp, Homo sapiens
ctaaaattcaacaaatga

SEQ ID NO: 1757420 - DNA, 16 bp, Homo sapiens
ctaaaattgtatgaaa

SEQ ID NO: 1757421 - DNA, 13 bp, Homo sapiens
ctaaaatttaaaa

SEQ ID NO: 1757422 - DNA, 14 bp, Homo sapiens
ctaaacaagatttt

SEQ ID NO: 1757423 - DNA, 24 bp, Homo sapiens
ctaaacataattgtggattataaa

SEQ ID NO: 1757424 - DNA, 15 bp, Homo sapiens
ctaaacattttttct

SEQ ID NO: 1757425 - DNA, 13 bp, Homo sapiens
ctaaaccaaaaca

SEQ ID NO: 1757426 - DNA, 16 bp, Homo sapiens
ctaaaccaaggactga

SEQ ID NO: 1757427 - DNA, 19 bp, Homo sapiens
ctaaaccttacatgtgtaa

SEQ ID NO: 1757428 - DNA, 17 bp, Homo sapiens
ctaaaccttagtactga

SEQ ID NO: 1757429 - DNA, 15 bp, Homo sapiens
ctaaactccttcctg

SEQ ID NO: 1757430 - DNA, 17 bp, Homo sapiens
ctaaactccttcctggc

SEQ ID NO: 1757431 - DNA, 17 bp, Homo sapiens
ctaaactgttttcatgt

SEQ ID NO: 1757432 - DNA, 15 bp, Homo sapiens
ctaaactttttttct

SEQ ID NO: 1757433 - DNA, 16 bp, Homo sapiens
ctaaagagcccttgcc

SEQ ID NO: 1757434 - DNA, 22 bp, Homo sapiens
ctaaagagcccttgcctcccca

SEQ ID NO: 1757435 - DNA, 19 bp, Homo sapiens
ctaaagatggagtttctaa

SEQ ID NO: 1757436 - DNA, 17 bp, Homo sapiens
ctaaagattttgatctc

SEQ ID NO: 1757437 - DNA, 14 bp, Homo sapiens
ctaaagcagccagc

SEQ ID NO: 1757438 - DNA, 18 bp, Homo sapiens
ctaaagcagtggacacca

SEQ ID NO: 1757439 - DNA, 22 bp, Homo sapiens
ctaaagcatgaaatgtgaattt

SEQ ID NO: 1757440 - DNA, 21 bp, Homo sapiens
ctaaagcctaccctattctat

SEQ ID NO: 1757441 - DNA, 16 bp, Homo sapiens
ctaaaggaaaaaactt

SEQ ID NO: 1757442 - DNA, 15 bp, Homo sapiens
ctaaagggagaagga

SEQ ID NO: 1757443 - DNA, 17 bp, Homo sapiens
ctaaagggagaaggaag

SEQ ID NO: 1757444 - DNA, 15 bp, Homo sapiens
ctaaagggcagggcc

SEQ ID NO: 1757445 - DNA, 17 bp, Homo sapiens
ctaaaggtgtatttaaa

SEQ ID NO: 1757446 - DNA, 20 bp, Homo sapiens
ctaaagtagcaactgctggt

SEQ ID NO: 1757447 - DNA, 21 bp, Homo sapiens
ctaaagtatacaactgcctgg

SEQ ID NO: 1757448 - DNA, 15 bp, Homo sapiens
ctaaagttacctgtt

SEQ ID NO: 1757449 - DNA, 14 bp, Homo sapiens
ctaaagttctaaga

SEQ ID NO: 1757450 - DNA, 18 bp, Homo sapiens
ctaaagttctaagattct

SEQ ID NO: 1757451 - DNA, 16 bp, Homo sapiens
ctaaataaaaatatgt

SEQ ID NO: 1757452 - DNA, 15 bp, Homo sapiens
ctaaatagttctatc

SEQ ID NO: 1757453 - DNA, 20 bp, Homo sapiens
ctaaatatacatctgtgtat

SEQ ID NO: 1757454 - DNA, 22 bp, Homo sapiens
ctaaatatttccttaaactgtg

SEQ ID NO: 1757455 - DNA, 14 bp, Homo sapiens
ctaaatcagagaca

SEQ ID NO: 1757456 - DNA, 14 bp, Homo sapiens
ctaaatccaaagaa

SEQ ID NO: 1757457 - DNA, 17 bp, Homo sapiens
ctaaatccattttctaa

SEQ ID NO: 1757458 - DNA, 21 bp, Homo sapiens
ctaaatcctttactgttagtc

SEQ ID NO: 1757459 - DNA, 15 bp, Homo sapiens
ctaaatccttttgtt

SEQ ID NO: 1757460 - DNA, 12 bp, Homo sapiens
ctaaatctattt

SEQ ID NO: 1757461 - DNA, 14 bp, Homo sapiens
ctaaatctatttat

SEQ ID NO: 1757462 - DNA, 16 bp, Homo sapiens
ctaaatctatttatta

SEQ ID NO: 1757463 - DNA, 19 bp, Homo sapiens
ctaaatctatttattaata

SEQ ID NO: 1757464 - DNA, 13 bp, Homo sapiens
ctaaatcttcctt

SEQ ID NO: 1757465 - DNA, 14 bp, Homo sapiens
ctaaatgaatgttt

SEQ ID NO: 1757466 - DNA, 16 bp, Homo sapiens
ctaaatgaatgtttac

SEQ ID NO: 1757467 - DNA, 16 bp, Homo sapiens
ctaaatgagctcctgc

SEQ ID NO: 1757468 - DNA, 16 bp, Homo sapiens
ctaaatgataaatgta

SEQ ID NO: 1757469 - DNA, 18 bp, Homo sapiens
ctaaatgcagttttaaga

SEQ ID NO: 1757470 - DNA, 21 bp, Homo sapiens
ctaaatgcatatcctgagcca

SEQ ID NO: 1757471 - DNA, 20 bp, Homo sapiens
ctaaatggtcgcccaggaga

SEQ ID NO: 1757472 - DNA, 21 bp, Homo sapiens
ctaaatgtggagaaactgtag

SEQ ID NO: 1757473 - DNA, 16 bp, Homo sapiens
ctaaatgttgaaagat

SEQ ID NO: 1757474 - DNA, 19 bp, Homo sapiens
ctaaattattagcatttgt

SEQ ID NO: 1757475 - DNA, 15 bp, Homo sapiens
ctaaattatttactg

SEQ ID NO: 1757476 - DNA, 23 bp, Homo sapiens
ctaaattatttactgcaaaaaga

SEQ ID NO: 1757477 - DNA, 14 bp, Homo sapiens
ctaaattccacact

SEQ ID NO: 1757478 - DNA, 14 bp, Homo sapiens
ctaaattgtataca

SEQ ID NO: 1757479 - DNA, 21 bp, Homo sapiens
ctaaattgtatacattttgtt

SEQ ID NO: 1757480 - DNA, 13 bp, Homo sapiens
ctaaatttaatgc

SEQ ID NO: 1757481 - DNA, 16 bp, Homo sapiens
ctaaatttaatgctgc

SEQ ID NO: 1757482 - DNA, 14 bp, Homo sapiens
ctaaattttaaagc

SEQ ID NO: 1757483 - DNA, 13 bp, Homo sapiens
ctaaattttatat

SEQ ID NO: 1757484 - DNA, 16 bp, Homo sapiens
ctaaattttatatctt

SEQ ID NO: 1757485 - DNA, 18 bp, Homo sapiens
ctaaattttgttactgat

SEQ ID NO: 1757486 - DNA, 19 bp, Homo sapiens
ctaaatttttataataatt

SEQ ID NO: 1757487 - DNA, 22 bp, Homo sapiens
ctaatttttggagaaatgtcat

SEQ ID NO: 1757488 - DNA, 13 bp, Homo sapiens
ctaatttttgtat

SEQ ID NO: 1757489 - DNA, 19 bp, Homo sapiens
ctaatttttgtattatttt

SEQ ID NO: 1757490 - DNA, 17 bp, Homo sapiens
ctacaaaaaaccaggat

SEQ ID NO: 1757491 - DNA, 20 bp, Homo sapiens
ctacaaaaacacagcaaggg

SEQ ID NO: 1757492 - DNA, 18 bp, Homo sapiens
ctacaaaatttgaaattt

SEQ ID NO: 1757493 - DNA, 13 bp, Homo sapiens
ctacaaacaaaat

SEQ ID NO: 1757494 - DNA, 17 bp, Homo sapiens
ctacaaagctttgctac

SEQ ID NO: 1757495 - DNA, 18 bp, Homo sapiens
ctacaaatttatgcattt

SEQ ID NO: 1757496 - DNA, 21 bp, Homo sapiens
ctacaaatttatgcatttcat

SEQ ID NO: 1757497 - DNA, 16 bp, Homo sapiens
ctacaactgattgcaa

SEQ ID NO: 1757498 - DNA, 19 bp, Homo sapiens
ctacaactggagttttttt

SEQ ID NO: 1757499 - DNA, 17 bp, Homo sapiens
ctacaacttaatggaaa

SEQ ID NO: 1757500 - DNA, 15 bp, Homo sapiens
ctacaagagcagcct

SEQ ID NO: 1757501 - DNA, 19 bp, Homo sapiens
ctacaagagcagcctgtgg

SEQ ID NO: 1757502 - DNA, 15 bp, Homo sapiens
ctacaagctggcact

SEQ ID NO: 1757503 - DNA, 21 bp, Homo sapiens
ctacaaggactccattggatc

SEQ ID NO: 1757504 - DNA, 18 bp, Homo sapiens
ctacaagtgtaggccacc

SEQ ID NO: 1757505 - DNA, 14 bp, Homo sapiens
ctacaataaaaaga

SEQ ID NO: 1757506 - DNA, 14 bp, Homo sapiens
ctacaatatgtaca

SEQ ID NO: 1757507 - DNA, 19 bp, Homo sapiens
ctacaatcagttgacttta

SEQ ID NO: 1757508 - DNA, 21 bp, Homo sapiens
ctacaatcagttgactttaag

SEQ ID NO: 1757509 - DNA, 11 bp, Homo sapiens
ctacaatcatg

SEQ ID NO: 1757510 - DNA, 15 bp, Homo sapiens
ctacacaatacagta

SEQ ID NO: 1757511 - DNA, 23 bp, Homo sapiens
ctacacagcacaccagccgctgc

SEQ ID NO: 1757512 - DNA, 12 bp, Homo sapiens
ctacacaggagt

SEQ ID NO: 1757513 - DNA, 20 bp, Homo sapiens
ctacacagtgggaactctga

SEQ ID NO: 1757514 - DNA, 18 bp, Homo sapiens
ctacacatgtaaaatatg

SEQ ID NO: 1757515 - DNA, 23 bp, Homo sapiens
ctacacatgtaaaatatgtaaaa

SEQ ID NO: 1757516 - DNA, 14 bp, Homo sapiens
ctacacccaagcct

SEQ ID NO: 1757517 - DNA, 14 bp, Homo sapiens
ctacacctccctcc

SEQ ID NO: 1757518 - DNA, 13 bp, Homo sapiens
ctacacctggctg

SEQ ID NO: 1757519 - DNA, 15 bp, Homo sapiens
ctacacctggctgag

SEQ ID NO: 1757520 - DNA, 15 bp, Homo sapiens
ctacaccttgccttg

SEQ ID NO: 1757521 - DNA, 14 bp, Homo sapiens
ctacactccagcct

SEQ ID NO: 1757522 - DNA, 17 bp, Homo sapiens
ctacagaaatactgctc

SEQ ID NO: 1757523 - DNA, 21 bp, Homo sapiens
ctacagaaattctgcaagttt

SEQ ID NO: 1757524 - DNA, 17 bp, Homo sapiens
ctacagaacttcagaaa

SEQ ID NO: 1757525 - DNA, 14 bp, Homo sapiens
ctacagaagtggaa

SEQ ID NO: 1757526 - DNA, 17 bp, Homo sapiens
ctacagacctggctctc

SEQ ID NO: 1757527 - DNA, 15 bp, Homo sapiens
ctacagactccatct

SEQ ID NO: 1757528 - DNA, 16 bp, Homo sapiens
ctacagactccatctc

SEQ ID NO: 1757529 - DNA, 17 bp, Homo sapiens
ctacagactccatctct

SEQ ID NO: 1757530 - DNA, 13 bp, Homo sapiens
ctacagcctgcac

SEQ ID NO: 1757531 - DNA, 20 bp, Homo sapiens
ctacagcctgcacacacctg

SEQ ID NO: 1757532 - DNA, 18 bp, Homo sapiens
ctacagcgagctgcatta

SEQ ID NO: 1757533 - DNA, 18 bp, Homo sapiens
ctacagctaatcagcatt

SEQ ID NO: 1757534 - DNA, 19 bp, Homo sapiens
ctacagctaatcagcattc

SEQ ID NO: 1757535 - DNA, 16 bp, Homo sapiens
ctacagctatatttga

SEQ ID NO: 1757536 - DNA, 19 bp, Homo sapiens
ctacagctcacctctgaag

SEQ ID NO: 1757537 - DNA, 19 bp, Homo sapiens
ctacagctttgatccctga

SEQ ID NO: 1757538 - DNA, 20 bp, Homo sapiens
ctacaggaagcaccccatgc

SEQ ID NO: 1757539 - DNA, 22 bp, Homo sapiens
ctacaggaagcaccccatgcca

SEQ ID NO: 1757540 - DNA, 18 bp, Homo sapiens
ctacaggagagggaagag

SEQ ID NO: 1757541 - DNA, 22 bp, Homo sapiens
ctacaggtgaaggctctcaccc

SEQ ID NO: 1757542 - DNA, 21 bp, Homo sapiens
ctacagtggttttatactgaa

SEQ ID NO: 1757543 - DNA, 20 bp, Homo sapiens
ctacagttgttttttgaaaa

SEQ ID NO: 1757544 - DNA, 19 bp, Homo sapiens
ctacagttttaactgtgga

SEQ ID NO: 1757545 - DNA, 23 bp, Homo sapiens
ctacataagtaattcaagaaaac

SEQ ID NO: 1757546 - DNA, 15 bp, Homo sapiens
ctacataattgtgac

SEQ ID NO: 1757547 - DNA, 17 bp, Homo sapiens
ctacatatcccttccag

SEQ ID NO: 1757548 - DNA, 17 bp, Homo sapiens
ctacatcttatttcctc

SEQ ID NO: 1757549 - DNA, 14 bp, Homo sapiens
ctacatcttctgcc

SEQ ID NO: 1757550 - DNA, 16 bp, Homo sapiens
ctacatcttctgcctt

SEQ ID NO: 1757551 - DNA, 10 bp, Homo sapiens
ctacatgaaa

SEQ ID NO: 1757552 - DNA, 15 bp, Homo sapiens
ctacatgaaacagaa

SEQ ID NO: 1757553 - DNA, 16 bp, Homo sapiens
ctacatgaaacagaaa

SEQ ID NO: 1757554 - DNA, 14 bp, Homo sapiens
ctacatgcagccca

SEQ ID NO: 1757555 - DNA, 15 bp, Homo sapiens
ctacatgcagcccat

SEQ ID NO: 1757556 - DNA, 17 bp, Homo sapiens
ctacatgcagcccatgc

SEQ ID NO: 1757557 - DNA, 23 bp, Homo sapiens
ctacatgcagcccatgcccacct

SEQ ID NO: 1757558 - DNA, 17 bp, Homo sapiens
ctacatgttctttgtac

SEQ ID NO: 1757559 - DNA, 11 bp, Homo sapiens
ctacattcctc

SEQ ID NO: 1757560 - DNA, 15 bp, Homo sapiens
ctacattcctcagct

SEQ ID NO: 1757561 - DNA, 23 bp, Homo sapiens
ctacattcgtgtgtgtctgcttt

SEQ ID NO: 1757562 - DNA, 23 bp, Homo sapiens
ctacattggaagctttgagttga

SEQ ID NO: 1757563 - DNA, 18 bp, Homo sapiens
ctaccaaacactcagtcc

SEQ ID NO: 1757564 - DNA, 14 bp, Homo sapiens
ctaccaaagcacct

SEQ ID NO: 1757565 - DNA, 15 bp, Homo sapiens
ctaccaaagcacctt

SEQ ID NO: 1757566 - DNA, 12 bp, Homo sapiens
ctaccacagact

SEQ ID NO: 1757567 - DNA, 13 bp, Homo sapiens
ctaccacagactt

SEQ ID NO: 1757568 - DNA, 12 bp, Homo sapiens
ctaccactctaa

SEQ ID NO: 1757569 - DNA, 18 bp, Homo sapiens
ctaccactctaatcaaga

SEQ ID NO: 1757570 - DNA, 16 bp, Homo sapiens
ctaccagccagcctca

SEQ ID NO: 1757571 - DNA, 21 bp, Homo sapiens
ctaccagcgccaaatgttcat

SEQ ID NO: 1757572 - DNA, 19 bp, Homo sapiens
ctaccagcgcccgctgggc

SEQ ID NO: 1757573 - DNA, 21 bp, Homo sapiens
ctaccagcgcccgctgggctg

SEQ ID NO: 1757574 - DNA, 20 bp, Homo sapiens
ctaccagtatttagaagcca

SEQ ID NO: 1757575 - DNA, 18 bp, Homo sapiens
ctaccatctgatgtttca

SEQ ID NO: 1757576 - DNA, 11 bp, Homo sapiens
ctaccatctgc

SEQ ID NO: 1757577 - DNA, 12 bp, Homo sapiens
ctaccatctgca

SEQ ID NO: 1757578 - DNA, 13 bp, Homo sapiens
ctaccatctgcat

SEQ ID NO: 1757579 - DNA, 19 bp, Homo sapiens
ctaccatgaacagaaaaca

SEQ ID NO: 1757580 - DNA, 13 bp, Homo sapiens
ctaccatgctgct

SEQ ID NO: 1757581 - DNA, 14 bp, Homo sapiens
ctaccatgctgctt

SEQ ID NO: 1757582 - DNA, 21 bp, Homo sapiens
ctaccattgctgttctacttt

SEQ ID NO: 1757583 - DNA, 12 bp, Homo sapiens
ctaccatttcag

SEQ ID NO: 1757584 - DNA, 20 bp, Homo sapiens
ctacccaaccctgccctgcc

SEQ ID NO: 1757585 - DNA, 23 bp, Homo sapiens
ctacccacgttctcacacccacc

SEQ ID NO: 1757586 - DNA, 16 bp, Homo sapiens
ctacccacttctaaat

SEQ ID NO: 1757587 - DNA, 20 bp, Homo sapiens
ctacccagctctgtcctctt

SEQ ID NO: 1757588 - DNA, 13 bp, Homo sapiens
ctacccagctgat

SEQ ID NO: 1757589 - DNA, 13 bp, Homo sapiens
ctaccccagccag

SEQ ID NO: 1757590 - DNA, 17 bp, Homo sapiens
ctaccccagtcccaggg

SEQ ID NO: 1757591 - DNA, 13 bp, Homo sapiens
ctaccccctgaaa

SEQ ID NO: 1757592 - DNA, 15 bp, Homo sapiens
ctacccctgctccca

SEQ ID NO: 1757593 - DNA, 13 bp, Homo sapiens
ctaccccttggaa

SEQ ID NO: 1757594 - DNA, 13 bp, Homo sapiens
ctacccgagccca

SEQ ID NO: 1757595 - DNA, 19 bp, Homo sapiens
ctacccgagcccagctaca

SEQ ID NO: 1757596 - DNA, 20 bp, Homo sapiens
ctacccgagcccagctacat

SEQ ID NO: 1757597 - DNA, 16 bp, Homo sapiens
ctaccctaaccaagtt

SEQ ID NO: 1757598 - DNA, 19 bp, Homo sapiens
ctaccctagccattcctgg

SEQ ID NO: 1757599 - DNA, 16 bp, Homo sapiens
ctaccctcagcctcca

SEQ ID NO: 1757600 - DNA, 20 bp, Homo sapiens
ctaccctcagcctccaatgc

SEQ ID NO: 1757601 - DNA, 23 bp, Homo sapiens
ctaccctcgggcccacctggcca

SEQ ID NO: 1757602 - DNA, 12 bp, Homo sapiens
ctagattgacta

SEQ ID NO: 1757603 - DNA, 14 bp, Homo sapiens
ctagatttgggaga

SEQ ID NO: 1757604 - DNA, 18 bp, Homo sapiens
ctagatttgtccttttat

SEQ ID NO: 1757605 - DNA, 16 bp, Homo sapiens
ctagcacttggagcca

SEQ ID NO: 1757606 - DNA, 19 bp, Homo sapiens
ctagcagagcaggggcagg

SEQ ID NO: 1757607 - DNA, 20 bp, Homo sapiens
ctagcagcccaccctgctgc

SEQ ID NO: 1757608 - DNA, 13 bp, Homo sapiens
ctagcagctgcag

SEQ ID NO: 1757609 - DNA, 16 bp, Homo sapiens
ctagcaggcacaggac

SEQ ID NO: 1757610 - DNA, 18 bp, Homo sapiens
ctagcaggcacaggacac

SEQ ID NO: 1757611 - DNA, 20 bp, Homo sapiens
ctagcaggcacaggacacct

SEQ ID NO: 1757612 - DNA, 22 bp, Homo sapiens
ctagcaggcctaagacatgtga

SEQ ID NO: 1757613 - DNA, 16 bp, Homo sapiens
ctagcagtaaaagatg

SEQ ID NO: 1757614 - DNA, 12 bp, Homo sapiens
ctagccaaggct

SEQ ID NO: 1757615 - DNA, 23 bp, Homo sapiens
ctagccaaggctagttcctttca

SEQ ID NO: 1757616 - DNA, 22 bp, Homo sapiens
ctagccacctcccaccccactc

SEQ ID NO: 1757617 - DNA, 12 bp, Homo sapiens
ctagccagacaa

SEQ ID NO: 1757618 - DNA, 17 bp, Homo sapiens
ctagccagagcccttca

SEQ ID NO: 1757619 - DNA, 20 bp, Homo sapiens
ctagccagcacttgtatata

SEQ ID NO: 1757620 - DNA, 13 bp, Homo sapiens
ctagccaggagtc

SEQ ID NO: 1757621 - DNA, 15 bp, Homo sapiens
ctagccaggagtctg

SEQ ID NO: 1757622 - DNA, 19 bp, Homo sapiens
ctagccagtgctccaggca

SEQ ID NO: 1757623 - DNA, 14 bp, Homo sapiens
ctagccattcctgg

SEQ ID NO: 1757624 - DNA, 21 bp, Homo sapiens
ctagccattcctggtacccag

SEQ ID NO: 1757625 - DNA, 20 bp, Homo sapiens
ctagcccactccctgcctac

SEQ ID NO: 1757626 - DNA, 23 bp, Homo sapiens
ctagcccagtccctggagctgtc

SEQ ID NO: 1757627 - DNA, 19 bp, Homo sapiens
ctagcccatggacttcaca

SEQ ID NO: 1757628 - DNA, 15 bp, Homo sapiens
ctagcccctggggtg

SEQ ID NO: 1757629 - DNA, 13 bp, Homo sapiens
ctagccctctcac

SEQ ID NO: 1757630 - DNA, 13 bp, Homo sapiens
ctagccctgggac

SEQ ID NO: 1757631 - DNA, 11 bp, Homo sapiens
ctagccctggt

SEQ ID NO: 1757632 - DNA, 13 bp, Homo sapiens
ctagccgacctca

SEQ ID NO: 1757633 - DNA, 18 bp, Homo sapiens
ctagccgacctcagcctt

SEQ ID NO: 1757634 - DNA, 18 bp, Homo sapiens
ctagccggccactttgga

SEQ ID NO: 1757635 - DNA, 22 bp, Homo sapiens
ctagcctaaagtatacaactgc

SEQ ID NO: 1757636 - DNA, 21 bp, Homo sapiens
ctagcctgtgattaacttgct

SEQ ID NO: 1757637 - DNA, 13 bp, Homo sapiens
ctagccttgcttg

SEQ ID NO: 1757638 - DNA, 19 bp, Homo sapiens
ctagcgatctctcctggcc

SEQ ID NO: 1757639 - DNA, 21 bp, Homo sapiens
ctagctagaaatatgatttta

SEQ ID NO: 1757640 - DNA, 17 bp, Homo sapiens
ctagctataacaactct

SEQ ID NO: 1757641 - DNA, 21 bp, Homo sapiens
ctagctataacaactctattt

SEQ ID NO: 1757642 - DNA, 14 bp, Homo sapiens
ctagctatatattt

SEQ ID NO: 1757643 - DNA, 17 bp, Homo sapiens
ctagctcaccaggcctg

SEQ ID NO: 1757644 - DNA, 17 bp, Homo sapiens
ctagctcctcctcctgg

SEQ ID NO: 1757645 - DNA, 18 bp, Homo sapiens
ctagctcctcctcctggg

SEQ ID NO: 1757646 - DNA, 19 bp, Homo sapiens
ctagctctatgtttacaaa

SEQ ID NO: 1757647 - DNA, 15 bp, Homo sapiens
ctagctctctaggcc

SEQ ID NO: 1757648 - DNA, 15 bp, Homo sapiens
ctagctggcaggaca

SEQ ID NO: 1757649 - DNA, 13 bp, Homo sapiens
ctagctggctctg

SEQ ID NO: 1757650 - DNA, 23 bp, Homo sapiens
ctagctgtgtgaatacctgctca

SEQ ID NO: 1757651 - DNA, 17 bp, Homo sapiens
ctagctgttctggacta

SEQ ID NO: 1757652 - DNA, 13 bp, Homo sapiens
ctagcttactgat

SEQ ID NO: 1757653 - DNA, 17 bp, Homo sapiens
ctagcttactgataaac

SEQ ID NO: 1757654 - DNA, 14 bp, Homo sapiens
ctagcttctgcttt

SEQ ID NO: 1757655 - DNA, 15 bp, Homo sapiens
ctagcttctgctttt

SEQ ID NO: 1757656 - DNA, 21 bp, Homo sapiens
ctagcttctgcttttctgccc

SEQ ID NO: 1757657 - DNA, 23 bp, Homo sapiens
ctagcttctgcttttctgccctg

SEQ ID NO: 1757658 - DNA, 15 bp, Homo sapiens
ctagctttagaccct

SEQ ID NO: 1757659 - DNA, 15 bp, Homo sapiens
ctagcttttaggaaa

SEQ ID NO: 1757660 - DNA, 15 bp, Homo sapiens
ctaggaagaggagtg

SEQ ID NO: 1757661 - DNA, 16 bp, Homo sapiens
ctaggaagcttggctt

SEQ ID NO: 1757662 - DNA, 17 bp, Homo sapiens
ctaggaatcccagaggt

SEQ ID NO: 1757663 - DNA, 14 bp, Homo sapiens
ctaggactcagaaa

SEQ ID NO: 1757664 - DNA, 19 bp, Homo sapiens
ctaggactcagaaacgaga

SEQ ID NO: 1757665 - DNA, 12 bp, Homo sapiens
ctaggactgagg

SEQ ID NO: 1757666 - DNA, 23 bp, Homo sapiens
ctaggagaaccaaatctggaagc

SEQ ID NO: 1757667 - DNA, 14 bp, Homo sapiens
ctaggagacagagc

SEQ ID NO: 1757668 - DNA, 15 bp, Homo sapiens
ctaggagacagagcc

SEQ ID NO: 1757669 - DNA, 18 bp, Homo sapiens
ctaggagacagagccaag

SEQ ID NO: 1757670 - DNA, 20 bp, Homo sapiens
ctaggagaccaaggcgggag

SEQ ID NO: 1757671 - DNA, 18 bp, Homo sapiens
ctaggagatatctgaggg

SEQ ID NO: 1757672 - DNA, 23 bp, Homo sapiens
ctaggagatatctgagggaggag

SEQ ID NO: 1757673 - DNA, 19 bp, Homo sapiens
ctaggagccccagcttcct

SEQ ID NO: 1757674 - DNA, 18 bp, Homo sapiens
ctaggaggctggccaagg

SEQ ID NO: 1757675 - DNA, 13 bp, Homo sapiens
ctaggagggagac

SEQ ID NO: 1757676 - DNA, 18 bp, Homo sapiens
ctaggagggagacactgg

SEQ ID NO: 1757677 - DNA, 22 bp, Homo sapiens
ctaggagggagacactggcccc

SEQ ID NO: 1757678 - DNA, 23 bp, Homo sapiens
ctaggagggagacactggcccct

SEQ ID NO: 1757679 - DNA, 23 bp, Homo sapiens
ctaggagttgagtacagtgagga

SEQ ID NO: 1757680 - DNA, 22 bp, Homo sapiens
ctaggatagctaactgtaaatc

SEQ ID NO: 1757681 - DNA, 20 bp, Homo sapiens
ctaggatgttgctcagaagt

SEQ ID NO: 1757682 - DNA, 22 bp, Homo sapiens
ctaggattggagtatgatttac

SEQ ID NO: 1757683 - DNA, 21 bp, Homo sapiens
ctaggcacctccccgctctcc

SEQ ID NO: 1757684 - DNA, 21 bp, Homo sapiens
ctaggcactgtagttctaaga

SEQ ID NO: 1757685 - DNA, 17 bp, Homo sapiens
ctaggcatcatgtccta

SEQ ID NO: 1757686 - DNA, 19 bp, Homo sapiens
ctaggccacaccatctcct

SEQ ID NO: 1757687 - DNA, 14 bp, Homo sapiens
ctaggccactcctc

SEQ ID NO: 1757688 - DNA, 18 bp, Homo sapiens
ctaggcccattgtcctcc

SEQ ID NO: 1757689 - DNA, 23 bp, Homo sapiens
ctaggcccattgtcctccttttc

SEQ ID NO: 1757690 - DNA, 20 bp, Homo sapiens
ctaggccccagaggccctgg

SEQ ID NO: 1757691 - DNA, 13 bp, Homo sapiens
ctaggcccccact

SEQ ID NO: 1757692 - DNA, 17 bp, Homo sapiens
ctaggcccccacttgcc

SEQ ID NO: 1757693 - DNA, 23 bp, Homo sapiens
ctaggcccccacttgcctcttcc

SEQ ID NO: 1757694 - DNA, 12 bp, Homo sapiens
ctaggccgggcg

SEQ ID NO: 1757695 - DNA, 24 bp, Homo sapiens
ctaggcgattttgtctaccatttg

SEQ ID NO: 1757696 - DNA, 20 bp, Homo sapiens
ctaggcgtggtggtgcatgc

SEQ ID NO: 1757697 - DNA, 18 bp, Homo sapiens
ctaggctctatttaactg

SEQ ID NO: 1757698 - DNA, 21 bp, Homo sapiens
ctaggcttcagcatatttata

SEQ ID NO: 1757699 - DNA, 23 bp, Homo sapiens
ctaggcttcagcatatttatagc

SEQ ID NO: 1757700 - DNA, 16 bp, Homo sapiens
ctagggaaacttcccg

SEQ ID NO: 1757701 - DNA, 17 bp, Homo sapiens
ctagggaaacttcccgt

SEQ ID NO: 1757702 - DNA, 15 bp, Homo sapiens
ctagggaatctggat

SEQ ID NO: 1757703 - DNA, 16 bp, Homo sapiens
ctagggatctgaaatc

SEQ ID NO: 1757704 - DNA, 18 bp, Homo sapiens
ctagggatctgaaatcca

SEQ ID NO: 1757705 - DNA, 14 bp, Homo sapiens
ctagggctagtctt

SEQ ID NO: 1757706 - DNA, 17 bp, Homo sapiens
ctaggggaagggctttg

SEQ ID NO: 1757707 - DNA, 16 bp, Homo sapiens
ctaggggtcaggctcc

SEQ ID NO: 1757708 - DNA, 18 bp, Homo sapiens
ctaggggtcaggctccat

SEQ ID NO: 1757709 - DNA, 15 bp, Homo sapiens
ctaggggtttctgtt

SEQ ID NO: 1757710 - DNA, 16 bp, Homo sapiens
ctagggtcttgggggt

SEQ ID NO: 1757711 - DNA, 13 bp, Homo sapiens
ctagggtggccct

SEQ ID NO: 1757712 - DNA, 14 bp, Homo sapiens
ctaggtacgatgac

SEQ ID NO: 1757713 - DNA, 14 bp, Homo sapiens
ctaggtacttcagg

SEQ ID NO: 1757714 - DNA, 15 bp, Homo sapiens
ctaggtaggaagagc

SEQ ID NO: 1757715 - DNA, 11 bp, Homo sapiens
ctaggtatcat

SEQ ID NO: 1757716 - DNA, 18 bp, Homo sapiens
ctaggtgcccagggccag

SEQ ID NO: 1757717 - DNA, 16 bp, Homo sapiens
ctattttatttgtatt

SEQ ID NO: 1757718 - DNA, 17 bp, Homo sapiens
ctattttatttgtattc

SEQ ID NO: 1757719 - DNA, 12 bp, Homo sapiens
ctattttcataa

SEQ ID NO: 1757720 - DNA, 16 bp, Homo sapiens
ctattttcatttgtac

SEQ ID NO: 1757721 - DNA, 21 bp, Homo sapiens
ctattttcttgaggaaaatat

SEQ ID NO: 1757722 - DNA, 22 bp, Homo sapiens
ctattttgaatgcagaaaacag

SEQ ID NO: 1757723 - DNA, 17 bp, Homo sapiens
ctattttgggtattaat

SEQ ID NO: 1757724 - DNA, 17 bp, Homo sapiens
ctattttgtgaagccat

SEQ ID NO: 1757725 - DNA, 13 bp, Homo sapiens
ctatttttatcat

SEQ ID NO: 1757726 - DNA, 13 bp, Homo sapiens
ctatttttgagga

SEQ ID NO: 1757727 - DNA, 13 bp, Homo sapiens
ctatttttgttgt

SEQ ID NO: 1757728 - DNA, 22 bp, Homo sapiens
ctatttttttagattgagaaat

SEQ ID NO: 1757729 - DNA, 17 bp, Homo sapiens
ctcaaaaaaagccttta

SEQ ID NO: 1757730 - DNA, 17 bp, Homo sapiens
ctcaaaaagcagaagga

SEQ ID NO: 1757731 - DNA, 14 bp, Homo sapiens
ctcaaaacaaaaca

SEQ ID NO: 1757732 - DNA, 15 bp, Homo sapiens
ctcaaaacctggaga

SEQ ID NO: 1757733 - DNA, 17 bp, Homo sapiens
ctcaaaacgggtcagta

SEQ ID NO: 1757734 - DNA, 17 bp, Homo sapiens
ctcaaaactgcactgtc

SEQ ID NO: 1757735 - DNA, 18 bp, Homo sapiens
ctcaaaagaggttacttt

SEQ ID NO: 1757736 - DNA, 22 bp, Homo sapiens
ctcaaaagaggttactttagtt

SEQ ID NO: 1757737 - DNA, 16 bp, Homo sapiens
ctcaaaagttttttct

SEQ ID NO: 1757738 - DNA, 18 bp, Homo sapiens
ctcaaaataaagaagtat

SEQ ID NO: 1757739 - DNA, 18 bp, Homo sapiens
ctcaaaatatttgtacat

SEQ ID NO: 1757740 - DNA, 18 bp, Homo sapiens
ctcaaaattgcttctaaa

SEQ ID NO: 1757741 - DNA, 19 bp, Homo sapiens
ctcaaaattgcttctaaaa

SEQ ID NO: 1757742 - DNA, 15 bp, Homo sapiens
ctcaaacctcctctt

SEQ ID NO: 1757743 - DNA, 18 bp, Homo sapiens
ctcaaacctgtttaaata

SEQ ID NO: 1757744 - DNA, 21 bp, Homo sapiens
ctcaaactcctgacctcaggt

SEQ ID NO: 1757745 - DNA, 13 bp, Homo sapiens
ctcaaagaaagtg

SEQ ID NO: 1757746 - DNA, 17 bp, Homo sapiens
ctcaaagaagtcggaat

SEQ ID NO: 1757747 - DNA, 15 bp, Homo sapiens
ctcaaaggagctttc

SEQ ID NO: 1757748 - DNA, 17 bp, Homo sapiens
ctcaaagggagagaaaa

SEQ ID NO: 1757749 - DNA, 19 bp, Homo sapiens
ctcaaaggtttggaaggag

SEQ ID NO: 1757750 - DNA, 20 bp, Homo sapiens
ctcaaataggctattaaaaa

SEQ ID NO: 1757751 - DNA, 20 bp, Homo sapiens
ctcaaatctgcttcatccaa

SEQ ID NO: 1757752 - DNA, 20 bp, Homo sapiens
ctcaaatggggccagatcca

SEQ ID NO: 1757753 - DNA, 13 bp, Homo sapiens
ctcaaatgttcta

SEQ ID NO: 1757754 - DNA, 21 bp, Homo sapiens
ctcaaatgttctaagtttcta

SEQ ID NO: 1757755 - DNA, 23 bp, Homo sapiens
ctcaaatgttctaagtttctaag

SEQ ID NO: 1757756 - DNA, 12 bp, Homo sapiens
ctcaaatttgga

SEQ ID NO: 1757757 - DNA, 21 bp, Homo sapiens
ctcaacaatggttgaatgaat

SEQ ID NO: 1757758 - DNA, 14 bp, Homo sapiens
ctcaacagagagga

SEQ ID NO: 1757759 - DNA, 15 bp, Homo sapiens
ctcaacagagaggac

SEQ ID NO: 1757760 - DNA, 16 bp, Homo sapiens
ctcaacatgttactga

SEQ ID NO: 1757761 - DNA, 16 bp, Homo sapiens
ctcaacattgcatggt

SEQ ID NO: 1757762 - DNA, 15 bp, Homo sapiens
ctcaaccagagtcac

SEQ ID NO: 1757763 - DNA, 15 bp, Homo sapiens
ctcaacccacatggg

SEQ ID NO: 1757764 - DNA, 22 bp, Homo sapiens
ctcaacccccatttctatttat

SEQ ID NO: 1757765 - DNA, 16 bp, Homo sapiens
ctcaacctaccctggt

SEQ ID NO: 1757766 - DNA, 18 bp, Homo sapiens
ctcaacctcttctggctc

SEQ ID NO: 1757767 - DNA, 20 bp, Homo sapiens
ctcaacctcttctggctcaa

SEQ ID NO: 1757768 - DNA, 22 bp, Homo sapiens
ctcaacgcctccccctccccca

SEQ ID NO: 1757769 - DNA, 22 bp, Homo sapiens
ctcaacggaagccccctcttcc

SEQ ID NO: 1757770 - DNA, 15 bp, Homo sapiens
ctcaactccaggatt

SEQ ID NO: 1757771 - DNA, 23 bp, Homo sapiens
ctcaactccgtgcttaaccaaag

SEQ ID NO: 1757772 - DNA, 20 bp, Homo sapiens
ctcaagaaatatactctccc

SEQ ID NO: 1757773 - DNA, 23 bp, Homo sapiens
ctcaagaaatatactctcccaga

SEQ ID NO: 1757774 - DNA, 19 bp, Homo sapiens
ctcaagaagacatggagac

SEQ ID NO: 1757775 - DNA, 18 bp, Homo sapiens
ctcaagacaaggctggca

SEQ ID NO: 1757776 - DNA, 16 bp, Homo sapiens
ctcaagaccagagacc

SEQ ID NO: 1757777 - DNA, 14 bp, Homo sapiens
ctcaagacctgagt

SEQ ID NO: 1757778 - DNA, 23 bp, Homo sapiens
ctcaagacggagatgcatggcct

SEQ ID NO: 1757779 - DNA, 15 bp, Homo sapiens
ctcaagactttagct

SEQ ID NO: 1757780 - DNA, 16 bp, Homo sapiens
ctcaagaggctgaggc

SEQ ID NO: 1757781 - DNA, 17 bp, Homo sapiens
ctcaagagggcactggt

SEQ ID NO: 1757782 - DNA, 22 bp, Homo sapiens
ctcaagatattcaggtggccag

SEQ ID NO: 1757783 - DNA, 16 bp, Homo sapiens
ctcaagatgaaggcaa

SEQ ID NO: 1757784 - DNA, 16 bp, Homo sapiens
ctcaagatgacagctc

SEQ ID NO: 1757785 - DNA, 21 bp, Homo sapiens
ctcaagatgggtccctggcca

SEQ ID NO: 1757786 - DNA, 15 bp, Homo sapiens
ctcaagattttttct

SEQ ID NO: 1757787 - DNA, 12 bp, Homo sapiens
ctcaagcaataa

SEQ ID NO: 1757788 - DNA, 12 bp, Homo sapiens
ctcaagccagcc

SEQ ID NO: 1757789 - DNA, 13 bp, Homo sapiens
ctcaagccagccc

SEQ ID NO: 1757790 - DNA, 18 bp, Homo sapiens
ctcaagccccatttcctc

SEQ ID NO: 1757791 - DNA, 13 bp, Homo sapiens
ctcaagccctgca

SEQ ID NO: 1757792 - DNA, 22 bp, Homo sapiens
ctcaagccctgcagtcacagct

SEQ ID NO: 1757793 - DNA, 18 bp, Homo sapiens
ctcaagccgcaagctctc

SEQ ID NO: 1757794 - DNA, 20 bp, Homo sapiens
ctcaagccgcaagctctcag

SEQ ID NO: 1757795 - DNA, 13 bp, Homo sapiens
ctcaagctagcca

SEQ ID NO: 1757796 - DNA, 19 bp, Homo sapiens
ctcaaggacaaagtctcca

SEQ ID NO: 1757797 - DNA, 23 bp, Homo sapiens
ctcaaggacaaagtctccagccc

SEQ ID NO: 1757798 - DNA, 22 bp, Homo sapiens
ctcaaggactttgcagccggca

SEQ ID NO: 1757799 - DNA, 14 bp, Homo sapiens
ctcaaggctgtgca

SEQ ID NO: 1757800 - DNA, 14 bp, Homo sapiens
ctcaagggaaaggc

SEQ ID NO: 1757801 - DNA, 19 bp, Homo sapiens
ctcaagggtggcaggtcac

SEQ ID NO: 1757802 - DNA, 23 bp, Homo sapiens
ctcaagggtggcaggtcactgtc

SEQ ID NO: 1757803 - DNA, 20 bp, Homo sapiens
ctcaaggtcatcaaacattt

SEQ ID NO: 1757804 - DNA, 16 bp, Homo sapiens
ctcaaggtgagaatta

SEQ ID NO: 1757805 - DNA, 20 bp, Homo sapiens
ctcaaggttactgggagtgt

SEQ ID NO: 1757806 - DNA, 14 bp, Homo sapiens
ctcaaggttttagg

SEQ ID NO: 1757807 - DNA, 22 bp, Homo sapiens
ctcaagtacccattctgttttc

SEQ ID NO: 1757808 - DNA, 20 bp, Homo sapiens
ctcaagtagaaaagcagtcc

SEQ ID NO: 1757809 - DNA, 14 bp, Homo sapiens
ctcaatcagtgcag

SEQ ID NO: 1757810 - DNA, 16 bp, Homo sapiens
ctcaatcagtgcagtg

SEQ ID NO: 1757811 - DNA, 14 bp, Homo sapiens
ctcaatcctaattt

SEQ ID NO: 1757812 - DNA, 19 bp, Homo sapiens
ctcaatgaaccataaattc

SEQ ID NO: 1757813 - DNA, 16 bp, Homo sapiens
ctcaatgagctcttcc

SEQ ID NO: 1757814 - DNA, 21 bp, Homo sapiens
ctcaatgcattgtcttgtgga

SEQ ID NO: 1757815 - DNA, 22 bp, Homo sapiens
ctcaatgcattgtcttgtggag

SEQ ID NO: 1757816 - DNA, 16 bp, Homo sapiens
ctcaatgccctgccat

SEQ ID NO: 1757817 - DNA, 16 bp, Homo sapiens
ctcaatgtcttcccac

SEQ ID NO: 1757818 - DNA, 19 bp, Homo sapiens
ctcaatgtttctggacatt

SEQ ID NO: 1757819 - DNA, 13 bp, Homo sapiens
ctcaattatttgc

SEQ ID NO: 1757820 - DNA, 14 bp, Homo sapiens
ctcaattatttgca

SEQ ID NO: 1757821 - DNA, 16 bp, Homo sapiens
ctcaattatttgcata

SEQ ID NO: 1757822 - DNA, 21 bp, Homo sapiens
ctcaattgaaagcttttaaaa

SEQ ID NO: 1757823 - DNA, 14 bp, Homo sapiens
ctcacaaggcccag

SEQ ID NO: 1757824 - DNA, 17 bp, Homo sapiens
ctcacaaggcccaggag

SEQ ID NO: 1757825 - DNA, 20 bp, Homo sapiens
ctcacaatttaaaatatttc

SEQ ID NO: 1757826 - DNA, 12 bp, Homo sapiens
ctcacacccacc

SEQ ID NO: 1757827 - DNA, 16 bp, Homo sapiens
ctcacacccctgtccc

SEQ ID NO: 1757828 - DNA, 20 bp, Homo sapiens
ctcacacccctgtcccaccc

SEQ ID NO: 1757829 - DNA, 19 bp, Homo sapiens
ctcacaccgcgtctggtga

SEQ ID NO: 1757830 - DNA, 19 bp, Homo sapiens
ctcacactaagagggcaga

SEQ ID NO: 1757831 - DNA, 19 bp, Homo sapiens
ctcacactccagtggcaga

SEQ ID NO: 1757832 - DNA, 16 bp, Homo sapiens
ctcagcctctcgaagt

SEQ ID NO: 1757833 - DNA, 20 bp, Homo sapiens
ctcagcctctgccagcgcca

SEQ ID NO: 1757834 - DNA, 11 bp, Homo sapiens
ctcagcctgca

SEQ ID NO: 1757835 - DNA, 14 bp, Homo sapiens
ctcagcctggccag

SEQ ID NO: 1757836 - DNA, 17 bp, Homo sapiens
ctcagcctggccagaca

SEQ ID NO: 1757837 - DNA, 15 bp, Homo sapiens
ctcagccttcagaca

SEQ ID NO: 1757838 - DNA, 22 bp, Homo sapiens
ctcagccttccccttgcccagg

SEQ ID NO: 1757839 - DNA, 15 bp, Homo sapiens
ctcagccttgccaga

SEQ ID NO: 1757840 - DNA, 15 bp, Homo sapiens
ctcagccttggataa

SEQ ID NO: 1757841 - DNA, 17 bp, Homo sapiens
ctcagcgagaggcagca

SEQ ID NO: 1757842 - DNA, 20 bp, Homo sapiens
ctcagcgggggccttgaaga

SEQ ID NO: 1757843 - DNA, 22 bp, Homo sapiens
ctcagctataattctgttatat

SEQ ID NO: 1757844 - DNA, 20 bp, Homo sapiens
ctcagctcactacaacctcc

SEQ ID NO: 1757845 - DNA, 15 bp, Homo sapiens
ctcagctcggggagc

SEQ ID NO: 1757846 - DNA, 18 bp, Homo sapiens
ctcagctcggggagcctt

SEQ ID NO: 1757847 - DNA, 19 bp, Homo sapiens
ctcagctcggggagcctta

SEQ ID NO: 1757848 - DNA, 14 bp, Homo sapiens
ctcagctctctggg

SEQ ID NO: 1757849 - DNA, 21 bp, Homo sapiens
ctcagctctctgggacctcct

SEQ ID NO: 1757850 - DNA, 17 bp, Homo sapiens
ctcagctgcacattcct

SEQ ID NO: 1757851 - DNA, 20 bp, Homo sapiens
ctcagctgcacattcctggc

SEQ ID NO: 1757852 - DNA, 23 bp, Homo sapiens
ctcagctgcacattcctggcccc

SEQ ID NO: 1757853 - DNA, 16 bp, Homo sapiens
ctcagctgccaagcac

SEQ ID NO: 1757854 - DNA, 17 bp, Homo sapiens
ctcagctgccaagcact

SEQ ID NO: 1757855 - DNA, 23 bp, Homo sapiens
ctcagctgcccatcccagtccct

SEQ ID NO: 1757856 - DNA, 14 bp, Homo sapiens
ctcagctgcctcac

SEQ ID NO: 1757857 - DNA, 18 bp, Homo sapiens
ctcagctgcctcacttcc

SEQ ID NO: 1757858 - DNA, 16 bp, Homo sapiens
ctcagctgctatactt

SEQ ID NO: 1757859 - DNA, 17 bp, Homo sapiens
ctcagctggctgagaca

SEQ ID NO: 1757860 - DNA, 23 bp, Homo sapiens
ctcagctggctgagacactgaag

SEQ ID NO: 1757861 - DNA, 16 bp, Homo sapiens
ctcagctgtcctgcag

SEQ ID NO: 1757862 - DNA, 18 bp, Homo sapiens
ctcagctgtcctgcagca

SEQ ID NO: 1757863 - DNA, 23 bp, Homo sapiens
ctcagctgtggctggaggagctg

SEQ ID NO: 1757864 - DNA, 20 bp, Homo sapiens
ctcagcttatctcttttata

SEQ ID NO: 1757865 - DNA, 16 bp, Homo sapiens
ctcagcttgcagctgg

SEQ ID NO: 1757866 - DNA, 22 bp, Homo sapiens
ctcaggaaatcaaatatgcaaa

SEQ ID NO: 1757867 - DNA, 13 bp, Homo sapiens
ctcaggaagaaca

SEQ ID NO: 1757868 - DNA, 17 bp, Homo sapiens
ctcaggaattcagtgcc

SEQ ID NO: 1757869 - DNA, 12 bp, Homo sapiens
ctcaggacagat

SEQ ID NO: 1757870 - DNA, 14 bp, Homo sapiens
ctcaggacagatgc

SEQ ID NO: 1757871 - DNA, 23 bp, Homo sapiens
ctcaggaccagatgtccgtctct

SEQ ID NO: 1757872 - DNA, 16 bp, Homo sapiens
ctcaggacccaggccc

SEQ ID NO: 1757873 - DNA, 12 bp, Homo sapiens
ctcaggagagac

SEQ ID NO: 1757874 - DNA, 18 bp, Homo sapiens
ctcaggagagacccctcc

SEQ ID NO: 1757875 - DNA, 20 bp, Homo sapiens
ctcaggagagacccctcccc

SEQ ID NO: 1757876 - DNA, 16 bp, Homo sapiens
ctcaggagatggaggg

SEQ ID NO: 1757877 - DNA, 15 bp, Homo sapiens
ctcaggagcacaggc

SEQ ID NO: 1757878 - DNA, 22 bp, Homo sapiens
ctcaggagcacaggcagctgga

SEQ ID NO: 1757879 - DNA, 22 bp, Homo sapiens
ctcaggagcttgcaagaagcag

SEQ ID NO: 1757880 - DNA, 18 bp, Homo sapiens
ctcaggaggcaggacctt

SEQ ID NO: 1757881 - DNA, 19 bp, Homo sapiens
ctcaggaggcgcccttggc

SEQ ID NO: 1757882 - DNA, 15 bp, Homo sapiens
ctcaggaggctgaga

SEQ ID NO: 1757883 - DNA, 23 bp, Homo sapiens
ctcaggaggctgaggcagaagaa

SEQ ID NO: 1757884 - DNA, 16 bp, Homo sapiens
ctcaggaggctgaggg

SEQ ID NO: 1757885 - DNA, 22 bp, Homo sapiens
ctcaggagggtgacgcccagct

SEQ ID NO: 1757886 - DNA, 23 bp, Homo sapiens
ctcaggagtggggttgggggaca

SEQ ID NO: 1757887 - DNA, 16 bp, Homo sapiens
ctcaggatgcccaggg

SEQ ID NO: 1757888 - DNA, 16 bp, Homo sapiens
ctcaggatggctcaga

SEQ ID NO: 1757889 - DNA, 20 bp, Homo sapiens
ctcaggatttaaaaactgga

SEQ ID NO: 1757890 - DNA, 19 bp, Homo sapiens
ctcaggcaagcccctcagc

SEQ ID NO: 1757891 - DNA, 15 bp, Homo sapiens
ctcaggcacacagct

SEQ ID NO: 1757892 - DNA, 14 bp, Homo sapiens
ctcaggcagacaag

SEQ ID NO: 1757893 - DNA, 17 bp, Homo sapiens
ctcaggcagacaagagc

SEQ ID NO: 1757894 - DNA, 23 bp, Homo sapiens
ctcaggcagacaagagctgctgt

SEQ ID NO: 1757895 - DNA, 13 bp, Homo sapiens
ctcaggcagcacc

SEQ ID NO: 1757896 - DNA, 21 bp, Homo sapiens
ctcaggcagcgttagggctgc

SEQ ID NO: 1757897 - DNA, 22 bp, Homo sapiens
ctcaggcataggcctgggtgct

SEQ ID NO: 1757898 - DNA, 23 bp, Homo sapiens
ctcaggcataggcctgggtgctg

SEQ ID NO: 1757899 - DNA, 17 bp, Homo sapiens
ctcaggccaagcccaat

SEQ ID NO: 1757900 - DNA, 17 bp, Homo sapiens
ctcaggcctctgcagaa

SEQ ID NO: 1757901 - DNA, 19 bp, Homo sapiens
ctcaggcctctgcagaagc

SEQ ID NO: 1757902 - DNA, 21 bp, Homo sapiens
ctcaggcgatccacctgtctc

SEQ ID NO: 1757903 - DNA, 19 bp, Homo sapiens
ctcaggctctgcacagaca

SEQ ID NO: 1757904 - DNA, 13 bp, Homo sapiens
ctcaggctctgcc

SEQ ID NO: 1757905 - DNA, 15 bp, Homo sapiens
ctcaggcttgaaatg

SEQ ID NO: 1757906 - DNA, 15 bp, Homo sapiens
ctcagggaagcccag

SEQ ID NO: 1757907 - DNA, 17 bp, Homo sapiens
ctcagggaagcccagct

SEQ ID NO: 1757908 - DNA, 18 bp, Homo sapiens
ctcagggaagcccagctc

SEQ ID NO: 1757909 - DNA, 19 bp, Homo sapiens
ctcagggacagagacacct

SEQ ID NO: 1757910 - DNA, 21 bp, Homo sapiens
ctcagggaccggtgctgcagg

SEQ ID NO: 1757911 - DNA, 23 bp, Homo sapiens
ctcagggaccggtgctgcaggag

SEQ ID NO: 1757912 - DNA, 18 bp, Homo sapiens
ctcagggattctgggctt

SEQ ID NO: 1757913 - DNA, 19 bp, Homo sapiens
ctcagggcacgcaggacca

SEQ ID NO: 1757914 - DNA, 14 bp, Homo sapiens
ctcagggcagcctc

SEQ ID NO: 1757915 - DNA, 13 bp, Homo sapiens
ctcagggccatgc

SEQ ID NO: 1757916 - DNA, 17 bp, Homo sapiens
ctcagggccatgctgag

SEQ ID NO: 1757917 - DNA, 19 bp, Homo sapiens
ctcagggccatgctgaggc

SEQ ID NO: 1757918 - DNA, 13 bp, Homo sapiens
ctcagggcgctca

SEQ ID NO: 1757919 - DNA, 14 bp, Homo sapiens
ctcagggcgctcag

SEQ ID NO: 1757920 - DNA, 22 bp, Homo sapiens
ctcagggctggagtgcgctctt

SEQ ID NO: 1757921 - DNA, 17 bp, Homo sapiens
ctcaggggtggagaagt

SEQ ID NO: 1757922 - DNA, 18 bp, Homo sapiens
ctcaggggtggagaagtg

SEQ ID NO: 1757923 - DNA, 22 bp, Homo sapiens
ctcagggtcaaagacagaatgg

SEQ ID NO: 1757924 - DNA, 13 bp, Homo sapiens
ctcagggtccaga

SEQ ID NO: 1757925 - DNA, 15 bp, Homo sapiens
ctcagggtggtctct

SEQ ID NO: 1757926 - DNA, 14 bp, Homo sapiens
ctcagggttggcca

SEQ ID NO: 1757927 - DNA, 23 bp, Homo sapiens
ctcaggtagaaggttgacacagt

SEQ ID NO: 1757928 - DNA, 17 bp, Homo sapiens
ctcaggtcaactgacct

SEQ ID NO: 1757929 - DNA, 16 bp, Homo sapiens
ctcaggtgccactccc

SEQ ID NO: 1757930 - DNA, 20 bp, Homo sapiens
ctcaggtgccactccctgag

SEQ ID NO: 1757931 - DNA, 21 bp, Homo sapiens
ctcaggtgccactccctgagc

SEQ ID NO: 1757932 - DNA, 22 bp, Homo sapiens
ctcaggtgccactccctgagct

SEQ ID NO: 1757933 - DNA, 20 bp, Homo sapiens
ctcaggtggccagcctggat

SEQ ID NO: 1757934 - DNA, 23 bp, Homo sapiens
ctcaggtgtgggtgggaggggcc

SEQ ID NO: 1757935 - DNA, 16 bp, Homo sapiens
ctcaggttctttccat

SEQ ID NO: 1757936 - DNA, 15 bp, Homo sapiens
ctcaggtttgttttg

SEQ ID NO: 1757937 - DNA, 20 bp, Homo sapiens
ctcagtaaacgggaacatgc

SEQ ID NO: 1757938 - DNA, 21 bp, Homo sapiens
ctcagtaaacgggaacatgcc

SEQ ID NO: 1757939 - DNA, 13 bp, Homo sapiens
ctcagtaccccat

SEQ ID NO: 1757940 - DNA, 22 bp, Homo sapiens
ctcagtagaaaaggatctaagg

SEQ ID NO: 1757941 - DNA, 20 bp, Homo sapiens
ctcagtagctgaacctgtct

SEQ ID NO: 1757942 - DNA, 18 bp, Homo sapiens
ctcagtatgctgcccctg

SEQ ID NO: 1757943 - DNA, 21 bp, Homo sapiens
ctcagtatgctttccctgagg

SEQ ID NO: 1757944 - DNA, 15 bp, Homo sapiens
ctcagtcatcaaagc

SEQ ID NO: 1757945 - DNA, 23 bp, Homo sapiens
ctcagtccactgttgagccccag

SEQ ID NO: 1757946 - DNA, 19 bp, Homo sapiens
ctccactcgacccagaatg

SEQ ID NO: 1757947 - DNA, 17 bp, Homo sapiens
ctccactctagttctag

SEQ ID NO: 1757948 - DNA, 18 bp, Homo sapiens
ctccactctagttctaga

SEQ ID NO: 1757949 - DNA, 16 bp, Homo sapiens
ctccactctcccccac

SEQ ID NO: 1757950 - DNA, 21 bp, Homo sapiens
ctccactctccttcgtgtctc

SEQ ID NO: 1757951 - DNA, 12 bp, Homo sapiens
ctccactctgct

SEQ ID NO: 1757952 - DNA, 23 bp, Homo sapiens
ctccactcttgatctctcttgtc

SEQ ID NO: 1757953 - DNA, 22 bp, Homo sapiens
ctccactgacaaacgtccccag

SEQ ID NO: 1757954 - DNA, 15 bp, Homo sapiens
ctccactgccctggc

SEQ ID NO: 1757955 - DNA, 19 bp, Homo sapiens
ctccactgccctggcagca

SEQ ID NO: 1757956 - DNA, 13 bp, Homo sapiens
ctccactgccttc

SEQ ID NO: 1757957 - DNA, 15 bp, Homo sapiens
ctccactgccttcga

SEQ ID NO: 1757958 - DNA, 15 bp, Homo sapiens
ctccactgcctttgg

SEQ ID NO: 1757959 - DNA, 19 bp, Homo sapiens
ctccactgctctcagcctc

SEQ ID NO: 1757960 - DNA, 14 bp, Homo sapiens
ctccactggatgga

SEQ ID NO: 1757961 - DNA, 16 bp, Homo sapiens
ctccactggatggagg

SEQ ID NO: 1757962 - DNA, 15 bp, Homo sapiens
ctccactgtgtccag

SEQ ID NO: 1757963 - DNA, 20 bp, Homo sapiens
ctccacttcccgtctcagaa

SEQ ID NO: 1757964 - DNA, 14 bp, Homo sapiens
ctccagaagatgcc

SEQ ID NO: 1757965 - DNA, 16 bp, Homo sapiens
ctccagaagatgccag

SEQ ID NO: 1757966 - DNA, 16 bp, Homo sapiens
ctccagaagcctctgg

SEQ ID NO: 1757967 - DNA, 19 bp, Homo sapiens
ctccagaatctgctgttgc

SEQ ID NO: 1757968 - DNA, 14 bp, Homo sapiens
ctccagacccctgg

SEQ ID NO: 1757969 - DNA, 19 bp, Homo sapiens
ctccagacccctggctttt

SEQ ID NO: 1757970 - DNA, 14 bp, Homo sapiens
ctccagaccctgcc

SEQ ID NO: 1757971 - DNA, 16 bp, Homo sapiens
ctccagaccctgcctg

SEQ ID NO: 1757972 - DNA, 12 bp, Homo sapiens
ctccagacctga

SEQ ID NO: 1757973 - DNA, 23 bp, Homo sapiens
ctccagacctgatcctggaggcc

SEQ ID NO: 1757974 - DNA, 13 bp, Homo sapiens
ctccagagccagc

SEQ ID NO: 1757975 - DNA, 16 bp, Homo sapiens
ctccagagccagcctg

SEQ ID NO: 1757976 - DNA, 17 bp, Homo sapiens
ctccagagccagcctgg

SEQ ID NO: 1757977 - DNA, 14 bp, Homo sapiens
ctccagagggacag

SEQ ID NO: 1757978 - DNA, 12 bp, Homo sapiens
ctccagagtctg

SEQ ID NO: 1757979 - DNA, 15 bp, Homo sapiens
ctccagagtctgagc

SEQ ID NO: 1757980 - DNA, 20 bp, Homo sapiens
ctccagataactctctttcc

SEQ ID NO: 1757981 - DNA, 21 bp, Homo sapiens
ctccagataactctctttcct

SEQ ID NO: 1757982 - DNA, 16 bp, Homo sapiens
ctccagatagagaaat

SEQ ID NO: 1757983 - DNA, 19 bp, Homo sapiens
ctccagatgtttccagact

SEQ ID NO: 1757984 - DNA, 22 bp, Homo sapiens
ctccagattagagcctgtaaac

SEQ ID NO: 1757985 - DNA, 17 bp, Homo sapiens
ctccagattctgatgca

SEQ ID NO: 1757986 - DNA, 17 bp, Homo sapiens
ctccagcaacacagcct

SEQ ID NO: 1757987 - DNA, 23 bp, Homo sapiens
ctccagcaactgcccttccaggt

SEQ ID NO: 1757988 - DNA, 14 bp, Homo sapiens
ctccagcagcacac

SEQ ID NO: 1757989 - DNA, 17 bp, Homo sapiens
ctccagcatccagcctg

SEQ ID NO: 1757990 - DNA, 20 bp, Homo sapiens
ctccagcatccagcctgtgt

SEQ ID NO: 1757991 - DNA, 12 bp, Homo sapiens
ctccagccagca

SEQ ID NO: 1757992 - DNA, 13 bp, Homo sapiens
ctccagccagcaa

SEQ ID NO: 1757993 - DNA, 23 bp, Homo sapiens
ctccagccagcaatgatgtccag

SEQ ID NO: 1757994 - DNA, 20 bp, Homo sapiens
ctccagcccctcttggagaa

SEQ ID NO: 1757995 - DNA, 17 bp, Homo sapiens
ctccagcccctgtccca

SEQ ID NO: 1757996 - DNA, 13 bp, Homo sapiens
ctccagccctgtc

SEQ ID NO: 1757997 - DNA, 17 bp, Homo sapiens
ctccagcctcagcctcc

SEQ ID NO: 1757998 - DNA, 17 bp, Homo sapiens
ctccagcctccctgtct

SEQ ID NO: 1757999 - DNA, 19 bp, Homo sapiens
ctccagcctccctgtctcc

SEQ ID NO: 1758000 - DNA, 24 bp, Homo sapiens
ctccagcctccctgtctccagctg

SEQ ID NO: 1758001 - DNA, 12 bp, Homo sapiens
ctccagcctctc

SEQ ID NO: 1758002 - DNA, 14 bp, Homo sapiens
ctccagcctctccc

SEQ ID NO: 1758003 - DNA, 15 bp, Homo sapiens
ctccagcctctcccg

SEQ ID NO: 1758004 - DNA, 19 bp, Homo sapiens
ctccagcctctcccggctg

SEQ ID NO: 1758005 - DNA, 20 bp, Homo sapiens
ctccagcctctcccggctgc

SEQ ID NO: 1758006 - DNA, 22 bp, Homo sapiens
ctccagcctctcccggctgcct

SEQ ID NO: 1758007 - DNA, 12 bp, Homo sapiens
ctccagcctgaa

SEQ ID NO: 1758008 - DNA, 23 bp, Homo sapiens
ctccagcctgaatgttatttcct

SEQ ID NO: 1758009 - DNA, 13 bp, Homo sapiens
ctccagcctgagc

SEQ ID NO: 1758010 - DNA, 13 bp, Homo sapiens
ctccagcctgggc

SEQ ID NO: 1758011 - DNA, 15 bp, Homo sapiens
ctccagcctggggac

SEQ ID NO: 1758012 - DNA, 16 bp, Homo sapiens
ctccagcctggggacc

SEQ ID NO: 1758013 - DNA, 18 bp, Homo sapiens
ctccagcctggggacccc

SEQ ID NO: 1758014 - DNA, 21 bp, Homo sapiens
ctccagcctgggtcacagagt

SEQ ID NO: 1758015 - DNA, 17 bp, Homo sapiens
ctccagcgatggtgctg

SEQ ID NO: 1758016 - DNA, 15 bp, Homo sapiens
ctccagcggccctgt

SEQ ID NO: 1758017 - DNA, 22 bp, Homo sapiens
ctccagcggccctgtcatccag

SEQ ID NO: 1758018 - DNA, 22 bp, Homo sapiens
ctccagcgggacaccctggttc

SEQ ID NO: 1758019 - DNA, 23 bp, Homo sapiens
ctccagcgggacaccctggttcc

SEQ ID NO: 1758020 - DNA, 19 bp, Homo sapiens
ctccagcgtcagctgctcc

SEQ ID NO: 1758021 - DNA, 19 bp, Homo sapiens
ctccagctcatgacactgt

SEQ ID NO: 1758022 - DNA, 14 bp, Homo sapiens
ctccagctgccccg

SEQ ID NO: 1758023 - DNA, 21 bp, Homo sapiens
ctccagctgccccgggatgcg

SEQ ID NO: 1758024 - DNA, 13 bp, Homo sapiens
ctccagctgcctg

SEQ ID NO: 1758025 - DNA, 16 bp, Homo sapiens
ctccagctgcctgggc

SEQ ID NO: 1758026 - DNA, 19 bp, Homo sapiens
ctccagctgcctgggcccg

SEQ ID NO: 1758027 - DNA, 21 bp, Homo sapiens
ctccagctgcctgggcccgga

SEQ ID NO: 1758028 - DNA, 14 bp, Homo sapiens
ctccagcttcagct

SEQ ID NO: 1758029 - DNA, 19 bp, Homo sapiens
ctccaggagagagccagga

SEQ ID NO: 1758030 - DNA, 18 bp, Homo sapiens
ctccaggagcctaccccc

SEQ ID NO: 1758031 - DNA, 19 bp, Homo sapiens
ctccaggagcctaccccct

SEQ ID NO: 1758032 - DNA, 11 bp, Homo sapiens
ctccaggagct

SEQ ID NO: 1758033 - DNA, 22 bp, Homo sapiens
ctccaggatctttgactgaaaa

SEQ ID NO: 1758034 - DNA, 18 bp, Homo sapiens
ctccaggattttaatttc

SEQ ID NO: 1758035 - DNA, 14 bp, Homo sapiens
ctccaggccaggtg

SEQ ID NO: 1758036 - DNA, 17 bp, Homo sapiens
ctccaggcccaaggctc

SEQ ID NO: 1758037 - DNA, 19 bp, Homo sapiens
ctccaggcccaaggctccc

SEQ ID NO: 1758038 - DNA, 13 bp, Homo sapiens
ctccaggccctcc

SEQ ID NO: 1758039 - DNA, 13 bp, Homo sapiens
ctccaggcctgac

SEQ ID NO: 1758040 - DNA, 16 bp, Homo sapiens
ctccaggcctgcaggg

SEQ ID NO: 1758041 - DNA, 22 bp, Homo sapiens
ctccagggaatccaagcctcca

SEQ ID NO: 1758042 - DNA, 18 bp, Homo sapiens
ctccagggagcaagacag

SEQ ID NO: 1758043 - DNA, 19 bp, Homo sapiens
ctccagggagcaagacaga

SEQ ID NO: 1758044 - DNA, 22 bp, Homo sapiens
ctccagggagcaagacagagac

SEQ ID NO: 1758045 - DNA, 23 bp, Homo sapiens
ctccagggaggcgatgccagcct

SEQ ID NO: 1758046 - DNA, 14 bp, Homo sapiens
ctccagggagtccc

SEQ ID NO: 1758047 - DNA, 18 bp, Homo sapiens
ctccagggagtcccctcc

SEQ ID NO: 1758048 - DNA, 14 bp, Homo sapiens
ctccagggcagcct

SEQ ID NO: 1758049 - DNA, 11 bp, Homo sapiens
ctccagggcca

SEQ ID NO: 1758050 - DNA, 16 bp, Homo sapiens
ctccagggccacgtgc

SEQ ID NO: 1758051 - DNA, 12 bp, Homo sapiens
ctccagggctgg

SEQ ID NO: 1758052 - DNA, 21 bp, Homo sapiens
ctccagggctggactgaggcc

SEQ ID NO: 1758053 - DNA, 16 bp, Homo sapiens
ctccaggggcctgcag

SEQ ID NO: 1758054 - DNA, 22 bp, Homo sapiens
ctccaggggcctgcagaaggaa

SEQ ID NO: 1758055 - DNA, 15 bp, Homo sapiens
ctccaggggctgctt

SEQ ID NO: 1758056 - DNA, 18 bp, Homo sapiens
ctccaggggctgcttcct

SEQ ID NO: 1758057 - DNA, 16 bp, Homo sapiens
ctccagggtcttgggc

SEQ ID NO: 1758058 - DNA, 17 bp, Homo sapiens
ctccagggtcttgggct

SEQ ID NO: 1758059 - DNA, 22 bp, Homo sapiens
ctccagggtcttgggctactgg

SEQ ID NO: 1758060 - DNA, 15 bp, Homo sapiens
ctccagggtgatttt

SEQ ID NO: 1758061 - DNA, 19 bp, Homo sapiens
ctcccctccgcagcaggga

SEQ ID NO: 1758062 - DNA, 24 bp, Homo sapiens
ctcccctccggactggtgccctcc

SEQ ID NO: 1758063 - DNA, 21 bp, Homo sapiens
ctcccctgatagaagattgtt

SEQ ID NO: 1758064 - DNA, 12 bp, Homo sapiens
ctcccctgcact

SEQ ID NO: 1758065 - DNA, 13 bp, Homo sapiens
ctcccctgcactg

SEQ ID NO: 1758066 - DNA, 15 bp, Homo sapiens
ctcccctgcactgga

SEQ ID NO: 1758067 - DNA, 16 bp, Homo sapiens
ctcccctgcactgtaa

SEQ ID NO: 1758068 - DNA, 17 bp, Homo sapiens
ctcccctgcactgtaaa

SEQ ID NO: 1758069 - DNA, 15 bp, Homo sapiens
ctcccctgcccccag

SEQ ID NO: 1758070 - DNA, 15 bp, Homo sapiens
ctcccctgcccttcc

SEQ ID NO: 1758071 - DNA, 12 bp, Homo sapiens
ctcccctgccgg

SEQ ID NO: 1758072 - DNA, 23 bp, Homo sapiens
ctcccctggagccagcagggctg

SEQ ID NO: 1758073 - DNA, 23 bp, Homo sapiens
ctccccttgatttaaacacacag

SEQ ID NO: 1758074 - DNA, 18 bp, Homo sapiens
ctccccttgggcggctga

SEQ ID NO: 1758075 - DNA, 14 bp, Homo sapiens
ctcccgaagccacc

SEQ ID NO: 1758076 - DNA, 24 bp, Homo sapiens
ctcccgagctcctcttccatgctg

SEQ ID NO: 1758077 - DNA, 18 bp, Homo sapiens
ctcccgattgagccttac

SEQ ID NO: 1758078 - DNA, 21 bp, Homo sapiens
ctcccgcaccttcctcctccc

SEQ ID NO: 1758079 - DNA, 14 bp, Homo sapiens
ctcccgccccgccc

SEQ ID NO: 1758080 - DNA, 20 bp, Homo sapiens
ctcccgcctcagcctcctga

SEQ ID NO: 1758081 - DNA, 19 bp, Homo sapiens
ctcccgcctcccccgcagg

SEQ ID NO: 1758082 - DNA, 13 bp, Homo sapiens
ctcccgctcccag

SEQ ID NO: 1758083 - DNA, 13 bp, Homo sapiens
ctcccgctgctgc

SEQ ID NO: 1758084 - DNA, 22 bp, Homo sapiens
ctcccggaattccgtcaccacg

SEQ ID NO: 1758085 - DNA, 23 bp, Homo sapiens
ctcccggcaagcgcttctgctga

SEQ ID NO: 1758086 - DNA, 16 bp, Homo sapiens
ctcccgggccctccct

SEQ ID NO: 1758087 - DNA, 20 bp, Homo sapiens
ctcccggggactcaagagga

SEQ ID NO: 1758088 - DNA, 18 bp, Homo sapiens
ctcccggggccttccttt

SEQ ID NO: 1758089 - DNA, 16 bp, Homo sapiens
ctcccggttcttccag

SEQ ID NO: 1758090 - DNA, 16 bp, Homo sapiens
ctcccgtcagggccca

SEQ ID NO: 1758091 - DNA, 20 bp, Homo sapiens
ctccctaagtaatcccagaa

SEQ ID NO: 1758092 - DNA, 14 bp, Homo sapiens
ctccctaccttgcc

SEQ ID NO: 1758093 - DNA, 15 bp, Homo sapiens
ctccctaccttgcct

SEQ ID NO: 1758094 - DNA, 14 bp, Homo sapiens
ctccctactcccct

SEQ ID NO: 1758095 - DNA, 21 bp, Homo sapiens
ctccctagttagcatccaggc

SEQ ID NO: 1758096 - DNA, 12 bp, Homo sapiens
ctccctcaactg

SEQ ID NO: 1758097 - DNA, 18 bp, Homo sapiens
ctccctcacccccaggtg

SEQ ID NO: 1758098 - DNA, 19 bp, Homo sapiens
ctccctcagctctctggga

SEQ ID NO: 1758099 - DNA, 19 bp, Homo sapiens
ctccctcatggctctggca

SEQ ID NO: 1758100 - DNA, 13 bp, Homo sapiens
ctccctccaccag

SEQ ID NO: 1758101 - DNA, 18 bp, Homo sapiens
ctccctcccctctcagaa

SEQ ID NO: 1758102 - DNA, 18 bp, Homo sapiens
ctccctccctaacagtga

SEQ ID NO: 1758103 - DNA, 13 bp, Homo sapiens
ctccctccctctc

SEQ ID NO: 1758104 - DNA, 17 bp, Homo sapiens
ctccctccggcttgacc

SEQ ID NO: 1758105 - DNA, 14 bp, Homo sapiens
ctccctcctcacct

SEQ ID NO: 1758106 - DNA, 19 bp, Homo sapiens
ctccctcctcacctctgga

SEQ ID NO: 1758107 - DNA, 15 bp, Homo sapiens
ctccctcctcccatc

SEQ ID NO: 1758108 - DNA, 13 bp, Homo sapiens
ctccctcctcctg

SEQ ID NO: 1758109 - DNA, 14 bp, Homo sapiens
ctccctcctgcaca

SEQ ID NO: 1758110 - DNA, 15 bp, Homo sapiens
ctccctcctgcaggc

SEQ ID NO: 1758111 - DNA, 17 bp, Homo sapiens
ctccctctcaggatcca

SEQ ID NO: 1758112 - DNA, 17 bp, Homo sapiens
ctccctctccctcccta

SEQ ID NO: 1758113 - DNA, 17 bp, Homo sapiens
ctccctctcctgcctac

SEQ ID NO: 1758114 - DNA, 13 bp, Homo sapiens
ctccctctctctg

SEQ ID NO: 1758115 - DNA, 22 bp, Homo sapiens
ctccctctctcttctgctccac

SEQ ID NO: 1758116 - DNA, 22 bp, Homo sapiens
ctccctctgccttcaggcttct

SEQ ID NO: 1758117 - DNA, 20 bp, Homo sapiens
ctccctctggccctgccttc

SEQ ID NO: 1758118 - DNA, 14 bp, Homo sapiens
ctccctcttcactg

SEQ ID NO: 1758119 - DNA, 14 bp, Homo sapiens
ctccctctttctca

SEQ ID NO: 1758120 - DNA, 23 bp, Homo sapiens
ctccctgaaaatgtttttctgcc

SEQ ID NO: 1758121 - DNA, 22 bp, Homo sapiens
ctccctgaccttagcgttctgg

SEQ ID NO: 1758122 - DNA, 12 bp, Homo sapiens
ctccctgagctt

SEQ ID NO: 1758123 - DNA, 17 bp, Homo sapiens
ctccctgagctttgggg

SEQ ID NO: 1758124 - DNA, 17 bp, Homo sapiens
ctccctgatcccagacc

SEQ ID NO: 1758125 - DNA, 20 bp, Homo sapiens
ctccctgatcccagacctgt

SEQ ID NO: 1758126 - DNA, 14 bp, Homo sapiens
ctccctgcacagcc

SEQ ID NO: 1758127 - DNA, 15 bp, Homo sapiens
ctccctgcagactcc

SEQ ID NO: 1758128 - DNA, 23 bp, Homo sapiens
ctccctgcagatgccaccctagc

SEQ ID NO: 1758129 - DNA, 17 bp, Homo sapiens
ctccctgccaagtctca

SEQ ID NO: 1758130 - DNA, 18 bp, Homo sapiens
ctccctgcccctcccttc

SEQ ID NO: 1758131 - DNA, 20 bp, Homo sapiens
ctccctgcccctcccttcaa

SEQ ID NO: 1758132 - DNA, 15 bp, Homo sapiens
ctccctgccgcctca

SEQ ID NO: 1758133 - DNA, 21 bp, Homo sapiens
ctccctgcctacacacacagc

SEQ ID NO: 1758134 - DNA, 12 bp, Homo sapiens
ctccctgcctgg

SEQ ID NO: 1758135 - DNA, 13 bp, Homo sapiens
ctccctgctgtgc

SEQ ID NO: 1758136 - DNA, 20 bp, Homo sapiens
ctccctgcttgcacacttcc

SEQ ID NO: 1758137 - DNA, 15 bp, Homo sapiens
ctccctggaagctgg

SEQ ID NO: 1758138 - DNA, 23 bp, Homo sapiens
ctccctggaggcacgcaccactg

SEQ ID NO: 1758139 - DNA, 16 bp, Homo sapiens
ctccctggcagacaca

SEQ ID NO: 1758140 - DNA, 12 bp, Homo sapiens
ctccctggccct

SEQ ID NO: 1758141 - DNA, 14 bp, Homo sapiens
ctccctggccttgc

SEQ ID NO: 1758142 - DNA, 15 bp, Homo sapiens
ctccctggccttgcc

SEQ ID NO: 1758143 - DNA, 15 bp, Homo sapiens
ctccctggctctcag

SEQ ID NO: 1758144 - DNA, 18 bp, Homo sapiens
ctccctggctctcagaag

SEQ ID NO: 1758145 - DNA, 20 bp, Homo sapiens
ctccctggctgccctggccc

SEQ ID NO: 1758146 - DNA, 13 bp, Homo sapiens
ctccctggctgtg

SEQ ID NO: 1758147 - DNA, 16 bp, Homo sapiens
ctccctggctgtgagc

SEQ ID NO: 1758148 - DNA, 18 bp, Homo sapiens
ctccctggggaccaggag

SEQ ID NO: 1758149 - DNA, 22 bp, Homo sapiens
ctccctggggaccaggagctag

SEQ ID NO: 1758150 - DNA, 14 bp, Homo sapiens
ctccctgggttcag

SEQ ID NO: 1758151 - DNA, 14 bp, Homo sapiens
ctccctggtgcctc

SEQ ID NO: 1758152 - DNA, 16 bp, Homo sapiens
ctccctggtgcctctg

SEQ ID NO: 1758153 - DNA, 17 bp, Homo sapiens
ctccctggtgcctctgt

SEQ ID NO: 1758154 - DNA, 18 bp, Homo sapiens
ctccctggtgcctctgtg

SEQ ID NO: 1758155 - DNA, 19 bp, Homo sapiens
ctccctggtgcctctgtgc

SEQ ID NO: 1758156 - DNA, 21 bp, Homo sapiens
ctccctggtgcctctgtgcac

SEQ ID NO: 1758157 - DNA, 20 bp, Homo sapiens
ctccctgtagctctgcctcc

SEQ ID NO: 1758158 - DNA, 23 bp, Homo sapiens
ctccctgtcacgctcatgtcctg

SEQ ID NO: 1758159 - DNA, 19 bp, Homo sapiens
ctccctgtcactcagctga

SEQ ID NO: 1758160 - DNA, 13 bp, Homo sapiens
ctccctgtcctcc

SEQ ID NO: 1758161 - DNA, 18 bp, Homo sapiens
ctccctgtctccagctgc

SEQ ID NO: 1758162 - DNA, 15 bp, Homo sapiens
ctccctgtctgtgtc

SEQ ID NO: 1758163 - DNA, 21 bp, Homo sapiens
ctccctgtggggcaggagtgc

SEQ ID NO: 1758164 - DNA, 21 bp, Homo sapiens
ctccctgttatttttctgccc

SEQ ID NO: 1758165 - DNA, 19 bp, Homo sapiens
ctccctgttgaagctctgg

SEQ ID NO: 1758166 - DNA, 22 bp, Homo sapiens
ctcccttcaaccattccccatg

SEQ ID NO: 1758167 - DNA, 23 bp, Homo sapiens
ctcccttcaaccattccccatgg

SEQ ID NO: 1758168 - DNA, 18 bp, Homo sapiens
ctcccttccatgccccag

SEQ ID NO: 1758169 - DNA, 21 bp, Homo sapiens
ctcccttccatgccccaggat

SEQ ID NO: 1758170 - DNA, 13 bp, Homo sapiens
ctcccttcccagg

SEQ ID NO: 1758171 - DNA, 16 bp, Homo sapiens
ctcccttcccaggagg

SEQ ID NO: 1758172 - DNA, 16 bp, Homo sapiens
ctcccttccctccctg

SEQ ID NO: 1758173 - DNA, 17 bp, Homo sapiens
ctcccttccctccctga

SEQ ID NO: 1758174 - DNA, 17 bp, Homo sapiens
ctcccttcctctctcct

SEQ ID NO: 1758175 - DNA, 16 bp, Homo sapiens
ctcccttcctggcctc

SEQ ID NO: 1758176 - DNA, 15 bp, Homo sapiens
ctcgagccccctgga

SEQ ID NO: 1758177 - DNA, 22 bp, Homo sapiens
ctcgaggcaccggcgctgcagg

SEQ ID NO: 1758178 - DNA, 23 bp, Homo sapiens
ctcgaggcaccggcgctgcaggt

SEQ ID NO: 1758179 - DNA, 18 bp, Homo sapiens
ctcgagggcagggaccac

SEQ ID NO: 1758180 - DNA, 23 bp, Homo sapiens
ctcgagggcagggaccacaccct

SEQ ID NO: 1758181 - DNA, 17 bp, Homo sapiens
ctcgaggggtgggctgg

SEQ ID NO: 1758182 - DNA, 17 bp, Homo sapiens
ctcgatcaaaaccttcc

SEQ ID NO: 1758183 - DNA, 15 bp, Homo sapiens
ctcgatctcctgacc

SEQ ID NO: 1758184 - DNA, 22 bp, Homo sapiens
ctcgatgtaagggattccttgt

SEQ ID NO: 1758185 - DNA, 13 bp, Homo sapiens
ctcgcacaggccc

SEQ ID NO: 1758186 - DNA, 16 bp, Homo sapiens
ctcgcacaggccctag

SEQ ID NO: 1758187 - DNA, 18 bp, Homo sapiens
ctcgcagacctaagccct

SEQ ID NO: 1758188 - DNA, 12 bp, Homo sapiens
ctcgcagcctga

SEQ ID NO: 1758189 - DNA, 18 bp, Homo sapiens
ctcgcagcctgaagcctg

SEQ ID NO: 1758190 - DNA, 16 bp, Homo sapiens
ctcgcagggtgcagga

SEQ ID NO: 1758191 - DNA, 18 bp, Homo sapiens
ctcgcataggacctttcc

SEQ ID NO: 1758192 - DNA, 22 bp, Homo sapiens
ctcgcatttgtcaatgacagtt

SEQ ID NO: 1758193 - DNA, 13 bp, Homo sapiens
ctcgccatgccgg

SEQ ID NO: 1758194 - DNA, 15 bp, Homo sapiens
ctcgccatttcctca

SEQ ID NO: 1758195 - DNA, 20 bp, Homo sapiens
ctcgccatttcctcacgtgc

SEQ ID NO: 1758196 - DNA, 17 bp, Homo sapiens
ctcgcccagcaggagag

SEQ ID NO: 1758197 - DNA, 14 bp, Homo sapiens
ctcgcccgcccact

SEQ ID NO: 1758198 - DNA, 21 bp, Homo sapiens
ctcgcccgcccactgtcctgg

SEQ ID NO: 1758199 - DNA, 13 bp, Homo sapiens
ctcgccctgggtc

SEQ ID NO: 1758200 - DNA, 16 bp, Homo sapiens
ctcgcccttcagccca

SEQ ID NO: 1758201 - DNA, 17 bp, Homo sapiens
ctcgcccttcagcccac

SEQ ID NO: 1758202 - DNA, 16 bp, Homo sapiens
ctcgccggccttgttt

SEQ ID NO: 1758203 - DNA, 17 bp, Homo sapiens
ctcgccgtccctcccag

SEQ ID NO: 1758204 - DNA, 18 bp, Homo sapiens
ctcgccgtgtctcagcct

SEQ ID NO: 1758205 - DNA, 21 bp, Homo sapiens
ctcgccgtgtctcagcctctg

SEQ ID NO: 1758206 - DNA, 17 bp, Homo sapiens
ctcgcctcagcctgatc

SEQ ID NO: 1758207 - DNA, 16 bp, Homo sapiens
ctcgcgctcagtaaac

SEQ ID NO: 1758208 - DNA, 18 bp, Homo sapiens
ctcgcgggcagcgggcca

SEQ ID NO: 1758209 - DNA, 16 bp, Homo sapiens
ctcgctcccctctgcc

SEQ ID NO: 1758210 - DNA, 13 bp, Homo sapiens
ctcgctcccttca

SEQ ID NO: 1758211 - DNA, 18 bp, Homo sapiens
ctcgctctcgctctcgct

SEQ ID NO: 1758212 - DNA, 12 bp, Homo sapiens
ctcgctgagggc

SEQ ID NO: 1758213 - DNA, 18 bp, Homo sapiens
ctcgctgcacaaatactc

SEQ ID NO: 1758214 - DNA, 24 bp, Homo sapiens
ctcgctgctgctactacccgagcc

SEQ ID NO: 1758215 - DNA, 15 bp, Homo sapiens
ctcgctgcttctgtg

SEQ ID NO: 1758216 - DNA, 17 bp, Homo sapiens
ctcgctggctttctctc

SEQ ID NO: 1758217 - DNA, 17 bp, Homo sapiens
ctcgcttcctcagcctc

SEQ ID NO: 1758218 - DNA, 19 bp, Homo sapiens
ctcgcttcctcagcctcca

SEQ ID NO: 1758219 - DNA, 13 bp, Homo sapiens
ctcggacccacca

SEQ ID NO: 1758220 - DNA, 14 bp, Homo sapiens
ctcggacccacccc

SEQ ID NO: 1758221 - DNA, 20 bp, Homo sapiens
ctcggacccaccccaactct

SEQ ID NO: 1758222 - DNA, 13 bp, Homo sapiens
ctcggagaagagc

SEQ ID NO: 1758223 - DNA, 20 bp, Homo sapiens
ctcggagaagagctgttcac

SEQ ID NO: 1758224 - DNA, 16 bp, Homo sapiens
ctcggagagcagcagc

SEQ ID NO: 1758225 - DNA, 13 bp, Homo sapiens
ctcggagcaccct

SEQ ID NO: 1758226 - DNA, 12 bp, Homo sapiens
ctcggagcctca

SEQ ID NO: 1758227 - DNA, 13 bp, Homo sapiens
ctcggagcctcat

SEQ ID NO: 1758228 - DNA, 23 bp, Homo sapiens
ctcggagcctcatccgaggcagg

SEQ ID NO: 1758229 - DNA, 15 bp, Homo sapiens
ctcggagctggccca

SEQ ID NO: 1758230 - DNA, 16 bp, Homo sapiens
ctcggagctggcccag

SEQ ID NO: 1758231 - DNA, 17 bp, Homo sapiens
ctcggagctggcccagg

SEQ ID NO: 1758232 - DNA, 18 bp, Homo sapiens
ctcggagctggcccaggg

SEQ ID NO: 1758233 - DNA, 21 bp, Homo sapiens
ctcggagggatggagaaagaa

SEQ ID NO: 1758234 - DNA, 23 bp, Homo sapiens
ctcggagggatggagaaagaagt

SEQ ID NO: 1758235 - DNA, 17 bp, Homo sapiens
ctcggagggattcccct

SEQ ID NO: 1758236 - DNA, 16 bp, Homo sapiens
ctcggaggtccagctg

SEQ ID NO: 1758237 - DNA, 21 bp, Homo sapiens
ctcggagtgtgtatgccaaga

SEQ ID NO: 1758238 - DNA, 19 bp, Homo sapiens
ctcggatgacaccctggcc

SEQ ID NO: 1758239 - DNA, 20 bp, Homo sapiens
ctcggatgacaccctggcct

SEQ ID NO: 1758240 - DNA, 21 bp, Homo sapiens
ctcggatgacaccctggcctg

SEQ ID NO: 1758241 - DNA, 21 bp, Homo sapiens
ctcggcacctccccggcctct

SEQ ID NO: 1758242 - DNA, 23 bp, Homo sapiens
ctcggcagcccttccaaactctt

SEQ ID NO: 1758243 - DNA, 15 bp, Homo sapiens
ctcggcctcccaaag

SEQ ID NO: 1758244 - DNA, 22 bp, Homo sapiens
ctcggcctcccacagtgctggg

SEQ ID NO: 1758245 - DNA, 19 bp, Homo sapiens
ctcggctaggggtcctcgg

SEQ ID NO: 1758246 - DNA, 19 bp, Homo sapiens
ctcggcttcttggaccttg

SEQ ID NO: 1758247 - DNA, 22 bp, Homo sapiens
ctcgggatgccgttctgttcca

SEQ ID NO: 1758248 - DNA, 13 bp, Homo sapiens
ctcgggcccacct

SEQ ID NO: 1758249 - DNA, 14 bp, Homo sapiens
ctcgggcccacctg

SEQ ID NO: 1758250 - DNA, 21 bp, Homo sapiens
ctcgggcccacctggccacct

SEQ ID NO: 1758251 - DNA, 15 bp, Homo sapiens
ctcgggccgaggccc

SEQ ID NO: 1758252 - DNA, 18 bp, Homo sapiens
ctcgggccgaggcccagc

SEQ ID NO: 1758253 - DNA, 20 bp, Homo sapiens
ctcgggccgtaggggctcct

SEQ ID NO: 1758254 - DNA, 21 bp, Homo sapiens
ctcggggcccttggggcctgg

SEQ ID NO: 1758255 - DNA, 15 bp, Homo sapiens
ctcggggggctctgc

SEQ ID NO: 1758256 - DNA, 16 bp, Homo sapiens
ctcggggggctctgcc

SEQ ID NO: 1758257 - DNA, 17 bp, Homo sapiens
ctcggggggctctgcct

SEQ ID NO: 1758258 - DNA, 12 bp, Homo sapiens
ctcgggtgcgtg

SEQ ID NO: 1758259 - DNA, 23 bp, Homo sapiens
ctcgggtgcgtgtgtttgtatgt

SEQ ID NO: 1758260 - DNA, 16 bp, Homo sapiens
ctcgggtgggggagcc

SEQ ID NO: 1758261 - DNA, 19 bp, Homo sapiens
ctcggtatctggcttccct

SEQ ID NO: 1758262 - DNA, 22 bp, Homo sapiens
ctcggtatctggcttccctgga

SEQ ID NO: 1758263 - DNA, 23 bp, Homo sapiens
ctcggtatctggcttccctggaa

SEQ ID NO: 1758264 - DNA, 16 bp, Homo sapiens
ctcggtgggccagagc

SEQ ID NO: 1758265 - DNA, 17 bp, Homo sapiens
ctcggtgggccagagct

SEQ ID NO: 1758266 - DNA, 23 bp, Homo sapiens
ctcggtgtgtggccgcctggcag

SEQ ID NO: 1758267 - DNA, 15 bp, Homo sapiens
ctcggtttgccaaaa

SEQ ID NO: 1758268 - DNA, 18 bp, Homo sapiens
ctcgtaatagcttctgtg

SEQ ID NO: 1758269 - DNA, 19 bp, Homo sapiens
ctcgtaggggatgtggagt

SEQ ID NO: 1758270 - DNA, 24 bp, Homo sapiens
ctcgtcaagagcatgcacatgctg

SEQ ID NO: 1758271 - DNA, 20 bp, Homo sapiens
ctcgtccaagggacagccca

SEQ ID NO: 1758272 - DNA, 15 bp, Homo sapiens
ctcgtccacaggggc

SEQ ID NO: 1758273 - DNA, 21 bp, Homo sapiens
ctcgtccacaggggcaggcct

SEQ ID NO: 1758274 - DNA, 14 bp, Homo sapiens
ctcgtccgtctgtc

SEQ ID NO: 1758275 - DNA, 16 bp, Homo sapiens
ctcgtccgtctgtctc

SEQ ID NO: 1758276 - DNA, 15 bp, Homo sapiens
ctcgtcctccccctg

SEQ ID NO: 1758277 - DNA, 24 bp, Homo sapiens
ctcgtcctccccctgccagtgcct

SEQ ID NO: 1758278 - DNA, 17 bp, Homo sapiens
ctcgtgcatccctgaga

SEQ ID NO: 1758279 - DNA, 19 bp, Homo sapiens
ctcgtgcatccctgagaca

SEQ ID NO: 1758280 - DNA, 14 bp, Homo sapiens
ctcgtgccagcagc

SEQ ID NO: 1758281 - DNA, 20 bp, Homo sapiens
ctcgtgccagcagcctcgca

SEQ ID NO: 1758282 - DNA, 17 bp, Homo sapiens
ctcgtggccagcccggc

SEQ ID NO: 1758283 - DNA, 15 bp, Homo sapiens
ctcgtggcggggcag

SEQ ID NO: 1758284 - DNA, 16 bp, Homo sapiens
ctcgtggcggggcagc

SEQ ID NO: 1758285 - DNA, 16 bp, Homo sapiens
ctcgtggtgaggctga

SEQ ID NO: 1758286 - DNA, 17 bp, Homo sapiens
ctcgtggtgaggctgac

SEQ ID NO: 1758287 - DNA, 16 bp, Homo sapiens
ctcgtgtatcctgggg

SEQ ID NO: 1758288 - DNA, 20 bp, Homo sapiens
ctcgtgtatcctggggctcc

SEQ ID NO: 1758289 - DNA, 23 bp, Homo sapiens
ctcgtgtgtgttatttccccagc

SEQ ID NO: 1758290 - DNA, 17 bp, Homo sapiens
ctctgagattctaagag

SEQ ID NO: 1758291 - DNA, 22 bp, Homo sapiens
ctctgagcagcctctgccaggc

SEQ ID NO: 1758292 - DNA, 14 bp, Homo sapiens
ctctgagcagtcag

SEQ ID NO: 1758293 - DNA, 13 bp, Homo sapiens
ctctgagcccagg

SEQ ID NO: 1758294 - DNA, 14 bp, Homo sapiens
ctctgagcccaggc

SEQ ID NO: 1758295 - DNA, 16 bp, Homo sapiens
ctctgagcccaggccg

SEQ ID NO: 1758296 - DNA, 12 bp, Homo sapiens
ctctgaggacag

SEQ ID NO: 1758297 - DNA, 22 bp, Homo sapiens
ctctgaggacagaggccggggt

SEQ ID NO: 1758298 - DNA, 14 bp, Homo sapiens
ctctgaggcctcac

SEQ ID NO: 1758299 - DNA, 15 bp, Homo sapiens
ctctgaggcctcact

SEQ ID NO: 1758300 - DNA, 19 bp, Homo sapiens
ctctgaggctctttctggg

SEQ ID NO: 1758301 - DNA, 21 bp, Homo sapiens
ctctgaggggaggcacctcca

SEQ ID NO: 1758302 - DNA, 23 bp, Homo sapiens
ctctgaggggaggcacctccagg

SEQ ID NO: 1758303 - DNA, 15 bp, Homo sapiens
ctctgagtcaaatcc

SEQ ID NO: 1758304 - DNA, 18 bp, Homo sapiens
ctctgagtcaaatccagt

SEQ ID NO: 1758305 - DNA, 23 bp, Homo sapiens
ctctgagtcaaatccagtggtgg

SEQ ID NO: 1758306 - DNA, 15 bp, Homo sapiens
ctctgagtcctttgc

SEQ ID NO: 1758307 - DNA, 12 bp, Homo sapiens
ctctgagtgtga

SEQ ID NO: 1758308 - DNA, 14 bp, Homo sapiens
ctctgatatgggac

SEQ ID NO: 1758309 - DNA, 15 bp, Homo sapiens
ctctgatatgggact

SEQ ID NO: 1758310 - DNA, 20 bp, Homo sapiens
ctctgatattccatgaatgt

SEQ ID NO: 1758311 - DNA, 15 bp, Homo sapiens
ctctgatctaacaaa

SEQ ID NO: 1758312 - DNA, 17 bp, Homo sapiens
ctctgatctaacaaaat

SEQ ID NO: 1758313 - DNA, 18 bp, Homo sapiens
ctctgatctaacaaaata

SEQ ID NO: 1758314 - DNA, 20 bp, Homo sapiens
ctctgatctaacaaaataag

SEQ ID NO: 1758315 - DNA, 20 bp, Homo sapiens
ctctgatcttgtgctcagca

SEQ ID NO: 1758316 - DNA, 18 bp, Homo sapiens
ctctgattcacctcttcc

SEQ ID NO: 1758317 - DNA, 19 bp, Homo sapiens
ctctgattttcaaagcttt

SEQ ID NO: 1758318 - DNA, 14 bp, Homo sapiens
ctctgcaacacttt

SEQ ID NO: 1758319 - DNA, 16 bp, Homo sapiens
ctctgcaaccccccag

SEQ ID NO: 1758320 - DNA, 14 bp, Homo sapiens
ctctgcaactgctc

SEQ ID NO: 1758321 - DNA, 19 bp, Homo sapiens
ctctgcaagcttcttgctg

SEQ ID NO: 1758322 - DNA, 20 bp, Homo sapiens
ctctgcaagcttcttgctga

SEQ ID NO: 1758323 - DNA, 22 bp, Homo sapiens
ctctgcaagcttcttgctgatc

SEQ ID NO: 1758324 - DNA, 16 bp, Homo sapiens
ctctgcaattcccctc

SEQ ID NO: 1758325 - DNA, 20 bp, Homo sapiens
ctctgcacaccctccagaga

SEQ ID NO: 1758326 - DNA, 22 bp, Homo sapiens
ctctgcacaccctccagagaca

SEQ ID NO: 1758327 - DNA, 16 bp, Homo sapiens
ctctgcacagacaagc

SEQ ID NO: 1758328 - DNA, 22 bp, Homo sapiens
ctctgcacagacaagcagccct

SEQ ID NO: 1758329 - DNA, 13 bp, Homo sapiens
ctctgcacatgtc

SEQ ID NO: 1758330 - DNA, 16 bp, Homo sapiens
ctctgcacatgtcttg

SEQ ID NO: 1758331 - DNA, 17 bp, Homo sapiens
ctctgcacccagaacag

SEQ ID NO: 1758332 - DNA, 17 bp, Homo sapiens
ctctgcacccgcctcga

SEQ ID NO: 1758333 - DNA, 15 bp, Homo sapiens
ctctgcactactcct

SEQ ID NO: 1758334 - DNA, 22 bp, Homo sapiens
ctctgcactactgacatgtggg

SEQ ID NO: 1758335 - DNA, 14 bp, Homo sapiens
ctctgcactccatg

SEQ ID NO: 1758336 - DNA, 20 bp, Homo sapiens
ctctgcactccatggccacc

SEQ ID NO: 1758337 - DNA, 22 bp, Homo sapiens
ctctgcagaagccaagggaaga

SEQ ID NO: 1758338 - DNA, 15 bp, Homo sapiens
ctctgcagccagccc

SEQ ID NO: 1758339 - DNA, 15 bp, Homo sapiens
ctctgcagctgacct

SEQ ID NO: 1758340 - DNA, 13 bp, Homo sapiens
ctctgcagtgcct

SEQ ID NO: 1758341 - DNA, 15 bp, Homo sapiens
ctctgcagtgccttg

SEQ ID NO: 1758342 - DNA, 16 bp, Homo sapiens
ctctgcagtgccttgg

SEQ ID NO: 1758343 - DNA, 16 bp, Homo sapiens
ctctgccaacatgagg

SEQ ID NO: 1758344 - DNA, 18 bp, Homo sapiens
ctctgccaacatgaggac

SEQ ID NO: 1758345 - DNA, 19 bp, Homo sapiens
ctctgccaacatgaggaca

SEQ ID NO: 1758346 - DNA, 21 bp, Homo sapiens
ctctgccaacatgaggacaga

SEQ ID NO: 1758347 - DNA, 23 bp, Homo sapiens
ctctgccaacatgaggacagaag

SEQ ID NO: 1758348 - DNA, 17 bp, Homo sapiens
ctctgccaccctacctg

SEQ ID NO: 1758349 - DNA, 12 bp, Homo sapiens
ctctgccacctc

SEQ ID NO: 1758350 - DNA, 13 bp, Homo sapiens
ctctgccacctcc

SEQ ID NO: 1758351 - DNA, 20 bp, Homo sapiens
ctctgccagtgacagacagg

SEQ ID NO: 1758352 - DNA, 14 bp, Homo sapiens
ctctgcccaaccct

SEQ ID NO: 1758353 - DNA, 20 bp, Homo sapiens
ctctgcccaacccttccctc

SEQ ID NO: 1758354 - DNA, 20 bp, Homo sapiens
ctctgcccagccgggcacag

SEQ ID NO: 1758355 - DNA, 15 bp, Homo sapiens
ctctgcccagcttgg
